United States Patent 9,782,462 (MODIFIED POLYNUCLEOTIDES FOR THE PRODUCTION OF PROTEINS ASSOCIATED WITH HUMAN DISEASE) - sequence listing, part 91

SEQ ID NO: 178779 - DNA, 2256 bp, Artificial Sequence
  Description of Artificial Sequence: Synthetic coding sequence
atgcccgccctgggctgggccgtggccgccatcctgatgctgcagacagctatggcagagccatcaccaggtacactgcctagaaaagccggcgtgttctctgatctgtcaaaccaggagctgaaagccgtgcactcctttctgtggtctaagaaagagctccggctccaacctagcagcacaactactatggcaaagaacaccgtgttccttatcgaaatgttattgcccaagaaatatcacgtgctgcgctttcttgacaaaggcgagcgccatcctgtccgagaggctagagcagtcatcttctttggagaccaggagcatcccaacgtcaccgagtttgccgtgggcccgctcccaggaccctgctatatgcgggccctaagtccaaggccggggtatcagtcaagttgggcctctaggcctatcagtacggcagagtatgccctgctgtatcataccctgcaggaagccaccaagccactccaccagttctttttgaatacgactggcttctcctttcaggattgccacgaccggtgtctcgcattcacggatgtagcacctcggggagtagcctctgggcagcgcagatcctggcttatcattcaacgatatgttgaaggttattttttacatccaaccgggcttgaactcctggtggaccatggtagtactgatgcaggacactgggcggtggagcaggtttggtacaatggcaaattttacggtagccctgaagagctggcccgcaagtacgccgatggggaagtggatgtggttgtgctggaggaccccttacctggaggcaagggacacgattctaccgaggagccaccactgttctcttctcacaagcctcgcggagactttccgagcccaatccacgtatcaggtccacgattggttcagccacacggacctagattcagactggaaggaaacgctgtactgtacggagggtggtcatttgcatttaggctccgtagcagctctggtctgcaggtgctcaacgtgcacttcgggggagagaggattgcatatgaggtcagcgttcaggaagctgtggcgctttacgggggccacactcccgccggaatgcagaccaaatatttagacgttggatgggggctaggaagcgtgacacatgagctcgcgcctgggatagattgtcctgagactgccaccttcctagacaccttccactactatgacgcagatgaccccgtccactaccccagggccctgtgcttatttgagatgccgaccggtgtgcccctgaggcgtcactttaatagcaattttaaggggggttttaacttctacgcgggtctcaaaggtcaggttctggtactgcggactacgtcaaccgtctataactacgactacatatgggactttatattttacccgaacggcgtaatggaggccaagatgcacgcaacagggtacgttcatgccacattttacacgcctgaaggattacggcacggtactcgtctccacacacacttgattggcaatatacacactcatctggtacactacagggtggacctggacgttgcagggactaaaaacagcttccagacgttgcagatgaagctggagaacataacaaacccttggagccccagacatagggttgtgcagcctaccctggaacagacacagtactcctgggagcggcaggcagctttcaggtttaaacgaaagctgcctaagtatctcttgtttacctcccctcaggagaacccatggggccataaaaggacttaccgcctgcagatacacagcatggcggatcaagtgttgcctccaggttggcaggaggagcaagcaattacatgggcccgctatccccttgctgtcactaaatacagagagtcagagctgtgttcgtcgagcatctatcaccaaaatgacccttggcacccaccagtggtgttcgagcagtttctgcataacaacgagaacatagagaatgaggatcttgtggcgtgggtgactgtcggtttcctgcacatcccccacagcgaggatatcccaaacactgccacccctggcaattccgtggggttcttgttgcggcctttcaatttttttccggaggacccctctctggcatcgcgtgatacggtcatcgtttggcccagggacaatggacccaactatgtccagaggtggatcccagaggatagagattgcagcatgccccccccattttcatacaatgggacctatcgtccggtgtag

SEQ ID NO: 178780 - DNA, 1014 bp, Artificial Sequence
  Description of Artificial Sequence: Synthetic coding sequence
atgcccgccctgggctgggccgtggccgccatcctgatgctgcagactgcgatggcagagccctctcccggcacgctgccccgcaaggctggagtgttcagcgatctctcaaaccaggagctgaaagcagtgcacagttttctctggtctaagaaggagcttaggctgcaaccctcaagtacaaccactatggctaagaatacagttttcctcatcgagatgttgctgccgaaaaaataccacgtgctgaggtttctggataagggcgaacgacaccctgttcgcgaagcccgggctgtgatcttttttggggatcaggaacaccctaatgttactgaattcgcggtgggtcccctccctggcccatgttatatgcgcgccctttccccgagacctgggtatcagtcaagttgggcctcgagacctatctccaccgccgagtatgcgctcctataccatacgttacaagaggcaacaaaaccattgcaccagttcttcctaaacactaccggattcagtttccaggattgtcatgatcgctgcctcgccttcaccgacgtggccccccgaggagtcgcctcagggcagaggcgtagctggcttataattcagcggtacgtagaaggatacttcctgcaccccacaggactggagctgttagtcgatcacggttctaccgacgccgggcactgggccgttgaacaggtctggtataacggaaagttctacggctcccccgaggaattggcccgcaagtacgccgacggcgaagtcgatgtcgttgtgctggaagatcctctgccagggggcaagggacacgattccaccgaggagccaccattgttcagtagccacaaaccacgcggggactttccttcacctattcatgtcagtgggcccagactcgtgcagccccacggccctagattcagattggaagggaatgctgtgctgtacgggggatggtcctttgcttttcggcttcggagctccagcggcttacaagtgttgtag

SEQ ID NO: 178781 - DNA, 582 bp, Artificial Sequence
  Description of Artificial Sequence: Synthetic coding sequence
atggaggccaagatgcacgccaccggctacgtgcacgccaccttctacactccagagggcctgcggcacggtactagactccatacacacttgattgggaacatccatacccacctggtgcactatcgtgtggatctggatgtagctggcacaaaaaattcattccagacgctccagatgaaactcgagaacattaccaatccgtggtctccccgccacagagtggtgcagcctaccttagagcagacgcagtactcatgggagcggcaagctgctttcaggtttaagcgaaagctccccaaatacttgctcttcacttcccctcaggaaaatccctggggccacaagcggacataccgtctgcaaattcactcgatggcggaccaggttttgccccctggatggcaagaggagcaggcaatcacctgggctagatacccgcttgccgtcaccaaataccgtgagtctgagttgtgtagcagctccatatatcatcagaatgatccgtggcatccttggagcctctcaagtttttttaccacaactagaactctgaaaatgaggacttggtggcccggatag

SEQ ID NO: 178782 - DNA, 2256 bp, Artificial Sequence
  Description of Artificial Sequence: Synthetic coding sequence
atgcccgccctgggctgggccgtggccgccatcctgatgctgcagactgcaatggctgagccctcccctggtactctgcctcggaaagctggtgtcttctctgacctgagcaaccaggagctcaaggctgtgcattcattcctgtggtcaaaaaaagaactacggctgcagccgtcgtcgacgactacaatggcaaaaaacacagtatttcttatcgaaatgctgctgccaaaaaagtaccacgtgctgagattcctggacaagggcgagcgccatccagttagagaagcccgggccgtgattttcttcggggaccaggagcaccccaacgtgaccgagtttgctgttggtcccctgccaggcccctgttacatgcgtgccctatcccccagacctggataccaatccagctgggcttcccgaccaataagtaccgcggaatacgcactgctgtaccatactcttcaagaggcaacaaaacccctacaccagtttttcctcaacacaacaggtttttcttttcaggattgccacgaccgctgcctggcttttaccgatgtggcccccaggggtgtcgcgagcggacagagacgaagctggcttataattcagcggtacgtggaaggctacttcctccaccctacaggactggagctgctggtagatcacggtagtacagacgccgggcactgggcagtagagcaagtgtggtacaatgggaaattttacgggtccccagaggagctggcccggaagtacgccgatggagaggtggacgtagtggttcttgaagaccctcttccaggaggaaagggccatgactccacagaagaaccccccctattctcctcgcataagccaaggggggacttccctagccccatccacgttagtggtccccgcttagtgcagccccacggcccccggtttagactcgaggggaatgccgtgctctacggcggctggagtttcgcctttcgccttcggtcgagctctggcctgcaggtgttgaatgttcactttggaggcgaacgcatcgcctatgaggtctccgtgcaggaggccgtggcactgtatggagggcacactccagcaggcatgcagacaaaatatctggacgtggggtgggggctaggcagtgtaacgcatgagttggctccaggaattgactgtccagagacagcaacctttcttgacacttttcactactatgacgcagacgacccagtccattatccacgtgctctctgcctgttcgaaatgccaaccggagtgcccctacgcagacacttcaattcaaacttcaaagggggctttaacttctacgctggactgaagggccaggttttagtattgcggactacaagtacagtttataattatgattatatttgggactttattttttatcccaacggcgtgatggaggccaaaatgcatgctacaggctatgtccacgcgaccttttatactcctgagggactgagacacggcactcgattgcatactcacctgattgggaacatccacactcacctggtgcactatcgcgtagatctggatgtcgcagggactaagaatagcttccagaccctgcagatgaagttagaaaacattaccaatccatggtcacccaggcatcgcgtggtgcagccaactctggaacagactcagtactcgtgggagcgacaggccgcatttaggttcaagcgaaaactcccaaaatatctgttgttcaccagcccccaagaaaatccctgggggcataagcggacctatagacttcagatacacagtatggccgaccaagtcctacctcctggctggcaggaagagcaagccattacatgggcccggtatcccctggctgtaaccaagtatagggaatcagaattgtgctcaagctcgatctaccatcagaacgacccgtggcaccctccagtggtctttgaacaattcttgcataacaacgaaaacatcgaaaacgaggacctggtggcttgggtgacagtcggattcttgcacattccccactcagaagatattcctaataccgctactcccggtaattctgttggcttccttcttagacccttcaactttttccctgaagatcccagcctggcttcacgggataccgtcatcgtatggccccgcgataatggacccaattacgttcaaaggtggattccagaagatcgagactgctcaatgcccccgccttttagttataatggcacttatagacctgtatag

SEQ ID NO: 178783 - DNA, 1191 bp, Artificial Sequence
  Description of Artificial Sequence: Synthetic coding sequence
atgctgcccagcctgcaggagagcatggacggcgacgagaaggagctcgaaagttcagaggaaggaggctccgcagaagaaagacggctggagcccccaagtagcagtcactactgtctgtatagttacagggggagtcgtctggcccagcagaggggcgattccgaagacggctcccctagtggaactaatgctgagactccttcaggcgacgacttctccctgagcttggcagacacaaacttgccgtctgaggtggaacctgagctgaggtcctttatcgcaaagaggctctctcgcggagctgtgttcgaggggttaggaaacgtggcctctgttgagctcaagattccgggctatagagtcgggtgttactactgcctattccagaacgaaaaactcctcccagagacggtaacaattgattccgagcggaatccctccgagtatgtggtttgttttctcggcggtagtgagaagggcttggaaacctttagactagagctggacaagtacattcaggggctcaagaacaacatgaactgtgaggcgagagggctcgaatctcacatcaagtcctacctgagtagctggttcgaggacgtggtgtgtcctattcagcgcgtcgttcttctgtttcaggagaaactaacattcttactgcacgctgctctgtcctacacaccagtggaggtaaaggagtccgatgagaagacaaagagagacattaataggttcctttcggtcgcaagcttacaggggctgatccacgaaggtactatgaccagcctgtgcatggctatgactgaggagcaacacaaaagcgtggttattgactgcagttcttctcaaccacagttctgcaacgcaggtagcaaccgcttttgtgaagactggatgcaggcattcctgaatggcgccaagggtggaaatccctttcttttcaggcaggtcctggaaaacttcaagctgaaggcgatacaggatacaaacaatctgaaaaggtttatccggcaggcagagatgaaccactacgcactgttcaagtgctacatgttccttaagaactgcggctcaggtgacatcctcctaaagatcgtcaaggtggaacatgaggaaatgccagaggcgaaaaatgtcatagctgtactggaggaatttatgaaagaggctctggatcagtcattttag

SEQ ID NO: 178784 - DNA, 1539 bp, Artificial Sequence
  Description of Artificial Sequence: Synthetic coding sequence
atggacctgaaggagagccccagcgagggcagcctgcagcccagctccattcagatatttgcaaatacatctacactgcatgggataagacacatattcgtgtacggccctctcacaatacggagagttctgtgggccgtagcttttgtgggcagcctggggctgcttttggtggaatcttctgagcgggtgtcttactacttcagctaccagcacgttacaaaggtcgacgaagtggttgcccagtcccttgtgtttccagccgtcacactgtgcaacctgaatgggttcaggttttcgcggctgacaacgaacgatctgtaccatgccggtgagttacttgctctgctagacgtaaacctccagatacccgacccacatctggcagatccctctgtattagaggccctccgccagaaagctaactttaaacactacaagccaaaacagttttctatgctagaattcttacaccgggtgggtcatgatttgaaagatatgatgctctactgcaagttcaaaggccaggaatgtggacaccaggacttcacaactgtattcactaaatacggcaagtgctacatgttcaactctggggaggacggtaagccccttttgaccacagtgaagggtggtaccggaaatggactggagatcatgctagacatccaacaggacgaatatttacccatctggggcgaaactgaggagaccacatttgaggctggtgttaaagtgcagattcactcccagtcagagccaccttttatccaggaactaggttttggcgtggcccccggcttccagacgttcgtcgccactcaggaacaaagattaacgtatctaccccccccctggggcgaatgccggtcttcagagatggggctggacttcttcccagtttactcaatcaccgcctgtcgaattgactgcgagacccgctacattgtggagaattgcaattgtagaatggtgcacatgcccggcgacgcccctttctgcacacctgagcagcataaagaatgtgccgagcccgcactgggtcttcttgcggagaaagacagcaactattgcctctgtaggaccccttgcaacttgacgcgttacaacaaggagctgtccatggtcaagatacccagtaagactagcgcgaaatatctggagaaaaagttcaacaagtccgagaagtatatatcagagaacatactggtgctggacatcttttttgaggccctgaactacgaaactatagaacagaagaaggcctatgaggtcgctgcactcctgggcgacatcggcggtcaaatgggcctctttattggcgcgtcaatcctgactattctagagctgtttgactatatttatgagctgataaaagagaagctgttggatctgcttggcaaggaggaagatgagggttctcatgacgagaacgtaagcacctgcgacaccatgcccaatcatagcgaaaccataagtcacactgtgaatgtaccattgcagaccaccctgggcactctggaagaaattgcttgttag

SEQ ID NO: 178785 - DNA, 612 bp, Artificial Sequence
  Description of Artificial Sequence: Synthetic coding sequence
atgttcaacagcggcgaggacggcaagcccctgctgaccaccgtgaaaggtggaacagggaacggtcttgaaatcatgctggacattcaacaggatgagtacttgcccatatggggtgagaccgaggaaaccacctttgaggcgggagttaaggtgcagatccattcccagagcgagcccccgttcattcaggagctgggttttggggtcgcccccggcttccaaactttcgtggctacccaggaacaaaggctaacataccttccaccaccttggggagagtgtagaagctctgagatgggactcgatttctttcccgtctacagtatcaccgcctgtagaatcgattgcgagaccaggtacattgtcgaaaactgcaattgccgcatggtgcacatgcccggggatgcgcctttttgcaccccagagcagcataaagagtgcgcggaacctgcgctcggtttattagccgaaaaagactcaaactattgcctttgtcgaacgccttgcaacttgaccagatacaataaagagctatccatggtgaaaattcccagcaaaaccagtgccaagtaccttgagaagaagttcaacaagagtgagaagtattag

SEQ ID NO: 178786 - DNA, 1287 bp, Artificial Sequence
  Description of Artificial Sequence: Synthetic coding sequence
atggccgtgggcgccagcggcctggagggcgacaagatggccggcgctatgcccctgcaactgctgcttcttttaatattactaggccccgggaacagtttgcagctgtgggatacttgggcagatgaggcggagaaagccctcgggccgctattagcaagggacagacggcaggctactgaatatgagtatcttgactacgactttctgccagagacagaaccccccgaaatgctgcgcaatagtaccgacacaaccccacttacgggacctggcacccctgaatcgaccacggttgagcctgctgccagacgttctaccgggttggatgcaggcggagcggtcactgagctgaccactgagctcgccaatatgggtaatttatccacagatagcgctgcgatggagatacaaaccacgcagccagccgctaccgaagctcagacaacccaaccagttcccaccgaggctcagactaccccactcgcggctactgaggctcagactaccagattgaccgcaaccgaggctcagaccacccccctggcggcaactgaggcacagactacgcctccagccgctaccgaggcgcagaccacccagcctacaggactggaagctcaaactaccgcccctgccgcaatggaagcccagactactgccccagcggcgatggaagcgcagacaacacctccagctgctatggaggctcaaacaactcaaacaaccgctatggaggcgcagactacagctccagaggcgaccgaggctcagacgactcagccaacagccaccgaggcacagacgaccccactggctgccatggaagccttatcaacagaaccaagtgctaccgaggcgttgtccatggaacctacgaccaagagagggctatttattcctttttccgtttcctctgtgactcataaaggcatccccatggcagccagtaacctaagtgttaactaccccgttggtgcaccggaccacatatcggttaagcagtgcctgctcgcaatactgattctcgctctggttgcaacaattttctttgtttgtaccgttgttctcgctgtacgtttgtcacggaagggacacatgtacccagttaggaattattccccaacggagatggtgtgtatcagcagtttgctgccggatgggggtgagggcccatcagccacagccaacgggggcctctccaaagcaaagtctcctggcctgacgcccgaaccgcgcgaggacagagagggtgacgacctaacattacattcgttcctaccctag

SEQ ID NO: 178787 - DNA, 1587 bp, Artificial Sequence
  Description of Artificial Sequence: Synthetic coding sequence
atggagctgaaggccgaggaggaggaggtgggcggcgtgcagcccgtgagtatccaggcgttcgcgtcttcaagtactctccatggtctggctcacattttcagctacgagcggcttagcctgaagagggccctgtgggctctttgctttcttggttcactggccgtactgctatgtgtttgcactgaaagggtgcagtattactttcattaccatcatgtaacaaagttagatgaagtggctgcaagtcagcttacttttcccgctgtaacgctatgcaacctgaatgagttcaggttttcccaggtgtccaagaatgacctgtaccacgctggggaacttctggccctgctgaacaaccggtatgagatccctgacacacagatggccgacgagaagcaattggaaattttgcaggataaagctaactttcgatccttcaagcccaagccttttaatatgcgcgaattttacgatagggctggacacgatatcagagatatgttattgtcatgtcatttcagaggtgaggtgtgtagcgctgaggatttcaaggtagtattcacaagatatggaaaatgctacaccttcaactcaggcagggacggcagaccacggctgaagaccatgaaaggtgggactgggaacggactggagatcatgcttgacatccagcaggatgaatacttgcccgtttggggagagaccgacgagacatcattcgaggccggaattaaagtgcagatccacagccaggatgagccgcccttcattgatcagctgggtttcggtgtcgccccgggctttcagacctttgtggcctgtcaggaacagagactgatttacctccctcccccttggggaacatgtaaggcagtaactatggactcagacctggatttcttcgattcctactccatcacggcctgccggatcgactgtgagactcgttatctggtggagaattgcaattgcagaatggtgcacatgcccggtgacgcaccctactgtaccccggagcaatataaagagtgtgccgatcctgctctggattttctggtcgagaaggaccaggaatattgtgtgtgcgagatgccctgtaacctaaccaggtacgggaaagaactgtccatggtgaagatccccagtaaagcctcagcaaaatacttagctaaaaaattcaataagtcagagcaatacatcggagagaatattttggtcttggatatcttctttgaggttttaaattatgagaccatcgaacagaagaaagcttatgaaatcgccggcctcctgggcgacattggcggtcagatgggactttttatcggcgcctctattctgacggtgctggaactctttgattacgcctacgaagtgatcaaacataagctctgccgccggggaaaatgtcagaaggaggccaagcgcagcagtgctgacaagggagtcgccctcagcctcgacgacgtgaagcggcataacccttgtgagtctttacgtggccaccctgcaggtatgacttatgccgcaaacatactgccccaccacccagcgcgaggcacctttgaggattttacttgttag

SEQ ID NO: 178788 - DNA, 1689 bp, Artificial Sequence
  Description of Artificial Sequence: Synthetic coding sequence
atgcccatccagatcttctgcagcatgagcttcagcagcggcgaggaagctcctggaccactcggagacatctggggcccccaccaccaccagcagcaacaggacatcagcgaaagcgaggaagaggaggaggaaaaggaaaaggaggctgttagaaaagaagctagcgaaggtcacagcccaatggacctggttgcattcgctaactcttgcacgttacacggtactaaccacatcttcgttgaggggggccccggcccacgtcaggtattgtgggccgttgcgtttgtgctagcactgggggcttttctgtgccaggtgggtgatcgagtggcctactacctctcatacccacacgtcacacttctaaacgaagtggcgaccacagagctggcatttcccgctgtcaccttgtgtaataccaacgcagtgagattaagtcaattgtcgtaccctgatctgctctacctggccccgatgctgggtctcgacgaaagtgatgaccctggagtacctctggccccgccgggacccgaggctttttccggcgagccctttaacctacaccgcttctacaacaggagttgccataggctggaagatatgcttctctactgttcctaccaaggtggcccttgcggcccacataatttctctgtcgtgtttacaaggtatggtaagtgctacacgttcaactctggccgggatggtagaccaagactcaagaccatgaagggcggcaccggcaatggtctggaaattatgctggatatccagcaggacgagtatctgcccgtctggggagaaaccgatgagacttcatttgaagcagggatcaaagtacagatacacagtcaggatgaacctccctttatagaccagctgggctttggagtagctccaggcttccagacctttgtggcctgccaggaacaaagattaatttacttacctccgccttggggcacctgtaaagcagtgaccatggactcagacctcgactttttcgattcttattcaatcactgcttgccgcattgattgcgagacgcgataccttgtggaaaattgcaattgccgtatggtgcatatgcctggggatgcaccttactgcaccccagagcagtacaaggagtgcgcagatcctgccttggattttctcgtggaaaaagatcaagaatactgcgtgtgtgaaatgccatgcaacctgacacgctacgggaaagagttgtcaatggtgaagattccgtccaaggcctccgcaaaatacttggccaaaaaattcaacaagagcgagcagtacattggggagaatatcttagttctggatattttctttgaagtcctgaactacgagacaatagagcagaaaaaggcttatgaaatcgctgggcttctcggggacatcggagggcagatggggctgttcattggcgcctccatactgaccgttttggaactcttcgactacgcctatgaggtcatcaaacataaactgtgtcgtagggggaagtgtcagaaggaggctaagcgcagctcggcagataagggagtcgcgctgagtctggatgatgtaaaaaggcacaacccttgcgagtccttgcggggtcaccccgcagggatgacatatgctgctaatatcctccctcaccaccccgctcgagggaccttcgaggatttcacttgttag

SEQ ID NO: 178789 - DNA, 1650 bp, Artificial Sequence
  Description of Artificial Sequence: Synthetic coding sequence
atgaagcccaccagcggccccgaggaggcccggcggcccgccagcgatatacgtgtgtttgcgagtaactgttccatgcacggacttggccacgtattcgggcccgggtccctgagtctcagacgtggcatgtgggcagccgcagtggttctctctgtagccacatttctgtaccaggtagctgaacgcgtgcggtattatcgcgaattccatcatcagaccgcactggatgaaagggaatcccaccgactaatattcccggctgttacactctgcaacattaatcccttgagacggtccaggctgacccccaatgacttgcattgggctggaagcgcattgctcgggttggatccagccgagcacgccgcttttctgcgcgctctgggaaggccacccgctccaccagggtttatgcctagtcctacattcgatatggcccagttgtacgcacgggcagggcacagtctggacgatatgcttctggactgcaggtttagggggcagccctgtgggccagagaatttcactactatttttacacgcatgggtaaatgttatacattcaactcaggcgcagacggcgccgaactgctaactaccactcgtggcggaatggggaatggtctggacataatgttagacgtacaacaggaggagtatctgcccgtgtggagggataatgaagaaacacccttcgaggtgggaatcagagtgcagatacattcccaggaagaaccgccaatcattgaccaacttgggctgggtgttagccctggatatcaaacgttcgtctcatgccagcagcaacagctcagtttcctacctccaccttggggcgattgcagttctgcttctttgaaccctaactatgaacctgagccctccgacccattgggaagcccaagtccctcccccagcccaccatatactctgatgggctgtcggctcgcttgtgaaacaaggtacgtagcgcgtaaatgtggctgccgcatggtctatatgccgggtgatgtgccagtctgttctccacagcaatacaagaactgtgcacatccagctatcgatgccatgctgcggaaagactcatgcgcttgcccaaatccatgtgcatccacccgatacgccaaagagttatctatggtccggatcccgagtagagccgcggcccgctttctcgcgagaaaattgaatcgcagcgaagcatacatagcagaaaacgtgctggccctcgatatctttttcgaggccctcaactacgaaaccgtggagcagaaaaaggcatacgagatgtcagagctcctcggagatattggcggccaaatgggcctatttatcggggcctctctgcttacaatactcgaaatcctggattacctgtgtgaggtctttcgggacaaggtgttgggctatttttggaatcgtcagcatagccagcgacattcttctactaatctgcttcaggaaggcttaggaagccatcgcacccaggtcccgcaccttagcctggggccatctactctgctgtgctccgaagacctgcccccactcccagtaccctctcccagactgtctcctccgcctactgcccctgcaacactttcccattctagtcggcccgccgtgtgtgttctcggggctccgccctag

SEQ ID NO: 178790 - DNA, 1596 bp, Artificial Sequence
  Description of Artificial Sequence: Synthetic coding sequence
atgaagcccaccagcggccccgaggaggcccggcggcccgccagcgacataagagtgtttgctagcaactgtagtatgcacggcctgggccacgtgttcggaccaggctctctgtcgctgcgacggggcatgtgggccgccgccgtcgtgctctcagttgccacgttcttataccaggtcgcagaaagagtccggtactacagagaattccatcaccagaccgctctggacgaacgagagtctcatcgcctaatttttccagcggtgaccttgtgcaacattaaccccttaagacggagccggttgacacctaacgacctgcattgggctgggtcagccctgctggggttagacccagcggaacacgctgccttccttcgggcattgggtcgcccccctgccccgccaggctttatgcccagtccaacttttgacatggctcaactatatgcgcgggccggtcactccctcgacgatatgttattagactgccggttcaggggtcaaccgtgcggtcccgagaattttaccaccatctttacgagaatgggcaagtgttacacgttcaactctggcgctgacggggcagaactcttgaccacgactcgaggcggcatgggaaacggccttgacataatgttggatgtgcagcaggaagaataccttccagtgtggagagacaacgaagagacgccgtttgaagtgggaattagagtgcagatccacagtcaggaggaacctccaattatcgaccaactgggtcttggcgtatcccctgggtaccagacctttgtgtcatgccaacagcaacagctgtctttcctaccacccccctggggggactgtagctccgcttccctgaatccaaattatgaacctgaacccagcgacccgctgggtagcccaagtccttcccccagccccccttatacgttgatgggttgtagactagcatgtgagacacgatatgtcgccagaaaatgtggatgtagaatggtatacatgcccggagacgtgcccgtatgcagtccacaacagtacaagaattgcgcccaccccgccatcgatgctatgttgcggaaggacagttgtgcctgccctaacccgtgtgcctccacgcgttatgccaaagagcttagcatggtgcgcatcccaagtcgcgcagcagcccgttttttggcacggaagctgaacaggagtgaagcctatattgccgaaaatgtgctcgccctggatattttttttgaggccctcaactacgaaacagttgaacagaagaaggcttatgaaatgtctgagcttctgggggatattggaggtcagatgggactgtttattggggctagcttactgacaatcttagagatcctagattatctatgtgaggtgtttcgtgataaagtgctggggtacttctggaacaggcaacactcgcaacgccactcttccacaaatttgctgcaggaaggactgggaagccaccgtactcaggtgccacatctgagcctaggcccccggccccctacacccccatgtgctgtgaccaaaactctgtccgccagccatcgaacctgttatcttgtgacccaactgtag

SEQ ID NO: 178791 - DNA, 1632 bp, Artificial Sequence
  Description of Artificial Sequence: Synthetic coding sequence
atgaagcccaccagcggccccgaggaggcccggcggcccgccagcgatattcgggtgtttgcctcaaactgttctatgcacggcctcggtcacgtgtttggcccggggtccctctccctgcgccgcggaatgtgggctgctgccgtggtcctgtccgttgcaacgtttctctaccaagttgccgaacgggtgcggtactacagggagttccatcaccagaccgctctggacgagagagaatctcatcggctgatcttcccagctgtgactctgtgtaacataaatccactccgcagaagcaggcttacgcctaatgatctccattgggctggatctgctctcctgggtctagatccagctgaacatgctgcctttttgcgagccctgggacgcccaccagctcctcctggcttcatgccctcccccacttttgacatggcccagctttatgctcgggctggacatagcttagacgatatgctgctggattgccgattcagggggcagccatgtggacccgagaatttcaccacgatctttacccgcatgggaaagtgctacactttcaattctggcgcagatggcgccgaattgctcactacaaccagaggcggcatgggtaacggtctagacatcatgctggatgtccagcaggaggaatacctgccagtctggagagataatgaggagaccccgttcgaagtggggatccgggtgcagatccactcccaggaagagcctcctatcatcgaccagctggggttgggcgtttctccggggtaccagacgttcgtgtcttgccagcagcagcagctgagttttttgccccccccgtggggagattgttcatccgctagtcttaacccaaactatgagcctgagccctcagatccgctgggaagtccatctccgtccccgtcccctccttacactctgatgggttgtagactggcctgcgagacccgatacgtggccagaaaatgcggatgccgaatggtgtacatgcccggggatgtgcccgtctgttcaccccagcagtacaagaattgtgcacacccagccatcgacgcaatgctgagaaaggattcatgtgcctgtcccaatccttgcgcctcgacccggtatgccaaggagctcagcatggtccggatcccctcccgggccgcagcccggtttctggccaggaaacttaacagatctgaggcatacattgccgagaacgtacttgctctggatattttcttcgaagcactcaactacgaaactgtggagcagaagaaagcgtacgaaatgagtgaactgctcggcgatataggaggacagatgggattgtttataggtgcctccctgcttactatcctggagatcttggactatctatgcgaagtgtttcgtgataaggtcctgggctacttctggaacagacagcacagccagcgacattcctccacgaacttaacgtcccacccgtccctgtgcaggcaccaagattccctgaggctacctcctcacctgttaccctgtcacacagctctcgatttattgtctgttagctccgaaccaaggcccgatatcctggacatgccctctctccacgtcgccttccccagttcacctcagatcaagagttag

SEQ ID NO: 178792 - DNA, 1944 bp, Artificial Sequence
  Description of Artificial Sequence: Synthetic coding sequence
atgctgagcggcgccgccggcgccgcccggcggggcggcgccgccttggcccctagccttacccgttccctcgcagggactcacgcaggggctgattcctgcgcgggcgccgataagggaagccacaaagagaccatagaggaacgggacaaacgacaacagcgccagcaacgacagcggcagcaccaggggtgtggggctgctggaagcggatcagattccccgacaagcggtccccacccagtcccggtcctcttcccgctcgccctgtctctcgaggagcaaccccttcctcccctgccgctggggcgggcaccagggcttcttgcccgtgagggacaaggccgggaggccctggcgtcacctagcagcagaggacaaatgcctatcgagatagtttgcaaaataaagttcgcggaggaagatgcaaagccaaaggagaaggaggccggagacgaacaatcactcttgggcgccgtggcgcctggagctgcaccacgcgatctggccacctttgcttccacgagcactcttcatggcttggggagagcttgcggaccagggccacatggcctccgacgcacactgtgggccctcgcgctacttacctctctcgccgcattcttataccaagccgcgggcctggctaggggttacctcactagacctcatttagtggctatggatcccgcagcgccagctcctgttgctggcttccccgccgttactctctgcaatattaaccggttcagacattcagctctttccgacgctgatattttccacctagctaacctcaccggtctgcctcccaaggacagagacggacaccgagctgccggattgcgatatcctgagccagatatggtcgatattttaaatagaactggacatcaactcgctgacatgctgaagagttgtaattttagtggtcaccattgctcagccagcaacttcagcgtggtatacacccggtatggcaagtgttatacatttaacgccgaccctcggtcctccttacctagccgagcgggaggaatggggtcaggactcgagatcatgctggacattcagcaggaggaatacctgcccatatggagagaaactaatgaaacaagcttcgaagccggaattcgcgtgcaaatccatagtcaagaggaaccgccctatatccaccagttgggcttcggcgtctcacctggattccaaaccttcgtcagctgccaggagcagcggctgacttacctgccccagccctggggcaactgccgagcagaatctgagctgagagagcctgaactacaggggtacagtgcctattcagtgtctgcctgccggctgagatgtgagaaggaggctgtgctgcaaagatgccactgtaggatggtgcatatgcccgactcactgggcggaggccccgaaggaccttgtttctgtcccactccctgtaatttgacccgctacggtaaagaaatctccatggtgagaatccccaataggggttctgcccgatatctggccagaaagtataatcgaaacgagacatacatccgggaaaacttccttgtgctggacgtgttttttgaggcccttacttccgaggccatggaacagcgcgcggcttacgggctgtcagcgttgcttggcgatctgggggggcagatgggtctttttatcggcgctagcatcctgactctcctcgaaatcctcgactacatttatgaagttagctgggaccgacttaaacgcgtctggaggcgacccaaaactccccttcggacctctacaggggggatcagcacacttggtctgcaggagctgaaagaacagagtccgtgccccagccggggacgagtggagggcggcggcgtgagtagtctgctgcctaatcaccatcatcctcatggccccccgggcgggttgttcgaagactttgcttgttag

SEQ ID NO: 178793 - DNA, 2001 bp, Artificial Sequence
  Description of Artificial Sequence: Synthetic coding sequence
atgctgagcggcgccgccggcgccgcccggcggggcggcgccgccttagcgccctcattgaccaggtcgttagccggaacacacgccggagcggacagttgtgccggagctgataaaggatcccacaaagagactatcgaagaacgtgacaagcggcagcaacgtcagcaacggcagcggcagcatcagggctgtggagccgcggggagcgggtctgattcaccaacctccggcccccatcccgtacctgtgctgttcccattggctcttagcctggaagagcagcccttgcccccccttccacttggtagggccccgggtttgctggctagggagggacagggccgcgaggccttggcctcacccagctccagaggacagatgccaatcgaaatcgtgtgcaaaatcaagttcgccgaggaagatgcaaaacccaaagaaaaagaggctggtgacgagcagtctctcctgggcgccgtcgcgcctggcgccgcacccagagacctggccaccttcgcatccacctctactcttcacggattagggcgtgcttgtgggccaggcccccatggtctgcgacggaccctgtgggccctagctcttctgactagtctggctgctttcttgtaccaggccgccgggcttgctagaggctacctcacaaggccacacctcgtcgcgatggacccagccgctccggcgccagtcgcaggcttccctgcagtcactctctgcaatatcaaccgatttaggcatagcgccctgagcgacgccgatattttccatctcgctaatttgactgggctgcctcctaaggatagggatggccaccgggctgctgggctcaggtacccagaacccgatatggtcgacatcctaaatagaaccggtcaccaactggccgacatgctgaagtcctgcaacttctctggccaccactgcagcgccagcaatttttccgtcgtttacacccgatatggaaagtgctacacatttaatgcggaccccaggtcctccttgccatctcgtgctgggggaatgggctccggtcttgagattatgttggatatccagcaagaggaataccttccgatatggcgagagaccaacgagacatcttttgaagcaggcatccgggtccaaattcactctcaggaggagcccccttacatccaccagctgggctttggcgtgagtcccgggtttcagaccttcgtcagttgccaggagcagagattgacatacctaccacaaccctggggcaactgtagggctgagagcgaactgagagagcccgagctccaagggtattcagcatacagcgtcagcgcttgccggttgcgctgcgagaaggaggccgttcttcagagatgtcactgccggatggtccacatgcccggaaacgagaccatatgtcctccgaacatttacatcgagtgtgctgatcatacactcgactccctgggaggaggcccggaaggcccttgcttctgccccaccccatgtaaccttacgagatacgggaaagagattagcatggtgagaattcccaataggggctctgcacggtatctcgcccgcaaatataaccggaatgagacttatattagggaaaatttcctggtcctggacgtctttttcgaggcactgacatctgaagcgatggagcagagggccgcatatgggctgtccgctctcttgggagatctgggaggccagatggggctgttcattggcgcgtctatattgactttactggaaatcctcgattatatttacgaggtctcttgggaccggctgaaacgggtgtggagacggccaaagacccccctaaggactagcaccggcggaattagcacccttggtctgcaggaattaaaggaacaaagcccatgccccagccggggtcgggtggagggaggcggcgtgtccagcctgctacccaaccaccatcatccccacggcccacctggcggcctgtttgaagacttcgcgtgttag

SEQ ID NO: 178794 - DNA, 2271 bp, Artificial Sequence
  Description of Artificial Sequence: Synthetic coding sequence
atgcacctgaagatcgtgctggccttcctggccctgagcctgatcacaattttcgcactcgcctacgtgttgctgacttctcctggtggttcaagtcagccccctcattgcccctctgtgtcacatcgtgcacagccatggccccatcccggccagtctcaactgttcgccgacctgtcacgagaagagctgacagcagtcatgcgattccttacacagaggttaggacccggactcgtagacgccgcacaagcccagcctagcgacaattgcatattctccgtcgagcttcaactccccccaaaagcggccgcactagctcacttggatagaggctccccaccccccgctagggaagccctggccatcgtcctcttcgggggccagccacagcctaatgtgtcggaactggttgtaggccctttacctcacccctcatatatgagggacgttaccgtggagcggcacggtggaccactcccttatcataggagaccagtgcttcgggccgaatttacacaaatgtggagacatttgaaagaggttgagttgcccaaggccccaatctttctgagctcaacgttcaattacaacggtagcacgctcgctgccgttcatgctaccccaagaggactgcggtctggggaccgggccacgtggatggctctttaccataatatttccggggtcgggctgttcctgcacccagtaggccttgagcttctgctcgaccacagggccctcgaccccgcccactggactgtccagcaagttttctacttaggccactactacgcagacttggggcagcttgagcgggaatttaagtccggaagactggaggtcgtccgtgtgccgctgcccccccctaacggtgccagcagtcttagaagtcgtaattctcctggcccactaccaccactgcaattttccccacaaggcagccagtatagcgtccaggggaacctggtggtgtcatccttgtggagttttacattcggtcacggagttttttctggactgaggattttcgacgtgcggtttcagggggaaaggattgcctacgaggtatctgtacaggagtgcgtgtcaatctacggcgcagattccccgaaaaccatgctgacacggtacttggacagctcatttggtctgggtagaaatagccgaggtctggtccgaggggtggactgtccatatcaggctaccatggtggacatccacattctcgttggcaagggtgctgtacagctgctaccaggcgctgtctgcgtattcgaagaggctcagggactgcccttgcgtcgccatcataattaccttcagaatcacttctacggaggcttggcctcctctgcattggtggtgagatctgtcagcagcgttggcaattatgactatatctgggactttgttctctatcccaatggcgctctggagggaagagtgcatgccaccggctacatcaataccgctttcttaaaaggaggggaggagggccttctgtttggcaatagggtcggagagagggtgcttggaaccgttcatacacacgcctttcactttaagcttgatttggacgttgctggactgaaaaactgggttgtggcagaagatgtcgtctttaagcccgtcgccgccccgtggaacccagagcactggctgcagagaccacagcttacacgccaagtccttgggaaagaggatctgactgcgttttcgctcggcagtcctcttccaaggtatctgtatcttgcctctaatcaaacgaatgcctggggtcaccagcgcggttatagaatccaaatccacagtcccctcggcatccatataccattagagtccgacatggagcgggccctgtcctggggtagatatcagctggtcgttacacagcgaaaagaggaggagtcccaatcgtcaagcatatatcatcaaaatgacatttggacaccaacggtcaccttcgctgattttattaacaacgagaccctgttgggggaagatctggtcgcatgggttaccgcttcatttctgcatattccgcacgctgaggacatcccaaataccgtgaccttgggaaatcgcgttggtttcctcctaaggccatataacttctttgatgaggacccttcaattttcagccctggaagtgtttattttgagaaggggcaggatgccggcctgtgttctattaatccagtggcatgtctacccgacttggccgcatgtgtgcccgacctcccgcctttctcctaccacggcttctag

SEQ ID NO: 178795 - DNA, 2190 bp, Artificial Sequence
  Description of Artificial Sequence: Synthetic coding sequence
atgcacctgaagatcgtgctggccttcctggccctgagcctgatcacgatattcgcgttagcatacgttctgttaacctccccaggtggttcaagtcagccaccacattgcccgtctgtctcacaccgggcccaaccatggccgcaccctggccagtcacagttgttcgcagatctgagcagagaggagctgaccgcagtgatgcgcttcctcacccaacgactaggtcccggactggtggacgccgctcaggcccaacctagcgacaactgtatcttttctgtcgaactgcagctccctccaaaagcggccgccctggctcacttggacagagggagccccccccccgccagagaagccctggcgatcgtgcttttcggcggccagcctcagcccaatgttagtgagctggtggtgggccctctaccacacccatcttacatgcgggacgttactgtggagcgccacggcggccccctgccttaccatagaagacccgtcctccgtgccgagtttactcagatgtggaggcacctcaaggaagtggagctgcctaaggcaccaattttcctgtcctccacgttcaattataacggctccactctggccgcagtccatgcgacaccccgaggtctgcggtctggcgacagggccacatggatggctctgtaccacaatatctcaggagtgggtttgttcttgcatcctgtcgggttggagcttctccttgaccatcgggctctcgatcccgcacactggacagtgcagcaggtgttctatctgggccactactacgctgatttgggccaactggaacgcgaattcaagagcggtcgtttggaggtggtgagggtgcccctgcctcctccgaatggagctagctccctgaggtcaagaaattcccccggtccactcccccctctccaattcagtccgcaggggtctcaatattcagtgcagggaaatctggtggtttcttccctctggagcttcacctttgggcacggcgtattctccgggctgcgaatattcgacgttagattccaaggggagcgcattgcctatgaagtgtctgtgcaggaatgtgtgtctatctacggggctgactcccctaaaaccatgctgacccgctatctggacagctcattcggcctgggtcgcaactcccgggggctggtgcgtggggtggactgtccctaccaggctaccatggtcgacatacacattctggtcggtaagggggctgtgcagctactgcctggcgcggtgtgcgtgttcgaggaggctcaaggcttgcctctgagacggcaccacaactacttgcagaatcatttctacggcgggctggcatctagtgccctcgtggtacgctcagtttcaagtgtggggaactatgattatatttgggatttcgttctgtatccgaatggagctctggaggggcgagttcacgccaccggatacatcaacaccgcttttctcaaagggggggaagaaggtctgctgtttgggaaccgcgtcggtgagagagtgctcggaactgtgcacacacacgcgtttcattttaagctggatcttgacgtcgccggactgaagaactgggtggtggccgaagacgtagtgtttaaaccagtcgccgctccctggaaccctgaacactggcttcaacggccccagctcacgaggcaggttctcggaaaagaggatcttacagcgttttccctggggtctcccctaccaaggtatctttacctcgctagcaaccagaccaatgcatgggggcaccaacgaggatatcaactagtggtgactcaacgcaaggaggaagagtctcaaagctcttcgatctaccaccagaatgacatctggacacccactgtcacttttgccgacttcatcaacaacgagaccctcctgggcgaggatttagtggcttgggtcacggcttctttcttacatatccctcacgctgaggacattcctaacaccgtgactcttggcaatagagtgggcttcctgcttcgcccttacaacttcttcgatgaagaccccagtatctttagtccgggcagtgtgtacttcgagaaagggcaagacgctggcctatgctctattaaccctgttgcttgtctcccagacctcgccgcctgcgtgcctgatctacctcccttttcgtatcacgggttttag

SEQ ID NO: 178796 - DNA, 2292 bp, Artificial Sequence
  Description of Artificial Sequence: Synthetic coding sequence
atgaaccagaagaccatcctggtgctgctgatcctggccgtgatcacaatttttgctttggtgtgcgtactgctcgtggggcggggtggcgacgggggtgaaccttcccaactgccacactgcccatccgtatccccctctgcccagccatggacccatcccggccagtcacaactcttcgcagacttatcaagggaagaactgacagcggtgatgaggtttctgacccagcgcctgggccctggacttgtggacgctgcccaggctaggccatctgacaactgcgtatttagcgtggagctacagctgccaccaaaggccgccgcccttgcccatttagaccgcggctcccctccccccgctcgagaggccctggccattgtatttttcggccgccaaccccagccaaacgtttcagagctggtggtgggaccccttccgcacccttcctacatgagagacgtaacggttgaacgacacggagggccccttccctaccatcgtcgccccgttctcttccaggagtacttagacatagatcaaatgatctttaaccgcgagctcccacaggcctccggtttgcttcaccactgttgtttttataaacaccggggccggaacctggtcactatgaccactgcaccgaggggactgcagtcaggcgaccgggccacctggttcggactttactataatatttcaggggccggcttttttttacaccacgtaggactggagctcttggtgaaccacaaagccctcgaccctgccaggtggacgatccagaaagtgttttaccagggaagatactatgattcgctagctcagctcgaggcccagtttgaggcaggacttgtgaatgtcgtcctgatccccgacaacggaacgggaggctcctggagcctaaaaagccctgtgccacccgggcccgctcccccactgcaattttaccctcaaggcccccgtttctcagtgcagggctcccgggtcgcctcttctctctggacattcagttttggccttggtgctttctcaggcccaaggatatttgacgtccgttttcagggagagaggctggtttatgagatttccctacaggaagctttggccatctatggcggcaattcacctgctgccatgaccacaagatacgtggatggaggctttgggatgggaaaatacactacacctctgacacgaggagtcgactgcccctatctcgccacttacgtcgattggcatttcctgctcgagagtcaggcacctaaaacaatcagagacgccttttgcgtatttgagcaaaaccagggactgcccctccgccgacatcacagcgatttgtacagtcattacttcggcggactggccgaaactgtccttgtcgtgagatctatgagtacgctgcttaactacgattacgtttgggacaccgtgttccatcctagtggagccatcgaaattcgtttctatgcgaccggttatatcagctcggcattcttgttcggagcaactggaaagtatgggaatcaggtcagcgaacataccctgggcaccgttcacacccacagcgcacacttcaaggttgacctggacgtggcaggacttgagaactgggtctgggctgaggacatggtgtttgtacctatggccgtcccgtggtctccagaacaccagctgcagcggcttcaggtcacgaggaaattactggagatggaagagcaggccgcatttctggttggttctgctacaccacgctacctttacctagcgagtaaccatagcaacaaatggggccatccacgaggctatcgtattcagatgttgagcttcgcaggggaacctctgccacaaaattcatctatggcacgcggatttagttgggaacgttatcagctggccgtcacgcagagaaaggaggaggagccctcttccagttccgtgttcaaccagaatgacccttgggcccccacagtggattttagcgacttcataaacaatgagaccatcgcagggaaagacttggtagcctgggtaaccgccggctttctgcatatcccccacgccgaggatatacccaacacagtgaccgtaggaaatggggtcggatttttcctgaggccatacaacttctttgacgaggatccttctttctacagtgctgatagcatatatttccgaggcgatcaggacgccggggcttgtgaggtgaaccctctggcctgtctgccccaagccgccgcttgcgctccggatttacccgcattttctcacggcggtttttctcataactag

SEQ ID NO: 178797 - DNA, 939 bp, Artificial Sequence
  Description of Artificial Sequence: Synthetic coding sequence
atggccaacaacgacgccgtgctgaagcggctggagcagaagggcgcagaggctgaccaaattatcgaatacctcaagcaacaggtgagcctcctgaaagaaaaagcaatcttgcaagcgacactccgtgaggagaaaaaactgcgcgtggagaacgctaagcttaagaaagagatcgaggagctgaagcaggagctgatccaggccgaaattcaaaatggggtaaaacagatacctttcccctctgggacacccctgcacgctaattcaatggtaagcgaaaatgtgatacagagcaccgcggtgactactgtctcgtctggcaccaaggagcaaatcaaaggagggaccggcgatgaaaagaaggccaaagaaaaaattgagaagaagggagagaagaaagaaaaaaaacaacagtcaatcgccggaagcgctgattcaaaacctatcgatgtatctcggttagacctaagaattggatgtatcattacagcgaggaagcaccccgatgctgattccttatacgtggaagaggtagacgtgggggaaattgccccccggactgtggtctctggactcgttaaccacgtgcctctggaacagatgcagaaccgaatggtgatacttctttgtaacctgaaacctgccaagatgcggggtgtcctgtctcaggccatggtaatgtgcgcctccagccctgagaagattgagattctcgctcccccgaacgggtctgttcctggagataggatcacatttgatgcatttcccggcgaacccgacaaagaacttaacccaaagaaaaagatttgggagcagatccagcctgacctccacactaatgacgaatgtgttgctacctacaagggcgttccgtttgaggtgaagggcaaaggtgtttgtagagcccagactatgagcaacagtggtatcaaatag

SEQ ID NO: 178798 - DNA, 1011 bp, Artificial Sequence
  Description of Artificial Sequence: Synthetic coding sequence
atgctgcccgccgtggccgtgagcgagcccgtggtgctgcggttcatgatattttgtcgactgctggctaaaatggcaaacaacgatgccgtgctaaagagacttgaacagaagggggctgaggccgatcagattatcgaatatctgaagcagcaggtgagtttactcaaggaaaaggccatcctccaggctacactgagggaggaaaaaaagttgcgtgtggagaacgccaagctcaagaaagagattgaagagctgaagcaagagctaatccaggcagaaatccagaacggcgttaagcagattccatttccctctggcacgcctttgcacgccaattctatggtatccgagaacgttatccaatccaccgccgtgaccaccgtctctagcggtactaaggagcaaatcaagggcggtacaggagacgagaaaaaggccaaagagaaaatcgaaaagaaaggggagaaaaaggagaaaaagcagcagtccattgcgggctctgccgattctaagccaatcgacgtttctcgcttagacctgaggatcggctgcatcattaccgcacgcaaacatccagacgccgattcactctacgtggaggaggtggacgtgggagagatcgccccccgtaccgttgttagcggcctcgtgaaccatgtaccactggaacagatgcagaaccgcatggttatcctgctatgcaatctaaaaccggcgaagatgcggggcgtgctttcccaagctatggtcatgtgtgccagtagtccagagaagatcgaaatccttgcgcccccgaacggttccgttcctggcgaccggattaccttcgacgccttcccaggggagccagataaggagcttaatccaaaaaaaaaaatctgggaacagatccagcctgatctgcatacgaatgatgagtgtgtagcaacatataagggcgtaccgttcgaggttaagggcaagggggtttgccgggctcagacaatgtccaatagcggaatcaaatag

SEQ ID NO: 178799 - DNA, 810 bp, Artificial Sequence
  Description of Artificial Sequence: Synthetic coding sequence
atggccaacaacgacgccgtgctgaagcggctggagcagaagggcgctgaggccgaccaaataatagagtacctcaaacagcaggtgagtctgcttaaagaaaaggccattttgcaggccactctcagggaggaaaagaaactgcgagtggaaaacgccaagctaaaaaaggaaatcgaagagcttaagcaggagctaatacaggccgagatccagaacggagtgaagcagatcccatttccatctggtacgccactccatgcaaacagcatggtttcagagaacgtcattcagtccaccgcagtcacaactgtgtccagtgggaccaaggagcagatcaagggtggaaccggcgatgaaaagaaagccaaagagaaaattgaaaagaaaggtgagaagaaggagaagaaacagcaaagcattgcaccaagaaccgtggtcagcggcctggtgaaccatgtgcccctagagcagatgcagaacagaatggttatcctgctttgcaacctgaaacccgccaagatgcgaggcgtcttatcccaggcaatggtgatgtgcgccagttcccccgagaagattgaaatcctggcacctcctaatggcagcgttccaggggataggatcactttcgacgcttttcctggggagcccgataaggaacttaacccaaaaaaaaagatctgggagcagatccagcctgatcttcatacgaacgacgagtgtgtggctacttataagggcgtgccttttgaggtgaaagggaaaggcgtctgcagagcccagacaatgagtaactccggtattaagtag

SEQ ID NO: 178800 - DNA, 939 bp, Artificial Sequence
  Description of Artificial Sequence: Synthetic coding sequence
atggccaacaacgacgccgtgctgaagcggctggagcagaagggcgctgaagccgatcagatcatcgagtacctgaagcagcaagtgtccctgctcaaggagaaggcaatccttcaggccactctgagggaagaaaaaaagctgcgcgtggagaatgctaaattaaaaaaggagatcgaagagctgaagcaagaactgatacaggccgagatccagaatggggtgaagcagataccctttccatccggcacccctcttcacgccaacagtatggtgtccgaaaacgtcatccaatccacagctgtaacaaccgtaagcagcggaaccaaggagcaaatcaagggtggcacgggagacgaaaaaaaagccaaagagaagattgaaaaaaagggcgagaagaaagagaaaaaacagcaaagcatcgctgggtccgcagattctaagcccatcgatgtctcacgtctcgacctgcgtatcggctgtatcatcacagctaggaagcaccccgatgccgatagtctgtacgtggaggaagtggacgtgggcgaaattgcccctaggactgtggtgtccggactcgtgaaccacgtccctttagaacaaatgcagaatcgcatggtgattctcctgtgtaacttgaagcctgctaagatgcggggcgtccttagccaagcgatggttatgtgcgcatcatctccggagaaaatcgaaatcttagccccaccaaacgggagtgtcccaggggatcgaattacctttgatgcttttcctggtgaacccgacaaggaactgaacccgaagaagaaaatatgggagcagatacaaccggaccttcacactaacgacgaatgtgtggcaacatacaaaggagtcccatttgaagtgaaaggaaagggggtgtgccgggctcagacaatgagtaatagcggcatcaagtag

SEQ ID NO: 178801 - DNA, 453 bp, Artificial Sequence
  Description of Artificial Sequence: Synthetic coding sequence
atggccaacaacgacgccgtgctgaagcggctggagcagaagggcgccgaagcagaccagattattgagtatttaaaacaacaagtctccctcctgaaggagaaagcaatactccaggctaccctgcgagaggagaagaagttacgtgttgagaacgccaaactgaaaaaggagattgaagaactcaagcaggagctgatccaggcagagatccagaatggtgtgaagcaaatcccttttcctagtggcacaccactgcacgccaattccatggtctcagagaacgtgatccagtctacagcagttaccacagtcagtagtgggacaaaggagcagattaagggcggcactggagacgagaagaaggctaaagagaaaatcgagaagaaaggcgagaaaaaagaaaaaaagcagcagtcaatcgcaggatccgctgatagcaagcctatctag

SEQ ID NO: 178802 - DNA, 1227 bp, Artificial Sequence
  Description of Artificial Sequence: Synthetic coding sequence
atgaccagcaagggccccgaggaggagcaccccagcgtgaccctgtttcggcagtacttaagaatccgtacagtgcagccaaagccagattatggagccgccgtcgcctttttcgaagagacggcgagacaactcgggctcggctgtcagaaggttgaggtggcccctggctatgtggtgaccgtgctcacatggcccggtaccaaccccacacttagttctatacttcttaacagccataccgacgtcgtgcccgtcttcaaagaacactggagccatgatccttttgaagcttttaaagattccgagggctatatttacgctagaggggcacaagacatgaagtgtgtgtcaatccagtatctggaggccgtgcgaaggctgaaagttgaaggccataggttccccaggaccatccatatgacgttcgtgccagacgaggaggtcggcggtcatcaggggatggagctttttgtccaacggccagaattccacgctctgcgcgctggatttgctctggacgaagggatcgcaaaccccacagatgccttcacagtgttttactcggagaggtcaccctggtgggtgcgagtgacgtcgactgggcgcccaggacacgcttctcgcttcatggaagatacggccgccgaaaagctgcacaaagtggtcaattcaatactggcgtttcgagagaaagagtggcagcgcttacaatcgaaccctcacctgaaagaggggtccgtcacatctgtgaaccttacaaaactggagggcggggtagcttacaacgtgatacccgctaccatgtctgctagcttcgattttcgcgtagcaccggatgtcgattttaaggcatttgaagagcaacttcagtcctggtgtcaggccgcgggggagggggttacgttagagttcgcgcaaaagtggatgcaccctcaggtcaccccgaccgatgatagtaatccatggtgggccgcattttctcgcgtgtgtaaagatatgaacctgactctcgaacccgagattatgcccgctgccacggataaccggtacattagagccgtgggagtacctgccttgggattcagcccaatgaacagaacccccgtcctgcttcatgatcacgatgaacgactgcatgaagctgtgttcctgagaggagtggacatctacacacgtttgctgccagcgctggctagtgtacctgcactgccctctgatagctag

SEQ ID NO: 178803 - DNA, 1497 bp, Artificial Sequence
  Description of Artificial Sequence: Synthetic coding sequence
atgtggggctgccaggcccccctgagccggctgcccgccagcggcgaaacccctatgtcccagtcatggctggtgtccccactggctactcggccgtccttcactgctcgctgtagtcattctacccgtcacactggatggcgatggtgttgcttcatggagagacctctgaccctaacccgcggtagtagctgggcacattgctcctattgccatagaggcgctactggcccatggccacttacctttcaactgactacccggagcgccatgacaagcaaaggccctgaggaagagcatcccagcgtgacgctgtttagacagtacttacgcatcaggacagtgcagccgaagcctgactatggagccgcagtcgctttctttgaggaaacggccagacagctcggcttaggatgtcagaaagtagaggttgcgcccgggtacgtcgtcacggtgcttacatggccaggtaccaatcccacacttagctccattcttctgaactcccacaccgatgtggttccagttttcaaggaacattggagccatgaccctttcgaggccttcaaggattcagagggatacatttatgctaggggagcccaagacatgaagtgtgtgtctatccagtatctagaggcagtacggcgcctcaaggtggagggacaccggtttccgcgcacaatacacatgacttttgtccccgatgaagaggtcggcgggcatcagggaatggagctgttcgttcagaggcccgaattccatgcactgagagccggctttgctctggatgagggtatcgccaatcctaccgatgcattcaccgtcttttattcggaacggagcccctggtgggtgcgcgtgacatctacgggtagacccgggcatgcctcacgctttatggaggatacggccgccgagaaattgcacaaggtggtgaatagcatattggcatttagggaaaaagagtggcaacggctgcagagcaatcctcatttaaaggagggttctgtgacaagtgtaaaccttacaaagctggagggcggcgttgcgtataacgtaatcccagctacaatgagcgcgtcttttgacttccgagtggcaccagacgtggactttaaagcttttgaagagcagctgcagagttggtgccaagccgctggagagggggtcaccctggaattcgcacagaagtggatgcatcctcaggtcacccccacagacgacagcaacccttggtgggccgccttcagtagggtttgcaaggacatgaatctgaccctcgagcccgagataatgccggctgctacagataatcgttacattcgagcggtcggagttccagcacttggcttcagtcctatgaatagaacgccagtgttgctccacgatcatgatgagcgcctgcacgaggcggtatttttaaggggcgttgatatttatacgcggctgttgccagctctggcctcagttccagcgctgccatctgattcctag

SEQ ID NO: 178804 - DNA, 1122 bp, Artificial Sequence
  Description of Artificial Sequence: Synthetic coding sequence
atgaccagcaagggccccgaggaggagcaccccagcgtgaccctgtttagacagtatcttaggattcgaaccgtgcaacctaaacccgattacggaaccaatcctacactttcctcgatactcctcaacagccataccgatgtagtcccagtgtttaaggaacactggtctcacgacccatttgaggcatttaaagattccgaaggttacatttacgcgcggggtgctcaggatatgaagtgcgtgtctatacagtatttggaggctgtaaggagactgaaagtagagggccaccggttcccccgtacgattcatatgacctttgtgccagatgaagaagtcggaggccatcaggggatggagcttttcgtacagagacccgaattccacgctctgcgggctgggttcgccttggacgaaggcatcgctaatccaacagacgcctttaccgtgttttactcggagagaagtccgtggtgggttagggtgacgagtaccggtcgtcctggccatgcttctcggttcatggaagataccgcagccgagaagcttcataaagttgtgaatagtatactcgcttttagagagaaggagtggcaacgactacagagcaacccacacttgaaggaaggctcagtgacgagtgtcaacctcaccaaactggaagggggtgtcgcttataatgtgatcccagccaccatgagcgcttcctttgatttccgggttgcccctgatgtcgattttaaggcttttgaagaacagctccagtcctggtgtcaggccgccggtgagggcgttacgttggagtttgctcagaaatggatgcatccccaggttacaccaacagatgattccaatccctggtgggcagccttcagtcgtgtctgtaaggacatgaatctgaccctggaacctgaaataatgcccgctgctactgataataggtatattagagcggtaggggtgcctgccttggggttcagcccaatgaacaggacccctgtccttctgcacgaccacgatgaaaggctacacgaggccgtttttcttcgaggagtggatatttataccaggctgcttccggcactggcctctgttccagccctgccctcagattcatag

SEQ ID NO: 178805 - DNA, 1032 bp, Artificial Sequence
  Description of Artificial Sequence: Synthetic coding sequence
atgaccagcaagggccccgaggaggagcaccccagcgtgaccctgttccgccaatacctgagaattaggaccgtgcagcccaagcctgattatggggcggcggtggcctttttcgaggagacagccaggcaactcgggctgggatgtcagaaagtggaggtcgctccagggtacgtggtaaccgtgctcacctggccggggacaaatcctacgctgtcttcaattctcctgaacagccatactgatgtggtgccagttttcaaggaacactggtctcatgatccttttgaggcctttaaggacagtgagggatacatctatgctcggggcgcccaggacatgaaatgcgtctccattcagtacttagaggcggtaaggaggctgaaagtggagggccaccgctttcctcgtaccattcatatgaccttcgtgccggatgaggaggtcggtggccaccagggcatggaactgttcgtccagaggcccgaatttcacgcacttcgtgcaggttttgcgttggatgaaggcatcgccaacccaaccgatgcctttaccgttttttacagcgagcgttcgccatggtgggtgagagtcaccagtactggccgccccggccacgcttctcggtttatggaggacaccgctgcagaaaaactcgcttttgaagaacagctgcagagctggtgtcaagcagctggagaaggagtaacattagagtttgcccagaagtggatgcatccacaggttaccccaaccgacgactccaacccttggtgggcagccttctctcgcgtgtgtaaggacatgaacctgactctcgagccggagattatgccagctgccacagacaaccgatatattagagccgtcggtgtcccagctctggggttctccccaatgaatcggacgcctgtgctgttgcacgatcacgacgaacggctgcacgaggcagtgtttctgcgcggtgtggacatttatacacgactactccctgccctggcttccgtgcccgccttaccctctgatagttag

SEQ ID NO: 178806 - DNA, 1011 bp, Artificial Sequence
  Description of Artificial Sequence: Synthetic coding sequence
atgaccagcaagggccccgaggaggagcaccccagcgtgaccctgtttcgtcaataccttagaatcaggaccgttcaacccaagccagactatggtgcagccgtggcatttttcgaagagaccgctcgacagttgggtctcgggtgtcagaaagttgaagtggcgccaggctatgttgtcacggtcctgacctggccaggtactaatccaaccctgtccagcatcctgctcaattctcacactgacgttgtcccagtgttcaaggagcattggtctcatgatccatttgaggcatttaaagactccgaaggtatcgccaatccgactgacgcattcactgttttctacagtgagcggtcaccatggtgggtgagagtgactagcacggggaggcctgggcacgcttccaggtttatggaagatactgccgctgaaaagctccacaaggttgtcaactcaatcttagcgtttagagaaaaggagtggcagcggctccagtcaaacccacacctcaaagagggttccgtgaccagtgtcaatcttaccaagctcgaaggcggggttgcctacaacgtgatcccagccaccatgagtgcgtcttttgatttcagggttgcgcccgatgttgatttcaaagcttttgaagaacagcttcagtcctggtgccaggccgccggtgagggcgtgactctcgagttcgctcaaaaatggatgcacccacaagtgacaccaaccgatgacagtaacccatggtgggccgcattctccagggtctgcaaggatatgaacttgaccctcgagcctgagattatgccggccgccactgataaccgatacatccgcgccgtgggtgtacctgctctaggcttctcacctatgaaccggacaccagttctccttcatgaccatgacgagagactccatgaagccgtcttcttacgcggggtcgatatttacacccgtttactgcccgccttagcttccgtccccgccctacccagcgacagctag

SEQ ID NO: 178807 - DNA, 1278 bp, Artificial Sequence
  Description of Artificial Sequence: Synthetic coding sequence
atgaactacgcccggttcatcaccgccgccagcgccgcccggaaccccagtcccattcgtaccatgaccgacatactctctcgtggaccaaagtccatgatttcactggcaggcggcctcccaaaccccaacatgttcccattcaagaccgccgtgatcactgtggagaatggcaagacaattcagttcggggaggagatgatgaagagggctcttcagtattccccatctgcaggcatccccgagctccttagttggttaaaacagctacaaattaaactccataatccacctaccatccactaccctccttcccaggggcaaatggatctgtgtgtaacgtccgggagccagcaagggctctgtaaagttttcgagatgatcattaaccccggggataacgtgctactggatgaacccgcctactctggcaccctgcaatcattgcaccccttagggtgcaacattattaatgttgcgtccgacgagagtggcattgtgccggattcgttgagggatattctgtccagatggaagcccgaagatgctaaaaatccgcagaagaatacgcccaagtttctgtacacagtgcccaatggcaacaatcccaccgggaattctctgaccagtgagcggaaaaaagagatttatgagctcgccaggaaatatgatttcttgatcatcgaagatgatccttactattttctgcagtttaataagtttcgcgtgcccacctttttgagcatggatgtggatggtagagtgatccgggccgacagcttcagtaagatcatcagctctggcctccgcatcgggttccttactggtccaaagcccctcattgagagagtgatcctgcatatccaggtatctactcttcatcccagcacatttaaccagctgatgattagtcagttgctgcacgaatggggcgaagaggggttcatggctcacgtcgaccgggtcatcgacttttacagcaatcagaaggacgctatcttagccgctgctgataagtggctgaccgggctcgcagagtggcatgtccctgccgccggaatgttcctgtggattaaagtgaaggggatcaatgatgtcaaggagctcatcgaagagaaggcggtgaagatgggcgttctgatgctccctggcaatgccttctacgtagattcttctgccccttccccatatctgcgggccagcttctcctccgcctcacctgagcaaatggatgtggcattccaggtgctcgctcagctgataaaggagtctctctag

SEQ ID NO: 178808 - DNA, 1278 bp, Artificial Sequence
  Description of Artificial Sequence: Synthetic coding sequence
atgaactacgcccggttcatcaccgccgccagcgccgcccggaacccctcaccaatccggacaatgacagatatcctgagtcgcggccctaaaagcatgatatccctggccgggggcctgccaaatccaaacatgtttcccttcaaaacagccgtgattaccgttgaaaatgggaagactatccagttcggagaggaaatgatgaagagggcgctgcaatactcaccctccgcagggattcccgagttgctctcatggctcaaacagctgcagatcaaattgcataaccccccaaccatccattatccaccatcccaaggccagatggatctgtgtgtgaccagcggcagccagcaggggctgtgcaaggtgttcgagatgatcataaacccaggggataatgtgctgctggatgagcccgcttactccggaacccttcagtctcttcaccccctgggttgtaatatcattaacgtcgccagcgatgagtcaggcatcgtgccagactcacttagggacatactctctaggtggaaacctgaagacgctaaaaacccacagaaaaatacgccgaagttcctgtacacggtcccaaacggtaacaaccctacaggcaattctctgacttcagaacggaagaaggaaatctatgaacttgcaaggaaatatgacttcctcatcatcgaggatgacccttactactttcttcaattcaacaaattccgtgtccccacattcctgagtatggacgtagatgggagagtgattcgggccgattctttctctaagatcatcagcagcggcctaagaattggttttctgaccggccccaaacccctaatcgaacgggtaatactgcacattcaggtttcaacgctccatcccagcaccttcaatcagctgatgatttcacagctcctgcatgaatggggcgaagaagggttcatggcgcacgtggacagagtgatcgacttctactctaaccagaaagacgccatattagcagccgccgacaagtggttaaccgggctggccgagtggcacgtgccagccgcgggcatgttcttatggataaaggttaagggaattaatgacgtaaaggagctgatcgaagagaaggctgtcaagatgggtgttctgatgcttccagggaacgcattttatgtcgatagcagcgccccttctccttacctgagggcatcgtttagtagcgcgagtccagaacagatggacgttgcgttccaggttcttgcacagctgatcaaagaatccttatag

SEQ ID NO: 178809 - DNA, 543 bp, Artificial Sequence
  Description of Artificial Sequence: Synthetic coding sequence
atgaactacgcccggttcatcaccgccgccagcgccgcccggaaccccagcccaattcgcactatgaccgacatcctcagtcggggtccgaagagcatgatcagcctagctgggggcctcccaaaccctaatatgtttccgttcaaaaccgccgtaataactgtggagaacggaaaaactatccagtttggggaggagatgatgaaaagggcccttcaatatagtccaagcgcaggcattcctgagctactctcctggctcaaacaactgcagattaaactccacaacccccccaccatccattacccaccttcccaggggcagatggacctctgtgtgacaagtgggagccagcagggcctctgtaaggtgttcgagatgatcataaacccgggggataacgtgcttctcgatgaacctgcttactctggcactctccagtctttacaccctctagggtgtaacatcattaatgttgctagcgatgagagtggcatcgtgccagattcccttagagacatactttcaaggtggaaaccctag

SEQ ID NO: 178810 - DNA, 630 bp, Artificial Sequence
  Description of Artificial Sequence: Synthetic coding sequence
atgaactacgcccggttcatcaccgccgccagcgccgcccggaaccctagcccgattaggacgatgaccgatattctatctagggggcccaagtcgatgataagtctcgcagggggacttcctaacccgaacatgttcccgtttaaaaccgctgtgatcaccgttgagaatggaaagaccatccagttcggtgaggagatgatgaaacgggctctgcaatactctccatccgccggtatcccagagctcctgtcatggctgaagcagcttcagatcaaactgcacaacccacccacaatccattatccaccttctcagggtcaaatggatctctgcgtcacttcagggagtcagcaaggtctctgcaaagtctttgaaatgatcatcaaccccggcgataacgttctgcttgatgaacctgcctattccggtacgttacagtctctccatccactgggatgtaatatcatcaacgtggccagtgatgagagcggaatcgtgcccgattccctccgcgacattctcagtagatggaagccggaggatgccaaaaatccacagaagaacactcctaaattcctctacacagtgccaaacggaaacaacccgacgggcaatagcctgacctag

SEQ ID NO: 178811 - DNA, 1290 bp, Artificial Sequence
  Description of Artificial Sequence: Synthetic coding sequence
atgaactacgcccggttcatcaccgccgccagcgccgcccggaacccctcacccatcagaacgatgtccgagaagcgcgcagatatcttgagccgaggccccaagtccatgatcagccttgccggtggcctacccaatccaaacatgttcccctttaagactgcagtgatcacagtggaaaacggcaaaaccattcagttcggagaagagatgatgaagcgtgcccttcagtactctccatccgcaggcatccctgagctactttcatggctgaagcagctgcaaatcaagttgcacaatccacctaccatccactaccccccctcccagggccaaatggacctatgtgttacctccggctcacagcaggggctttgcaaagtttttgagatgatcatcaatcctggcgacaatgtccttctggacgagcctgcatactccgggactctccagtcactgcaccccctgggatgtaacattataaacgtcgcgagtgatgaaagcggcattgtacctgatagccttcgagatatactgtcacgttggaaaccagaagatgctaaaaacccgcagaagaatactccaaaatttctatatacagttccgaatggcaacaaccctaccgggaactctcttacatccgaaaggaaaaaagaaatctacgagctcgctcggaagtatgacttcctgatcatcgaggacgatccgtactacttccttcagttcaacaaatttcgagtgccaacttttcttagcatggatgtggacggaagggtcatacgggccgactctttcagcaagattatttcttctggtctgagaatagggttccttacgggccctaaaccactgattgaaagggtgatcctgcatattcaggtgtcaaccctgcatccctcgaccttcaaccagctgatgattagtcagctgctgcacgagtggggcgaggaaggcttcatggcacatgtcgatcgtgtgattgacttttacagtaatcaaaaggatgctatactggcagccgcagacaagtggttaactggtctggctgagtggcatgtaccagcagctggcatgtttctatggattaaagttaagggtataaatgatgtaaaggaactgattgaggaaaaagccgttaagatgggtgtgctaatgcttcctgggaatgctttctatgtcgattcctccgctccatcgccatacctgcgggcctcattttcaagtgcttccccagagcaaatggacgtcgctttccaggtgctggcccagctcataaaggaatctttatag

SEQ ID NO: 178812 - DNA, 1278 bp, Artificial Sequence
  Description of Artificial Sequence: Synthetic coding sequence
atgaactacgcccggttcatcaccgccgccagcgccgcccggaacccctctcccattcggacaatgacagacattctatccaggggacctaaatccatgattagtcttgcagggggcctgccaaatcctaacatgttcccctttaagacggctgttatcacagtggagaacggcaagactatccagtttggggaagaaatgatgaagcgcgctctgcaatattcaccctcagcagggatccccgagttactgagttggctgaagcagctacagatcaaactacataacccacccaccatccactatccaccaagccaggggcagatggatttatgcgtgacctccggcagtcagcagggcctgtgtaaagtgtttgaaatgatcataaatcccggagataatgtgcttctggatgagcctgcttattccggcactctccaatccttgcaccctctgggctgcaatatcattaacgtcgcaagtgacgaatcaggaattgttcctgactctttgcgggacatcctgtctcgttggaaaccggaagacgccaaaaaccctcagaaaaacacaccgaagttcctttatacagtccccaacggcaacaacccaactggtaactccctcacctcggaacgtaagaaggagatttatgagcttgctagaaaatatgattttctgattatcgaagatgatccttactacttcctccagttcaataaattccgagtccccacattcctcagcatggacgtggacgggcgcgtgataagggctgattcattctcaaagatcattagtagtgggctcaggataggctttctcaccgggcctaaaccactcatcgagagggtgattctgcatattcaggtgtccacactgcatcctagcacctttaaccagctaatgatctcccagctgctacatgagtggggcgaagagggctttatggcccatgtggaccgtgttatcgacttctacagcaaccagaaggatgcgattcttgccgccgccgacaaatggctgacggggctcgcagaatggcacgtcccagctgccggcatgtttctgtggatcaaggttaaaggcatcaacgacgtgaaggaactgattgaagaaaaagcggttaaaatgggcgtgttgatgcttcccggtaatgcattctacgtagacagcagtgccccatccccctacttgcgcgcatctttttctagtgcctctcccgagcagatggatgttgcattccaggtgctggctcaactgatcaaagaaagtttatag

SEQ ID NO: 178813 - DNA, 621 bp, Artificial Sequence
  Description of Artificial Sequence: Synthetic coding sequence
atggcccccagccacctgagcgtgcgggagatgcgggaggacgagaagccactggtgctggagatgttgaaggcaggagttaaagataccgaaaacagagttgccctgcatgcactcacccgcccaccagcactcctcctcctggccgccgccagcagcggacttcgcttcgtgttagcatctttcgccctggccctgttactgcctgtgtttctcgctgttgcggctgtgaaactcggcttgcgcgcaagatggggctcgcttcctccacccgggggtctgggaggcccctgggtcgctgtgaggggctcaggagacgtttgtggggtcctggccctggccccgggtaccaacgcgggtgatggagcccgggtgacgcgtctgtcggtgagtcggtggcacaggaggcgaggcgtgggcaggaggctgctcgccttcgctgaagcccgggcccgcgcttgggcaggtgggatgggtgaacccagggcccgactggtcgtgcccgtggccgtcgccgcctggggcgtcggaggcatgctagaaggctgtggctatcaggccgaaggcgggtggggatgtctcggatatacgctagtgcgagagttttctaaggacctttag

SEQ ID NO: 178814 - DNA, 1842 bp, Artificial Sequence
  Description of Artificial Sequence: Synthetic coding sequence
atggtgagcaaggacgccagcgtgaaggagtacatcttcaaggagttgcaaaaatacctgcccagccacgctgttccggacgaattagtgctgatcgactccctgccatttacatctcatgggaagattgacgtgagcgagctaaataagatttatctcaactatataaacttaaagagtgaaaacaaattaagtggcaaggaggacctgtgggagaaactgcagtacttgtggaaaagcacattgaatctaccagaggacctgcttcgggtccccgatgaatctcttttcctcaactccggcggagacagtcttaaatctataagattattgagcgagatcgagaagttggtgggaacgtctgtgcctggactcctggaaattatcctgagcagctcaatcctcgagatctacaatcatattctccagaccgtggttccagatgaggacgtaacattccgaaagagttgcgctactaagaggaagctttcggacatcaaccaggaagaggcaagcggtacatcgctccatcaaaaagcaattatgactttcacgtgtcacaatgagataaatgccttcgtggtgctgagcagaggcagtcagattttgagcctcaacagcacaagatttctgacaaaactcgggcactgctcgtctgcgtgccctagcgactccgtttcacaaactaacattcagaacttgaaaggcctcaattccccagtcctgataggcaagagcaaagatcccagttgtgtggcgaaggtttcagaggagggcaagcctgctataggtacccagaagatggaattacacgttagatggagatccgacaccggtaaatgcgttgatgcctcaccactggttgtgattccaaccttcgacaagtcctccacgacagtgtatattggtagccactcacatcgtatgaaggcggtggatttttactctggtaaggtgaagtgggagcagattctaggagaccgcattgaaagctctgcctgcgtgagtaaatgcggaaatttcatagtggtaggctgctacaatgggctggtgtacgtgctgaaatcaaacagtggagagaagtactggatgtttacaaccgaagacgccgttaaaagcagtgctaccatggatcctaccacaggactcatttacatcggtagccacgatcagcacgcttacgcactggacatctaccgcaagaagtgtgtatggaaaagtaagtgcggtggtactgtcttttcatccccttgcctgaacctgatcccccatcatctatatttcgccacactgggcggcctgctcctcgccgtcaatcctgcgaccggcaatgtgatatggaagcactcttgtgggaaaccactgtttagctcaccacagtgctgctcacaatacatttgcattggttgtgtggacggtaatctcttatgttttacacactttggcgagcaggtttggcagttctctacctcggggcccattttctcgagcccctgtacctcaccctcggaacagaagatcttcttcgggagtcacgattgttttatttactgttgtaacatgaaggggcatctccagtggaagttcgagacaaccagtcgcgtttatgccacgccatttgcctttcataattacaacggatcaaacgagatgctcttagcagctgctagcactgatgggaaggtgtggattcttgagagtcagtccggccagctacaatccgtttacgaacttcctggggaggtttttagcagcccagtggtactagagagcatgctgatcatcggatgtcgagacaattacgtttactgtttagaccttctcggaggcaatcaaaaatag

SEQ ID NO: 178815 - DNA, 2574 bp, Artificial Sequence
  Description of Artificial Sequence: Synthetic coding sequence
atgaccctgcaggagctggtgcacaaggccgccagctgctacatggatcgcgttgccgtgtgctttgacgaatgtaacaatcaactgcctgtgtactacacgtacaagactgtggtcaacgctgcctccgaattgtccaacttcctcctgctgcactgcgacttccaagggatccgggagatagggttatactgccagcccggcatagacctgccaagctggatcctggggattctgcaggtacctgcagcctacgtgccgatcgaacctgactcaccccctagtctttctacacacttcatgaagaagtgcaatctgaaatatattcttgtggagaaaaaacagattaataaattcaagagcttccatgaaacattgttgaattacgatacctttacagtggaacataacgatctggtgctcttccgtctccactggaaaaacactgaggtgaacctcatgttgaatgatggcaaggaaaaatacgagaaggagaaaattaaaagcatcagctctgagcacgtgaatgaggaaaaggccgaagagcatatggatctgcggttgaagcattgtctcgcctatgtgttgcacacctcagggacgacgggtattcctaaaatcgtccgggttccccataagtgcattgtaccaaacatccaacactttagagtgctctttgacataactcaagaagacgtcctatttttggcatccccattaaccttcgatccctctgtggtcgagatcttcctggcattgtccagtggggcttccttactgatcgtcccgacgtcagttaagcttcttcctagtaaactggcatccgtgttattcagccatcaccgcgtgacagtccttcaggccacccccacactgctgcgtaggtttgggtcccagctaatcaaatcaactgtattgagcgccacaacttccctccgggtcctggcactcgggggcgaagcatttccatcactgaccgttctccgctcatggaggggagaagggaacaagacacagatatttaacgtgtatggtatcaccgaagtgagcagctgggccaccatctataggatccctgagaagaccctgaacagcaccctgaagtgtgagctgcctgtgcagttgggcttcccgttgcttggtaccgtcgtggaggtgcgcgacacaaacggttttactattcaggagggttctggccaggtatttctggggggacgaaatcgggtctgtttcctggacgatgaggtgacggtgccccttggtactatgcgtgccactggggatttcgtcacggttaaagatggagagatcttctttctgggtaggaaggactcacagataaaaaggcacgggaaacgactgaacatcgaactggtgcagcaagttgccgaagagttgcagcaggttgagtcatgtgccgtaacatggtacaatcaggagaagcttattctttttatggtgtccaaggatgcctcggtgaaggaatacatctttaaggaactccaaaagtacctcccttcacacgctgtgcccgatgaactggtgttgatcgactcactgccattcacttcccacggaaagatcgacgtgtcagaactgaacaagatctacctgaactatattaatctgaaatctgaaaacaagctctctggaaaggaggacttatgggagaagctgcagtacctatggaagagcaccctgaacttgcctgaggacctgctcagggtgcctgacgagtctctattcctgaattctggtggggactccctgaaatccattcgattactctcagaaattgagaagctagtcggaacatctgtgcctggactcttggagatcattttaagctccagcatattagagatttataaccacattcttcagaccgtggtccccgatgaggacgtgacgttcagaaagtcctgcgcaacgaagagaaaactctctgacatcaaccaggaggaagcatctggcacatcactacatcaaaaagctatcatgacattcacatgccacaatgaaattaatgccttcgtcgtactgagtcgtggctcacaaatcctgtccttgaactctacccgttttttaacaaagttaggccactgttctagcgcgtgtccctcagactcagtctcccagacaaacattcagaatctgaaggggcttaacagccctgtactcatcggcaagtccaaggacccatcttgtgttgcaaaggtttctgaggaaggcaagccagccattgggactcagaagatggagttgcacgtccgatggcgcagcgacacagggaagtgcgttgatgcctcccctctggtcgtgataccaacttttgacaaatcatctaccaccgtctacatcggctctcacagccataggatgaaggctgtggacttttattctggcaaggttaaatgggagcaaatattaggcgaccggatagagtccagtgcctgtgtgtcaaagtgtggcaactttatcgtggtcggcctggcggtcctgtaccagtggacgaaccttttcatccctgtatatctcactatcagagccaagaatattttctggtttccttag

SEQ ID NO: 178816 - DNA, 2526 bp, Artificial Sequence
  Description of Artificial Sequence: Synthetic coding sequence
atgaccctgcaggagctggtgcacaaggccgccagctgctacatggacagggtggctgtgtgtttcgacgagtgcaataaccagctgccggtgtattatacttacaagaccgtcgttaacgctgcaagcgaactatctaatttcttgctcttacattgtgactttcaaggtatccgtgaaatcggactatactgccagcccggtatcgacttaccaagctggatccttggtatcctccaagttccagcggcttatgtgcctattgaacccgattcacctcctagtcttagtacccattttatgaaaaaatgtaacctgaaatacatattggttgaaaaaaaacagatcaacaagttcaagtctttccacgagaccctgttaaactatgatacttttactgtggaacacaatgatcttgtgttgtttcgcctgcactggaagaataccgaggtgaaccttatgttgaatgatggtaaggaaaaatacgagaaagaaaagataaaatccattagctcagagcacgtgaacgaagaaaaagccgaagagcatatggatctacgattaaaacattgcctggcctacgtgctgcacactagcggaacgaccggcattcccaaaattgtccgggtgccacataagtgcatcgtcccgaacatccagcatttcagggttctgttcgacattacccaagaggatgtattattcctcgcatcaccactgacctttgacccttccgttgtcgagatttttttggcgctttcatccggcgcctcactcttgatcgtacccaccagcgtcaaactacttccctccaaattagcatcagtgctgtttagtcaccacagagttactgttttacaagccaccccgacattgctcaggcgttttggatcacaattgattaaaagtactgtgctgagcgccacaacgagcttgcgggtccttgcactgggaggggaagccttcccaagcctgactgtgttgaggtcgtggcggggggaggggaacaaaactcaaatctttaatgtctatgggatcactgaggtctcatcctgggccaccatctatagaatacccgaaaagaccctaaactcaactctcaaatgtgaactaccggtgcagttgggctttccattgctgggcaccgtcgtcgaggttcgcgatactaacgggtttaccatccaggaggggtcaggacaagtgttcctcggcggacgcaacagggtttgtttcctggacgatgaggtgacggtgccactgggaactatgcgtgctactggcgattttgtgacagttaaggatggagagatcttctttcttgggcggaaagattcccagattaagcgccacggtaagcgcctcaacatcgagctggtgcagcaagtcgcagaagaactgcaacaagtggagtcgtgtgctgtcacatggtataatcaagagaagctgatcctgttcatggtttctaaggacgcctctgtcaaggagtatatttttaaagagctgcagaaatacctgccttcccacgctgtgcccgacgagctggttctgatcgacagcctgcccttcacgagccacggaaaaattgacgtcagcgaactgaacaagatttacttaaactatatcaacctgaagtcagagaataaattgtctggaaaggaagacctctgggaaaagctgcaatatctgtggaagagcaccctgaatctccccgaagacctacttcgagtgcccgatgagagcctctttctcaatagtggaggtgacagcttgaagtccatccggctgttgagtgagatcgagaagctggtggggactagcgtgcctggtctccttgagattatcctttcaagttcgatcctggaaatctataaccacatcttgcagacagtggtgcccgatgaagacgtgacgttccggaagtcatgtgcgaccaagcgaaagctgagtgacatcaatcaggaagaagcttccgggacctcactccaccagaaagcaataatgacattcacttgccataacgagatcaacgccttcgttgtcctgagccgggggtcacagattctctccctcaacagtacccggtttctgactaagttaggccattgttcctctgcctgtccgagcgactctgtctcgcagacaaatatccaaaatctgaagggactcaatagcccggtcctaattggcaagagcaaggatccctcatgcgtggcaaaagtgagcgaggaaggcaaacccgctattggtacccagaaaatggaacttcatgtgcggtggagatcagataccggaaagtgcgttgatgcaagcccattggtggttatccccacgtttgataaatcctccaccaccgtgtatataggaagccatagccaccgaatgaaagctgttgatttttatagcggcaaagtcaagtgggaacagattttgggagatcgcatagaatcaagcgcatgcgtctctaagtgcggtaactttattgtggtgggtaaatttttaaatctaaggtttgtcgaactgaactag

SEQ ID NO: 178817 - DNA, 2997 bp, Artificial Sequence
  Description of Artificial Sequence: Synthetic coding sequence
atgaagaagtgcaacctgaagtacatcctggtggagaagaagcagataaataagttcaagagtttccatgaaaccttactgaattacgacacttttactgtagagcacaacgatctggtgctgttccggttgcactggaaaaatactgaggtcaatctcatgttaaatgatggcaaagagaagtacgagaaagagaaaattaagtcgatttccagcgaacacgtcaacgaagagaaagcggaagaacacatggaccttagactgaagcactgtctcgcttatgttttacataccagcggcaccacagggatcccgaagatagtgagggtgcctcataaatgcatcgtccccaacattcaacactttagggtgctgttcgatattacccaggaagatgtactgtttctggcatcaccccttactttcgatcctagcgtggtggaaatcttcctggcactctcctcaggcgcttctctgctcatcgttcccacatctgttaaactgctgcccagcaagctcgcgtctgtgcttttttctcatcacagggtgacagtgctccaggcaacccctaccctcctgaggcgctttggatcacagcttatcaagtccactgtgcttagtgccactacaagcctgagggtccttgcattaggcggtgaagcttttccctctctgactgtcctcaggtcatggagaggagagggaaacaagacacagatcttcaacgtctatgggataaccgaagtctcttcctgggctaccatctacagaatcccggagaaaacgctgaacagtaccctaaagtgcgaactcccagttcagttagggtttcccctcctagggacagttgtggaggtccgggatacaaacggatttaccattcaagaaggttcagggcaggtcttcctgggtggacgcaacagggtttgctttttggatgacgaagtgactgttcccttggggactatgagggccacaggcgatttcgtcacggtgaaggatggtgagattttctttttgggccgcaaggattcccagataaagcgacatggcaagaggcttaacattgaacttgtgcaacaggtagcagaagagctgcagcaggtcgagagctgcgctgttacttggtataaccaagaaaaacttatactgttcatggtatctaaagacgctagcgtgaaggagtatatattcaaagagttacagaagtatttaccatctcatgccgtgcctgatgaactggtgcttatcgacagcctgccctttaccagccacggaaaaattgacgtcagcgagcttaataagatctacctcaattacattaacttgaaatctgaaaacaagttatccggcaaagaggatttgtgggaaaagcttcagtacctctggaaatccaccctgaacctgccggaagacctcctgcgcgtgccagatgagtcactgtttttgaacagcggaggggattctctgaagagcataaggcttttatctgaaatcgaaaagctggtcggcacaagcgttccggggctgcttgaaatcatactgtcatcttctattctggagatctataaccacattctacagacggtggtacccgacgaggacgtaacttttcgcaaaagctgcgccaccaagagaaagctctccgacataaaccaggaagaggcatctggtacatcactgcatcagaaagcaataatgacatttacctgtcataacgaaatcaacgcgttcgtggtgttgagccgagggtcacaaatcctctcccttaattccacaagatttctgacgaagctaggtcattgcagctccgcctgcccctctgatagtgtgtctcagacaaacattcagaatctaaaggggctgaatagtccagtcctcattggaaagtccaaggacccatcatgtgttgccaaggtctctgaggagggtaaaccagctattgggacccaaaagatggaactgcatgttagatggagatccgacacaggtaagtgtgtagatgcaagcccattagtggtaatcccaacctttgacaagtcctccactacagtttacataggtagccatagccaccggatgaaggccgtggacttctatagcggaaaggtgaagtgggagcagatcctgggggatcggattgaatcctccgcttgcgtgtcaaagtgcggaaattttatcgttgtaggctgttataatggccttgtctacgtgctaaaaagcaacagcggcgaaaagtactggatgttcaccacggaggacgctgtaaagtccagtgcgaccatggatccaacaacggggttgatctacattggcagccatgaccagcacgcatacgcactggacatttacagaaaaaagtgcgtgtggaagtctaagtgcggcggaacagtgtttagcagcccttgtcttaacctgatccctcaccatctatatttcgccactctgggaggcctcttgctggcagtaaatcctgccactggcaatgtgatatggaaacatagctgcggaaaaccactgtttagctcgccacagtgctgttcacagtacatttgtataggctgtgtcgatggtaacctcttatgctttacacatttcggagaacaggtttggcagtttagtacatccggaccaattttcagctccccctgtactagtccatccgaacagaagatcttttttggctctcacgactgtttcatttactgctgcaacatgaagggacacctgcagtggaagtttgagactacatcaagggtatatgctacgccgtttgcattccataattacaatggctccaacgagatgcttctggccgctgcgagcacggatggaaaggtgtggatacttgagagccagtccggtcagctccagtcagtctacgaacttcccggagaggtgttctcatcccctgtggtgctggagtccatgctcatcattggatgtagagacaattacgtgtattgtttggatctcctggggggcaaccagaagtag

SEQ ID NO: 178818 - DNA, 2781 bp, Artificial Sequence
  Description of Artificial Sequence: Synthetic coding sequence
atgctgcaggtgcaccggaccggcctgggccggctgggcgtgagcttgagcaaggggctccatcacaaggctgtcctggctgtgcgccgggaagatgtaaatgcatgggagagaagggcccctctggcacccaaacatattaaggggatcaccaatttaggatacaaggtcctcatccagccaagtaaccgaagggcaattcatgacaaggattacgtcaaagctgggggcatccttcaggaggatatttccgaggcctgtttaatcctgggagtcaaacggcccccagaagagaagctgatgtctcgcaaaacctatgcctttttctcccacaccatcaaagctcaggaggctaatatggggctcctcgatgagatcctgaagcaggagatccgcctgatagattacgagaagatggttgaccacaggggggtgcgtgttgtggcctttggtcagtgggccggagtcgccggcatgatcaatatcctacacgggatgggccttcgtttgctcgcgttgggccatcatacaccgtttatgcacatcggcatggcccataattaccgaaactcttcccaggccgtgcaggccgttcgggacgccgggtacgaaatttcacttgggctgatgcctaaaagtatcgggccattgaccttcgtatttaccggtactggcaatgtgagcaagggagctcaggccatcttcaatgaactgccttgcgaatacgtggaaccacacgaactgaaggaagtgtctcagaccggcgacctaaggaaggtctacgggacggtcttgagcaggcaccatcatctcgttagaaaaacagacgctgtttacgacccagccgagtatgataagcaccccgaaagatacattagcagatttaacactgacattgccccttataccacctgtctcattaacgggatctactgggagcagaatacaccaagactgttaacccgccaggatgcccagtcactcctggctcccgggaagtttagccctgctggagtcgagggttgcccagccttgccccataaactggtcgccatctgcgacattagcgctgataccggcgggtccatcgagtttatgacagagtgtaccaccatagaacacccattttgcatgtatgatgcagatcagcacataattcacgattcagtggaaggcagtggaatcctgatgtgttcaatcgataacctgcccgcacagctccccattgaagcaactgaatgcttcggagatatgctatacccatatgtggaggagatgattctttccgacgctacacagcctctcgaatcgcagaatttctctcctgtagtaagagacgccgttatcacctcaaatggcacactcccagacaagtataagtacattcaaaccctgcgggaatctcgcgagagagcgcagtctcttagcatgggcaccagacgcaaagttctggtgcttggatccggctatatctccgaacctgttctagaatatttgagcagggacggcaacattgaaataacagttgggtctgatatgaagaaccagatagaacagttagggaagaaatacaacatcaatccagtgagcatggatatttgcaaacaggaagagaaactcgggttcctcgtggccaagcaggacctcgtgataagcctgctcccctatgtccttcatccgctcgtggcgaaggcttgcatcacaaacaaggtcaacatggttactgcatcctatatcactccggctctgaaggagctagaaaagtcagtggaagacgccggcatcacaattatcggtgaactcggcctcgacccaggattggatcacatgctcgctatggagaccattgacaaagccaaggaggtgggggccaccatcgaatcctatatttcatactgcggaggcctgccagcccccgaacatagcaacaatcctctcagatataaattcagttggagcccagtgggcgtcctgatgaacgtgatgcagagcgccacatatcttctcgatggaaaagtggttaatgttgcgggtggtatttcatttctggatgccgtgacctcaatggatttttttccaggattaaatctggaggggtacccaaaccgggatagcacaaagtacgctgagatctatgggatttcttcagcccacacactgctgagggggactctgaggtataaagggtacatgaaagcactgaacgggttcgtgaaattggggctcataaaccgggaagcactgcccgcattccgccccgaggcaaatcctctcacgtggaagcagctcctctgcgaccttgttgggatcagcccatcgtctgagcacgacgtgctgaaagaggctgtgctcaagaaattggggggagataatacacagctggaagccgccgaatggctcgggcttttgggcgatgagcaggtgccccaggctgagagcatcctggatgcacttagcaagcatctagtcatgaagctgagctacgggcccgaggaaaaagatatgatcgttatgagagatagcttcggcatccgacatccatctggccatctcgagcacaagacgatcgacctggtcgcttatggggacatcaacggatttagtgcaatggctaaaactgtcggactgccaacagctatggccgccaagatgctcctggacggcgagatcggagctaaaggacttatgggcccttttagcaaagagatctacggacccatcttagaacggatcaaagcagagggtatcatctatacaacgcagtccacgattaagccctag

SEQ ID NO: 178819 - DNA, 2781 bp, Artificial Sequence
  Description of Artificial Sequence: Synthetic coding sequence
atgctgcaggtgcaccggaccggcctgggccggctgggcgtgagcctaagtaagggactccaccataaggccgttttggctgttaggagggaggacgtgaacgcatgggaaagaagggcacctttggctccaaagcatatcaagggaatcactaatctcggatataaagtactcatacagccatccaatagaagggcaattcacgataaggactatgttaaagccggaggtatccttcaggaagatatctcagaagcgtgcctcatcttgggcgtaaaacgtcccccagaggaaaaactgatgagtagaaaaacatacgcgtttttctctcataccatcaaagcccaggaggccaacatgggcctgctcgatgagatccttaaacaagagatcaggctgattgattacgaaaaaatggtcgatcatcgcggcgtgcgcgttgttgcttttggtcagtgggcaggcgtcgcgggcatgatcaatattttgcacggcatgggtctgaggcttcttgcactgggccaccacacaccctttatgcacattggcatggcacataactatagaaacagctcccaagccgttcaggctgttagagacgccggttacgaaatcagtctggggctcatgcctaaaagcataggccctctgactttcgtgtttactggcacaggcaacgtgtctaagggcgcgcaggctatatttaacgagttgccctgtgagtatgtggaaccgcatgaactcaaggaggtatcacagaccggggatctgcgcaaggtctacggaacagtgctctctcgacatcatcatctcgtgcgcaaaaccgatgccgtgtacgatccagcagagtacgacaagcaccccgaacggtatattagccggttcaacactgatatcgccccttacacaacatgcctcataaatggcatttactgggagcaaaacacacctaggctactgactcgtcaagatgcacagagcctgctcgcgcctgggaaatttagcccggcaggagtagagggatgccccgctctccctcacaaactcgtggccatctgtgatatttccgcggacactgggggatcgatagaattcatgaccgagtgtacaacgatcgagcacccgttttgcatgtacgacgctgatcagcatatcatccacgacagcgtggagggctcaggtatactgatgtgttcaatcgacaacttacccgcccagctgccaattgaagccacagaatgcttcggagacatgctgtatccttacgtggaggaaatgatcttatctgacgcaacacagccgcttgagtcacagaatttttcacctgtggttcgggatgctgtaatcacatcgaacggtacattgcccgataagtacaagtacattcagaccttgcgtgaatcacgagagcgggcccaatcactaagcatgggaacgcgtcggaaggtgctcgtgttggggtcaggctatatctccgaacccgttctggagtacttgagcagagacggcaatattgaaattaccgtgggaagcgacatgaagaatcagatcgagcagctgggaaagaaatacaacatcaacccagtatctatggatatctgcaaacaggaagaaaagctgggattcctggtggctaagcaggacctggtaatctccctgcttccttacgtgctgcatcccctcgtggcaaaggcctgcattactaataaggtgaacatggtgacggcaagttacatcaccccggccctgaaagaattagagaagtccgtggaggatgccgggattacaataatcggagagctgggtttggatcccggactcgaccatatgctcgccatggagacgatagacaaagccaaggaggtgggcgccaccattgagtcttacatttcttactgcggagggctaccagctcccgagcattccaacaatccactccggtacaaattcagctggtctcccgttggggtgttgatgaacgtcatgcagtctgctacttatcttctggatggtaaggtcgtgaacgtagcaggcgggatatcatttctagacgctgttacgagtatggactttttccccgggctgaacctcgaggggtaccctaatcgcgattccaccaagtacgctgaaatttatggtattagctccgcgcatacgctgcttcgcggcactttgcggtacaaaggatacatgaaggccctgaacggctttgtcaaactcggactgattaatcgcgaagcactgcccgctttcaggcccgaagctaaccccctcacctggaaacagctgctgtgcgacctggttggtatctcacccagttccgaacatgacgtgttaaaggaggctgtccttaagaaactgggaggcgacaacacccagttagaggccgctgaatggctgggtttactgggagacgagcaggtgccccaggcagagtcaatacttgatgccctatcaaaacatcttgtaatgaagctcagctacggcccagaagagaaagacatgattgttatgagagatagctttggaatccggcatccttctggccacctggaacacaagacaatcgacctggtggcctacggtgacattaacggatttagtgccatggccaaaacggtagggcttcccaccgctatggcagctaagatgctgctcgacggagagataggcgccaagggcctaatgggcccatttagtaaggagatttacggacccattcttgagcgaatcaaggctgagggcattatttatacgacacaatcaaccatcaaaccctag

SEQ ID NO: 178820 - DNA, 942 bp, Artificial Sequence
  Description of Artificial Sequence: Synthetic coding sequence
atgcagccccagagcgtgctgcacagcggctacttccaccccctgttgagggcctggcagaccgctaccactacactgaacgcctctaatttgatctacccgatatttgtgacctatggggtaaaacgcctcgaagaaatgctgcggcctctagtggaagaaggcctgcgatgcgtgcttatctttggtgtccctagcagggtccccaaggatgagcggggctctgcggcagactccgaggagtcccctgcaattgaggctatacacctattaaggaaaactttccccaacctgctggtggcctgtgacgtgtgcctgtgcccctacactagtcatggtcattgcggacttctgtctgaaaatggggccttcagggctgaggaatcccgccagcggctggctgaagtcgccttggcttatgccaaagcggggtgtcaggtggtggcaccaagcgatatgatggatggacgagttgaagccatcaaggaggcgctgatggcccacggcttgggaaacagagtctccgtgatgtcttattcggccaagttcgccagctgcttctacggaccctttcgcgacgcggccaaaagttctccagcatttggcgaccgccggtgttaccagctccccccaggcgccagggggctggcactgagggcagtggacagggacgtccgcgaaggcgcagatatgctaatggtaaaacccggcatgccttatctagacattgtgagggaagttaaggacaaacacccggacttgcccttggccgtctaccacgttagcggagaatttgccatgctatggcatggagcacaggctggggcgttcgacttaaaagcagcagtgttggaagccatgacagccttcaggcgcgccggagcagatattatcattacttactatacacctcaactcctgcagtggctcaaggaggaatag

SEQ ID NO: 178821 - DNA, 993 bp, Artificial Sequence
  Description of Artificial Sequence: Synthetic coding sequence
atgcagccccagagcgtgctgcacagcggctacttccaccccctgctgagggcctggcagaccgccacaaccaccctgaatgcatcaaacctcatttatcccatcttcgtgaccgacgtccctgatgacatacaacccataacaagcttgccaggagttgcccgatacggggttaagcggctcgaggagatgctgcggcctctggtggaagaggggctgaggtgcgtactgattttcggtgtaccaagtcgcgtacctaaagatgaacgcgggtccgcagccgactctgaggaaagccctgcaatagaggccattcacctgttgagaaaaacattcccgaatctcctggtagcatgcgacgtgtgtctctgtccttatacctcccatgggcactgcggactgttgtccgaaaatggggcctttagagctgaggagtcacgtcagaggctggctgaagttgcattggcgtatgcaaaagctggctgccaggtggtcgcaccttccgacatgatggatggcagggtggaagcgataaaggaggcccttatggcccatggactgggtaatcgtgtctccgtgatgtcctactccgcaaagtttgcatcctgtttttacggacccttcagagacgcagcaaaaagctctcctgcatttggtgacagaaggtgttaccagcttccacctggagcacgaggcctggccctgcgcgccgtggacagggacgtgcgcgagggggctgacatgctgatggttaagcctggaatgccctacctcgacatcgtcagagaagtcaaagataagcaccccgaccttccccttgccgtctaccacgtgtccggggaattcgccatgctttggcacggcgcacaagccggagcatttgacctcaaggccgcagtactagaggcaatgactgccttcaggagagccggagccgatattattatcacttactatacacctcagctactgcaatggttgaaagaagagtag

SEQ ID NO: 178822 - DNA, 45 bp, Artificial Sequence; identical to SEQ ID NO: 72628
  Description of Artificial Sequence: Synthetic coding sequence

SEQ ID NO: 178823 - DNA, 363 bp, Artificial Sequence
  Description of Artificial Sequence: Synthetic coding sequence
atgcccctgtgccccctggcccacgccatgcagccccagagcgtgctccactccggctattttcacccacttctcagagcttggcaaacagcaacaactacactgaacgcctccaatttgatttaccctatctttgtgactgatgtgcctgatgacattcaaccaattacttctttgccaggtgtagccagatacggtgtgaaacgtctagaagagatgctcaggcccctagtggaagaaggtctccgatgtgtactgatcttcggggtcccctcccgagtaccaaaagacgaacggggcagcgccgccgattccgaggagtcgcccgccatagaagccattcatttactcagaaagacgtag

SEQ ID NO: 178824 - DNA, 180 bp, Artificial Sequence
  Description of Artificial Sequence: Synthetic coding sequence
atgcccctgtgccccctggcccacgccatgcagccccagagcgtgctgcattctggctacttccatcctctgctgcgcgcctggcagaccgctaccaccaccttgaacgcttccaatctcatctaccctatttttgttaccgacgtacctgatgatattcaacccataaccagtctctag

SEQ ID NO: 178825 - DNA, 1923 bp, Artificial Sequence
  Description of Artificial Sequence: Synthetic coding sequence
atggagagcgtggtgcggcggtgccccttcctgagccgggtgccccaggcttttctccagaaggctgggaagtctttactgttttatgcacagaattgccccaaaatgatggaagtcggcgccaaaccggcccctagagccctgagcaccgctgcagtgcactaccagcagattaaggagacaccaccagctagcgaaaaggacaagaccgccaaagcgaaggtgcagcaaactcctgacggcagccagcaatcacctgatgggacccaactaccgtcgggccacccgctgcctgcaaccagtcaaggaacagcatcaaaatgtcctttcctcgccgcacagatgaatcaaagggggagctctgtcttttgtaaagcctcactggagctgcaggaagacgtacaagaaatgaacgcagttagaaaggaagtggctgaaacctctgccggcccctctgtggtgtccgtcaagaccgacgggggcgaccctagtggactgctgaagaattttcaagatattatgcagaagcaacggcctgaaagggtttctcacctgctccaagataacttaccaaaaagcgtgtccaccttccagtatgataggtttttcgagaaaaaaattgacgagaagaagaatgatcacacgtaccgagtgtttaagactgtcaaccgacgcgcccatatttttcctatggccgacgattactccgattcattgatcaccaagaaacaggtgtctgtgtggtgttccaacgactatcttggaatgagtcgccacccaagagtttgcggcgccgtgatggacaccctcaaacagcatggggctggtgctggaggaacccgcaatatctccggcacatccaagttccatgtggacctcgaaagagaactcgccgatctgcacggaaaggacgccgcattgctgttcagctcatgtttcgtggccaacgatagtactctattcacactcgctaagatgatgcccggatgtgagatctactcggacagtgggaatcatgctagtatgattcaggggataagaaattctcgggtacctaaatatatctttagacataacgatgtttcgcacttaagagagctattacaacgctctgatccatccgtgcccaagatagttgctttcgaaaccgtacattcaatggacggcgccgtttgtcccctggaagagctgtgtgacgtcgctcatgagttcggggccattacctttgtcgacgaagttcatgccgtgggcctttatggtgcccgcggcggcggcataggtgatagagacggtgtaatgcccaagatggacatcatatcaggcacactgggaaaggccttcggctgtgtgggtggctacatcgcctcgacatcttcattaattgataccgtgcggagctacgctgccggattcattttcaccactagtctacccccaatgcttctggcaggcgctcttgaatctgtgcgcatcctgaagagcgctgaggggagagtcctcaggcgacaacaccaacggaacgtaaagctcatgcgtcaaatgctgatggatgctggcttgccagtggtccactgtccctctcatatcattccggtgcgtgtggcagacgctgcgaagaatactgaagtgtgcgacgaactcatgtctaggcacaacatttacgtgcaggccatcaattaccctactgttcctcgtggtgaggaactcctcaggatcgcccctactccacatcatactcctcagatgatgaattattttctggaaaatctgctggttacttggaaacaagtcggactcgagctcaagccgcatagcagcgcggagtgcaatttttgtcgcagacccctgcatttcgaggtgatgagcgagagagaaaaaagctatttctctggattatcgaaactggtgagtgcacaggcctag

SEQ ID NO: 178826 - DNA, 1923 bp, Artificial Sequence
  Description of Artificial Sequence: Synthetic coding sequence
atggagagcgtggtgcggcggtgccccttcctgagccgggtgccccaggcctttctgcagaaggccggaaaatccctgctcttctacgcacaaaattgcccaaagatgatggaggtcggtgctaaacccgccccccgcgctctaagtaccgctgccgttcattaccagcaaattaaggagactcccccggcttccgaaaaggataaaacagccaaggcgaaggttcagcagacccccgatgggagccaacagtcacctgacggcacacagctaccaagtggacacccactgcctgccaccagccagggaacggcctcgaagtgcccatttttggcggcccagatgaaccagcgcggatcgtcagtgttctgtaaggccagcctggagctacaggaggatgtccaagagatgaacgccgttcggaaggaggtggccgagacctctgctggtccttctgtggtttcagtaaagaccgacggcggcgacccctcgggccttctgaagaatttccaagacattatgcagaaacagcgcccagagagggtcagtcatttgctacaggacaatcttcccaaaagcgtgtcaacatttcagtatgatcgttttttcgagaaaaagattgacgagaagaaaaatgatcacacctaccgagtgtttaagactgtaaacagacgtgcccatatattccctatggccgacgattattcagacagcttgataaccaaaaagcaagtgtcagtctggtgctccaatgactacctgggtatgtccagacacccaagggtctgtggtgctgtgatggatacgctgaaacagcatggggcaggtgccggaggcaccagaaacatctccggcacttctaagttccacgtggatctagaacgcgaactcgcggatcttcacggaaaggacgccgccctgttgttttccagttgctttgtggccaatgattctaccctgtttaccctcgccaagatgatgccaggatgcgaaatttattccgattctggcaatcacgcgagtatgatccaaggtatccggaactcacgcgtgccaaaatatatatttaggcacaacgacgtctctcatttgcgggagctgctgcagcgatctgacccgtcagttccaaagatcgtggccttcgaaacggttcatagcatggacggagctgtgtgcccactcgaggaactgtgtgacgtggctcacgagttcggcgctattacctttgtggatgaggtgcacgccgtcggcttatatggcgcgcgtggcgggggtatcggagacagggacggtgttatgcccaagatggacatcattagcggaactttggggaaggcctttggttgtgtcggagggtacatcgcctccacatccagcttgatcgatacagtgaggtcatatgcagctggattcatctttacaacgagtctgccgccgatgctactggccggcgctttagagtccgttcgaatcctgaaatctgctgaggggagagtgctgcgacggcagcatcagaggaatgtgaagctgatgagacaaatgctgatggatgccggactgcctgtcgttcactgcccgagccacatcataccggtcagggtggccgacgctgccaaaaacacagaggtgtgcgacgagctaatgtccaggcacaacatctacgtacaggccattaactatcctacagtgcccagaggcgaggaactgctgcggatcgctcctaccccgcaccacacaccccagatgatgaactatttcctggaaaatcttctggtgacttggaaacaggtgggactcgagctgaagccccattccagcgctgaatgtaatttctgccggagacccctgcacttcgaagtgatgtctgaacgcgagaagtcttatttttccggtctgagcaagctggtctccgcccaggcctag

SEQ ID NO: 178827 - DNA, 345 bp, Artificial Sequence
  Description of Artificial Sequence: Synthetic coding sequence
atggagagcgtggtgcggcggtgccccttcctgagccgggtgccccaggcctttttgcagaaggccggaaaaagtttacttttttatgcccagaactgccccaagatgatggaagtgggcgctaaacccgccccccgggccctgtcaacagctgcggtgcattaccagcagattaaagagacccccccagcttctgaaaaagacaaaaccgcgaaagccaaagtccagcagactcccgacggctcccagcagtcccctgacgggacacagtttaggttggacactccctgtctgccccaggctcgcgccttacaagcaaacgccctctcctggcagcaccgctag

SEQ ID NO: 178828 - DNA, 1923 bp, Artificial Sequence
  Description of Artificial Sequence: Synthetic coding sequence
atggagagcgtggtgcggcggtgccccttcctgagccgggtgccccaagcctttctgcaaaaagccggaaagtcactgctcttctacgcccagaactgccctaaaatgatggaggtgggcgcaaaacccgccccacgggcgttgtcaactgcagccgtccactaccaacagattaaggagaccccaccggctagtgaaaaggataaaacagccaaggctaaggtccagcagaccccagacggatcccagcagtcacccgatgggacccagctcccaagtggacaccctctgccagctacctcacagggaactgccagcaagtgccccttcctcgccgctcagatgaaccagagggggagctccgtgttctgcaaggctagtctggagctgcaggaggatgtccaggaaatgaacgccgttcggaaagaggttgctgagacttctgccgggccgagcgtcgtctccgtgaagaccgacggcggagacccatccggcctgctcaagaattttcaggatatcatgcaaaagcaacgacccgagcgagtgtcacacctgctccaggataatttacccaagtctgtgagcactttccagtatgacaggttttttgagaagaagattgacgagaaaaagaacgaccacacctatagggtttttaagacagtgaacaggcgtgcccacatttttcccatggcggatgactacagcgattctctcattacaaagaaacaggtgagtgtgtggtgcagcaatgactacctgggaatgagtcgccatccgcgtgtgtgcggggccgtgatggacactctgaagcagcacggggccggcgccggagggactaggaacatttcagggaccagtaaattccatgttgacttggagcgagagctcgccgatcttcacggcaaggacgctgcactactgttcagctcatgttttgttgccaatgattccaccttgtttaccctggcgaagatgatgccaggctgtgaaatttattctgacagtggtaatcacgcgagtatgatccaaggaatacggaacagccgggttccaaaatacattttccgccacaatgatgtctcacacctcagggaactgctccagcgcagcgatccatcagtccccaagatcgttgcttttgaaactgttcactccatggacggagccgtgtgcccactggaagaactttgtgacgtagctcacgagtttggagccataaccttcgttgacgaagtccatgctgtcggcctgtatggcgctcgtgggggggggataggtgacagagacggagttatgccaaaaatggacattatttctggaactctgggaaaagcgttcggatgcgtgggaggctacattgcttctactagctctctaatcgatactgtccgtagctatgccgctgggtttattttcaccacttctctgccccccatgctattggcaggcgcccttgaatccgttcggatattgaagtcagctgaggggcgcgtactaagacggcagcatcagagaaatgttaagttaatgcgacagatgctgatggacgccggacttccagtggtgcactgcccaagtcacattataccggttcgggtggccgacgccgccaagaatacagaggtgtgcgacgagctcatgtctagacataacatctatgtgcaggcaatcaactacccaaccgtcccacgtggcgaagaactattgcggattgctcctaccccccaccacaccccgcagatgatgaactattttctggagaacctgctggtgacgtggaaacaagtgggcctggaactgaaacctcatagttctgcggaatgtaatttttgtaggagacccctgcacttcgaagtcatgtccgagcgcgagaaaagttacttctcagggctgtctaaactcgtgtcagcccaggcgtag

SEQ ID NO: 178829 - DNA, 1923 bp, Artificial Sequence
  Description of Artificial Sequence: Synthetic coding sequence
atggagagcgtggtgcggcggtgccccttcctgagccgggtgccccaggcatttctgcagaaggcaggcaagagtctgttattttacgcccagaattgtccaaagatgatggaggttggggccaagccagccccccgggcgctgagcaccgccgccgtgcactaccagcagataaaggaaacgccccccgcttctgaaaaagataagaccgccaaggcaaaggtgcagcagactcccgatgggagtcaacagtcacccgatggaacccagctcccatctggacacccactaccggcaacatcccaaggtacagcatccaagtgcccctttttagctgcgcaaatgaatcagaggggatctagcgttttctgtaaggcttctctcgaacttcaggaagacgtccaagagatgaacgctgttcggaaagaagtcgcagagacttctgccggcccctccgtagtgtccgtgaagacggacggaggagatccctccgggctgctgaagaactttcaggatataatgcagaagcagcgacctgagcgagtgtcacatctgctgcaggacaatctcccaaagtccgtgtctacatttcaatatgaccgcttctttgaaaaaaaaatcgacgagaaaaagaacgatcatacatacagggtcttcaagacggttaaccgcagagcacacatttttccaatggcagatgattactcagattctctcattactaaaaagcaggtaagtgtgtggtgcagtaacgattaccttggcatgtcaagacacccgcgcgtctgtggagctgtgatggatacgctcaagcagcatggagctggcgctggtggtacaagaaatataagcggcacctccaaattccacgttgacctggagcgcgagttggccgatttgcacggaaaggatgctgcattacttttttctagttgtttcgtggcgaacgattccacactctttacattagccaaaatgatgcccgggtgtgagatctactcagattcgggtaatcacgcttccatgatccagggcatccgaaatagcagggtgccgaagtatatctttcggcacaatgatgttagtcatctgcgggagctcctgcaaagaagtgacccttcagtccccaagatcgtggcatttgaaacagtgcacagcatggatggggctgtttgtcccctggaagagttgtgcgatgtcgcccacgaattcggcgctatcacatttgtagatgaggttcacgccgtgggcctctacggcgcacgaggtggcgggattggtgaccgcgacggagtcatgcctaaaatggacatcatctccggaactcttggcaaggcctttggatgcgttggggggtacatcgcctctacttcaagcttgattgacactgtgcggtcatacgccgctggctttatttttacaacctcactgcctccaatgttgttggccggtgcgctggagagcgtgagaatccttaagagcgcagaaggtcgtgttttacggagacagcatcagcggaatgtcaagctgatgagacagatgttgatggatgctggactgcctgtcgtgcattgcccatcgcacatcatacccgtgagggttgccgacgcagcaaaaaatacagaggtgtgcgatgagctgatgagccgccataatatctacgtccaagccattaattacccaacggtgccccgcggcgaagagctgctgcgtatagccccaactccacaccacacccctcagatgatgaattatttcctggagaacctgctggttacctggaaacaggtaggacttgaacttaaacctcactcctccgccgagtgcaacttctgtcgccgcccactgcatttcgaggtaatgtccgagcgagagaagtcatacttttccgggctctccaagcttgtttctgctcaggcttag

SEQ ID NO: 178830 - DNA, 1764 bp, Artificial Sequence
  Description of Artificial Sequence: Synthetic coding sequence
atggtgaccgccgccatgctgctgcagtgctgccccgtgctggcccgcggaccaaccagcctactgggaaaggttgtgaagacacatcagttcttgttcggaatcgggcgctgccctatcctggccacgcagggccccaactgctctcaaatccacctgaaagctacgaaagccggcggggactcaccttcgtgggcaaagggccactgtccatttatgttgtccgaactccaggatggcaagtccaagatcgtccagaaagccgcacccgaagtccaggaggacgtgaaggccttcaagaccgacctgccttcaagcctggtctctgtttccctgaggaaaccattctcaggccctcaggaacaagaacagatttcgggcaaggttactcacctgatccagaacaatatgccaggcaactacgtcttctcctacgaccagttttttcgagacaagatcatggagaaaaagcaggaccatacttatcgcgtcttcaaaaccgttaatcggtgggctgatgcttatccttttgcacagcacttctccgaggctagtgtggccagcaaggatgtgtcagtgtggtgctcaaacgactatctgggtatgagtaggcatccgcaagtacttcaagctacccaggagacactgcagaggcatggagcaggtgccggaggcacacggaacatttctggcactagcaaatttcacgtcgagctcgaacaggaattggccgagctgcatcaaaaagacagcgcgctgctcttttcctcttgcttcgttgctaacgactctacccttttcaccctggccaagattctgcccggctgtgaaatctacagcgacgcggggaatcacgcctcaatgattcaggggatcagaaattctggagcagctaagttcgttttccgtcataacgaccctgaccatctcaaaaagctgctagagaagtcaaatcctaaaatcccaaagattgtagccttcgaaacagtccatagtatggatggcgccatttgccccctggaggaattgtgcgacgtgtcccatcaatacggtgcgctgaccttcgtggacgaggtacacgctgtgggactgtacggatcgcgcggcgcgggtattggagagcgcgacggcatcatgcacaaaatagatattataagtggtacccttggcaaggcgtttggttgtgtcggcgggtacattgcctctaccagagatcttgtggacatggtgcgcagctacgccgcgggattcatctttacgacctctcttcctccgatggttctgtccggcgctctcgagtcagtgagactgctaaagggcgaggagggacaggctctgcgccgcgctcatcaaaggaatgtgaaacatatgcgccagttgctaatggacagaggcctgccggttatcccatgcccatcccatattatccccatcagggtggggaacgccgctctaaattctaaactctgcgacttgctgctgagtaagcatgggatctacgtgcaggccatcaattatcctaccgtacctagaggcgaggaattgctgagactggcaccgtccccccaccactcaccccagatgatggaagactttgtagaaaaattgctgcttgcttggaccgctgtgggtctgccgctgcaagatgtcagcgtggctgcatgcaacttctgtagacgacccgttcactttgagctgatgtccgaatgggagcgctcttactttggcaacatgggcccccagtacgtgactacctacgcgtag

SEQ ID NO: 178831 - DNA, 1653 bp, Artificial Sequence
  Description of Artificial Sequence: Synthetic coding sequence
atggtgaccgccgccatgctgctgcagtgctgccccgtgctggccagaggccccactagcctgctgggaaaggtggtgaagacccatcagttcttatttgggataggaaggtgccctatactggctacacaaggcccaaattgctcacaaatccacctgaaggccacaaaggccggcggcgacagcccaagttgggcaaaaggccactgccccttcatgctgtcagaactgcaggacggcaagtcaaagatcgtgcaaaaggccgcccctgaggtgcaggaggacgtcaaggcttttaagaccgggaactacgtattcagctacgatcagttctttcgcgataagatcatggaaaaaaagcaggatcacacatacagagtgttcaaaaccgtgaatcgatgggcggatgcgtacccttttgcccagcatttttctgaggcaagtgtagcctcaaaagacgtaagtgtttggtgttccaacgactacctggggatgtcgagacacccccaggtactgcaggccacacaggagactctgcagaggcacggcgcaggggcaggaggcacgcgcaatatctccggtacttccaagttccacgtcgagctggaacaggagctggcagaattgcaccaaaaggactctgctcttttgttcagctcctgtttcgtagcaaacgactctacgctgttcacactggccaagatcctaccgggatgcgagatctatagcgacgccggcaatcatgcaagcatgatccagggcatccgtaactccggcgccgccaagttcgttttcagacacaatgatcctgatcacttaaaaaagctcttggagaagtctaaccctaagattcctaagatcgtagcttttgaaacagtacactcaatggatggggccatatgcccactggaggaactgtgcgacgttagccaccaatatggcgccctcacattcgtcgatgaggtgcacgccgtgggactctacggctccagaggggcaggcataggggagagggacggcatcatgcacaagatcgatataataagtgggacgctagggaaggctttcggttgcgtcggggggtacatcgcttctacaagagacttggtcgacatggtcaggagctacgctgccggattcatctttacaacaagtctgccacccatggtgttatctggggctctggaatcggtgaggctcctgaagggcgaagagggtcaggccctaaggcgggcacatcagcgcaacgtcaaacacatgaggcaactgctgatggacagaggactgccagtgatcccctgcccaagccacattatccctattcgcgtcggtaatgccgcgctgaactccaaactctgcgacctgcttttgtctaagcacggtatttatgtgcaggccatcaattacccaactgtacctcggggtgaagagctgctcaggctggccccttcaccacatcactccccacagatgatggaggactttgtggagaagctgctgctggcctggacagccgtgggccttccgttacaggacgtgtctgttgccgcttgcaacttttgtcggagacctgtccactttgaactgatgagtgaatgggaaaggtcctactttggcaatatgggacctcaatatgtcaccacttatgcctag

SEQ ID NO: 178832 - DNA, 1725 bp, Artificial Sequence
  Description of Artificial Sequence: Synthetic coding sequence
atgcggggcggcgaggtggccctgggctggaacaagaagaagcggctgttttgcgaagactttcgatttaagatggttacggctgccatgctccttcagtgctgtcccgtgttggccagaggacctacttcccttctgggcaaagtggttaagacccatcagtttttatttgggataggaaggtgtccgatcttggcaacgcaggggcccaactgttcccaaattcatttgaaagcaaccaaggctgggggagattccccgagttgggccaagggccattgccctttcatgctctcggagctgcaagacgggaagtctaagatcgtacagaaggccgcccccgaagtccaagaggatgttaaggctttcaagaccggcaattacgttttttcatatgaccagttctttagagacaagatcatggaaaagaagcaggaccatacctatcgggtgtttaagaccgtcaaccgctgggcagacgcatatccattcgcccagcacttctctgaagcgtctgttgccagcaaggatgtgtccgtgtggtgctctaacgattacctcggaatgtcccggcatccccaggtgctccaagccacccaggaaactctgcagcggcacggagcaggcgcagggggtacaaggaatatcagcgggacttcgaagttccacgtggagctggaacaggagctggctgagttgcaccagaaggattctgcactgctgtttagctcttgttttgtggcaaatgatagcacactttttaccctcgctaagatcctgccgggctgcgagatttattcagacgcagggaatcacgcatcaatgatacagggtatccggaactctggcgctgcaaaatttgttttcaggcacaacgaccctgatcacctgaaaaagttactggagaaatctaatccgaagatcccaaagatcgtagccttcgagacagtgcactcaatggacggggcaatttgccctttggaggagctgtgcgatgtgagtcaccagtatggcgcacttaccttcgtggacgaagtgcacgccgtgggcttgtatggatcacggggcgctgggataggtgaacgagacggcatcatgcataaaatagatatcatttctggaactcttggcaaagcgttcgggtgcgtggggggctacatagcatccactcgggatttagttgatatggtgcgttcatatgccgctggtttcatctttaccacatccctccctccaatggttctgtccggcgcactggagtctgtgagactgttaaagggggaggaagggcaggcgctgcgacgggcacaccaacggaacgttaaacacatgaggcagctgcttatggataggggcctcccagtaattccatgtcccagccatatcatcccgataagggtggggaatgccgccttaaactccaagctctgcgatctcctgttaagtaaacacggtatctacgttcaggccatcaactacccaaccgtgcctcgtggtgaggagcttttgaggctggcaccgagccctcaccatagccctcaaatgatggaggattttgtggagaaactgctgctggcctggacagccgttggcctgccactccaagacgtctctgtagcagcctgtaacttttgtagacgtcccgtgcattttgagctgatgagtgaatgggagaggagctactttggcaatatgggccctcagtacgttaccacttacgcttag

SEQ ID NO: 178833 - DNA, 669 bp, Artificial Sequence
  Description of Artificial Sequence: Synthetic coding sequence
tgactgagcttcgtgcggccccagtgccgggccaccgacagcccctcttgggcgaagggccactgtccttttatgctcagcgagttacaggatggaaagagcaagatagtgcaaaaggcagctccagaggtgcaagaagacgtcaaggcctttaaaacagacctgccatcatcactcgtatctgtcagcttgcggaaaccgtttagtggccctcaggagcaggaacagataagcgggaaagtaacacacctgatccagaataacatgcctggaaactacgtcttcagttacgaccagttttttcgggataagatcatggagaaaaaacaggaccatacataccgcgtcttcaaaacagtgaaccggtgggccgatgcctacccattcgcccagcacttctccgaggccagcgttgcctctaaagatgtgagtgtgtggtgtagcaacgactatctggggatgagcaggcacccccaggtactgcaggctacccaagaaacactgcagcggcatggcgcgggcgctggcgggacacgaaacatctctgggacctctaagttccacgtcgagttagaacaggagctggccgaactgcaccagaaggattccgccctcctgtttagcagttgtttcgtggcgaatgactcgaccctttttacattggcatag

SEQ ID NO: 178834 - DNA, 1212 bp, Artificial Sequence
  Description of Artificial Sequence: Synthetic coding sequence
atgcagcgggccgtgagcgtggtggcccggctgggcttccggctgcaggcctttcctcccgcactatgccgtcccttgagttgcgcgcaggaggtgctccgcaggacacctctgtacgactttcatctcgctcatggcgggaagatggtagccttcgctggatggagtctgcccgtgcagtatcgcgatagccatactgatagccatctgcacacacggcaacactgtagcctttttgatgtgtcacatatgctacaaacaaagatcctaggcagtgacagagtgaagctgatggaatccctggtcgtcggcgatatcgcagaactgaggccaaatcaggggactttaagtctgtttactaatgaggctggtggaattctggatgaccttatagtgacaaatacctctgagggacacctctacgtggtctcaaatgctggttgttgggagaaagatctggctctaatgcaggataaagtgcgggagctccagaatcagggacgggacgtcgggctcgaagtgctagacaatgcattgctggccctgcaggggcccactgctgcccaggtgctccaagctggcgtcgccgacgatctcaggaaactgccttttatgacttctgctgtcatggaggtctttggagtgtctgggtgtcgagttacccgttgcggctataccggcgaggatggcgtggagatctctgtgccagtcgcgggggcagttcatctggcaaccgccattctgaagaatcctgaggtcaagctcgctggcctggccgcccgggactccttgcgcttagaagctggtctgtgcctgtacgggaatgatatagacgaacacactacgccagtcgagggcagcttgtcttggaccctggggaagaggagacgtgccgcgatggacttcccgggagccaaggtgatcgtcccacaactaaagggacgggtgcagcggcgccgggtggggctcatgtgcgaaggagctcctatgagagcacatagcccgatcctgaacatggaggggaccaaaatcgggacagtgacttccggatgtccaagcccctccctgaagaagaatgtggccatgggttatgtaccatgtgagtattctagaccaggcaccatgctgctggtggaagttaggcgcaaacagcagatggccgttgtgtcaaaaatgccgtttgtgcctacaaactattacacactgaagtag

SEQ ID NO: 178835 - DNA, 1161 bp, Artificial Sequence
  Description of Artificial Sequence: Synthetic coding sequence
atgcagcgggccgtgagcgtggtggcccggctgggcttccggctgcaggcattcccacctgccctctgccggccgctttcctgcgcacaggaagtgctcaggaggacgcctctgtacgattttcatctggcccacggcgggaaaatggtggcattcgcaggctggagtctgccagttcaatacagggacagccacaccgatagccatctacatacacgccagcactgttctctcttcgatgtctctcatatgttgcaaacaaagatcctgggtagcgacagggtcaaactgatggagagccttgttgttggcgacatcgccgagctgcggcctaaccaggggacactgtcactttttacaaacgaggctggcgggatcctggatgacttgattgtgacaaacactagtgaaggacatctgtatgtggtctccaatgctgggtgctgggaaaaggatctcgcactgatgcaagacaaagtaagagaacttcagaaccaggggagagatgtaggcctggaggtgctggacaatgccctcctggctctccaaggtcctaccgccgcccaggtacttcaagctggcgttgcggacgatcttcgcaaactgcccttcatgactagcgctgtgatggaggttttcggggtgagcggctgcagagtaacccgttgtggatataccggcgaggatggcgtggagattagtgtccccgtggccggagctgtgcacctcgccacagcaatcctgaagaaccctgaggttaaactagccggactcgccgcacgtgatagtctccgcctggaagccggcctgtgcttatacggcaacgatatcgatgaacatacaaccccagtggaggggtctctaagttggacactcgggaagagacgtagagctgccatggattttccaggcgccaaagttatcgtgccacagctgaaagggcgggtgcaacgacggcgggtgggccttatgtgtgagggagcccccatgagggctcacagtccgattttgaatatggagggcacaaaaataggtaccgttacctctggctgtcccagtccttctttaaagaagaatgttgctatgggctatgtgccctgtgaatactcccgccccggaactatgctcctagtggaactgccatcaggtccatgcttttag

SEQ ID NO: 178836 - DNA, 1155 bp, Artificial Sequence
  Description of Artificial Sequence: Synthetic coding sequence
tgagccgtgagcgtggtggcccggctgggcttccggctgcaggccttccctcctgcactgtgtcgacctttgagctgcgcccaggaggttttgaggaggactcctctctatgacttccacctcgcacacggtggaaagatggtggctttcgcaggctggtctttgcccgtgcagtatcgagacagccacaccgatagccatctgcatacacggcagcattgcagcttgttcgacgtgagtcacatgttacagactaaaatcctaggttccgatagggttaagctaatggagtccttggtcgtgggcgatatcgccgaactacggcccaaccagggaaccctgtccctattcaccaatgaggcggggggaatcctagacgatctcatcgtgaccaacacatccgagggccacctatacgtggtctcaaacgccggatgctgggaaaaagacttagccctcatgcaagacaaagtgcgcgagctgcagaatcaggggcgggatgtcggcctcgaagtgctggataatgcccttttagccttgcagggtccgaccgccgcccaagtgctccaggccggcgtcgctgatgacttaagaaagctgccgtttatgacaagcgccgtcatggaagtctttggggtgagtggctgcagggtaacaaggtgcggctatactggagaggacggtgttgaaatatcggtgcctgtggctggcgccgttcacttggccaccgctattctgaaaaatccagaggtgaaactggctgggctagccgctagagacagcctgagactggaagctggcttatgtctttacggcaacgacatagacgagcacacaacgccggtcgaaggatccctctcctggacattgggcaagcggcgaagagctgccatggactttcctggtgccaaagtgatagttccgcagttgaaggggcgagtccagcgacgacgggtaggcttgatgtgtgaaggcgcacccatgcgcgcccacagccctatccttaacatggaaggcacaaagataggtactgtgaccagcggttgcccctcaccaagcctaaagaaaaatgtggctatgggttacgtgccttgtgagtactctagacccggaacaatgctcctcgtggagttgccatccggtccatgtttctag

SEQ ID NO: 178837 - DNA, 1080 bp, Artificial Sequence
  Description of Artificial Sequence: Synthetic coding sequence
atgcagcgggccgtgagcgtggtggcccggctgggcttccggctgcaggcctttcccccagcactctgccgacccctgtcttgtgctcaggaggttctgaggcgcactccattgtacgattttcaccttgcgcatggaggcaagatggtggctttcgctggctggagtttgcccgtccagtaccgtgactcccataccgacagccatcttcacaccagacagcactgcagtttattcgacgtgtcgcatatgctgcagaccaagattttggggtccgatagagtgaagctgatggagagtttggtggttggcgacatcgctgagctgaggccaaaccaggacaaggtaagagaactccagaatcagggaagggatgtaggtttggaggttttggataatgctctattagcgctccaggggccgaccgccgcccaggtattacaggccggggtggccgatgatcttcggaagctgcccttcatgactagcgctgtcatggaagtcttcggtgtcagtggctgtagagtcactaggtgtgggtatacaggcgaggacggcgtcgagatctcagtgccagtggcgggcgccgtgcacttggcaactgcgattctgaagaacccagaggtgaaattggctggattggcggcccgcgactctctccggctggaggcaggcctgtgcctctacgggaatgatatcgatgagcacacgacacccgtggagggcagcctgtcatggaccctcgggaaacggcggagagccgccatggattttcctggcgccaaagtgatcgtgcctcagttgaagggacgagtgcaaaggaggcgcgtggggttgatgtgtgaaggcgcaccaatgcgtgcccactctcccattctgaatatggagggaactaagataggcacagtgacatccgggtgtcctagcccctctctgaagaaaaatgtcgctatggggtacgttccttgtgaatacagtaggcctggcaccatgctgctggtagaggtgcgccgcaaacagcagatggctgtcgtttccaaaatgccgttcgtgccaactaattattacacccttaaatag

SEQ ID NO: 178838 - DNA, 1044 bp, Artificial Sequence
  Description of Artificial Sequence: Synthetic coding sequence
atgcagcgggccgtgagcgtggtggcccggctgggcttccggctgcaggctttccccccggctttatgccggccactaagttgtgctcagacaaaaatattagggagcgaccgggtgaagttgatggaatcactcgttgtgggtgacatagctgagctgcgccccaaccagggcaccctgagtctttttacaaatgaagccggaggtattctggacgaccttatcgtgaccaacacgtcagaggggcatctgtatgtcgtaagtaatgccggctgctgggagaaggacctggcccttatgcaggataaggtccgagaactgcagaatcagggaagggacgtgggcttggaagtgctggacaacgctctccttgcgctgcagggccctactgccgcccaagtgctccaggctggagtggccgatgacctccggaaactacccttcatgacatccgcagtaatggaggtcttcggtgtgtctgggtgtcgcgtgacacggtgcggatataccggtgaagatggcgtcgagatcagtgtgcccgtggctggggctgtgcacctcgcaacagctatcttgaagaatcctgaagtgaagctggctgggttggcggctagagacagcctgcggctggaggcaggcctttgcctctatggaaatgatattgacgagcacaccactccggttgagggctccttaagctggaccctgggcaagaggaggcgagcagctatggactttccaggcgccaaagttatcgttccccaactcaaagggcgcgttcagcgcagaagggtaggactcatgtgtgaaggcgcacctatgcgcgcccacagtccaatcctcaatatggaaggaacaaaaatagggacagtaacaagtggttgtccatccccttcactcaaaaagaacgtggctatgggatacgtgccctgtgagtactccaggcctggcaccatgctgcttgtcgaggttaggaggaaacagcaaatggccgtagtgtctaaaatgcccttcgtcccaaccaactactacaccctgaagtag

SEQ ID NO: 178839 - DNA, 921 bp, Artificial Sequence
  Description of Artificial Sequence: Synthetic coding sequence
atggagagcctggtggtgggcgacatcgccgagctgcggcccaaccagggtacactctcactgttcacgaatgaggcaggcggcatcctggacgatctgattgtcacaaataccagtgaaggccacctttacgtcgtgtccaacgcagggtgctgggagaaggatctggccttgatgcaggacaaagtgcgggagctacaaaatcaggggcgagatgttggactggaagtgctggataatgcattgcttgccctccagggacctacagcagcccaggtcctccaggcgggcgtcgccgacgacttacgtaaactcccgttcatgacaagcgcagtcatggaggtcttcggcgttagtggctgtagagtgacgcgttgcggctatacgggtgaggatggcgttgaaatcagcgtccctgtcgccggcgctgtacaccttgccacagcaatactcaaaaacccagaggtcaagcttgcaggcttggcagctcgcgattcactgagactggaggccggcctctgtctctacggcaatgatatagacgagcacaccacaccagtggagggctccctttcttggacactcggaaaaaggcgcagagccgccatggattttcctggcgctaaggttattgttcctcagctcaaaggccgggtgcagaggcggcgcgtggggctcatgtgtgagggcgctccgatgagggcacactccccaatcctgaacatggaaggcactaaaatcgggaccgtgacaagcgggtgtccctctccttccctcaagaagaacgtggccatgggatacgtgccttgtgagtattccaggccaggaacaatgctcctggtggaggttcgacgaaaacagcagatggcagtagtctcaaagatgccctttgtacctacgaactactacaccctaaaatag

SEQ ID NO: 178840 - DNA, 2760 bp, Artificial Sequence
  Description of Artificial Sequence: Synthetic coding sequence
atgtggctggccgccgccgcccccagcctggcccggcggctgctgttcctcggaccacctcccccacctctcctactcttagtcttttcacgaagctcccgtaggcggctccactctttaggactcgctgcaatgcccgagaaacggccattcgaaagactgccggcagatgttagccccatcaactactcactgtgtctgaagccagacctgctcgactttactttcgagggcaagttggaggccgctgcccaagtgcgccaagctactaaccagattgtcatgaattgtgccgatattgatatcattacagcatcctatgctcctgaaggggatgaagaaatccacgctacaggattcaactatcaaaatgaggacgagaaagttactctttcctttcctagcactcttcaaactggcaccggaacccttaagatagactttgtcggcgaacttaacgataagatgaaaggcttttacaggtctaagtataccacaccatccggagaagtgcgctatgccgccgtgacgcagtttgaggccactgatgcccggagagcttttccttgttgggacgaacccgcaatcaaagcgaccttcgatatatctctcgtggtcccaaaagatagggtggccttgtctaacatgaatgtcatagacagaaagccgtacccagacgacgagaatctggtagaggtgaaattcgctcggactcccgtaatgtcaacctacctggtggcatttgtggtgggggagtacgacttcgtcgagactagatctaaggacggagtctgcgtaagggtgtatacccctgtgggcaaagccgaacagggcaaatttgctctcgaggtggccgcaaagaccctgccgttctacaaggactatttcaatgtaccctaccccttgcccaaaatcgacctgatcgcaatcgcagacttcgcagccggcgccatggagaactggggcctggtgacgtatcgcgaaaccgccttgctcattgacccaaaaaacagctgctcgtcctcaaggcaatgggtggctcttgtagtcggccacgaactcgcccaccagtggtttgggaatcttgtcacgatggagtggtggactcatctttggctgaatgaaggatttgccagctggattgaatacctttgcgtcgaccattgtttccctgagtatgacatctggacacaattcgtgagtgccgattacactcgtgctcaagagcttgacgctctggataatagccatccaatcgaagtgtctgtgggccacccatcggaggtagatgagatctttgatgcgattagctacagcaaaggcgcttccgtgatccgcatgttacacgattatatcggagacaaggattttaagaaaggcatgaacatgtacctgacgaagtttcagcagaagaatgcagcaacggaggacttatgggagtctctggagaatgctagtggtaagcctatcgcagcagtgatgaacacctggactaaacagatggggttccccctaatatacgtcgaggctgagcaagtcgaagacgatagactcctgcgcctgtcccaaaaaaaattctgcgcgggtggatcctacgtgggagaggattgcccccaatggatggttcctataacgatttccacatctgaagaccctaaccaagcaaagctcaaaatcctcatggataaacccgaaatgaacgtagtactgaaaaacgtcaagcccgaccagtgggttaaattaaatctcggcacggtcggattttacagaactcagtatagcagtgccatgctggagtctctcctgcccggaattcgagatttaagcctgcctcccgtggaccggctggggctccagaacgacctgttcagtctcgctagagccgggatcattagtactgttgaagtgctcaaggttatggaggcttttgtgaacgagccgaattataccgtgtggtctgacctgagctgcaaccttggaatcttgtcaacactgctgtcacacacggatttctacgaagaaatccaggaattcgtgaaagacgttttctccccaattggggaaagactgggatgggaccctaaacctggcgagggacacttagatgccctgttaaggggcttagtactgggcaagttagggaaggctggccacaaggcaactctggaggaagcgcggaggcgctttaaggatcatgtcgagggcaaacagatactgagcgctgatctcaggtcacccgtgtatctcacggtgcttaaacatggcgatggcactactcttgatattatgctgaagcttcacaaacaggccgatatgcaggaggaaaaaaatcgaatcgaacgtgttctgggcgctaccctgcttccagacctaatacaaaaggtgttaacctttgccttatccgaagaagttcgaccacaggatactgtcagtgtaatcgggggcgtggccggaggttcaaaacacgggcgaaaggcggcctggaagttcattaaagataattgggaagaactgtataaccgttatcagggcggttttttgattagtcgccttataaagctgagcgtggaagggtttgccgttgacaaaatggcaggagaagtgaaagcttttttcgagtcccatcccgccccctccgctgagcgtacaatccaacagtgctgcgagaatatcttgcttaacgccgcctggctcaagagggacgctgaatcaattcatcagtatcttctgcaaagaaaagcgagtccccccaccgtctag

SEQ ID NO: 178841 - DNA, 1884 bp, Artificial Sequence
  Description of Artificial Sequence: Synthetic coding sequence
atgtggctggccgccgccgcccccagcctggcccggcggctgctgtttcttggcccaccgcctcccccattgctgctcctggtgttctcacggagttcacggcgaaggctccactcattgggactggcagatgtttctccgatcaattactcgttatgtctgaaacccgacttgctcgattttacgttcgaggggaagttggaagctgccgcgcaggtacgccaggccaccaaccagatcgtaatgaattgtgccgacattgatatcataactgcctcctacgcgccagaaggcgacgaggagattcacgcgaccggttttaattaccagaatgaggacgagaaggttactttgtccttccctagcaccctgcagacagggaccggtaccctcaagattgatttcgtcggtgaattgaacgacaaaatgaaaggattttacaggtctaaatatacgacacccagtggggaggtccgctatgctgccgtgacacagttcgaggcaacagatgcccgcagggcattcccatgttgggacgaaccagctatcaaagccacgttcgacatttcactagttgttccgaaggatcgggtggcattaagcaatatgaatgtcatagataggaagccctatcctgatgatgagaatttggtggaggtcaaatttgcacggaccccagtgatgtccacttatttggtggcctttgtcgtcggcgagtatgatttcgtggaaacccggtcaaaggatggagtttgtgtcagggtctacactccagtcggtaaggcggagcagggaaagtttgcactggaggttgccgcgaagacgctccctttttacaaggattatttcaacgtcccataccctctcccaaagatagacctgatagctatcgcagacttcgccgccggcgctatggaaaactgggggctggtgacatacagggaaaccgccctcctgatcgatccgaaaaactcttgctccagttcccgacagtgggtggcattggtggtgggtcacgaattggcacatcagtggttcggcaatttagtgaccatggaatggtggactcacctgtggctgaacgagggctttgcgagctggatagagtatttatgtgtggaccattgcttccccgaatatgatatttggacccagtttgtatccgctgattacaccagggcccaggaactagacgctctggacaacagccacccaattgaggttagcgtgggccatccaagcgaggtggatgagattttcgacgctatcagctatagcaagggggctagtgtgatccgcatgttgcatgactacattggggataaagattttaagaaaggaatgaacatgtacctaacaaaattccagcagaagaatgctgctacagaggatctgtgggagtcactagagaacgcttccggcaagcccatagccgctgttatgaacacctggactaagcagatgggctttcccttgatctacgtggaggcggaacaagtggaggatgataggctgctgagactctcgcagaagaagttctgcgcaggcggatcctatgttggcgaggactgtccacaatggatggtgcccattaccatcagtacttccgaagatcctaaccaagccaaactgaagattctcatggataaaccagagatgaatgtggtgctcaagaatgtgaaaccggaccaatgggtcaaactcaacctcgggacagttggcttctatcgtacacaatactccagtgcaatgctggaaagtcttctgcctggcattcgggatctgagccttccccccgttgataggctgggtttgcagaacgacctcttcagtctctttattttatgtgttagagaggtgtctgggaactgctgtcgagcctag

SEQ ID NO: 178842 - DNA, 2520 bp, Artificial Sequence
  Description of Artificial Sequence: Synthetic coding sequence
atgcccgagaagcggcccttcgagcggctgcccgccgacgtgagcccaattaactattctctctgcttgaaacctgatctcctcgacttcacatttgaaggtaaactagaggccgcagctcaggtccgtcaggccaccaatcaaattgtaatgaactgcgctgacatagatattattaccgcatcctatgcaccggagggcgacgaagaaattcatgcaacgggtttcaattaccagaacgaggatgagaaggtgaccctgtcctttcccagcaccctccagaccggtacaggaactctgaaaatcgacttcgtgggcgagctgaacgataaaatgaaaggcttctatcggagcaagtacactactccctctggggaggttcgatatgctgcggtcactcaatttgaaaatgtgatcgatcgcaagccgtacccggatgatgagaaccttgtagaggtgaagttcgctaggacacctgtaatgtctacttatctcgtggctttcgtcgtaggagaatatgatttcgtggagaccaggtctaaggatggagtgtgcgtaagggtctacactccggtgggaaaggcagaacagggcaaatttgccttggaggtggctgccaaaacccttcctttctacaaggattatttcaacgtaccatatccactgcctaagatcgacctgatcgccatcgcggatttcgccgctggggctatggagaattgggggctggttacctatcgagagactgccctgctgatcgatcctaagaatagttgttcctccagcagacaatgggtggccctggttgtgggccatgaactggcccaccaatggttcggaaatctggttaccatggagtggtggacacatctctggctgaatgaagggttcgcaagctggattgaatacctgtgcgtcgaccactgtttccctgagtacgacatttggacccagttcgtgagtgcggactacacaagggctcaggaactagatgcattagataattcacatcctatcgaagtgtccgtgggccacccctccgaggtggacgaaatttttgatgccatctcttacagcaaaggagcgagtgtaatccgcatgctgcacgattacatcggcgataaagactttaagaaaggtatgaatatgtacctgacaaagtttcagcaaaagaacgctgcaaccgaagatttgtgggagtcactggagaatgcttcgggcaagcccattgcagcggttatgaacacttggaccaagcaaatgggcttccccctgatctacgttgaggctgagcaggtggaggacgatcggcttctgagactctcacagaaaaaattctgtgccgggggtagctacgtgggtgaagattgtccgcagtggatggttccgattacgatctccaccagcgaggatcccaaccaggctaaactgaagattctgatggataagccagaaatgaatgtggtgctgaaaaatgtaaagcccgaccaatgggtcaagctgaacctgggcacggtggggttctaccgcacacagtacagcagcgcgatgttggagtcgttgctgcctggaattagggacttgagtctcccacctgtggaccgtcttggcctgcaaaatgatctgttttctcttgccagagctgggattattagcaccgtggaggtgctcaaagtgatggaggccttcgtaaatgagcccaattacaccgtgtggtccgacctgtcttgcaatcttgggattttgtccaccctgctaagccatactgatttctatgaagagatacaggagttcgtgaaggacgtgtttagcccaatcggtgagaggctgggctgggacccgaaacccggagaaggccatctagatgcattactacgcggtctggttctgggcaaactaggaaaggcggggcacaaggccacactggaagaggctcgccgacgattcaaggatcacgtagaaggcaaacagatcctgtccgcggacttgagaagccctgtgtatttgaccgttctgaaacatggagacggcaccacactagatataatgttgaaactgcataagcaggctgatatgcaagaagagaagaacaggattgagagagttctgggcgctacattactgcctgatctcattcagaaggtgctgacttttgccctctctgaggaggtccgcccccaggatacagtatcagtcatcggcggcgtcgccggggggtccaagcatggccgtaaggctgcctggaaatttataaaagacaactgggaagaattgtataacagataccagggaggcttccttatctctcgcctcattaagcttagtgtagagggtttcgccgtagacaagatggctggcgaagtgaaggctttttttgagagtcacccagctcccagcgctgaacgcaccattcaacagtgctgcgaaaatatcctcctaaatgcagcctggctcaagcgagacgctgaatccatccaccagtatcttctccaacggaaagcctccccacccaccgtatag

SEQ ID NO: 178843 - DNA, 1125 bp, Artificial Sequence
  Description of Artificial Sequence: Synthetic coding sequence
atgcggagccccgccgtgcccacccccgcccggggccagctgggcgtcgccttcgttctgctgccaccccatagtgagggggcaagggtcttcggcgccctggggccaatagggccaagtagtccaggtcttaccctggggggcctggcagtgtccgaacaccgtctgagcaacaaactactcgcctggagtggggtgttggagtggcaggaaaagaggaggccctattctgacagtaccgcgaagttaaaacgaacattgccctgccaggcctacgtcaatcaaggtgagaacctcgagactgatcagtggccccaaaagttgatcatgcagctgattcctcagcagctgctgaccaccctcggcccgttgtttcggaacagtcaacttgcacagttccattttaccaaccgtgactgtgattccttgaagggactctgtagaatcatgggcaacgggttcgctgggtgtatgctgtttccacatatttcaccctgcgaggttcgtgtcctgatgctgctttacagctcaaaaaaaaaaatctttatgggtctgatcccatacgatcagtctgggtttgtttccgccataagacaagtcattaccactcgcaagcaggcggtgggccccggcggtgtaaatagcggccccgtgcagatcgttaacaataaattccttgcatggagtggcgtaatggagtggcaagagccacggcctgaacccaatagccggagtaagagatggctgccatctcacgtctatgtgaatcagggagaaatcttgcggactgaacagtggcctagaaagctatacatgcaacttattccgcaacagttactcacgacgctggtgccactcttccggaacagtcgcttggtgcagttccactttactaaggatttggagacattaaagtctctatgccgaattatggataacggctttcgcagaaagagcagcctagcatcaagtcccatgaccagagcaacactgtccaccgctagcggtgtgagcttgccaacaagctcaaggagttgttccgggacgtggagtcgctcaaactccaacgaaggttggggcgggagtggttaccctggcctgggaccttcaaggtcacatagatag

SEQ ID NO: 178844 - DNA, 594 bp, Artificial Sequence
  Description of Artificial Sequence: Synthetic coding sequence
atgatgttcccccagagccggcacagcggcagcagccacctgccccagcaactcaagttcacaacctcggactcctgtgacagaatcaaggacgagttccagcttttacaagcccagtaccacagcctgaaattagaatgtgataaacttgcaagcgaaaaatccgaaatgcaaagacactatgtcatgtactacgagatgagttacgggttgaatatcgaaatgcacaagcaggccgaaatagtcaaaagactgaatgggatctgcgcacaggtgttgccttatctatcacaggagcaccagcagcaggtcctgggcgccatcgagcgagccaaacaggttactgccccagagctaaatagcattataaggcaacaactacaggcacatcagctgagccagctgcaagctcttgccttgcccctgacaccacttccggtaggcctacagccccccagccttcccgctgtaagcgcaggaacaggactgttatctctgtccgccttgggaagccaggcccacttaagtaaggaggataagaatggacatgacggagacacgcatcaagaagacgatggtgagaagagcgattag

SEQ ID NO: 178845 - DNA, 1362 bp, Artificial Sequence
  Description of Artificial Sequence: Synthetic coding sequence
atgggcgtgctgggccgggtgctgctgtggctgcagctgtgcgccctgacccaggccgtcagcaaattgtgggttcccaatacagatttcgatgtagctgcaaactggagccagaaccggactccctgcgccggaggagccgtcgaattccctgccgacaaaatggtgtcagttctcgtgcaggaaggccacgccgtcagcgatatgctattacccctcgatggggaattggtccttgccagtggagcgggtttcggggtaagcgatgttggaagccatctggattgcggtgctggagagcctgcagtgtttcgggatagtgacaggttttcctggcacgaccctcacctatggcgatctggcgatgaggcgccgggcctgttctttgtggacgccgaacgggtaccttgtaggcacgatgacgtcttttttcccccatccgcgtcttttcgagtgggcctggggccgggcgctagcccggtgcgggtgcggagcatctctgccctgggccgtacattcaccagagacgaagacctggccgtgtttctggcgtcaagagccggacggcttaggttccacggccctggagccctctcagttgggcctgaggactgtgctgatcccagcggctgcgtctgcggcaatgccgaggcccaaccctggatttgtgccgctctgcttcagcctctcggcggacgctgtccacaggccgcctgtcacagtgctctgcgtccccaaggacagtgttgtgatctgtgcggggcggttgttcttctcactcatggcccagcgttcgatctggaacgctatcgcgctaggattttagacaccttcttagggctgccccagtaccacggactgcaggttgctgtgtctaaggtaccccgtagttcacggctgagagaagccgacaccgaaattcaagtcgtcctggtggagaatggtcctgagacaggcggagcaggccgcctggcaagggccctgcttgctgatgtcgcagagaatggtgaggccctaggagtcctcgaggcaacgatgcgggaatcgggtgcgcatgtgtggggctcctcagctgcagggcttgctgggggcgtggccgcagccgtgcttttggctttattagtgcttttggtcgctccacctctgctgaggagagcaggacggctccgatggcgcaggcatgaggctgccgccccggccggggcacctttgggcttccgaaatccagttttcgatgtgacagcctccgaggaactgcctctgccacgtcggttaagcctggttcctaaggcagctgcagattcaacatcccacagctatttcgtcaacccactgtttgctggcgctgaggcagaggcctag

SEQ ID NO: 178846 - DNA, 1962 bp, Artificial Sequence
  Description of Artificial Sequence: Synthetic coding sequence
atggccgacatcaagaccggcatcttcgccaagaacgtgcagaagaggctcaaccgggcgcaagaaaaagtgttgcagaagctggggaaagctgacgagacgaaagacgaacaatttgaggaatatgtgcagaatttcaagaggcaagaagccgagggtactagactgcagagggaactccgaggctacctcgcagctattaaagggatgcaggaggcctctatgaagctcaccgagagcctccatgaggtgtacgagcccgactggtacggacgcgaagacgtgaagatggtaggcgagaagtgtgatgtgctctgggaagattttcatcaaaagcttgtggatggctcactcctcacgcttgacacttacctgggtcagttccctgatatcaaaaacagaatcgctaagcggtcccgcaaactagttgactacgacagcgccaggcaccatctggaggccctccaatcctctaaaaggaaggatgaatccagaatttcaaaagctgaagaggaatttcaaaaagctcagaaagttttcgaggagttcaacgttgatttacaagaagagctcccgtctctgtggagtcgaagagtgggcttttatgtaaatacctttaaaaatgtcagctccctcgaggccaaattccacaaggagatcgccgtgctctgtcataagctgtacgaggttatgacgaagctcggagatcagcatgcagataaggccttcacgatccagggggctccatccgatagtggccctttgcgaattgccaagacccctagcccgcccgaggagcccagccctctgcctagtccaacggcgagccctaaccatacgctagccccggcgtcaccagctcctgccaggccgaggtcaccctcccagacacgcaaggggccgccggtgccccccctacccaaggttacacccacaaaagaattgcagcaggagaatatcattagcttcttcgaagataatttcgtgcccgagatctcagtaacgactccttcccagaatgaagtgccagaggtaaagaaagaggagacactgctcgacctggacttcgatcccttcaaacctgaggtaaccccagctggaagtgcaggagtgacacatagtcccatgagtcagactctgccctgggacctttggacaacctcaacagacctcgtgcaacccgcttccggagggtctttcaacggattcacccaaccgcaggacacaagcctatttacaatgcagactgaccagtccatgatctgtaatttaataatccccggagccgacgcagacgctgctgtggggaccctcgtctccgcggctgagggcgcccccggggaggaagccgaggctgagaaggccaccgtgccagcaggcgaaggagtcagcctggaggaagccaagatagggacagaaacgaccgagggcgctgaaagtgcacagccagaagccgaagagctggaggccactgtcccccaggaaaaggtgattccctctgtggtgatcgaaccagcctctaaccatgaagaggagggcgagaacgaaataaccatcggcgcggagcctaaggaaaccactgaagacgccgctccacctggtcccacttccgaaacaccggaactcgctaccgagcaaaaacccattcaggacccccagcctacacctagcgctcctgcgatgggcgcggcagaccagctggcttctgcccgcgaggccagccaagagttaccacctggattcctgtataaggtggaaacactccacgatttcgaggccgcaaattccgatgagttgacactacagcggggcgatgtggtgttggttgttcccagcgattctgaggccgatcaggacgccggctggcttgttggagtgaaagagtccgattggctgcagtacagggatctggctacatacaagggcctgttcccagagaactttacgcggaggctcgattag

SEQ ID NO: 178847 - DNA, 1794 bp, Artificial Sequence
  Description of Artificial Sequence: Synthetic coding sequence
atgaccaagctgggcgaccagcacgccgacaaggccttcaccatccaaggagcacctagcgacagcggacccctaagaatcgctaagacaccctcccccccagaggaaccgtcacccctgcccagcccaactgcctcccccaatcatactttagcccccgcctcccccgcacccgcgcgcccaaggagcccttcgcagacaaggaaaggacctccggtgccgcctctgccaaaggtgacaccaacaaaagaactccaacaagaaaacattattagtttctttgaggacaacttcgtgccagaaatatcagttaccacccccagtcagaatgaggtccctgaagtgaagaaagaagaaactctcctcgatttggacttcgacccttttaagccagaggtcactccggcagggtcagctggcgtgacacactccccaatgtctcagaccctgccatgggatctatggactacacatacttttaacgatgacattactgattcctcagagtcgttaagcctttgtaacctgatcatggaggagactcctgactccggccttgcagaggaaattcagcgttctcagaacgatatcggcgcgtttacctgggggccagacgcctccaccgatagagtgtcccaggaggtcacgagtggtggctttggtgaagattctgcatgtcccagcgaaactgaacaagatattcggctgtcaacaagtctcctttcctcagccgactggccaactgtggccgaagagtcagagcatgccccaggcccggcattcccaggcggtaatgaacagcttccaccgaaacctgccccggaggccggagtggctatagccgcatgtgtcgaaatggagcagctgtacgaccccctcgatagtgacatgcccgccatggacaccgcggggctgtttaaagagagccacgaggatatgaagaagtccgacgaggaggaggaaaagcaaaagatggaggactctctgtgggcaggcgttgaagcatgccagaaggcctccggcggctccttcaatgggtttacacagccacaggacacttctttattcactatgcagacagatcagagcatgatttgtaacctgatcattcccggcgcggatgccgacgctgcagttgggaccctcgtatcagccgcagagggggctccaggagaggaggcagaagcggagaaagctacggtgcccgccggggagggagtttctctggaggaggcgaaaatcggaactgagactacagaaggggctgagtccgctcagccagaagccgaagaacttgaagcaactgtgccccaggaaaaggttatcccttcagtcgtcattgagcctgcttctaaccacgaggaggaaggggagaatgagattacgattggggccgaaccaaaagagaccaccgaagacgctgctcccccgggtcccacttctgagacccccgagctggcgaccgaacagaaacccattcaagatcctcagccaaccccatcagcacccgcaatgggagctgccgaccagctggcatctgcaagagaagcctcccaggaactccctcctggtttcctttacaaggttgagaccctccacgatttcgaagctgccaactcagacgagcttaccctacaaaggggagatgtcgtactggttgttccttcagactctgaagcggatcaggacgcaggctggctggtgggtgtgaaggagagtgactggctgcagtatagagacctggcgacgtacaaaggtctattccctgaaaacttcacaaggagactggactag

SEQ ID NO: 178848 - DNA, 2088 bp, Artificial Sequence
  Description of Artificial Sequence: Synthetic coding sequence
atggccgacatcaagaccggcatcttcgccaagaacgtgcagaagcgtctcaaccgtgcccaggaaaaggtgctgcaaaagctgggaaaagcagacgagaccaaggatgaacagttcgaagaatatgtacagaactttaagcgccaggaggccgaaggcacccggctgcaacgcgagctgcgcgggtacctggctgcgatcaagggaatgcaggaggctagtatgaaactcactgaaagtctgcacgaggtgtacgagccagattggtacgggcgtgaggatgtgaaaatggtaggagaaaagtgtgatgttttgtgggaggacttccaccagaaactggtggacggatctttgctaactctcgacacctatctcggccagttcccagatatcaagaataggattgcaaaacgttccaggaaactggtagactacgactcagccagacaccatctggaggccttgcagtcttccaaaagaaaggacgagtctaggattagcaaggccgaggaggaattccagaaagcacagaaggtgtttgaagaattcaacgtcgacctgcaggaagaattgccctcgctctggtcaagaagagttggtttctatgtcaatacgtttaaaaatgtgtcctcacttgaggccaaattccataaagagattgctgtgctttgccataagctctatgaagtgatgacaaagttgggagaccaacacgccgataaagcctttaccattcagggggccccatccgactccggcccgctccgcattgccaaaaccccttccccacctgaagagccttcaccactccccagcccaactgcctcacctaaccatacgctcgcgcctgcatctccggctcctgctcgccctcgctcgccctcacagacaaggaaagggccccctgtgccaccacttcctaaggttacccctacgaaggaactgcaacaggagaacatcatcagtttttttgaggataatttcgtgcccgagatcagcgtgaccaccccaagccaaaatgaggtacctgaggtgaagaaagaggagaccctgctggacctggatttcgacccattcaagcctgaagttacaccagctgggtcagcgggagtcactcatagccctatgtcccaaacacttccttgggatttgtggacaaccagtactgatttggtacaacctgctagtgggggttcattcaacggttttacccagccgcaggatacttccctgttcacaatgcagaccgaccagtcaatgatctgtaatttggccgaatcggagcaggccccccctacggagccaaaagccgaagagccgttagccgctgtgacaccagcagtgggattggacctcggaatggatacaagggcagaggagccagtcgaggaagctgtaatcatacctggagcagatgctgacgctgctgtaggaacattggtgagcgcagcagagggggcccccggggaagaagccgaagcggagaaagcaactgtgccagccggggaaggcgtctctttggaggaggccaagattggcaccgagaccaccgaaggagctgagtctgcccaacccgaggctgaggagctggaggctaccgtgcctcaggagaaggtgatcccttcagtggtgatcgaaccagcatccaaccatgaagaagaaggcgagaatgaaatcaccattggcgctgagccaaaggagaccacggaggacgccgcccccccaggacctactagcgagacgcctgaactggccactgaacagaagcccatccaagaccctcaaccaacgcccagtgcgcctgctatgggtgctgctgatcaactagcctcagcccgcgaggccagtcaggaactgccaccagggttcctgtacaaagtggagactcttcatgacttcgaggcggcaaatagcgatgaactcacactccaacggggcgacgtagttctggtcgtcccctcagactctgaagccgaccaggatgcaggatggctagtgggcgtcaaagaatcagattggttgcagtacagggaccttgccacgtacaaggggttgtttcccgaaaactttaccagacgccttgactag

SEQ ID NO: 178849 - DNA, 591 bp, Artificial Sequence
  Description of Artificial Sequence: Synthetic coding sequence
atggaggagacccccgacagcggcctggccgaggagatccagcggtctcagaacgacattggtgctttcacctggggccccgatgcctcgacggatcgcgtgagccaggaagtgaccagcggcggatttggagaggattcagcttgtccttctgagactgagcaggatatccgactgagcacgtctctgctgagtagcgccgattggccgaccgtggcggaagagagtgagcatgcgcccggcccggcgttccctggaggtaacgaacagctcccccccaagccagctcccgaggctggagtggcaattgcagcctgcgttgagatggagcaactttacgatcctctggactccgatatgcccgcaatggacaccgctggattgttcaaggagtctcatgaagacatgaaaaaatcagacgaggaggaagagaaacagaagatggaagattcactctgggcgggcgtggaagcctgtcagaaagcaagtggaggttccttcaacggatttacacaacctcaggatacgtcgctgttcactatgcagactgaccagtccatgatatgtaatctggagataaccgtgaactag

SEQ ID NO: 178850 - DNA, 1962 bp, Artificial Sequence
  Description of Artificial Sequence: Synthetic coding sequence
atggccgacatcaagaccggcatcttcgccaagaacgtgcagaagaggttgaaccgggcacaggagaaggtgctccagaaactcggtaaggcggacgagactaaggatgaacagttcgaagaatatgttcagaattttaaaagacaagaggctgaagggacacggctgcaaagggagcttcggggctatttggccgcaattaagggaatgcaagaagcctcgatgaaactaaccgagtctctccatgaagtatatgagcccgattggtacggtagggaagacgtcaaaatggtaggcgagaaatgtgacgtgctgtgggaggactttcatcaaaagctcgtcgacggaagtttgctgactctcgacacctatctgggtcagttccccgatatcaagaacagaatcgccaaaagatctaggaagttagtggattatgattctgctcggcaccacctcgaggccctccagtcctcgaagagaaaagacgagagtcgaatttccaaggccgaagaagaattccaaaaagcccagaaggtctttgaagaatttaatgtggacctgcaggaagagctgccaagtttgtggtccagaagagtcggtttttacgtaaatactttcaaaaacgtgtcctcactggaggcgaagttccataaagagatcgccgtgctgtgccacaagctctacgaggtcatgactaaactgggcgaccagcacgctgataaagcgtttactatccaaggggccccgtctgattccggacctctcaggatcgctaagactccctccccccctgaggagcctagccctcttccaagtcctacagcctctcctaatcacacattggctcctgcttcaccggccccggctcgcccccgctctccctctcagacacgcaaaggaccacccgtgccacccctcccgaaagtgactcctacgaaggagctccaacaggagaatatcattagtttctttgaggataatttcgtgcccgagatcagcgtgacaacaccgtcacagaatgaggttccggaagtcaagaaggaggaaacactgttggacttggattttgacccgttcaaaccagaggtcacgcccgccggtagcgcgggggtgacccacagtccaatgagtcagaccctgccttgggacttgtggacagcgggggtggaagcctgtcagaaagcatccggcggatccttcaacgggtttacacagcctcaggatacgtcccttttcactatgcagacagatcagtcaatgatttgcaacctcattatcccaggcgcagacgcggacgctgccgtgggcactctggtctccgccgctgagggggcccctggggaggaggcagaagctgaaaaggctaccgtccccgctggcgagggtgtgagcctcgaggaagcgaaaatcggcaccgagactactgagggggctgagagcgcacaaccagaggccgaggagctggaagccaccgtgcctcaggagaaggtgatacccagtgtcgtaattgagcccgcctctaatcatgaggaggagggggagaatgagattaccatcggagccgagcccaaggagactaccgaggacgcagcaccaccagggcccacaagcgaaacccccgagcttgctacagaacagaaaccaatccaggacccccagcctacccccagtgccccagccatgggcgccgccgaccaactggccagcgcccgcgaggctagccaggaactgccccctggtttcctctacaaagtggagacactgcacgattttgaagccgccaactcggacgagctgaccttgcagagaggtgatgtggtcctggttgtaccatccgactccgaggccgatcaagacgctggatggctcgtgggggttaaggagagcgattggttgcagtacagagacttggccacctacaaaggtctgtttccagaaaacttcacacgaagactggactag

SEQ ID NO: 178851 - DNA, 1158 bp, Artificial Sequence
  Description of Artificial Sequence: Synthetic coding sequence
atggccgacatcaagaccggcatcttcgccaagaacgtgcagaagagactgaatagagcacaagagaaagtcctccagaaactaggaaaagcagatgagactaaggatgagcagttcgaggaatacgtgcaaaatttcaagcgccaggaagcagagggtaccagactccagagggagctgagaggctatctagccgctattaaagggatgcaagaagcttccatgaagctgacagagagcctccatgaagtgtacgagcccgattggtacggaagggaagacgtgaaaatggtgggggagaagtgcgatgtcctttgggaagacttccaccagaagctggtggatggatcacttttaacacttgacacgtacctgggccagttccccgatatcaaaaatagaatcgcaaagcggtcccgcaaactggtggactacgacagcgcccggcatcacctggaggccttgcagagcagtaaaagaaaggacgaaagcagaatatccaaggcggaagaagagttccaaaaagcacaaaaggtgttcgaggaatttaacgtcgatctccaggaagaattaccttccctgtggtctcgccgcgtcggcttctatgtgaatacgtttaagaacgtgagctctctcgaggcaaaatttcataaggagattgccgtgctttgccacaaactgtacgaggtcatgaccaagcttggagaccagcacgcagacaaggcttttacaattcagggcgcccctagacagtacctcgattccggtcccctgaggatcgctaagacaccctcccccccagaggagcctagccccttgccctctcctacagcttctcctaaccatactttggcacctgcttcgcccgcccccgctaggcctcgttccccctcacagaccagaaagggtcccccagtgcccccgctgcctaaagtgacacccaccaaggagctgcagcaagaaaatataatctcctttttcgaggacaactttgtgcctgaaatttcggtgacaacaccgtcccagaacgaagtacccgaggtcaaaaaagaggagacactgctggacttagactttgacccattcaaaccggaggttaccccagctgggagcgcgggtgttacccatagtccgatgagtcaaactgtggggtggtag

SEQ ID NO: 178852 - DNA, 759 bp, Artificial Sequence
  Description of Artificial Sequence: Synthetic coding sequence
atgcgggcccccctgctgccccccgcccccgtggtgctgagcctgctcatcttgggatcagggcactatgcggcggggttggacctgaacgacacttatagcggtaagcgggaacctttttccggcgatcattctgccgatggctttgaagtgacatctcggtctgaaatgagctccggtagtgagatttcccctgtctccgagatgccaagttcttctgaaccatccagtggagcagattacgattactccgaagagtacgacaacgagcctcaaattcccgggtacattgtggacgactcagtcagagttgagcaggttgtaaagccaccacagaacaagacagagagtgagaatacctccgacaaaccaaaaaggaaaaagaaaggtggcaagaacggaaaaaaccgacggaacagaaagaaaaaaaatccatgcaacgctgagttccaaaacttttgtatccatggcgagtgtaaatacatcgaacatttggaggcagtgacttgtaagtgtcagcaggagtacttcggcgaacgctgtggcgaaaaaagcatgaagacacattccatgatcgattctagcctgtctaaaatcgccttggccgctatcgcagccttcatgtcggcggttatcctgactgcagtcgccgtcataacggtgcagctccgccgacaatacgtccgcaaatatgagggagaggccgaagaacggaagaaactccgtcaggaaaatggcaatgtgcatgctatagcttag

SEQ ID NO: 178853 - DNA, 759 bp, Artificial Sequence
  Description of Artificial Sequence: Synthetic coding sequence
atgcgggcccccctgctgccccccgcccccgtggtgctgagcctgctgatattagggtctggacactacgctgccggcctggacctcaacgatacttacagtggaaagagggagcctttttccggggatcatagcgctgatgggtttgaagtgaccagtcgatccgaaatgtcaagcggctctgagatctcccctgtttccgagatgcccagttctagcgagccaagctccggggcggactacgactacagcgaggagtacgataatgagcctcaaattccaggatacatcgtcgacgactccgtaagggtcgaacaggttgttaagccaccccagaataagactgaaagtgagaacacgtctgataagcccaagcgcaagaagaaaggaggaaagaacggtaagaaccgtcggaatcgtaagaagaagaacccctgtaacgctgaattccagaacttttgtatacacggtgaatgtaagtatattgagcaccttgaagcggtgacttgcaaatgccaacaagagtactttggcgaacgatgcggtgagaaatccatgaaaacccattccatgatcgactcatctctttccaagatcgcccttgcggcaatcgcagcctttatgtccgccgtaatcctgacagcggtagccgtaataacggtgcagctgcgaaggcagtacgtccggaaatacgaaggagaggccgaagagagaaagaagttaagacaagaaaacggaaatgtgcatgctatcgcttag

SEQ ID NO: 178854 - DNA, 1536 bp, Artificial Sequence
  Description of Artificial Sequence: Synthetic coding sequence
atgaagctgttctggctgctgttcaccatcggcttctgctgggcccagtacagttccaacacacaacaggggagaacatccattgtacacttatttgaatggaggtgggtagacatcgcgctcgagtgtgagcgatatctggcacctaaagggtttggaggggtgcaggtatcaccccctaatgaaaatgtggccattcacaatccattccgcccctggtgggagcggtatcagcctgtgtcttacaaactttgcacgagatcgggtaacgaagatgagtttcgcaacatggtcacccgatgcaataatgtgggcgtgcggatatacgttgatgcagtgatcaatcacatgtgtggtaatgcagttagcgcaggaacatcctccacatgcggctcttactttaatcccggatcccgggattttccagcagtcccatacagcggttgggattttaatgatggcaagtgcaaaaccggatctggggacatcgagaattataacgacgctacccaggtaagagactgcaggctgtctgggctcctagaccttgctcttggcaaggactacgtaaggagcaaaatagcggagtacatgaaccacctgatcgatatcggcgtggcgggttttagaattgatgcctctaagcacatgtggcctggtgatatcaaagcgatcctggataagctgcacaatctcaatagcaactggtttccagagggtagtaaaccatttatctatcaggaagtcatagatctgggcggcgaacccatcaaatcttctgattattttggaaacggcagggtgacagaattcaagtacggcgctaaactgggaacggtgataagaaagtggaacggggaaaaaatgagctatttgaagaactggggggaaggctggggtttcatgccttctgatagagctttggtgtttgtggataatcacgataaccagaggggccacggagcgggcggagcttcaatcctgactttctgggacgctcgtctgtacaaaatggccgttggatttatgctggcccacccctacggttttacacgtgtgatgtcctcctaccgatggcctcgttattttgaaaacggaaaagacgtgaatgactgggtcggaccgcccaatgacaatggggtgaccaaggaggttaccattaaccccgacactacctgcggtaacgattgggtgtgcgaacatcggtggcgccaaatccgaaacatggtgaactttcgaaacgtcgtggacggccagccttttaccaattggtacgataacggatccaatcaagtggcctttgggagggggaatagaggctttatcgtattcaacaacgatgattggacgttctccctcacactccagaccggactgcctgctggcacatattgcgatgtcattagtggtgacaagatcaacgggaattgtactggaataaaaatttacgtgtcagacgatggaaaggctcacttctccatctccaactctgctgaggacccctttatcgctatccacgccgaatctaaattatag

SEQ ID NO: 178855 - DNA, 318 bp, Artificial Sequence
  Description of Artificial Sequence: Synthetic coding sequence
atgaagctgttctggctgctgttcaccatcggcttctgctgggcccagtatagtagtaatactcaacaggggcgaacatctatcgtgcatctgtttgagtggagatgggtggacattgcgctggagtgcgagcgataccttgcccctaaaggattcggaggtgtccaggtgagcccacccaatgagaacgtcgctatccacaatcctttcaggccttggtgggagcgctaccagcccgtgtcgtataagctctgcacgcggtcaggcaatgaggacgaatttaggaacatggtaacgcggtgcaataacgtgggatag

SEQ ID NO: 178856 - DNA, 681 bp, Artificial Sequence
  Description of Artificial Sequence: Synthetic coding sequence
atgaagctgttctggctgctgttcaccatcggcttctgctgggcccaatattctagtaacacccagcaaggacgcaccagcatcgtccaccttttcgaatggcgctgggtcgacatagctctggagtgcgaaaggtacctcgctccgaaaggcttcggcggtgttcaggtctcaccccccaatgaaaacgtggccatccataatcccttccgaccgtggtgggaaaggtatcaaccggtttcttataaactgtgtactaggagcggtaacgaggacgaattccgtaacatggtaaccagatgtaacaatgtcggtgtcaggatctacgtggatgctgtcattaatcatatgtgtggaaacgcggtgtccgctggtacatcatctacgtgcggctcttattttaatcctggatccagggatttcccggcagtaccttattcaggttgggacttcaatgatggcaagtgcaagacaggatcaggcgacatagagaattataacgatgccacacaggtgcgagactgccgacttagtggtttattggatctggccttaggcaaagactacgtgagatccaagattgccgagtatatgaatcacttgattgacatcggcgtagcggggttcaggatagatgcatcaaaacacatgtggcctggcgacatcaaggctattctgtag

SEQ ID NO: 178857 - DNA, 1536 bp, Artificial Sequence
  Description of Artificial Sequence: Synthetic coding sequence
atgaagctgttctggctgctgttcaccatcggcttctgctgggcccagtatagcagcaatacccagcagggccggaccagtatcgtacacctgtttgagtggcgctgggtggatatcgcattggagtgtgaacggtatctggcccccaaagggtttggcggagtgcaagtttcccctcctaatgagaatgtcgccatccataatccgtttaggccatggtgggagaggtatcagccggtatcctacaaactgtgtacccggtcaggaaacgaagacgagttccgcaacatggttactcggtgtaacaatgtgggggtgcgaatttatgttgacgcagtgataaatcacatgtgtggtaacgccgtaagtgcaggcacctcatccacctgtggatcttacttcaaccctggctccagggatttccctgccgtcccatacagcggatgggatttcaacgacggaaagtgtaagaccggaagtggcgacattgagaactataacgatgccacgcaggtgagggattgcaggctttccggcctgctagacctggcacttggtaaggactacgtacgtagcaagatcgctgagtatatgaatcacctcattgatatcggggtggccggtttcaggatcgacgcatctaaacacatgtggcccggtgatatcaaggcaattctggacaagctgcacaatctgaactctaattggtttccagaagggtcgaagcccttcatttaccaggaagtgatagatctcgggggtgagccaataaagtcatcagattacttcgggaacggcagggtgaccgaatttaagtacggcgctaaattaggcaccgtgatcaggaaatggaacggagaaaagatgtcttatctgaagaattggggcgagggctggggctttatgcccagcgacagggcccttgtgttcgtggacaaccacgacaatcaacgagggcacggcgctggaggagcgagcatcctcaccttctgggacgcgcgtctgtataaaatggccgtcggatttatgctggcccatccctacggattcactcgcgtgatgtccagttacaggtggccacgatattttgaaaatgggaaggatgtaaacgactgggtcggtcccccaaatgacaacggggtgacaaaagaggtcaccattaatccagatacaacctgcgggaacgactgggtttgcgaacatcggtggcgccagattcgcaacatggtgaatttccgaaatgtggtggacggacagccattcacgaattggtacgacaacggctcaaaccaagttgcctttggcaggggtaatagagggtttatcgtgttcaacaacgatgattggaccttctccctcacattgcaaaccggcctgccggcagggacctattgcgacgtgatctcaggggataaaatcaacgggaactgcactggaatcaaaatttacgtctcagacgatggaaaagctcatttctccataagcaactctgcagaagatccattcatagcaatacacgccgaaagtaaactctag

SEQ ID NO: 178858 - DNA, 1536 bp, Artificial Sequence
  Description of Artificial Sequence: Synthetic coding sequence
atgaagctgttctggctgctgttcaccatcggcttctgctgggcccagtatagctcgaacacacagcagggaaggacttcaattgtgcacctattcgagtggcgctgggttgatatagcgctggagtgtgagcgatacctggcccccaaaggttttggcggcgtgcaggtgtcccctcctaatgagaatgtggccattcacaatccattccgaccgtggtgggagcgataccaacctgtaagttacaagctctgtactagatccggcaatgaagatgagttcagaaacatggtgactaggtgtaataacgtgggtgtccgcatttacgttgacgcagtgataaatcatatgtgtggaaacgcagtttcagcaggcactagctctacctgcggcagttattttaacccaggcagtagggatttccccgctgtgccctattccggatgggatttcaatgacggcaagtgtaagaccggctcgggagacatagaaaattacaatgacgctacccaggtcagggactgccggctgtctgggttgctggatctggcattaggtaaagactatgtgaggagcaaaattgctgagtacatgaatcatctcattgacatcggtgtggcgggcttccggattgatgcatcgaaacatatgtggcctggcgatatcaaggctatcctcgataaactccacaacctgaacagcaactggtttcctgagggctctaagccatttatataccaggaggttatagacttggggggcgaacctataaagagcagcgactacttcgggaacgggcgggtgaccgagttcaagtacggagcaaagcttggcacagtcatcaggaagtggaacggcgagaaaatgagctatctcaagaactggggagagggatggggctttatgccatcagatagagcgctggttttcgttgacaatcatgataaccagcggggccacggtgccggcggtgcctccattctgaccttttgggatgcacggctgtacaagatggccgtcgggtttatgctggcgcacccttacggcttcaccagggtcatgtccagttaccggtggccaagatatttcgaaaacgggaaagacgtgaatgactgggtagggccaccgaatgacaacggcgtgacgaaggaggttactattaatccagacaccacatgcggcaacgactgggtgtgtgaacacaggtggcgtcaaattagaaacatggtgaattttagaaatgtggtcgatggccagcctttcaccaactggtacgataatggctcgaaccaagtggccttcgggagaggtaacaggggatttatcgtctttaacaatgacgactggactttcagcctgaccttgcagacaggtctgcccgccgggacttactgcgacgtgatcagtggggataagataaacggcaattgtaccggaatcaaaatctatgtcagcgacgatggtaaggcccacttctcaatatccaatagtgccgaagacccctttattgctatccacgcggaaagtaaactgtag

SEQ ID NO: 178859 - DNA, 318 bp, Artificial Sequence
  Description of Artificial Sequence: Synthetic coding sequence
atgaagctgttctggctgctgttcaccatcggcttctgctgggcccagtactcatctaatacccagcaggggagaacaagtatcgtgcacctgttcgagtggcggtgggttgacatcgccctggagtgtgaaaggtaccttgcacctaagggctttggaggggtccaggtctcgcccccgaacgagaacgtggccatccataatccgttccgcccctggtgggagcggtatcagcccgtctcttataagctgtgcacacggtcaggaaatgaggacgagttcagaaacatggtcacgcggtgtaataatgttgggtag

SEQ ID NO: 178860 - DNA, 681 bp, Artificial Sequence
  Description of Artificial Sequence: Synthetic coding sequence
atgaagctgttctggctgctgttcaccatcggcttctgctgggcccagtattccagcaatacgcagcagggacgtacctccattgtgcatctatttgaatggcggtgggtcgacattgcgctcgaatgtgaacggtacttagcgcctaagggcttcggcggggtgcaggtctcacccccaaatgaaaatgtggctattcacaaccctttccgaccctggtgggagcgctatcagccggtcagctataagctctgcacgcggtctggaaacgaggacgaattcagaaatatggtcactcgatgtaacaacgttggagtgagaatctacgttgatgcagtgatcaaccacatgtgtggcaacgctgtctctgctggaaccagctccacttgcggctcttattttaacccagggtcacgcgattttccggccgtgccctactctggctgggactttaatgatggcaagtgcaagaccggctcaggagacattgaaaattataatgatgctacacaggtccgagattgtaggctgtcaggactgttagatctggctctcggtaaagattacgttcgcagtaagattgccgagtatatgaatcacctcatcgatataggcgtggcaggctttaggatcgatgcatcgaagcacatgtggcccggagacattaaggcaattctctag

SEQ ID NO: 178861 - DNA, 1536 bp, Artificial Sequence
  Description of Artificial Sequence: Synthetic coding sequence
atgaagctgttctggctgctgttcaccatcggcttctgctgggcccagtatagcagcaacactcagcaaggacgaacatccatcgtgcacttattcgagtggagatgggtcgacatagccttagaatgcgagcggtacctggcaccgaagggcttcggcggcgtgcaggtttcccccccgaatgaaaacgtcgctatccacaacccattccggccttggtgggaaagatatcaaccagtgtcctataagctctgcactaggtctggaaatgaagatgaatttcgtaacatggtgacaagatgtaacaatgtgggcgttagaatttatgtggacgcagtgataaaccacatgtgcggtaatgccgttagtgctgggacctccagcacttgtggctcttactttaatccagggagtagagacttccccgcagtcccgtattccggatgggatttcaacgacgggaagtgtaagaccgggtccggcgatatcgaaaactataacgatgctactcaggtaagagactgccggctatccgggctcctggacctagctttgggaaaagactacgtgaggagcaagatcgctgagtatatgaatcaccttatagacataggggtggccgggtttcgaatcgatgccagcaagcacatgtggcccggcgacataaaggcaattttggataagctgcacaatttaaactctaactggtttcctgaaggttctaaaccattcatctaccaagaggtcattgatctgggaggtgaaccaatcaaatcatccgattatttcggaaacgggcgcgtgacagaattcaagtatggcgctaaactggggaccgtgattaggaagtggaacggggaaaagatgagctacctcaagaactggggagaaggatggggatttatgccatcagaccgcgctttagtgtttgtggataaccatgacaatcagcgtggccacggagccggtggagccagtatactgacattttgggatgcccggctgtataagatggctgtcggctttatgctggctcacccctacggttttactagagtgatgtcaagttataggtggcccagatattttgagaacggtaaggacgtgaacgactgggttggcccccccaacgataatggcgtcacaaaggaggtgaccattaatcctgatactacgtgcgggaatgattgggtgtgtgaacataggtggcgccagatcaggaacatggtcaacttccgcaatgttgtcgacggccagccctttactaactggtatgataacggcagtaaccaggtggctttcggacgggggaataggggcttcatagtgttcaacaacgatgactggacattttctcttaccctccagaccgggctgccagcggggacttattgtgacgttatcagcggagataaaataaatggaaattgcactgggattaaaatatatgtgtccgacgatgggaaagcccattttagcatttccaattcagcagaggaccctttcattgcgattcacgccgagagcaagctgtag

SEQ ID NO: 178862 - DNA, 1536 bp, Artificial Sequence
  Description of Artificial Sequence: Synthetic coding sequence
atgaagttcttcctgctgctgttcaccatcggcttctgctgggcccagtacagccccaacacacagcagggacggaccagcatcgtgcatctttttgaatggcggtgggtggatatcgctcttgaatgtgaacgatacctggccccgaaaggttttggcggggtccaggtgagtccgccgaatgagaatgtagcgatttataatccttttaggccctggtgggagcgctatcagcctgtgtcttacaagctctgcacaaggtctggaaacgaagatgagttccggaacatggtgacaaggtgcaacaacgtgggggtgagaatatacgtggatgcggtcataaaccatatgtgcggtaacgctgttagcgccggtacctcctccacttgtggtagttacttcaaccccggctctcgagattttcccgccgtaccatactccggctgggacttcaatgacggcaagtgtaagacaggatcaggcgatattgagaattacaacgacgcgacacaggtgagagactgtagactcacaggattgctggacctggcccttgagaaggattacgtgagatccaaaatcgccgaatatatgaatcacctgattgatattggtgttgccggcttcagattagatgcttctaagcacatgtggcccggggacatcaaggcaatcctggacaagctacataacctcaatagtaattggttcccagcgggtagcaagccctttatttaccaggaagtgatcgatctgggaggcgagcccattaagtcaagtgattacttcggtaatggaagagtgaccgagttcaagtacggcgccaaactgggtactgttatcaggaagtggaatggcgaaaaaatgtcatacctgaagaactggggcgagggctggggatttgtgccatcagatagagccctggtatttgtggacaaccacgacaaccagaggggacacggagccgggggagcttcgattctgaccttttgggacgcaagactgtacaagatggccgtcggctttatgctggcacacccatacgggttcactagggtcatgtcttcctatcgttggcccaggcaatttcagaatggaaatgatgttaacgactgggttggaccacctaataataacggggtgataaaagaagtaactataaatcctgacacgacatgtggaaacgactgggtgtgtgagcatcggtggcgccagatccgaaacatggtcatttttagaaacgtcgtggatgggcagccttttacgaactggtacgacaatggctcaaaccaggtggctttcggcaggggcaacagaggttttatcgtcttcaataatgatgactggtctttctcgctcaccttgcagaccggtctgccggccggcacgtattgcgatgtgatctcaggtgataagattaacggcaattgcaccggaatcaagatctacgtgtcagatgacggtaaagctcatttctcaataagcaattcagcagaagatcctttcattgcaatccacgcagagtccaagttgtag

SEQ ID NO: 178863 - DNA, 1536 bp, Artificial Sequence
  Description of Artificial Sequence: Synthetic coding sequence
atgaagttcttcctgctgctgttcaccatcggcttctgctgggcccagtattctcccaatacgcagcaaggccgtacctctattgtgcatctgtttgaatggaggtgggtggatatcgctctcgaatgtgaacgctatctcgcccccaagggattcggcggggtacaagtgtcaccccctaacgagaacgtggccattcacaatccattccgaccttggtgggaacgctatcagcctgtgtcctataaattatgtacaaggagtgggaatgaggacgagtttaggaatatggtaactcgatgcaacaacgtcggtgtccgtatttatgtggacgcagtcataaatcatatgagtggtaacgcagtgtctgcaggaacatcaagcacctgcggaagctatttcaaccccggtagcagggactttcccgccgtcccctatagcggatgggacttcaacgatgggaaatgcaaaaccggttcaggagacattgagaactataatgacgccacccaggttcgtgattgtaggctcgtgggtcttctagatctggccctggaaaaagattacgtgcggagcaagattgccgagtatatgaaccatcttatcgatatcggcgtggccgggttcagactggatgctagtaaacatatgtggcccggtgacattaaggccatcctcgacaaattacacaaccttaactcaaactggtttccagcagggtcaaagccgttcatctaccaagaagtgatagacctcggaggcgaacccattaagagctctgactattttggcaacggacgtgtgacagaatttaagtacggtgccaaactgggaactgtgatacggaaatggaatggtgagaagatgagttatctgaaaaactggggcgagggctggggatttatgccatcagatagagccctcgtttttgttgataatcacgataaccagaggggacatggggccggcggggcatctatcttgacattttgggatgcaaggctgtataaaatggccgtgggctttatgttagctcacccctatggcttcacccgggtgatgagctcctacagatggcccaggcagttccagaacggtaacgatgttaacgactgggtcgggccccctaataacaacggagtcatcaaggaagtaacgataaaccccgataccacctgtgggaacgactgggtctgcgagcaccgctggcgccagatccgcaacatggtgaactttagaaacgtggtggatgggcagcctttcaccaactggtacgataatggttcaaatcaggtggctttcggacgggggaatagaggttttattgtgttcaacaacgatgactggaccttttcactgacgctgcagaccgggctgcctgccggtacctactgcgatgtgattagcggcgacaagattaatggcaattgtactgggatcaagatctatgtgtcagacgacggcaaagctcatttttccatctcaaattctgccgaggaccctttcattgctattcacgctgaatccaagctatag

SEQ ID NO: 178864 - DNA, 291 bp, Artificial Sequence
  Description of Artificial Sequence: Synthetic coding sequence
atgaagttcttcctgctgctgttcaccatcggcttctgctgggcccaatacagcccaaacacccaacagggtagaacttctatcgtccatctgttcgaatggagatgggtcgatatcgcccttgaatgcgaaagatatctggcccctaagggatttggaggtgtccaagtgtcacctcccaatgagaatgtcgcaattcacaatccatttcggccttggtgggagcgctaccagccagtgtcttacaagttatgtacgcgctcggggaatgaagatgaatttaggaactag

SEQ ID NO: 178865 - DNA, 261 bp, Artificial Sequence
  Description of Artificial Sequence: Synthetic coding sequence
atgaagttcttcctgctgctgttcaccatcggcttctgctgggcccagtacagccctaacacacagcagggcagaacgtcaatcgtgcacctgtttgaatggcggtgggtagatatcgcactcgaatgtgaaagatacttggcccctaagggcttcggaggagtccaggtgtcacccccaaatgagaacgtcgcaatccataatccttttcgcccttggtgggagcgctatcagcccgtgagttacaaattgtgcacttag

SEQ ID NO: 178866 - DNA, 2313 bp, Artificial Sequence
  Description of Artificial Sequence: Synthetic coding sequence
atgctgcccggcctggccctgctgctgctggccgcctggaccgcccgtgcgcttgaagttcctacagacggtaatgctggtttgctggccgagccccagatagcgatgttctgtggcagactgaatatgcacatgaacgttcaaaacggcaaatgggattccgacccctccgggactaagacgtgcattgatacgaaagaaggcatcctgcagtattgtcaggaggtgtatccagaactacagattacgaatgttgtggaggccaaccagcctgtaactatccaaaactggtgcaagcgaggacgtaagcagtgcaagactcatccacacttcgttattccttaccggtgcctggtgggcgagttcgtgagtgatgcccttttggtacctgacaaatgcaaattcctccatcaggagcgtatggacgtctgtgaaacccacctgcattggcatacagtcgcaaaggaaacctgttccgagaaaagcacgaacttgcatgactatggtatgctactgccctgtggtattgataagttcaggggtgtcgagttcgtgtgttgtcctttggccgaggaatccgataatgtcgattctgctgatgcagaagaggacgacagcgacgtctggtggggtggcgccgatacggactatgcagacgggagtgaggataaggtagtggaggtggcggaggaagaggaagtcgctgaagtggaggaggaagaggcggacgatgatgaagatgatgaagacggtgacgaggtggaagaggaggccgaggagccctacgaggaggcaaccgaaaggactacatccattgccacgactaccacgactacaactgagtctgtggaagaggtggttagagaagtttgctccgagcaggctgaaacgggcccttgcagagccatgattagtcgctggtatttcgatgtaaccgaaggcaaatgcgcacccttcttttacggcggttgcgggggaaatcggaataacttcgatactgaggagtactgcatggctgtgtgtggttctgctatgagccagtccctgcttaagactacacaagagccactggcacgcgaccccgtaaaactacctaccactgcagctagcacacccgatgccgttgacaagtacctcgagacccccggcgacgaaaatgagcacgcgcattttcagaaagccaaagagagacttgaggccaagcatagggagcgcatgtctcaggtgatgcgagaatgggaggaggctgaaagacaggccaaaaatctgcccaaagcagataaaaaagctgtcatacagcactttcaggagaaggtggagtcactggagcaggaggccgcaaatgagcgccagcagttggttgagactcatatggcaagggtggaggccatgctgaacgatcgccgcaggctggctctggaaaattacattactgcgctgcaggcagtgccccctcggccccgacacgtcttcaatatgctgaagaagtatgtaagggcagaacagaaagataggcagcatactttgaagcactttgaacacgtgagaatggtggaccccaaaaaggctgcccaaattaggagccaggtcatgacacacctgcgggtgatttacgagcgaatgaatcagtcgctgagtctgctttataacgtccctgccgtggctgaggaaattcaggacgaagtagacgagctcttgcagaaagagcagaactacagcgacgatgtcttggcaaacatgattagcgagccgcgaatcagctacgggaacgatgcgttgatgccttctctgacagaaacaaagacaaccgtggaacttctgccagtgaatggagagttctctcttgatgatcttcaaccttggcacagttttggagctgacagtgtgccagccaacaccgaaaatgaagtagaacccgttgacgctagacccgccgccgataggggactcaccacaagaccaggcagcggcttgaccaatatcaagacagaagagatttctgaagttaagatggatgctgaattccggcacgacagtgggtacgaggttcaccatcagaagttggtgttctttgcggaggacgtgggcagtaacaaaggcgccatcatcggcctgatggttgggggcgtggtcatagccacagtcatagtcattacccttgtgatgcttaagaaaaagcaatacacgtctatacaccacggagtcgtcgaagtggacgccgcagttactcctgaggagagacatctgagtaaaatgcagcagaatggatatgaaaaccccacttacaaatttttcgaacagatgcagaactag

SEQ ID NO: 178867 - DNA, 2088 bp, Artificial Sequence
  Description of Artificial Sequence: Synthetic coding sequence
atgctgcccggcctggccctgctgctgctggccgcctggaccgcccgcgctctagaggtcccaaccgacggcaatgccggactgctggcggaaccacagatcgccatgttttgtggtagactgaacatgcatatgaatgtgcaaaacggcaaatgggatagcgaccccagcggaacaaagacgtgcatagacaccaaggaggggattcttcaatactgtcaggaggtgtatccagaacttcaaataactaatgttgtggaggctaaccagccagttacaatccagaactggtgcaaaagaggccgcaaacaatgtaaaacccatccccacttcgtgataccctacaggtgtctggtcggagagtttgtgagtgatgccttgctggttcccgacaaatgcaaatttctgcatcaggaacggatggatgtctgcgaaacgcatcttcactggcacactgtggctaaggagacctgctcagaaaagagcactaatctccacgactatggcatgcttttgccatgtggaatcgataaatttaggggagtagagttcgtgtgctgtccgctggccgaagaaagtgacaatgttgactctgccgatgctgaggaggatgattccgatgtatggtgggggggggcagacaccgattatgctgacggctctgaagataaggtggtcgaagttgctgaggaagaggaagtggccgaggtcgaagaagaggaggccgatgacgacgaagatgacgaagacggcgacgaagtcgaggaagaagccgaggagccatacgaagaggctacagagagaactacttcaattgccacaactaccacaacaacgacagagtcagtcgaagaagtggttcgggtaccaaccacagctgcttcaacccctgacgccgttgataaatatttggagacgccaggtgatgagaatgaacacgcgcattttcagaaggctaaggagcggctcgaagccaaacatcgcgaacgcatgagtcaggtcatgagggaatgggaagaggccgaaagacaggccaagaacctgcccaaggcggacaagaaagccgttatccagcattttcaggagaaagtcgagtctcttgagcaggaagccgcgaacgagaggcagcagcttgtggagacgcatatggcacgcgttgaagccatgcttaatgatagacggcgactcgcgctcgagaactatattaccgccctgcaggcagtcccgccgcggccgaggcatgtttttaacatgctgaagaaatacgtgcgagcagaacagaaggatcgtcagcacaccctgaagcattttgagcatgttaggatggtagatcccaaaaaagcagcccagatccggagccaggttatgactcacctcagagttatttatgagcggatgaaccaatccctgtcgctgttatataatgtgcctgcggtcgctgaggagatacaggacgaggtggatgagctgctgcagaaggagcagaattattccgacgacgtgctggctaacatgatcagcgaaccgaggatctcatacggcaatgacgctctgatgccatccttgacagagactaagaccacggtggagttgctgcctgtgaacggagaattcagtctcgacgatctgcaaccctggcatagcttcggagccgactccgtgccagccaacaccgagaacgaggtcgaacctgtggacgccagaccggcagccgatcgagggctcactactaggcctgggtcaggcctgactaacatcaagaccgaggaaatcagtgaggttaagatggatgccgaatttcgacacgatagtggttatgaggtgcaccatcagaagttggtatttttcgctgaagatgtcggctcgaacaaaggcgccattattggtttgatggtgggaggggtcgtgatagccaccgtgatcgtcattactctagtcatgctcaagaaaaagcagtatacttcaatacaccatggagtagtggaagtcgatgccgccgtaacgccagaggaacgacacctttccaagatgcagcagaacgggtacgagaatcccacatacaagttttttgagcagatgcagaactag

SEQ ID NO: 178868 - DNA, 1920 bp, Artificial Sequence
  Description of Artificial Sequence: Synthetic coding sequence
atgctgcccggcctggccctgctgctgctggccgcctggaccgccagagctttagaagtatatcctgagcttcaaattaccaacgtagtagaagccaatcagccagttaccatccagaactggtgcaagcgcggacggaagcagtgtaagacacatcctcactttgtgattccataccggtgcctggtgggagagtttgtgtccgatgcattgctcgttcctgataagtgtaaatttctccaccaagagcggatggatgtttgtgaaacgcacctccactggcacaccgtcgccaaggagacctgtagtgagaaatctacaaatttacacgactacggaatgctcttgccgtgtggaattgacaagtttcgaggagtagaattcgtctgttgccccctcgctgaggaatccgacaacgtggactccgcagatgctgaggaggacgacagcgacgtgtggtgggggggagctgacaccgactacgccgacgggagtgaagacaaggtggtggaggtggctgaggaggaggaagtggccgaagtggaggaagaagaggctgatgatgatgaagacgacgaagacggcgatgaggtcgaggaggaagccgaggaaccctacgaggaggcaacggaacgcaccaccagcatagccactactacaaccaccacaaccgaatccgtggaagaagtggtacgggttccaacaaccgccgcttcaacacctgacgcagtggacaagtacttggagacacccggggacgagaatgaacacgcgcactttcagaaagcaaaggaaagactcgaggctaagcaccgagagcgtatgtctcaggtaatgcgtgagtgggaggaggccgagcgacaagccaagaatcttccgaaggccgacaaaaaagcagtcattcagcatttccaggagaaggtggagtccctggaacaggaggccgctaatgagaggcagcagctggtcgagacacacatggcgagggtggaggccatgctcaacgatcgccgaaggctcgctctggagaactatataactgccctgcaggcagtgccgcccaggccccggcatgtgttcaacatgctcaaaaagtacgtccgagcagagcagaaggaccggcaacatacactgaaacattttgagcatgtgaggatggtggacccaaagaaggccgcccaaattcgatctcaagtgatgactcacctgcgcgtgatttatgaaaggatgaatcagagtctctccttgctgtacaacgtacctgccgtggcggaagagatccaggacgaagtagatgaattgctgcaaaaggaacagaattactcagacgacgtactggccaatatgattagcgaacctcgcattagctatggcaacgatgctctgatgccgagccttacagaaaccaaaactacagtcgaactgttgcctgtcaacggcgaattctctctcgatgacttgcagccgtggcactccttcggtgccgattcagtacccgccaataccgagaatgaagtggaacctgtggatgctagaccagcagcggataggggtctgactacacgccccggtagcggcctgactaatatcaaaactgaagagatatctgaggtcaaaatggatgctgagtttcgacatgatagtggctacgaagtacatcatcagaaacttgtgttctttgctgaagatgttggctctaacaaaggggccataattgggttaatggtcggcggcgttgtgattgccacagtgattgtcattacattagtaatgctcaaaaagaagcagtacacatcaattcaccatggcgtggttgaagtggacgctgctgtaacccctgaggagaggcacctgagtaagatgcagcagaacggatacgagaatccgacatacaagtttttcgaacagatgcaaaactag

SEQ ID NO: 178869 - DNA, 2256 bp, Artificial Sequence
  Description of Artificial Sequence: Synthetic coding sequence
atgctgcccggcctggccctgctgctgctggccgcctggaccgcccgggctctggaagtgccaaccgatggcaacgccgggctgctagcagaaccacagattgcgatgttctgtggcaggctgaacatgcacatgaacgtgcagaacggcaaatgggattctgatcccagcgggactaaaacgtgcattgatacaaaagaaggaatcttacagtattgtcaggaggtatacccagaactccagatcacgaatgtggtcgaagccaatcagccagtaactattcagaattggtgtaagagaggaagaaaacaatgtaaaacccacccccactttgttatcccttaccggtgcctcgtgggggagttcgtatctgacgcgttgctcgtcccggacaaatgcaaattcctccatcaggagagaatggacgtatgtgaaacgcaccttcattggcatacagtagcaaaggagacttgttccgagaaatcgacgaatttgcacgactatggaatgctgttgccctgcggtatcgacaagtttcgtggtgttgagtttgtgtgctgccctcttgctgaagagtccgacaatgtggattcggccgatgccgaggaggacgatagcgacgtgtggtggggcggggccgacacagattacgccgatgggagtgaggataaggtcgtggaagtggcggaagaggaagaggtggcagaagtggaagaagaagaagctgacgatgacgaagatgatgaagacggagatgaggttgaagaagaggctgaggaaccatatgaagaagctacagaacgcacgacatctatagccaccaccaccaccactaccactgagtccgttgaggaggtggtgcgcgaagtttgttcggagcaggctgagactgggccctgcagggcgatgatttcacggtggtacttcgacgttactgaggggaagtgcgccccctttttttacggtggatgcgggggaaaccgaaataattttgatacagaggagtactgtatggccgtgtgtgggtctgcgatcccaacaaccgcggcaagcactccagacgcggtagataagtacttagaaacacccggcgacgaaaatgagcatgcgcactttcagaaagccaaagagaggctcgaggctaagcaccgtgagcgaatgtcccaggtgatgcgagaatgggaggaagcagaacgacaggccaaaaatttaccaaaggccgataagaaggcggtgatacagcatttccaggagaaggtggaatccttagagcaagaggctgcaaatgagcgccagcagttggtggaaacccacatggcacgggttgaagccatgctgaacgaccgaaggagactggccctggagaattatattaccgcgctgcaggcagtgccaccccgaccccgccatgtcttcaacatgctgaagaaatacgtccgggccgagcagaaagatagacagcacaccctcaagcattttgagcacgtccgcatggttgatcctaagaaagccgcacagatccgctctcaggtgatgacacacctgcgtgtcatctacgagcggatgaaccagtccctaagtctattatacaacgtccctgccgtagcagaggagatccaggacgaggtggacgaactcctccagaaggagcagaactattcggatgatgtcctcgccaatatgataagtgagccaagaatcagctatggcaacgatgcactgatgccttctttgactgagaccaaaacgaccgtcgaactcctgcccgtgaacggtgaattttctctcgatgatctccaaccatggcattccttcggcgccgattccgtgccagccaacaccgagaatgaagtggagccagtggacgcacggccagccgccgatcggggactgacaactagacctgggtctggactgacaaatattaagacggaagaaatctctgaggtaaagatggatgcagaattccgtcatgattctgggtacgaagtgcaccaccaaaagctggttttttttgcagaagacgtcggttctaacaaaggagcaattatcggattaatggtgggtggtgtcgttatcgccacagtgattgtcatcactttagttatgttgaaaaaaaagcagtatacaagcattcaccatggggtggtagaagtggatgccgcagtgacgccggaggaacgacacctgtctaagatgcaacagaatggttacgagaatccaacttataagttctttgagcagatgcaaaattag

SEQ ID NO: 178870 - DNA, 2259 bp, Artificial Sequence
  Description of Artificial Sequence: Synthetic coding sequence
atgctgcccggcctggccctgctgctgctggccgcctggaccgcccgggctcttgaggtgcccacagacggtaacgccggactgctggctgagccacagatcgctatgttttgtggcagacttaacatgcacatgaacgtgcagaatggcaagtgggatagcgacccaagcggcaccaaaacttgcatcgacacaaaggaggggatactgcagtactgtcaggaggtctaccctgagcttcaaataaccaacgtggtcgaggcaaaccagcccgtgaccattcagaattggtgtaaacgtgggagaaaacaatgcaagacgcatccccacttcgttataccttacaggtgtcttgtcggcgagtttgtgtcagacgccctgcttgtcccagataagtgcaagttcctgcaccaagaaagaatggacgtgtgcgaaacccatcttcattggcacaccgtggccaaagagacctgtagcgagaaatcgacaaacctgcatgactatggcatgctgctaccatgcgggattgataagtttcgcggcgtggaattcgtgtgctgtcccttggccgaggagtccgacaatgttgacagcgccgacgccgaggaggacgacagtgacgtatggtggggtggagctgatacggactacgctgacgggtcagaggataaggtggtcgaagtagcagaggaggaggaggtagcagaagtggaggaggaagaggctgatgacgacgaggacgatgaagatggagacgaagtggaggaggaggccgaagaaccctacgaggaggccaccgaaagaactacatcaatagcaacaaccaccacgactaccaccgagtccgtcgaggaagtggtgagagaggtttgttcagagcaagcagagaccggcccctgtagggctatgatctccagatggtattttgatgttacggagggcaaatgcgcgcccttcttttacggtggttgtgggggcaatcggaataactttgacactgaggaatattgtatggccgtatgcgggagcgctatgtcccagagcctgttgaagaccactcaggaaccattagcgcgcgaccctgtgaagctgcccacaacggccgccagtactcccgatgctgttgataaatatttagaaactcctggggacgagaacgagcacgcgcattttcaaaaagcgaaagaaagattagaagctaaacaccgcgagcggatgtcccaagtgatgcgcgagtgggaggaggctgaaaggcaagctaaaaatctgcctaaggcagataaaaaggctgtgattcagcattttcaagagaaggttgaatccttagagcaggaagctgcaaatgagaggcagcagctcgtggagactcacatggccagggtggaagccatgctgaacgaccgacgaaggctggcactcgagaactacatcacagccctgcaggccgtccctccacgcccgagacacgtgttcaacatgctgaagaaatacgtgagggccgagcagaaagatcggcaacacacacttaagcactttgagcatgtgcgtatggttgacccaaagaaagccgcccaaatccgctcacaggttatgacacacctgagggtaatctacgaaaggatgaaccagtctttgagcctcctgtacaatgtccctgccgtggcagaagaaattcaagacgaggtcgacgagctgttacagaaagagcaaaattatagtgatgacgtgctggctaacatgatcagtgagccacggatctcatatgggaatgacgccctgatgcccagcctgactgaaacaaaaaccaccgtggaactcctgccggtaaacggggaattctctctggatgatcttcagccttggcattcttttggtgctgattctgtgccggcaaacactgagaacgaggggtctggactcactaacattaagaccgaggaaatttccgaggttaaaatggacgcggagttccggcacgattctggatatgaggtacaccatcagaaacttgttttttttgccgaagacgtgggttctaataagggcgctattatcggcctgatggtcggcggggtcgtcatcgcgaccgtcatcgtgatcactctagtgatgctgaagaagaaacaatacacctcaatacaccatggggtggtagaggtcgatgctgctgtgacacccgaagagcgccacctctctaaaatgcagcagaatgggtatgagaacccaacttataaattctttgaacagatgcaaaattag

SEQ ID NO: 178871 - DNA, 2145 bp, Artificial Sequence
  Description of Artificial Sequence: Synthetic coding sequence
atgctgcccggcctggccctgctgctgctggccgcctggaccgcccgagctttggaggtgcctaccgacggaaatgcagggctcctggccgaaccacagatcgccatgttttgtgggagactgaacatgcacatgaacgtgcagaacggaaagtgggatagcgacccttcaggtaccaagacttgcatcgataccaaggagggaattcttcagtactgccaagaggtgtacccagaactccaaattaccaatgttgtggaggctaatcagccagtaactattcagaattggtgcaagcgagggaggaagcagtgtaagacccacccccattttgtaattccgtacagatgcctagtcggggagttcgtgagcgatgccctgttggtgcctgacaagtgcaagtttctgcatcaggagcgaatggacgtctgtgagacgcacctgcactggcacaccgtggcgaaagaaacttgctcggagaaatctaccaatctgcacgattacggaatgctgttgccatgcggaattgataagtttcgcggcgtagagtttgtctgttgtccactggccgaggaatctgataatgttgatagtgcagatgcggaggaagatgactccgacgtgtggtggggaggtgccgacacagactatgcagatgggagtgaagataaggtggtcgaggtcgcagaggaagaagaggtggccgaagtagaggaagaagaagcggacgacgacgaagatgatgaagatggagacgaagtggaggaagaggcagaggagccctacgaagaggcaaccgaacgcaccaccagcatagccaccacaaccactacgacgacagaatctgtggaagaagtggtgagagtatctcagtcccttctgaagactacccaagagccactggcacgggatcctgtgaaactgcctaccactgcggcgtccacccccgacgccgttgacaaatatctcgagactccgggagacgagaatgagcatgctcacttccagaaggccaaggagcgactggaagctaagcaccgcgagagaatgtctcaggtgatgagagagtgggaggaggccgagcgccaagcaaaaaatctgccgaaggccgataaaaaagccgttatccagcactttcaggagaaagttgagtccttggaacaggaggcagctaatgagcgccagcagctggtcgagacacatatggccagagtagaggccatgctcaatgacaggcgacgccttgctcttgaaaactatattacagccctacaggcggttcctccccgccctcgtcacgtgttcaatatgctgaagaagtacgtgcgcgccgagcagaaagaccgccagcatacactgaagcatttcgaacacgtccgaatggtggatccaaagaaagctgctcaaatccgttcccaggtcatgacacatttacgagtcatttacgagcggatgaatcagtcactgtctttgctctacaatgtgccagctgtggctgaggaaattcaggatgaggttgacgagctattacagaaggaacagaattacagcgatgacgtccttgctaacatgatcagcgaacctcgaatttcttatggtaacgacgccctcatgcctagccttacagagaccaagacaacagttgagctgctgcctgtgaatggcgagttcagcttagacgatttgcagccctggcattcgtttggcgcagactccgtacctgccaatacagaaaatgaagttgaacccgtggacgcaaggcccgccgctgaccgaggtctgacaacccgaccaggaagtggactgaccaacattaagacagaggaaatttccgaggtcaagatggatgccgagtttaggcacgatagtggttacgaggtccatcaccaaaagcttgtatttttcgctgaggacgtgggaagcaacaagggcgcaattatcggcctgatggtcggcggggtggtgatcgcgaccgtcatcgtaataaccctggtcatgctcaaaaaaaaacagtacacttcaattcatcacggggtggtggaagtggacgcagcagtgacccctgaagagagacacctatcaaagatgcaacagaacggatacgagaaccctacctacaagttctttgagcagatgcagaactag

SEQ ID NO: 178872 - DNA, 2145 bp, Artificial Sequence
  Description of Artificial Sequence: Synthetic coding sequence
atgctgcccggcctggccctgctgctgctggccgcctggaccgcccgggcactcgaggtataccctgagctacaaattacaaatgtcgtggaggctaatcagcccgtcaccatccaaaactggtgtaagcggggacggaagcagtgcaagactcatccacactttgtgataccataccgatgcctcgtgggcgaatttgtcagcgatgccctgctggtgcctgacaagtgcaagtttctgcatcaggagcgcatggatgtgtgtgaaacgcatttacactggcatactgttgccaaggagacgtgtagcgagaaaagtactaacttacatgattacggtatgctgctgccctgcggcatagacaaatttcggggtgtcgaatttgtgtgttgcccactggcggaggagagcgataacgttgattctgcggacgctgaggaagacgacagcgacgtctggtggggaggagcagacactgactacgccgacggaagcgaagacaaagtggtggaagtagcggaggaggaagaggtggctgaagtggaagaggaagaggctgacgatgacgaagacgatgaggacggagacgaggtggaggaggaagccgaggaaccatatgaggaagcaacggaacgcaccacatcaatcgccaccacaacgacaaccaccacagagagcgtagaggaggtagtccgggaggtctgttctgagcaggcagaaacagggccctgtagggccatgattagtaggtggtactttgacgtcacggaaggcaaatgcgcaccattcttttacggcggctgtggcgggaaccgtaacaattttgataccgaggagtactgtatggctgtctgtggctccgccatgagccagtctctgctgaagaccacacaggagccactggcccgtgaccctgttaaattgcccaccacagccgcaagtacgcccgatgcagtcgacaaataccttgagactccaggggacgaaaatgagcatgcccatttccaaaaggccaaagagcgcctggaagcaaaacaccgggagaggatgagtcaggtgatgagggaatgggaggaagcagagcggcaggccaagaatcttccgaaggctgacaaaaaagctgtgattcaacactttcaagagaaagtagaatctctggaacaagaggctgcaaacgagcgacagcaacttgtagaaacccacatggctagggtcgaggctatgctgaacgacagacggcgcctcgcccttgagaattacatcacagcattgcaggccgttcccccccggcccagacacgtgttcaacatgctcaaaaagtacgtcagggcggagcagaaagatcgccaacacaccttgaaacattttgagcatgtgaggatggtggaccctaagaaagccgcccagatccgttcccaggtcatgactcatctgcgagttatctatgaaaggatgaatcaatctctctctctgctctacaacgtgccagccgtcgctgaggaaatccaggacgaggtggacgagctgcttcaaaaggaacaaaactacagcgatgatgtcctagctaacatgatctcagaaccgagaataagctatggtaatgatgccctcatgcccagccttacagagaccaaaactaccgtcgaactcctgccagtgaacggggagttctcactagatgacctccagccgtggcacagtttcggcgccgactccgtgccggccaataccgaaaatgaagttgaaccggtggacgctagacctgcggcggatcgcggacttacaacgaggccaggatctggcctgacaaatatcaagacggaggagatcagcgaggtgaagatggatgcggaattccgtcatgactcgggctacgaggtgcatcaccaaaaattagtgttctttgctgaggatgtcggttcaaacaaaggagctattatcggactaatggtagggggagtggtcatcgctacagtcatcgttattacccttgtgatgctgaaaaaaaaacaatatactagtatccaccacggtgtcgtggaagtggacgccgccgtgacgcctgaggaacgccacctgagtaaaatgcagcaaaacggatatgagaacccaacatataaattcttcgagcagatgcagaactag

SEQ ID NO: 178873 - DNA, 2241 bp, Artificial Sequence
  Description of Artificial Sequence: Synthetic coding sequence
atggaccagctggaggacctgctggtgctgttcatcaactacgtgcccaccgatggcaacgcggggctgcttgctgagcctcagatagcgatgttctgtggtaggctgaacatgcacatgaatgttcagaatggaaagtgggatagtgacccatccggtacaaaaacctgtattgacacaaaggaaggcattcttcagtactgccaggaggtttatccagagttgcaaattacaaatgtggtggaggctaatcagccagtgactattcagaactggtgcaagcggggccggaaacagtgcaagactcacccccatttcgtcattccttatcggtgcctagtaggtgaattcgtatcagatgctcttctggtcccggataaatgcaagttcttacatcaggagagaatggacgtgtgtgagactcacctacattggcacacagttgcgaaggagacatgcagcgagaagtctaccaatcttcatgattacggcatgctgttaccctgcggcatcgacaagttcaggggagttgaatttgtctgctgtcccctggctgaggagtctgataacgtggacagtgctgatgcagaagaggatgactcagatgtgtggtggggcggagccgatactgactatgccgacggatccgaagacaaggtcgtggaagtggctgaagaagaagaggttgccgaggtagaagaggaggaggccgatgatgatgaggatgacgaggacggggacgaggttgaagaagaggccgaggaaccgtatgaagaagccactgaacgcacaacatcaatcgctactaccaccaccacaaccactgaatccgttgaggaggttgtgagagaggtgtgcagtgagcaggccgagaccggaccgtgtcgcgctatgattagtaggtggtacttcgatgtgacggagggcaaatgtgcaccattcttctacggcgggtgcggcggcaaccggaacaattttgacacagaagagtactgtatggctgtctgtggtagtgctatacctactactgccgccagcacacctgatgcagtcgataaatacctggagacccctggggatgagaatgaacacgctcactttcagaaagccaaggaacgcttagaggctaaacatagggaacgcatgtctcaagtgatgagagaatgggaggaggctgagcgacaggccaagaacctccccaaggcagataagaaagccgtgattcaacacttccaggagaaggtggagagtctggagcaggaggcagctaatgaacgccagcagttggtggaaacacatatggcaagggttgaggccatgcttaacgataggcgacggctagctctggaaaattacatcactgctctccaggctgtcccaccccgcccacgacacgtttttaatatgttaaagaaatacgtgagggctgagcagaaagacagacagcacaccctgaaacatttcgaacatgtgcgcatggtggatccaaagaaggctgctcagattaggagccaggtaatgacacatcttagggtcatctatgagcgaatgaaccagtcactgagtctgctgtacaacgtcccagctgtggcagaggaaattcaggatgaggtcgatgagctcctgcagaaggagcagaactatagtgatgatgtgctcgccaacatgatcagtgagccaagaatcagctatgggaacgacgcgctcatgccatccctgactgaaacaaagaccaccgtggaactgctacctgttaacggcgagtttagtctggacgatctccagccctggcactctttcggcgctgatagcgtcccagcaaatactgagaacgaggtagagcccgtcgatgcccgcccagccgcggaccgcggcctcacaactagacctggatcaggacttactaacattaagactgaggaaatttccgaagtcaagatggacgcggaattccgacatgacagtggctatgaagttcatcaccaaaaactagtcttttttgctgaagacgtgggcagcaacaaaggtgcaataattggcctgatggtggggggtgtcgtgattgctaccgtgattgtgatcactctggtcatgctgaagaagaaacagtacaccagcatccatcatggcgtagtggaggttgatgcagctgttactcccgaagagcgacatctgtcaaagatgcaacagaacggatatgaaaacccaacgtataagttctttgagcagatgcaaaattag

SEQ ID NO: 178874 - DNA, 1983 bp, Artificial Sequence
  Description of Artificial Sequence: Synthetic coding sequence
atgttctgcggccggctgaacatgcacatgaacgtgcagaacggcaaatgggactccgacccatccggcactaaaacgtgtatcgacactaaagagggcattctgcagtactgccaggaggtgtatccagagctgcagatcactaacgttgtagaggccaatcaacccgtaactatccagaactggtgcaagaggggacggaagcaatgcaagacgcaccctcatttcgtaataccgtaccggtgcctcgtgggtgaatttgtctccgacgctctcctggtgcccgataagtgtaaattccttcaccaggagcgcatggatgtgtgtgagacccacctgcactggcacacagttgcgaaggagacttgttctgagaagtccactaatctgcatgactatgggatgctgctgccatgcggcattgataagtttcgaggcgttgaatttgtctgttgccccctggccgaggagagcgataacgtcgatagtgcggatgccgaggaagatgacagtgacgtgtggtggggtggtgcggatacagattacgccgatggaagtgaggataaggtcgttgaagtggctgaagaagaggaagtcgctgaggtggaggaagaagaagctgacgatgatgaggatgacgaggatggtgacgaagtcgaagaggaagccgaagagccctacgaagaagctactgagcgcacaacctccatcgccacgaccactacgactaccacagagagcgtcgaagaggtggtgagagtgccaacaacggcagcctctactccagacgcggtcgataaatacctggagactcctggcgatgaaaatgaacacgcacactttcaaaaagcgaaagaacgcttagaagcaaagcacagagaaaggatgtcgcaagtgatgagagaatgggaggaagctgaacggcaggcaaagaacctgcctaaggcagataaaaaagcagttatccagcatttccaagaaaaggttgaatctttggagcaggaggccgctaacgagagacagcagttggtggagacacacatggcacgcgtggaagcaatgctgaacgatcggcgccgtctggccctggagaactatattaccgcactccaggccgtcccaccccggcccaggcacgtctttaacatgctgaaaaagtatgtccgggccgaacagaaagaccgccagcacaccttgaagcacttcgagcacgtccgcatggtagaccctaagaaagctgcccagatccgatcccaagtgatgacacacctgcgggtgatatacgagcgcatgaatcagtctctgagtttactgtataacgtgcccgccgtcgctgaagagatccaggacgaggtcgatgaactgctgcagaaggaacaaaactacagcgatgatgtgctggctaatatgatctctgagcctaggatctcttatggtaatgacgctcttatgccgagcttaacagaaaccaagaccacagtagagctactccccgtgaacggtgaattctccttagacgacctacagccctggcacagcttcggagctgacagcgtccccgccaatactgaaaacgaagttgagccagtggacgcacgcccggcagctgaccgggggctgacaactcggccaggatccgggctgaccaacatcaagactgaagagatcagcgaggtgaagatggatgccgagtttcggcacgactccggatacgaagtgcaccatcagaagctcgtatttttcgccgaggatgtgggaagtaacaaaggggccattatagggcttatggtggggggtgtagtgatcgctactgttattgtcataacactagtcatgcttaaaaagaaacagtacacctccatccatcacggggtggtggaagtagacgccgctgtcacgcctgaggagcgccatctgagcaagatgcagcagaacgggtatgaaaaccctacctacaagtttttcgaacaaatgcagaattag

SEQ ID NO: 178875 - DNA, 789 bp, Artificial Sequence
  Description of Artificial Sequence: Synthetic coding sequence
atgcgggtgcaggacaccagcggcacctactactggcacatccccactggcaccactcaatgggaaccacctggccgtgcctcgccaagtcaaggatctagtcctcaagaggaatcacagctcacatggaccggttttgcacatggtgagggcttcgaggatggcgagttttggaaggacgagccaagcgacgaggcacctatggaattgggcctgaaggaacctgaggagggcaccctgacctttccagcccagtccttaagccccgaacccttgcctcaggaagaagagaagctccccccaagaaacaccaaccccggcattaaatgttttgcggtccgttccctgggctgggtggagatgaccgaggaagaactggcccctggaaggtcatcagttgcggttaataactgcatacgacagttatcttatcacaagaacaatttgcacgatccaatgtccggggggtggggagagggtaaagacctactgctgcagttagaggacgagacacttaaactggtagagccacagtctcaggccctgttgcacgcccagccgattatctccattcgagtgtggggtgtcggacgtgactcaggccgggactttgcttacgtggcgcgcgataaattgactcagatgctaaaatgtcatgtgttccgttgcgaagctcccgccaaaaatatcgctacctcactgcacgagatctgcagtaaggcaaggccacctccactgcccggcctggtagctacttttgcactgcaggggtgcggttggggccattag

SEQ ID NO: 178876 - DNA, 1482 bp, Artificial Sequence
  Description of Artificial Sequence: Synthetic coding sequence
atgctgggcaaggactacatgctggccatcatcctggtgaactgcgatgatgacttgtggggtgatcacagccttgaagtggaagctgggctgccgcccggctggcggaaaatccatgacgcagcagggacatattactggcacgtgccttcagggtctacccagtggcagcgcccaacctgggagttgggcgatgccgaggatcctggcacagggacggagggcatttgggggctacggccaccaaagggcagatcattcagcagtttggagtcatcattagaccgatcaaatagcctgagttggtacggaggggagtcctatatccaatctatggagccgggggctaagtgctttgctgtcagatccctgggatgggtggaggtgccggaggaggacttagcacctgggaaatcatcaattgcggtgaacaattgtatccagcaactcgcgcagactaggtcacggagccaacccccagatggagcatggggagagggccagaatatgctcatgattctgaaaaaagacgcgatgtccctggtcaaccccttggaccacagtttgatacactgccagcctctcgtgcacattcgcgtgtggggggtgggctcctctaaaggccgggacagccctatatccgcccctgcacgggactttgcattcgtggcgtccgataaagacagctgtatgcttaagtgtcatgtgttttgctgtgatgtgcctgctaaggccatcgcttcggcgctccatggactgtgcgctcagatcctgtctgagcgagttgaggtctctggggatgcatcttgctgctcaccagatccaatcagccccgaggacctccctagacaggtcgagctgctggacgctgtttctcaggccgcccaaaagtacgaggccctgtacatgggcactctcccagtgaccaaggctatgggcatggacgtgctgaatgaagctatcggaactcttacagcgcgtggcgacagaaatgcctgggtaccaaccatgctttccgtgagtgattccctgatgaccgcccaccccattcaggccgaggcctccactgaagaggaaccgctgtggcaatgtccagtgcgcctcgtcactttcattggagtcggacgcgatccccatacattcggattgattgcggatctgggcaggcaatcgtttcagtgcgctgccttttggtgtcagccgcacgctggcggattatccgaggccgtccaggctgcttgcatggtgcagtaccagaaatgccttgtcgctagtgccgctaggggaaaagcttggggagcccaggcaagagctaggctgcgactgaagcgcactagttctatggacagtccggggggccctctgccattgcccctgctgaaagggggcgtcgggggagccggagctacgccacggaagagaggagtgttctcatttctagacgcctttaggctcaagccttctcttttacatatgccttag

SEQ ID NO: 178877 - DNA, 1377 bp, Artificial Sequence
  Description of Artificial Sequence: Synthetic coding sequence
atgatcaccaagacccacaaggtggacctgggcctgcccgagaagaaaaaaaaaaaaaaggtggttaaggagccagaaactcgctactcagtgctcaataacgacgactatttcgcagacgtgagtcctctgcgcgcaaccagcccctcgaagagcgtggcgcatggccaggcacccgagatgcctctggtgaaaaaaaagaagaaaaaaaaaaaaggagttagcacattgtgtgaggaacacgtcgaaccggaaactactttgcccgcacgtcgcaccgaaaagtctccttcactgagaaaacaggttttcggacatctggaattcctgtcgggggagaagaaaaataaaaaatcgccattagcaatgagtcacgccagcggggtcaagacttctcctgatcctaggcagggcgaggaagagacccgggttggaaagaagctgaaaaagcacaagaaagagaaaaaaggagcccaggacccaacagctttttctgtgcaggatccgtggttttgcgaagcccgggaggcacgggacgttggtgacacttgctctgtgggaaagaaggacgaagaacaagcggctctgggacagaagcgcaagcggaagagtccaagagagcacaacggaaaggtgaagaagaaaaaaaaaatacaccaggaaggggacgcgctcccgggtcacagcaagcccagccgcagtatggagtcctctccccggaaaggcagcaaaaagaagcccgttaaggtggaagcacccgagtacatccctatttccgacgatccaaaggccagtgccaagaagaaaatgaagtctaagaagaaggttgagcagcccgtaatcgaagagcctgctctgaagagaaagaaaaaaaagaagagaaaagagtcgggagtagccggggatccatggaaggaagagaccgacacggatctggaggttgtgctcgagaaaaagggcaacatggatgaagctcatatagaccaagtacgcagaaaggctctccaggaggaaatcgaccgggagtctggcaaaactgaagctagtgagactaggaaatggacaggaacgcagtttggacaatgggatactgccggcttcgagaatgaagaccagaaattaaagttcctgcggctgatgggagggtttaaaaacttgtcaccttcctttagtaggcctgcaagtacaatcgcgagacctaacatggccctcgggaagaaggcggctgattcactccagcagaacctgcagagggattacgaccgcgccatgagctggaagtattcgcggggtgccggccttggatttagtactgcaccgaacaagatattttatatagaccggaacgcttctaaaagcgtcaaactggaggactag

SEQ ID NO: 178878 - DNA, 2214 bp, Artificial Sequence
  Description of Artificial Sequence: Synthetic coding sequence
atggcccaccggaagctggagagcgtgggcagcggcatgctggaccatcgagtaaggcccgggccagtgcctcacagtcaggagcccgagagcgaggacatggagctaccactggaaggctacgtgccagagggcctcgaactggccgccttaaggcccgagtcccccgccccagaagaacaggagtgccataaccattcccccgacggcgactcctcaagtgattacgtgaacaatactagcgaagaagaagactatgacgaaggactgccagaggaagaggaggggattacttactatattcgttactgcccagaagatgatagttacttggagggtatggattgtaatggagaggaatacctagcacacagtgcccatcctgtggataccgatgaatgtcaggaggcagtagaggaatggactgactctgccgggccacacccacatggacacgaggcagaaggcagccaagactaccccgatggccaactccctatccctgaagacgagccctcagtcctggaggctcacgaccaggaagaagatggacactactgcgccagcaaggaaggatatcaggactattaccccgaagaggcaaatggcaatactggtgccagtccctatcggcttcggcgaggagacggtgacctggaggaccaggaagaagatatcgaccagattgtcgccgaaattaaaatgagcctgtccatgactagcatcacaagtgcgtcagaagctagtcccgagcatggtcccgaacccgggcctgaggattccgtggaggcttgtcctccaatcaaggccagctgctcaccgagtcggcacgaggcgcgacctaagtccctgaacttgcttcctgaagccaagcaccccggcgatccccagcgtgggtttaagccaaaaacccgcacacctgaagaacgactcaaatggccacacgaacaggtctgcaatgggttggagcagccacgcaaacaacaacgctcagatctgaacggtcccgtcgacaacaacaacatccccgagacaaagaaggtggcctcctttccttcttttgtagccgtaccgggtccttgtgaacctgaggatctgattgacggaattatttttgccgccaattatctgggatccactcaattgctgtccgaaagaaatccctccaaaaatattaggatgatgcaggcccaagaagctgtgagcagggtaaaaaactccgaaggagatgcacaaaccctaaccgaagtcgatctcttcatttccacccaaagaatcaaggtgctcaatgccgacacccaggagacgatgatggatcacgcgttgcgcaccatctcatatatagcagatattggaaacatcgtagttctcatggctcggaggcgaatgccccgtagcgcctctcaggattgcattgaaaccacgcccggagcacaggaaggcaaaaagcagtacaagatgatatgccatgtcttcgagtctgaagacgcccagctgatcgcccagtcaatcgggcaggccttttccgtggcctaccaggagtttcttagggctaacgggatcaatccagaggatctatcacagaaagagtacagtgacatcatcaacacccaggagatgtataatgacgaccttatccacttcagtaattccgaaaactgcaaagagctccagttggaaaagcacaaaggggaaattctcggtgtggtagtggttgagagcggctgggggtccatcctacccactgttatcctggccaacatgatgaatggaggccccgcggcccggtctggaaaactttctatcggtgatcagatcatgagtattaacggcacaagcttagtgggtctgcctttggccacatgccagggcatcataaaaggtctcaagaaccagacacaggtcaagctgaacatcgtctcatgccctcccgttacgacagttcttataaaacgacctgatttaaagtatcagctggggttcagtgtccagaacggcattatatgcagcctcatgaggggaggcatcgcagaaagaggcggcgtccgcgtagggcataggatcattgaaataaatggtcagagcgttgtggctacagcccacgagaaaattgtgcaagctctttccaactctgttggggagattcacatgaaaactatgccagccgctatgttcagattgttgacaggtcaggaaaccccgctatacatttag

SEQ ID NO: 178879 - DNA, 84 bp, Artificial Sequence
  Description of Artificial Sequence: Synthetic coding sequence
atggcccaccggaagctggagagcgtgggcagcggcatgctggaccacagggtgagacccggtcccgtcccccactctcagtag

SEQ ID NO: 178880 - DNA, 2250 bp, Artificial Sequence
  Description of Artificial Sequence: Synthetic coding sequence
atggcccaccggaagctggagagcgtgggcagcggcatgctggaccaccgcgtccggcccggacccgtcccacattctcaggagccagaatccgaagatatggaacttcctctggagggatacgttcccgaaggcttggagcttgctgcgctccggccagaatcccccgccccagaagagcaggagtgccacaaccactcacctgacggagactctagttcggattatgtgaataatactagtgaggaagaggattacgacgagggactgcctgaagaggaagaaggcatcacctattacatacggtactgtcccgaagatgatagttacctcgaagggatggattgtaacggcgaggagtatcttgctcactccgcccatccagtggatacagatgaatgccaggaagccgtggaggagtggacagattctgctggacctcacccccacggtcacgaagctgaaggcagccaggactacccggatggccagctgccaataccggaggacgaacccagcgtattagaggcccacgaccaagaggaagatggccactattgtgctagcaaagaagggtatcaagactattatcctgaagaggctaacggcaataccggggcatccccctatcgcctgcgccgaggcgacggagacctggaggaccaggaggaagacattgaccagatcgttgcagagattaaaatgtctctgagtatgacaagtattacctcagcgagcgaagcctctccagagcatggcccagaacccggccctgaggacagcgtggaggcctgtccacctattaaagccagctgttccccttctagacacgaggctaggcctaaatccttaaatctgttgcctgaggcaaagcatcccggcgaccctcaacgggggttcaagcccaaaacccgcacacctgaggagcgattaaagtggccgcatgagcaggtttgcaacggactcgagcagccaagaaaacaacaacggtctgatttgaacgggcccgtggataacaataacatacctgaaactaaaaaagttgcctcctttccaagcttcgtggccgtaccagggccctgcgagccagaagacttgattgatggaatcatttttgcagcaaactacctgggctccactcagttgctgtcagaaagaaaccctagtaagaacatccgaatgatgcaggcacaagaagcagtctccagggtaaaaaggatgcagaaagccgcaaaaatcaagaagaaagccaatagcgagggtgatgcacagactttaaccgaggtggatctgtttatcagcactcagcgtataaaagtgcttaatgcggacacacaggaaacaatgatggaccatgcactaaggacgattagctatattgccgatatcggcaatatcgtggttttaatggcgaggcgccgcatgcctcggagcgcctcccaggattgcatcgaaactaccccgggagcgcaggagggcaaaaagcagtacaaaatgatttgtcatgtctttgaaagcgaagatgctcaattaattgcgcagtctataggccaggccttctccgttgcatatcaggaatttctgcgtgctaatgggattaatcccgaggatttgtcccagaaggagtactcagacattattaatacacaggagatgtacaatgacgatctcatccacttctctaattctgagaactgtaaggagttgcagttggagaaacataagggcgagattctaggggtggtggtcgttgagtctgggtgggggtctatcttgcccaccgtcatactagctaacatgatgaacggaggcccggcagccagatccggcaaactgagtatcggggaccagatcatgtccatcaacgggacttccctggtgggcctcccgctggctacgtgtcaaggcatcatcaaaggattaaagaatcaaacccaggtaaaactgaacattgtgagctgccccccagtgaccaccgtcctcattaaacggccagacctgaagtaccaattggggttcagcgtgcagaatggcatcatctgctcgctgatgcgcggaggaattgctgaaagaggtggcgtaagggtgggacacagaattatcgaaattaatgggcagtcagtcgtagcaacagctcacgaaaagatcgtgcaagctctgtccaacagcgtaggggaaattcatatgaagaccatgccagccgccatgttccggctgttgacagggcaggaaactcctctttatatctag

SEQ ID NO: 178881 - DNA, 2214 bp, Artificial Sequence
  Description of Artificial Sequence: Synthetic coding sequence
atggcccaccggaagctggagagcgtgggcagcggcatgctggaccacagagtgcgtcctggacccgtcccgcacagccaggagccagagtctgaggatatggaattaccactggaaggatacgtgcctgaaggcctcgagctggctgctttgcgtcccgagtcccctgctcctgaagagcaggagtgccacaatcactcacccgatggagacagcagctccgattacgtgaacaacacaagtgaagaagaagactatgatgaaggtcttcctgaggaggaggagggcatcacttattacataaggtattgtccagaggacgattcttatctggagggcatggattgtaatggcgaggagtacctggcacacagtgcccaccctgtggatacagacgaatgtcaggaggccgttgaggagtggactgattccgctggaccccatccacatggccatgaagctgagggcagccaggactatcctgatggccagctgccgattcccgaagatgaaccttcggtccttgaagcacatgatcaggaggaggatggccattattgcgcatcgaaagagggctatcaagattactatcccgaagaagccaatggcaacacaggcgcctccccttatcgcctgagaaggggcgatggcgatttagaggatcaggaggaggatatagaccagatcgttgctgagataaagatgtctctctctatgacatccattactagcgctagcgaggcaagtcccgagcatggtcccgagcctgggccggaggatagcgtggaagcatgcccccccattaaggcctcttgtagccctagcaggcatgaggcccggcccaagtcccttaacctcctacccgaggctaagcatcctggggaccctcagagaggattcaagcctaagacaagaactccagaggagaggcttaaatggccccacgagcaggtatgcaacgggcttgaacagcccaggaaacagcagcgcagtgacctaaacgggccagtggataataacaatattcccgagacaaagaaggtcgcatcctttcctagtttcgtcgccgtgccaggcccctgtgaaccagaggacctgatcgatggcatcattttcgcagctaattatttggggtcaacacagctgctgtccgagcgcaacccaagtaagaatattaggatgatgcaggcacaggaggccgtatctagagtgaagaattcggagggtgatgcgcagacccttactgaagtggacttatttatctctacccagcggattaaagttctaaatgctgacactcaggaaactatgatggaccacgccctgcgcaccatctcttatatcgctgacatcgggaacatagtcgttctgatggcgcggaggaggatgcctagatcagcaagtcaagactgcattgaaactacaccaggcgcccaggagggcaaaaaacaatacaaaatgatatgtcacgtgttcgagtccgaggatgcccagttgatcgctcagtcaattggccaggcttttagcgtggcctaccaggagtttcttagagcaaacggtatcaatccggaggatcttagccagaaggaatatagcgatataatcaacacacaagaaatgtacaacgatgatctgatccacttcagtaattctgaaaattgtaaagagctccagctggaaaaacataaaggtgagattctgggggttgttgtggtcgaatcaggatggggatctatcctgcccacggttattctggcaaatatgatgaacggcgggcctgcagccaggagtggtaaattgtcgatcggagaccagatcatgagtataaatggcacatcactggtggggctgccactcgcaacctgccagggcatcataaaagggttgaagaatcagacgcaggtcaagctgaacatcgtgagctgtccaccagttaccaccgtcctcattaaacggcctgaccttaagtaccagctgggattctctgtccagaatggcatcatctgttctctgatgagaggaggcattgctgagcgtggaggggttcgagttggccaccgaatcatcgagattaacggccaatcagtggttgccaccgcccatgaaaagattgtgcaagctctcagcaactcagtgggcgagatacacatgaagaccatgccagccgccatgttcagattgctgaccggacaggagacaccactctacatttag

SEQ ID NO: 178882 - DNA, 795 bp, Artificial Sequence
  Description of Artificial Sequence: Synthetic coding sequence
atggcccaccggaagctggagagcgtgggcagcggcatgctggaccatagagtgcgcccagggccagttcctcactcgcaagaacctgagagtgaggacatggaactgcccctggaggggtatgtgccggagggcctcgaacttgccgccctgagaccagagtctcctgcaccggaggagcaagaatgtcataaccacagccccgatggcgactcctcttcggattatgttaataatacttctgaagaggaagattacgatgagggcctcccagaagaagaagagggtattacctattatattcgatattgtccggaagacgacagttatctggagggtatggactgcaatggggaggagtacctggctcacagcgcacatcctgtggatacagatgaatgccaagaggccgtcgaggaatggaccgactccgcaggcccgcacccccatggccatgaagcagaggggagtcaggactacccagatggccaacttcccattcctgaggatgaaccaagcgtactggaggcacacgaccaggaggaggacggacactattgtgccagtaaagagggctatcaggactactatccggaggaagctaacggaaatacaggagcatcaccctacagattaagacgaggcgatggagatctcgaagaccaggaggaagacatcgatcaaattgtggcagaaattaaaatgtcactgagtatgacaagcattactagcgctagtgaggctagtcctgaacacggccccgaacctggccccgaagattctgtcgaggcttag

SEQ ID NO: 178883 - DNA, 2250 bp, Artificial Sequence
  Description of Artificial Sequence: Synthetic coding sequence
atggcccaccggaagctggagagcgtgggcagcggcatgctggaccatagggtgagacctggccccgtgccccactcgcaggagcctgagagcgaggacatggagctccccctcgagggctacgtaccagagggcctggagttagccgctctgcgaccagaaagccccgcccctgaggagcaggagtgtcataatcatagcccagacggcgacagctcctcagattacgtcaacaatacaagtgaggaagaggactatgacgaaggtctcccagaagaggaagaagggataacatattacatccggtattgccctgaagacgattcttatttagaagggatggattgcaacggtgaggagtacctcgcccacagtgctcatcccgtcgatacagatgaatgccaagaggcagtggaagagtggaccgacagcgccggaccccatccacacggccatgaggcggagggttctcaggactacccagatggccaactacccatccctgaagacgagccttctgtgttggaagcacacgaccaggaggaggatggccactactgcgcctcgaaagagggctaccaagactactaccccgaagaggccaatggcaataccggggcttctccttacagactcaggcgcggcgacggggatctggaggaccaagaggaggacattgatcaaattgtggcagagatcaagatgtctctctctatgaccagcattacttccgccagtgaagctagccccgagcatggccccgaaccaggacctgaagattccgtggaagcatgtcctcctataaaggcaagctgctccccatcccggcacgaggcccgcccaaagtcgctgaacctgctgcctgaggcaaagcacccgggtgacccacaacggggcttcaagcccaagacacggacacccgaggagaggcttaaatggcctcacgagcaggtgtgtaacgggctggagcagccacggaaacagcaacgctcagatttaaacggccccgttgataataacaacatccctgagaccaaaaaggtggcgtcttttccatcttttgtagccgtgccaggcccgtgcgaacccgaagacctgattgatggcatcattttcgctgccaactatctagggtccactcaacttctctccgagagaaatccctccaaaaacatcagaatgatgcaagcccaggaagcggtgtctcgggtaaaacgtatgcagaaggctgccaaaatcaagaagaaagctaatagcgaaggagacgctcaaacactaactgaagtagatctatttatctcgacgcagaggattaaggttctgaacgcagatacccaggaaactatgatggatcatgccctccggacaatcagctatatcgccgatattggcaacatagttgtgctaatggctcgccgaagaatgcctagaagcgcaagccaggattgcatcgaaaccactcccggtgcccaggagggtaaaaaacagtataaaatgatatgtcacgtcttcgaatcagaggacgcccaactcatcgcgcaatcaatcggccaggctttctcagtagcctatcaggaattcctgcgggcaaacggaattaatcccgaggacctgagccagaaagaatactccgacatcatcaacactcaagagatgtacaatgacgatttgattcatttcagtaattcagaaaactgtaaagagctccagttggaaaaacacaagggagagattctgggcgtggtggtcgttgagagtggttggggttccatcttgcctactgttatcttggccaatatgatgaatgggggtccagcagcacgctctggcaaactgtctatcggcgatcagatcatgtcgattaatgggacctccctggtcgggctgcccctcgcaacatgtcagggaattatcaaagggctgaaaaatcagactcaggtaaagctgaatatcgtctcctgtccacccgtgacgacggtgttgattaaacgcccagaccttaagtaccaattgggcttttcagtccagaacgggattatctgtagtctgatgcggggaggtatcgccgaacgcggtggagtgagggtgggccaccgcatcatagaaattaacggccaaagcgtcgtagcgactgcacacgaaaagatcgtgcaagcactctccaattcagtgggcgagatccacatgaagacaatgcccgccgccatgttccgtctgctcacgggacaggagacacctctgtacatatag

SEQ ID NO: 178884 - DNA, 213 bp, Artificial Sequence
  Description of Artificial Sequence: Synthetic coding sequence
atggcccaccggaagctggagagcgtgggcagcggcatgctggaccacagggtccgccctgggcctgtgccccactctcaggagcccgagagcgaagatatggagctcccattggaaggatacgtgccagagggccttgagttagccgctttaagacccgaatctcccgcccctgaagaacaagagtgtcacaaccacagtccagatggctag

SEQ ID NO: 178885 - DNA, 15 bp, Artificial Sequence
  Description of Artificial Sequence: Synthetic coding sequence
atggcccaccggtag

SEQ ID NO: 178886 - DNA, 339 bp, Artificial Sequence
  Description of Artificial Sequence: Synthetic coding sequence
atggcccaccggaagctggagagcgtgggcagcggcatgctggaccaccgtgttcgccccggacctgtgccacattctcaggaacctgagagcgaggatatggaattgccgttggagggctatgtgccagaaggactggagctggccgcccttaggcctgaaagtcctgctcctgaggaacaggagtgtcacaatcactcaccagatggagattccagcagcgactacgtcaacaatactagcgaggaagaagattatgatgaaggactgcccgaagaggaggaggggatcacatattatattaggtattgcccggaagacgactcctatttggagtag

SEQ ID NO: 178887 - DNA, 2250 bp, Artificial Sequence
  Description of Artificial Sequence: Synthetic coding sequence
atggcccaccggaagctggagagcgtgggcagcggcatgctggaccaccgggtccggcctggcccagttccgcacagccaggaaccggaatcagaagatatggagctgccccttgaaggttatgttccagaaggtctcgaactcgccgcactgagacctgaatcgcccgcaccagaagaacaagagtgtcataatcattctcccgacggcgattctagcagcgactacgttaataatacttccgaggaagaagattacgacgagggcctacccgaagaagaggagggcataacatactacattcgctattgccccgaggatgactcttatctcgaggggatggactgcaacggtgaggaatacctcgctcactcggcacaccccgtcgacactgacgagtgtcaggaggctgtggaggagtggactgactccgcgggtcctcatcctcatggtcacgaggccgagggatcccaggactaccccgatggacagctccctattcctgaggacgagcccagtgtcctggaagcccacgaccaggaggaggatggtcattactgtgcgagtaaagagggctatcaggattattatcctgaagaagcaaatggaaacaccggcgccagcccctaccgccttcgcaggggtgacggagacctggaggatcaggaagaagatatcgaccagatagtcgctgagattaaaatgagcttgtccatgactagtattacaagcgcatctgaggcctctcctgaacatggccccgagccaggccccgaggacagcgtggaggcctgcccaccgattaaggctagctgttctccctctcgccacgaagctagacctaaatccctcaacctgctgcccgaggccaagcacccaggggatccacagagaggattcaaacccaagactagaacccccgaggaaagactgaagtggccccacgaacaggtgtgcaacggtctggagcaaccccgcaagcagcagcgttccgatctgaatggtcctgttgataataataacattcccgagaccaagaaagtggctagctttccgtcatttgtagcagtgcctgggccttgtgagcctgaagacctgatcgacggcattattttcgccgcgaactacctgggttccacccagctgctcagcgagaggaaccctagcaagaatatcagaatgatgcaggctcaggaagcagtttctagagtgaagcgcatgcagaaggcagctaaaatcaaaaaaaaagctaattctgagggggatgcgcaaacactgaccgaagtggacttgttcatctccacccagcgaataaaagtgttgaacgccgatacacaggagacgatgatggatcatgcactgcgaacgatatcttacatagcggatattgggaacatcgtcgtcctgatggcccgacgtaggatgcctcgttcagcgagccaggattgcattgaaacgacccccggtgctcaggagggaaagaagcagtataaaatgatctgccacgtgttcgagtcggaagacgctcagctaatcgcccaatcaataggacaagccttttcagttgcctatcaagagttcctacgggccaatgggataaacccagaggacctgtcacagaaggagtacagtgacattatcaacacccaggagatgtataacgatgatttaatacacttttctaactctgagaactgcaaagaactgcagctggagaagcataagggagagattctgggtgtcgtggtcgtggagtctggatgggggagcatcctgcccactgtcatcctcgctaacatgatgaacggtggacctgcagccaggtccggcaagctgtccattggagaccagataatgagtatcaatggaaccagcctggtgggcttacccctggccacatgccagggtatcatcaaaggcctgaagaaccagactcaagtgaagctcaatatcgtaagttgcccacctgtcacaacggtgctgataaagcgtcccgatcttaaataccagcttggattttcagttcagaacgggatcatctgttctttgatgcggggtgggatcgccgagaggggcggcgtccgggtcggccatcgaattatagaaatcaatggccagtcagtagtagcgactgcccacgaaaagattgtgcaggctctaagcaattccgtgggtgagatccatatgaaaactatgccagcggcaatgttccgcctactgaccggacaagagaccccactctatatctag

SEQ ID NO: 178888 - DNA, 2127 bp, Artificial Sequence
  Description of Artificial Sequence: Synthetic coding sequence
atgagcgtgcccagcagcctgagccagagcgccatcaacgccaactcacacggagggcccgccctgtctctgcctctccctctgcacgcagcacacaaccagctgttaaacgccaaactccaagccactgcagttggcccaaaggatttgcggtctgccatgggagagggaggagggcccgagcccgggccagctaatgccaagtggctgaaggaaggccagaatcagttacgccgcgcggccactgcccatagagatcaaaatcgcaatgtgacgctcacgctggccgaggaggctagccaggaacccgagatggcacccttgggacctaagggcctgattcatctgtatagcgagttggagttgagtgcccacaacgccgccaatagggggctaagggggccaggactcatcatatctactcaggagcaaggtcctgatgagggcgaagaaaaggccgcaggggaagcagaagaagaggaagaagatgatgatgacgaagaggaagaggaggacctgtcttccccgcccggtctccccgagcctttggagtccgttgaggcaccacccaggccgcaagccctgacggacggacccagagagcattccaagtcagcgtcactccttttcggaatgcgcaacagcgccgccagtgacgaggattccagttgggctactctgagccaagggtctcctagttacgggtctccagaggacaccgacagcttctggaatcccaacgcatttgaaactgattctgacctcccagccggctggatgcgtgtccaagacactagcggcacttactactggcatatccctacgggtacaacccagtgggaaccccctggtagagcctcaccgtcacaagggtcaagcccccaggaggaaagccagctgacttggaccggtttcgctcacggagagggatttgaagacggggagttttggaaggacgagccgtctgacgaggcacccatggagctaggtcttaaggagcctgaggaggggacgctaactttcccggctcaaagcctatcccccgagccactgcctcaggaggaggaaaaactgccacctcgaaacaccaaccccggaatcaaatgtttcgctgtaagatctctaggctgggtcgagatgacagaggaagaactcgctcctggccgcagctctgtagccgtgaacaactgtatcagacaactctcataccataaaaacaacttacacgacccaatgagcggaggctggggagagggaaaagatctcctgttgcaactcgaagatgagactttgaaactggtagagccacagtcgcaagccctgctgcacgcgcaaccaattatatcaatccgagtgtggggcgtgggccgcgacagtggacgcgattttgcctacgtcgccagagataagttaacacaaatgctgaaatgccatgtattcaggtgcgaagcacccgctaagaacatcgccacatcattgcacgaaatctgcagtaaaatcatggcagaaagaagaaatgctcgatgcctggttaacggactgagcttggaccatagtaagcttgtagacgtgcctttccaagtcgaattccccgcacccaagaacgagctggtgcagaagttccaggtctactatctcggtaacgtgccagtcgctaaacctgtaggggtggatgtcattaacggagccttggaatctgtcctttcaagctcatcccgcgaacagtggacgccaagccacgtgtccgtggcacctgcaacgttgaccattctgcaccaacagacagaagccgtgctgggagagtgtcgcgtgcggttcctcagctttctcgccgtgggcagggacgtgcacactttcgcattcattatggctgccggacccgccagtttctgctgccatatgttttggtgtgaaccgaacgccgcctcattgtctgaagcggtgcaggccgcttgcatgcttcgctatcaaaagtgcttggacgcacgatcccaggcatccacaagttgcctaccggcacctccagctgaaagcgtcgcgcggagggtgggctggaccgtgagacggggcgtccaatccctgtgggggagcctcaagcccaagcggcttggcgctcacaccccatag

SEQ ID NO: 178889 - DNA, 2127 bp, Artificial Sequence
  Description of Artificial Sequence: Synthetic coding sequence
atgagcgtgcccagcagcctgagccagagcgccatcaacgccaactctcacgggggcccagctctcagcctgccgctgcctctgcacgctgcacacaatcagcttctgaacgcaaagttacaagcaaccgctgtgggtcccaaggacctgagatctgcaatgggagaaggtggaggtcctgagcccggcccagcaaacgctaagtggctcaaggaggggcaaaaccagctgcgcagggccgcaactgcccatcgcgaccagaaccggaatgtgacccttactctggcggaagaagcatcccaagaacctgagatggcccccctgggacccaaagggctcatccacttgtactctgagcttgaactgagcgcccataacgcagctaatcgtggtctgcgggggcccggccttataatctccacccaggagcagggacctgatgagggtgaggaaaaagctgcgggagaagcagaggaggaggaggaggacgacgacgatgaagaggaggaggaagatctctcctctcctccaggactgcccgagcctctagagagtgtggaagcgcctccacgcccgcaggctttaacagatggaccacgcgagcattcaaaaagtgcctcactgctcttcggtatgagaaactcggcagcgtctgacgaagactcctcctgggctacactttctcaagggtccccctcctatggatcacccgaggacacggatagcttctggaacccaaatgccttcgaaaccgactccgatctccccgctggatggatgcgcgttcaggataccagcggaacctactactggcatattcccacgggaaccacccagtgggaacccccaggccgggccagcccctcacagggctctagtcctcaagaggagtcacaactgacctggaccgggttcgcgcacggggaaggttttgaggatggagaattttggaaggatgagccttccgatgaagccccaatggagttgggtctcaaagaaccagaggagggcaccctaaccttccccgctcaatcactttcacctgagccactcccccaagaagaggagaaattaccgccgaggaataccaacccaggaattaagtgttttgctgtgcgaagtctagggtgggtggagatgaccgaggaggagcttgctccaggcagaagttcagtggcagtgaacaattgcattaggcagttgtcctatcataaaaacaaccttcatgatccaatgtcaggcggctggggggaaggtaaagacctcctgctgcagctggaagatgaaactctcaagttggtggaaccccaaagccaggcgctactccatgcacaacctatcattagtattcgagtatggggcgttggccgagacagtggaagggactttgcttacgtagccagagacaaactgacccagatgttgaagtgccacgtttttagatgcgaagctccagccaaaaacattgctacatcactccatgagatttgctccaagattatggccgaaagacggaatgctcgctgtctggtgaatggcctgtctttggaccacagcaaactggtggatgttccctttcaagtcgaattccctgccccaaaaaacgagcttgtccaaaaattccaagtgtattacttgggaaatgtacctgtcgccaagcctgtgggggtggacgttatcaatggagccctcgagagtgtcctctcttcctcgagcagggaacagtggacgccgtcccacgtatcagtcgccccggctacactgaccatccttcaccagcagaccgaagcagtgctgggggagtgtagagttaggtttctcagcttcctcgccgtgggaagagacgtgcataccttcgcctttatcatggccgccggtcctgctagtttctgttgtcatatgttttggtgcgagcctaacgctgcctccttgtccgaggctgttcaggccgcgtgtatgctgcgctatcagaaatgcctcgacgcgcgctcacaggcgagcacaagctgtctgccagcgcccccagccgaatcagtggctaggagagtaggatggacagtgaggcggggcgttcagtccctgtggggaagcttaaagcccaagaggcttggcgcccatactccctag

SEQ ID NO: 178890 - DNA, 2133 bp, Artificial Sequence
  Description of Artificial Sequence: Synthetic coding sequence
atgagcgtgcccagcagcctgagccagagcgccatcaacgccaactctcatgggggcccagccctgtcactaccactgccactgcatgcagctcacaatcagttacttaatgccaagcttcaagccaccgctgtgggtccgaaagacttgcgctctgccatgggtgaaggtggcggacctgagccaggccccgccaacgctaagtggctgaaagaagggcagaaccagctgcgccgggccgcaaccgcccatagagaccagaatcgtaacgttacactgactctggctgaggaggccagtcaggagccggaaatggcccctctgggtccaaaaggactgatccacctctacagcgagctggagctcagcgctcataatgcagctaaccggggcctgagagggcccggcctgataataagcacgcaggagcagggcccagatgagggtgaggagaaggccgcgggggaggcagaggaggaagaggaggatgacgatgatgaagaggaagaggaagacctttcaagtcccccggggttgcccgagcccctggaatcagttgaggcccccccccgtccccaggctcttactgatggaccacgggagcactctaagtccgcaagcctgttgttcggaatgcggaacagcgctgcctcagatgaggatagtagctgggccaccctgtcacaggggtccccctcctacggaagccctgaggatactgactcattctggaatcctaacgcctttgagacagactccgacctgccagccggctggatgcgtgtccaagatacttctgggacatactattggcacatcccaaccggcacaactcaatgggagcctcccggaagagcttccccatcccagggttcttcgccacaagaggagtcccagctgacgtggaccggctttgctcatggagaaggatttgaggacggggagttctggaaggatgagccttccgatgaggccccaatggaattaggactgaaggaacctgaagagggcaccctgactttccccgcacagtcattgtctccagaaccgctccctcaggaggaagaaaagcttccgccacgtaataccaatcccggtatcaaatgtttcgcagtgaggagcctgggctgggtggagatgaccgaggaggagctagcgcccggtcgtagctcagtagccgtgaacaattgtataaggcagctgagctatcacaaaaacaatttacacgatcccatgagcggcggatggggggaaggcaaggatctgctgctgcaactggaagatgagaccctgaaactcgtcgagcctcaaagccaggcccttttacatgctcaacctattatcagtatccgggtgtggggggttggcagagattcagggtctaacagagacttcgcttacgtggcaagagataagctgacgcaaatgctgaagtgccacgtgtttaggtgcgaagccccagctaagaacattgccacttccttgcacgaaatctgctcaaagataatggccgaacgtagaaatgcaaggtgtctggtaaacgggttgagccttgatcactctaaactggtcgacgtgccttttcaggtggagtttcccgccccgaagaatgagctggttcagaagttccaggtatattatctgggcaatgtgccggtagcaaagccagtgggagtagatgtgatcaacggcgccctagagtccgtgctatcttcctcctctcgcgagcaatggacaccgtctcatgtcagcgtcgctccagccacactcaccatcttacatcaacagaccgaagccgtgcttggagaatgccgggttcgcttcctgtccttcttagccgtgggccgggacgtccatacgttcgcctttatcatggccgctggaccagcctccttctgctgtcacatgttctggtgcgagcccaacgctgccagtctgagcgaagcagtccaagccgcatgcatgcttcgctaccagaagtgcctggacgcaaggtcacaagccagtaccagttgcctccctgcgccaccagctgagtccgttgcacgacgcgttggatggacagtgagaaggggcgtacagagcctttggggaagcctgaaacctaaacgactgggagcccatacgccatag

SEQ ID NO: 178891 - DNA, 1356 bp, Artificial Sequence
  Description of Artificial Sequence: Synthetic coding sequence
atgcgggtgcaggacaccagcggcacctactactggcacatccccaccggtaccacccagtgggagccccctggccgggcatctccctcccagggttcctctccccaggaggagtcccaactcacgtggacagggttcgcacatggcgaggggtttgaggatggggagttttggaaggacgagccatctgacgaggcacctatggaactgggcctcaaggaacccgaggaggggacgttgacctttcccgcacaatcgctgagccctgaacctcttccacaggaggaggaaaagctgcccccaaggaatacaaacccaggaattaagtgtttcgccgtccgaagcctgggatgggtagagatgactgaggaagaactcgctccaggccgatccagcgttgccgtgaacaattgcattcgccagcttagctaccacaagaacaacctccacgatccaatgagtggtggatggggcgaagggaaagatcttcttcttcagctggaggacgagactctgaagctcgtggagccccagtcccaggctctgctccatgcccagccgattatcagcattcgagtctggggcgtgggaagagactctggttccaaccgagacttcgcctacgtggcgagggataagctcactcagatgctgaaatgccatgtcttcaggtgtgaggccccagctaagaacattgctacctctttgcacgagatttgctcaaagattatggcagaaagacggaacgcacgctgcctcgtcaatggattatccctcgatcatagtaaattggtcgacgtgccatttcaggtggaattccctgcccccaaaaacgagctggtacagaaatttcaagtctattatcttggaaatgtgcctgtagcaaaaccagtgggtgtagatgttattaacggtgctctggaaagcgttctctcttcgagcagtcgggagcaatggaccccctctcatgtcagcgtagctcccgccactctgacaatactgcaccaacagacagaagcggttctcggcgaatgtagggttcggttcctttcatttctcgccgtcggaagagatgtgcatacctttgcatttattatggctgccgggccagcctccttctgttgtcacatgttttggtgtgagcctaacgccgcctctctctctgaggccgtgcaggcggcgtgcatgctcagatatcagaagtgtttggatgctcgctcccaggcatccaccagctgtctgcccgctcccccagcagagtcagtcgcccgtagagtgggatggactgttcgtcgcggggtccagagcctttgggggagcctaaaacctaaacggctgggagcccataccccctag

SEQ ID NO: 178892 - DNA, 1680 bp, Artificial Sequence
  Description of Artificial Sequence: Synthetic coding sequence
atgagcgtgcccagcagcctgagccagagcgccatcaacgccaactctcacggcgggccagcactttctctcccattacccctgcatgcagcccataaccaactcctgaacgcaaagctgcaagcgactgctgtggggccgaaggacctccacagcaagtcagcttcgctgcttttcgggatgcgcaattctgcggctagcgatgaggactcaagctgggcgacactgtcccagggcagccccagctacgggagtccagaggacaccgactcattctggaatcctaacgcatttgaaaccgactcggatttgcctgctggatggatgcgtgtacaagacacaagtgggacatactattggcatattccaactggcacgacgcaatgggagcctcccggcagggcgtccccctctcaaggatcaagtcctcaggaagagagccagctcacatggactggctttgcccacggcgagggatttgaagacggtgaattttggaaggatgaacctagtgatgaagcccccatggagctggggcttaaggaaccagaagaaggcactctcacctttccggcccaatcactgtcgcctgagccgttgccacaggaagaagagaagctgcccccgagaaacacaaacccggggatcaagtgcttcgctgttcggagcctgggttgggtggaaatgactgaagaggaactggcacccggccggtccagtgttgccgtcaacaattgtataagacagctgtcctatcataagaataatctccacgaccctatgagcggcgggtggggcgagggtaaagaccttctgctccaacttgaggacgaaaccttgaaactggtcgagcctcagagtcaggctctgctccatgcacagcccataatctctattagagtttggggtgttgggcgagattcaggctcaaatcgagacttcgcctacgtggcccgcgataagctgacccagatgctgaaatgtcatgtttttcgctgcgaggcacccgcaaagaacatcgctacaagtctgcatgagatctgctcgaaaataatggccgagcgccgaaacgctcgatgtctcgtgaatgggctgagtctggatcactctaaactggtagacgtccctttccaggtggagtttcccgcgcccaagaacgaactggttcagaaatttcaggtttactacctggggaacgtgccagtggcaaagccggttggcgtcgatgtaattaacggcgctctggagtccgtgctatcctccagtagcagggagcagtggaccccttcccatgtcagcgtggcacccgccaccctgactattctccatcagcagactgaagccgtgctcggtgagtgccgggtacggttccttagctttctagctgtcggcagggatgtgcacacatttgcattcattatggcagccgggcccgcatctttctgctgccacatgttctggtgtgagccaaatgcagcctccctaagcgaagccgtgcaggcagcatgcatgctgagataccaaaaatgcctggacgcacgatcccaggcatccactagttgcttacctgcccccccagcagaatctgtggcgagacgggtgggatggaccgtgaggcgcggtgtacagtccctgtggggaagcctgaagccaaagagactgggcgcccacacaccttag

SEQ ID NO: 178893 - DNA, 1428 bp, Artificial Sequence
  Description of Artificial Sequence: Synthetic coding sequence
atgacccagatgcgggacagcttctggaaccccaacgccttcgagactgatagcgacttgcctgcgggctggatgcgtgttcaagatacaagcggaacttactattggcacatcccgaccggcaccacacagtgggagcccccaggtcgagccagtccatctcaaggaagctcccctcaggaagagtctcagctgacctggacaggatttgcacacggtgagggctttgaggacggcgaattctggaaggacgagcccagcgatgaggccccaatggaactgggcctgaaagagccagaagaaggcaccctgacattcccggcccagtccttatctcctgaaccactgcctcaagaggaggaaaagctcccccctcggaatacaaatccaggtattaagtgctttgccgtgagatctctggggtgggtggagatgacggaggaagaactggccccagggagaagttctgtggcggttaataattgtatacggcagctctcctatcacaagaacaatctccacgaccctatgtcgggagggtggggcgagggaaaagacttgctgctccagcttgaagatgagaccctaaagcttgtcgaaccacagtcacaagccctgctgcacgcacagcccataatctccataagggtgtggggggtcggacgagactcaggaagcaatcgggattttgcttacgttgctagagacaagttaacgcagatgctgaagtgccacgtattcagatgcgaagcgccagcaaaaaacattgcgacatcccttcacgagatctgctcaaagatcatggcagaaaggcgaaatgcacggtgtctagtgaatggattgtccttggaccattcaaaactcgtcgacgtgcccttccaggtcgagtttccggcaccaaaaaacgaactggttcagaagttccaggtgtactatctagggaatgttcctgtagcaaagccagtgggagtggacgttatcaatggtgccctggaatcagtgcttagcagtagtagcagggagcagtggacgccttctcacgtgtccgtagcacccgccactctcacaatcctgcaccagcagacagaagctgtccttggggaatgcagagtgcggttcttgtcgtttctggccgtgggccgcgatgtgcacacttttgcctttatcatggctgctggcccagcctctttctgttgccacatgttttggtgcgaacccaatgctgctagcttatcagaggcagtgcaggcggcttgtatgctaaggtaccaaaaatgtctggatgctaggagccaggctagcacaagctgcctccctgccccccctgccgaaagcgtggcaaggagggttggctggactgtacgtaggggggtgcaatccctgtggggttctctgaagcccaaaaggctcggcgcccacaccccgtag

SEQ ID NO: 178894 - DNA, 2277 bp, Artificial Sequence
  Description of Artificial Sequence: Synthetic coding sequence
atgagcgaggtgctgcccgccgacagcggcgtggacaccctggccgtgttcatggccagcagcgggactacagatgtgaccaacaggaactcccccgccactcccccaaataccctgaacctccgcagcagccataacgagctgctaaacgccgagatcaagcacacggaaacaaagaactcaactccccctaagtgccgtaagaaatatgcattaaccaatattcaggctgctatgggactgtctgatccagcagctcagcccctgcttgggaatgggtccgccaatatcaagctggtgaaaaacggagaaaaccagcttcggaaggctgcagagcagggccagcaagacccaaataagaaccttagtccaactgccgttatcaatattacttcggagaaactggaaggcaaggaaccgcatccacaagactcttccagttgcgagatacttcccagccaaccccggcggacgaagtcctttttgaattattacgccgatctggagacttctgcccgcgagctggagcagaatcgcggtaaccaccatgggacagctgaagaaaaaagtcaaccagttcaaggtcaagccagcaccattatcggaaacggagacctgctgcttcagaagccgaataggccccagtcatcacccgaagatggacaggtcgcgacagtatcaagtagcccagagacaaagaaagaccacccaaaaaccggagcaaaaacagactgtgcactgcacagaatccagaacttagcaccttctgatgaagagtcttcttggaccacacttagccaggacagcgcatctccttctagcccggacgaaacagacatctggagtgaccactctttccagaccgatcctgaccttccccccggttggaaaagagtttcagatatcgctggcacatactattggcacatccccaccggtaccactcagtgggagcgacctgtcagtattcccgctgacttacaggggtcccgaaagggctccctgagctctgtaacacctagtcccacccccgaaaatgaaaagcagccctggtctgacttcgccgtcctgaacggtggcaaaatcaattccgatatttggaaggacctccatgccgccacagtcaacccggacccatctctgaaggagtttgaaggcgcaaccttacgctacgcaagcctgaagctccgcaacgccccccaccccgacgacgacgattcatgttctatcaacagtgaccccgaagcgaagtgtttcgccgtacggagtctcgggtgggtggaaatggctgaagaagatttggctcccggaaagtccagtgtggccgtcaacaactgtatcagacagttgagctactgtaagaatgacattagggacacagtcggtatctggggcgaaggaaaggatatgtatcttatcctggaaaacgacatgctgtctcttgttgaccctatggaccggtcagtcctgcacagtcagcccatcgttagtatacgcgtctggggggtgggccgcgataatggacgtgatttcgcttatgtggcacgggacaaagatactaggattctgaagtgtcatgtctttcggtgtgacacgcctgccaaagccattgcaacctcattacatgagatttgttctaagattatggctgaacgcaaaaacgccaaggccttagcgtgttcgtcactgcaagagcgcgccaacgtgaatctagacgtcccactacaggtggatttcccgacaccaaaaacagagttagttcagaaatttcacgtgcagtatctgggaatgctgccagtagacaaaccagtggggatggatattcttaactcggctatcgagaaccttatgacgtctagcaacaaagaggattggcttagtgtgaacatgaacgttgctgacgctacagtaactgtcatctcagaaaagaatgaagaggaggtgctggtcgagtgtcgtgtgaggttccttagttttatgggggttggtaaagatgttcacaccttcgcctttattatggacacaggaaatcagagattcgagtgccatgtgttttggtgtgaacctaacgccgggaacgtctccgaagccgtgcaggctgcctgtatgctgcggtatcagaagtgtctggtggctagacccccaagccagaaagtgcgccccccacctccccccgcggactctgtgactcgcagggtgaccactaacgttaaacgcggtgtcttgagcctgatcgatacactgaaacagaaacggcctgtcacagagatgccgtag

SEQ ID NO: 178895 - DNA, 2274 bp, Artificial Sequence
  Description of Artificial Sequence: Synthetic coding sequence
agccactgcatccccgccgacagcggcgtggacaccctggccgtgtttatggcttcatccggaaccacagacgtcactaaccggaacagccccgcgactcctccaaatacactgaatctccgctcgtcccataacgaactgcttaatgctgagattaagcacaccgagaccaaaaattctacacctcccaagtgccgcaaaaagtatgcgcttacaaatatccaagcggccatgggcttatccgatcctgccgcccagcctcttctgggcaacggaagcgctaacataaaactggtaaaaaacggagagaatcaactgcggaaggcagccgaacagggccagcaagacccaaataagaatctcagtccgaccgctgtaattaatattaccagcgaaaaactggaaggcaaggagcctcaccctcaagatagctccagttgcgaaatactccccagccagccccggcgtacgaaaagctttcttaactattatgccgatttggaaaccagtgcccgagaactggaacagaaccggggtaatcaccacggcacagcagaagagaagagccagccagttcagggccaggccagcactattattggtaatggtgatttgctgttgcaaaagccaaatcgaccacagtcgagtccggaagatgggcaagtggcaaccgtcagttcctcacccgagaccaagaaagaccacccgaagacaggggccaaaacggattgcgctctgcatcggattcagaatcttgccccgtccgatgaggaatctagctggactactttgtcacaggattccgcgagcccctcttcaccggacgaaaccgatatttggagcgatcactctttccaaacggatccagacctcccacccggctggaaacgggtgtccgatatcgctggtacatattattggcacatcccaacaggcaccacacagtgggagcgcccagtttccatccctgcggacctacagggatccagaaagggtagtctatctagcgttacacctagcccaacccctgagaatgaaaagcagccatggagtgactttgcagtactcaatggcgggaaaatcaactccgatatctggaaggacctccacgcagcaaccgtgaatcccgacccttcactgaaggagttcgagggcgccacattgcgttatgcctcacttaagctccggaacgccccccaccccgacgacgatgattcttgttcaattaattctgaccctgaagctaagtgtttcgccgtgagatctctggggtgggtcgaaatggccgaggaggacctggcccccgggaagtcttccgtcgccgttaacaactgcataaggcagttgagttattgcaagaatgatatccgggatactgttggaatctggggagaaggtaaggacatgtatctcattctcgaaaatgacatgctgagtctggttgacccaatggaccggagtgtcttacatagccaaccaatcgtctcaatcagggtgtggggtgtggggagagataacggtcgggattttgcctatgtggcccgggataaagacacacgcatactgaagtgtcacgtgtttcgctgtgatactcctgcaaaagcgatcgccacgtccctacacgaaatttgcagtaaaataatggccgagcggaaaaatgccaaggctctggcctgttctagcctccaggaacgtgcaaacgtgaatctcgatgtgccactccaagtcgatttccccacccccaagactgagctggttcaaaagttccatgtgcagtacctgggcatgctccctgtggacaagcctgttggcatggacatcctcaacagcgcaatcgaaaacctgatgaccagcagcaataaagaggactggctcagcgttaacatgaacgtagccgatgcaactgtgacggtgatttctgaaaagaatgaggaagaggtcctcgtggagtgtagagtacgattcctgtccttcatgggcgtgggtaaagacgtccacacttttgcctttattatggacaccggcaatcagcgcttcgaatgccatgtcttttggtgtgagcctaatgcaggcaatgtgagtgaagctgtgcaagctgcctgcatgttgaggtatcagaagtgtctggtagcccgacctccctcacagaaggtgcgccctccccctccacctgctgatagtgtgacccgtcgtgtcaccactaacgtgaagcgcggtgtcctctctctcattgataccctaaaacagaagaggccagttactgagatgccctag

SEQ ID NO: 178896 - DNA, 633 bp, Artificial Sequence
  Description of Artificial Sequence: Synthetic coding sequence
atggccgagcggaagaacgccaaggccctggcctgcagcagcctgcaggagcgcgcaaacgtgaacctcgatgtgcccctccaggtggacttcccgacgccaaaaacggagctcgttcagaagttccacgtgcagtatctcggcatgctcccggttgataagcctgtgggaatggacattctaaacagtgccatagagaacctgatgactagcagcaacaaggaagactggctctccgttaacatgaacgtggctgatgcaacagtaaccgtgattagcgagaagaatgaggaagaggtgctggtggaatgtcgggtgcgtttcttatcctttatgggagtcggaaaggatgttcataccttcgctttcatcatggatacagggaaccaacggttcgaatgccacgtgttctggtgcgaaccaaacgctggtaacgttagcgaggccgttcaagcagcttgcatgctgaggtaccagaaatgcttggtggcccggcccccgtcacagaaggtgcggcctcctcccccgccagcagacagtgtgacccggagggtcactaccaacgttaagcggggtgttctcagtctgatcgacacccttaagcagaagcggcccgtcacagagatgccatag

SEQ ID NO: 178897 - DNA, 33 bp, Artificial Sequence; identical to SEQ ID NO: 72703
  Description of Artificial Sequence: Synthetic coding sequence

SEQ ID NO: 178898 - DNA, 633 bp, Artificial Sequence
  Description of Artificial Sequence: Synthetic coding sequence
atggccgagcggaagaacgccaaggccctggcctgcagcagcctgcaggaacgcgcaaatgttaatttagacgtgcccttgcaggtggacttccccacaccgaaaactgaattggtgcagaagttccacgttcagtacctgggaatgcttccagtagacaagcccgtcgggatggacatcctgaattctgccatcgaaaatttaatgacatcttcaaataaggaagactggcttagcgtgaatatgaacgtagcagatgctactgtgaccgtaatttcggaaaagaacgaggaggaagtgctggtggagtgccgggtccgttttctgtccttcatgggagtgggcaaagacgtgcatacatttgcgtttattatggatactggcaaccagcgcttcgagtgccacgtcttctggtgtgaacccaacgctggaaacgtctcagaggcagtgcaagcggcttgtatgctgagataccagaaatgtctcgttgcacgccctccctcccagaaggtcagaccaccaccgccacccgcagactcggttacccgtagagtgactacaaacgtcaaaagaggggttctctctctgatagacactcttaagcaaaagagacccgtgactgaaatgccctag

SEQ ID NO: 178899 - DNA, 2214 bp, Artificial Sequence
  Description of Artificial Sequence: Synthetic coding sequence
atgagcgaggtgctgcccgccgacagcggcgtggacaccctggccgtctttatggcctcctcagggaccaccgacgtcacgaaccgtaactcgcccgccactccacccaatactctaaatctgaggagtagtcacaacgaactgctgaatgctgagatcaagcatacggaaaccaaaaatagcacgccaccaaaatgcaggaaaaagtatgctctgaccaatattcaggcagccatgggactctctgatcccgccgcgcagccccttctgggaaatggaagcgccaacatcaagctagtgaagaacggcgaaaaccagttaaggaaggctgcagagcaaggacaacaggatcctaataagaatctcagtccgaccgcagtgattaacattaccagtgaaaaactagagggtaaggaaccacacccacaggatagctcctcatgcgaaattctcccctcacagcctcgcagaacgaagagcttcttgaactattacgccgatctcgaaacgtcagctagggagctggagcagaaccggggcaaccaccatggcaccgcagaggaaaaaagtcagcctgttcaggggcaggcgagtactatcatcggaaatggcgacctgttgttgcaaaagcctaataggcctcagtcaagccctgaagatgggcaggtggccaccgtcagttcctctcctgagactaaaaaagatcatcctaaaacaggagctaaaaccgactgtgcgttgcatcgtattcaaaatctggcaccctccgacgaggaaagttcttggacaactctgtcccaagacagcgctagcccaagctcacctgatgaaacagatatctggtccgatcattccttccagacagatccagacttacccccaggctggaaacgcgtgtctgatatagccgggacatactactggcacattccaacagggacgactcagtgggaacgacccgtcagtatacctgccgacctccaggggagccggaagggcagtcttagtagcgtcaccccctcacccactccagaaaatgaagacctgcacgccgcgacagtgaaccccgaccccagcttgaaggagtttgaaggcgctactctccgatacgcttcactcaagctgagaaacgcacctcatccggacgacgacgatagctgctccattaatagcgacccagaagcaaaatgtttcgcagtgcggtccctcgggtgggttgaaatggcggaggaagatctggctccaggcaaatcctcagtggcagtaaataactgcatccgacagttgagctattgtaaaaacgatattcgcgataccgtgggcatttggggcgagggcaaggatatgtatttgatcttagagaatgacatgctatctctagttgatccgatggaccggtctgtcctgcacagtcagccaatcgtctcaattcgcgtgtggggggtggggcgagacaatggaagggacttcgcctatgtcgcccgagataaagatactcgcattctcaaatgccacgtgtttaggtgcgacacgcccgccaaggcgatcgctacttccttgcacgaaatatgcagcaaaataatggctgagcggaaaaatgccaaggcccttgcttgttctagcctacaggagcgtgctaacgtaaacttggacgtcccattgcaggtggattttccaactcctaagaccgagctcgtgcagaagttccacgttcaatatctgggaatgctgcctgtcgataaacctgtggggatggatatactcaactcagccatcgagaatcttatgacgtcttccaacaaggaggattggttgagcgtgaacatgaacgtagcggacgcaaccgttactgttataagcgagaaaaatgaggaggaagtgctcgtcgaatgtcgggtgcgcttcctcagttttatgggcgtcggcaaggacgtgcatacattcgctttcattatggacactggcaaccagcggttcgagtgccacgtgttttggtgcgaacctaatgctggtaatgtcagcgaggccgtccaagccgcatgtatgctgcggtatcaaaaatgcctggtcgctcgtccaccatcacagaaagtcagaccacccccaccgcctgccgattccgtgacccggcgggtaaccactaatgtgaagcgcggggtgctctcactcatcgacacactgaaacagaagcggcctgtgactgagatgccttag

SEQ ID NO: 178900 - DNA, 2280 bp, Artificial Sequence
  Description of Artificial Sequence: Synthetic coding sequence
atgagcgaggtgctgcccgccgacagcggcgtggacaccctggccgtcttcatggctagctccggaaccacggacgtaacaaacaggaattcgcctgcaacacccccaaataccttgaatctgcgttcttcccacaacgaactactcaacgcggagatcaagcatactgagacaaagaacagcaccccacccaagtgcagaaagaagtatgctttaaccaacattcaagcggccatggggctgagcgatcctgccgcacagcctctgctgggcaacggaagcgccaatatcaagctggtcaagaacggtgaaaatcagctgagaaaggccgccgagcaggggcagcaggacccaaataaaaatctcagccctacggcagttatcaacataacatctgagaagctggaggggaaggagccgcatccccaggactcttcgtcctgtgagattctcccctcgcagcccaggagaacgaagagtttcctgaactactacgcagacctcgaaacttccgcacgcgagctcgagcagaatcgcggcaaccaccacggcacagccgaagagaagtcacaacccgtacaggggcaagcgtcaaccattattggcaacggtgacctgttgttgcagaagccgaatcggccacagagcagtccggaagatgggcaggtggctactgtgagtagttccccagaaactaagaaagaccacccaaagactggggctaagactgattgtgctctgcatagaatacagaacctggccccatctgacgaagaatcatcttggaccactttgtcacaagatagcgcaagccctagttcaccagacgaaacggccgacatttggagtgatcattctttccagacagaccctgacctcccgcctggctggaaacgagtgagcgatatcgcgggtacctactattggcacatccccacgggcacaactcagtgggaacgcccggtgtctatccccgcggacctacaaggcagcaggaaaggttccttgtcctcggtgacccccagcccaacccctgaaaatgaaaaacaaccctggtcggatttcgctgtgctcaatggggggaagataaactctgatatttggaaggatcttcatgcagctactgtcaacccagatccctccctgaaggaatttgaaggcgccacattaaggtatgcgtctctgaaactgcggaacgccccgcacccagatgacgatgatagctgtagtatcaatagcgacccggaggctaaatgcttcgcagttcgatcactgggctgggtcgagatggccgaggaggaccttgctccgggaaaatcatctgttgctgtcaataactgtatcaggcaactgagttattgcaagaatgatattagagacaccgtgggtatctggggagagggcaaagacatgtaccttattctcgagaacgatatgctgagtctcgtggatcccatggaccggagtgtgctccattctcagccaattgtgtccattagagtctggggggtgggccgggataatggtagggactttgcttacgtcgctagggacaaagataccagaatcttgaagtgtcacgtgtttcgctgtgatacacctgcgaaagcaatcgccactagccttcatgagatctgctctaagattatggctgaacgcaaaaatgcaaaggcgcttgcctgttcatctctccaggagcgggccaatgtgaacttggatgtcccactccaagttgactttccaacccctaagaccgagttagtccaaaaatttcacgttcagtatctaggcatgctgcccgtcgacaaacccgtgggcatggacatactgaattctgccattgaaaacctcatgacatcctcaaacaaggaggactggctcagcgttaatatgaacgtggccgatgccactgtgaccgtgatatccgaaaagaacgaggaggaagttctggtggaatgcagggtgagattcctcagttttatgggtgtgggaaaagatgtgcatacattcgcattcatcatggacaccggcaaccagaggttcgagtgtcacgtgttctggtgtgagcccaatgctggcaacgtaagtgaggctgtgcaggctgcctgtatgttgcggtaccagaagtgtctggtggccaggccaccctcgcagaaagtgaggccaccccctccgcctgctgactctgtcacaagacgagtaaccacaaatgtcaagcggggagtcctttcactaatcgacacactgaagcagaaacgacctgtgacagagatgccatag

SEQ ID NO: 178901 - DNA, 84 bp, Artificial Sequence
  Description of Artificial Sequence: Synthetic coding sequence
atgagcgaggtgctgcccgccgacagcggcgtggacaccctggccgtgttcatggcctcgagcggtacaacagatgtgacctag

SEQ ID NO: 178902 - DNA, 207 bp, Artificial Sequence
  Description of Artificial Sequence: Synthetic coding sequence
atgagcgaggtgctgcccgccgacagcggcgtggacaccctggccgtttttatggcctcctcagggaccactgacgtgactaacaggaactcccccgcaacacccccaaataccctcaacttgcgttcttcccacaacgagttgttgaacgctgaaatcaaacacacagaaaccaagaactcaacgcctccaaagtgcaggaaatag

SEQ ID NO: 178903 - DNA, 2211 bp, Artificial Sequence
  Description of Artificial Sequence: Synthetic coding sequence
atgagcgaggtgctgcccgccgacagcggcgtggacaccctggccgtgttcatggccagtagcggaacaaccgatgtgacaaatcggaattcccccgcgacccctcccaacacgctcaatttacgaagttctcacaatgagctcctgaacgcagagattaaacatacagaaaccaaaaatagcaccccccccaagtgccggaagaagtatgccctgactaacattcaggcagccatgggactctctgaccctgccgcccagccccttctgggcaacggtagcgccaacataaagctggttaaaaacggagaaaaccagctgaggaaggcagccgagcagggtcaacaggaccctaacaagaacttgtcaccaaccgcggtaattaatatcactagcgagaagctcgagggcaaggagccgcaccctcaggattccagcagttgcgagatcctaccctctcagccaagaagaaccaagtcattcttgaactactatgcagatctcgaaaccagcgcacgcgagcttgagcaaaaccggggcaatcatcacggtacagctgaggaaaaatcccaacccgtccaggggcaggcaagtactattatagggaacggtgacctcctgctgcagaagccgaacaggccacaatcctcacccgaagatggacaggttgccactgttagcagttccccagagaccaagaaggatcaccctaagacgggcgccaagaccgactgtgcactgcacaggatccagaacctggccccaagtgacgaggagagctcatggacaactctctcacaagatagcgcgtcaccctcctctcccgacgagacggacatttggtctgaccacagctttcagaccgatccggacctgcctcccggctggaaaagagtgagtgacatcgccggcacttactactggcatatccccacgggaacaacgcaatgggagaggcctgtcagcatcccggctgacctgcagggaagccgaaaaggatcgttgtcgtcagtgaccccttctccgacacctgaaaacgaagatctgcatgcagctaccgttaatccagatccgagtctgaaggagtttgagggggcgacactgcggtatgcaagcttaaagctgcgcaatgccccacaccctgatgacgatgactcatgctctattaacagtgaccctgaagctaagtgctttgccgtgagatctctagggtgggtggagatggctgaagaagatctggctcccggaaaaagttctgtggcagtgaataactgcattcgccagttgagctattgcaagaatgatatcagagacactgttggtatatggggagaggggaaggacatgtatctcattctggaaaacgacatgctgtccctcgtggaccctatggatcgctctgttctgcatagtcagcctattgtgtctattagggtatggggggtgggccgggacaacggccgggactttgcgtacgtggcacgggataaggacacccgcattctgaaatgccatgtgtttagatgcgatacacccgcaaaggctattgcaacttccttgcatgagatatgcagcaaaataatggccgagagaaagaatgccaaggctctggcatgctcgtctttacaggagagagctaacgtgaatcttgacgttccactgcaggactttcccactcctaaaaccgaattggtgcagaaattccatgttcagtatctgggtatgctgcccgtggacaagccagtcggcatggatatccttaacagtgccatagagaatctgatgactagtagcaataaagaggattggttaagtgtgaatatgaacgttgcggatgcaactgttactgtgatttcggagaagaatgaagaagaagttcttgtggagtgtagagtacgctttctaagttttatgggagtgggtaaagatgtgcatacatttgcttttatcatggacaccggcaatcaaagattcgagtgtcacgtgttctggtgtgaaccaaacgcaggcaacgtcagtgaggccgtacaggccgcgtgcatgctgaggtatcagaagtgtctggtcgcgagacccccctcgcagaaagtgcggcctccacctccaccagcagactcagtgacccgacgcgtgaccaccaacgtgaaacggggggtgttgtcactcattgatactctgaagcagaaaagacccgtgaccgagatgccttag

SEQ ID NO: 178904 - DNA, 2187 bp, Artificial Sequence
  Description of Artificial Sequence: Synthetic coding sequence
tgagacaccctggccgtgttcatggccagcagcggcaccaccgacgtgaccaacagaaattcccctgccaccccgccaaacaccttgaatttacggagctctcacaacgagctgttaaacgccgaaatcaagcatacggaaaccaagaatagcactccgccgaagtgtagaaaaaagtatgctctgactaatatccaggccgccatggggctgagcgatcctgcagcccagccactcctcggtaacgggagcgcgaacattaagttagttaagaatggggagaatcagctgcggaaggccgctgaacaggggcagcaagatcctaacaagaacctgagcccaaccgccgttattaacataacctccgagaaactcgagggaaaagagccacatccccaggactctagctcatgtgagatcttgcctagccagccaaggcggaccaagagcttcctcaattattatgccgaccttgagaccagcgctagagagctcgaacaaaaccggggcaaccaccacggcactgccgaggagaaaagtcagcccgtacaggggcaggcctccaccataattggtaatggagacttactcctgcaaaagccaaacagaccacagagcagtcccgaagacggccaggtggcaacggtgtccagtagtcctgaaaccaagaaagatcaccccaagacaggtgccaagaccgactgcgcccttcacaggattcaaaacctggctccttctgatgaagaatcgtcctggacgaccctgtcacaggacagtgcctcaccctcgtccccggatgaaaccgccgatatatggagtgatcacagttttcagacagacccagacctgccccctggatggaagagggtgagtgatatagccggaacatattactggcacatccccactggtacgacccagtgggaacgtccagtcagtatcccagccgatctgcagggaagtcgcaagggctcactctccagcgtgacacctagccccacccctgaaaatgaggatctacatgctgcaactgtgaatcctgacccgtctttaaaggagtttgagggagcaaccctgcgctacgccagcttgaaacttcgtaatgcacctcaccctgacgatgatgatagctgtagtattaacagcgaccctgaggctaagtgctttgccgtacgttcactggggtgggtggaaatggccgaagaggacttggcccccggtaaaagcagtgtggctgtgaataattgcatccgccagctgagttattgcaagaatgacatccgggacaccgtcggcatctggggagaaggcaaagacatgtacctgatcttggagaatgacatgttatccttggtcgaccctatggatcggagcgttttgcactcccagcccatcgtgagcattagagtctggggtgtcggtagagacaacggcagagactttgcttacgtcgctcgcgacaaagacacccggatactgaagtgccacgtatttcgatgcgacacccccgctaaagctatagccacgagcctgcatgagatatgtagcaaaataatggctgagagaaagaatgctaaagctctagcttgtagctcgttgcaggagagggctaacgttaatttggacgtgccgctacaggttgactttcctacccctaagaccgaactcgtacaaaagtttcatgtgcagtatttgggaatgctgcctgtggacaagcctgtggggatggacattctcaactccgccatcgaaaatctcatgacgtcttctaacaaggaggactggctgtctgtcaacatgaatgttgcagatgccacagtgaccgtaatcagcgaaaaaaatgaggaggaagtgcttgtagaatgcagggtgagattcctaagtttcatgggggtcgggaaagatgtccacacctttgcatttatcatggacaccggtaaccagcgatttgaatgtcatgtcttttggtgtgagcctaatgccgggaatgtctctgaagccgtgcaggcagcctgtatgttgcgttatcaaaaatgccttgtggccaggcctccgtcacagaaggtccggccacctcccccacccgcagactcagtgacaagacgggtcactaccaacgttaagcgaggggtgctgtcattgatagatactctgaagcagaaacggcccgtgactgaaatgccttag

SEQ ID NO: 178905 - DNA, 633 bp, Artificial Sequence
  Description of Artificial Sequence: Synthetic coding sequence
atggccgagcggaagaacgccaaggccctggcctgcagcagcctgcaggaacgggcgaatgtcaacttggacgtcccgctccaggtggattttcccacaccaaaaacggaactcgtgcagaagttccacgtgcaatatttgggcatgctgccggttgacaagcccgttggcatggacatcctgaacagcgctattgaaaacttgatgacgagctctaacaaggaagactggttgtcagttaacatgaatgtagcagatgcaactgtcactgtgatcagcgaaaaaaatgaagaagaagttctagtggaatgcagggtcaggttcctctcgttcatgggagtgggtaaagacgtgcatacttttgcattcatcatggacacaggtaatcagcgcttcgaatgccacgtgttttggtgcgagcctaacgccggtaatgtttcagaggcagtccaggcggcctgtatgctccgctatcagaagtgtctcgtcgcccgcccaccgtcgcagaaggtgaggcctccccccccaccggcagattctgttacccgtagggtgactactaatgtcaaaagaggggtgcttagcttgatcgacactctaaagcagaaacgccctgtgactgagatgccctag

SEQ ID NO: 178906 - DNA, 1476 bp, Artificial Sequence
  Description of Artificial Sequence: Synthetic coding sequence
atgctgggcaaggactacatgctggccatcatcctggtgaactgcgatgatgacctttggggtgaccactcgctagaggtggaagcaggcttgcctcctggttggcggaagatccacgacgcagctggtacctattactggcacgtacctagcggcagcacgcagtggcagcggccgacatgggagttgggcgatgcggaggatccgggtactggaactgaaggtatctggggcctcagaccacctaaagggcggtcattttccagcctggagtcctctctcgatcgatccaatagcttatcatggtatggcggtgaaagttacattcaatctatggaaccaggcgcgaagtgtttcgccgtacggtcactggggtgggtcgaggtgcctgaagaggaccttgcacccgggaaaagttctatcgccgttaacaactgcattcagcagctggcacaaacccgctctaggtcgcaaccccccgacggagcttggggcgaaggccagaatatgttaatgatccttaaaaaagacgccatgtccctggtgaatcctttagaccacagtctgatccattgtcagcccctggtgcacatccgggtgtggggagtgggatcgagcaagggaagacctatatccgcccctgcccgagatttcgcctttgtcgcaagtgataaggactcttgcatgctcaagtgtcacgttttttgttgtgatgtgcctgcgaaagccattgctagcgccctgcatgggctctgcgctcaaatactcagcgaacgggtggaggtgagcggggacgcttcttgttgcagtcccgatcccatctcaccagaggacttgcccaggcaggtcgaacttctggacgccgtgtcacaggctgcacagaagtatgaggctttgtatatgggcactctgcccgttacaaaggccatgggaatggacgtactaaatgaggccataggtaccctgacggcccgcggcgatcgcaatgcctgggtgccaacaatgctttcagtgtcagatagtctgatgactgcccaccccatacaggccgaggcaagtaccgaggaagaacctctgtggcagtgtccggtgcggctggtgacatttataggcgtcggaagagatccacacacattcggtctgattgctgacctgggccgccaatcatttcagtgcgccgccttttggtgtcagccacacgctggcggcctatccgaggctgtgcaagccgcttgcatggttcaataccagaagtgcctggtagccagcgctgcgcgggggaaagcctggggagctcaggcgcgggctaggttaaggctcaagagaacgtcaagcatggactctcctggaggcccacttccgcttcctctgttgaaggggggagtgggtggggccggggcaacccctcgtaagcgcggagtgttttcattcctcgacgcgttcagacttaaaccctccctgttacacatgccttag

SEQ ID NO: 178907 - DNA, 1461 bp, Artificial Sequence
  Description of Artificial Sequence: Synthetic coding sequence
atgctgggcaaggactacatgctggccatcatcctggtgaactgcgacgacgatttgtggggagatcactccctggaggtagaggctggtttaccgcctggatggcgtaagattcatgatgctgctggtacctactactggcacgtgccctctggttccacccagtggcagcggccaacttgggaattaggcgacgccgaagaccccggcaccgggactgaaggcatttggggactgcggcctccgaagggaagaagtttttcaagtctagagtcttctcttgatagatctaactcactgtcctggtacggtggggagagctacatccaaagcatggaacccggggccaaatgcttcgccgtcagatccctaggctgggtcgaagtccctgaggaagatctggccccgggaaagtcttctatcgctgtgaacaattgtatccagcaactggcacaaacgcgcagcaggtcccagccccctgacggtgcatggggcgaagggcagaacatgcttatgatactcaagaaagatgcgatgagcctggtgaatccactcgaccactccctgatacactgtcagccactcgtgcatattagagtgtggggcgtgggtagcagtaagggaagagaccgggactttgccttcgtggccagtgataaagacagttgtatgctgaaatgccacgtgttttgctgtgatgtcccagccaaagcaatcgcatctgcccttcatgggctgtgtgcacagatacttagcgaacgggtggaagtgtccggcgatgcatcttgttgcagcccggacccaattagtcctgaggatctgccccggcaggtggagctcctcgacgctgtgtcccaggcagcacagaaatatgaagcgctttacatgggtaccctccctgtaactaaagctatggggatggatgtcctcaacgaggccatcggcaccttaaccgcccgcggggaccgcaacgcttgggtacctaccatgttgtctgtgtcggactctctgatgacagctcaccccattcaggctgaggcttctacggaggaggaacccttgtggcaatgtcccgtccgcctcgtaacatttatcggcgttggccgcgacccccacacttttggcttgatcgctgatctcggcaggcagtctttccagtgcgccgccttctggtgccagcctcacgctggaggactgagcgaagccgtccaggctgcttgcatggtgcagtaccaaaaatgtcttgtcgcttctgcagcccgaggaaaggcttggggcgcccaggcacgagcaaggctcaggctgaaaagaacctcttctatggatagccccggaggccccctccctctgcctcttctgaaagggggagttggtggcgccggtgctaccccaagaaaacggggagtgtttagctttctggatgcgtttaggctgaagcctagccttctacacatgccatag

SEQ ID NO: 178908 - DNA, 1020 bp, Artificial Sequence
  Description of Artificial Sequence: Synthetic coding sequence
atgctgggcaaggactacatgctggccatcatcctggtgaactgcgacgatgatctctggggtgaccactcgctggaggtagaggctggactccctcctgggtggcggaagatccacgacgctgccggaacatactattggcacgtcccttccgggtcaactcagtggcagagaccaacgtgggaattgggggatgcggaagaccccgggacaggaacggaaggaatatgggggctcagacctccaaaaggaaggtcattcagttcactggagagcagcttggaccgttccaattctctgagttggtacgggggggagagttatattcagtctatggagccgggagccaagtgttttgctgtccgctctctgggctgggtggaggttcctgaggaagacctggccccgggaaagagctctatcgccgttaataattgcattcaacagctcgcgcagacgaggtctagatctcagcctcctgacggagcctggggcgaaggacagaatatgctcatgatacttaaaaaggacgccatgagtctagtgaatcctctcgatcacagtctgattcactgccagccacttgttcacatccgtgtgtggggtgtaggatctagtaagggccgtgacagagactttgcctttgtcgcctcagacaaggatagctgtatgctaaaatgtcacgtgttctgctgcgacgtcccagcaaaagctatagcctcagcactgcacgggctgtgcgcacaaattctttcagaacgggtggaagtttccggcgacgcctcatgttgctctccggacccaatcagtccggaggacctgccacgtcaggtggagctgctcgatgccgtgagtcaggcagcccaaaagtatgaagcactgtatatgggaactctgccggtaaccaaagccatggggcgaggccaataccgcggcggagcaattgtggccgtcccctgcgccccctgcgatatctactggtgctggcctaggccgacacatctctggcctcaccgatag

SEQ ID NO: 178909 - DNA, 1455 bp, Artificial Sequence
  Description of Artificial Sequence: Synthetic coding sequence
atgctgggcaaggactacatgctggccatcatcctggtgaactgcgatgatgacctttggggggatcactccttggaggtagaagcaggtctaccaccagggtggcggaagatccatgatgctgccggcacatactattggcacgtgcccagcggttccacccagtggcagaggcccacatgggagctgggcgacgctgaagatcccggaacgggcacggagggaatctgggggctgaggccacccaagggccggagtttctcaagtctagagagcagcctagaccgctctaacagtctttcatggtacgggggagagagctacatccaatctatggaaccaggggccaagtgtttcgcagtgcgttcgttaggatgggttgaagttcctgaggaggatcttgcccctggaaaatcctccatcgctgtgaacaactgcatccagcagttggcccaaaccagatctcgatctcagccgccggacggcgcctggggcgagggtcagaatatgcttatgattctgaagaaagatgcaatgtccctggtgaatccactggatcactctctcattcactgtcagcctctggtgcacatccgtgtgtggggagtggggtcctcgaaagggcgcgatttcgccttcgtcgccagcgataaagatagttgcatgttgaagtgccacgtgttctgttgtgatgtgcctgccaaggccatcgcctcggcactacacggactttgtgcccaaattctcagtgaacgtgttgaggtctcaggggacgcctcctgttgttcccccgaccccatttcaccggaggacctccctcgccaggtcgagctcttggacgccgtgtctcaagctgcacagaaatatgaggcactgtacatggggacgctgccagtgacaaaagccatgggcatggacgtgttgaacgaggcgattggtaccctcaccgccaggggggataggaatgcttgggtcccaacaatgctatcagtcagcgatagcctcatgacggcacaccctatacaagctgaagcctctactgaggaggagccactgtggcagtgccccgtgcggttggtaacatttattggtgtggggagggatccccacacattcggattaattgcggatctgggccgccagtcattccagtgcgccgcattctggtgtcaaccacacgccggaggtctgtctgaggctgtccaagccgcatgtatggtccagtaccagaaatgcctcgttgcctctgcggcacgcggtaaggcgtggggcgctcaagctcgggcccgcttacggctgaagcgcaccagcagtatggactctcctggcgggcctttgcccctcccgttactgaagggcggtgttggcggcgccggggccaccccaaggaagcggggagtgttttcattcctggacgcttttagacttaaaccttctcttctgcacatgccttag

SEQ ID NO: 178910 - DNA, 738 bp, Artificial Sequence
  Description of Artificial Sequence: Synthetic coding sequence
atgctgggcaaggactacatgctggccatcatcctggtgaactgcgacgatgatttatggggtgaccactcacttgaggtagaggcggggctgcctccaggctggcgcaaaattcatgatgccgctgggacctattactggcatgtgccatccggctcaactcagtggcagcgcccaacgtgggagttaggagacgcagaggaccccggaaccggcactgaggggatatggggcttaaggcctcccaagggcaggtccttttcctcccttgagagctcattagaccgatccaatagcttgagttggtatgggggcgagtcatacatacagagcatggagccaggcgcaaaatgcttcgccgtaaggagtctggggtgggtggaggtcccagaggaggatctggcccctggaaaaagcagcatcgcggtcaacaattgcattcagcaattggctcaaacgagatccagaagtcagccccccgatggagcctggggcgagggtcagaacatgctaatgatactcaagaaggatgccatgtctctggtcaatcccctcgatcactcactgattcactgccagccactggtccatatccgcgtctggggagtaggttcctctaaggggaggtctagtgacgtggatcccggcctgctgccactccccggcccagccctggtcggcgaaggcggaccctcaagtgcgggcaccgtttggggggaaagtgaacgactaggctag

SEQ ID NO: 178911 - DNA, 792 bp, Artificial Sequence
  Description of Artificial Sequence: Synthetic coding sequence
atgctgaagtgccacgtgttctgctgcgacgtgcccgccaaggccatcgcatccgctctccacggtttatgcgcccaaatcctctccgaaagagtcgaggtgagtggggatgctagttgctgctcacccgatcccatctcccccgaagatttacccagacaggtcgaattgctcgatgcagtctcccaggcggcccaaaaatacgaagccctttacatgggcacactccctgtcacaaaagcgatgggcatggacgtgctgaacgaggccattggaaccctgacagcacgcggagacaggaatgcctgggttcccacaatgctctccgtgagcgacagcctcatgaccgctcaccccatacaggccgaggcatccaccgaggaagagcctctctggcagtgcccagtgaggcttgtaaccttcattggcgttgggagggatccccacactttcggcttgatcgccgatctgggcaggcaatcctttcagtgcgcagccttttggtgccagccacacgccggtggactctcagaagcagtgcaggcagcttgcatggtacaataccagaaatgtctggtggcaagtgctgcgcgcgggaaagcctggggggcccaggcccgcgcaaggctgagactcaagcgtacatccagtatggattcaccaggcggccctctcccgctgccactcttaaagggtggggttggcggcgcaggggcgacccccagaaaaagaggggtattctctttcttggatgcctttcggcttaagccatcactgttacacatgccttag

SEQ ID NO: 178912 - DNA, 645 bp, Artificial Sequence
  Description of Artificial Sequence: Synthetic coding sequence
atgctgggcaaggactacatgctggccatcatcctggtgaactgcgatgacgatctgtggggcgaccacagtctggaagtggaagcaggcctccctccaggatggcggaagatccacgatgccgctggaacttattactggcacgtaccttctgggtctacacagtggcagagacccacatgggagctgggtgacgcagaggatcctggaaccggaacagagggcatctggggcctacgcccccccaaaggccggagcttctcctcacttgagagctccctcgaccgatcaaatagtctcagctggtatggaggtgaatcttatatccagagtatggagcctggagcaaaatgctttgccgtgcgtagtctgggctgggtcgaagtccccgaggaagatctggctcctggaaaatcctcaattgcagtgaacaattgcatacaacagttggctcagacccgttcaagaagccagcctcccgatggggcgtggggagaaggacagaatatgctaatgattttgaagaaagacgcaatgagtctagtcaatcctttggaccactctcttatacattgtcaaccacttgctgtgatcccaactgatgccgacccccagtaccttaacccgtggactcagattctttag

SEQ ID NO: 178913 - DNA, 378 bp, Artificial Sequence
  Description of Artificial Sequence: Synthetic coding sequence
atggagcccgacggcacctacgagcccggcttcgtgggcatccggttctgccaggagtgcaacaacatgttataccctaaagaggataaggaaaataggatcctcctctacgcttgccgaaattgcgattaccagcaagaagccgataactcatgcatttatgtgaataagatcacccacgaggtcgatgaactgacgcagataatcgcagacgtctctcaggacccaactctgccgagaaccgaggaccacccatgtcagaagtgtggccacaaggaagcggttttcttccagtcccatagcgcacgggcagaggatgcaatgcggctgtattatgtgtgtaccgcgcctcactgcggccacagatggaccgagtag

SEQ ID NO: 178914 - DNA, 1836 bp, Artificial Sequence
  Description of Artificial Sequence: Synthetic coding sequence
atgctggccagcctggagaaggacaagaccgcccccggcagcgcccaggttgccgggctttgtggcagactcactcttcatcgagatctacgcactgggcgatgggagcctgaccctcaaagatcaaggcggtgcctgagggacccgcagagggttctcgagtactgccgccaaatgtaccctgaactgcagatagctcgggtcgaacaggctacacaagcgatcccaatggaacggtggtgtggcgggtcacgaagtggttcttgcgctcaccctcatcaccaggtcgtccccttcaggtgcctaccaggcgagtttgtatccgaggctctgcttgtgccggaggggtgcaggtttctgcaccaggagcgtatggaccaatgcgagtcgagcacaagaagacaccaggaggcccaggaagcctgttcttcacagggcctgatacttcatgggtcgggcatgctactaccttgtgggagcgaccggtttagaggtgtggagtacgtgtgctgtccacctccaggcacaccagaccccagcggcacggccgtgggagatcccagcacaagatcatggcccccgggaagccgggtggagggcgccgaagatgaggaagaagaagagtccttcccccaacctgttgacgattattttgtagagcccccgcaagcggaggaggaggaagagaccgtgcctcccccatcatctcatacccttgctgttgtgggaaaggttacgccaaccccaagaccaacagatggagtggacatttacttcggtatgccaggggagatctccgagcatgagggattcctgcgggctaagatggacctggaggagagaagaatgcgacagataaatgaggtgatgcgggagtgggccatggctgacaaccaatcaaagaatctgcccaaggccgatcgccaggcattaaatgaacactttcagagcatcctgcagacactggaggaacaggtgagcggagagaggcagcggctggtggagacccatgctacccgagttatcgccctgatcaatgatcagcgtcgcgcggcacttgaaggattcctggcggcactgcaagcggatcccccccaggctgaaagagtcctgttagctctgaggcggtatctgcgcgcggagcagaaagagcagcgacatactctgagacactatcagcacgtagccgcagtggatccagagaaagcccaacagatgcgatttcaggtgcacacccacttgcaggtaatcgaggagagggtaaaccagagcctcgggctgctggatcagaatccccatctcgctcaagagctaagacctcaaatccaagaactgctccattccgaacatctcggtccctcagaacttgaggccccagccccaggtgggagcagcgaggataaaggtggattacaacctcctgatagcaaagacgatactcccatgaccctgccaaagggaagcacagagcaagatgccgcttcacctgaaaaagaaaagatgaatcctttggaacaatatgagagaaaggtgaacgcgagcgtgcccaggggcttccctttccacagctccgagattcaacgcgacgagttggctccagctggcaccggagttagccgagaggcggttagcggcctgctgatcatgggagctggaggtggtagcttgattgtcctttcaatgctgttgctgcgccggaaaaagccatatggtgcgatctcacatggtgtggtggaggtggatccaatgctgacgcttgaggagcagcagctgagagagctgcagaggcacggatacgaaaatccgacttacagattcctggaggaaaggccctag

SEQ ID NO: 178915 - DNA, 2292 bp, Artificial Sequence
  Description of Artificial Sequence: Synthetic coding sequence
atggccgccaccggcaccgccgccgccgccgccaccggccggctgctcttgctactgttagttggtctgacagcacctgctcttgcactcgctggttatatcgaggcccttgccgctaacgcaggaacaggattcgctgtggcagaaccccagattgccatgttctgcggaaagctcaatatgcatgtcaatattcagacaggcaaatgggaacctgacccaaccggcaccaagtcttgcttcgagactaaggaggaagtcctccaatactgtcaagagatgtacccagagctgcagattaccaatgtcatggaggctaatcagcgggtgtctatcgataactggtgccggagagacaaaaaacagtgcaaaagtcgtttcgtaaccccattcaagtgcctagtgggtgagttcgtgagtgacgtgcttttggtacccgagaaatgccagtttttccacaaggagcgaatggaggtgtgtgagaaccaccagcactggcataccgtggtgaaggaggcctgcctgacacaaggcatgacgctttactcatacggcatgttgctgccatgtggagtggatcaatttcatgggactgaatacgtgtgttgcccgcaaaccaaaattataggctccgtgtccaaggaggaggaagaggaggacgaagaggaggaggaagaggaggacgaggaagaggactacgatgtgtacaagtcagagttccctactgaagcagatctggaggactttactgaggcagccgttgacgaggatgatgaagacgaggaagagggcgaggaggtcgtcgaagaccgcgattattattacgatacctttaaaggcgatgactataacgaggagaacccaaccgaacccgggtctgacgggaccatgagcgataaggagataactcatgacgtgaaggccgtctgttcacaagaggcaatgacgggcccatgtcgagcggtgatgcctagatggtacttcgacttgtcaaaaggaaaatgtgtgcggttcatatacggtggctgcggcgggaatcggaataactttgagtccgaggactattgcatggccgtgtgtaaagccatgattcccccaacccctttacctaccaacgacgtcgacgtctacttcgagacctcagctgatgacaatgaacacgccaggtttcagaaggccaaggagcagctggaaattcggcaccggaataggatggaccgcgtcaagaaggaatgggaggaagccgagttgcaggctaagaatctgccaaaagctgagcgacaaactctaatccaacatttccaggcgatggtaaaggcgcttgagaaagaagccgcctcagagaaacagcagcttgtcgagacacacctggcaagggtcgaggccatgttaaatgataggcggagaatggctttagagaactacctggccgctttgcagagcgaccctccaagaccacaccggatcctgcaggccctccgccgctatgtgagagccgaaaacaaggataggctgcatacaataagacattaccaacacgtgctggcggtggatcccgagaaggccgcccagatgaagtctcaggtgatgacacacctgcacgtgatcgaagagcggcgcaatcagtcgctcagtcttctatataaagtgccatatgtggcacaggagattcaggaggagattgacgaactgctgcaggagcaacgcgcagatatggaccagttcacggccagcatcagcgaaaccccagtggacgtgcgggtgtcctcagaagaatcagaagaaatcccacccttccacccttttcaccccttcccagccctgccagagaacgaggatacccaaccagagctttatcacccgatgaaaaaaggctcaggtgtcggagagcaggacggcggtttgatcggggcagaggaaaaggtcataaactccaaaaacaaggttgacgagaacatggttatcgatgagacactggatgtgaaggagatgatcttcaatgcggagcgagtgggaggcctggaagaggagagggaatcagtcggaccgctgcgggaggactttagcctgagcagctctgctcttatcggccttctagtaattgcagtggcaattgctaccgtcattgtgatttcgctcgtaatgttgcgcaagcgccagtacggtacaattagccacgggatagtggaggtggacccaatgctcacacctgaggagcggcatctcaacaagatgcagaatcatggctacgagaaccctacctataagtacttggaacaaatgcaaatttag

SEQ ID NO: 178916 - DNA, 2286 bp, Artificial Sequence
  Description of Artificial Sequence: Synthetic coding sequence
atgctgcgggcccccggcgagctgccccggcaggccgcccggtgcagtctctgtcgcctcgggccgggccgaggtagggctttcttcaagtggagatgtctcccagcgtctgttgataggggtaatcccctgtgggccctggccgccaacgccggaacagggttcgcggtggctgaacctcagatcgccatgttctgcgggaagctcaatatgcacgtgaatattcagacagggaagtgggagccggatccaacaggcactaaatcctgttttgagacaaaagaggaggtgctccagtactgccaggagatgtacccggaactacagattacaaatgtcatggaggcaaaccaaagggtttctatagacaattggtgccgacgagacaaaaagcagtgcaaaagccggttcgtcactcctttcaagtgtcttgtcggagaatttgtgtctgacgttctgctggtacccgagaaatgccagttcttccacaaagagaggatggaagtttgtgagaatcaccagcactggcacactgtagttaaggaagcctgcttaacacagggcatgacattgtattcatacggcatgctactgccatgtggagttgatcaattccatggaactgaatatgtctgctgtcctcagacaaagattataggatcggtaagtaaggaggaggaggaagaagacgaggaggaggaagaggaggaggatgaagaagaggattacgatgtctataaatcagaattcccaaccgaagccgatctggaggacttcactgaggccgcagtggatgaggacgatgaggacgaggaagaaggcgaagaggtggtcgaagaccgcgattactactacgacacatttaaaggtgacgattataatgaagagaaccccaccgagcctgggagtgatggcactatgtctgacaaagaaatcactcacgacgtcaaggcggtctgctctcaagaagcgatgactgggccttgtagggctgtgatgccacggtggtattttgacctgtccaaaggaaagtgcgttcgcttcatttatggcgggtgcggtggaaacaggaataatttcgagtcggaggattactgcatggccgtgtgtaaggccatgatcccccctacccctctccctactaacgacgttgatgtgtactttgagactagcgccgatgataatgagcatgctcgtttccaaaaggcaaaggaacagctggagattcgccataggaatagaatggaccgcgtcaagaaggagtgggaagaagcagaactccaggccaaaaacctccccaaagctgaaagacagaccttgatccaacacttccaggctatggtgaaagcactggagaaagaagcagcgtcggaaaaacagcagctagtggaaacacatcttgcacgggtagaggctatgctgaacgatcgcagacgcatggccttagagaactatctggcggctctgcagagcgatcccccccgcccccatcgaatccttcaagcccttaggcgatacgtccgagctgagaataaagacagattgcatacaataaggcattatcagcacgtactagcagtagatcccgaaaaggccgcccaaatgaaaagccaggtgatgacccatctgcatgttatcgaggagaggaggaatcagtctctgagtctcctgtacaaagtaccttatgtagcccaagaaattcaggaggagatagacgagctgttacaggagcagcgcgcagatatggaccagttcaccgcttccatttctgagacgcctgtggacgtgcgcgtatctagtgaagaatcagaggaaattcctcccttccacccattccatccattccccgcacttccagaaaatgagggcagcggagtcggtgaacaggatggcggcctgattggggctgaagaaaaggtaatcaacagtaagaacaaggtggacgagaacatggtgatcgacgagacactagacgtgaaggaaatgatctttaacgcggagcgagtcggaggactcgaagaggagcgcgagagcgtgggcccattaagggaggatttttccctgtcctcttctgccctaatcggcctgctcgtgattgcggtcgctatagccaccgtcatcgtcatctcgctcgtaatgcttcgcaaacggcagtatggcaccatttcacacggcattgtggaagtggatcccatgctgacccccgaagagaggcacttaaataagatgcagaatcacggatatgaaaatccgacatataaatatctcgagcaaatgcagatctag

SEQ ID NO: 178917 - DNA, 2256 bp, Artificial Sequence
  Description of Artificial Sequence: Synthetic coding sequence
atggccgccaccggcaccgccgccgccgccgccaccggccggctgctcctgttgctgttagtaggcttaaccgctcctgctttagctttggctgggtacatagaagcactggctgccaatgcagggacaggatttgctgttgctgaacctcaaatagccatgttttgtggcaaactgaacatgcatgtgaacattcagactggtaaatgggagccggatcccactgggaccaaaagctgcttcgagactaaggaggaggttctccagtactgccaagaaatgtaccccgaattgcaaatcactaatgtcatggaggccaatcagcgggtgagcatagataattggtgtaggagagacaaaaagcaatgcaaatcccgatttgtgaccccatttaagtgtttagtgggggaatttgtgtcggatgtgctgctggtgccagaaaaatgccaattcttccacaaagagcggatggaagtctgtgagaaccaccagcattggcacaccgtggtgaaagaggcctgccttacacaaggtatgacgctctactcctatggcatgctcctgccatgcggggtggatcagtttcacggtacagagtatgtgtgttgccctcagaccaagattatcggtagcgtctctaaagaggaggaggaggaagatgaggaggaggaagaggaggaggatgaagaggaggattacgacgtgtacaagtccgagtttcctaccgaagcggatttggaggactttaccgaagccgcagtcgacgaggacgacgaggacgaagaggagggggaggaagtggtggaagaccgcgattattattatgacacatttaagggggacgactataacgaggaaaaccccaccgaacctggatcggatggcactatgagcgataaagagataacacacgacgtgaaagctgtgtgcagtcaggaggcgatgaccggcccctgccgagcagttatgccccgatggtacttcgacctctccaagggcaagtgcgtcagatttatctacggcgggtgcggtgggaatcgtaataattttgagtccgaagattactgcatggccgtctgcaaggcaatgattcccccaaccccccttcccacaaatgatgttgacgtctatttcgagacttcagccgacgacaacgagcatgcgcgatttcagaaagctaaagaacagctagagattaggcacaggaaccgcatggatcgcgtcaagaaagagtgggaggaagcagagctgcaggccaagaacctcccaaaggccgaaagacaaaccctgattcaacattttcaggcgatggtgaaggctctcgagaaagaagccgcaagcgagaaacagcagcttgtcgagacacacctggccagagtggaggccatgctgaacgacaggaggcggatggcgctagagaattatctggccgccctgcagagcgacccacctaggccccacaggattctacaggctctcaggcgctacgttcgtgcggagaataaagacaggctccataccattcgccactaccaacatgtcctggcagtggatccagagaaggcagcacagatgaaatctcaggtaatgactcacctgcacgtaatcgaagaaaggcgcaaccagtccctgtcactactttacaaagtcccttatgtagctcaggagatccaggaggagatcgatgaactgctgcaagagcagagggccgatatggatcagttcactgcttcaatcagcgaaacccccgtcgatgtccgcgtaagtagcgaggaaagcgaagagattcccccatttcaccccttccatccattccctgccttaccagagaacgaaggaagtggcgtcggtgaacaagatggaggactgataggggctgaggagaaagtaattaactcaaagaacaaggttgacgagaatatggtgattgacgaaacactggacgtgaaagaaatgattttcaacgctgagcgggtgggcggattggaagaggaacgggagtccgtgggtccactgagagaggacttttctctcagttcttcagccttaatcgggctgctggtaatcgctgttgccattgccaccgtaattgtgatttccctagtcatgcttcgtaaacggcagtatggcacaatttcccatgggatcgtggaagtggatcctatgttgactccagaagaaagacaccttaacaagatgcagaaccacggctacgagaaccccacctacaagtacctcgagcagatgcagatctag

SEQ ID NO: 178918 - DNA, 1569 bp, Artificial Sequence
  Description of Artificial Sequence: Synthetic coding sequence
atggccgccaccggcaccgccgccgccgccgccaccggccggctgttgttattattgctggtgggcttgaccgccccagctttggccctcgcaggctatatagaagctctcgcagctaacgctggcactgggttcgccgtcgctgaacctcagattgctatgttttgtggtaaattaaacatgcacgttaatatccagaccggcaagtgggagccagatcctaccggaactaagagttgctttgaaacgaaggaagaggtattgcagtactgccaggagatgtatccagagctgcagatcacaaacgtgatggaggctaaccagcgtgtgtccatagacaactggtgtagaagagataagaagcagtgtaagagtcgcttcgttacacctttcaaatgcttggtgcctccgacccctctgcctaccaacgatgtggatgtgtacttcgaaaccagcgctgatgacaacgagcacgcccgctttcagaaggcaaaggagcagctggagatacgtcaccggaatagaatggatcgggtgaagaaggaatgggaagaagccgagcttcaggcaaaaaacctcccgaaggccgaacggcaaactctaatacagcactttcaggccatggtgaaggcactggagaaggaggccgcgagtgaaaagcagcagctggtggaaactcaccttgcaagggttgaagccatgcttaatgacaggaggaggatggccttagaaaactatttagctgcgctgcagtctgatccaccccgccctcaccgcatcctccaagccttgcggcggtacgtgagagccgagaataaggaccgccttcacactattcgccattatcaacacgtcctggccgtggaccccgaaaaagccgcccaaatgaagtctcaggttatgacccacttacatgttattgaagaaagacggaaccagtcattaagccttctgtacaaagtcccctacgttgcgcaagaaatacaggaggagatagatgaacttctccaggagcagcgagcagacatggatcagttcacagcaagtatcagcgagaccccagtggacgtaagggtttcctcggaagaatccgaagagatcccccccttccacccattccacccttttccagctctgcccgagaatgagggaagcggggtcggggagcaggacggtgggctgatcggagcggaagaaaaagttattaactctaagaacaaggtggacgagaatatggtgatagacgaaacattggacgtgaaggagatgattttcaatgcagagcgggtggggggactggaggaggaacgggaaagcgttgggccattgcgggaagatttctccctcagtagcagcgcactaattggcttgttagtgattgcggtggcgattgctactgttatcgtgatttcccttgtgatgctgaggaaacgacaatacggcacaatctctcacggtattgttgaagtggacccgatgttgactccagaagaacgacacctgaacaagatgcagaaccacggatatgagaacccaacatacaaatatctggagcaaatgcagatttag

SEQ ID NO: 178919 - DNA, 2088 bp, Artificial Sequence
  Description of Artificial Sequence: Synthetic coding sequence
atggccgccaccggcaccgccgccgccgccgccaccggccggctgcttctgctcttgttggtgggacttactgcccccgccttagctctggcaggttacattgaagccctggctgccaatgcagggactgggttcgccgtggccgaaccacagattgctatgttctgtggtaaattaaatatgcacgtgaatattcagacggggaaatgggagccggaccccaccggtaccaaatcatgcttcgagactaaagaggaggtcttacaatactgccaggaaatgtaccccgaactgcagatcacaaacgttatggaggccaatcagcgggtatccatcgacaattggtgcaggcgggataaaaaacagtgtaaatcaaggtttgtgactcctttcaaatgtcttgtgggtgaatttgtaagtgacgtattactggtgcctgagaagtgccagtttttccacaaggagcgcatggaggtatgcgaaaatcatcagcattggcacacagtggtcaaggaggcctgtctgacacaggggatgaccctatactcctacgggatgctcctgccttgtggggtcgaccaatttcacggtactgagtacgtatgttgccctcagactaaaattattgggagtgtgtccaaagaggaggaggaagaagatgaggaagaagaagaagaggaggacgaagaagaagactatgatgtatataagtccgagtttcctaccgaggcagatctggaggatttcaccgaggctgcagtggacgaggatgatgaggacgaagaggagggcgaggaagtggtcgaagacagggactattactatgacacgttcaaaggggacgactataacgaggagaatcccaccgagccaggatccgatggcaccatgagcgacaaagagatcacacacgatgtaaaagtgcctcccacacccctccctacaaatgacgtagatgtgtatttcgagacatccgccgatgataacgagcatgcgcggttccagaaagcaaaggagcaactggaaatacgccaccggaaccggatggaccgggtcaaaaaggagtgggaagaagctgagctccaggcgaagaacctgcccaaggctgagcgccagactctgatccagcattttcaggccatggtcaaggctctggagaaagaggcggctagtgagaaacagcaactggtggagacccatctcgccagagtcgaagccatgcttaacgaccggaggaggatggcgttagagaattacttggcagcgctgcagtcggatccaccccgtccccatagaatcctgcaagcgcttcgaagatacgtgagagctgagaacaaagatagactgcatactattaggcactaccagcatgtgctcgcagtcgacccagaaaaagcagctcaaatgaagtcccaggtcatgacccacttacacgtgatcgaagagagacgtaatcagagcctgtcgcttctgtataaagtgccgtatgtggcccaggagatacaagaggagattgacgaacttctacaggagcaacgggccgacatggaccagttcacggcttccatcagtgaaactcctgtggatgttcgagtgtcttcggaagagtcagaagaaatccccccttttcacccgtttcaccccttcccagccctgccagagaatgaagggtccggtgtgggcgaacaagatggcgggctgattggggccgaggagaaggtgattaattctaagaacaaagtggacgagaatatggttatagatgaaactctagatgtcaaggaaatgatttttaacgctgagagagttggcgggcttgaggaggaacgggaatccgtgggtcccctccgcgaggacttttcactcagcagcagcgcgctgatcggactactggttattgcagttgccatcgcgacagtgatcgtaatctcattggtgatgctgcgtaagcgccagtatggaaccatatcccacggcattgtggaggtggaccctatgcttacccccgaggagcgtcacttaaataaaatgcagaatcatggatatgagaacccgacttacaaatatttggaacagatgcagatctag

SEQ ID NO: 178920 - DNA, 480 bp, Artificial Sequence
  Description of Artificial Sequence: Synthetic coding sequence
atggccgccaccggcaccgccgccgccgccgccaccggccggctgctcttattgttgctcgtgggattgacagcccctgccctggccctcgcagggtatatcgaaagctcccagatatgttgcagcccgaggagttttctgatcagtaccctcaaatgtctcatcgtagatgaaatcaatgctctcgccgctaacgccggaacgggcttcgccgtcgctgaacctcaaatcgctatgttctgcggaaagctgaacatgcacgttaatattcagaccggaaaatgggaacccgaccccacaggaacaaaatcttgctttgaaactaaagaagaagtattacagtactgtcaggaaatgtacccggagctgcagattactaacgttatggaggcaaatcaacgcgtgtcaatcgataactggtgccgacgcgacaagaaacagtgcaaaagccgcttcgttaccccattcaagtgtctatag

SEQ ID NO: 178921 - DNA, 351 bp, Artificial Sequence
  Description of Artificial Sequence: Synthetic coding sequence
atggccgccaccggcaccgccgccgccgccgccaccggccggctgttattactgctgttggtcgggctcacggctcctgcactggctcttgctggatatatcgaggccctagcagccaatgcaggaacagggttcgctgtcgcagagccacagatcgctatgttttgcggcaagttaaacatgcatgtcaatattcagactggaaagtgggagcccgatccaactggcactaagagctgcttcgaaacaaaagaagaagtcttacaatattgtcaggaaatgtaccccgagctccagataaccaactcaggatggaggtgcgtaaggattactagcacaggaacacgctag

SEQ ID NO: 178922 - DNA, 1656 bp, Artificial Sequence
  Description of Artificial Sequence: Synthetic coding sequence
atggaggtgtgcgagaaccaccagcactggcacaccgtggtgaaggaggcctgcctgactcaggggatgaccctgtattcgtatggcatgctgctgccttgtggcgtcgatcagtttcacgggactgagtacgtctgctgtccacagactaagattatcggatccgtcagcaaagaggaggaggaagaggacgaagaggaggaggaagaggaagacgaggaggaagattatgacgtctacaaatctgagttccccacggaggccgatttggaggatttcacggaggccgctgtggatgaggacgatgaggatgaggaggagggggaggaggttgtggaagatcgcgactactactatgacacattcaagggcgatgattataacgaagagaacccaaccgagcccggcagcgacggtaccatgtccgacaaggagataacacatgacgtgaaggtgccccctacccctctccctacgaacgatgtggacgtctatttcgagacctctgccgatgataacgagcatgcaagattccagaaagcgaaagaacagctggagattagacaccgcaatagaatggaccgcgtcaagaaggagtgggaagaagctgagcttcaggcgaagaacctgcctaaggcagagcgccaaaccttaatacagcactttcaggctatggttaaggcactagaaaaggaagccgcgtccgaaaaacagcagctcgtggaaacacatttggcacgagttgaggctatgttaaatgataggagacggatggcccttgagaattatctggctgccctccaatcagacccccctaggcctcatcggatcttgcaggcactacgacggtatgttagggctgagaataaggatagactgcacacaattcgccattaccagcatgtacttgcagtcgatccagaaaaggccgcacagatgaaatcacaagtgatgacacacctgcatgtgatcgaggaaagaaggaatcagtccctaagcctgctctacaaggttccttatgtcgcccaggagattcaggaggagattgacgaacttctgcaggaacaacgtgccgacatggatcagtttaccgccagcatcagtgaaacccctgtcgatgtgagagtgtccagcgaggagagcgaagagatcccaccattccacccctttcatccctttccagccctgcctgagaatgaagatacgcaacccgaactgtaccacccaatgaagaaaggtagcggggtcggtgagcaggacggcggactcatcggtgccgaagaaaaggtgatcaatagtaagaacaaggtcgatgagaacatggtgattgacgagacacttgatgtcaaggaaatgattttcaatgccgagcgcgtcggcggactcgaggaggagagagagagcgttggacctttgcgtgaggatttcagtctcagcagctcagcactgatcggattactcgtcattgcggttgccattgctaccgtgatcgtgattagcttggtaatgcttagaaaaaggcagtatgggaccatcagccacggtatcgtggaggtcgatcctatgcttactcctgaggagcggcacctcaacaaaatgcagaaccacggttacgaaaatcccacttataaatacctggagcagatgcagatttag

SEQ ID NO: 178923 - DNA, 1977 bp, Artificial Sequence
  Description of Artificial Sequence: Synthetic coding sequence
atgtaccccgagctgcagatcaccaacgtgatggaggccaaccagcgggtctccatagataactggtgcaggcgggacaaaaagcaatgtaagtcccgcttcgtgacaccattcaaatgtctcgtgggcgagtttgtctccgatgtgctgcttgtccccgagaaatgtcagtttttccacaaggaacgcatggaggtgtgcgagaatcaccagcactggcacacggtggtgaaagaggcttgtttgactcaaggaatgacactctatagctatggaatgctgcttccatgcggtgtggatcagttccatggaaccgagtacgtgtgctgcccacagacaaagataatcgggagcgtgtctaaggaggaggaggaggaagatgaggaggaagaggaggaagaggacgaagaagaggactacgacgtttataagtctgagttcccaacggaggctgacctagaggattttacagaggctgcggtggatgaagatgacgaggatgaggaggaaggtgaagaggtcgtggaggatagggactactactatgataccttcaaaggagatgactacaacgaggaaaaccctactgaacctggctccgacgggaccatgtccgataaagaaatcactcacgacgttaaagcggtctgttcccaagaggccatgacaggcccatgtcgcgctgtgatgccgaggtggtattttgatctatccaagggtaagtgcgtgagatttatctacgggggctgcgggggtaatcgcaataatttcgagagtgaggactattgcatggcagtatgtaaggcaatgatcccgcctacccccttaccaactaatgatgtggacgtgtattttgaaacatcggcagatgacaacgagcacgcacgctttcagaaggctaaagaacagctggaaattcgacatagaaaccgcatggatagagttaagaaggaatgggaggaagctgagctgcaggccaaaaacctgcctaaggcagagcgccaaaccctcatccagcactttcaggcaatggtcaaagctctcgaaaaggaggcagccagcgaaaagcagcagttggtggaaactcatttagccagagtggaagccatgctgaacgaccggaggaggatggccctagaaaattatctcgcggctcttcagtctgacccgccacggccacaccgcatccttcaagccttgcgcaggtatgtaagagccgagaataaagacaggctccacacaatacgccattaccagcacgtcctggctgtggatcccgagaaggccgcacagatgaaatcccaagttatgacacatctccatgtcatcgaggaacgcaggaatcaatctctgtctttgctctacaaggttccttacgtggcccaggagatccaggaagaaatagacgaactccttcaggagcagagggctgacatggaccagttcactgcctccataagtgagactccagtggatgtgagggtgtcttcagaggaatctgaagagataccgccattccaccccttccatcccttcccggcactgcccgagaacgaaggatctggcgttggagagcaagacgggggcctgatcggagccgaagaaaaggttattaactccaagaataaggtggatgaaaacatggtaatcgatgagacactggatgttaaggaaatgatctttaacgctgagagagtgggcggtctggaggaggaaagagagagcgttggacctctacgggaggatttctctctctcaagcagcgcgctgatcggcctcctcgtgatcgccgtggcgattgcaaccgtgattgttatcagcttggtcatgctgagaaaacggcagtatggcactatcagtcatggtatcgttgaggtggaccctatgctgacaccagaggaacgccacttaaacaagatgcaaaatcacggttacgagaaccctacctacaaatacctagaacagatgcaaatctag

SEQ ID NO: 178924 - DNA, 1758 bp, Artificial Sequence
  Description of Artificial Sequence: Synthetic coding sequence
atggccgccgtggagctggagtggatccccgagaccctgtacaacacagccatctccgcagtggtggataattatattcgctccagaagagacatcagaagtctgcctgaaaacattcagtttgacgtgtactataagttgtaccagcagggtcgcctgtgccaattggggagtgaattttgcgagctggaggtgtttgccaaagtcctaagggccttagataagcgccatctactgcaccattgtttccaagccctgatggatcacggtgtgaaggtggctagtgtgcttgcgtattcgttcagtcgccgctgttcatacatcgccgaaagcgatgctgctgttaaagaaaaggctatccaagttggttttgtcctcggaggatttctcagcgacgcaggatggtacagtgacgccgagaaggtattcttgtcttgcctccagctttgcactttgcatgatgaaatgttgcactggttcagggccgtagaatgctgtgtgcgactcttgcatgttcgcaatggaaactgtaaatatcacttaggcgaagagacattcaaactagctcagacttatatggataagctgagtaagcacggccagcaggctaacaaagctgccctgtacggggagctatgcgctctattgtttgcgaagagccactacgatgaggcctacaagtggtgcattgaggcaatgaaggagattacggcaggcctccccgtgaaggtggtggtcgatgttttaagacaggccagcaaagcctgcgtggttaaaagagagttcaagaaagcagaacagttgatcaagcacgccgtgtatctcgcacgggaccactttgggagcaagcatcccaagtactcggacaccctactggactacggcttttacctgctgaacgtggataatatttgccaatctgtcgccatctaccaggctgctctggacattagacagtcagtgtttggcggcaagaacatccacgtggctactgcccacgaagacctcgcatactcctcctatgtgcaccaatactctagcggaaagtttgacaacgcactattccacgccgagagagcaattggcattattacacatattctgccggaagaccacctgctactagcctcttccaaaagggtcaaggcgttgattttagaggaaattgctattgattgtcacaacaaagaaaccgaacaaagactgctgcaagaggcgcatgatctgcacctgagctcacttcagttagcgaagaaagccttcggggagtttaacgttcagacagctaagcattacggcaacctgggtcgtttgtaccagtcaatgcgtaaattcaaagaggccgaagaaatgcacattaaagcgattcagatcaaggagcagctcttgggccaggaggactacgaggttgcgttgagcgtgggacacctggctagcctgtataactatgatatgaaccagtacgaaaacgccgaaaagttatatctgaggagcatagctattggcaaaaaacttttcggggagggctatagcggtctggagtatgattatcggggactgattaaattgtacaattctatcgggaattacgagaaggtctttgaataccataacgtattaagcaactggaaccgactgagagaccgtcaatacagcgtgaccgacgcgttggaggacgtcagtacaagtccacagagcactgaggaggtagtgcagagtttcctcatttcccagaatgtggaagggccaagttgttag

SEQ ID NO: 178925 - DNA, 4974 bp, Artificial Sequence
  Description of Artificial Sequence: Synthetic coding sequence
atggacagcaagaagcggagcagcaccgaggccgagggcagcaaggaaaggggcctggtgcatatctggcaggccggctcttttcccattactcctgagaggctgcctgggtggggcggaaagacggtgctgcaagcagccctcggggtaaaacatggtgtcctattgacggaggatggcgaagtgtattccttcgggacactcccctggcggtccgggccagttgaaatctgcccttctagtcctattctggaaaatgcccttgttgggcagtacgttattactgtggctacagggtcgtttcacagtggggcagtgacagataacggtgtcgcttacatgtggggcgaaaattcagccggccagtgcgcggtggcaaatcagcagtatgtgcccgagcctaaccccgttagtatcgccgactctgaggcttccccactgctggcagtgcgcatcctgcagttggcgtgcggagaggagcatacgctggccctgtcaatctcccgcgaaatctgggcctggggcacaggctgtcagcttggcctcattaccacagcattccccgtgaccaagccacagaaagtggaacatcttgcaggccgggtggtgctgcaggtggcttgcggtgcctttcactccctcgccctggtacaatgtctccccagtcaggatttaaagcctgtccccgagcgatgcaaccagtgctcccaactactcatcacaatgaccgacaaagaggatcatgttatcattagtgactcacactgttgccccttgggggtcactttgacagagagtcaggctgaaaatcatgccagtactgccctgagccccagcaccgagactctggaccggcaggaagaagtgtttgagaatacccttgtggctaatgaccagtccgtcgctaccgaacttaatgctgtctcagcacagatcacttccagcgatgccatgtctagccaacagaacgtaatgggaacaactgagatctcatccgctcgtaatatccctagttatcccgacacgcaggccgtcaacgaatatttgcgcaaattgtccgatcattccgtgagggaagatagtgaacacggggagaagcccgtgccctcacagccgttactcgaagaggctatccccaacctgcacagcccccccactaccagtaccagcgctttgaacagcctcgtagtgagttgtgctagcgctgtgggagtacgggtggcagcaacttacgaagctggcgctctctccctaaagaaagtcatgaatttctattccaccacaccctgcgaaacgggggctcaggccgggagttccgccattggccctgaaggactcaaggacagtcgggaggagcaggttaagcaggaaagcatgcaaggaaagaagagtagcagtcttgtggacatccgcgaagaggagactgaaggtggtagcaggagactctccctgcctggactgctgagtcaagtgagccctcggttgttaagaaaagccgctagggtaaagacaaggactgttgtattgacgcctacttattcaggagaagctgatgccctccttccaagcctccggaccgaagtgtggacgtggggcaagggcaaagagggacagttgggtcatggggatgtactacctcggctacaaccactgtgtgttaagtgtctggatggaaaagaagttatccacctcgaggctgggggttaccacagcctggctctgacagcaaaatcgcaggtgtacagctggggttctaatacatttggccagttgggacacagcgactttcccacaaccgtaccgagactggccaaaattagctccgagaatggagtttggtcgatcgccgccggccgggattattcattgttcctggtcgataccgaggatttccagccagggctgtactacagtggtagacaggatcctactgaaggggacaacttgcctgaaaaccattcaggatccaagactcctgtgctgctgtcgtgctcaaaactgggatatatcagcagagtgaccgccggtaaggacagctatctggctcttgtggacaagaatataatggggtacatagcgagcctgcacgagttggcgaccacagaacggaggttttatagtaaactgtccgatattaaatcccagatcttgagacccttgctctccctggaaaatcttggcacaaccacaacagtgcaactccttcaggaagtcgcctccaggttttccaaactgtgttatctcattggacaacacggggctagcttatcttctttcttacatggcgtgaaagaagccaggtcactggtgatcctcaagcatagctcgttgtttcttgacagctacacggaatactgcacctctatcacaaattttcttgtcatgggcggatttcagctcttagcgaaacctgctattgacttcctaaataagaatcaggagctgttacaagacctcagcgaagttaacgacgagaacactcagcttatggagatacttaataccttgttcttcttacctatcagacgcttgcataactatgcaaaggtcctgctgaaactggcaacctgctttgaagtggcatcccctgagtatcaaaagctgcaagactcatctagttgttacgagtgcctggctctgcatctcggtcggaagagaaaggaagcagagtatactctcgggttctggaaaacgtttcctggaaagatgaccgactctctgcgcaagcccgaaaggaggctcctttgtgagtcgtccaatcgcgctctgtcactacagcatgcaggccggttctccgttaactggtttatcctctttaatgacgcgttagtgcatgctcagttctctacccaccacgtttttcccctggcaactctgtgggcagaacccctatctgaagaagcagggggcgtgaacggcctgaaaatcaccactccagaggagcaattcaccctcatttccagcacacctcaggaaaagaccaagtggctccgagctatttctcaggctgtggatcaggcgttgaggggcatgtctgatctaccgccatatggatcagggagctctgtccaaaggcaggagccgcctatttcccggtctgccaaatatacattttataaggatcctcggctcaaggacgctacatacgatggacggtggctgtcaggcaagccccacgggaggggcgttctcaagtggcctgatggaaaaatgtacagcggaatgttcaggaacgggttagaggacggctacggggagtataggattcccaataaagcaatgaacaaggaggatcattatgtgggacactggaaagagggaaaaatgtgtggacagggagtctattcatatgcatccggagaagtgttcgagggttgcttccaggacaacatgcgccacggacacggacttttacgatcaggaaaactgacatcctccagtccatcgatgttcatcggccagtgggtcatggataaaaaagccgggtacggagtattcgacgacattactaggggggagaaatatatgggcatgtggcaggatgacgtctgccagggaaatggtgtcgtggtgacgcagtttggcctgtactacgagggcaacttccacctcaataagatgatgggcaacggcgtgctgctttcagaggacgataccatatacgagggcgagttctcagacgattggaccctaagcggcaagggtactctgacaatgcccaatggtgactatatagagggctatttttccggagagtggggttcagggatcaagatcaccggaacgtattttaaacctagcctttatgagagtgacaaggatcgcccgaaagtcttccgcaagcttggaaacctcgcggtgccagcagacgagaagtggaaggccgtatttgacgagtgctggaggcagctgggctgtgagggaccaggtcagggcgaggtgtggaaggcttgggataacatagctgtggctttaacaacctcacgcaggcagcatcgcgattctcctgagatcctgtccagatcacagacccagacgctggagagcctagaattcatacctcagcatgtgggtgcctttagcgtcgaaaaatatgacgacattagaaagtatcttattaaggcctgtgacactccactccacccccttgggagactcgtggaaaccctcgtagctgtgtaccgaatgacatatgttggtgtcggggcgaatcgtcgtctcctgcaagaggccgtgaaagagattaaatcatacctgaagcgaatttttcagctagtccggtttctgtttccagaactaccggaggaggggagtaccattccattatctgcacctctccccaccgaacggaagagtttttgtacgggaaaaagcgactccaggtccgaatcaccggagcccggttacgtggtcacttcctcaggactcctcttacctgtgctccttccccgtttatatcctccgctgtttatgctgtatgccctcgataatgatcgggaggaggatatttattgggagtgtgtgctgaggttgaacaaacagcccgatatcgcgctgctgggattcctgggcgtacagaggaagttttggcctgccaccctgtcaatattgggcgagtccaagaaagtcctgcctactaccaaggacgcgtgctttgcctccgccgtggaatgccttcagcagatctccacaacattcactccctcagacaagctcaaagtaatccagcagacgttcgaggagatatcacagagcgttttggcttccctgcatgaagacttcctgtggtctatggacgatctgttccccgtttttctgtacgtggttttgagagccaggatacgcaacttgggaagcgaagttcacctcatcgaagatttgatggatccgtacctgcaacacggcgagcagggtatcatgttcactactcttaaagcatgttattatcagatacaaagggagaaattaaactag

SEQ ID NO: 178926 - DNA, 420 bp, Artificial Sequence
  Description of Artificial Sequence: Synthetic coding sequence
atggacagcaagaagcggagcagcaccgaggccgagggcagcaaggaacggggtctggtgcacatctggcaagccggctcctttcctatcacgcctgagagattaccgggctggggaggaaagacagtgctccaagccgctctgggcgtcaagcacggcgttcttctgactgaggatggcgaggtgtacagtttcgggaccctgccgtggagaagtggccccgtggaaatctgtcccagttcccccatcttggagaacgctctggtgggccagtatgtgatcactgtggcgacagggagctttcactctggcgctgttactgataacggagtggcttatatgtggggcgagaatagcgccggacagtgtgcagtggctaatcagcaatatgtccccgagccgaacccagttagcatctag

SEQ ID NO: 178927 - DNA, 321 bp, Artificial Sequence
  Description of Artificial Sequence: Synthetic coding sequence
atggacagcaagaagcggagcagcaccgaggccgagggcagcaaggagagaggcctggtgcatatatggcaagcaggttctttcccgattacgccagaacgcctacctggctggggcgggaaaactgtccttcaggctgcactgggagttaaacatggcgtgcttctcacagaagatggtgaggtatacagcttcggaaccctgccatggagaagcggaccggttgagatttgtccctcaagccccatattagagaacgcgctagttgggcagtacgtgatcactgtagctactggatcatttcacagcggcgccgtctag

SEQ ID NO: 178928 - DNA, 1758 bp, Artificial Sequence
  Description of Artificial Sequence: Synthetic coding sequence
tgactggccctggtggacaagaacatcatgggctacatcgccagcctgcacgagctagctaccaccgagagacgcttttattcaaagctaagcgacattaagtcacagatcctccgaccactgctctcactggagaaccttggcactaccaccaccgtgcagttactgcaagaagtggcctctagattctccaagctgtgttacttgatcggccaacacggggcctctcttagttcttttctgcatggggtgaaagaagccagaagcttggtgattctgaaacatagtagcctcttcttggattcatatacagagtactgtacaagcataaccaatttcctggtcatggggggcttccagctgttggctaaacccgccatcgattttctcaacaaaaaccaggagctgctgcaggatctgtccgaagtaaacgacgagaacacacagcttatggaaatcctgaatacattattctttttgcctataaggcggctgcacaactacgcaaaggtcctactaaagcttgccacatgctttgaagtcgctagccccgagtaccagaagctgcaagattcaagctcttgctacgaatgcctggctctacatctgggccgtaagcgaaaggaagccgagtatacattgggtttctggaaaaccttccccggtaaaatgacggattcactgagaaaacccgagcgacggctcctgtgcgaatcctccaatcgtgccttgagcctgcagcatgccgggcggttcagtgtcaactggtttattttgtttaatgatgcactggtccacgcccagttcagtacacatcatgtcttccctctggcaactctgtgggcggaaccgctgtcagaagaagctggtggggtcaacggccttaagatcacaacgcctgaggaacagttcactcttatttcttctactccccaagaaaaaaccaagtggctgcgcgctatctcccaagctgtggaccaggccctaaggggtatgtccgatctgccaccgtacggctctggaagttctgttcagagacaggaaccccctatttctaggagcgcaaaatacactttctacaaagaccctagacttaaagatgctacttatgatgggagatggctgtcaggcaagccgcacgggcgcggtgttctcaaatggcccgacgggaagatgtactcagggatgtttaggaacggtttggaagatggatacggagagtacaggatcccaaataaggctatgaataaggaggatcattatgttggacactggaaggaaggtaagatgtgcgggcagggcgtatattcgtatgccagcggtgaagttttcgaaggctgttttcaagataatatgcgccacggtcatggcctgctcagatcgggcaagcttacctcctcgtccccatccatgtttatcgggcagtgggtcatggataaaaaagccgggtacggggtatttgatgacataactcgaggagaaaagtacatggggatgtggcaggacgacgtctgtcagggcaacggcgtggtggtgacacagtttggtctatattacgaaggaaactttcacctgaacaagatgatgggcaacggggtcctgcttagtgaggacgacacaatctacgaaggagagttcagtgacgactggactctgtcaggaaaagacaactcaggcctcatcgaacaggtggggaaatgtagcctcctcccctacttcctaaaagtgtgtgaggcactcgtgttatttcttctgtag

SEQ ID NO: 178929 - DNA, 1731 bp, Artificial Sequence
  Description of Artificial Sequence: Synthetic coding sequence
atgggctacatcgccagcctgcacgagctggccaccaccgagcggcgattctattcaaaactgtccgacatcaaatctcaaattctgcgcccccttttgtcattggagaacttaggcaccaccactaccgttcagctgctgcaggaagtggcctctcggttttctaagttgtgctatttgatcggacagcacggggcttccctctcatccttcctgcacggcgtgaaggaagcacggagcttggtcattctgaagcactcatcactgtttctggattcgtacaccgagtattgcacgtccatcaccaacttcttggtgatgggaggattccagttgttggccaagcctgccatcgattttctgaacaagaatcaggagctgttgcaagacctcagcgaggtgaacgatgagaacacgcagttgatggagattctcaacaccttatttttcctgcccatccgtcgtttgcataattacgctaaagtgctgctcaagctggcgacttgttttgaagtggcaagtcccgaatatcagaagctgcaagacagctcttcctgttatgaatgccttgcccttcaccttgggcggaagagaaaagaggctgaatatacacttggcttctggaaaacatttcccggcaagatgactgatagcctacgaaagcctgaacgtagactgttgtgcgagtcctctaaccgcgccctctctttgcaacatgccggtcggttcagtgtcaactggtttattttatttaacgacgcacttgtacacgcccagttttccacgcatcacgtatttcccctcgccactctgtgggccgaaccactgagcgaggaggctggcggtgtaaatggattaaaaataactacccctgaggagcagttcactctgatttcatctacgccccaggaaaaaaccaagtggcttcgggcaattagtcaggctgtcgatcaggccctcaggggcatgtccgatctgcccccttacggcagtggcagctccgtccagaggcaggagccgcccatttcccggagtgctaaatataccttttacaaggacccaaggctgaaggatgccacctatgatggtaggtggttgtcaggcaaaccacacgggcgaggcgtgctgaaatggccggacggcaagatgtactctggaatgtttcgcaacggactcgaggacgggtatggtgagtaccggattccaaataaggctatgaacaaggaagatcactacgttggacattggaaggagggcaaaatgtgtggtcagggcgtatacagctacgcgtcaggagaagtgttcgaaggatgcttccaagataatatgagacatggacatggcttattgagaagtggcaaactcacctctagttctcctagcatgttcattggccagtgggtgatggataagaaagccgggtatggcgtctttgacgatatcactcgaggagaaaaatacatgggcatgtggcaggacgacgtatgtcagggaaatggcgtcgtggtgacccaattcgggctgtactacgaaggcaattttcacctgaacaaaatgatgggaaatggcgtcttgctgagtgaagatgatacaatttatgaaggcgaattcagtgatgattggacactttcagggaaggataattccggtctgatcgagcaggtgggaaagtgtagcctgctcccctatttcctgaaagtctgtgaagccctagtgttatttctgctgtag

SEQ ID NO: 178930 - DNA, 1191 bp, Artificial Sequence
  Description of Artificial Sequence: Synthetic coding sequence
atggacagcaagaagcggagcagcaccgaggccgagggcagcaaggagcgaggtttagtccacatctggcaggccggatcctttcccataacacctgaacggcttcccggatggggaggtaagacagtcctccaagctgcactcggtgtaaagcacggcgttctcctcactgaggatggcgaagtgtacagctttgggacattgccatggagaagtggccccgtggagatctgccccagctcaccaattctggaaaatgccctggtaggacagtacgttataacagtggctacagggtctttccactccggcgccgtgaccgacaatggtgtcgcctacatgtggggcgaaaactctgccgggcagtgcgcggtcgccaaccagcagtatgtccctgagcccaatcctgtgagcatcgcggacagtgaagcaagccccctcttggccgtcagaatattgcagttagcatgcggggaggaacacaccctggctctgtcaatttcccgagaaatctgggcctgggggactggctgccaattgggactcatcactaccgcctttccagtgaccaagcctcagaaggttgagcacctcgccgggcgtgttgtcctgcaggtagcctgtggtgcctttcattccctggccctggtgcaatgtctgccttctcaagacctgaagcccgtgccagagcgctgtaatcagtgttcccagctcctgatcaccatgaccgacaaggaagaccatgttatcatatcagactcccattgttgcccacttggcgtgacactaaccgaatcccaagcagaaaaccacgcctcaaccgccctgtctccttctaccgaaaccttggataggcaggaggaggtattcgaaaacactttggtggcaaacgatcagtcagttgcaacagaactgaatgctgtgtctgcccaaatcacatctagtgacgccatgagcagccagcagaacgtgatgggaacaaccgaaattagttctgcacggaatatcccatcataccccgacactcaggccgtgaatgaataccttagaaaacttagcgatcacagcgtgagagaggacagtgagcacggagaaaagcccgtaccatcccaggtgccagcccagttttacaagattaaagtttgcctcgagttgaactgcatgggattctccttagaaacactgaagtag

SEQ ID NO: 178931 - DNA, 2178 bp, Artificial Sequence
  Description of Artificial Sequence: Synthetic coding sequence
atggagcagagcaacgacagcctgcgggtgaaccacaacgacggcgaagagtccaagacgtccgcccaagtttttgaacacctgatttgcatggacagcagggatagctccttcggccagaatgacagtcctacggttctgccaataaccaccagagaggctaataatagcttgattagtcagaacatccctggcccactgactcaaactcaaacccttagcgctgagcagtttcacctggtggaccaaaacgggcaggcaatccagtacgagctccagtcgcttggcgagtctaatgctcaaatgatgatcgtggcctcgcccaccgagaacgggcaggtcttgcgtgtaatcccacccacgcagacaggaatggcccaagttatcattccacagggccagctcgtcgatgttaactccccccgagatgtgcctgaggagaaacctagtaacaggaatttacctacagtccgagtagacactcttgctgataatactagtaattacattcttcatcctcagacaagtttcccactgccaaaaaagtccgtgacaggaatgctggaggagccgctgttggggccacttcaacctctttccagcaatactccaatttgggcgtgcagattgcgcagttgcgagaaaatcggcgattcctatcggggatactgcgtgtccgaaactgaactcgagagcgtcctaaccttccacaagcagcaaactcagtccgtttggggaaccaggcagagccctagcccagcaaagccagccacccggctgatgtggaagtcccagtacgttccctacgacggcattcctttcgtaaatgcagggagccgggccgtcgtgatggaatgccagtatggcccgaggcgtaagggtttccagctgaagaaggtcagtgaacaggagtcacgaagctgtcagctctataaggccacatgtcctgcgaggatttacatcaaaaaagtgcagaagtttcccgaataccgcgtccccactgatccaaagatcgataagaagataattcggatggaacaggaaaaggcatttaacatgttaaagaaaaatcttgtcgatgcaggcggcgtgctgcggtggtacgttcagctcccaactcagcaggcccatcagtatcatgaactggagactccatgcctgaccctttctcctagcccttttccagtatcgtctctggaggaagaggaaaccgcagtccgcgatgagaattgcgccctaccatctcgacttcatccgcaggttgctcacaagatccaggagctggtatctcagggcatagagcaggtttacgccgtcagaaaacagctccggaagtttgtggagcgcgaactgttcaaacctgatgaagtacctgaacgacacaacctgagtttttttcccacagtgaatgatattaagaaccatatccacgaggttcagaaaagccttaggaacggtgataccgtttataactccgagatcatccccgccactcttcagtggactactgactccggaaatattctgaaggaaaccatgacagttacctttgcggaggggaactctcctggagagtctatcaccacgaaggtggaaacaaatcaaacgcgcggatcattaagccccgagcctacccatttattgagctctctcagttctttccagccaaagatcttcacccagctccaggggctccagcttcagccgcgatacacgtctccagatgagtctccggccgtggtcagtgtcaacaaccagccaagctcctcaccatctggacttctggatacgatcggctcggccgtcatgaacaataacagcctgctgctcggccagtcacacagtcttcagagagacacatgcctgacccaaaacaatagtaccgccagcaccatgggtaatttacctgaacctgatcagaatctggtggctatggatgagctggtggaagtgggtgacgtggaggacacaggcaatctggagggaacagtccaccgcattctgttaggggacgtgcagaccattcccatacagattatagacaatcattcagctctgatcgaagagaatcccgagtctactatctctgtgtcccaagtgaagcaggagccaaaagaacctgctctgtctatggaggctaaaaagacggttgactacaagaaactctctgcgacttag

SEQ ID NO: 178932 - DNA, 2178 bp, Artificial Sequence
  Description of Artificial Sequence: Synthetic coding sequence
atggagcagagcaacgacagcctgcgggtgaaccacaacgacggcgaggaatccaagacctccgcccaggtgttcgaacatctcatttgtatggactcacgagacagctcctttgggcaaaatgattcaccaaccgttttaccaattaccacaagagaagcaaataactccctgatcagtcagaatatccctgggccgctgactcaaacccaaactctgagcgccgagcagttccatctcgttgatcagaatggccaggcgatacagtacgaactgcagtcactgggcgagagcaatgcccaaatgatgatagtggcgtctccaacagaaaatggacaggtgttacgagttatcccccctacgcagacaggcatggcacaggtgattatacctcaggggcagctcgtggacgtaaactcacctagagatgtgccggaagaaaagccatctaacaggaatctcccgacggtgcgagtagacaccctagccgacaacacatctaactacattctgcacccacagacctcttttccactgccaaagaaatccgtcaccgggatgctggaggaaccccttctcggccctttgcagccccttagtagcaacaccccgatttgggcctgccggctgcgcagctgcgagaaaatcggggactcctaccggggctattgtgtgtcggagacagaactagagtctgttctgacattccacaaacagcagacacagtctgtgtggggaaccagacagagcccgagccccgcgaagccggcaactcgcctcatgtggaagagccagtatgttccttacgatggaatcccctttgtgaatgccgggtccagagctgtggtaatggagtgccaatatggccctcgacggaagggatttcagttgaagaaggtctccgagcaggaaagccggagctgccaactctacaaagcgacctgtcctgcacgaatctacataaagaaagtgcagaaattccccgagtatcgggtgcctactgaccctaagatcgacaaaaagattattcgcatggagcaggaaaaggcctttaacatgctgaaaaagaacctggtggacgccgggggagtgctgaggtggtacgttcagctccctacacaacaggctcaccagtatcatgagttagaaaccccctgcctcaccctttcaccttccccgttcccggtgagttccctggaagaggaagaaaccgctgtgcgagacgaaaactgcgcattgccctctagactgcaccctcaggtcgctcacaagatccaggagttagtgagtcaaggtatcgagcaggtctacgcggttaggaagcaactgaggaagttcgtagagcgcgagttattcaaacccgatgaggtccctgagcgacacaatctgagtttctttccaactgttaacgacattaagaatcatattcacgaagtccagaaaagtctgaggaatggtgatacagtgtataattccgagatcatacctgcaacactccaatggacaaccgatagcggaaacatcctcaaagagaccatgaccgtaacgttcgccgaaggcaactcgccaggcgaatcaatcactacaaaggtcgaaacgaatcagaccaggggttccctcagtccagaacccactcacctcctctcatccctatcaagcttccagccgaaaattttcactcagctgcagggactccagctccagccccgttacaccagcccagacgagtcacccgccgtggttagcgtgaataatcagccgagttcatctccatccggcctgctagataccattggtagcgcggtgatgaataataatagcttgctcctgggacaaagtcactccttacagcgagatacttgccttacacagaataacagtacggctagcacaatgggcaacttgccagagcccgatcagaatctagtcgccatggacgagttagtggaggttggggacgtggaggacaccggcaacttagagggaaccgtccatcgcattctgctcggggatgtccagacaattccaatccaaatcatcgacaatcactctgctctcatagaggagaacccagagagcaccatcagtgtgtcacaggtgaaacaggagccaaaggaaccagccctgtccatggaagcaaagaagacggttgattataagaaactgtctgcaacatag

SEQ ID NO: 178933 - DNA, 165 bp, Artificial Sequence
  Description of Artificial Sequence: Synthetic coding sequence
atggagcagagcaacgacagcctgcgggtgaaccacaacgacggcgaggagagtaagacatctgcacaagtatttgagcacctgatttgtatggactcgcgcgactcgagtttcggccagaacgattctcccacggtgctgcccataaccactagggaggcttag

SEQ ID NO: 178934 - DNA, 396 bp, Artificial Sequence
  Description of Artificial Sequence: Synthetic coding sequence
atggagcagagcaacgacagcctgcgggtgaaccacaacgacggcgaagagagcaagactagcgcacaggtgttcgaacacctcatttgcatggattctagagacagttcatttggacagaacgattccccaacggtccttcccatcacaaccagagaggcaaacaattcactcataagccaaaacatccctgggccattgactcagacgcagacactgagcgctgaacagtttcacttggttgaccagaacgggcaggcgatacaatacgagctgcagagcttgggagagtctaatgcccagatgatgattgtggcgtcccccacggaaaatggtcaggtgctgcgcgtgattccgcccacacagacgggaatggcccaggtgattataccttag

SEQ ID NO: 178935 - DNA, 66 bp, Artificial Sequence
  Description of Artificial Sequence: Synthetic coding sequence
atggagcagagcaacgacagcctgcgggtgaaccacaacgacggcgaggagagcaagacatcctag

SEQ ID NO: 178936 - DNA, 222 bp, Artificial Sequence
  Description of Artificial Sequence: Synthetic coding sequence
atggagcagagcaacgacagcctgcgggtgaaccacaacgacggcgaggagtctaagactagcgctcaggtgtttgagcacctgatttgcatggactccagggacagctcttttggacaaaacgatagcccgactgtgttaccaataaccacgagagaggcaaacaattccctcatctcccagaatattcctggtcccttgacccaaacacagacactctag

SEQ ID NO: 178937 - DNA, 2178 bp, Artificial Sequence
  Description of Artificial Sequence: Synthetic coding sequence
atggagcagagcaacgacagcctgcgggtgaaccacaacgacggcgaagagtcaaagacctccgcccaggttttcgagcatttgatttgtatggattcccgtgattctagctttggccagaacgacagtcccaccgttttgcctatcacgacccgagaggccaataatagcctaatcagtcagaacatacccggtcccctgacacagacccaaacgctgtctgcagagcagttccacctcgtagaccagaatgggcaggctattcagtatgaactgcagtcactgggtgaaagcaatgctcagatgatgatcgtggcctcgcccaccgaaaacggccaggtactgcgggtgatcccgccgacgcagaccggcatggctcaagtgattataccccagggccagctggtcgatgtgaactctcccagagatgttccagaggagaagccaagcaaccgcaatttgcccaccgtgcgcgtggatactctggcggacaatacatccaattatattctgcatcctcaaacctcttttcctttacccaaaaagtccgtgactggcatgcttgaggaaccgctcctagggccgctgcaacctttgagttcgaatacacccatatgggcctgcaggctgcgcagctgtgagaaaatcggcgactcatatagaggctactgtgtctctgagacagaactcgaaagcgtgctcaccttccataaacagcagacgcagtccgtgtggggtactcggcagtcgccttctccggccaagcccgctacacgtctcatgtggaagagccagtacgtcccttacgacggaatcccattcgtcaatgcgggcagcagagccgtagtgatggaatgccagtatggtccccgtcgaaaaggcttccagctgaagaaagtgtctgagcaggagtctaggtcgtgccaactttataaagctacgtgcccagccagaatatatattaaaaaggtgcaaaaattcccagagtaccgcgtccctacagatccaaaaatagataagaaaattattaggatggagcaggagaaagctttcaatatgctaaagaaaaatttggtggatgccggcggcgtcctgcggtggtatgtacaactccccacacagcaagcccaccagtaccatgagctggagactccctgcctaactctaagcccctccccctttcccgtgtcctcactggaggaggaagaaaccgcggttcgggacgaaaattgtgctcttccgagcagactgcaccctcaggttgcccataaaattcaagagctggtcagccaggggatcgagcaggtgtacgccgtaaggaagcagctgaggaagtttgtggagcgagagctgttcaaaccagatgaggtgccagagagacacaacctgagttttttcccaacagttaatgacataaagaaccacatccacgaagtacagaagagcctgcgaaacggcgacacagtgtacaatagcgagattatccccgcaacgttgcaatggactactgacagcggcaacatactgaaggagaccatgacggtaacgtttgctgagggtaactcccccggtgagtcaatcaccaccaaggttgagaccaaccaaactcgtggatctttaagtccagagcccacacacctactctcctcactatcgagctttcagcctaagattttcactcagcttcagggtctccagttgcaaccgcgctatacctctcccgacgaaagccccgccgtggtctccgttaataatcagccaagtagctccccatcaggcctgctggacaccataggaagcgctgtgatgaacaataatagccttctactgggacaatctcattctcttcagagagacacttgcctgacacagaataactccaccgcatccacgatgggcaatctgcccgagcccgaccagaatctggtcgctatggatgaacttgtagaagtgggggacgtggaggacactgggaacttggagggtacagtacatcgaattctgctgggagacgtgcaaacaattcccatccagatcatcgataaccactccgccctgattgaagagaatcccgagagcacaatctcagtaagtcaggtcaagcaggagcctaaagaacccgccttatccatggaggccaagaagacggtggactacaaaaagctctcagcaacttag

SEQ ID NO: 178938 - DNA, 222 bp, Artificial Sequence
  Description of Artificial Sequence: Synthetic coding sequence
atggagcagagcaacgacagcctgcgggtgaaccacaacgacggcgaggagtccaagacctccgctcaggtctttgaacacctgatatgcatggacagtagggactccagttttgggcaaaatgatagtcctactgtacttccaatcactacacgggaagcaaacaatagcctgatatcacagaacattcctggcccactcacacagacacaaacgctttag

SEQ ID NO: 178939 - DNA, 288 bp, Artificial Sequence
  Description of Artificial Sequence: Synthetic coding sequence
atggagcagagcaacgacagcctgcgggtgaaccacaacgacggcgaggagagcaagacaagcgcccaggtgttcgagcatctaatatgtatggattctagggattcctcgtttggccagaacgatagccctacagtgctccctattacaacgcgggaggctaacaacagcctcatttcccagaacatcccagggccactgacacagacgcagaccctgtcagctgagcagtttcacttggtggaccaaaatggccaggctatccaatacgagctacagtccctgtag

SEQ ID NO: 178940 - DNA, 624 bp, Artificial Sequence
  Description of Artificial Sequence: Synthetic coding sequence
atgctggaggcctggaacctgaacctgagccactacctgaagcaccttatctgcatggatagccgtgattcctcctttgggcaaaatgacagccccaccgtgctgcccataacgactcgtgaggcaaacaacagcctgattagccagaacatacccggacccttaacccaaacccagacactgtctgccgaacagttccatctcgtcgatcagaatggacaagccatccagtatgagctgcagagcctaggagagtctaacgcccagatgatgattgtggcctctccaactgaaaacgggcaggttctgagggtcatccctccgactcagacaggcatggctcaagtcatcattccgcaggggcagctcgtggatgtgaacagtcccagggacgtacctgaggagaagccgagcaaccgtaatttaccgacagtacgcgtggatacccttgcggacaatacgtcaaactacatcctgcacccgcagacatccttccctcttcccaagaaaagcgtgaccggaatgctggaggaacccctactaggacccctgcagcctctatcttcaaacacccccatttgggcttgtaggctgcgaagctgtgagggagttgagctctggtag

SEQ ID NO: 178941 - DNA, 1914 bp, Artificial Sequence
  Description of Artificial Sequence: Synthetic coding sequence
atgctggaggcctggaacctgaacctgagccactacctgaagatgatcgtggcatcccctactgagaacggtcaggtgcttcgggtgatccccccaactcagaccggcatggctcaggtgataatccctcaagggcagctcgtggatgtgaactctccccgcgacgtgccagaggagaaaccaagtaatcgcaaccttcccacggtacgggtagatacactggccgataatacgtcaaactatatcctccacccacagacatcctttcctctcccaaaaaaatcagtgactggcatgttggaggaacctttgctgggaccactgcaacccctatccagcaacacacccatttgggcttgtcgtttgagatcttgcgaaaagatcggcgattcctaccgggggtattgcgtgtctgaaacggagctagaaagcgttttgacctttcataagcagcagacacagtcagtatggggtacccgccaaagccctagtcctgccaagcctgccacacgtctgatgtggaagtcccagtacgtcccatatgacggcatacccttcgtgaacgcaggttcaagggccgtggttatggagtgtcagtacggtccacgcagaaaaggctttcagctcaaaaaggtatctgaacaggaaagccgttcctgccagctttacaaggcaacctgtcccgctaggatttatatcaagaaggtccaaaaattcccagaataccgtgtgccaacagacccaaagatcgataagaagattatccggatggaacaggagaaagctttcaacatgcttaagaaaaatctagttgatgccggcggggtcctgagatggtacgtacagctgccaacccagcaggctcaccagtaccacgagctggagaccccatgcctaaccctatctccaagcccgtttcccgtgtcttccctggaggaagaagagactgcagtcagggatgaaaactgtgcactgccgtccaggctgcatccccaggtagctcataagatccaagagctggtgagtcaggggatcgaacaggtgtacgcagttcgcaagcagctgcggaagttcgttgaacgggagctttttaagcctgatgaagttcctgaacgccacaacttgagtttttttcccactgtaaatgacatcaaaaatcacattcacgaagtccagaagagccttaggaatggtgacaccgtttacaacagcgagatcatcccggccactttgcagtggactactgactctgggaatatactcaaggagacgatgacggtgacattcgccgaaggaaacagcccaggcgaaagcattacaactaaggtggaaacaaaccagactagggggtctctctcaccagagcctactcatcttcttagctccttgtcttcattccaacctaagatcttcacacaattacagggactgcagctgcaaccccgctatacatctcctgatgagtctccagccgttgtgagcgtgaacaaccagccatcatcttccccgtcaggattgctggatacaatcggttccgcagtcatgaataataacagcctcctcctcggacagagccatagcttgcagcgggatacatgtctcacacagaacaacagtactgcaagtactatgggaaatttgcccgaaccggatcagaacctcgtcgctatggatgagctggtcgaagtcggcgatgttgaggacacggggaacctggaaggaacggtccaccgaattctgctcggggacgttcagactattcctatccagattatcgacaatcacagtgcattaatcgaggagaaccccgagtcgaccatctcagtaagccaagtcaaacaggagcccaaagaacccgctctgtccatggaagccaagaagacggtggattacaagaagctgtctgcaacgtag

SEQ ID NO: 178942 - DNA, 1950 bp, Artificial Sequence
  Description of Artificial Sequence: Synthetic coding sequence
atggagcagagcaacgacagcctgcgggtgaaccacaacgacggcgaggaaagcaagactagtgctcaagtcttcgagatgatcgtggcttctcctactgagaacgggcaggtgcttagagtcataccccccacccagaccggtatggctcaggtgattatcccccaaggacagctggtggacgtcaactcacccagagacgtccccgaggagaaaccctcaaatagaaacttgccgacagttagagtcgacaccttggcagacaatacttccaactacattctgcacccacagacaagctttcctctgcccaaaaagtcggttaccggtatgctggaggaaccacttttgggaccactgcagccactgtctagtaataccccaatatgggcttgccgactcagaagttgcgagaaaattggagacagctaccgaggatactgtgtgagtgaaaccgaactggaatccgtccttacatttcacaagcagcagactcaaagcgtgtggggaactcgacagtctccatcgcccgccaaacctgccaccagattgatgtggaaaagtcagtacgtcccatatgacggaattccttttgtcaatgccggttccagagccgtggtgatggaatgtcagtatgggcccaggagaaagggatttcagctaaagaaggtgtcagagcaggagtccaggagttgccagttgtacaaggccacatgcccagcacgcatttacattaaaaaggttcagaagtttccagaatatcgggtgccgaccgatcccaagattgataaaaagattatccgtatggagcaggagaaagccttcaacatgttaaagaagaatctggtggatgcagggggcgttttgcggtggtatgttcagttaccaactcagcaggctcaccaatatcacgagctggagacaccttgcctaaccctgtcaccaagtccgttccccgtgagttctctcgaggaggaagagacagccgtgcgtgatgagaattgcgctctgcccagccggctccaccctcaggttgcgcataagatccaagagttagtctcacagggcatcgagcaggtgtacgccgttagaaagcagttgcggaaattcgtggagcgcgagttgttcaaacccgatgaggtgccggaacggcacaacctgagtttctttcctaccgtgaatgacattaaaaaccatatacatgaggtgcagaagtccctccgaaatggggacacggtctataactcagaaatcattccggccacattgcaatggaccaccgattccggtaacattctgaaggagacaatgactgtaacattcgctgaggggaacagtcccggcgagagcatcaccaccaaggtggagactaatcagacccgaggctcgttgtctcctgaacccactcacttgctctcgagcctgtcgtcttttcagcccaagatttttacccagttacaggggcttcaactgcagccaagatacacttcccccgatgagtcccccgccgtggtatctgtcaataaccagccttcctcctctccttccggcctgcttgatactattggatccgccgtcatgaacaataatagtctactgctgggacaatcccattctctgcaacgtgatacatgtctgacacagaataattcaaccgcatcgactatggggaatctgccagagccagatcagaacctcgtagctatggacgagttagttgaagtgggagacgtagaggatactgggaacctggaggggactgtgcacaggatcctcctcggcgatgtgcagacaattccaatacagatcatagataatcatagtgctttgatcgaggagaaccccgaatctaccatatccgtgagccaggttaagcaagaacccaaagagcctgcactcagtatggaggctaagaaaaccgtggactacaaaaaactgtccgcgacctag

SEQ ID NO: 178943 - DNA, 558 bp, Artificial Sequence
  Description of Artificial Sequence: Synthetic coding sequence
atgaccacccccaacaagaccccccccggcgccgaccccaagcagttagagcggaccgggaccgtacgcgagatcggtagtcaggccgtttggtcacttagctcgtgtaagccaggctttggggtggatcagctgcgggacgacaaccttgaaacatactggcagagcgatggctctcagccccacttggtgaatatccagtttcgtaggaaaacaactgtcaaaacactctgtatttatgccgactataagtctgacgaaagctacacgcccagcaagattagcgtgagagttggcaacaacttccataatcttcaagaaatcagacagctggagctggtcgagcctagtggatggatccacgtgccacttacggataatcacaagaagccaaccagaaccttcatgatccaaatcgccgtcctggctaatcatcaaaacggacgagacacacatatgagacagattaaaatatataccccagtggaagaaagtagtatcggcaagttcccgcggtgtaccacaatcgatttcatgatgtatcgctcaatccgctag

SEQ ID NO: 178944 - DNA, 558 bp, Artificial Sequence
  Description of Artificial Sequence: Synthetic coding sequence
atgaccacccccaacaagaccccccccggcgccgaccccaagcagcttgaacgtactgggacagtccgggagattggctctcaggccgtgtggagcctgagtagctgcaagccaggcttcggggtggaccagctgcgagatgacaacctcgaaacctattggcaaagtgatggatctcaacctcacctcgtgaacatacagttcaggcggaagaccaccgtcaagactttgtgcatctacgccgattacaaatccgacgagtcatacacacctagcaaaatcagcgtgagggttggaaataacttccacaatttacaggaaatccggcagctggaattggtcgaaccgtccggctggatccacgttccccttaccgacaatcataagaagcctactcgcaccttcatgattcagatcgccgtgctggccaaccaccagaacggtagggatacccacatgcggcagataaaaatttacacacctgttgaggagagtagcatcggcaagttcccacgctgcacgaccattgattttatgatgtacagatcaatacgttag

SEQ ID NO: 178945 - DNA, 207 bp, Artificial Sequence
  Description of Artificial Sequence: Synthetic coding sequence
atgaccacccccaacaagaccccccccggcgccgaccccaagcagttggagaggacgggaacagtgagggaaattggaagccaggctgtgtggagcctgtcttcatgcaagcctggattcggcgtcgaccaactccgcgatgataacctggagacatattggcagagcgacgggtcacaacctcacctagtgaacatccaattctag

SEQ ID NO: 178946 - DNA, 330 bp, Artificial Sequence
  Description of Artificial Sequence: Synthetic coding sequence
atgaccacccccaacaagaccccccccggcgccgaccccaagcagctggagaggaccgggaccgtccgagagatagggtcccaggccgtgtggagcctaagctcctgtaaaccaggcttcggagtcgaccagctcagggacgataatctggagacttattggcagagcgatggcagccaaccccacctggtgaacatccagttccggaggaagacaaccgtgaaaaccctgtgtatctatgctgactacaagagtgacgagtcttatactccatctaagattagcgttagagttggaaataacttccacaacctccaggagatcagatag

SEQ ID NO: 178947 - DNA, 558 bp, Artificial Sequence
  Description of Artificial Sequence: Synthetic coding sequence
atgaccacccccaacaagaccccccccggcgccgaccccaagcagcttgaacggacagggaccgttcgggagatcggatcgcaggctgtctggagcctgagctcttgtaagccgggtttcggcgttgaccaactgagggacgacaatctggagacttattggcagagcgacgggtctcagcctcacctggtcaacatacaattccgccggaaaactactgtcaagaccctgtgcatttatgcagattacaagagcgacgagtcctacaccccgtccaagatatcagtacgcgtggggaataattttcacaatttgcaggagatccggcagctcgaactggtggagccctccggttggatccatgtcccgctaacggataatcataagaagcccacccggaccttcatgattcagatcgctgttctcgccaatcaccagaacggaagagacacccacatgcggcaaatcaagatctacaccccagtggaagaaagctccatcgggaagttcccccgctgtaccacaatcgacttcatgatgtaccgttctatcaggtag

SEQ ID NO: 178948 - DNA, 477 bp, Artificial Sequence
  Description of Artificial Sequence: Synthetic coding sequence
atgaccacccccaacaagaccccccccggcgccgaccccaagcagcttgagcggactggcaccgtgcgtgaaatcggctctcaggctgtgtggagcctgagctcctgtaaaccaggattcggtgttgaccagctgcgcgatgataatctagaaacttactggcagagcgacgggagtcaaccccatctggtcaacattcagtttcgaagaaagacaacagttaagaccctgtgcatttatgcggattataaatctgacgaatcctacacaccatctaaaatcagtgtgcgcgtagggaataatttccacaacctccaggagatacgccagctggaattagtggagccgagcgggtggattcacgtgccactaactgacaaccacaagaagcctacccggactttcatgatccaaatcgcagtcttggcaaatcaccagaacggccgcgacacgcatatgaggcaaattaagatttag

SEQ ID NO: 178949 - DNA, 477 bp, Artificial Sequence
  Description of Artificial Sequence: Synthetic coding sequence
atgaccacccccaacaagaccccccccggcgccgaccccaagcagcttgagagaacaggcactgtgcgtgagataggctcccaagccgtttggtccctgtccagctgtaaaccaggctttggagtggatcagcttcgcgacgataaccttgagacttattggcagtccgacgggtcccaaccacatttggtgaacattcagttcagaagaaaaactactgttaagaccctttgcatctatgctgactacaaaagcgacgagtcctacaccccttccaaaataagcgtcagagtgggaaacaactttcacaacctgcaagaaatcagacagctcgagctggtggagccgagcggctggatccatgtgcctcttacagacaatcataagaaaccaacccgtacattcatgatccagatcgctgtgcttgcaaaccaccagaacgggcgagatacgcacatgcggcagataaagatatag

SEQ ID NO: 178950 - DNA, 333 bp, Artificial Sequence
  Description of Artificial Sequence: Synthetic coding sequence
atggccgccagcagcagcagcagcagcgccggcggcgtgagcggcagctctgtcactggttcaggattctcagtgtccgatctcgcccctcccaggaaagctctctttacctatcccaagggcgcaggtgaaatgctggaagatggaagcgagaggttcctatgtgaatcagtgtttagctaccaggtggcatctactctcaaacaggtgaaacacgaccagcaggtggcccggatggagaagctggctggactggtggaagagttggaagcagacgagtggaggtttaagccgatagaacaactcctgggtttcacgcctagtagcgggtag

SEQ ID NO: 178951 - DNA, 2427 bp, Artificial Sequence
  Description of Artificial Sequence: Synthetic coding sequence
atgctgcggttccccacctgcttccccagcttccgggtggtgggcgagaaacagcttccccaggagatcatctttctcgtatggtctccaaaacgggatcttattgctcttgcaaatacggccggggaagtgctgttgcatcggctggcgagtttccaccgagtttggtcattccccccaaatgaaaatacgggaaaagaggttacctgcctggcctggagacctgatggcaagttactcgctttcgcgctcgcagatacaaagaagattgtgctatgcgacgtggagaaaccggaaagtctgcactccttctcagtggaagcccctgtgagctgcatgcactggatggaggtgacagtcgaaagcagtgtgctcacttcattttataacgccgaagacgagagtaacctgttgctgccaaagctccccacactgcctaagaattactccaacaccagtaagatctttagcgaggaaaactccgacgaaattatcaaactgcttggggatgtaaggctgaatatcttagttctcgggggcagcagcgggtttatcgagctgtacgcctacggcatgtttaagatcgctagagtcacaggcattgctggcacttgtctggctctgtgcctgtcgtctgatttgaaaagtttatcagtggtcactgaggtgagcaccaatggcgccagtgaagtgtcctactttcagttggaaaccaatttgctttattcattcttaccagaagtcacaaggatggccaggaagtttacccacatctcagcactgctgcagtatattaacctatcccttacgtgcatgtgcgaagcctgggaagaaatactcatgcagatggatagccgcttgactaaatttgtgcaagagaagaatacaactacatccgtccaggatgagtttatgcacctcctgctctggggcaaggcctccgccgagctgcaaacactattgatgaatcaactgaccgtgaaaggactgaagaagcttgggcagtctatcgagtcttcctatagttctatccagaagctagtgatctcccatttgcagtcaggatctgagtctttactttatcacctgtccgagctgaagggaatggcttcgtggaaacagaagtacgaacctctcggtctggacgctgccggcatcgaggaagcaattacagctgtgggctcctttatcttgaaggccaacgagttgctccaggtgattgatagctccatgaagaatttcaaagcattctttagatggttgtacgtcgctatgctgcgcatgactgaagatcatgttcttccagagttgaataagatgacacagaaagatatcaccttcgttgccgaatttcttactgaacatttcaacgaggctccagacctgtataacagaaagggtaagtacttcaatgtcgagcgcgtcgggcagtatctgaaggatgaggatgatgacctggtctctccccctaatactgagggcaatcaatggtatgacttcctgcagaacagtagccatttgaaagaatcgccccttctgtttccttattacccgagaaaaagcctgcacttcgtgaagagacggatggagaacattatcgaccagtgtctgcagaagcccgccgatgtcattgggaagtctatgaaccaggcaatatgtattcccctgtacagagatacacgttccgaagactctacccgtagacttttcaagttcccatttctttggaacaacaaaacttccaacctccattacctgctgtttacaatcctggaggatagcttgtacaagatgtgtatactgagacgccacacagatatctcccagagcgtctcaaatggactcatcgctataaagttcggatccttcacatacgcaactaccgaaaaagtgcgacggtccatttactcgtgcttggacgctcagttttatgacgatgagactgtcaccgttgtgcttaaggacactgtggggagagaaggacgtgataggctcctcgtgcaactaccactgagcctcgtgtacaactccgaagattccgctgagtatcaattcacagggacatatagcacgaggctcgacgagcagtgctccgctattcctaccagaacaatgcatttcgagaaacattggaggctgctggaatctatgaaagcccaatatgttgccggcaacggcttccgcaaggttagctgcgtgctctcctcaaacttacgacacgttcgcgtgtttgaaatggatatcgacgacgagtgggagcttgacgaatcttccgacgaagaagaggaagccagtaacaagcccgtcaaaatcaaggaagaggtgttgtctgagagcgaggccgagaatcagcaggccggtgccgccgctctggcccccgaaattgtcattaaagtggaaaagctggaccccgagcttgactcatag

SEQ ID NO: 178952 - DNA, 489 bp, Artificial Sequence
  Description of Artificial Sequence: Synthetic coding sequence
atgctgcggttccccacctgcttccccagcttccgggtggtgggcgaaaagcaactcccccaggaaattattttcctggtctggtcgcccaaacgggatctcatcgccctggccaacaccgcaggggaggtgctgctccaccgactggcctcattccatagggtgtggtccttcccgcctaatgagaacacaggcaaagaggtcacttgcctggcttggagaccagacgggaaactcctggcctttgctctcgctgatactaagaaaattgtgctttgcgacgtggaaaagccagagtcgctccactcctttagtgttgaggcgcctgtgtcatgtatgcactggatggaagttacggtcgaaagctcagttcttacttctttctataatgccgaagacgagagcaacctgcttttgcctaaattaccaacactaccaaagaattatagcaacacatcgaagattttttccgaggagaactcagactag

SEQ ID NO: 178953 - DNA, 2430 bp, Artificial Sequence
  Description of Artificial Sequence: Synthetic coding sequence
atgctgcggttccccacctgcttccccagcttccgggtggtgggcgaaaaacagttgccccaagaaatcatttttcttgtgtggagccctaagcgggacctgatcgccctggccaacactgctggcgaggtgctgctgcatagacttgcttcctttcacagagtgtggagcttccctcccaacgaaaatacggggaaagaggtcacttgtctggcctggagacctgacggtaagcttctggccttcgccctggcggatacaaaaaagatcgtactgtgtgatgtggagaagcccgagtcgctccactctttttctgttgaggctcctgtcagctgtatgcactggatggaggtgacagtcgaatcaagcgttttgaccagcttttataacgctgaggacgagtcgaacctcctgctgcccaagctccctactctgccgaaaaattattccaatacttcgaagatcttctctgaagagaactcagacgagattatcaagctgttaggggatgtccggttgaatattctggtcctcgggggctcgtcaggcttcatagaactgtatgcctatggcatgtttaagattgctcgcgtgactggtatcgctggaacctgcctggcgctatgtttgtcatccgatctgaagtcgctgtccgtggtgactgaagttagcaccaacggggcaagcgaagtgagttactttcagctagaaaccaatctcttgtattcatttttgcccgaggttactcgtatggctcggaagtttacacatatctccgccttgctgcagtacatcaaccttagtttaacttgtatgtgtgaggcctgggaagagattttgatgcagatggactctcgcctgaccaaatttgtccaggagaagaataccaccacatccgttcaagatgaatttatgcacctcctgctgtggggtaaggcctccgccgaacttcaaacactcctcatgaaccaactgaccgttaaggggttgaagaaactggggcagagtatcgaatcctcctactcctccatccagaagttggtaatttcgcacctccagagcggttcggagtctcttctgtatcacctctccgaattgaagggcatggcctcttggaagcagaagtacgaacctctggggcttgacgcagccggcatagaagaggcaatcacagctgtcggatcattcatcttgaaggccaatgagctcttgcaggtcattgattcatccatgaaaaattttaaggccttcttcagatggctgtacgtggccatgctgagaatgaccgaagatcatgtcttgcctgagttaaataaagtgatgacacagaaagatattacgttcgtggccgagttcttgaccgagcactttaatgaagccccagacctctacaacagaaagggcaagtatttcaatgttgaacgagtgggtcagtacctcaaagacgaggatgatgacctggtgagcccccccaatacggagggaaaccagtggtatgattttttgcagaactcatcccatctcaaagaaagccctttactgttcccgtattacccacgaaagtccctacactttgtcaaacgccgcatggagaatataatagatcagtgcctgcaaaaaccagcagacgtgatcgggaagtctatgaaccaggcaatctgcattcccctgtaccgggacacgagaagtgaggatagcacacgacgccttttcaaattccctttcttatggaataataaaacaagcaacctgcattacctcctgtttaccatcctcgaggattccctttataagatgtgtatcctacggcgtcacactgacatcagccagagcgttagtaacggactcatcgcaataaaattcggttccttcacttatgcaacgacggagaaagtgcggcggagtatttacagctgtttagatgctcagttttatgacgatgaaacagtcaccgtagtgttaaaagacaccgtgggccgagagggtcgggacagactgctcgttcagctgccacttagtcttgtttacaatagtgaagactctgccgagtatcagttcactggcacttatagcactagactcgacgagcagtgctccgcgatcccgacgcgtactatgcattttgaaaagcactggagacttctggagtcaatgaaggctcagtacgttgcgggcaacggtttccggaaggtctcttgcgtactgtcctcgaacttgagacacgtgcgggtgttcgagatggatatcgatgatgagtgggaattggatgaatccagcgatgaggaagaagaggccagcaataagcctgtaaagatcaaggaggaggtgctgtctgagtcagaggccgaaaatcagcaagccggggctgctgctctggctccggagattgtcatcaaggtggagaagctcgacccggagctcgacagctag

SEQ ID NO: 178954 - DNA, 2268 bp, Artificial Sequence
  Description of Artificial Sequence: Synthetic coding sequence
atggccagcgtgcacgagagcctgtacttcaaccccatgatgaccaatggcgtggtgcatgccaatgtgttcgggatcaaggactgggtgactccgtacaagatcgctgttctggtgctgctgaatgagatgtcacgcactggtgaaggcgccgtcagccttatggaacgccgcagactgaaccagctacttttgccgctactgcaaggccctgacattacccttagcaagctgtacaaacttatagaggagagctgccctcagctggccaatagtgtccagattcgaatcaagttaatggccgagggagagttgaaggatatggagcagtttttcgatgacctgtctgattcattctctggcactgagccagaggtgcataagacgagcgtggttggcctttttctcagacacatgattctggcttattctaaactgtctttttctcaggtgtttaaactgtacacagccctgcagcagtacttccagaacggcgaaaagaagaccgtcgaggatgcagatatggagctgacatcccgcgacgaaggtgagagaaagatggagaaggaagagctagacgtgtccgttagagaggaggaagtgagctgcagcggcccccttagccagaagcaggctgaattttttctctcgcagcaggcatccctgctgaagaatgacgaaacaaaggctctgacaccagcttccttacaaaaagagctgaataatctactgaagttcaacccagactttgctgaggcccactacctttcttacctcaacaatcttcgagtacaagatgtgtttagtagtacccattccctgcttcactatttcgaccgactgattctgacaggggccgagtctaagagcaacggggaggaaggatacggaagaagcttgcggtacgccgctttaaacctggccgcactacactgccgatttggacattatcagcaggcagagctcgccttacaggaagccatccggattgcgcaagagagcaatgatcacgtatgtttgcagcactgtctgtcctggctgtacgtactcggacagaaaagaagcgattcctacgtactgctcgagcattccgtgaaaaaagccgtgcatttcggactcccctacctggcctcccttggcatccagtctctcgttcagcagcgggccttcgctggcaagacggcgaacaaacttatggatgcacttaaggactcagatctgctgcactggaaacacagcctgtcagagctaatagacatcagcatcgcccaaaaaaccgcaatatggagactgtatggacgatcgactatggcgctgcaacaggcacagatgctgttgagcatgaatagcctcgaggcagtcaatgcaggcgttcaacagaataacaccgagtcttttgcggtcgcactgtgccatttggctgagctgcacgcggaacagggctgtttcgccgcagcctccgaggtccttaagcacctgaaagaaaggtttccccccaacagccaacacgcccaactgtggatgttgtgtgatcagaaaatccagtttgatagggcaatgaacgatggaaagtaccatttggccgactctctagtcaccggcattaccgccctaaacagtattgaaggggtctaccgcaaagccgtagtgcttcaggctcaaaatcagatgtctgaagctcataaactcctgcagaaacttttggtccactgccagaagctgaagaataccgagatggttatcagcgtgctgcttagcgtggcagaattgtactggcgatctagttccccaacgatcgccctgccaatgcttctccaggccctggctcttagcaaggaataccgactgcagtatctcgcgagtgaaacagtgttaaacctggccttcgcccagcttattctgggcattccagaacaggcgctgtcactcctgcatatggccattgaacctatcctggcagacggtgctatcctggacaaaggccgcgcgatgtttctggtggccaagtgccaggtggctagtgcagcttcatacgaccagcctaaaaaagctgaggctctagaagcggccatcgagaatctgaacgaagcgaaaaactatttcgcgaaggtggattgtaaggaaaggattcgggacgtagtctactttcaggcaaggctttaccacaccctcggaaaaacacaagagagaaatcggtgtgcgatgctattccgccaattacaccaggaactcccatcacatggagtgccattaataaatcatctctag

SEQ ID NO: 178955 - DNA, 1932 bp, Artificial Sequence
  Description of Artificial Sequence: Synthetic coding sequence
atggccgagggcgagctgaaggacatggagcagttcttcgacgacctgagtgactctttttcaggaaccgaacctgaagtgcacaagacgagcgtggtgggtctgtttctccgtcacatgatacttgcttacagcaagctttctttctcccaggtcttcaaactgtacactgccttgcaacagtactttcaaaacggggagaagaagaccgttgaggatgccgacatggaacttacctcaagggacgaaggagaacgcaaaatggaaaaggaagaactcgatgtgtctgtgagggaggaggaagtgagctgctcgggtcctctctcccaaaagcaggctgaattctttctctcacaacaagcatccctactaaagaatgacgagacaaaggcccttactccagccagccttcaaaaggaactcaataatttacttaaatttaaccctgatttcgctgaagcccactacctgtcctatctgaacaacctgcgcgttcaggacgtcttctcctcaactcacagcttgctgcattactttgacagactgattctgactggcgcagagtccaaaagcaacggagaggaaggctatggcagatcgctcagatacgccgcactcaacttggcggccttgcactgtcggtttggccactatcagcaggcggagctggccttacaggaagccatcaggattgctcaggagtccaacgatcacgtgtgtcttcagcattgcttgagttggctctatgtactgggccagaagcgctctgattcttacgtactactggaacactctgtaaagaaagcagtccacttcgggttgccgagggcctttgccggcaaaaccgccaataagctgatggacgctctgaaggactctgacctgctgcactggaaacacagtctcagcgaactgatcgatatttcaatcgcacagaaaaccgccatttggaggctgtatgggagatctacaatggcactgcagcaggctcagatgctcctgtccatgaacagcctagaagccgtcaacgccggcgtccagcagaacaatacagagagcttcgctgtcgcactctgtcatctcgcagagctgcacgctgagcagggatgcttcgccgctgctagcgaggtgctgaagcatttgaaggagcggtttccccccaactcccagcacgcccaactgtggatgctttgcgatcaaaagattcagtttgacagagcaatgaatgacgggaagtatcacctagccgattctttagtcacgggcattactgctcttaactccattgagggtgtgtaccgtaaggctgtcgtgctgcaagctcagaaccagatgtcggaagcacataagttactccagaaacttctggttcattgtcaaaaattaaaaaatactgagatggtgattagtgtgctcctgagtgtggccgagctgtactggagaagcagctctcccaccatagcgcttcctatgctgctgcaggctctggctttgagcaaggaatacaggctgcagtacctggctagtgaaactgtgttgaacctcgcatttgcacagctaattctgggcatccccgaacaggcattgtccctgctgcatatggctattgagccaatcttggccgatggagcaattctggacaaggggagagcaatgtttctagtggctaaatgccaggttgccagcgctgcttcctatgatcagccaaaaaaagctgaagccctcgaggccgctatcgagaacctgaacgaggctaaaaattacttcgccaaggttgactgtaaggaaaggataagagacgtcgtttattttcaagctcgactgtaccacacccttggcaagactcaggaacgaaacagatgcgctatgctgttccggcagttgcaccaagaactgcctagccatggagtccctttgatcaaccatctttag

SEQ ID NO: 178956 - DNA, 1932 bp, Artificial Sequence
  Description of Artificial Sequence: Synthetic coding sequence
atggccgagggcgagctgaaggacatggagcagttcttcgacgacctgtctgacagctttagcgggacggagccagaggtacataaaacatctgtggtcgggttatttctgcgccatatgattctggcatactccaagcttagcttttcccaagttttcaaactatatacggcgctgcagcaatatttccaaaacggagaaaaaaagactgtcgaggatgccgacatggagctgacatcccgcgacgaaggagaaaggaaaatggagaaggaggagctggacgtttcagttcgggaggaggaagtaagctgttccgggcccctgtcccagaaacaggccgagttcttcctgagccagcaggccagccttcttaaaaacgacgagacgaaggcccttacccccgccagtcttcagaaggaactcaataacttgctaaagttcaacccagattttgcagaggcgcactatctctcttatctgaataatttgcgggtccaggatgtgttttcaagtacccacagcttgctgcattacttcgatagactgattctgactggggctgaatcaaagtcaaacggcgaagagggatatggcagatccttgcgctacgcagctctgaatttagctgccttacattgtagatttggtcactaccagcaggctgaattagctctccaagaagccatccggatcgcacaagagagcaatgatcacgtctgtctgcagcattgtctcagctggctgtatgtgctgggacaaaaaaggtccgattcatacgtgctcctggagcatagtgtgaagaaggccgttcattttgggctcccgagagcctttgccggaaaaactgccaataaactcatggacgcccttaaagattccgacctgctacactggaaacattccctctcagaattgattgatatcagcatagctcagaagacagccatttggcgcctgtatggccgatccactatggccctgcaacaagcccagatgcttttatccatgaactccctggaggccgtgaatgccggtgtgcaacaaaataacacagaatcatttgccgtggctctgtgccaccttgccgagctgcacgccgagcaaggctgcttcgcggcagcctccgaggttttgaagcatctcaaagaacgctttccacccaattcccagcacgcccagctctggatgctgtgtgatcagaagattcaatttgacagagccatgaatgacggaaagtaccacctggcggactccttggttacagggatcactgccctgaactccatcgaaggggtgtatcggaaagccgtcgtgctccaggcccagaatcaaatgtccgaagcccataagctgctccaaaagctgttagttcattgtcagaagctcaaaaataccgagatggtaatcagcgtcttgttgtccgtcgctgaactgtactggcggagctcctccccaactatcgctctgcccatgctgcttcaggctctggcgctttcaaaggagtatagattgcagtatctggcctctgagaccgtgctgaaccttgccttcgcccagctgatcctgggtatccccgaacaggctttgagccttctccatatggcaatagaaccaatccttgccgacggtgctatcttggataagggcagggccatgttcctcgtggcaaagtgtcaggtggcaagtgctgctagctacgatcagcccaagaaagccgaggccctggaggccgccattgagaatctgaacgaggcaaaaaattattttgccaaggtggactgcaaagaacgcatcagagatgtggtatatttccaggctaggttgtaccacactttaggaaagacccaagaacggaatcggtgtgcaatgctctttcgccaactccatcaggaattgccgagtcacggagttccgctgattaaccacctgtag

SEQ ID NO: 178957 - DNA, 660 bp, Artificial Sequence
  Description of Artificial Sequence: Synthetic coding sequence
atgctgagcccctgcctgagcagctacttcgtgggcctgttcctgagacatatgatactggcttactcgaaattgagtttctcccaggttttcaagctgtacaccgcgttgcagcagtattttcaaaacggtgagaagaaaacggttgaggacgccgatatggagctgacctcaagagacgagggggagaggaagatggaaaaagaggagcttgacgtatcagtgagggaagaagaagtgtcctgctccgggccgctttcccagaaacaagctgaattctttttgtctcagcaggcctcgcttctgaaaaatgatgagacgaaagccttaaccccagccagtctgcagaaggaacttaataatctcttgaagttcaaccccgactttgctgaggcacactatctttcctaccttaacaacttgagggtgcaagatgtgttttcttccacccactcacttctccactactttgacaggttgatactgacgggggctgagtccaaatcaaatggtgaggaagggtatgggcggtcccttcgctacgcagccttgaacctggccgctctccattgccgcttcgggcattacacaagtcctccttgggagtattccccactttttaatcgagagctgctcctcggacgacgccagacttcctag

SEQ ID NO: 178958 - DNA, 135 bp, Artificial Sequence
  Description of Artificial Sequence: Synthetic coding sequence
atggccgagggcgagctgaaggacatggagcagttcttcgacgacctgtccgatagcttctcggggactgagcccgaggtccacaagacttcagtcgttggtctctttctcagacacatgatcctggcatattag

SEQ ID NO: 178959 - DNA, 1074 bp, Artificial Sequence
  Description of Artificial Sequence: Synthetic coding sequence
atggacgccctgaaggacagcgacctgctgcactggaagcacagcctaagtgagctgatagacatcagtatagctcagaaaactgcaatttggcgcctatacggcaggtctacaatggccttgcaacaggcccagatgttgctcagtatgaactctctggaggcagtcaacgcaggagtgcaacaaaacaacacggagagcttcgcagtcgcgctctgtcatctggccgaactccacgcggaacaaggttgtttcgccgccgcaagcgaggtgctcaagcacctcaaggagcgttttcctccaaactcccagcatgcgcagctgtggatgctctgcgatcaaaagatccagtttgatagagcaatgaatgacggaaaataccatctggccgactcactggtaaccggcatcacagccctcaattctatcgagggcgtctacaggaaggcggtcgtgctgcaggcacagaaccagatgtccgaagcacacaagctccttcagaaactgctcgttcactgtcagaagctgaaaaacaccgagatggtaatttcagtgttgctcagtgtcgcagagctctattggcgaagtagcagccctaccattgcactacctatgctgctgcaggccctagccctgtcgaaagagtatcgtctgcaatatctggccagcgaaaccgtactgaacctcgcctttgcccagctgattctggggataccggagcaggctctgtctttgctgcacatggccattgaaccgattctggcggacggggccattcttgacaaaggcagggcaatgttccttgtcgctaagtgccaggtggcttcagctgctagttacgatcaacctaagaaggcagaagctttagaggcagccattgagaacctgaatgaagcaaagaattatttcgccaaggtagactgtaaagagcggatacgggacgtagtctactttcaggcacggctgtatcacacactgggcaaaacccaggaacgaaataggtgtgctatgttatttcgacagctgcaccaggagctgccatcacacggcgtcccactgattaatcatttatag

SEQ ID NO: 178960 - DNA, 2229 bp, Artificial Sequence
  Description of Artificial Sequence: Synthetic coding sequence
atggccagcgtgcacgagagcctgtacttcaaccccatgatgaccaatggagtggtccacgcaaatgtattcggaattaaggactgggttacaccttacaaaattgccgtcctcgtactcctgaatgagatgtcccgcaccggcgaaggggcagtgagcctgatggagaggaggcgccttaatcagttgctactcccactactacaagggcctgatatcaccctctctaagctgtataaattgatagaagaatcatgtccacaactggcgaattccgtacagatccgcatcaagctgatggcggaaggggaactcaaggacatggaacagttctttgacgacctctctgactccttttcgggaaccgaaccagaagtccacaagacctctgtggtcggcctgttcctccgccatatgattctggcatactccaaactttctttttcccaggtcttcaaactgtacacagcactgcaacagtatttccaaaacggagagaagaagactgtcgaggacgcagatatggagctgacatctagagacgaaggggagaggaaaatggagaaggaagaactggacgtcagcgttcgggaagaggaagtgtcttgcagcggtccgttgagccaaaaacaggctgagttttttctttctcagcaggccagtttgcttaagaacgacgaaaccaaggccctgacccctgcctcactccagaaggagctgaacaatttgctaaaattcaaccccgattttgcggaggctcactatctatcctatctaaacaacctgcgcgtacaggatgtcttctcttctacccattcactgttacactatttcgacagactgatcctcaccggggctgaatctaagtcaaatggcgaagaaggctacggacggtctttaagatatgccgccctgaacctggccgcccttcactgccggtttgggcactaccaacaggctgaattggcgctccaagaggccatcaggattgcccaagagtctaacgatcacgtgtgcttgcaacattgcttatcatggctgtatgtgctagggcaaaagcggtccgattcctatgtactcttggagcacagtgttaagaaagccgttcatttcgggctgccaagggcctttgctggcaaaaccgccaataaattaatggatgcccttaaagattctgacctacttcactggaaacactctttgtctgagcttattgacatttccatagcccagaagacagccatttggcgcctctacggacgttcaaccatggctctgcagcaagcccagatgcttctgtcaatgaacagcctcgaggccgtcaatgccggcgtgcaacaaaataatacggagtctttcgctgtggctttatgtcaccttgctgagttacacgctgaacaaggatgcttcgctgccgcgtccgaagtgctgaagcacctcaaggagcgctttcctccaaattctcaacatgcgcagctttggatgttatgcgaccagaagatccaattcgatcgggctatgaatgacggaaaataccatctggccgattcactcgtcaccgggatcaccgcgcttaattctatcgaaggagtgtacaggaaagccgtagtgctccaggcccaaaaccagatgtctgaggctcacaaattactccagaaattactcgtgcactgccagaagctgaagaacactgaaatggtgattagcgttttgctatccgtggcagaattgtactggcggtcttccagtcccacgattgccttgccgatgctacttcaggctttagcactgagcaaagagtacaggctgcagtacttggcttccgaaacggttctgaacttggcttttgcccaactgatactgggcatcccagaacaggccttaagcctgttgcatatggccatcgaacccatcctggcagacggggcaattcttgacaagggcagggcaatgttcctggtggccaagtgtcaggtcgctagtgccgcgtcttatgaccaaccaaagaaggctgaagctctggaggccgccattgaaaacctgaatgaagccaaaaattattttgccaaagttgattgcaaagaaaggatcagagatgtggtgtattttcaggcccggttgtatcacaccttaggtaagacacaggaacggaaccgatgtgccatgctctttcgacaactgcatcaggagctcccatcacatggggtccctctcataaaccacctctag

SEQ ID NO: 178961 - DNA, 1425 bp, Artificial Sequence
  Description of Artificial Sequence: Synthetic coding sequence
atggagctgcccagcggccccggccccgagcggctgttcgacagccatagactgccaggcgattgcttcctgttgctagtgctgctcttgtatgcaccagtaggattctgcctgctggttttgagattatttctaggcatccatgtgtttctggtctcttgtgctctccctgactctgtgctgaggaggtttgtggtgcgaactatgtgtgcggttctgggactagttgcaaggcaagaagacagtggcctgcgggaccactctgtgagagtgcttatttcaaaccacgttaccccatttgaccacaacattgttaacttgctgacgacttgctcgaccgtgagtgaatcagaagcagagtctgctacgggcagatttccaggagcccagcttaaggccccactgtctcctctcgcttttccgatggaagatactgaactgcccctcacccccatactatacccgacttgccagtttttctttattttcctcaacatctttctgctggcatttagttcccccggctcccagcccctgctcaacagccccccatcgttcgtgtgttggtcccgagggtttatggagatgaatggacggggagagcttgttgaatccctgaaacgcttttgcgccagcacacgtctgccaccgacccctctgctcctttttccagaggaggaggccaccaacgggcgggaaggcctattgcggtttagttcctggccattttctatccaggatgtagtacagccgctgaccctgcaagtgcagcgacctttagtctctgtcactgtctcagatgcttcctgggtttctgaactgttgtggtcgctgttcgttcccttcaccgtgtaccaagtgagatggctccgacccgtgcacagacaactgggcgaagctaacgaggaatttgccctcagagtacagcagctggtcgcgaaagagttaggccagacaggaactagactcacacctgccgacaaggccgagcacatgaagagacaacgtcatccccgactgagaccccaatctgcacaatcttcctttcccccctcccctggcccctccccagacgtacagttggctactctcgctcagcgcgtaaaagaggtattaccacacgtgccactgggagtgattcagagggacctggccaaaactggatgtgtggatttgacgattaccaacttgctcgaaggtgccgtagcgttcatgccagaggatatcaccaagggaacgcagtctctgcccaccgcaagtgctagtaagtttccctcatcggggcccgtcacaccccagcccaccgctctgaccttcgccaagagttcttgggcccgccaagaatcactccaggaacgcaagcaggcactctacgaatacgctagaaggaggtttaccgaaagaagggcccaagaagctgactag

SEQ ID NO: 178962 - DNA, 1233 bp, Artificial Sequence
  Description of Artificial Sequence: Synthetic coding sequence
atggagctgcccagcggccccggccccgagcggctgttcgacagccatcgccttcccggcgactgctttcttctcctggttttgcttctttacgcgcctgttggcttctgcttgcttgtgctgcggctgttcctagggatccatgtctttctggttagttgcgcgctcccggattcggtgcttaggaggtttgtggttcgtactatgtgtgcagtgctgggactggtagctcgacaggaggacagcgggctcagagaccactccgtgcgagtattgatttcaaaccacgttaccccatttgaccataacatcgtcaacctcctgacgacatgttccacgcctctgctgaactcccctccgagtttcgtatgttggagtaggggatttatggaaatgaacggaagaggagagttggtcgaaagtctgaagcgcttctgtgcatctactcgcctaccccccacccctctgctgctattccctgaggaagaggcaaccaacgggagagaagggctcttacgtttttcctcatggccttttagtatccaggatgtcgtgcagcccctgacgctccaggtgcagaggcccttggtgtctgttactgtgagcgacgcatcctgggtgtccgaacttctgtggtcgctctttgttcctttcaccgtgtaccaagttcggtggctgcgccctgtccacagacaattaggcgaggctaacgaggaattcgcacttagagtccagcagctggttgctaaagagttgggtcaaacaggcactaggctcacccctgccgacaaagcagagcacatgaagaggcagaggcatccccgtctacggccccaaagtgctcagagctctttccctccatctccaggtccatctccagacgttcaactggcgaccctggctcaaagagtaaaagaggtcctgccacacgtgccactcggcgtgatccaaagagacttggctaagaccggctgcgtcgatctcaccatcactaacctcctggaaggagctgtcgcttttatgccggaggacatcactaagggcactcagtccctcccgaccgcgtctgcttccaagtttccatctagtgggcccgtcacaccacagccaaccgccttaacattcgcaaaatctagctgggccaggcaggaatcactgcaggagaggaagcaagctttgtacgagtatgcaagaaggagatttacagagcggcgcgcccaggaagccgattag

SEQ ID NO: 178963 - DNA, 1128 bp, Artificial Sequence
  Description of Artificial Sequence: Synthetic coding sequence
atggagctgcccagcggccccggccccgagcggctgttcgacagccaccgcctcccaggcgattgctttttgctgctcgtattgctcctctatgcgcccgttgggttttgcctgttggtgctaaggctgtttttagggattcacgtgtttctggtttcctgcgccttgcctgacagtgttctgaggcggttccggtttgtggtgagaaccatgtgcgccgttctgggcctcgtggccaggcaggaggactcgggccttcgggatcacagcgtaagggtgctgatctcaaatcacgtgaccccttttgatcacaatattgtgaacttgcttactacttgcagcaccccactgctgaattcgccccctagctttgtgtgctggagcaggggattcatggaaatgaatggacgcggtgagctggttgaatctctgaagagattttgcgccagcacacggcttcctccaactccactgctgttattccctgaagaggaggccacaaatggccgcgagggattactgagattctcttcttggcctttttcgatccaagacgtcgtccaaccactgacgctgcaggtccagcggcctctggtgagcgtgactgtaagtgacgcctcatgggtcagcgaactcctgtggtcattgtttgtaccttttaccgtgtaccaggtgcggtggttgcggcccgtgcatcgccaacttggagaggcgaatgaggaattcgcactgcgtgttcagcagctggttgctaaagagttaggccaaacaggaactcggttgacccccgctgacaaagccgagcatatgaaaaggcagcgacaccctaggctgcggccccaatctgcccagagctccttcccaccaagtccgggaccttcgcccgatgtgcagctcgcaaccctggcccaaagagtgaaggaagtgctgccgcatgtgcctctgggagtgattcagagagaccttgcgaagaccggatgtgtcgacctcacaattaccaatctgctggagggtgctgtggctttcatgcctgaggacattacgaagggaactcaaagtctccccaccgcgtcagccagcaaggccttcgatgcatgtctgatgatgatgacaccccaagccctgtag

SEQ ID NO: 178964 - DNA, 2145 bp, Artificial Sequence
  Description of Artificial Sequence: Synthetic coding sequence
atggccagcgaggcccccagccccccccggagcccccccccccccacaagcccagagccagagctggcgcagctgcgccgcaaggtagaaaagcttgagcgagaactaaggtcgtgcaaaagacaggtacgcgaaattgagaaattgctgcaccacactgagcggctctaccagaatgccgagtcgaataatcaggagctgcggacccaggtcgaagagctgagcaagattctgcagcgcgggcgtaatgaggacaacaaaaagtccgatgtagaggttcagacagagaatcacgctccatggagcatatcagattatttttaccaaacgtactacaacgacgtcagcctgcctaataaggtgacagagctgtcagaccaacaggatcaagctattgaaacttcaatattgaactcaaaggaccatctgcaggtcgagaatgatgcatacccaggtactgaccgcaccgaaaacgtaaaatatcgacaagttgatcatttcgcctctaacagccaggagcccgcttctgccctcgctaccgaggacacatctctggagggttcctcacttgccgagtctctccgtgcagcagcagaagctgcagtgtcccaaacagggtttagctacgatgagaatactggcctgtacttcgatcactcaacaggcttctattatgattccgagaaccagctgtattatgacccctccaccggaatctactactactgcgacgttgaatctgggcgctaccagtttcactcccgcgtggacctccaaccgtatcctacatcctccactaagcagagcaaggacaaaaagctaaagaaaaagcgcaaggaccccgattctagtgcgaccaacgaggagaaggatctcaactctgaagaccagaaggccttttcagttgagcacacttcctgtaatgaagaggaaaatttcgcaaatatgaagaagaaggcgaaaattggcatccaccacaagaatagccctcccaaggtcaccgttcccacaagcgggaacaccattgagtcgccgctgcatgaaaacatcagcaattcaacatccttcaaggatgaaaaaatcatggaaaccgactcggagccagaagagggcgaaattaccgactcccaaaccgaggattcctacgacgaggcaatcacctccgaggggaacgttaccgccgaggactcagaagacgaggacgaggataagatctggcccccttgcatacgggtgattgtgatccgttctcctgtactgcagatcgggtcactttttataatcacagcggtgaatcctgccaccatcggacgagagaaggacatggagcataccctgaggatccctgaagtgggggtgtccaaattccacgcagagatttactttgaccacgatctccagtcttacgtcctcgtggatcagggctcccagaatggaactatcgtgaacggaaagcagatattacagccgaagacaaagtgtgacccatacgtgttggagcacggagatgaggttaagattggagagactgtgctttcattccatattcatcctggcagtgatacatgtgacggttgtgagcccggtcaggtgcgagcccacctaaggctagataaaaaggacgaatcgtttgtgggacccaccttgtccaaagaagaaaaggagctggaaaggcgcaaagaactgaagaaaatcagagttaagtacggcttgcaaaacacagaatacgaagacgagaagacgcttaagaacccaaaatacaaagatcgtgctggaaagcggcgcgaacaggtcgggagtgaaggtactttccagcgcgatgacgcccctgcaagtgtacattccgaaatcacagattccaataaaggccgtaagatgttggagaagatggggtggaaaaagggcgagggccttggcaaggatggaggtggaatgaagactcctatccagcttcagttgcggaggactcatgcaggcctcgggaccggtaagccaagctcatttgaagacgtgcacttgctgcagaacaagaataaaaagaactgggataaggcacgagagagattcactgaaaactttccagaaacgaaaccccaaaaagacgatcctgggactatgccatgggttaaagggactttggaatag

SEQ ID NO: 178965 - DNA, 531 bp, Artificial Sequence
  Description of Artificial Sequence: Synthetic coding sequence
atggccagcgaggcccccagccccccccggagcccccccccccccacgtccccggaacccgagctggcacagttacgccgcaaggtagaaaagttggaacgcgagttgcgatcctgtaagcggcaagttcgagaaatcgaaaagcttcttcatcacactgagcgcctttaccagaatgccgaatccaacaaccaggaacttcgaacacaggttgaagaactatccaaaatcctgcagcggggtagaaatgaagacaacaagaagtctgatgtcgaagttcagaccgaaaatcatgccccttggagtattagtgactacttttaccagacatactataacgatgtgagcttaccaaacaaagtgactgagctgagcgaccaacaggatcaggctatagagacttctatccttaacagtaaggatcatcttcaagttgagaacgatgcatatcctggcactgacagaacagaaaatgttaaatatcgccaggttgaccacttcgctagcaattcacaggtgatcaagtgttag

SEQ ID NO: 178966 - DNA, 2028 bp, Artificial Sequence
  Description of Artificial Sequence: Synthetic coding sequence
atgccccgggcccagcccagcagcgccagctaccagcccgtgcccgcagatccttttgccatcgtgtctagggcccagcaaatggtcgagatcctgtccgatgaaaacaggaatctgagacaggaactggagggctgctatgagaaggtagccagactgcagaaagtcgagactgagatccagagagttagcgaggcgtacgaaaacctggtgaaatctagtagcaagagagaggccctagagaaagcaatgcgaaacaagcttgaaggcgagatccgtcgcatgcatgactttaaccgcgatctaagggagcgactggagaccgcaaacaagcagctggccgagaaggagtacgagggatcagaagatacccggaagacaattagccaactgttcgccaaaaacaaggaatcacagagagagaaggagaaactggaggctgagctggccacagcaaggtccaccaacgaggaccagaggcgtcacatagaaattagagatcaagcgcttagcaacgctcaggctaaggttgtgaaactcgaagaagagcttaagaagaagcaggtgtatgttgacaaggtggagaagatgcagcaggcgttagtgcagctgcaagccgcctgcgaaaagagagagcaactcgaacataggctccggacccggctagagagagagttggaaagcctgaggatccagcagcggcagggaaattgtcaacccactaacgtgagcgaatacaatgccgcagccttaatggagctccttagagaaaaagaagagcggattcttgctcttgaagcagacatgaccaagtgggaacagaaatatctggaagaaaacgttatgcgtcatttcgcactggatgcagccgctaccgttgccgcacagagagacaccactgtgatctcccactcccctaatacatcttatgatacagccctggaagcccgcatacaaaaggaggaggaagagatacttatggctaacaaacggtgtctcgatatggaaggccgtattaagacactacacgctcaaatcattgagaaggacgctatgattaaggtgctgcaacaaagaagtaggaaggaacccagcaagacagagcagctgagctgcatgagacctgccaagtctctgatgtcaatcagcaatgccgggagtgggcttctgtcccacagtagcaccttgaccggttctccaattatggaagaaaaaagggacgacaaatcctggaaaggaagccttggaatcctcctcgggggggattatagagctgagtatgtccctagtactcctagccccgtgccgccctctactcccctcttaagcgcccattccaagactggtagcagggattgttccacccagactgaacgcggaaccgaaagtaataagacagcagcggtggctccaatctctgtccctgccccggttgccgccgccgccaccgccgcagccatcaccgccacagcagctaccattaccacaactatggtggccgcagcacctgttgctgtagctgcagctgcagctccggctgcagctgccgcaccctctcccgccaccgccgccgccacagccgccgctgtttcccccgctgctgccggccagatacctgcagctgcctcagtggcctccgccgccgccgtggctccctcggctgccgccgcagctgcagtgcaggtagcccctgccgcgcctgccccagtgcctgcacctgctctggtgcctgtcccggcgcctgcggcagctcaggcatcagctcctgcccaaacacaggctcccacgagcgcccctgccgtcgcacccacgccagcgcctaccccaactcctgcggtggcacaggccgaggtgccggcatctcctgctaccggaccaggcccccacagacttagtatcccttcgctgacctgcaatcccgacaagaccgacgggccagtctttcattcaaataccctggaaagaaagacacctatccagatcttaggccaagagccagacgccgagatggttgagtacctgatttag

SEQ ID NO: 178967 - DNA, 1794 bp, Artificial Sequence
  Description of Artificial Sequence: Synthetic coding sequence
atggagcaccggggccccccccccgagtaccccttcaagggcatgccgccacaaagtgtggtatgtaagccccaagagccggggcacttctacagcgagcaccgactgaaccaaccagggcgtacagaaggacagttaatgcggtaccagcatccgcctgaatatggcgctgccagacctgcccaggacattagcctcccactctctgcccggaactctcagcctcattctccgacatctagcctgactagcgggggatctcttccactgttgcagtctcctccctctacacgtttgtccccagccaggcatcccctggtccctaatcaaggggaccactcagcccacttacctcggccccagcaacatttcctgcccaaccaagcacatcagggcgatcattaccgcctaagccagcctgggctgagccagcagcaacagcagcagcagcagcagcaccaccaccatcatcatcaccagcagcagcagcaacaacagccacagcagcagccgggggaggcatactcagctatgccacgggcacagcccagtagcgcctcataccagcccgttcccgctgatcccttcgccattgtctcgcgtgcacaacagatggtggagatcctgagcgatgaaaacaggaacctcaggcaggagcttgagggttgttacgagaaggtggcaaggttgcagaaggttgaaacagaaattcagagagtcagcgaggcgtatgagaacctagttaagtcatcaagtaagagggaggccctcgagaaagccatgcgaaataaacttgagggagagataagacgaatgcatgactttaatcgggacttgcgggaacgtctcgaaactgcaaataagcaactggcggagaaagaatatgaaggctctgaggataccaggaagactatcagccagctgttcgcaaaaaataaggagtcccagcgggaaaaagagaagctggaggccgagctggccacagctcggagcaccaacgaagatcagcggcggcatattgagattagggaccaggctctctccaacgcacaggccaaggttgtcaaactcgaggaagaattaaaaaagaagcaggtctatgtggacaaggttgaaaaaatgcagcaggcccttgtgcagcttcaggccgcctgtgaaaaacgggaacaactcgaacataggctgcggacacggctggagcgcgaactggaaagccttcgcatccagcagaggcaggggaattgccagcctaccaatgtgagcgagtacaatgccgcagccctcatggagctactgcgggagaaggaagagcgaatcctcgcactggaagccgacatgacaaagtgggagcagaagtatctggaggagaatgttatgaggcatttcgccctggacgcggccgccaccgtggccgcgcagcgggacaccactgtgatcagtcattctccaaacacctcctatgataccgccctggaggccagaattcaaaaagaggaggaggaaatactaatggccaataaacgctgtctcgatatggaggggaggattaagacgctgcacgctcagataatcgaaaaggacgctatgatcaaggtcctgcagcaacgctcgcggaaggaacctagcaaaactgaacagctctcatgtatgcgacccgccaagtctctgatgtctatttctaacgccgggtctgggcttctgtcacactcctctaccctgaccggaagccccatcatggaggaaaagagagacgataagtcttggaaaggaagcctgggaaacgactccaaatag

SEQ ID NO: 178968 - DNA, 3255 bp, Artificial Sequence
  Description of Artificial Sequence: Synthetic coding sequence
atgcggaacagcgaggagcagcccagcggcggcaccaccgtgctgcaacgactgctccaggagcagctcagatacgggaatccgtccgaaaaccggagtctgcttgccattcatcagcaagctactgggaatggtcccccttttccaagtggctccggcaacccgggtccacagtctgacgtgttgagccctcaggatcatcaccaacaactggtggcacatgctgctaggcaggaacctcagggacaagagattcagagcgaaaatctgatcatggagaaacagctgtccccaagaatgcagaacaacgaggagctccccacctatgaggaggctaaagtgcagtctcagtattttcgcggacagcagcacgctagcgtcggcgccgcattctacgttaccggcgtcaccaatcagaaaatgcggacagagggaaggccttcagttcaaaggctgaatccaggtaagatgcatcaggacgaaggactgagagatctgaagcagggccatgtacgatctcttagtgaacgcctaatgcagatgtccctcgccactagcggcgtcaaggctcacccacctgtcacctcggctcctctctcccctccccagcctaacgatctgtataagaacccaacgagttcatcggagttctacaaagcccagggaccactccccaatcagcatagtctgaaaggcatggaacataggggtcctccacccgagtatccctttaagggaatgccaccccagtcagtagtgtgcaaaccccaggagcccgggcatttctattcagagcataggcttaatcagccaggcaggaccgagggccaattgatgcgttaccagcaccccccagaatacggagccgcccgcccagctcaggacatttcactgccactgagcgccagaaactctcagccccatagcccaacaagctccctcacaagtgggggcagcttacccctgcttcaatcgccacccagtactagacttagccctgctcgccatcctcttgtgccgaaccagggcgatcattcagcgcacctaccacgacctcaacagcattttttgcccaaccaagcacaccagggagatcactatcggctatcacaacccggtctgagccagcagcagcagcagcagcagcagcagcaccaccaccaccaccaccatcaacagcaacaacagcagcagcctcagcagcagccaggagaggcttactccgctatgccccgggcccagccatcctccgcctcttatcagcccgttccagctgacccttttgcaattgtgtcccgcgctcaacagatggtggaaattctctcggacgaaaatagaaatctgcgtcaggaactggagggctgctatgagaaagtagcaaggctgcaaaaggtcgagaccgagatccagcgggtatctgaagcttacgagaatctcgtgaaatcaagttcaaaacgcgaggctctcgaaaaggccatgaggaacaagcttgaaggggagattaggagaatgcatgactttaaccgtgacctgcgcgaacggctcgaaaccgctaacaagcagcttgcagagaaggaatacgagggcagcgaagacaccaggaagactatcagtcagctgttcgccaaaaacaaagagtctcagcgcgaaaaagagaaattggaagccgagcttgcgacagcccggagcacgaacgaggatcagcgtaggcacatcgagatccgggatcaggccctgagcaatgcccaagcaaaggtcgtgaaattggaagaggagctgaaaaaaaaacaggtctatgtcgacaaagtggaaaagatgcagcaagctctggtgcagttacaggcagcctgcgagaaaagggaacagcttgagcaccgcttgagaactcgcctcgaacgagaattggagagcctgcgtatacaacagaggcagggaaactgtcagcctaccaatgtgagcgaatataacgcagcagcactcatggagctgcttcgcgagaaagaagagagaattctcgctctggaggcagacatgaccaagtgggaacagaaatatctggaggagaacgttatgcggcatttcgcccttgatgcagcggcgactgtggcagctcagagagacactactgtgattagccatagccctaatacaagctatgatacagcattggaagctcgaatacagaaggaagaggaggaaatcctcatggcaaacaaaagatgcctggacatggaagggcggatcaaaacacttcacgcccagataattgagaaggatgccatgatcaaggtgctacaacagaggagtaggaaggagccttcaaaaacagagcagctgtcttgcatgcggcccgcaaagagtctgatgtctatttctaacgctggcagcgggctgctatcccactcaagcacgctgactgggtctcccatcatggaggaaaagagagacgacaaaagttggaaaggatccctagggatccttcttggtggcgattacagagcggaatatgtgcccagcaccccgagccctgtgcctccctccactccactgctttctgctcacagtaagaccggctctcgggactgttccacccagacagagcgaggaaccgagtctaacaagactgccgccgtcgcccctatctccgttcccgcaccagtggccgccgcagccacagctgctgccataactgccaccgccgctaccatcaccacgacaatggtggccgccgcaccagtggcagtggctgcagcagcagcccccgcagccgcggctgcaccctcccccgccactgccgccgcaaccgctgccgccgtgtcacctgctgctgccggccagattcccgctgctgcatcagtagcttccgccgcggccgtagccccctccgccgctgctgcagctgctgttcaggtggccccagccgcacctgcccccgtgccggctcctgcattagtgcctgtgccggccccagctgcggcacaagccagcgctcccgcccagacccaggcacctacttccgctcctgcagtagcaccaactcctgcgcctacaccgactcctgctgtggctcaggctgaggtgcctgctagccctgccaccggcccgggaccacacagactgtcaattccctctcttacttgtaatcccgataaaacggacgggcccgttttccactccaacacgctggagcgaaaaactccgatccaaattttgggacaggagccagacgctgaaatggttgaatatcttatctag

SEQ ID NO: 178969 - DNA, 2559 bp, Artificial Sequence
  Description of Artificial Sequence: Synthetic coding sequence
atggagcaccggggccccccccccgagtaccccttcaagggcatgccaccacagagcgttgtctgcaagcctcaggagccagggcacttctacagcgaacacagacttaatcaacccggcagaaccgaggggcaactgatgcggtaccagcacccacctgagtacggagcagctaggccagcgcaggacatctctctgcccttatcagcacgcaacagtcaaccccattctccaacttcatccctcacgtcaggtggctctctgccattgttgcaaagcccaccctcaactagattgtccccagcccgccacccactcgtcccaaatcaaggtgaccactccgctcatctgcccaggccacagcaacacttccttccaaaccaggctcaccagggggatcactataggctgagtcaacctggccttagccagcagcagcagcagcagcaacaacagcaccaccatcatcatcaccatcaacagcagcagcagcagcaaccacagcagcagcccggtgaggcctacagcgccatgcccagggcccagcctagcagtgcaagttatcagcccgtccccgccgatccgtttgccatcgtgagccgtgcccagcagatggtcgagattctgtccgacgaaaatcgcaatctgcgccaggagctcgagggttgctacgagaaggtggcccgcttacagaaggtggaaacagaaattcagagggtgtcggaagcgtatgagaatcttgtgaagtcttccagtaagagagaggcgcttgagaaggcgatgcggaataagctcgagggcgaaattcgccgcatgcatgatttcaatagagacctgagggagcggttagagaccgcaaacaagcaacttgccgagaaggagtatgagggcagtgaggatactcgcaaaacgattagccagctctttgcaaaaaataaggaatcccaaagagaaaaggagaaactggaggcagaacttgcaaccgcaaggtctaccaatgaagaccagcggcggcatatcgaaataagggaccaggctcttagtaatgctcaggcaaaagtcgtgaaactggaagaggagctgaaaaagaagcaagtctacgtcgacaaagtggagaagatgcaacaagcgctcgttcagctgcaggccgcctgtgaaaagagagagcagctggaacaccgcttgcggacaagactcgagcgggagttggaatcccttaggatccagcagcgacagggtaattgtcaacccactaacgtgagtgagtacaacgcggctgcactcatggagcttctgcgagaaaaggaggagagaattttggccctggaggccgacatgaccaagtgggagcagaagtatttagaagaaaacgtcatgcgacatttcgctctggacgcagcagccacggttgccgcccaacgagacaccaccgtgatctcacactcacctaacacctcctacgacaccgcacttgaagcacggattcagaaggaagaggaggaaatactaatggccaacaagaggtgtttggacatggagggaaggatcaagacccttcatgctcaaattattgagaaagatgccatgataaaggtgttacagcaacggagccgcaaagagccctctaaaacagaacaactttcctgtatgcgcccagccaagtcccttatgtctatatcgaatgccggctctggtcttttatcacattcaagcactcttactggtagcccaatcatggaggagaaaagagatgacaagtcctggaagggctcacttggtatcctgcttggtggagattatcgcgcagaatacgtgccgtctacaccctcccccgtcccgccaagtactcctctcctctcggcccatagtaaaactggctccagggattgctcaacacagactgaacgcgggaccgaatcaaataagaccgctgctgtggcccccatctccgttccggcccccgtggcggcagccgccactgccgcggccatcacggctaccgctgcaaccataacaacaacaatggtcgcagctgcgcccgtggcagtggcggctgctgctgctcctgccgcggcagcagccccttccccagccacagcggcagccactgcagccgcagtctctccggccgcggccggacagatccctgccgccgcaagtgtggcctcagctgcggccgttgcaccatcagccgcggctgccgcagccgtccaggttgcgccagccgcccccgccccagtgcctgccccggccctggtgcccgtgccggccccagccgccgcccaggcctctgcccccgcacaaactcaggcaccaacgagtgcgccagccgtagcgcccacacctgcgcccacccctacccctgctgtggcacaagctgaagtccccgccagtccagccaccggtccaggcccccatcggctatccatcccttcacttacttgcaaccccgacaaaacagacggcccagtatttcactctaacactcttgaacggaagacacccatccagattctcggccaggagcccgatgctgagatggtcgagtacctaatctag

SEQ ID NO: 178970 - DNA, 549 bp, Artificial Sequence
  Description of Artificial Sequence: Synthetic coding sequence
atgatcaaggtgctgcagcagcggagccggaaggagcccagcaagacggagcaattatcttgtatgcgccccgccaagtctttgatgtcaatttctaatgctggcagcgggttgctgtcccactcaagcactttgaccggctcccctattatggaggagaaaagagatgataaaagttggaagggatcactgggtatcctgctggggggggactaccgcgctgagtatgtgccgtccacacctagcccagttccgccatccacccccttgctgtccgctcactctaaaactggatcacgcgattgtagcacacagacagagcgaggcaccgagagcaataagacagcagcggtcgctcccatatcagtaccagcccctgtggctgccgccgcaaccgcggcagcaatcacagcgactgctgcaaccattacaactaccatggctgctgcagcagcaccaagtccggcaacagccgctgcaactgctgctgcagtctccccagctgcggctggccagatccctgcagccgcttccgtcgcaagcgcctag

SEQ ID NO: 178971 - DNA, 3255 bp, Artificial Sequence
  Description of Artificial Sequence: Synthetic coding sequence
atgcggaacagcgaggagcagcccagcggcggcaccaccgtgctgcagcgtttgctgcaagagcagttaaggtatggcaatccttctgagaatcggtccttactggctattcaccaacaagccaccggtaatggacccccattcccctcaggctccggtaaccccggaccgcagtcagacgtgttgagccctcaggaccaccatcagcagctggtggcgcacgccgctagacaagaacctcaagggcaggaaattcagtccgagaatctgataatggagaaacaactgtcccccaggatgcagaacaacgaggagctccctacctacgaagaggccaaagtccaaagtcaatatttccggggccagcagcatgcctctgtcggcgccgccttttacgtgaccggcgtgacaaatcagaagatgcgcacagaaggccgccccagcgtgcagcgcctcaatcccggtaaaatgcatcaggatgaaggtcttagggacctgaaacagggccacgtaagatctctctccgagaggctcatgcaaatgtcacttgccacatctggtgtcaaagcacacccccctgtcacttccgcacccctgagcccgcctcaacctaatgacctgtacaagaacccaaccagcagttctgagttctacaaggcacagggaccactccctaatcagcactctctgaaaggcatggaacaccggggaccacccccagagtacccgttcaaaggtatgcccccacagtcagttgtatgcaaaccccaggagccgggacatttctattctgagcatagacttaatcaacctgggcggacagaaggacagttaatgagatatcagcacccccccgagtacggcgcggcccgccctgcccaggacatttcacttcccctttccgcgcgaaacagccaacctcattcccccacgagtagcctgacaagcggtggatccctgccacttttgcaaagcccaccatctacccgcctgtcccccgcaaggcaccccctggtccctaatcagggcgaccacagcgcgcacctgccccgcccacaacaacactttctacctaaccaggcccatcaaggggatcattacaggctttctcagccaggactgagtcagcaacaacagcagcagcagcagcagcaccatcaccaccatcaccaccagcagcagcagcagcaacagccacaacaacagcctggcgaggcctactctgcaatgcctcgggctcagccctcaagcgcaagctatcaacccgtccccgcagacccgttcgccatagttagtcgggctcaacagatggtcgaaatcctttctgacgagaacaggaacttacggcaagagctggaggggtgttatgagaaagttgccagattgcagaaagttgagactgagatccaaagagtgtcagaggcttacgagaatcttgtgaaatcctctagcaagagagaggcactggaaaaggcaatgcggaataaactggagggggagattaggcgcatgcacgacttcaaccgcgacctgagggagcgattggaaaccgccaacaagcagttggctgaaaaggagtacgaaggttcagaagatacgaggaagaccataagtcagctttttgccaagaataaagagagccagagggagaaagagaagcttgaagccgaactggccacagcacgcagtacgaacgaggatcagagacgacatatcgagatacgcgaccaagctctgagcaatgcccaggccaaagtcgtcaaattggaagaagaactaaagaagaagcaggtgtatgtggataaagtggaaaagatgcagcaggctctcgtgcagctacaagctgcctgcgagaagcgtgagcaactggagcaccgccttagaacacggctggagcgcgagttggagtccctgaggatccagcagaggcagggtaactgtcaacccactaatgtaagcgagtacaatgcagctgctttaatggagcttctgcgggagaaggaagagcggatcctggccctagaggccgatatgactaagtgggagcaaaaatatcttgaagagaatgtcatgcgacatttcgcactggacgccgcagctacagttgccgcacaacgggatacaacggtgattagccatagtcctaacacaagctacgacacagcactcgaagctaggatccagaaagaagaagaagagatccttatggcgaacaagcgatgcctcgacatggagggaaggattaaaaccttgcacgctcagattatcgagaaagatgccatgataaaagtactccagcagcggtcccgcaaagagcctagcaaaaccgagcagttgtcgtgcatgaggcccgccaagtccctgatgtctatatctaacgccggaagcgggctcctgagccattcaagcacattaaccgggagccccataatggaagagaaaagggatgacaagagttggaaaggcagtctgggtattttgcttggtggtgattacagggccgaatacgtgccatcaacaccctctccggtgcctccctccacaccactccttagcgcacacagcaagaccggctcccgagactgtagcacccaaacagaacgaggtaccgaatcaaacaaaaccgctgcagtggccccgatcagcgtgcctgccccagtcgctgccgctgccactgccgccgctattacggctacagccgcaacgatcacaaccactatggttgccgctgccccagtcgctgtggccgcagctgccgcaccagccgccgcggctgctcccagcccagctactgccgccgccacagccgctgcagtctcacctgccgccgccggtcagatcccagcggccgcttctgttgcgtcggcagccgccgttgctccatcagcagctgctgcagccgctgtgcaggtcgccccagcagctcccgcccctgtgcccgccccggctttggtgcccgtgcctgctcctgccgcagctcaggcttcggctccagcccagacacaggccccaacttcggcccctgcagtggcgcccactcctgcaccaactcctactccggccgtggcccaggcagaagtgcccgcatctccggcaaccggtccaggcccccaccgactttccataccctctctgacatgtaatcccgacaagacagatggaccagttttccactccaacactctggagcggaagaccccaattcagattctcggccaggaaccagacgccgaaatggtggaatacctgatatag

SEQ ID NO: 178972 - DNA, 1512 bp, Artificial Sequence
  Description of Artificial Sequence: Synthetic coding sequence
atgctgagccagctggccatgctgcagggcagcctgctgctggtggttgctactatgtctgtcgctcagcagacaaggcaggaagctgataggggctgtgagaccctcgtggtgcagcacggccactgtagttatacttttctgctgccgaagtccgagccatgccctccgggccccgaggtatctcgggactccaatactctgcagcgtgaatccctggctaaccccttgcatttgggaaagctgcccacccagcaggtcaagcagttagagcaagctctccagaataacacgcaatggctgaagaagctcgagcgagctataaaaaccatactgagaagcaagcttgagcaagtccagcagcagatggctcagaaccagaccgctcccatgttagagctcggaacatctctgctgaaccagacaactgcacagattcgcaagttgacagacatggaggcccagctgctaaaccagacctccagaatggacgctcaaatgcccgaaacattcctgagcacaaacaagctggagaatcaattgctgctccagcggcagaagctacaacagctgcaaggacaaaacagcgcactcgaaaaacggctgcaggccttggagaccaaacaacaggaagagctggcctctattttgtccaagaaggctaaactgttgaacaccctctcacgccaatctgcggctcttaccaacatagaaagggggttgcggggagtacggcacaatagctcgctgctccaggaccaacaacattccctgcgtcagctgcttgtcttacttaggcacctggtccaagagagggccaatgcctccgctcccgcattcattatggctggagagcaggtatttcaagattgcgccgagatccagcgaagcggcgcttccgcatcgggagtctacacaatacaggtctctaatgctacaaaaccaagaaaggtcttctgcgatctccagagcagcggcgggcggtggactttaattcagaggcgggagaatggcactgtgaacttccagcgaaattggaaagactacaagcagggtttcggagatcctgcaggcgagcactggttgggcaacgaggtcgtccatcagctgactagacgcgccgcttactctctacgtgtagaactccaggattgggaaggacatgaggcctacgctcagtacgaacactttcatctcgggagcgagaaccagttgtaccgtctgtccgtagtagggtacagcgggtcagcaggacgccagagctccttagttttgcagaacacctccttttctactctggattcagataacgaccattgcctttgcaaatgcgcccaggtgatgtctggaggctggtggttcgacgcatgtggtctcagcaatttaaacggggtgtactatcacgctcccgacaataagtacaaaatggatggcattcggtggcactactttaagggtccttcttatagcctccgagccagtaggatgatgatcagacctctcgatatctag

SEQ ID NO: 178973 - DNA, 1233 bp, Artificial Sequence
  Description of Artificial Sequence: Synthetic coding sequence
atgctgagccagctggccatgctgcagggcagcctgctgctggtggtggcaactatgtccgtcgcccagcaaaccagacaggaagctgatcgcggatgcgagacattagtggtgcagcatgggcactgcagctatacattcctgcttcccaagtctgaaccatgcccccctgggcctgaggtgagtagggatagcaacacattgcagagagaaagtctcgcgaatcccctccatctcggaaagctacctactcagcaggtgaagcagcttgaacaagctctccagaacaatacccagtggctgaagaagctggagagagccatcaagacgatactgcgcagcaagctcgaacaggtccaacagcaaatggctcaaaaccagaccgccccaatgctggaactgggtaccagtctgctaaatcagactactgcacaaatcaggaagctaactgacatggaggcacagctcctgaatcagaccagccggatggatgctcaaatgcctgaaaccttcctgtcgacaaataagctagagaatcagttactgctgcagcgccagaagctgcagcagttgcagggacaaaattccgccctcgagaaaaggctgcaagcgttagaaaccaaacaacaagaggaactcgcaagcattctctccaagaaagctaaactcctgaacacgctcagccggcaatctgccgccctcacaaacattgagcggggactgcgcggcgtacggcataactccagcctcttgcaagatcagcagcacagcctgaggcagttactcgttctgttgcgccatttggttcaggaaagggccaacgcctcagcacccgcattcattatggcaggggaacaagtgtttcaagactgtgctgagatccaacgctctggcgcttcagcctcaggcgtgtacactatacaagtctccaatgcaaccaaacctcgcaaggtgttttgtgatctccagtcctcaggagggagatggacactcattcagcggcgggaaaacggaaccgtgaatttccaaagaaattggaaggactacaagcagggcttcggtgatccggccggcgagcattggttaggcaacgaggtagtgcatcaactgacacgtcgggctgcgtatagccttcgtgtggaactgcaggattgggaaggtcacgaggcctacgctcagtacgaacactttcacctgggcagtgagaaccagttatacagggtggtcgtgtag

SEQ ID NO: 178974 - DNA, 1383 bp, Artificial Sequence
  Description of Artificial Sequence: Synthetic coding sequence
atgttcaccatcaagctgctgctgttcatcgtgcccctggtgatctctagccgaatcgatcaggataattcctcctttgactctctgagtccggaacctaagagcaggttcgcgatgctggatgacgtcaagatcttggctaatgggctgctgcagctgggccatgggctaaaagatttcgtgcataaaactaagggccagattaacgatatcttccaaaaactgaatatttttgaccagtcattttatgacttgtccctccaaacatcagagatcaaggaggaagagaaggaactgcgacggacgacgtacaaactgcaagttaagaacgaagaagtgaaaaatatgagtctcgagctcaactccaagctcgaatcactccttgaagaaaaaatcctgttgcagcaaaaagtgaaatacctcgaggagcagttgaccaaccttattcaaaaccagcctgaaacacccgagcaccccgaagttacttcactaaaaacttttgtcgagaagcaggataatagcattaaagaccttttgcagaccgtggaagatcagtacaaacagttaaatcaacagcatagtcagatcaaagagatcgagaaccagctgcggcggacatcgatccaggaacccacagagatctctctgtcctccaagcccagagccccaagaactacccccttcctccagctgaatgagatccggaacgttaaacacgatggtatccccgcggagtgtaccacgatttacaacagaggtgaacacacatctggtatgtacgctattcgcccatcaaattcccaagtgtttcacgtttactgcgatgtgatctcgggctccccttggacactgatacaacaccggatagatggatcacagaatttcaatgagacctgggagaattataagtatggcttcgggcgcctcgacggtgagttttggctcggcttagaaaaaatttactcaattgttaagcagagcaattatgtgttgaggatcgagcttgaggactggaaagacaacaagcactatattgaatacagcttttatctgggtaatcacgagactaactacacgctgcacctggtggcgatcactgggaacgtcccaaacgcaatccctgagaacaaagatctggttttttcgacgtgggaccacaaagctaaaggtcattttaattgccccgagggctacagcgggggctggtggtggcatgatgaatgtggcgaaaacaatctcaacggaaaatataataagccacgggccaagagcaagcccgaaaggaggagaggattgagctggaagtctcagaacggacgcctgtattctatcaagagcaccaagatgctgatccatcccacagattccgagagttttgaatag

SEQ ID NO: 178975 - DNA, 1167 bp, Artificial Sequence
  Description of Artificial Sequence: Synthetic coding sequence
atgatgagccccagccaggccagcctgctgttcctgaacgtgtgcatattcatctgtggcgaagcagtacaggggaattgtgtgcaccattccaccgacagctctgtggtgaacatcgtagaggatggttccaatgcgaaagacgagtccaaaagtaatgatactgtctgcaaggaagattgtgaggagtcctgtgacgtgaagactaagatcacacgcgaggagaaacattttatgtgccggaatcttcaaaatagcatagtctcttacacccgatctactaaaaagcttttgcgaaatatgatggatgagcagcaagcttccctggactacctctctaaccaggtgaacgagctcatgaaccgggtgcttcttcttacaactgaagttttccgcaagcagctcgatcccttcccccaccgccccgtacaatcccacggcctggattgtacagacatcaaggacaccatcggaagcgtcaccaaaacaccttcaggattgtacatcattcaccccgagggatcttcctaccccttcgaagtgatgtgtgacatggactacagaggcggcgggcgaaccgttatccaaaagcggatcgatggcataatagatttccagcggttgtggtgcgactacctggacgggttcggtgatttgctgggcgagttttggctgggcttgaaaaaaattttctacatcgtgaatcagaaaaatacgagcttcatgctatatgttgcgcttgagagtgaagatgataccctcgcctacgcatcctacgataacttttggctagaagatgaaactagattcttcaagatgcatcttggacggtactccggcaacgcgggagatgccttccgcgggctcaagaaggaggataatcaaaacgctatgcctttttccacctcagatgtggataatgacggctgcaggcccgcctgtctggtgaatggtcaatccgtgaagagctgtagccatctccataataaaacgggatggtggtttaacgagtgtggtctggcaaatctaaacggaatacaccactttagtggtaagctgcttgccactggcatccaatgggggacgtggactaagaataactctcccgtgaaaataaagtctgtgtctatgaagatccggagaatgtataatccatattttaagtag

SEQ ID NO: 178976 - DNA, 1413 bp, Artificial Sequence
  Description of Artificial Sequence: Synthetic coding sequence
atgggcaagccctggctgcgggccctgcagctgctgctgctgctgggagcctcctgggcacgagccggagcgccacggtgcacgtacacatttgtgctccctcctcagaaatttaccggtgccgtgtgttggtctggaccagcatccacccgcgccacgccggaggctgctaatgcttccgagctcgccgcactaagaatgagggtgggccgccacgaagagctcctacgtgagttgcagagactggcggccgccgacggcgcggtggccggcgaagtgagggcactccggaaggaaagtcggggtttgtctgcccgtttgggacagctgagggctcagctgcagcacgaagcaggacccggcgccggacccggcgcggacttgggagctgaacctgcagctgcattagcactcctaggcgaacgggtcctgaatgcctcagccgaggcccagcgtgcagcagcacgattccaccagctagacgttaaatttcgggagcttgcccaactcgtgacccagcagagttcgcttattgctagactagagagactctgcccagggggagcgggtggccaacagcaggtgctgcctccccccccactcgtgccagttgtgcccgttcggctggtggggtccacgagcgacacttctcgcatgttagaccctgcccccgaacctcagagagatcagactcagagacagcaggagcctatggccagtcctatgcccgcaggacacccagctgttcctactaaaccggtggggccatggcaggactgtgcggaagccaggcaggcaggacatgaacagagtggggtctatgaactcagggttgggcgacatgtagtgagtgtctggtgtgagcagcaactggaaggcggcgggtggacagtgatacagagacggcaagatggaagcgtgaactttttcacaacctggcagcactataaggccgggttcggacgacccgacggcgaatactggctgggcctggagcctgtttaccagcttacctccaggggcgaccacgagctgctcgtcctgctggaagactgggggggccgcggggcaagagcgcattacgacggattttcattagagccagaatctgatcactaccggctccgcctcggacagtatcacggcgatgctggagattcactttcatggcacaacgataaaccctttagcacggttgatcgtgaccgcgatagctactctggcaattgtgcgctgtaccagcgaggcggctggtggtatcacgcttgcgctcattcaaatctgaatggtgtttggcaccatgggggccactacaggtcccggtatcaggatggggtttattgggccgaatttcgggggggcgcttatagcctgagaaaagccgcgatgctcatccgaccattgaaactgtag

SEQ ID NO: 178977 - DNA, 2199 bp, Artificial Sequence
  Description of Artificial Sequence: Synthetic coding sequence
atgggccagggctgggccaccgccggcctgcccagcctgctgttccttttactctgttatggccaccctctgcttgtaccaagccaggaagcttcgcaacaggtcaccgtcacacacggcacatcttcccaggccaccaccagttcgcaaactaccacacatcaggctactgcccaccagacctctgctcaaagtcctaacctcgtgacggacgaggccgaagccagtaagttcgtggaggaatatgacagaacttctcaggtcgtctggaatgagtacgctgaggctaactggaactataacaccaatatcactacagaaacaagtaagattctgctgcaaaagaatatgcagatcgcgaatcacactctcaagtatggaacacaggccaggaaattcgacgtgaaccagttgcagaacaccaccatcaaaagaatcatcaagaaggtccaggacctggagcgtgccgcactccctgcacaagagttggaggaatacaataagattcttctcgacatggagacaacatacagcgtggctaccgtgtgccacccaaatgggagttgtctgcaattagagcccgatctgaccaatgtaatggccacatctaggaagtatgaggatctgctgtgggcctgggaggggtggagagacaaagccggccgcgccatcttacagttctatccaaaatatgtggaacttatcaaccaggctgctagactgaacggttacgtggatgctggggactcgtggcgcagcatgtatgaaacaccctccctggaacaggatctggaacggctgttccaggagctccagcctctctacctcaatctccatgcttatgttcgcagagcgctccataggcactatggagctcaacatattaatctggaaggcccaatccctgcccacctcttaggaaacatgtgggctcaaacctggtctaacatttacgacctggtggtcccattcccttcagccccatccatggacaccacagaggccatgttaaaacagggctggacacctaggaggatgtttaaggaagccgacgatttctttacctctctggggttgctccccgtgccccctgagttctggaacaagtcaatgctggaaaagccaaccgatggtcgggaggtggtctgccacgcgtctgcttgggacttttataacggaaaagacttccgcatcaagcagtgcacaactgtcaatctcgaagatctcgtggttgcccaccatgagatggggcacattcagtatttcatgcagtacaaagacctgccagtcgccctcagagagggggctaatccaggctttcatgaagctataggggatgttttggcactgagcgtttccaccccaaagcatctgcactctctgaatctgctgtcgtccgagggcggctccgatgaacatgacatcaatttcctgatgaagatggccctggacaaaattgcttttatcccgttctcctatctggttgaccaatggagatggagggtcttcgacggcagcattacaaaggagaattacaaccaagaatggtggtccctacgtttaaagtatcagggtctgtgccccccagtaccgcggacccaaggggattttgaccccggtgccaaattccacatcccttcttctgttccttacattagatacttcgtgtctttcatcatccaattccagtttcatgaagcattgtgtcaggccgctggtcacaccggtcctcttcacaagtgcgatatctaccagtccaaagaagcaggacagcggttggccacagcaatgaaattagggttctcccggccatggccagaagcaatgcagctgataaccgggcagccaaatatgtccgcatccgctatgcttagttattttaagccattgctggactggttgcggacagaaaacgagctccatggtgaaaagttgggatggccccagtacaactggactccaaatagcgcccgctcagagggtccactgccagatagcgggcgcgtgtcattcctggggcttgaccttgatgcccagcaagctagggtgggacagtggctcctcttgttcctgggaatcgctctcttggtagccacactggggctctctcagagactgttcagtattcgtcatagaagcctgcacagacattcacacgggccacaattcggaagcgaagtggaattaaggcacagctag

SEQ ID NO: 178978 - DNA, 3921 bp, Artificial Sequence
  Description of Artificial Sequence: Synthetic coding sequence
atgggcgccgccagcggccggcggggccccggcctgctgctgcccttgccgctgctgcttctcctgccgccacagcccgccctggcgcttgatcctgggcttcagccaggtaacttcagcgccgacgaggctggggcccaactgtttgcgcagagttataactcctctgccgaacaggtcctgtttcaaagcgttgcagccagttgggcccatgatacaaacataactgctgaaaatgcccgtagacaagaggaggcagcgctcctgtcacaggagttcgccgaagcttggggccagaaggcgaaagaactgtacgagcccatctggcagaacttcacggatccccaattaaggcgcattattggggccgtccgcacacttggcagcgcgaatctcccactggccaagagacagcagtataacgctctcttgagcaatatgagtaggatatactccactgcaaaggtgtgcctccccaataaaactgctacctgctggtccctggacccggacctaacaaacatacttgcctcttccaggtcatacgccatgctcctctttgcttgggagggatggcataacgcggcaggcatccctttgaaacccctgtatgaggattttacggcactgtccaatgaagcctataaacaggacggctttactgacacaggcgcatattggcgaagttggtacaatagccccacgttcgaggatgatctggagcatctgtaccaacagctggaaccgctctacctgaacctccatgcgttcgtgcgcagggccctgcaccgtcgctacggagaccgatatatcaatcttcggggacccattcctgctcacctactcggcgacatgtgggcccagtcatgggagaatatctacgacatggtcgtgccgttcccagataaacctaacctagatgtgacctcaacgatgctgcagcagggatggaacgccacccacatgtttagggttgccgaggaattcttcacatctctggaacttagtcccatgcctccagaattttgggaggggagcatgctggaaaaaccagctgacggccgcgaggtcgtttgccatgcctccgcttgggacttctacaatagaaaggatttccggattaagcagtgcacgagggttacgatggatcagctgtccactgtgcaccacgaaatgggacatatccagtattatctgcagtataaggacctacccgtctcattgaggcggggtgctaatccgggcttccatgaagccatcggggacgtgctagcgctctctgtgtctacccccgaacacttgcacaagattggcctccttgatcgagtcactaacgacacagaaagcgatatcaattatctgcttaagatggcactggagaaaatcgcattcctccccttcggctatttggtcgatcagtggaggtggggcgtgttcagcggtagaacacctccttctcggtacaattttgattggtggtaccttaggacaaagtaccagggcatctgtccaccagtgacccgaaatgagacccacttcgatgcaggcgcaaagttccatgttcccaacgtcaccccatatattaggtatttcgtctcctttgtgttgcaattccagtttcatgaggccctatgtaaagaagcgggttatgaaggcccgctgcatcagtgtgatatctatcggtcaactaaagccggagccaaactgcggaaagtgcttcaggccggcagtagcaggccgtggcaggaggtcctgaaagacatggttgggcttgacgccctggacgctcaacctctgctgaagtactttcagccggtgacacaatggctccaagaacagaatcagcagaacggtgaggttctaggatggccagagtatcagtggcatcccccgctacccgataactatcctgaaggtatagatttggtgaccgatgaggctgaagcaagcaagttcgtcgaggagtatgacaggacttctcaggttgtgtggaatgagtatgcagaagcgaattggaattacaataccaacatcaccacagagacaagcaaaatattgctgcaaaagaatatgcaaatagcaaaccataccctgaaatatgggactcaggcaaggaaatttgatgtgaatcaactgcagaacactacaataaaacggattataaaaaaagtccaagacctagagcgagctgcgctgcccgcccaagagctggaggaatacaataagatcctcctggacatggagaccacatacagcgtcgctacggtgtgtcacccaaacggcagttgtctgcaattggagcctgatttaaccaatgtaatggccacttccagaaaatacgaagacctgctgtgggcctgggaggggtggcgagacaaagcaggacgcgccatcttacaattttaccctaagtatgtggaactcatcaaccaggctgccaggctgaatggttatgtggatgcaggagactcttggcgctcgatgtatgagacccctagtcttgagcaagacctcgaacgccttttccaggaactccagcctctgtatctgaacctgcacgcctacgtccgcagggccctccatcgacattatggcgcacagcacattaatctggagggtcctattccggcgcatcttctgggcaacatgtgggcacagacctggtccaatatctacgacctggtggtcccattcccctccgcaccatcgatggatacaactgaggccatgctgaaacaggggtggacacctcggcggatgttcaaggaagccgatgattttttcacgtccctgggactgttacctgtgcctcctgaattttggaacaaaagtatgttagagaagccgaccgacggacgcgaggtcgtgtgccacgccagtgcttgggacttctacaacgggaaggacttccgaattaaacagtgcacaactgtaaacttagaggatttagtggttgcccatcatgagatgggccatattcagtactttatgcagtacaaggacctccctgtcgcacttcgcgagggcgctaacccaggatttcatgaagcgatcggcgacgtcttggccctcagtgtgtccacacccaagcacctccatagcctgaatctgctgagctctgaaggggggtcagatgagcacgatattaatttcttaatgaagatggcacttgacaagattgcttttataccattcagctatctcgtggaccaatggcgatggcgagtctttgatgggagcataaccaaagagaactataatcaggaatggtggagcctacggctcaagtatcagggcctgtgtcctcccgtgccccggacccagggtgatttcgatccgggggcaaagttccacattcccagctcagtgccctatatccgctactttgttagtttcataatccagttccaatttcacgaagccttgtgccaggccgctggccacacaggcccactacataagtgcgacatctatcagagcaaagaagccggacagcggctcgccactgcaatgaagctgggattttcaaggccttggcccgaggctatgcaactgatcacagggcagccaaatatgagcgcctccgccatgctgtcttacttcaaacctctgctcgactggctcaggactgagaatgagctccatggcgaaaagctcggatggccgcagtacaattggactccaaactcagctagaagtgaaggtccgctccctgactctggccgggtgagcttcctggggctcgatctggacgcccagcaggcgcgggtagggcagtggctgttgctgtttctaggcatagctttactggtggctacactgggtttgtctcaaagactcttctctattcggcaccggtcactgcataggcactcacacggcccacagtttgggagcgaagtggaactaaggcactcttag

SEQ ID NO: 178979 - DNA, 2076 bp, Artificial Sequence
  Description of Artificial Sequence: Synthetic coding sequence
atgggccagggctgggccaccgccggcctgcccagcctgctgttcctcctgctctgctacggccaccctttgctggtgccctcccaagaagcttctcagcaggttaccgtgactcatgggactagtagccaggccactactagcagccagaccacgactcaccaggccacagcacatcaaacaagcgctcagtcacctaatttggtgacagacgaggcagaggctagtaaatttgtggaggaatacgacagaacaagtcaggtggtatggaatgagtatgccgaggcaaactggaattacaacacgaatatcaccaccgagaccagtaagattctgttacagaaaaacatgcagattgctaatcacaccttaaagtacggcacccaggctcgcaagttcgatgttaatcagcttcaaaatacgacgatcaaaagaatcattaagaaagttcaagacctcgagagggccgccctgccggcacaggagctggaggagtacaataaaattctgcttgacatggaaacaacttactccgtggcaacagtctgtcaccccaatggtagttgtttgcagctcgaacctgaccttacaaatgtcatggccactagcaggaaatacgaggatttgctctgggcctgggagggctggagggataaagcgggacgggccattctgcagttttacccaaaatacgtcgaactgataaaccaagctgctcggttaaatggatacgtggatgccggagacagctggcgatcaatgtacgagaccccttcacttgaacaagatctggaacgcctgttccaggaactacagcccctgtacctcaatttgcatgcgtacgtgcggagagcacttcatagacattacggggcccagcatatcaatctggaaggccctatacctgctcacctgttagggaatatgtgggctcagacgtggagcaatatctacgacttggtagtgccatttccatcagctccatccatggacactacagaggccatgctgaaacagggatggacaccccggagaatgtttaaagaagctgatgactttttcacctctctcggtctgctaccagtcccccccgagttttggaacaagtctatgctggagaagccgactgatggccgggaggttgtttgccacgcctcggcttgggatttttataacggcaaagatttcagaataaagcagtgcaccacagttaatctggaggacctagtggttgcgcaccacgagatgggacatatccagtactttatgcaatacaaggacctgcccgtggctttacgagagggagccaatcctgggttccacgaagcaatcggtgatgtgctcgccctgagcgtttcgacacccaagcacttacatagtttaaatctgttatcatccgagggcggctctgacgagcatgacatcaactttctgatgaagatggccctggataaaatcgcattcattcccttcagctatctggtcgaccagtggcgctggcgagtgttcgatggatccataactaaggaaaactataaccaggagtggtggagcctgagactcaaataccaggggttatgccctcctgtgcccagaacacagggcgactttgacccaggagctaagtttcatattccctcctcagtaccttacatacgcaccgccatgaagttgggcttttccaggccgtggcccgaggccatgcagctcataaccggacagccaaacatgagcgcctctgccatgctgagctactttaaaccactgctggactggctgcgaaccgagaacgagctgcacggcgagaaactcggctggccgcagtacaattggacacccaattcggcacggtccgagggccctctgcctgactctggccgagtgtctttcttgggcctggacctcgacgctcagcaagccagagtgggccagtggcttctgctgtttttaggcatagccctactggttgccacactaggcctctcccaacggctgtttagtatcagacaccgctcactccatcgccactcccacgggccgcagtttggatccgaggtggagttaaggcactcatag

SEQ ID NO: 178980 - DNA, 1536 bp, Artificial Sequence
  Description of Artificial Sequence: Synthetic coding sequence
atgcagatcgccaaccacaccctgaagtacggcacccaggcccggaaattcgatgttaatcagctgcagaataccactattaagaggatcattaagaaagtccaggatctggagcgggctgcccttcccgcccaggaattggaagagtacaataaaatcctcttggatatggaaaccacctattcggtagccactgtctgtcatccgaacggttcctgccttcagctcgagccggacttgacaaacgttatggctacctccagaaagtatgaagatcttttatgggcctgggagggttggagggataaagccggtcgcgccattctgcagttctacccaaaatatgttgagctgattaatcaggccgctcggttaaatggcaacatgtgggcacagacatggtctaatatttatgatctcgtcgtgccgtttccatctgcacctagcatggataccacggaagccatgctaaaacagggatggacccccagacggatgttcaaggaagctgacgatttctttactagcttagggttgcttccggtgcccccagagttttggaacaagtctatgctggagaagcccacagatggtagggaagtcgtgtgtcatgccagcgcgtgggatttctacaatggcaaagatttcaggataaagcagtgtacgacagtgaatctggaagatctggtggtagctcatcatgagatgggccatatacagtacttcatgcagtacaaggatttgcctgttgcccttagagagggcgcaaaccctggcttccacgaagctatcggagacgtgctggcactttccgtgtctactcctaagcacctccacagcctcaacctgctgagctcagaggggggttccgatgagcacgacataaatttcctgatgaagatggcacttgacaagattgctttcattccattcagttatctcgttgatcagtggaggtggagggtgttcgatggaagcattaccaaggagaactacaatcaggaatggtggtcactccgcttgaagtatcagggattgtgccctcccgtgccccgcacacagggcgactttgacccaggggctaagttccatattccctcgtccgtcccatatatcaggacggcaatgaagctgggcttttctcgtccatggcctgaggcaatgcagttaatcacaggccagccaaatatgagtgcttccgccatgctgagttattttaagcctctcctggattggctgagaaccgagaacgaactccacggcgagaagctcggctggcctcagtataactggacgccgaactccgcccggagcgagggaccactgccggattccgggcgggtctcattcctgggattagatctggacgctcagcaggcccgggtaggtcaatggctcctgcttttcctcgggatcgccttattggtggctacattgggtttgtcacaacggctgttctcgatccggcaccgtagccttcacaggcatagtcacggtcctcagttcgggagcgaggtagaactgcggcacagctag

SEQ ID NO: 178981 - DNA, 3438 bp, Artificial Sequence
  Description of Artificial Sequence: Synthetic coding sequence
atgggcgccgccagcggccggcggggccccggcctgctgctgccccttcctctgttactgctgctgcctccgcagccagccctagcacttgatcctgggctccagccgggcaatttcagcgccgatgaagcaggcgcccaattgtttgcccagtcctataattccagcgcagaacaggtattattccaaagcgtcgctgcttcttgggctcatgacaccaacataactgccgagaacgctaggagacaggaggaggcagcactcctgagccaagagttcgctgaggcatggggccagaaagccaaggaattgtacgaacctatctggcaaaacttcacagacccacaactcagaagaattataggtgccgtgcggactctcggttccgcaaatctgcccctggcaaagcgccagcagtataatgcccttctctctaacatgagtcggatttacagcactgccaaggtttgcttgccaaataaaactgctacatgttggagccttgacccggatctgactaacattttggccagctcgagatcttacgcaatgctgctctttgcctgggaaggctggcacaatgctgccgggattcctttaaagcctttatacgaagacttcactgccctttcaaacgaggcttataagcaggacggcttcacggacacaggcgcgtattggaggtcatggtacaactccccaacctttgaagacgatctggaacacttgtatcagcaactggagcccctctacttgaacctccacgccttcgtgagacgtgcattacaccgaaggtatggggacagatacatcaacctcagaggccctataccggctcacctactgggagacatgtgggctcaatcttgggaaaacatctatgacatggtggttccctttcccgataaaccaaacctagatgtgaccagcaccatgttacagcaagggtggaacgccacacacatgttccgggtcgctgaagaattctttacaagcttagaactatctcccatgccacctgaattctgggagggatcgatgctggagaagcccgctgacggtcgcgaagtggtctgccacgcaagcgcttgggacttctataaccgcaaagatttccgaatcaagcaatgtacccgtgtgactatggatcagctgagcacagtgcaccacgaaatgggtcatattcagtactacctgcaatataaggacttgcctgtgtccttaagacgtggagcaaatcccggcttccatgaggcaattggagacgtccttgccctctccgtcagcacacctgaacacctacacaaaatcggactgctggaccgtgtaacaaacgacacagaatctgacattaattacctgcttaaaatggccctggagaaaatcgccttcctacctttcggctatctggtcgaccagtggaggtggggcgtcttttctgggaggacaccaccatcacgttacaacttcgactggtggtacctcagaacaaagtatcaaggtatttgtcccccagttactcggaacgagactcactttgatgccggcgcaaagtttcatgtgccgaatgtgaccccctatatacggtacttcgtgagctttgttctccaattccaatttcatgaagcgctttgtaaagaagccggctacgagggacccttacaccaatgtgacatttaccggagcaccaaagccggcgccaagctgagaaaggttctgcaggctggatcaagcagaccttggcaggaagtgctgaaagatatggtgggcctcgacgcccttgatgctcagccgctactaaagtacttccaacccgtgacacaatggcttcaggagcagaaccagcaaaacggggaggtgctgggttggcctgagtaccagtggcatcctcccctcccagataattacccagagggaatagatcttgtgacagacgaggcggaagcctcgaagttcgtagaggaatatgaccgaacttcccaggtggtatggaatgagtatgccgaggcaaactggaactacaatactaacatcactacagagactagcaaaattctgcttcagaaaaatatgcaaatcgccaatcacaccctgaagtatggcactcaagcgcggaagttcgatgtgaaccagctccaaaacactacaatcaagcgcatcattaagaaagtgcaggatcttgagagggccgccctgcccgcacaggagctggaggaatataataaaattcttctggacatggagacaacgtactccgtggctacagtgtgtcacccaaatgggtcctgtttacagctcgaacccgatctaactaacgtgatggcaacatcccggaagtatgaagacctcttgtgggcctgggaggggtggcgcgacaaagctggaagagccattttgcagttctatcctaaatacgtcgagctgatcaaccaggctgcgcgcttgaatgggtacgtcgatgccggcgactcctggagaagcatgtacgaaactccgtccctggagcaggatttagaaagactgtttcaggagctgcagcctctgtacttgaacctgcatgcatacgtgcgcagggccctgcaccgtcactacggcgcccagcatatcaacttggaaggccctatcccggcccacttattgggcaatatgtgggcgcagacatggtcaaacatttatgatcttgttgttccctttccaagcgcacctagcatggacaccacggaagccatgctaaaacaaggttggacgccacgccgcatgttcaaagaggccgatgattttttcacctcactcgggctgctgcccgtccctcctgagttctggaacaagtcgatgctggagaagcccacagatggtcgcgaggtagtctgccacgcgtcagcatgggatttttataacggaaaggactttcgtattaagcagtgtacaaccgtgaatctggaagatctagtagtcgcccatcatgaaatgggccacatccagtacttcatgcagtacaaagatctccccgtggcactccgggaaggcgcaaatccaggtttccatgaagcaataggtgacgtgttagccctctccgtgtccacccccaaacatctccattcactaaacttgctcagttccgaaggtgggagtgacgaacacgatatcaacttcctaatgaagatggcacttgataaaatagccttcataccatttagctacctcgtggaccagtggcggtggagggtgtttgatgggagcattaccaaagaaaattataaccaagagtggtggtctttgcgtctgaaatatcaggggttgtgccccccagtgccgcgcacacagggtgactttgaccccggagcgaaatttcacattcccagctccgtgccctacatccggtatttcgtatctttcatcattcagtttcatccattcagtcagcataccgctgcctag

SEQ ID NO: 178982 - DNA, 1428 bp, Artificial Sequence
  Description of Artificial Sequence: Synthetic coding sequence
atgggcgccgccagcggccggcggggccccggcctgctgctgcccttgcctttactcctgcttctgcctcctcagccagccctggccctggatcctggcctgcagccaggaaattttagtgcagatgaggctggggcccagctcttcgcccagtcatacaattcatctgccgagcaggtgttatttcagtccgtggcagcctcttgggctcatgataccaatatcacggcagagaatgccaggaggcaggaagaggccgccttattatcccaagaatttgccgaagcctggggacagaaggccaaggagctgtatgagcctatatggcaaaattttaccgatcctcagctacggcgcattatcggggcagtgcgaacactgggctcagccaacttacctctggctaagaggcagcagtataacgctctcctgagcaacatgagtcggatctactccacagctaaagtgtgcctccccaataagacggccacatgttggtctctagatcccgacctgacaaatatcctggcatcttcccgctcttatgctatgcttctcttcgcctgggagggctggcataacgctgcaggtataccactgaagccgctttacgaggacttcaccgcactgagcaacgaagcctataagcaggatggattcacagacaccggtgcctattggaggtcctggtataactcccctacatttgaagatgatctggagcatctctaccagcaacttgagcccctctacttgaacttgcatgcattcgtgagacgcgcacttcataggagatatggcgaccggtatataaatcttcggggaccgatccctgcccacctcctaggcgacatgtgggctcagagttgggaaaatatatacgacatggtggtgccgttccccgataaacccaatttagatgtaacttcaactatgctacaacagggctggaatgccacccacatgttccgcgtcgccgaagagtttttcacgtctctggaactttcaccaatgccccccgaattctgggagggtagcatgttagaaaagcctgcagacggcagggaagtggtgtgtcacgcctctgcctgggacttttacaacagaaaagacttccgcattaaacaatgcaccagagtgacgatggaccagctgtcaacagtgcaccacgagatgggtcacattcagtattacttgcagtacaaagaccttccagtctcactgcgtcgaggagcgaaccccgggttccacgaggcaattggggacgtactggcattatcagtgtctacaccagagcacttgcacaagataggccttctcgacagagtcaccaatgacactgagccctccattcgtggctcagtcctgcttctccccgaaaccaagcctacccttatgctggagctgagctttatgtttcagatgtag

SEQ ID NO: 178983 - DNA, 1080 bp, Artificial Sequence
  Description of Artificial Sequence: Synthetic coding sequence
atgatcctgaacagcagcaccgaggacggcatcaagcggatccaggacgactgcccaaaagcaggccggcacaattacatatttgtaatgatcccaaccctttactctattatcttcgtggtggggattttcggcaattccttagtggtgatagtgatctatttttacatgaaactgaaaaccgtggcttcggtgtttttattgaatctggcgctggctgacctctgcttcctgctaaccctgccgctgtgggcagtgtacactgctatggagtacagatggccttttggcaactacctgtgcaagatcgctagcgcctctgtatcttttaatttatacgctagcgtcttcctgctgacatgtctttcaatcgatagatatctggccattgtgcacccgatgaaaagcagactacgtagaaccatgttagttgctaaggtaacctgtataatcatctggctgctggctggcttagcttcattaccggccataattcatcgcaacgtcttttttatcgagaacacaaacatcaccgtttgtgcctttcactatgaaagtcagaattcaacgctacctatcgggctcggccttacaaagaatatcctggggttcctcttccctttcctgatcattttaacctcatatacacttatctggaaagccctcaaaaaggcctacgagattcaaaaaaacaagcctagaaatgacgacatctttaaaatcattatggccatagtgctgtttttctttttctcttggatcccacaccaaattttcacctttcttgacgtcctgatccagcttggtatcatcagggactgcaggatcgctgatattgttgatactgcaatgcccatcaccatctgcattgcctacttcaacaattgtctcaacccgctgttttacggcttcctgggtaaaaagttcaaacggtatttccttcagcttttgaaatacataccgcctaaggcaaaatcccattcaaacctgagcaccaaaatgagtaccctgtcgtacagaccgtcggataacgtaagcagctctaccaagaaaccagccccctgctttgaggtcgagtag

SEQ ID NO: 178984 - DNA, 1080 bp, Artificial Sequence
  Description of Artificial Sequence: Synthetic coding sequence
atgatcctgaacagcagcaccgaggacggcatcaagcggatccaggacgactgcccaaaggccgggaggcacaactatatctttgtgatgattcccaccctgtattcaataatctttgtcgtgggcatttttgggaactcactcgtggtcatagttatctatttttacatgaagctcaagaccgttgcgtcagtgttccttctgaacttagcccttgccgacctgtgcttcctgctgaccctgcctttatgggctgtgtataccgcaatggagtatagatggccttttggtaactacttatgtaagattgcatctgccagtgtgagtttcaacctgtatgcctctgtgttcctgcttacatgtctgagtatcgacaggtatctggccatcgttcaccccatgaagagccgactgaggaggacaatgctggtggcaaaggttacttgtattattatttggctgcttgcaggcctggccagcctgcctgcaataattcacaggaacgtgttcttcattgaaaatacaaatatcaccgtttgcgccttccactacgaaagccagaacagcaccttgcctatcggtttaggcctaacaaagaacatactggggtttctgttccccttcctgataatactgaccagctacactctaatttggaaagcactgaagaaggcctatgagattcagaaaaacaagcctcgaaatgacgatattttcaagatcatcatggctatcgtgctgttctttttcttctcttggatccctcatcagatctttacattcctggatgttctcatccagctgggcattataagagactgccgtatcgcggatattgtcgacactgccatgcccatcaccatctgtatagcctactttaataactgtctcaacccactcttttatggcttcctgggcaagaaatttaagagatattttctgcagcttctgaaatatattccgccaaaagctaagtcccattcgaatctgagcaccaaaatgagtacgctgtcctacaggccttcagataatgtgtcctcatctactaaaaaacctgccccgtgctttgaagtcgagtag

SEQ ID NO: 178985 - DNA, 1080 bp, Artificial Sequence
  Description of Artificial Sequence: Synthetic coding sequence
atgatcctgaacagcagcaccgaggacggcatcaagcggatccaggatgactgccctaaggccggccggcacaactacatctttgtcatgatccctaccctgtatagtatcatttttgtggtaggaatctttggaaacagcctggtggtgattgttatttacttttatatgaaattgaaaaccgtagcgtcagttttccttctcaatctcgcactcgcagacctttgtttccttttaacgctgccactttgggccgtttacacagcaatggagtaccggtggccctttgggaattacctgtgtaaaatcgcttccgcatccgtctcttttaatctgtacgcttcagtgtttttgctgacttgcctgtcgatcgacagatacttggcaattgtgcatcccatgaaaagcagattaaggagaacaatgctcgtagcaaaggtaacatgtatcatcatctggctgctggcaggcttggcctctctacccgccataatccacagaaatgtatttttcattgaaaacaccaatatcacagtgtgtgcattccactatgaatctcaaaactctaccttgccaattggactgggcctgaccaagaatattctaggattcctgtttcccttcctaatcatcctgacctcctatacgctgatttggaaagcccttaagaaagcctatgagattcagaagaacaaacctcggaatgacgatatttttaaaataattatggctattgtcctcttcttctttttttcttggattccccaccagatcttcacatttttggatgtcctcatccaactggggatcatccgagactgtcggatcgctgatatagttgacaccgctatgccgatcactatttgtattgcctattttaataactgtctcaaccctctcttttatggatttttgggcaagaaatttaagaggtatttcctgcaactccttaaatacataccccctaaggcgaaatcccatagcaatctgagcaccaaaatgtctactctgtcatataggccctctgacaatgtctcatcttccacaaaaaagccggctccctgttttgaagtggaatag

SEQ ID NO: 178986 - DNA, 1080 bp, Artificial Sequence
  Description of Artificial Sequence: Synthetic coding sequence
atgatcctgaacagcagcaccgaggacggcatcaagcggatccaggacgattgtccaaaggccggccggcacaactacatcttcgtcatgattccgaccctgtacagcatcatattcgttgtgggcatcttcggtaattctttggttgttattgtgatttacttctacatgaaattaaagacagtggcatctgtgttcttactgaatttggccctcgctgacttatgttttctgttgacactccctctatgggccgtgtacacagccatggaatacaggtggccgttcggcaattacctgtgtaagatcgcaagtgcctctgtttcctttaacctctatgccagtgtctttttgctgacttgcctgtccatcgaccgttacctggccattgtgcacccaatgaaatctcgcctgaggcggactatgctcgtcgctaaggttacttgcataattatttggctactggccgggcttgccagcctgcctgccataatccacaggaacgtgttctttatagaaaacactaacattactgtatgtgcatttcattatgaaagtcaaaactcaaccctgcccattggcctgggcctcacaaaaaacattctgggcttcctgtttcctttcctcattatcctaaccagttacacactcatttggaaagcgctaaagaaagcctatgagatccagaaaaacaaacccagaaatgacgatatatttaagatcataatggccatagtgttgttcttttttttttcatggatcccgcaccaaatctttacattcctagacgtgctgatacaattgggtatcatccgcgattgcaggattgccgatattgtcgacacagctatgcctatcactatatgcattgcctactttaacaactgtctaaaccctctcttttacgggttcctgggtaaaaagtttaagcgttatttcctacagctcctgaaatacattccacccaaagctaaatctcactcaaacctctctacaaagatgtccaccctgtcttacagacctagtgataatgtgtcctcatctacaaagaagcccgcaccgtgcttcgaggtggagtag

SEQ ID NO: 178987 - DNA, 1080 bp, Artificial Sequence
  Description of Artificial Sequence: Synthetic coding sequence
atgatcctgaacagcagcaccgaggacggcatcaagcggatccaggacgactgcccgaaggccggtagacacaactatatctttgtgatgataccgaccctctactctattatcttcgtggtagggatctttggcaactcactcgtggttatcgtgatatacttctacatgaaattgaaaacagtcgcgtccgtattcttgcttaacttggctctggctgatctctgtttcctgctcacacttcccctgtgggcagtctatacagcaatggagtacaggtggcctttcggaaactatctgtgtaagatagctagcgcctcggtgtccttcaacttgtatgcctccgtatttttgctcacctgtctgtcaatcgaccggtacctggcaatcgtgcacccaatgaagtctcgtctcagacggaccatgctcgtcgcgaaggtgacttgtattattatttggttattagccggactcgcaagcctccctgcgataattcaccgtaacgtgtttttcatagagaacaccaatattactgtgtgtgcattccattatgaatctcagaacagcacattgcctataggcctcgggctgaccaagaacattctagggttcctgtttccttttttgataattttgacctcttatactcttatatggaaagcattaaagaaggcctatgagattcagaaaaacaagcctcggaatgatgatatttttaaaatcatcatggccatcgttctcttcttctttttttcttggattccgcaccagatttttacctttctcgacgttctgatccagctgggtattatccgcgactgcaggattgctgacatcgttgataccgctatgcctatcactatctgtatcgcctatttcaacaactgcctgaatccgcttttttatggctttctaggaaaaaagtttaagcgatacttcttacaactgctgaaatacatcccccccaaggcaaaaagccattccaatctgagcacgaaaatgtcaacactatcctatcgaccctccgacaacgtgagctcttctacgaagaagcccgcaccgtgcttcgaagtggagtag

SEQ ID NO: 178988 - DNA, 1080 bp, Artificial Sequence
  Description of Artificial Sequence: Synthetic coding sequence
atgatcctgaacagcagcaccgaggacggcatcaagcggatccaggatgattgtcctaaggctgggcggcacaattatatcttcgtcatgataccaacactgtattctataattttcgtggtcgggatcttcggcaactctctagtcgtaattgtgatttatttctatatgaaactgaaaaccgtggcctcagtgttcctgctaaacctggcattagcggacttgtgttttctactgacactgcccttatgggcagtgtacaccgccatggaatatcgttggcctttcggaaattatctgtgcaagatcgcgtctgcctctgtatcttttaacttatacgcctccgtgtttcttcttacctgcctctccatcgaccgctacctagccattgttcacccgatgaagtcgaggttgagaagaacgatgttggtagctaaagtcacgtgtatcattatttggctcctagctggcctggccagcctccctgcaatcatacatagaaacgtgtttttcatcgagaacacgaacatcacagtttgtgcattccactacgagtcccaaaatagcaccctgcctatcggcctcggcctgacgaaaaacatcctgggattcctgttcccatttttgatcatcctcacttcatacacccttatctggaaagcattgaagaaggcctacgagattcagaaaaataagcctaggaacgacgacatcttcaaaattatcatggcaatcgtgctgtttttcttcttttcctggattccacaccagatctttaccttcttggatgtcctaattcagctaggaatcatcagagattgccgaatcgctgacatcgtcgacaccgcaatgcccattaccatttgtattgcctactttaataactgcctgaaccccttgttttatggattcttgggaaaaaaatttaaacgatatttccttcagctgctaaagtatattccacccaaggctaagagccatagcaatctctccaccaaaatgagtaccctgtcttaccgcccaagcgacaatgtcagctcctccacaaaaaagcccgctccttgtttcgaggtggagtag

SEQ ID NO: 178989 - DNA, 1080 bp, Artificial Sequence
  Description of Artificial Sequence: Synthetic coding sequence
atgatcctgaacagcagcaccgaggacggcatcaagcggatccaggacgattgcccaaaagccggccgccacaattacatttttgtcatgattccaaccctgtacagcatcatcttcgttgtaggaattttcggcaacagtttagttgtaatcgttatatatttctacatgaaattaaaaaccgttgcttccgtcttccttctgaatttggctttagctgatctctgcttcttgctaactctgcctctgtgggccgtgtacaccgccatggaatatcggtggcctttcggaaactacctatgtaagatcgcctccgcatccgtgtccttcaacctctacgcttctgtttttctcttaacatgcttgtcaattgacaggtacctcgctatcgtccaccccatgaaaagtaggctgagacggacaatgctagtcgcaaaggtaacttgcattatcatctggcttctggctggcctggctagcctgcctgccattatacaccggaacgtgttcttcattgagaatacaaatataactgtatgtgccttccattacgagagtcaaaactcaacacttcccatcggcttggggctgacgaagaatatcttggggtttcttttcccattcctcattatcctgacaagctacacgcttatctggaaggccctgaagaaagcatacgagatccaaaaaaacaagcccaggaacgatgatattttcaaaattatcatggctattgtgctgttctttttcttcagttggatcccccatcagatctttactttcctcgacgttttgattcagctgggcattattagggattgtcgaatagcggatattgtagacaccgctatgcctatcaccatttgtattgcttacttcaacaactgtctaaaccctctcttctatggtttcctaggtaaaaagtttaagaggtatttccttcagctactgaagtatatcccgcccaaagctaagagccattctaacctgtccactaaaatgagtacgctgagttaccgtccatcagacaacgtgtcatcgagtactaaaaagccagctccctgctttgaagtggaatag

SEQ ID NO: 178990 - DNA, 1080 bp, Artificial Sequence
  Description of Artificial Sequence: Synthetic coding sequence
atgatcctgaacagcagcaccgaggacggcatcaagcggatccaggacgactgccctaaagccggcagacacaattatatctttgtaatgatccctactctttatagcattattttcgtcgtcggaatattcggaaactccctggtggtgatagtaatctacttttatatgaagctgaagacggtcgccagtgtctttctgctgaatctggccctggccgacctttgtttcctgctgactctccccctgtgggctgtgtacaccgcgatggaatatagatggccatttggaaactatttgtgcaaaatcgcctcagcaagtgtgagctttaacctctacgcgtcagtctttctgctcacttgcctctccattgaccgatacctggccatagtccaccccatgaagagccggctcagacgcaccatgctggtcgcgaaggtgacatgtattataatttggctgttggcgggactggcttcactgcctgcaattatccacagaaatgtttttttcatcgagaacacgaacattactgtgtgtgcctttcattatgagtcacagaatagcactcttccaatcgggcttggtctcacaaagaatatactgggtttcctgtttccgttcctcattatattgacaagttacaccctgatctggaaggccctgaaaaaggcctacgagatacagaagaataaacctcgaaatgacgatatctttaagatcattatggctatcgtgctgttcttctttttttcctggatcccccatcagatttttaccttccttgatgtgctcatccagctggggatcattcgggactgtcggatcgcagacatcgtggacaccgccatgccaattacgatctgtattgcctattttaacaactgcctgaatccactgttttacggcttcttaggaaaaaagttcaaaagatatttcctccagctgctcaagtacattccccccaaagcgaaatctcactcaaaccttagcaccaagatgagcaccctatcctatcggccaagtgacaacgtttcctcttctacaaagaagcccgccccctgcttcgaggtcgaatag

SEQ ID NO: 178991 - DNA, 1080 bp, Artificial Sequence
  Description of Artificial Sequence: Synthetic coding sequence
atgatcctgaacagcagcaccgaggacggcatcaagcggatccaggatgactgccctaaagctggtaggcacaattacatcttcgtcatgattcctaccctttacagtattatcttcgtggtgggaatctttggcaactcacttgtggtcatagttatttatttttacatgaaactaaagacagttgcatcagtgttccttcttaatctggcgctggcggacttgtgtttcctgttgaccttgccactctgggcagtgtacactgcgatggaataccggtggccctttgggaactatctatgcaaaattgcatctgcctctgtctcatttaacctttatgcgagtgtgttcctgcttacctgtctgtctattgatcgctacttggctattgtgcatcccatgaagagtcggcttcggcgcacaatgctagtcgccaaggtgacatgcatcataatctggttgctcgccgggctggcctcactgcccgcaatcatccatagaaatgtcttctttattgagaacaccaacataacagtctgcgccttccattacgaaagtcagaattccaccctgccgataggcctggggctgaccaagaatatcctgggttttctttttccctttctcatcattctgacttcctatactctcatctggaaagcattaaagaaagcatacgaaatccaaaaaaataagcctagaaacgacgatatctttaaaattatcatggctatagtcctgttcttttttttttcttggattccacatcagatcttcacctttctggacgttctgatccaacttggtattatcagggattgcagaatagcagatatcgtggacaccgccatgcccataacaatatgcatcgcttacttcaacaattgccttaaccccctcttctatgggttccttggcaagaaatttaaaaggtacttcctccagctgctaaaatatatcccacctaaagccaagagtcacagcaacttaagcacgaaaatgagcactctgtcctatagaccctcagacaatgtctcctcctctacaaagaaaccagcaccatgttttgaggtggaatag

SEQ ID NO: 178992 - DNA, 1092 bp, Artificial Sequence
  Description of Artificial Sequence: Synthetic coding sequence
atgaagggcaacagcaccctggccaccaccagcaagaacatcaccagcgggctgcacttcgggctggtgaatatcagtggaaataacgagtccaccctgaactgctcccaaaagccaagcgacaagcatctggacgcgatccccattttgtactatattattttcgtgattggttttctcgtgaacattgtggttgtgacattgttttgttgtcagaaggggccaaagaaggtcagctctatctacattttcaacttggcagtggccgacttgcttctgctagcaactctcccactctgggcaacgtactattcgtacagatacgactggctgttcggaccagtgatgtgcaaggtctttggatccttcttaacacttaacatgtttgctagcatcttcttcataacatgtatgagcgtggacaggtatcagagtgtcatctacccttttctgagtcagaggcgaaacccctggcaggcaagttacatcgtcccactggtttggtgtatggcttgcctgtcttccctcccaactttttactttcgtgacgtgcggacaatcgaatacctgggcgttaacgcctgcatcatggcctttccaccagagaagtacgcccaatggtccgccggaattgcgctgatgaaaaacattctgggcttcatcatacctctgatatttatcgccacttgctattttggcatcagaaagcacctcctgaagacaaacagctacggtaaaaaccgtattacccgggatcaagtcctgaagatggcagctgcggtcgttctggcgtttatcatctgctggctaccgttccatgttctgacgttcttagatgccctggcctggatgggcgtcataaacagctgtgaggtgattgctgtgattgatctcgcacttcccttcgccattctgctcgggttcactaactcctgcgtgaaccctttcctctattgctttgtcggcaaccgtttccagcagaaactccgaagcgtctttagagtgcctataacctggctccagggaaaaagagagtcaatgagctgcagaaaatcctcatctctaagagagatggagacgttcgtctcctag

SEQ ID NO: 178993 - DNA, 1458 bp, Artificial Sequence
  Description of Artificial Sequence: Synthetic coding sequence
atgcggaagcgggccccccagagcgagatggcccccgccggcgtgagtcttcgggctaccattttgtgtttgctcgcttgggcaggactagctgcaggcgatcgtgtttatatccatcccttccatctggtcatccacaatgagtccacctgcgagcaattagctaaggccaatgctggcaaacccaaagaccccacctttattccggcgcctatccaggccaagacctctcccgtggatgagaaggcactgcaagaccagctggtgctggtggcagcaaaactggacaccgaggataaactgcgtgcagcgatggttgggatgctggccaatttcctggggtttagaatctacggaatgcatagcgaattgtggggggtggtgcatggcgcaaccgtgctctcaccaacagccgtgtttggaaccctagcctctctctatctgggagcccttgaccatactgccgaccggttacaagccattctgggggtgccttggaaggacaaaaactgtacttcccgactcgacgcacataaagtgctcagcgctctacaggccgttcaaggactcttagtcgcgcagggtagagcggattcccaggcgcagctgctcttgtctaccgttgttggagtcttcactgcgcccggtcttcatcttaaacagcctttcgtgcaggggctggctctgtatacaccggtggtcctgcctcggtcactggactttactgagctggacgtggctgccgagaagattgatagattcatgcaggcagtgactggctggaagactgggtgcagtctgatgggagccagcgtggatagcactctggcatttaatacgtacgtgcactttcagggcaagatgaaaggatttagcctcctggctgagccacaggagttttgggtggacaacagcacctcggtcagcgtccccatgctgtcaggcatgggcacctttcaacattggtccgacatccaggacaacttctctgtgacccaggtgccgtttacagagtcagcctgtctcctcctcattcagccgcactatgcttctgatctcgataaggtggagggcctcacctttcaacagaattcactgaactggatgaagaagttgtcacctcggacgatccatctgactatgccgcagctcgtgttgcagggatcttacgatctgcaggacctgttggcgcaggcagagttgcctgccatccttcatacagagttgaatttgcagaagctgtctaatgacagaattagagtgggcgaggtgctaaactccatctttttcgagttggaggcagatgagagggaacctaccgagagtacccaacagctgaacaagcctgaagtgttagaagtaacgctgaataggccatttctgtttgcagtttatgaccaaagcgccactgccctgcattttttagggcgcgtagcaaatcccctgtccacagcatag

SEQ ID NO: 178994 - DNA, 1212 bp, Artificial Sequence
  Description of Artificial Sequence: Synthetic coding sequence
atgcggaagcgggccccccagagcgagatggcccccgccggcgtgtcactgcgcgccaccattctgtgcttactcgcatgggccggccttgcagctggggatcgtgtttacatccacccgttccacctggtcatccacaatgaatccacctgtgagcagttggccaaggctaacgccggcaagccaaaagaccctactttcattccagctccgatccaagctaagactagtcctgtggatgagaaggccctgcaggatcagctcgtccttgtagcagctaagttagacacagaggataagctgagagccgcaatggtgggcatgctggccaattttctggggttccgcatttacggcatgcactcagagctgtggggcgtggtccatggcgcaaccgtcctttctccgaccgccgtgtttgggaccttagcctccctgtatctgggcgctctggaccacacagccgacaggctacaagctatcctggacgtggccgctgaaaagatagacaggttcatgcaggccgtgacaggttggaagacggggtgttcattaatgggggctagcgtcgacagtactctggctttcaacacttatgtgcactttcagggaaagatgaagggattcagcctgctggccgaaccccaggagttttgggtagacaatagtacctccgtgtccgtccctatgctgagtggaatgggcacctttcagcattggtctgatatccaggacaactttagcgtgacacaagttccctttacagagtcggcctgcctgctactgattcagcctcattacgctagcgacctggacaaggtggagggcttgacctttcaacaaaatagtttgaattggatgaaaaaattgagcccacgtaccattcacttaacaatgccacaactcgtactgcaaggatcctatgacctccaggacctcctcgcccaggcagaactcccagccattctccacacggagctcaatttgcagaaactcagtaatgaccgaatacgcgttggcgaagtgcttaattctattttctttgagctcgaggcagacgaacgcgaaccaactgagagcacccagcaacttaacaagcctgaagtcctggaagtgaccctcaaccgccctttcttgttcgcagtttatgaccagtcagctacagctctccactttctcgggcgtgtcgcaaaccctttgtccaccgcttag

SEQ ID NO: 178995 - DNA, 1479 bp, Artificial Sequence
  Description of Artificial Sequence: Synthetic coding sequence
atggtgaagttccccgccctgacccactactggcccctgatccggttccttgttcccctcggaatcacaaacatagcaatcgactttggagaacaagccctcaataggggaattgcagctgtaaaagaagatgctgtggagatgctagcatcgtatggcctggcatacagcttaatgaaattcttcactggaccgatgagtgattttaaaaatgtcggccttgtttttgtaaatagcaagagagacaggactaaggcagtgttgtgtatggtggtggctggagcaatcgccgcagtgtttcacacgctgatcgcctacagcgacctgggatactacattattaacaagctgcatcacgtggacgaatcagtgggcagcaagactcggagggcattcttatacctagctgcattcccattcatggacgccatggcgtggacccacgccgggattctcctaaagcacaagtattcattcctggtaggatgtgcttcaatatctgacgtgatcgctcaagtggtattcgtggctatccttctgcatagtcacctggagtgtcgagaacctctcctcatccccatcctgtccctctacatgggcgcattggtgaggtgtaccaccttatgcttggggtattataaaaacattcacgatatcattccagatagatctggacctgaactgggaggcgacgccacaatcagaaagatgttgtccttttggtggcctctcgcccttatattggcaacccaaaggatctctagaccaatagtgaatcttttcgtgagccgggatctagggggctctagcgccgctactgaggccgttgcaatccttacagcaacctatccagtggggcatatgccttacggatggctgaccgagattcgcgcagtgtatcccgcgtttgataaaaacaatccttccaataagttagtctcaactagcaatacagtgaccgcggcacatattaagaaattcacattcgtgtgcatggctttgtctctgaccctttgcttcgtgatgttttggacacccaatgtgtctgagaaaatcttgatcgacattattggtgtagactttgcttttgccgagctctgtgtggtgccactgcgtatttttagcttcttccctgtacctgtgaccgtccgcgcccacctgaccggatggttgatgactcttaagaagacattcgtgctagctccctcctccgtgctgcgaatcattgtgttaatcgcatctttagtcgtactgccgtacttaggcgtgcatggagcgaccctaggcgtgggatccctgttggctggcttcgtcggggagtctactatggttgcaatcgccgcatgctacgtttatagaaagcagaagaagaagatggaaaatgaatctgccacagaaggcgaagacagcgctatgacggatatgcccccaaccgaggaggtgactgacattgtggaaatgcgggaggagaacgagtag

SEQ ID NO: 178996 - DNA, 885 bp, Artificial Sequence
  Description of Artificial Sequence: Synthetic coding sequence
atgggcgccctggtgcggtgcaccaccctgtgcctgggctactacaagaatattcatgacatcatccccgaccgtagcggaccagagctgggcggagatgcgacgatccgtaagatgctcagcttctggtggcccctggcactaattttggctacccaaaggatcagtaggcccattgtgaacctgtttgtgagccgcgacctggggggatctagcgcagcaaccgaggccgtggctatcctgaccgccacgtaccccgtgggccacatgccctacggctggctgactgaaattcgagccgtgtatccggccttcgacaaaaataacccctccaacaaattggttagcacatccaatactgtaacggctgcgcatatcaaaaagtttactttcgtttgcatggccctgtccctaactctatgctttgtgatgttttggacacccaatgtaagcgaaaaaattctgatcgacattatcggagtcgactttgcctttgccgaactgtgcgtcgtgccgcttagaatcttttccttctttccggtgccggtgacagtgcgggcacatcttaccgggtggttgatgaccctgaagaaaacttttgtgctcgcccccagctccgtgttaaggatcattgtgctgattgccagtttggtcgtgctgccttacctcggtgtgcatggcgccactctgggggtaggttctcttctggcaggattcgtgggagaatcgacaatggtggctatcgctgcctgctacgtttaccggaagcagaaaaagaagatggagaatgagtcagctaccgagggggaagatagcgctatgaccgacatgcctccaacggaggaggtaaccgatattgtagagatgcgagaagagaatgagtag

SEQ ID NO: 178997 - DNA, 471 bp, Artificial Sequence
  Description of Artificial Sequence: Synthetic coding sequence
atgtggaccttcgtgacccagctgctggtgaccctggtgctgctgtcctttttcttggtgagttgtcagaacgtcatgcacatcgtccgcggctcgctgtgctttgtgctcaaacacatacatcaggagctcgataaagaacttggtgaaagcgaaggcttgtcggacgacgaagagacaatcagtacccgtgtcgttcggaggagggtatttctgaagggcaatgagtttcagaatattcccggcgagcaagtgaccgaagaacagtttaccgatgaacagggaaatatcgtcacaaaaaagattattaggaaggtcgtcagacagattgatttatcatctgccgacgctgcccaggaacacgaagaagtaacagtggagggtccattggaggacccctctgaactcgaagtcgacattgattattttatgaaacacagtaaagaccacacaagcactcccaacccgtag

SEQ ID NO: 178998 - DNA, 5694 bp, Artificial Sequence
  Description of Artificial Sequence: Synthetic coding sequence
atggcccaggccgccaagcagctgaagaagatcaaggacatcgaggcccaagcattacaggaacaaaaggaaaaggaggagagcaaccgaaagagaagaaacagatcccgcgatagaaaaaagaaagcggatgcagcaacgtcttttctgagagccgcgcgcagcggcaaccttgacaaagcactagaccatctgcgcaacggagttgacattaatacctgtaaccagaatgggctgaacggactgcacctggctagcaaagaaggacatgtcaaaatggtcgtggaactgctgcataaggagatcattctggagactacaacaaaaaaagggaatacagctctgcacatcgcggctttagcgggacaagatgaggtggtgagagagttggtcaactacggggccaacgtgaacgcgcagtctcaaaagggcttcacacctctgtacatggccgcccaggaaaaccacctcgaggtagtcaagttccttctcgaaaatggtgcaaaccagaacgtagcaacagaagacgggttcactccactggcagtcgccctccagcaggggcatgaaaatgttgttgctcacctgatcaattacgggacaaagggcaaagtgcgactacccgcccttcacatcgctgcacggaacgacgacactcgaacagccgcagtcttgcttcagaacgatcccaacccagatgtgttgagcaagaccggttttacacctctacatattgccgcccattacgagaacctgaacgtggcacagctattactgaaccggggagccagcgtgaattttaccccccagaacggaattaccccgctgcacatcgcctcacgccgtgggaacgtgattatggtacggttgctgctggatcgcggcgctcagattgagacgaaaacaaaagatgagttaacccccctacactgcgccgcccgcaatggacatgttcgcatcagcgaaatcctgctagatcatggcgcacccatccaggcgaaaaccaagaacggactgtcccctattcacatggccgcccagggggatcatctggactgcgtgaggctgctgctccagtacgatgctgagatcgacgacattaccttggatcaccttacccctctgcacgtggccgcccactgcgggcaccacagggttgccaaagttctgctggacaagggcgctaagcctaacagtcgggctttgaatggcttcactccactccacatagcttgcaagaagaaccacgtccgagtgatggagctgcttctcaaaacaggcgcgtccattgatgccgtgactgagagtggtctcaccccactgcatgttgccagcttcatgggacacctgcccatagtgaagaatttgctccagaggggggcatcaccaaatgtcagcaacgtcaaagtggaaacaccactgcatatggcagctcgggcagggcacactgaagtcgccaagtacttgctgcaaaataaggccaaggtaaatgcaaaggctaaggacgaccagacccccttacattgcgctgcccgcatcgggcataccaacatggtcaagttattacttgagaacaatgccaacccaaacttggccacgaccgctggccacactcccttacatatcgccgcccgtgagggccatgttgaaacagttctggccctgctcgagaaggaggcttcccaggcgtgcatgacaaagaagggattcacccctcttcacgtcgcagctaaatacggaaaagtgagagtggcagagttactgctggagagagacgctcaccctaacgcagccggcaaaaatggcttgacccccctgcacgtagccgttcatcataacaacctggatattgtgaaacttctactccctaggggagggagtccccattcccctgcttggaacgggtacacacctctgcacatcgcggcaaagcagaatcaagtggaagtggctcgttctttgcttcagtacggtgggtcagctaacgctgagagcgttcagggcgtcacccctctccacctcgccgcgcaggagggtcatgccgaaatggtcgctctgttgctaagcaaacaggcaaacggaaacctaggaaataaatccggactcaccccattgcatctcgtggcccaggaaggtcacgtcccggttgccgatgtcctgattaagcatggagtcatggtcgatgctacgacccgtatgggatacactcctctgcacgtagcttctcattatgggaacatcaagctggttaagttcctcctacagcaccaggctgacgtaaacgccaagacaaagctgggctacagtcctctgcatcaggccgcacaacagggtcacaccgacatcgttacgttgttgctgaaaaatggcgccagtcccaatgaggtttcatcagatggcacaactcctctggccattgctaagcgcctgggttatatctcagtgaccgatgtgctcaaagtggtgacagacgagacaagctttgtgttggtcagtgacaaacatagaatgtcgttccccgagaccgttgatgagatccttgatgtctccgaggatgaaggcactgcgcacattacgattatgggcgaggagctgatatccttcaaggcagagagacgggattcacgggacgttgacgaggagaaagagttgctcgacttcgttcctaagctggatcaagttgttgaaagccccgccatcccacgcattccctgtgctatgcccgagactgttgtaattaggagtgaggaacaagagcaggcctcgaaagagtatgatgaggactcacttatcccctcttcacccgctacagagacttccgataatatctcacctgttgctagtcccgtccatacaggctttctagtcagctttatggtagatgccaggggcggaagcatgcggggctcaaggcacaacggcttgcgggtggtgatccctccacggacctgcgctgctccaacaaggatcacttgccgtttggtcaagccacagaagctctccacaccaccccccctggccgaagaggaaggactggcatctagaatcatagcgctcggacccaccggagcccagtttctcagtcctgtcattgtggaaattccacactttgcttcacacggtcgcggcgaccgtgagttggtggtgctacgcagtgaaaatggctcggtctggaaagagcaccgaagtcggtacggcgaatcctatcttgaccaaatcctgaacggcatggatgaagaattaggaagcttggaggaattagagaaaaaacgcgtgtgccgaattataaccaccgacttccctctctactttgttatcatgagcagactgtgccaagactacgacaccattggaccagaaggtgggtccctgaagagtaaactggtccctctggtacaggcgacatttcctgaaaatgcagtgactaagcgagtgaaactggcacttcaagcacaacccgtgcccgacgagctggtaacaaaacttctgggtaatcaggctacgttcagccccatcgtcacagttgaaccccggaggcgtaaatttcaccggcctatcggtttgaggatcccactgcctccatcttggacggataacccaagggattctggggaaggtgacacgacgtctctaagactcctatgtagtgtgatcggagggaccgatcaggcccaatgggaggacattacaggaactacgaagctggtgtacgctaacgaatgtgcgaattttaccacaaatgtgtctgccaggttctggctttctgactgcccaagaactgccgaagctgtgaatttcgccacattgctgtataaagagctcacagcagtgccttatatggccaagttcgttattttcgctaagatgaacgaccccagggaagggcggctcaggtgttattgtatgactgacgacaaggtggacaaaacactcgagcaacatgaaaacttcgtcgaggtggcacgttcaagggatatcgaggtgctcgaagggatgagtctgtttgctgagctcagcggtaatctcgttcccgtcaagaaggccgcgcagcagcgatctttccactttcaatcttttcgcgaaaaccggcttgctatgcctgtgaaggtgagggactcatcgcgcgagcccggagggtcgctgagcttcctgcgaaaggctatgaagtatgaagacacacagcatattctctgccacctgaacattaccatgccaccatgcgccaagggttctggtgcagaagaccgacgccgcacccccactccactggccctaagatactccatcctgtcagagtctacgccgggaagcttgagcggcaccgaacaggcagaaatgaagatggctgtaatatctgagcatctcgggttaagctgggccgaactggcccgtgagctgcagttctccgtggaggatataaatcgcatccgggttgaaaacccaaactcattgcttgagcagtccgtagccttgttgaatctctgggtgattagagagggacagaatgcaaatatggaaaatctgtatacagcactccagtctatagacaggggagagattgtcaatatgctggaaggtagcggtagacagtcccgaaatcttaagcccgatcgcagacacacagacagggattattcgttaagtccatcacagatgaacgggtactcgagccttcaagatgaactgcttagccctgcaagtctgggatgcgccctgtccagccccctccgagcggaccagtactggaacgaagtcgcagttctagacgccattcctctggccgccactgagcacgatacaatgttggaaatgagcgacatgcaggtgtggtccgccggattgacaccgagtctggttaccgctgaagactcgtccctggagtgttctaaagccgaggacagcgatgccactggtcatgaatggaaactcgaaggggcactcagcgaggagccccgtggccccgagctcggatcactggaactggtagaagatgatacggtggatagcgacgcaaccaacggactgatcgatctgctggagcaagaggaaggtcagcggtcagaagaaaaactaccggggtccaagagacaagatgacgcaaccggtgctgggcaggacagtgaaaacgaggtgtcattagtgagcggacatcaacgagggcaggccaggatcacccattcaccaaccgtgagccaggtgactgaacgtagtcaggaccgactgcaggattgggacgccgacgggtccatcgtgtcctacctgcaggatgctgcccagggatcgtggcaggaggaggtcactcaaggcccacactcatttcagggaactagcaccatgaccgagggcctggagcctggcggatcccaggaatacgaaaaagttctggtgagcgtgtcagaacacacttggactgagcagccagaggcagagagctcacaggctgacagagaccgccgtcagcagggccaggaggaacaagtgcaggaagcaaagaatactttcacccaggtagtgcagggtaatgaatttcagaatatcccaggagaacaggttaccgaggaacagtttaccgacgagcaaggcaacattgtgaccaagaagatcattagaaaagtggttcgtcagattgatttgtcgtctgccgatgctgcacaggaacacgaagaagatcacacttcaacccccaacccatag

SEQ ID NO: 178999 - DNA, 5643 bp, Artificial Sequence
  Description of Artificial Sequence: Synthetic coding sequence
atgccctacagcgtgggcttccgggaggccgacgccgccaccagcttcctcagagccgcacggagcgggaacctcgacaaggccctcgatcacctgcgtaatggagtcgacataaacacatgcaatcagaatggcctgaacggcttgcacctcgcgtccaaggagggccatgtcaaaatggtggtggaattattgcataaagaaattatcctcgagactacgactaaaaaaggcaatactgcgttgcatatcgcagccctggccggccaggatgaagttgttagagaactcgtaaactacggtgcgaacgttaatgcgcagtctcagaaggggttcacccccctttacatggcggcacaggaaaatcatttggaggtggtcaagttcctgttagaaaacggagccaatcagaatgtggccacagaagatgggtttacgcctctcgcagtggccttgcagcagggccacgaaaacgttgtggcacatctgatcaactatggcaccaaggggaaggtgagactccctgccctgcatatcgctgctcgaaatgacgacactcgtaccgccgccgtgctactacagaacgaccccaacccagatgtcctctcaaagacaggctttacaccccttcacattgccgcgcattacgagaacttgaatgtcgctcagctgttgctcaataggggagcatcagttaatttcaccccacagaacgggatcacaccccttcatatcgctagcagaagaggaaatgtgattatggtaaggctactgttggaccgcggagctcagattgagaccaagaccaaagacgagctgacaccactgcattgcgccgcccggaatggccatgtgcggatctcagagattctcttggaccacggcgcccctatacaggcaaagaccaagaatggtctcagtcccatccatatggcggcgcagggggatcatctggactgtgttcgcctgctgctgcaatacgacgccgagattgacgatattaccttggaccacttgaccccactgcacgttgctgcccattgcggacatcacagagtcgcaaaggttctgctggataagggcgccaagccaaactctcgggccttgaacggtttcactcctctgcacatcgcctgcaagaaaaatcatgtgcgggtgatggaactcctcctgaagaccggggcttccatagacgccgtgacggaaagcggcctcacacccctccatgtggcatcatttatgggccacctcccaattgttaaaaatctgttgcaaagaggcgccagccctaacgtctccaacgtgaaggtggagaccccactgcatatggccgcccgcgccgggcacactgaggtcgctaagtacctcctccagaacaaagcaaaggtcaatgctaaggcaaaagatgaccagacccctttgcactgtgctgctcgaatcggccacactaacatggtaaagctcctgcttgagaataacgcaaaccctaatctcgctaccaccgcggggcacacaccacttcatatcgccgctagagaggggcatgtcgagacggttttggcccttctggaaaaggaagcaagtcaagcttgcatgactaaaaaaggattcacccctttacacgtggccgccaagtacggaaaagtgagagtggctgaactgctgctggagagagatgctcaccctaacgccgcaggcaagaacggcctcaccccgctacatgtcgccgtgcatcataacaacctcgacatcgttaaactccttctccctcgaggcgggtcccctcattcccctgcttggaatggatacaccccgcttcacatcgccgctaaacagaatcaagtggaagtggctcggagtctcctccagtatggtggttccgcgaatgcagagtctgtgcagggcgtcacccccctccatctggccgcccaagagggccacgccgagatggttgccctgttactgtcaaaacaggctaacgggaaccttggcaacaaatcaggactgacccctctgcaccttgtggcacaggaagggcacgtcccggttgctgacgtgcttatcaagcatggggtgatggtggacgctaccaccagaatgggctacactcctttacacgtggctagccattacggcaatatcaagctcgtaaagtttctcctgcagcaccaagccgatgtaaatgccaaaaccaagctaggctactcccccctccaccaggccgcccagcagggtcatacggatatcgtgacccttcttctcaaaaatggcgcttcccctaacgaggtctcttcggatgggaccacgcccctggccatcgctaagcggctggggtacatctctgtgacggacgtgttaaaagttgtcaccgatgaaacaagtttcgtcctcgtctccgataagcatagaatgtccttccctgagaccgttgacgagatattggatgtgtccgaagatgaaggggaagagttaatcagctttaaggctgaacgccgcgactccagagatgtcgatgaagagaaagagctgctagatttcgtgcctaaactggatcaagtcgtggagtctcctgccatccccaggattccatgcgctatgccggagaccgttgtgatcagatccgaagagcaggagcaggcgtcaaaggagtatgacgaagactcactgataccctcctccccagccactgaaacaagtgataatatatcccctgttgcatcacccgtgcataccggattcttggtttcctttatggtagatgcgagaggtggctccatgagagggagccggcacaacggattgagggtcgtaattccgccgcgcacctgtgctgccccaacacggattacgtgccgcctcgtcaagccacaaaagctttccacacccccccctttagccgaggaagaaggactggcaagtcggattatcgcattgggacctacaggcgcacagttcctgtccccagttatagttgaaattcctcattttgctagtcatgggcgaggcgacagagagctcgtcgtgctgcgcagcgagaatggcagtgtgtggaaggaacaccggagccgatacggcgagtcttacctggaccaaatcctgaacggaatggatgaagaactggggtctctggaggaactcgagaagaaacgagtctgcagaatcatcacaactgactttcctctgtacttcgtaattatgtctcgtctgtgccaggactacgacactatcggaccagaaggtggtagcctcaaatctaaactcgtgccactggtccaggctaccttcccggaaaatgccgtgacgaaacgggtgaagttggcccttcaagcccagccggtccctgacgagttggttaccaaactgctggggaaccaggctacattttcccctattgtgacagtcgaacccagacggaggaagttccatcggccaatcggcctacgtattccccttcctccatcctggactgataatccacgagactctggcgagggtgacaccacgtcactcagactcctgtgcagcgttattggaggcaccgatcaggcccagtgggaagacattactggaaccacgaagttagtgtacgcgaacgagtgtgctaactttacaaccaatgtttccgcccggttttggcttagcgattgtccaagaaccgcagaggccgtgaattttgcaactttactgtataaagagctaaccgcagtgccctacatggccaaattcgtaatctttgctaaaatgaacgatccgagagaaggcagactgagatgctattgcatgactgatgataaagtcgacaagacccttgaacagcacgaaaatttcgtcgaggtggcccggtccagggatatagaggtccttgagggtatgagcttgttcgccgaattaagcggtaatcttgtgccagtcaagaaagctgcgcagcagagaagttttcactttcagtccttccgggagaatagacttgccatgccggtcaaggtgcgggattcttcacgtgagcccggcggatctctttcctttcttaggaaggccatgaaatacgaagatacacagcatatcctttgccacctcaatataactatgcctccttgcgctaagggtagcggcgctgaagaccgtaggaggacacctacgccactggcactccggtactccatcctgagtgaaagcacccccggatctctgagcggtacagagcaggccgaaatgaagatggctgtgatttctgagcatctaggcctgtcctgggccgagctggctagagagctccaattttctgtggaggacatcaatcgtatcagggtcgagaatcctaattctttgttagaacagtcagtagctctgcttaatctctgggtgataagggagggacaaaatgcaaacatggaaaatctctacaccgcactacagagcattgacaggggcgaaattgtaaacatgctagagggcagcggacgacagtctaggaatttgaagcctgataggcggcacaccgacagagattattcactgtcacctagtcagatgaacggatattcatctctccaggacgaattactgagtcccgcctctttgggatgtgctctctcctctcccctgagggctgatcagtattggaacgaggttgcagtccttgatgccatcccactggccgccacagaacatgatacaatgctagagatgtctgacatgcaggtgtggagcgccggcttaacgccaagcctcgtaacagctgaggattcatcgctggagtgttcgaaagcagaggacagcgacgcaacaggacatgaatggaaactggagggcgcgctgagcgaggaacctaggggtccggagcttggctccttggagcttgtcgaggacgatacagtcgactcagacgccactaatggactaattgatctgctggagcaagaggaagggcaacgatccgaagaaaagctaccagggtccaaaaggcaagacgacgccactggtgccggccaggattctgagaacgaagtgtcgctggtgagcggtcaccagcggggtcaagctcggataacccatagccccaccgtttcacaagtcaccgagagaagtcaggacaggttgcaggactgggatgcggacggcagtatcgtgtcttatctgcaggatgccgctcagggctcttggcaagaagaagtcacacaaggaccacactcattccaggggactagcacaatgaccgaagggcttgagccgggggggtcccaggaatatgagaaggtactggtctcagtatccgaacacacttggaccgagcagcctgaagcagaaagctcccaagcagaccgcgacaggagacagcagggccaggaagaacaggtccaagaggctaagaatacttttacccaggttgtgcaaggaaacgaattccagaacataccaggagagcaggttaccgaggaacagtttacagatgagcaaggcaatattgttacgaaaaagatcatccgcaaagtagtgaggcagatagatctctcctcagcagacgcagcccaggagcacgaggaggtggagctccgcggctctggtctgcagcccgatttgatagagggacggaaaggggctcagattgtgaaacgggcgagcctgaagcgaggtaaacaatag

SEQ ID NO: 179000 - DNA, 468 bp, Artificial Sequence
  Description of Artificial Sequence: Synthetic coding sequence
atgtggaccttcgtgacccagctgctggtgaccctggtgctgctgagtttttttctggtgagctgtcaaaatgttatgcatatcgtgaggggtagcttgtgcttcgtgctaaagcacatccaccaggagctcgacaaggagttaggggaatccgagggcctgtctgatgatgaagaaacaatatcaactagagttgtgaggcgtcgggtgttcctcaaaggcaatgaatttcagaatatccctggtgaacaagtgacagaggaacagtttacagacgaacagggaaacattgtgaccaagaaaatcatccgaaaagtcgttcgtcagattgacttgtctagtgccgacgctgcacaagagcacgaagaagtggagctgcgtgggtctggattgcagcctgatctcatagagggcaggaagggagcccaaattgtgaagcgagccagccttaagcgggggaagcaatag

SEQ ID NO: 179001 - DNA, 5646 bp, Artificial Sequence
  Description of Artificial Sequence: Synthetic coding sequence
atgccctacagcgtgggcttccgggaggccgacgccgccaccagctttttgagagccgccagatccgggaaccttgataaagccctcgaccatctgaggaatggcgtcgacatcaatacgtgcaaccaaaacggactcaatggcctgcacctagcatccaaagagggacacgttaagatggtggtggagttgctacacaaggagatcatcctggagacaaccaccaaaaaaggaaataccgcgctgcatattgctgccctggctggccaggatgaggtagtaagagagttagtgaactatggggccaatgtgaacgcacagagtcaaaagggctttacccccctgtatatggcagcccaggagaaccacctggaggtggtgaaattcctgttggaaaacggtgctaatcagaacgtggccaccgaagatggatttactccactggccgtcgctcttcaacaggggcacgaaaatgtggtagcacacctgatcaactacggtacgaagggtaaggttcgtctgcctgccctgcatatagcagccaggaacgatgacacaaggactgctgcggtgcttctccagaacgatcccaaccctgatgtcctctctaagacaggcttcaccccactgcatatcgccgcgcactatgagaatttgaatgtcgcccagctgctgctcaaccgcggcgcttcagttaactttacaccgcaaaacggtattacaccactccatatcgccagccgcagaggtaatgtgatcatggttcgactgcttctggacaggggagcgcagattgagacgaagacaaaggatgagttgactccactgcattgcgccgctagaaacgggcacgtccgtatctctgaaatactgctggatcatggggctccaatccaagcaaagactaagaacggcttgagcccaatccatatggcagctcagggcgaccatctggactgtgtaaggcttctgctgcaatacgatgccgagatcgacgacattaccctggaccacctcacccctctccacgtagcggcgcattgcggccaccatcgcgtagcaaaggtcttgctcgataaaggagcaaaaccgaacagtcgggccctgaatggtttcacaccgctacatatcgcctgtaagaaaaaccacgtccgggtgatggaacttctgctcaagactggcgcgtctatagacgcggttacagagtcaggattaacacctctacacgtagcttccttcatgggacatctgccaattgtcaaaaacctgctgcaacggggcgccagccccaatgtgagcaacgttaaggtggaaactcctctgcacatggcagctcgggccggtcacaccgaagtggctaagtatctgcttcaaaacaaggctaaggttaatgccaaggctaaggacgaccagacgcccctacactgtgctgcccggattggtcacaccaatatggttaagctcctgctggagaataatgcaaatcccaacctggcaacgacagccggtcacacacctctgcacatcgcggctcgcgagggacacgtggagactgtgttggccctcctcgagaaagaagcctctcaagcttgtatgactaaaaaaggttttacaccgctccacgttgccgcaaagtatggcaaggtaagggtggccgagctgctgctggagcgggatgcccatcctaatgcagccggaaaaaatggcctgacgccactccatgtcgccgtacatcacaataatctggatattgtcaagttacttctccctaggggcgggtcaccccattcgcccgcttggaacggctatacacctctgcacatcgccgccaagcagaatcaggtggaagtggcgcgatcactgcttcagtatgggggatccgcaaatgctgagagcgttcagggggttacccccctgcacctcgctgcccaagagggacatgccgagatggttgccttattgttatccaaacaagctaatggtaacttgggcaacaagagcgggcttactccattacacctggtagcccaggaaggccacgtgcctgtggcggatgtgttaattaaacacggcgtcatggtcgatgcaacaacccgcatggggtatacacccttacacgttgcctctcactacggcaacatcaagctggttaagttcctcctccagcatcaggcggatgtgaatgctaaaaccaagttaggttattccccattacatcaagcagctcaacagggacacactgacattgtcactctgctcttgaaaaatggggcttctcctaacgaggtttcatctgatggaactactcctctagcaattgcgaaacgcctggggtacatatctgttactgacgtgctgaaagtcgtgacagacgagacttcttttgtgttggtttctgataagcatcggatgagcttccccgagaccgtggatgagatcctcgatgtgtcagaggatgagggggaagaactgataagtttcaaggcggaaaggcgtgatagccgcgacgtggatgaggaaaaagagctgttagatttcgtgccgaagcttgaccaggtggtggaatcaccagcaatccccaggatcccatgtgccatgcctgaaacggtggttattcgttccgaagagcaggagcaagctagtaaggagtatgatgaggactctttgatcccatcctccccagctaccgagaccagcgacaacattagtcctgtggcctctccggtgcatactgggtttctggtaagtttcatggtggacgctagaggagggtccatgcgagggtcccgccacaatggccttcgcgtcgttatcccacccaggacgtgcgcagccccaacacgaatcacttgccgactggtgaagccgcagaagctgtccactccccctccgttggctgaggaagagggcttagcatctagaattatcgctctgggccccaccggtgcacaattccttagccctgtaattgtcgagattccgcacttcgcctctcacggaaggggcgaccgggagctggtggtgctgcgctccgaaaacggtagcgtttggaaggaacatcgatctcgatacggagaatcatacttggaccagatcctgaatggcatggatgaagagctgggtagtttggaagagctggagaagaagcgggtctgtcgaattattactactgatttccccttgtactttgtgataatgtctcgactgtgccaggattatgacaccattggccctgaagggggttccctgaagagcaaacttgtgcccctcgtacaagctacctttcccgaaaatgccgtgaccaagcgcgttaagctggcattacaggcccaacctgtcccggatgaactggtcacaaaactccttggtaaccaggccacattctcacccatcgtgaccgtggaaccccgccggcgcaaatttcacagaccaattggcttgcggatcccactacctcccagctggactgacaatccgagggactcaggcgaaggagacaccacctctttaaggcttctttgcagcgtgattgggggaactgaccaggctcagtgggaagacatcactggcacgaccaagttggtgtatgcgaacgagtgtgccaattttaccaccaacgtttccgcacggttttggcttagtgattgccccagaacagctgaggccgtgaacttcgccaccttgctttataaggaactgaccgctgtcccttatatggccaagtttgtcatatttgcaaagatgaatgatccacgggagggacgactgagatgctattgcatgacagacgacaaagtggacaagacgttagaacagcatgaaaattttgtggaagtggctcggtctcgtgacattgaggttttggaggggatgtctttgttcgcagaactgtcagggaatcttgtccccgtgaagaaggcagctcagcagcgctcttttcacttccaatcattcagagagaatcggctcgctatgccggtgaaagtgcgagatagctcacgcgagccggggggttctttgagcttccttcgtaaagctatgaagtacgaggatactcagcatatcctctgtcacctgaatattactatgccaccctgcgccaaggggtccggagctgaggaccggcgcaggacccctacaccacttgctttaaggtattccatcctctctgagtcaacccctggcagtctttccggcacagaacaggcagagatgaagatggccgtcatatccgagcatttggggttgagctgggccgagctggctcgtgagctgcaattcagcgtggaggatatcaatcgcatccgcgtcgagaatcctaactccctgctggaacagtcagttgctctactgaatctgtgggtgattcgggaggggcagaacgctaatatggagaatctgtatactgccctgcagagtatagaccgcggcgagattgtgaatatgttagaaggtagcggcagacagtctcgaaaccttaaaccagatcgaaggcatacagaccgggattactcactgagtcctagccaaatgaacgggtactcatctctccaagatgagctgctcagcccagcatcactcgggtgcgctctctccagtcctctgcgtgcggatcagtattggaatgaggtggcagtgctcgacgcaataccgcttgcagcaactgagcacgacaccatgcttgaaatgtcagatatgcaggtctggagcgccggactgaccccatcattagtgaccgccgaggactcttctttggaatgtagtaaggccgaagattcagatgcgacagggcacgagtggaagctggagggtgcgctgtctgaggagcccagagggcctgagctcggatcactggaactcgttgaggatgatactgtcgattccgatgccacaaacggtctcatcgatctgctggaacaagaggagggtcagagaagcgaagagaaactgcccgggtctaaaaggcaagacgatgcgactggagccgggcaggactctgaaaatgaggtgtccttagtgagcggacatcagcgcggccaggctcggatcacacatagcccaaccgtgtctcaggtgacggaacgctcccaagatagactgcaggactgggacgcggacgggtctatcgtatcttacctccaggatgcagcacaagggtcctggcaggaagaagttacgcaagggcctcacagttttcagggaacatcgacaatgactgaaggcctcgaacctggtgggtcacaagaatacgagaaggtcctggttagcgtgagtgaacacacttggaccgaacaacctgaggccgagagctcacaggctgacagggatagacggcaacagggtcaggaggaacaggtgcaagaggctaagaatacttttacgcaagtggttcagggcaacgagtttcaaaacattcctggcgaacaggtcacagaagaacaatttacagacgaacagggaaacattgtcacgaagaaaatcatccggaaggtggtcagacaaatagacctgtcctccgctgacgctgcacaggaacatgaagaggtgacagtggagggcccactggaagatccatctgagctggaggtcgacatagactattttatgaagcacagtaaagatcacacgtccacgccgaacccatag

SEQ ID NO: 179002 - DNA, 330 bp, Artificial Sequence
  Description of Artificial Sequence: Synthetic coding sequence
atgtggaccttcgtgacccagctgctggtgaccctggtgctgctgagctttttcctagtgtcatgtcagaacgtcatgcatatcgtgaggggatctctatgctttgtgctgaagcatattcaccaggagcttgacaaggaacttggggagagtgaaggactatccgatgatgaagaaaccatctcaacacgcgttgtaaggcggcgcgtatttctgaagggcaacgaatttcagaatattcctggtgagcaggtgaccgaggaacagtttactgatgagcagggcaacattgtgacaaagaaggaccacacttccacccccaacccctag

SEQ ID NO: 179003 - DNA, 5577 bp, Artificial Sequence
  Description of Artificial Sequence: Synthetic coding sequence
atgccctacagcgtgggcttccgggaggccgacgccgccaccagctttctgcgagccgcgaggtctggtaatttggataaggcactggatcatctgcggaatggagttgatataaacacatgcaaccaaaacggattgaatgggcttcacctggcctcaaaagaagggcacgttaagatggtggtcgaactgctgcataaagaaattatcctggagacaaccaccaagaagggtaacacagcattgcatatcgcagcattggccggacaagacgaggtggtcagagagcttgtgaactacggagccaatgtgaatgcccagtcacaaaaaggctttacccctctgtacatggcagcgcaagagaaccacctggaggtcgtgaagtttctcctcgaaaacggagcaaaccagaacgttgcaaccgaagatggatttacccccctggccgtagcactacagcagggccatgagaacgtggtggctcatctgatcaattatggaactaaaggtaaagtgagactaccggcactccacatcgctgctcggaatgacgatacccggacagctgcagtgttgttacagaatgaccccaatccagatgtgctctccaagactggattcacaccccttcatatcgcggctcactatgagaatttgaatgtcgcacagcttctactcaaccgaggggcctccgtgaactttactccccagaacggtatcacgcctctgcatatcgcttctaggaggggcaacgtgatcatggtgcgactgctgctggatcgcggtgcccaaatagaaacaaagaccaaggatgaattaactcctctgcactgcgctgctcggaatggacatgtgcgtattagcgagatcctgctggaccatggagctccaattcaggcaaagactaagaacggactgtcaccaatacatatggctgcacaaggcgatcatctggattgcgtgagactgctcctgcagtatgacgctgaaattgatgacattaccctggaccacctgaccccactgcatgttgccgcacactgcggtcaccacagggtcgccaaggtgctactggataaaggggccaagcctaattctagagccctcaatggctttacccctctgcatatagcctgtaaaaaaaaccatgtacgcgtcatggagctcctcctgaagacaggcgcgtctattgatgctgtgacagaatccggattgacacctctgcatgtggcatctttcatgggacacctgcccatcgtcaaaaacctactccagaggggcgcttcacctaacgtttcgaatgtcaaagtggagactcctctacacatggctgctagggccggccatactgaagtcgctaagtatttactgcagaacaaggcaaaggttaacgcaaaagctaaggatgaccagacaccgttacactgcgcggcccggatcggtcacactaatatggtaaagctgctcttagaaaataatgccaatcctaacctggccaccacggccggccacactcctctccacattgccgctcgggaaggccacgtggagaccgtcctggccttattggagaaagaggcctctcaggcatgcatgacgaagaaaggtttcaccccccttcacgtcgccgctaagtacggcaaagtgagagtggcggaactgctgctggagagggatgcccacccaaacgccgccggaaagaatggcttaacccctcttcatgtcgcggttcatcataataatctggacatcgtaaaacttttactacctagaggaggctcccctcatagcccagcctggaatggctacacacctctgcacatcgccgccaagcagaaccaggttgaggtggctcgcagtctgctccagtacggaggaagcgccaatgcggaatccgtccagggtgtcacccccctgcatcttgctgcccaagaggggcatgccgagatggtagccttgctcctgtcaaagcaggctaacggcaacttggggaacaaatccggccttactcccctgcatttggtggcacaggaaggtcatgtgcccgtggcagacgtgctgataaaacatggagtcatggtggatgccaccacgcggatgggctacactccactgcacgtggccagccattacggaaacattaagctcgtcaagtttctgctgcaacaccaggcagacgtgaatgcaaaaacaaagctgggatattctccactccatcaagcggctcagcaagggcataccgacattgtcacactgttgttaaaaaacggggctagtcctaatgaagtttcctccgatgggacaacacctttagctatcgccaagcgcctaggctacataagtgtgaccgacgtgctaaaggtggtgaccgatgagacatccttcgtgttggtgagcgataaacatcgaatgtcattcccagaaacggtcgatgaaattttagatgtgtctgaggacgagggggaagagttaatttcgtttaaggctgaacggcgtgatagtcgtgatgtcgacgaagagaaggagctgctcgattttgtgcctaaacttgaccaggtcgtggagagccccgcaatacctcgtatcccctgcgctatgcccgaaacagtggtgatccggtcggaggaacaggagcaagcatccaaagagtatgatgaagattcgctgatacccagtagccccgctaccgagacttccgataacattagtccagtagccagccctgtgcatacaggcttcttagtctcctttatggttgatgcccgcggtggaagcatgcgcgggagtcgccataacggactcagagtggtgatacctccacgaacttgtgccgcccctactcgcatcacatgtaggctggtgaaacctcagaaactgtccactcccccgcctctggccgaagaagaaggactcgcaagcagaataatcgctctgggaccgacgggggcccagtttctgtcacccgtgatcgtggagataccccatttcgctagtcacgggagaggcgatagggagctagttgtgttgagatcagagaacggcagtgtctggaaggagcataggagtcgttatggggagagctatctggaccagatcctcaatgggatggacgaagagctagggtctcttgaagagctcgagaagaaacgcgtttgccggattattacgactgattttcctttgtatttcgtgatcatgtcgcgcctgtgccaggactatgacacaatagggcctgaaggcggatcccttaaatccaaattggtgccactagttcaggctacattcccagaaaatgcagtgacaaagcgggtgaaactagcactccaggcccagcccgtgcctgacgaacttgtcactaaattgctgggcaaccaggcaacctttagccccatcgtgactgtggaacccaggcggcggaagttccacagaccaatcggactgcggattcccctccctccctcatggacagataatccacgagacagcggggagggcgatacaacaagcctccggctcctgtgcagcgtaattggcggcaccgatcaagcccagtgggaggacataacaggtaccacaaagctggtctatgccaatgagtgcgccaatttcactaccaacgtctcagcccgtttctggctctcggactgtcctagaaccgccgaggctgtaaattttgcaaccttgctctacaaagagctcacagccgtcccatacatggctaagttcgttatctttgcaaagatgaacgaccccagggaaggccggcttcggtgttactgcatgacagatgataaggtggataaaacactggagcagcacgagaattttgtcgaagtcgctagatctagggacatagaggtgctggaaggaatgtcactgttcgctgagctgtcagggaacctcgtgcctgtcaaaaaggcggctcagcaaagatcattccattttcaaagtttcagggagaacagacttgccatgccagttaaggtaagggattcaagtagggagccaggcggctctctgtcctttctaagaaaagccatgaaatacgaagatacccagcatattctctgccacctgaatatcacaatgcccccttgcgcgaagggaagcggtgccgaagataggaggagaactccaactcctttggctctccggtactccatcctgagcgagagtacccccggtagcttaagcggcacagagcaggctgagatgaagatggccgtgatttcagaacatttggggctgtcttgggcagagttagctagggagttgcagttcagcgtggaagacatcaatagaatcagggttgagaaccccaatagcctgctggagcaatctgtcgcactgttgaacctatgggtcatacgggaaggtcagaatgccaacatggaaaatctgtataccgccctccagagcatcgacagaggcgagattgtcaacatgctggaaggttctggaagacagagtaggaatttgaagcctgatcggagacataccgaccgggattacagtttgtctcccagccaaatgaacggatacagctcactgcaagatgaactgctctcccctgcctccctgggctgcgcgctgagcagtcccttgcgggcagatcagtattggaacgaggtcgccgtgttggacgctatccctttggctgccactgaacacgacaccatgctcgagatgtcagacatgcaggtctggtcagcaggcctaacacctagtctcgtgactgcagaggactcgtccttggagtgttccaaggcagaagactcagacgccacgggtcatgagtggaagcttgagggcgccttgagtgaggaaccgagaggaccagagttgggctcactagaactggttgaggatgatactgtggatagtgacgctacgaatggcctcattgacctgttagaacaagaggaaggccaacgatccgaagagaaactgcccgggtctaaacgacaagacgacgccacaggtgctggtcaagacagcgagaatgaggtcagcctggtcagcgggcaccagcgtggacaagcaaggatcacacattcccctactgttagccaggtgaccgaacggtcacaggaccggctccaggattgggacgctgacggctctattgtgtcatatctgcaggacgcagcgcaggggtcatggcaagaagaggtgacacagggtccccattctttccagggaacatctacaatgactgaaggtcttgagcccggggggtcccaagagtatgagaaagtcctcgtgtctgttagcgaacacacttggacggagcagccagaggctgagagctcacaggccgatcgtgaccgacgccaacaggggcaagaggagcaggttcaagaagcaaaaaatacatttacgcaagtcgtgcagggcaatgagtttcaaaatatcccaggggagcaggtaaccgaggaacagttcactgacgagcaaggaaatattgtgacaaaaaaggtggagctgcgaggcagtggcctgcagccagatctcatcgaagggcgaaagggcgcacagattgtgaaacgcgctagcttaaagaggggtaagcagtag

SEQ ID NO: 179004 - DNA, 4560 bp, Artificial Sequence
  Description of Artificial Sequence: Synthetic coding sequence
atgccctacagcgtgggcttccgggaggccgacgccgccaccagcttcctgcgggccgcccggtcaggaaacttggacaaagcccttgatcatctaaggaatggcgtggatattaacacctgtaaccagaatggactcaatggcttacacctggccagcaaagaggggcatgtgaaaatggtggtggaactattgcacaaagaaatcattctggagacgactacaaaaaagggaaataccgctctgcatattgcagccctagccggtcaagacgaggtggtgagagaactggtgaattatggtgcgaacgtcaatgcccaatctcagaagggattcacccccttgtacatggccgcccaggaaaaccacctggaggtggtcaagttcctgctggagaatggggccaaccagaacgtcgccacagaggacggcttcactccgctggccgtggccttgcagcagggccatgagaacgtagtggcacatttgatcaattacggaacgaagggaaaagtcaggctcccggctttacatattgccgcacggaacgatgacaccaggactgcagcagtgttgctgcaaaacgatcccaatcctgacgttcttagcaagactggattcacaccgctgcatattgcagcacactatgagaatctcaacgtggctcagctcctgttgaatcgcggagcatccgtgaacttcacccctcaaaatgggatcacacccctgcatattgcgtctaggagaggcaacgttattatggtgaggctgctgctggacaggggcgctcagatcgagacgaagaccaaggacgagttgacgcccctccactgcgccgccagaaacggacacgtacgtatatccgagatccttctcgatcatggtgcccctatccaggccaagaccaagaatggactgtcacccatccatatggcagcccaaggcgatcacctagattgcgtgcgactgctgctgcagtacgacgccgaaattgatgacatcacgctagaccatctgacgccactgcatgtggctgcccactgcggccaccatcgggtggcaaaagttctgctggacaagggggccaagccaaatagtcgcgctctaaacgggtttaccccgctgcacatcgcgtgtaaaaagaaccacgtccgtgtgatggaactgctgctgaagacgggcgcctccatcgatgccgtgaccgagtctgggctgacgcctctgcacgtggccagcttcatggggcatcttccaattgtcaagaatttactgcagaggggtgcttcgcctaacgtgagcaatgtgaaggtggagactccattacatatggcagcaagggccggacacactgaggtcgcaaagtaccttttacagaataaggctaaagtcaatgccaaggccaaggatgaccagactcctctccattgcgcagcccgcatcggacacactaacatggttaagctgcttttagaaaacaacgcgaatccgaatctggccaccaccgctggccacacccccctccacatcgccgcaagagaaggtcacgtggagacagtgctggccctcctagaaaaggaggcgagccaagcgtgcatgacgaagaaaggtttcacccccctacacgtcgccgcaaagtacggcaaagttagagtcgccgaactgcttctcgagcgcgacgcccatccaaacgcagccggaaagaatgggctgacgcctctacacgtggccgtccaccataataacttggatattgtcaaactgcttcttcccagaggaggatccccccacagccctgcctggaacgggtacaccccacttcatattgctgcaaagcaaaaccaggttgaggtcgcgcgaagccttttacagtacggtgggagcgctaacgccgagtcagtccagggcgtgacacctctccacctggctgcccaagaagggcacgccgaaatggtggccctgctcctgagtaagcaagcaaatggaaaccttggcaataaaagcggcttgaccccattacacctggtcgcccaggagggacacgtgccagtggctgatgtgctgataaagcatggagttatggtcgacgctaccactcggatgggctatactcccctccacgttgcttcgcactatgggaacatcaaactggtgaagttccttttgcagcaccaggccgatgtgaacgctaaaactaagttaggctatagtcctctccatcaagcggcacagcaagggcatactgatatcgtgacactgttactgaagaacggggcctcccctaacgaagtgagttccgacggtactactcctctggcaatcgccaagcgcctgggatatatttctgttaccgacgttctcaaagtggtaactgacgagaccagctttgtcctagttagcgataagcacaggatgagttttcctgagacagtggacgaaatcctggatgttagcgaagatgaaggagaggagttgattagctttaaagccgaacggagagacagtagggacgtagatgaggagaaagaacttttggattttgtgccaaagttggatcaggtggtggagagccccgcaattccacgtatcccctgcgcaatgcccgaaacagtggttatcagaagtgaggaacaagaacaagcttccaaggaatacgacgaggacagcttaatcccctcaagtcccgcaacagagacctcggacaacatctctccagtagcgtcgccggtacatactggcttcctggtgtcttttatggtggacgccagaggcggtagcatgcgaggcagccggcataatgggctgcgggtggttataccacctagaacttgcgccgctccaacaagaattacatgccgcctggtgaaaccgcagaagctgagcactcctcccccgcttgccgaagaagagggtctcgctagcagaatcatcgcactgggacccacaggagctcaattcttatcacctgtgatcgtggagatcccccattttgcatcacacggacgtggcgatagagagctggttgtgcttaggtcagagaacggcagtgtctggaaagaacacaggtcccggtacggggagtcctacttggaccagatcctgaacggaatggacgaggagcttggttccttagaggaattggaaaaaaaacgcgtctgtcgaatcatcaccaccgattttcctctttatttcgtgataatgtctcgcctctgtcaggactatgacacaataggacctgagggggggtcactgaagagcaagttggttcccttagtgcaggcaacgtttccggaaaatgcggtaaccaagcgggtgaaattggcactgcaggctcaacccgtgccagacgaactcgtgactaagcttttgggaaatcaagcaaccttttcaccaattgtgacagtagagccaagacgcaggaagtttcataggccaatagggttgcgcattccccttcccccaagttggactgacaatcccagggactccggcgagggtgatactacaagcctgcggctgctgtgcagcgtcatcggcggaaccgaccaagcccagtgggaggacatcaccggaaccaccaagttagtttacgccaacgaatgcgctaactttacgacgaatgtatcagcgcggttttggctgagcgactgtccgcggacagctgaggccgtgaactttgcaacactgctgtacaaggaacttacagccgtcccctacatggcgaaatttgtaatcttcgctaagatgaatgatccccgcgaaggcagactacggtgctattgtatgacagatgacaaagtggacaagaccttggaacagcacgagaacttcgtggaagttgccagaagtcgcgatattgaggttctggaggggatgtccctgttcgccgaattgagcgggaacctggtaccagtgaaaaaggccgcccaacagcgatcctttcacttccaatcatttcgggagaacaggctggcgatgccagtcaaggtaagggactcatcccgcgagcccggcggttccctgagctttctgcggaaagcaatgaagtatgaagacacccaacatatcctttgtcacttgaacatcacaatgcccccctgcgctaaaggaagcggggccgaggaccgcaggcggacacccacccctttggcactgaggtactcaatcctgtctgagtcaactcccggttctctgtctggcaccgagcaggccgaaatgaaaatggccgtaatttctgaacatctaggccttagctgggccgaacttgcgcgcgagctgcagttctctgtagaggatattaatcggatccgggtggaaaaccccaactctctgttggagcaaagcgtagcactgctgaatctgtgggtgattagggaagggcaaaacgctaacatggagaacttatatacagcattgcagagcattgatcggggcgagatcgtaaatatgttggagggctctggacggcaatcccgaaatcttaagcctgaccgacgccatacagaccgcgactatagcctttccccaagccaaatgaatggtatctcgaccaataatccatag

SEQ ID NO: 179005 - DNA, 5505 bp, Artificial Sequence
  Description of Artificial Sequence: Synthetic coding sequence
atgccctacagcgtgggcttccgggaggccgacgccgccaccagcttcctcagagcagcccgatctggcaacctggacaaggccctggatcacctgcggaatggggttgacataaacacctgtaatcaaaatggcttaaacggcttgcacctagcatcaaaggaagggcacgtcaagatggtggtggagttgttgcacaaggagatcatcctcgagaccacgactaagaagggcaatacggctctccatatagcggcattggccggccaagacgaggtcgttcgagaactagtgaattatggggcaaatgtcaacgcccaaagccagaaggggttcactccattatacatggcagcacaggagaaccacctcgaggttgtgaagttcttgcttgaaaacggcgccaaccaaaacgtggccacagaagatggctttactccccttgctgtcgctctccagcagggccatgaaaatgtcgtggcgcacttaatcaactatggtactaaaggcaaagttcggctgcctgcactccacatagccgcaagaaacgatgatacacggaccgcagcagtgctgttgcagaacgacccaaaccccgatgtcttgtccaagaccggcttcacccctctgcacatagctgcccattatgaaaacttgaatgtggcccaactgttactgaatcgcggtgcttcagtgaacttcacgcctcagaacggaattaccccactccatatcgcaagtaggcggggaaacgtgattatggtcaggctgctattagaccgcggggcccaaatcgagacaaaaacaaaggatgagctgacccccttgcactgtgcagcccgaaatggccacgtaaggatctctgagattcttctggaccatggcgctccaatccaggcaaaaacaaaaaacggactgagtccaattcatatggccgctcagggcgatcacctggattgcgtgcgtctgctcctgcaatatgacgccgaaatcgacgacatcactctggatcacctgacgccgcttcatgtggccgcacattgcggccatcaccgagtagccaaggtgttgcttgataaaggcgcgaagcccaactcacgcgccctaaacgggttcactcccctgcatattgcctgtaagaagaaccatgtccgggtcatggagctgctgctgaagacaggcgcctctatcgatgccgtgacagaatccgggttaactcctctgcatgtggcaagctttatgggccacttgccgattgtgaagaacctacttcagcgcggtgctagccctaacgtgtcaaacgtgaaggtagaaactccccttcacatggctgctagagccgggcataccgaggtggccaagtacctgttgcagaataaggccaaggtcaacgctaaggccaaggacgatcagaccccactgcactgcgccgccaggataggacacaccaacatggtaaaacttctgttggagaataatgccaatcccaatcttgccactacagccgggcatactccactgcacattgcggcgcgcgaaggacatgtcgaaaccgtcctggctctcctggaaaaggaagcatcacaggcctgcatgaccaaaaagggcttcacaccattacacgttgccgcaaagtatggcaaggtccgcgtggccgaactcctactggagagagatgcgcaccccaatgccgcaggcaagaatggactgactcccctacacgtcgccgtgcaccataataacctagatatcgtgaagctcctgttgccccgcggaggatctccgcacagccctgcctggaacggatacacgccactccacatagcagctaagcaaaatcaagtcgaggtggcccgttcactgttgcaatacggcggctccgcgaacgcagagtcagtacagggcgttacacctctgcatctggcagcgcaggaagggcatgccgagatggtggccctgttgctgagtaagcaggcaaacggtaacctgggcaacaagtccggccttactccacttcacttggtcgctcaagaaggtcacgtccccgtggcggacgtattgatcaaacatggagttatggtagacgccaccacaagaatgggctacactcccctgcacgttgcatcgcattacggcaatatcaaactggtgaagtttctgctccaacatcaggcagacgttaacgctaaaaccaaactgggatactcaccccttcatcaggcagcacagcagggccataccgatattgtgaccttactgctgaagaacggagcaagcccgaatgaggtaagcagcgatggcaccacaccactggcgattgctaaaaggttgggctacatcagtgtgactgacgtgctgaaggtagtcaccgacgagacaagtttcgtgctcgtttcagataaacaccgcatgtccttcccagagaccgtcgacgagatcctggatgttagtgaggacgagggcgaagagctgatttcatttaaagctgaaagaagagacagccgtgatgttgatgaagaaaaggagctcttagatttcgtgcccaagttagatcaggttgtagagtctcctgcaatccctagaatcccctgcgcaatgccagagacggttgtgattcggagtgaggagcaggaacaggcgagtaaggagtacgatgaggactctctgatcccctcatcaccagcgacggaaacatctgacaacatttccccagtggcttcaccagttcacaccggttttttggtgagctttatggtggacgctcggggtgggagtatgagaggctctcgccacaacggcctgcgggtggtcataccccctaggacttgtgcggcgcccacacggatcacctgtcgcctcgtgaagcctcagaagctctccactccaccacctttggctgaggaagaagggctcgcatcccggatcatcgctcttggacccacaggcgcccagttcctatctcctgtgattgtggagatcccacacttcgcttcccacggccggggggatagagagctagtcgtgcttaggtctgagaatgggtcggtgtggaaagagcaccggtcacgctacggagaatcatacctggaccagatcctcaacggcatggacgaagaactcggaagcctcgaggagctcgaaaagaaaagagtctgccgcatcatcacgaccgactttccactgtattttgtgataatgagtagactttgtcaggactacgacactatcggacccgaggggggatcgctgaagtccaaattggttcccctggtccaagccactttccctgagaacgcagtgacgaagcgtgtaaaacttgccctgcaagcccaacccgtgcctgacgaattggtaactaagctgctcggaaatcaagcaacttttagccccattgtgacagttgaaccgcggcgcaggaagttccaccggcctattggcttgaggatcccattgcctccatcctggaccgacaacccgagagacagcggcgagggagacactacctcccttaggcttctctgtagcgtcatcggggggaccgatcaggcccagtgggaggatattactggcacaacaaagctggtgtatgcaaatgaatgtgccaacttcacaactaacgtttctgccaggttctggttatctgactgtccacggactgccgaagccgttaactttgctacactgctttacaaagaactgaccgcagttccctacatggccaaattcgtgatatttgcaaaaatgaacgatccccgggagggcagactgaggtgctactgtatgactgatgataaagtagataagaccctagagcagcatgagaattttgtggaggtggctagaagtagggatatcgaggtcctggaaggaatgtccctattcgctgaactgtccggtaatctcgtcccagtgaagaaggccgcccaacagcgctcttttcattttcagtctttcagggagaatagactagccatgcctgttaaggtgcgcgacagcagtagagagccagggggaagcctgagcttcttgcgtaaagccatgaagtacgaggatacccagcacatactatgtcatctcaatatcaccatgccgccctgtgctaaagggagcggagctgaggatcgtcggcggaccccaacaccgcttgcacttaggtattctattctcagtgagagtactccaggcagcctgtctgggacggaacaggcagagatgaaaatggcagtaattagtgaacacttagggctctcgtgggccgagctcgccagagagttgcagttttccgtggaagatatcaacagaatccgcgttgaaaatccgaactctctccttgagcagagcgtggccctgttaaatctgtgggttataagggaggggcaaaacgccaatatggaaaacctgtacacagcactgcagagcatcgaccggggcgagatcgtgaatatgcttgaaggctctgggcgccagtccaggaacttgaagccagataggcgccacacggaccgggactacagcctgtcaccctcccagatgaatggatactcatcactgcaggacgagttacttagtccagcctccctgggttgtgccctgtcttccccactcagagcggatcagtactggaacgaggtagccgtactggacgctattccactggccgctaccgagcacgacacaatgctggaaatgtctgatatgcaggtgtggagcgctgggctgacccccagcctggtgactgcggaggactcatctcttgagtgtagcaaagcagaggattccgatgcaacaggccacgaatggaagcttgaaggggccctgagcgaagagccacgtggtcctgaactgggcagtttggaactggtggaggacgatacagtggactctgacgccacaaacggtctgatcgacttgctggaacaggaggaaggtcagcgatcagaggaaaaactgcccggaagcaagcgacaggacgatgccactggagccggccaggactctgagaacgaggtgtccttggtttctggccatcaaaggggccaagcccgtattacacacagcccaactgtgtctcaggtgacagaaagaagccaggaccgtctccaggactgggacgccgacggaagtattgtaagctatttacaggatgccgcccaggggtcttggcaagaggaggttacccaggggccacactcttttcagggcacatccaccatgacggaaggattagaaccaggcggtagccaagagtacgagaaggtcctggtgtctgtaagtgagcatacatggactgagcagcccgaggcagaatcatcccaggccgaccgagatcgcaggcagcagggacaggaggaacaggtgcaagaggcgaagaatacgttcacacaggtcgttcagggaaatgaatttcagaacattcctggggaacaagtgactgaggagcagttcaccgatgaacagggcaatatcgtgactaaaaaggaccatacgtctacccccaacccctag

SEQ ID NO: 179006 - DNA, 5718 bp, Artificial Sequence
  Description of Artificial Sequence: Synthetic coding sequence
atgccctacagcgtgggcttccgggaggccgacgccgccaccagcttcctcagagctgccagaagcggcaacctggacaaggccttggaccacttaaggaacggagttgacataaatacctgcaaccagaatggtttgaatggtctccacctcgccagcaaggagggacacgtcaaaatggtggtcgagctgttacacaaggagataattttggagaccacaacaaaaaagggtaacacagcactccacatcgctgcactggccggccaggatgaagtagtgcgtgaacttgtgaactacggagctaatgtgaatgcacagtcccaaaaggggttcacgccattgtatatggcggcccaagaaaaccatctggaagtcgtgaagtttttgcttgaaaacggagcaaaccagaacgtggccacagaagatggcttcaccccactcgcggtggccttacagcaggggcacgaaaacgtggttgctcaccttattaactatggaacaaagggaaaagtgaggttacctgcacttcatattgccgctaggaatgacgacacacggactgctgcggttttgttgcagaacgaccccaatcctgatgtgctgtccaagactgggtttacccctctccatatagccgcgcattatgagaacctcaatgtggcccagttgctgttgaatcgcggggcttccgtcaatttcacgccccaaaatggcataacaccacttcatattgcgtccaggcgaggaaacgttataatggtgaggcttctcctggaccgaggagctcagattgagacaaagacaaaagacgagctgacacccctgcattgcgctgcccgaaacggtcacgtgcgcatctcggaaattctgttggatcatggagcccctatacaggccaaaacaaaaaatgggcttagtcctattcatatggcggcccagggggatcatcttgattgcgtgcgtttgctgcttcaatacgacgcagagatcgacgatatcacactggatcacctcacccctctgcacgtggcagctcattgtggtcatcaccgtgtggccaaggtgctgctagataagggggcgaagccaaattcccgtgctttgaacggatttacacccctccacatcgcttgtaaaaagaatcatgtacgagtgatggagttgttactgaagaccggcgccagtatcgatgccgtgactgaatccggtttgactcctctgcacgtcgcctccttcatggggcatctcccgatcgtgaagaatcttctgcaaagaggtgcaagcccaaatgtgtcaaacgtaaaggtggaaaccccccttcacatggcagctagagcaggccacacggaggtagctaaatacttattacaaaacaaggctaaggtcaacgcaaaggctaaggacgaccagacccccctgcattgtgctgctcggattggacacaccaacatggtgaagctgctcctcgagaacaacgctaaccccaatcttgccacaaccgcgggccacaccccgctgcacattgcagcacgagaaggacacgtcgagaccgtcctagcacttttggagaaggaggctagccaagcatgtatgacaaagaagggatttacccctcttcatgtcgccgcaaagtacggcaaggtgagggtggctgagttactattggaacgcgacgctcacccaaacgcagcaggaaaaaatggcttaacccccctacacgtggcagttcaccataataacctggacattgtaaagttactattgcccaggggcggctcaccgcatagccctgcttggaacggatacactcctctgcacattgctgcaaagcagaatcaggtcgaggtggctcgctcactgctgcaatacggtgggagcgcaaacgccgagagcgtgcagggagtgacccccctacacctggcagcccaagaaggccatgccgaaatggtggccctgctccttagtaaacaggcaaatgggaacctaggtaacaaaagcggtttgaccccattgcatctcgtcgcccaagagggacacgttccagtagccgacgttctcatcaagcatggcgtgatggtggatgccactactagaatgggctatactcctttacacgtcgccagccactatggaaatataaaactggtgaagtttctgctgcagcatcaggcagacgtaaatgccaaaaccaaactcggatactccccgctgcaccaggcagctcagcagggtcacacagatatcgtcacactactcctcaaaaacggtgcgagcccgaatgaggtcagctccgacggaactacccctctggcgatcgcaaaaaggctggggtacataagcgtgacagatgtattaaaggtcgtgaccgacgaaactagctttgtgctggtaagtgataagcatagaatgagctttcccgaaactgttgatgagatcctcgacgtaagtgaagacgaaggcgaggagctgatctccttcaaggctgaaagacgcgacagtagagatgtggatgaggagaaagaactgctggacttcgtcccaaagctcgaccaggttgtggagtctcccgccatccctcggatcccatgcgcaatgccagagaccgttgtcatccgatccgaagagcaggagcaggcatctaaggaatacgacgaagactctcttatcccgagttccccagccacggaaacatccgacaatatcagccccgtagcgtctccagtccatactggattcctggtcagttttatggtggacgcccggggggggtctatgaggggctctcggcacaatggattaagagttgtgatcccccccaggacttgcgccgcccctacacggatcacatgccgcttagtaaaacctcagaagctctccacgccgccacccctcgcagaagaagaaggactcgcaagtaggattatcgccctcggccctactggagctcagtttttgtccccggtcatagtggaaatcccccatttcgcttcacacggcaggggtgacagagaacttgtagttctgagaagcgaaaatgggtcagtctggaaggaacatagaagtaggtatggtgagtcctatctggaccagattcttaacggcatggacgaggagctgggtagtctcgaggaacttgagaagaaacgagtctgtaggatcatcactactgacttcccactttacttcgtgatcatgtctagactctgccaagattacgatactatcggtcccgaagggggatcattgaaatctaaactggtgcctctggtccaggcaacattcccggagaacgccgttacaaaaagagtgaaactggctctgcaagcacagcccgttcccgatgagctggttaccaagctgctgggtaaccaagctacctttagccccattgtaaccgtagagcccagaagacgaaaattccaccgccctatcggactgcgcatccccctcccacctagctggactgacaacccaagggatagtggagagggtgatacaacgagtctcagactactctgttctgtaatcggtgggactgaccaagcccagtgggaggacattaccggtactaccaagttggtgtacgccaatgaatgcgcgaacttcacaaccaacgtgagcgctaggttttggttaagtgattgtcctcggaccgctgaggccgtcaactttgctaccctgctgtataaggagctgacagccgttccatatatggcgaagttcgttatcttcgctaaaatgaacgaccctcgggagggacgtctgagatgttactgtatgacagatgataaagtagataagactttagagcagcatgaaaacttcgtcgaggtggctaggagcagggacatcgaggtgctggagggaatgagtctcttcgccgagctatcaggaaacctggtgcccgtgaaaaaggccgctcagcaaagatcatttcatttccagtcttttcgggaaaatcggcttgccatgccggtaaaggtacgcgatagtagccgagagcccggtggttctctgagcttcctcagaaaggccatgaaatatgaggacacccagcacattttatgtcacttgaacattaccatgcccccttgcgccaaagggtccggcgcagaggatcggcgacggacacctactcctctggctttgaggtacagcatcctctcagaatctactcccggttccctcagcggcaccgaacaggccgaaatgaaaatggccgtgattagtgagcacctcggccttagttgggccgaactggccagagaacttcagttttccgttgaagacatcaaccgcattcgggttgaaaatcccaacagcctcctcgagcaaagtgtggccctattgaacctctgggtcattcgagagggacagaatgcaaatatggaaaacctgtacacagccttgcagagcatcgacagaggagagattgtcaacatgctcgagggaagcggccggcagtctcgaaatttaaaacccgacagacgtcacaccgatagagactattctttatcacccagccagatgaatggatactcctctctacaggacgaattgctgtctcctgcgtcccttggctgcgccttaagttctcctctccgcgccgatcagtattggaacgaagtcgctgtgctggatgccatccctttggctgcaaccgagcatgatacaatgcttgagatgtccgatatgcaggtctggagcgctggcctgactccaagtttggtgacagctgaggatagttccctggagtgtagcaaagctgaggactccgatgctacagggcatgagtggaaactggaaggcgctctgtctgaggagcccagaggccctgagcttggaagcctggaattggtcgaagatgacaccgtggactctgacgcgactaacggactcattgatctccttgaacaggaagaaggacagaggtctgaggaaaagctaccagggtcgaagcggcaggatgacgcaacaggcgccggacaggacagcgagaatgaggttagcttagtgtctggacatcagagaggtcaggcccggattacccacagtcccacagtgagtcaagtgactgagcgttctcaggaccggcttcaggattgggatgctgatggcagcattgtaagttacctgcaggacgcggctcagggctcctggcaggaggaggtgacccaaggcccacattcctttcaaggaacttccacgatgaccgaaggcctggaacctggcggatcccaggagtatgaaaaggtgctcgtgagcgtgagtgagcacacctggaccgaacagccggaagccgagagttcacaagccgaccgagatagacgtcaacagggccaggaagaacaagtacaggaagccaaaaacacattcacccaagtggtgcaggggaatgaattccagaacatcccgggtgagcaggtcacagaggagcaatttactgatgagcagggcaacattgtcaccaaaaagataatcaggaaggtggtcagacagattgatctttccagcgcagatgccgcccaggaacacgaggaagtcacagttgagggtcccttggaggacccttccgaattggaagtcgatattgattatttcatgaagcactctaaagtggagctgcgaggatctggtttacagcccgacctgatcgagggccgcaagggggcccaaatcgtaaaaagggcgtccctaaagaggggaaagcaatag

SEQ ID NO: 179007 - DNA, 5421 bp, Artificial Sequence
  Description of Artificial Sequence: Synthetic coding sequence
atgccctacagcgtgggcttccgggaggccgacgccgccaccagcttcctgcgcgcagcgaggtccggaaacctggataaggcactggaccacctccgcaatggggtcgatatcaatacatgcaaccagaacggactgaacggactgcacctggcctccaaagagggtcacgtgaaaatggtggtggagttactgcataaagaaatcattctggagacaactacaaagaaaggaaataccgctctacacatcgctgccctggccggccaagatgaagttgtgcgcgagctcgttaactacggggccaacgttaacgctcagtctcaaaaaggctttactcctctatatatggccgcacaggaaaatcatctcgaggtggtcaagttcctccttgaaaacggggccaatcagaatgtggccacagaagacgggtttacaccactcgcggttgctttacagcagggtcacgaaaacgtagtagcccaccttatcaattatggcacaaaaggcaaagttcgcctgcccgccctgcacatagccgccaggaatgacgacactcgtacggccgcagtgctgttacagaacgatcccaatcctgacgtgctgagtaaaaccggattcactcccctgcacatcgccgcacactatgaaaaccttaacgtggcacagctgctgcttaatcggggcgccagtgtcaatttcacccctcagaacggtataactcctctgcatatcgccagccggcgcggtaacgtcattatggtcagacttctgctggaccggggggcacagattgagacaaaaacaaaggacgagctgacaccattgcactgcgctgctaggaatggacacgtccgcataagtgaaatactcctggatcacggagccccgattcaagccaagaccaaaaatggcttatcacccatccacatggctgctcagggcgatcatctggattgcgtccggcttctcctgcagtatgatgccgaaatcgatgatattacactggatcatctcacacctctccatgtcgccgctcactgcggccatcatagggttgccaaggtgctcctggacaaaggcgctaagccaaacagtagagccctgaacggtttcactccactacacatcgcttgtaagaaaaaccatgtccgagtcatggagttgttgttgaagactggagcatctattgatgccgtaacagaaagcggacttacgcccctccatgtggcaagcttcatgggacatctgccgattgtgaagaatctgcttcagcggggagcctcaccaaatgtctccaacgtgaaagtcgaaacccccctgcatatggcagccagagccggtcataccgaggttgcaaagtatcttttgcagaacaaagccaaggtgaacgcaaaagctaaagacgaccagacaccactgcattgtgcagccaggatcggccatactaacatggtgaagcttttgctggagaacaatgctaatcctaacctggctacgaccgcagggcacacacctctacacattgcagcaagagagggacatgtggagacggtgctggcattacttgagaaggaagcctctcaggcctgtatgaccaagaaaggcttcactcctctccacgtggccgccaagtatggcaaagttagagtggcggagctccttctcgagcgcgatgcccacccaaacgcagccgggaaaaacgggctgacgccactgcacgtggcagtgcaccataacaatctggacatcgtcaagctcttactcccacggggggggtctcctcactccccagcctggaatggatatacacctttacatattgccgcaaagcagaatcaagtggaggtggcacgctctcttctccagtatggaggctcagccaatgccgagtccgttcagggggttacacctttgcacctggcagcccaggaaggacacgccgaaatggttgcgctactactgtctaaacaagcaaatggtaatttaggaaataagtcgggcttgaccccactgcatctcgtcgcacaagagggccacgtgccggtagctgatgttctcatcaaacatggtgtcatggtcgacgccaccaccagaatggggtacacccccctccatgtcgcaagccattatggcaacatcaagcttgtgaagtttctactgcagcatcaagcagatgtcaatgccaaaaccaagctgggctactctccattacaccaggctgcgcagcaaggacatacagacatcgtcaccctgctgttgaagaatggagctagccccaatgaagtctctagtgacggcactacccccctcgccatagctaaacgcttgggctacattagcgtcaccgatgttctgaaagtggttacagatgaaaccagcttcgttctggtgtccgataagcataggatgtctttccccgagactgtggacgagatcttggacgtttcagaagatgaaggtgaagagcttatttctttcaaagcagagcggcgggacagtcgggacgtcgacgaggagaaggagttacttgacttcgtgccgaaactggatcaggtggtggaaagtcccgcgattccccggatcccttgcgctatgcccgagaccgtcgtgattcgaagcgaggagcaggaacaagcgagcaaagaatacgacgaggactccctgatcccatcgtctcctgccacagagacgtcggacaacattagtccagttgcatcccctgttcacactggcttcctggtgagtttcatggtggatgctagaggcgggagtatgagaggtagccggcataacgggcttcgagtagtgatcccgccaagaacctgtgccgccccaacccgcattacctgtcgcctggtgaagcctcagaagctctccacgccgccgccattggccgaggaggaggggctggcctcaagaataatagcactcgggccaactggagcccagtttctgagtccggtgatcgtggagatcccacacttcgcctctcatggccgcggtgatcgagaactggtagtgctgaggtctgagaacggctctgtatggaaagagcaccgcagccggtacggcgagtcataccttgaccaaattctgaatggaatggatgaggaattgggctcgttggaggaactagagaagaagcgtgtatgccgcattatcacaacggactttcctctctatttcgtcattatgtccaggttgtgccaggattacgacaccatcggacccgaggggggcagcctgaaaagtaagttggtcccattggtccaggccacattccctgaaaacgccgttactaaaagagtaaaactcgctttgcaggcccagcctgtgcccgacgaattagtgaccaaactgctcgggaaccaggccaccttctccccaattgtgacggtagagcctcgtaggagaaaatttcacagacccattggtcttagaattcccctgccccccagctggacggacaatcccagagattcaggcgaaggcgacaccacaagtctccggcttctgtgctccgtgatcggcgggaccgatcaggcccagtgggaggacattaccggaacgaccaagctcgtgtacgcgaatgagtgtgcgaacttcactacaaatgtctctgccaggttttggctgtccgactgtccacgcaccgctgaagccgtcaactttgccacgctgttgtacaaagagcttaccgcagtgccttacatggcgaaattcgtgatttttgccaaaatgaacgacccccgtgaaggtagactcaggtgctactgtatgacagatgataaagtggacaagaccctggaacagcatgaaaactttgtcgaggtcgcgcgatcccgggatatagaagtgctggagggcatgtcactgttcgctgagttatcggggaatctcgttcccgtgaaaaaggctgcccaacagcggtcctttcactttcagtcttttagagagaatcggctcgccatgccggttaaagtgcgggacagttcccgggagccgggcggtagtttgagctttttgcggaaagctatgaaatatgaagatactcaacacatcctttgtcacctgaacatcacaatgccgccatgcgcaaaggggagcggcgcagaagatagacggaggacccccacccctctggcactcaggtattcaattctgagtgagtccaccccagggtcactgtctggaaccgaacaggctgaaatgaaaatggccgtgatcagcgagcatctaggactgtcttgggccgaactggctcgagaattgcagttcagcgtcgaagatattaataggatccgcgtggaaaatccgaactctctgcttgagcaatccgtggcactcctcaatctctgggtgatccgcgaagggcaaaatgccaacatggagaatctatatactgcccttcagtccattgatcgtggagaaatcgtcaacatgttagaaggcagcgggagacagagccgcaacttgaagcccgacagacgtcataccgatcgcgattattcgctctctcctagtcagatgaatgggtactccagcctgcaggatgagttgctgagtccggccagcttgggctgcgcactgtcaagtcctctgcgtgcagaccaatactggaacgaggtcgctgtgctcgacgcaattcccctcgccgctaccgagcatgataccatgctagagatgagcgatatgcaggtgtggtctgccggcctaacccccagcctagtcaccgccgaggatagcagcctggaatgcagtaaagcagaggactctgatgccaccgggcacgaatggaaactggagggagccctttcagaagaaccacgaggcccagagttagggtccctggagctagtcgaagacgacacagtggatagtgacgcgacaaacgggctgattgaccttcttgaacaggaggagggtcaacggtcagaggagaagttacctggcagtaaaaggcaagatgacgctacaggcgctggccaagactctgaaaatgaagtgagcctcgtgagtggacaccagaggggtcaggcccgtatcacacatagcccaaccgtttcacaagttaccgagcgatcccaagataggctacaggattgggacgcggacgggtcaatcgtctcctacctacaggacgcagcccagggatcctggcaagaggaggtcactcagggaccccactcattccagggcacatcaaccatgactgagggtttagagccgggtggcagtcaggaatacgagaaggtgctcgtctcagtgtccgaacatacatggactgagcagcctgaagccgaatcctcccaggcggaccgcgacagacggcagcagggacaggaggaacaggtccaggaggctaagaacactttcactcaagtcgtccaagatcacaccagtactccgaatccctag

SEQ ID NO: 179008 - DNA, 330 bp, Artificial Sequence
  Description of Artificial Sequence: Synthetic coding sequence
atgtggaccttcgtgacccagctgctggtgaccctggtgctgctgtcatttttcttggtgtcttgtcaaaatgtgatgcacatcgtgagaggcagcctttgctttgtgcttaagcatatacaccaggaactggataaagagttaggcgaaagcgaggggctgtcagacgatgaggagaccataagtacgcgggtagtccggcgcagagtcttcctgaagggcaatgaatttcaaaatatccctggagagcaggtgaccgaagaacagtttactgacgaacaggggaatattgtgacaaaaaaggatcacacaagcactccaaatccctag

SEQ ID NO: 179009 - DNA, 11775 bp, Artificial Sequence
  Description of Artificial Sequence: Synthetic coding sequence
atgatgaacgaggacgccgcccagaagagcgacagcggcgagaagttcaacgggtcttcccagagacgcaaaaggccaaaaaagtccgactcaaacgcttctttcctccgcgcggcccgagcgggcaatctggataaggtcgtggaatatctgaaaggcggtatagacatcaatacctgcaaccaaaacggtctcaatgcacttcacctggcagcaaaagagggacacgtgggactagttcaagagttactgggtaggggctctagcgtcgacagcgcaactaaaaaaggcaataccgctttgcatatagcctcactggctgggcaagcggaagtggtaaaggtgcttgtaaaagaaggtgccaacataaatgcccagagccagaacggcttcaccccactgtatatggccgctcaggaaaatcacattgatgtcgtaaaatatttgctggaaaacggggcaaatcagtctacagcaacggaagatgggtttacaccactggcagttgcactccaacaggggcacaaccaggcggtggctatcctgctagagaacgatacgaaggggaaggttcgcttgccagcattgcatattgccgccaggaaggatgataccaagagcgccgccctgctgctgcagaacgaccataatgcggacgttcagtcaaaaatgatggtcaacagaacgaccgaaagcggattcactcccctacatattgctgctcactacggcaacgttaatgttgcgactctcctgctgaatcgaggtgcagccgtcgatttcactgccaggaacgggatcacccctctgcatgtggccagcaagaggggcaatacgaatatggtgaaattattactcgaccggggtgggcaaatcgacgctaagacgagagacggacttaccccattacattgtgcagcaagaagtggacatgatcaggtggttgaattgctgctcgagcggggagctcctctcctggcccgtaccaagaatggtctgagccctttacacatggccgctcagggagaccacgtagaatgcgtcaaacatctcctgcagcataaagctccggtggacgatgtgacactggattatctgaccgccctgcacgtggcggcccattgtgggcactatagggtcacaaaacttcttctggataaaagggctaatccaaatgcaagagccttgaacggtttcactcctttgcacatcgcttgtaagaaaaatagaataaaggtgatggaactgctggtaaaatacggcgcatccatccaggccatcactgagagcggtcttacccctatccacgtcgcggcttttatgggccatcttaatatcgtgctcctcctgcttcaaaacggagcatctccggacgttaccaatatcagaggcgagactgcactgcacatggctgctcgggccggacaggtggaggtcgtcagatgtctgctgcgaaatggcgccttggtggatgcccgtgcacgggaagagcagactccactgcatattgctagtagactaggaaagacagagatcgtgcaactactcctgcagcacatggcccatcccgacgcagcaaccactaacggctatacgcctctccacattagtgccagggagggtcaagtggacgtggcctccgtactgctggaagctggggcggcccactctctcgctaccaagaaaggattcacgccactacatgtagctgccaagtatggatcccttgatgtcgcaaaactcttactgcagcggcgcgctgcagctgactcagccggcaagaacggactcacaccactccacgtcgccgctcactatgataaccagaaggtcgctctgctgctgctcgaaaaaggagcttcaccacacgctactgccaaaaacggttatacgcctctgcacatcgcagctaagaaaaatcaaatgcagattgcctcgacattactgaactacggagctgaaacaaacattgtcactaagcagggggtgacaccactgcacctggcctcccaggaggggcatactgacatggtcacactgctcttagacaagggagctaacattcatatgagcaccaagtccggtctcacctccttgcaccttgcagcccaggaagacaaagtcaatgtggccgatatcctcacaaagcacggtgctgaccaggatgcgcacacgaagctgggatacactccgctcattgtcgcctgccattatggaaatgtcaaaatggttaactttctgctcaagcagggggcaaatgtgaatgccaagaccaagaatggctatacacctctgcatcaggccgcccaacaaggccatacacacatcattaacgtcttattgcagcatggcgcgaaaccaaacgctactaccgccaacggaaataccgcccttgcaattgctaaaaggttggggtatatctcagttgtggacacactaaaagtggtcactgaagaagtgactacaaccacaaccactattacagaaaagcataaactgaacgtgcccgaaaccatgactgaggtccttgacgtgagtgatgaagaaggtgacgatactatgactggcgacggaggagaatatctgaggcccgaagatctcaaggaactcggagacgactccctcccgtcatcacagttcctggatgggatgaactacctaaggtatagcctggagggtggtcggtcagacagtctacggtcattttcttcagatcgaagtcacacactaagccacgcttcatacttgagagactcggcggtaatggatgacagcgttgtcattccgagtcaccaggtctccacactggccaaggaggcggaacgcaactcttatcggctatcctgggggaccgagaatttggacaatgtggccctgagtagttccccaattcacagtggcttcttagtgagttttatggtggatgctcgcggcggagcaatgcgcggatgtagacataatgggttaagaattattataccacctagaaagtgcactgcaccaacacgggtcacttgcagacttgtgaaacgccatcggcttgcaaccatgcctcctatggttgagggcgaaggcctggccagccgactgatcgaggtgggcccaagcggcgcacaatttctcggcccggtcatcgttgaaatcccccattttgccgctctgagaggaaaagagcgcgaacttgtggtgctaagaagtgagaatggtgattcttggaaagagcatttctgcgattatactgaggacgagctaaacgaaatccttaacgggatggatgaggtgctggactcaccagaggatctcgagaagaagcgaatctgtaggatcattactagggacttcccgcagtacttcgctgtcgtgtctcgcatcaagcaagattcaaacttgattggtcccgaaggcggagtactgtcctcaactgtcgtcccacaggttcaggccgtgttccccgagggggctctcaccaagaggattagagtggggctccaggctcaacctatgcattccgagctcgtgaagaagatactgggaaacaaggctacgttcagcccaatcgtaaccttagaacctcggagacgcaaattccacaagcctatcaccatgactatcccagtcccaaaggcctctagtgacgtgatgttgaacggtttcggaggggacgcgcctacgcttcgcctgctttgtagcatcactggcggtaccaccccagctcagtgggaggacattaccgggacaacacctctcacctttgtgaatgagtgtgtgtcgttcacaacgaacgtgtccgcccgattttggctgattgattgtcgccaaatccaggagtccgtcacgtttgcctctcaggtttatagggaaattatctgtgttccttacatggctaaattcgtggtgttcgccaagtctcatgatcctattgaggcgcggctgcgatgcttttgcatgaccgatgacaaggtcgataaaacccttgaacagcaggagaacttcgcggaggtcgctcgcagccgagatgtggaagtcttggagggcaaacctatttatgtggactgttttggtaacctggtaccattgaccaagtctggccagcatcatatttttagcttcttcgcctttaaagaaaaccgactgccactcttcgtgaaggtgagggacacaacccaagaaccctgcgggcgcctgtcctttatgaaggagccaaagagcaccagaggcttagttcaccaggccatctgcaatcttaatatcactctgcccatttacacaaaagagtccgagtcagaccaggagcaggaggaagaaattgatatgactagtgagaagaacgatgaaacggagtcaaccgagacaagtgtgctgaaaagccatctggtcaatgaggtgcccgtcttggcctcccctgacttactctccgaggtttcagagatgaagcaggatctgattaagatgaccgccattttgaccacggacgttagcgacaaggccgggtctatcaaagtaaaggagctggtgaaagcagcggaggaagagcctggtgagccgtttgaaatcgtagagagggtcaaagaagacctggaaaaggtgaatgagatactgcgctctggaacctgcactagggacgaatccagcgtccagtccagcagatctgaacggggtttggttgaggaagagtgggtcattgttagcgatgaggagatcgaagaggcgaggcaaaaggcacctctggaaattactgagtacccatgcgtggaagtgcggatagataaggagattaagggtaaggtggagaaggactctaccggattagtgaactatcttaccgatgatcttaacacatgtgttccgctgcccaaagagcagctgcagaccgttcaagacaaagccgggaaaaaatgcgaagcgttggccgtcggtcgctcctctgagaaagaaggaaaggatatccctcccgacgaaacgcagagcacccagaagcagcacaaaccatccctggggatcaagaaacccgtaaggcggaagctgaaagaaaaacagaaacagaaggaagaaggattgcaggcaagtgccgagaaagcagagctcaagaaggggtcatccgaggaatctctcggagaggatcctggtcttgctccagagcctcttccaaccgtgaaagccacctcacctctcattgaagaaaccccaatcggctccataaaggataaagttaaagccctgcagaagcgcgtggaggacgagcagaaaggcagatccaagttgccaatccgtgtgaagggcaaggaggatgttcctaagaaaacgacacatcgcccccaccctgccgcttccccttccctcaagtcagagcgacacgcccctgggagtccctcacctaagaccgaaaggcacagtacattgagcagctctgcaaaaaccgagaggcacccacccgtgagcccttcatccaagaccgagaaacattctcccgtcagtccgtccgccaagacggaacgccacagccccgctagtagcagctcgaaaaccgagaaacacagtcccgtgtctccttcaacgaagacagaaaggcacagccccgtgagttccaccaaaactgaaagacacccgcccgtgagccctagcggaaaaaccgataaacggcctcccgtaagccctagcggacgcacagaaaagcatcctcctgtaagtccgggtcgtactgagaaacggctcccagtcagcccttccggtcggaccgacaagcatcaacctgtctcaacagcagggaaaacggagaagcatctccccgtcagcccctccgggaagacagagaaacaacctcccgttagtccaacttcgaagacagagcgaattgaagagactatgtccgtgcgcgaattgatgaaggctttccagtcggggcaggatccttctaagcacaagactggcctgttcgagcataaatcggccaagcagaaacaacctcaggaaaaaggcaaggtcagggtggagaaggagaagggcccaatcctgacccaaagagaagcccagaaaaccgagaaccagaccataaagcgcgggcagagactcccggtaacggggactgcggagtcaaaacgaggcgtcagagtgagcagcatcggagtcaagaaagaagacgccgccgggggaaaggagaaagtgctgtctcacaagatccccgagccggtgcagagtgtaccagaagaagagtctcatcgcgagagcgaagttcccaaggagaagatggctgatgagcagggcgatatggacctccagatatctcccgatcgtaagacttcaactgatttttctgaggtgataaagcaggaactggaagataatgataagtatcagcaatttcgattgagcgaggagacagaaaaggcacagctgcatctggatcaggtactgaccagccccttcaatacaacgtttcccctcgactacatgaaagacgagtttctgcccgctctcagtctgcagagtggtgctcttgacggaagcagcgaaagcctgaaaaacgagggggtggcggggtctccctgtggatctctgatggagggcaccccccagatcagttcggaggaatcctacaaacacgaaggattggccgaaacaccggagacatcacccgagtccttatctttctctcctaagaaatcagaggagcagaccggggagactaaggaatctactaaaactgaaaccacgaccgagatccgctctgagaaagagcaccccacgactaaggatatcacaggcgggagtgaggaacgaggcgccaccgtgaccgaggactccgagacttctacagaatccttccagaaggaggccactctcgggtcccctaaggatacatcacctaagagacaggacgattgcactggcagctgctcagtggctcttgcgaaggagactcctactgggctgaccgaagaggccgcctgtgacgaggggcagcggacctttgggtctagcgctcataaaacccagacggactcagaggttcaggaatccacagcgacatccgacgaaacaaaagcattaccactgcccgaggccagcgtgaaaacagataccggaacggagagtaagccacaaggggtaattagaagcccccaagggcttgagctggctctgccttctcgtgacagcgaagtcttgtctgcagtggccgatgatagtctcgccgtgagccacaaagatagtttagaggcttctcctgtgctggaggataacagctcccacaaaactcccgatagtttggaaccgagtccacttaaggagagcccctgtagggactcgttggaatcttcccctgtggaaccgaagatgaaagccggcatctttcccagccactttccactgcctgcagcggtggctaagactgaactgctgactgaggtcgcaagcgtccgctccagattgttacgagaccccgatggctcggccgaggacgatagtcttgaacagactagcctgatggaaagttccggcaaatctccactttccccggatacaccttcatccgaagaagtctcatatgaagtgacccctaagaccaccgacgtgtcaactccaaaacccgccgtcatacatgaatgcgcagaggaagacgattcggagaacggagagaaaaaaagatttacccccgaggaggagatgtttaagatggtcacaaagatcaagatgttcgacgagctcgagcaggaggccaagcagaaacgggattacaagaaggaacccaaacaagaggagagtagttctagcagtgacccagacgccgattgttctgtggatgtggacgagcctaaacataccggcagcggagaggatgaatccggagtgcctgtgctggttacttcagagtcacgaaaagtgagcagctcttccgaaagtgagccagagttggcacagcttaagaagggcgccgatagcggactgctgcctgagcctgtgataagagtccagcctccctcccctctcccctcttccatggactccaactcgagtcctgaggaagtacagtttcaacctgttgtctctaaacagtatacattcaagatgaatgaggatactcaggaagagcctggtaaaagcgaggaggagaaagattcagagtcccacctggccgaagatagacacgcagtaagcaccgaagccgaagataggtcatacgataaactgaacagagacacggaccagccaaaaatctgcgatgggcatggttgtgaagccatgagcccaagttcttctgccgctccggtttcttccggactccagtctcccaccggggatgatgtggacgagcagcctgtgatttataaggagagtctcgccctgcaggggacccacgagaaagacacggagggggaggagctcgacgttagtagggcagagagtccccaagctgactgtccatccgaaagtttctcaagttccagcagtctgccacattgccttgtgagcgaaggaaaggaattggacgaggacatttccgccacatccagcatacagaaaacagaagtcactaaaaccgacgagacctttgaaaacttacctaaggactgcccttctcaagatagttccattacgacccagaccgatcgcttcagtatggacgtgcccgtaagcgatctcgccgagaatgacgagatctatgatcctcagattacctctccatacgagaacgtgccttcccagtcttttttttcttctgaggagagcaaaacacagaccgatgcaaaccacacgacatcttttcacagcagcgaggtgtactctgttacaatcacgagtccagtcgaggacgtcgtggtggcctcaagctcttccggcacggttctgtccaaagaaagcaacttcgaaggccaggatatcaagatggagtcccagcaggagtcaaccctatgggagatgcagagtgatagcgtgtcgtcctccttcgagccaacaatgtctgccactacgacagtggtcggggagcaaatttcgaaggtcattatcaccaagacagacgtggattctgactcatggtctgagattcgggaggatgacgaagcctttgaggcccgtgttaaggaggaggagcagaagatcttcggtctgatggtcgatcggcagtcacagggaacaacaccagatacaacaccagcacgcacaccaacagaggagggcacccccacgtccgagcagaacccctttctcttccaagaaggaaagctctttgagatgacacgatcaggggctattgacatgactaagagaagctatgctgacgaatcatttcatttttttcagatcggacaggaaagcagggaagagactctctcagaagatgtcaaagagggagcaaccggcgcggacccgctaccactggagacctcagccgaatcacttgccctgtccgaatcaaaggaaacggtggacgatgaagccgacctgctgcccgacgatgtaagtgaggaagtagaagagatcccagcttcagacgcacagcttaattctcagatgggaatctcagcctccacggaaactccaacaaaggaggctgtcagcgtcggcacaaaggacctgccaaccgttcagacaggagatatacctcctttgagcggggtaaagcagatctcctgtcctgacagctcagaacccgccgtgcaagtgcagttggacttcagtacattgacaagaagtgtgtattccgacagaggagatgacagtccggactctagtcccgaagagcaaaaatctgtgatcgagatcccaaccgctcctatggagaacgtgccctttacagaaagtaagtcaaagattccagtgagaaccatgcctacttctaccccggccccaccaagtgctgaatacgaaagttctgtctccgaggacttcctttcaagcgtggacgaagaaaataaggctgacgaggccaaaccaaaaagcaaactaccagtaaaggtacccctccagagagttgaacaacagttatccgacttagacacatcagtgcaaaagacagtggccccgcaaggtcaagatatggcctccatcgcacccgataataggtctaagagtgagtcggacgctagctctttggattcaaaaacaaagtgtcccgtgaagactaggtcctatacagagacagagaccgagtcccgagagagggccgaagaattggagttggagtccgaggaaggtgccaccaggccaaagatactcacatcaaggctgcccgtcaagtcaagatctaccacttcttcttgtcggggcggaacaagccctactaaagagagtaaagaacatttcttcgatctctatagaaactcaatcgagttttttgaggagatttcagacgaggccagtaagctcgtggacagactcacgcagtcagagagggaacaggagatcgtcagtgatgatgaatcctcatctgctctcgaggtttcggtgatcgagaatctcccgcccgtagagaccgaacactctgtcccagaggatattttcgatacacgacctatttgggacgagagcattgagactctgatcgaaaggatcccagatgaaaatggccatgatcatgccgaagatccacaggatgagcaagagaggatcgaagagagactggcatacatcgccgatcacctgggtttcagttggaccgagctggctagagaactcgacttcacagaggaacaaatacatcaaattagaatagagaaccctaattccctgcaggatcagtcccacgccctactgaaatactggctggagagagacggcaaacatgctaccgacacgaatctggttgaatgcttgaccaaaatcaacagaatggacatagtacatctgatggaaactaataccgaaccactccaagagcgaataagccactcttatgctgagattgagcaaactattacactggatcacagtgagggtttttcagtgctgcaagaagagctctgtacagctcaacataagcagaaagaggaacaggctgtgtccaaggagagcgaaacgtgcgatcacccccctatcgtcagcgaagaagatatctcggtagggtatagcaccttccaagacggcgttcccaagaccgaaggggattcttctgcaactgctcttttcccacagacacacaaggagcaggtccagcaggacttctccggaaaaatgcaggacctcccagaagaatcttctttggaatatcagcaggagtactttgtaacaacccccggcacggaaacctcagagacacagaaagccatgattgtcccaagctcaccatcaaagactccggaagaagtgtctacccctgccgaagaggaaaaattgtacctgcaaacccccacctcatctgagaggggcggcagccccattatccaggagcccgaggaacctagcgagcaccgagaggaaagttcacctagaaaaacgagcctggttatcgtggaaagcgcagataaccaacccgagacttgtgagagactggatgaggacgccgcttttgagaaaggtgacgacatgccagaaatcccaccggagactgtcacagaggaggaatacatagacgaacacggccacactgttgtgaagaaagtgacccgaaagatcattagaaggtacgtcagctcagaaggtaccgagaaggaggaaattatggtgcagggcatgccacaagaacctgtcaatattgaggagggggatggttacagtaaagtcatcaagagagtcgtgttgaagtctgataccgaacagagtgaggataacaatgagtag

SEQ ID NO: 179010 - DNA, 5592 bp, Artificial Sequence
  Description of Artificial Sequence: Synthetic coding sequence
atgagccaccacatccagcggagcgacagcaacgccagcttcctgagggctgcgcgggccggcaacctcgataaagtggtggagtacctcaaaggggggatcgacatcaacacatgcaatcagaacggcttgaacgccctgcacctagcagccaaagaaggccacgtgggcctcgttcaagaactgcttggaagggggtcatcagtggatagcgcaactaagaaaggcaataccgcactacacatagcatcgctggcaggacaggccgaggtagttaaggtgctggtgaaggaaggtgccaacatcaacgcgcagtcccaaaatggtttcacgccgctttatatggccgcccaggagaaccacatcgatgtggtgaagtaccttctggagaacggggcgaatcagagcacagcaaccgaggatgggtttactcccctcgcggtggccctacagcagggccacaatcaggctgttgccatcctgcttgagaacgataccaagggcaaggtgcgcttgccggccttgcacatagcagccagaaaggatgacacaaagtctgcagccttgctactgcagaatgaccacaatgcagatgtgcagtctaaaatgatggtcaaccgcactaccgaaagtggattcacacctctgcatatcgcggcccattacgggaacgtgaacgtcgcaacactgctgctgaaccgtggggccgcagttgatttcactgccagaaacgggattactcccctgcatgtcgctagtaagagggggaacacaaatatggtaaagttgctgctggatagaggtggccaaatcgacgcaaagacccgcgatggtctcaccccccttcattgtgcagccagatcaggacatgaccaggtagttgaattgctcctggagagaggagcaccacttttggcccggaccaagaacgggctgtcccccctgcacatggccgcccagggcgaccacgtggaatgcgtgaaacatctcttgcagcacaaagctcccgtggacgatgtcacacttgattatctgactgctttacacgtggcagctcactgtggacattatcgggttacgaaactgcttctggacaagcgcgccaacccaaatgcaagagcccttaatggctttaccccactccatatcgcctgcaagaagaacaggatcaaagtgatggagctgttagtgaagtatggggcttccatacaggcgattactgaatccgggcttacccccatccacgtcgctgccttcatgggtcatctgaacatcgtactgctgttgctccaaaatggcgcctcccctgacgtgactaatatccgtggggagaccgctcttcatatggccgctagggccggacaggtggaagtggtgaggtgcctgctgcggaatggggccctggtggatgctagggccagagaagagcagacaccactgcacattgccagcagactgggtaaaacagaaattgtccaattactgctgcagcacatggcccaccccgatgccgccacgacgaacggatacaccccgctccacatttccgctcgtgagggacaggtcgacgtggcctcggtgctcttggaggcaggggctgctcactcgctcgccaccaaaaagggctttacccctctgcatgtcgcggccaaatacggctcactggatgttgccaagcttctgctccagaggcgcgctgccgccgacagcgctggcaagaatgggctcacccctctccatgttgccgcccattacgacaaccaaaaagtggcgctgttgcttctggagaagggcgcttcaccacacgccacagcaaagaatgggtacactcccttacatattgctgcaaaaaagaaccagatgcagatcgcatctacgcttctaaattacggcgctgagaccaatatcgtgaccaagcaaggggtcactcccctacatctcgcgagccaagagggtcataccgatatggtcacacttcttttagataagggggccaatatacacatgagcacgaagagtgggctgacttccctgcacctggcagcacaagaggacaaagttaatgtggccgacatccttacaaagcacggggctgaccaggatgcccacaccaagctaggttacacgccactcatagtcgcatgtcactacgggaatgtaaagatggtaaactttctgctgaagcaaggagccaacgtgaatgccaagacaaagaatggttatacgcctctgcaccaggcggcccaacagggacatacccatattattaacgtactgctccagcacggagcgaagccaaacgccaccacggccaacggcaataccgccttggccattgctaagcgacttggctacatctccgtcgttgacacgttaaaagtggtcaccgaagaggtgacgacaactactacaactatcaccgaaaaacataaactgaatgtcccggagacaatgacggaggtcctggacgtctcagacgaagagggcgacgatacaatgaccggggacggcggggagtatctgcggcctgaggacctcaaagaactgggcgacgattcgctgccatccagtcagttcctcgacggtatgaattacctgcgctatagcctggaaggcggcaggtcagatagcctgcggagcttctcatcagataggtcgcataccctgtctcacgcttcatacttacgagacagtgcagtgatggatgattcggtggtaattcccagtcatcaagtcagcacactcgcaaaggaggcagagaggaactcataccgtttgagttggggcactgagaacctggataacgtggctctgtctagcagccctatacattccggacgggctagcccttgcctcgagcgcgacaactcatcattcctagtttcctttatggtggacgccagaggcggagctatgcgggggtgtaggcacaacggcctgaggattatcataccaccccggaaatgtaccgcacccacacgagtgacatgcagacttgtcaagaggcaccgcctggcaacaatgccaccgatggtggagggagagggccttgcttctcgtcttatcgaggttggcccctctggtgcacagttcttgggaaagctccacctccctactgcgcccccacctctcaacgagggagaatcacttgtgagtaggatcttacagctgggaccccccggtaccaaattcctggggcctgttatcgtcgagatcccgcactttgcggcccttagaggcaaggagcgggagttagtggtgctccgatccgagaacggggacagctggaaagaacatttttgtgattatacagaagacgaattaaatgaaattttgaatgggatggatgaggtgctggattcgcctgaagatctggagaaaaaacgaatctgcagaatcatcacccgggacttccctcaatatttcgctgtggtgagtcgcatcaagcaagattcgaacctgattgggcccgaggggggagtgttatcctcgaccgtggttccccaggttcaggctgtgttccccgagggggcccttaccaaaagaatcagagttggacttcaggcgcaacccatgcattccgaattggtgaaaaagatccttgggaataaggctacgttctcccctattgtgacgctggagccaagacgaagaaaatttcataaacccattacgatgaccatccccgtccctaaggcctcatccgacgttatgctgaacgggttcgggggcgacgctcccacactacgtctgttgtgtagcataacaggcggaaccacccctgcacaatgggaggatattactggaacaacccctctgacgtttgttaacgaatgcgtgagctttaccaccaatgtcagtgcccggttctggttgattgactgccggcagattcaagaaagtgtcacattcgcgtcccaggtctacagagagatcatctgcgtgccctacatggccaaattcgtcgtgtttgccaaaagccacgaccctattgaagctcggcttcggtgcttctgtatgaccgacgataaagtggataagacccttgaacaacaggagaactttgcagaagtggcacgcagcagagacgtcgaggtactggagggaaaacctatttacgtagattgtttcggtaatctcgttccattaacaaagtccggacagcaccacatcttttctttctttgcatttaaggagaatcgccttcccctgttcgtcaaggtgcgtgatacaactcaggagccgtgtggccgcttatcttttatgaaggagcctaaatctactaggggcctggtgcaccaggcgatctgcaatctgaacatcaccctaccaatctacaccaaggaatcggaatcagaccaggaacaggaggaagaaattgggcaggaatcccgaaggtatccgcaggatgagcaggagcgtatcgaggaacggttagcatacatcgcggaccacttaggctttagctggactgagctcgccagagaattggactttacagaggaacagatccatcaaatccggatcgagaatcctaatagcctccaggatcagtcccacgcacttcttaagtactggctggagcgggacggcaaacatgccacagacactaacctcgtggagtgccttacgaagataaatcgtatggacatcgtccacctgatggagaccaatactgaacccctacaggagcgcataagtcattcttatgcagagatcgagcagacgataacactggaccattcagagggtttctccgtgctgcaagaggagctgtgtacagcccagcacaagcaaaaggaggaacaggctgtctctaaggagtccgagacctgcgaccacccacccatagtgtccgaggaggacatatcagtgggatatagcacattccaagatggagttccgaaaaccgaaggggattcaagtgcaactgccctctttcctcagactcataaggagcaggtgcagcaagattttagcgggaaaatgcaggacctgccggaggaatcctcattggaataccagcaggagtacttcgttacaacccctggtaccgagacctctgagacccaaaaggccatgatagtacctagcagtcccagcaaaaccccagaagaagtctccactccggctgaggaggaaaagctgtatctgcagacaccaacctcaagcgagcggggtggctcccctatcatccaggagccagaagaaccctccgaacacagagaggaatcaagcccacgcaaaacatcactggtgattgtggaatccgccgataaccagcctgagacatgtgaaaggcttgacgaggatgcagcattcgagaaaggcgacgacatgccggagattccccctgaaaccgtcaccgaagaggagtatattgacgagcatggtcataccgtggtcaaaaaggtcacacggaaaatcattaggcgctatgtcagttcagaggggacagagaaggaggagatcatggttcaaggaatgcctcaggaaccagtgaatattgaggaaggagacgggtattccaaagtgattaagagggtcgttcttaagtctgacaccgagcaaagcgaggactctatggagtag

SEQ ID NO: 179011 - DNA, 11874 bp, Artificial Sequence
  Description of Artificial Sequence: Synthetic coding sequence
atgatgaacgaggacgccgcccagaagagcgacagcggcgagaagtttaacggcagctcccaaagacgcaaacgacccaagaaaagcgactccaacgcatctttcctgcgggccgcccgggcagggaacctcgacaaggtggtcgaatacctgaagggaggaattgacatcaatacatgcaaccaaaacggcttgaatgcccttcatctggccgcgaaagaaggtcacgttggcctggtgcaagagctccttggcaggggctcaagcgtggactctgctacaaaaaaaggcaacaccgccctccatatcgcgagcctcgccggacaggcggaggttgtgaaagttctggtgaaagaaggagccaacatcaatgcgcagtcacaaaatggctttacccctctttacatggctgctcaagagaaccatattgacgtggttaagtaccttttggaaaacggggccaatcagtcaacagctacagaggacggcttcacaccgcttgccgtggcgctgcagcagggacataatcaggctgtagccatcctgctagagaatgacaccaagggtaaggttcgtctaccagccctgcacatagctgcacggaaggatgatacaaaaagcgctgccttgcttcttcagaacgatcataacgcggacgtgcagtcaaagatgatggttaatagaaccacagagtctggatttacgcctctgcacattgctgctcactatggaaatgtcaatgttgcaacactactacttaacagaggcgctgccgtggactttacagctaggaatggcattacacctcttcacgttgctagtaaacgcggtaataccaacatggtgaagctcctgctggaccgcggtgggcagattgacgcaaagacgagggacggacttacacccctgcactgtgctgctcgctcaggccacgaccaggttgtggaactcctgttggagagaggcgctccactactggcaagaacgaagaacggcctgagcccgttgcacatggctgcccagggggaccacgtggagtgtgttaagcacctgctgcaacacaaggcccctgtagacgatgtcactctggattacttgacagcccttcatgtggccgcccattgtggacactatcgggtaaccaaactgctcttagataaaagagccaatcccaacgcccgtgcactgaatggctttacccccctgcacattgcctgcaaaaaaaatagaatcaaggtgatggaactgctcgttaaatacggagcctccattcaggcaatcactgagtccggtctcacccctatccacgtcgccgcattcatgggccatctgaacatcgtcttactccttctgcaaaatggagcgtcgcctgatgttactaatattcggggagaaactgcacttcatatggctgccagagctggccaagtggaggtggtccgctgcctgctgcgcaacggggcactggtggatgcccgggctcgggaagagcagacacctctgcacatagcgtcgcgtttgggaaagactgaaattgtgcagctgctcctgcagcacatggctcacccagacgctgcgacaacgaacgggtacaccccccttcacatttcagcccgtgaaggacaggttgacgtcgcctcagtcttgctcgaggctggagccgcccatagcttggcgacaaaaaaagggttcaccccactacatgtggcggccaagtacggctccttggacgtagcaaagcttctgttacagcgcagagccgccgccgacagcgctggaaaaaatggtctcacacccctgcatgtcgctgcacactacgataatcagaaagtggctctgctacttttagagaaaggcgcttcccctcatgctacagccaagaacggctacaccccgctgcacatcgccgcgaagaagaatcagatgcagattgccagcacactgctcaattacggggctgagacgaatattgtgactaaacagggcgtgacacccctgcatctcgcgtcccaggaagggcacaccgatatggttacactgctactcgataagggagctaacatacatatgagcacaaaatctggtctcacatctttgcatctggctgctcaagaggacaaggttaatgtggcagacatactgaccaaacacggcgccgaccaggatgctcacacaaagctcgggtatacccctttaattgtggcctgccactacggaaacgtcaagatggtgaactttctactgaaacagggagccaacgtcaacgccaaaaccaaaaatggatacacacccctgcaccaggccgcgcagcagggccacactcacattatcaatgttttgttgcagcatggggcgaaacccaatgcgacaacggcaaatggtaacactgcgctggctattgccaagcgccttggttacatctccgtggtggacaccctgaaggtagtcaccgaggaggtaaccaccactacgacaaccattacggagaaacacaagctgaatgtgcctgaaaccatgactgaggttttggacgtctcggacgaggagggcgatgacaccatgactggcgatggcggggaatatctgagacccgaagatctaaaggagttaggggatgactcgctgccaagctctcaattcctggatggcatgaactatcttagatacagcttggaaggcggccggagcgatagcttgcggagctttagctctgaccgcagccacacacttagtcatgctagctatctgcgcgattcagccgtgatggacgactccgtcgtgatcccttcgcatcaggtttcgacgctggcgaaagaagcagagcgcaacagctacagactgtcttggggaacagagaatctcgacaatgtggccttgtcaagttccccgattcactccggatttctcgtctctttcatggtggatgccagaggcggcgccatgcggggctgtaggcataacggtcttcgtatcattatcccacctaggaagtgcacggctcctactcgggtgacttgcaggttagtgaaacggcataggctggccacaatgcccccgatggtggagggtgagggccttgctagcaggctcatcgaggtgggcccttctggcgcacagtttctcggaaagctccatcttcccactgcaccaccccctctgaatgagggggagtccttggtctcccgtattctgcagttaggcccccccggaacaaagtttctggggccggtgatcgttgagatccctcattttgctgcacttagggggaaagaacgcgagctggtggtactgaggtcggaaaacggcgactcttggaaggagcacttctgtgactacacagaggatgagctgaacgaaatcctgaacggcatggacgaggtcttggatagtccggaggacctcgagaagaagaggatttgtcggattatcacacgcgatttccctcagtatttcgccgtggtcagccgaatcaaacaagatagcaatcttattggccctgagggaggagtgctgtctagcaccgttgtacctcaggtccaggctgtgttcccagaaggcgccttgactaagagaatcagagtgggattacaggcccagcccatgcactcagagctagtgaaaaagattctgggaaataaagctacctttagtcccatcgttaccctggagccacgccgaagaaagttccacaagccgattaccatgactatacccgtgcccaaagcgagttccgatgtgatgttgaacggttttggaggagatgcccccaccctgagacttctgtgctccattaccggagggaccaccccggctcagtgggaggacattacgggcactactccgctcacttttgtgaacgaatgcgtaagctttaccaccaacgtttccgcacggttttggctcatcgactgtcgacaaattcaggagtccgtgacttttgcaagccaggtgtatagagaaattatctgcgtgccatatatggccaagttcgtcgtgttcgctaagtcgcatgacccgatagaagcgaggttgaggtgtttttgcatgactgatgacaaagtggacaagactctcgagcagcaggaaaatttcgccgaagtagcgagatccagggacgtggaggtgttggaaggtaaacctatctacgtggattgcttcgggaatttagtgccgttaactaagtcaggacagcaccatattttcagcttctttgcctttaaggagaatcgccttcccctgtttgtgaaagtacgggacacaacacaggaaccctgtgggagactgtcattcatgaaagagcccaaaagtacaaggggacttgtacatcaagcaatttgcaacctgaatataacgctgccaatctacaccaaagaatcagaatccgatcaggagcaggaagaggaaatcgacatgaccagtgagaagaacgacgaaacggaatctacagaaacctcagtgttaaagagccatctggtcaacgaagtgcccgtgctcgcatctccggacttgctctctgaagtgtctgagatgaagcaggatttaatcaaaatgaccgccattttaactacagacgtatctgacaaagccggaagtataaaggtcaaggagctggtgaaagccgccgaagaggaaccgggggaaccattcgagatagtcgaacgggtgaaagaggatctggagaaggtcaacgaaatactgagaagcgggacctgcactagagatgaaagctccgtgcagagttcgagatcagaacggggtctggtggaagaggaatgggttatagtgagcgacgaggagatcgaagaggcgagacagaaagctccattagagatcactgagtatccatgcgttgaggttcgaattgacaaagaaatcaaagggaaagtggagaaggactccaccggcttagtaaattatctaacagacgatctgaacacctgtgtgcctcttcctaaagagcagttgcagaccgtgcaggacaaagctggcaaaaagtgcgaggccctggcagtcggaagatcatcagagaaagagggaaaagatataccccccgatgagacacaaagcacacagaagcaacataaaccatctctcggaattaaaaagcccgtccggaggaaactgaaagaaaagcagaagcagaaggaagagggcctgcaggcctcggctgagaaggccgagctaaaaaagggatctagtgaggaatccctaggcgaggaccccggcctggcacccgaaccattacccactgttaaagccactagccctctgattgaggagacccctatagggtccattaaagacaaagtgaaggctctgcagaaacgtgtggaagacgagcagaagggacggagtaaattgcctatacgggtgaagggcaaagaggatgtgcctaaaaagacgacacacagaccacatcccgctgcaagtccctccctgaagtcagaacgccacgccccaggtagtccctcccccaagaccgaacgccatagcaccctgtccagttccgccaagacagaaagacacccaccagtctccccctcttcgaagactgaaaaacacagtccagtatcgccttcagccaagacagaaaggcactcaccagcttcttcttcctctaaaaccgaaaaacactctcctgtttccccaagtacaaagacagaaagacacagcccggtttcctcaaccaaaacagagcgccaccccccggtcagtccaagcggcaaaaccgataagaggcctcctgtcagcccctccgggcgaaccgagaagcaccctcctgtcagccccggacgcacagagaagcggctcccagtcagcccttctggaagaacagacaagcaccagcctgtctcaaccgcaggaaaaaccgaaaaacatcttcccgtgtcaccttcaggaaaaaccgagaagcagccccctgtatccccaaccagcaagacagagaggattgaggaaaccatgtctgtgagagagttaatgaaggcattccagtccggccaggatccctccaagcataaaactggcctctttgagcataagagcgccaaacagaaacagccacaagagaagggcaaggttagggtagagaaagagaaaggccccatattaacgcagagggaagctcagaagaccgagaatcaaacaattaaaaggggccagaggctgcctgtgaccggcacagctgagagcaaaaggggcgtcagagtgtcctccattggcgtgaaaaaagaggatgcagctggcggcaaggagaaagtgttgtcccataagattcctgaacctgtacaatctgtacctgaagaggagtcccaccgagaatccgaggtgccgaaagagaagatggccgacgagcagggtgacatggatctacaaatcagccctgaccggaaaacctctaccgatttcagcgaagtaataaagcaggagctggaggacaatgataaataccaacaattccggttgtcagaagagaccgagaaagcgcagttgcatctggaccaggtgttgaccagcccttttaacacaacttttccgttggattacatgaaagatgaatttttgcctgccctgtctctgcagtcgggggccctggacggctcttccgagtcactcaaaaatgagggcgtagctggaagtccctgcggcagcctgatggagggaaccccacagatttcctccgaggagtcttataaacacgaggggctggccgagacccccgagacaagccccgagtccctctctttttcgcctaagaagtcagaggagcagactggcgagacaaaggagtctactaaaacagaaactacgaccgaaataagatctgagaaagaacaccctacgacaaaagatattacaggggggagcgaagaaagaggcgccaccgtgacagaagactccgaaacgtccacggaatcgtttcagaaagaggctacgctgggcagtccaaaagacacctctcccaagcgtcaagacgattgcacagggtcctgttccgtggccctcgcaaaggagacgcccaccgggcttaccgaggaagccgcttgcgacgagggacaaagaacttttgggagctctgcccacaagactcagacagattcagaggttcaggagtctacagcaacgtcagatgagacaaaggctttacctttgcccgaggccagtgtgaagacggacaccggcacagagagcaagccacagggagtgatccgctctccgcaggggttagagctggctttacccagtcgcgactctgaagtgctgtcagccgtggcagacgattctttggcggttagccacaaagactctctggaggcctcacccgttctagaggataatagtagccacaagacaccagattcattggagcccagtcccctgaaggaatccccatgccgagatagtctggaatctagccctgtggaaccaaaaatgaaggccggcatcttccccagtcacttccctttacccgcagccgttgccaaaactgaactattaaccgaagtggcctccgtccgcagtcggttactgagggatcctgacggctctgcagaagacgatagtctggagcagaccagcttgatggagagctcggggaaaagtcccctgtctccggatacaccctcttccgaagaagtctcatacgaggtaacacccaaaaccacagacgtttcgacgcctaaacctgccgtaattcacgagtgcgccgaagaggacgactccgaaaacggggaaaagaagcgattcacaccagaggaagaaatgttcaagatggtcacgaagattaaaatgttcgatgaactggaacaagaggctaaacaaaagagggattataagaaagagcccaaacaggaggaaagtagctcaagtagtgaccccgacgccgattgttctgtagacgtggacgagcccaaacatacggggtccggggaagatgaatctggcgtccctgtgctggtgacttctgaatctagaaaggtgagctcctcatctgagtcggagcccgagctggctcagctaaaaaagggggcagattcggggctgctgcccgagcctgtgatccgcgtccagccacccagtccactgccgagcagcatggatagtaattcttctccagaagaggtgcaatttcagccggtggtaagcaaacagtacacttttaagatgaacgaagatacccaagaagagcctgggaaaagtgaggaggaaaaagatagtgagtcccatttggccgaagatcgtcatgcggtttctacagaggccgaggaccgtagctatgataagctgaacagagatactgatcagcctaagatttgcgatggtcatggctgtgaggcgatgagcccctccagcagcgccgcccctgtgtcctcaggccttcagtcaccaacgggagatgatgtggacgaacagcctgtaatatataaggaatctttggccctgcaagggacccacgaaaaggacacagagggagaagagctggacgtaagtcgtgcagaatcacctcaggctgactgtccttctgagtctttctcatctagctcttccctccctcattgcttagtctcagagggaaaggagcttgatgaagatattagcgcgaccagtagcattcagaagacagaagttacaaagaccgatgagacatttgagaatctgccaaaagattgcccctcccaggactcctccattacaacccagaccgatcggttctccatggatgtacccgtttcagatctcgctgaaaacgacgaaatctacgatccccagatcacttcgccatacgagaacgtcccaagccagtcgttcttctcgtccgaggaatccaagacccagaccgatgctaatcacactacatctttccactcctctgaagtctattctgtgactatcacaagcccagtggaagacgtggtggtggcaagcagttcttccggcactgtgctatcaaaagaatcaaatttcgagggtcaggacatcaagatggaaagtcagcaagaaagtactctgtgggagatgcagtccgatagcgtgtcctcaagctttgagcccactatgagtgctacaactaccgttgtaggggagcaaatcagtaaggttattattacaaaaaccgacgtggactcagatagctggtctgaaatacgcgaggacgatgaggccttcgaggccagggtcaaagaagaagagcaaaagatatttgggcttatggtggataggcagagtcagggcactactccggacacaaccccagctcggacaccaacagaagaagggacgccaacaagcgaacagaatccgtttctgttccaggaaggcaaactgttcgagatgacacggtctggcgccatcgatatgacaaagcgtagctacgccgacgaaagcttccatttctttcagatcggccaggagtcacgcgaggagaccctctccgaagacgtgaaagagggcgctaccggagcagaccccttgccgctggaaacctctgccgagtccctggcactgagtgagagcaaagagaccgtggatgacgaagcagatctgctgcctgatgacgtttctgaagaagtcgaggaaattccagcttcagacgcacagctgaactctcagatgggcatatctgccagtaccgaaactccgacaaaagaggcagtaagcgtgggcactaaagacctgcccactgtccagaccggcgacattccacccctctccggggtgaagcagatctcttgtcctgatagctccgagcctgcagtgcaggtgcagctcgacttttctacgcttaccaggtcagtctacagtgatcgcggcgatgactccccagattcttcccctgaggaacagaagtccgtaatcgaaatcccgacggctcctatggagaacgtacccttcactgaaagtaagagcaagattccagtcagaactatgcctacatcaacgcccgcacctccttccgcagaatatgaatccagtgtgtcagaggactttctgtctagcgtcgatgaggagaacaaagcagatgaggcgaaacctaagtcaaaattgcccgttaaagtccccctacaacgcgttgaacagcagctatcagacctagacacatcagtccagaagactgtcgccccccaaggacaggacatggcctccatcgcaccagacaacagatcaaagagcgaaagcgatgcaagtagccttgactcaaagaccaagtgtcccgtgaagacacgatcctatacagaaaccgagacagagtcaagggagcgcgcagaagaactggagctcgagtctgaagagggcgcaacaaggcccaagattctcacctccagattacctgttaagtcaaggagtaccacatcgtcctgcaggggagggacatcgcccaccaaggaaagcaaggagcatttctttgatctttatcgcaattcaattgaattttttgaggagatttccgacgaagccagtaagctggttgaccgactcactcagtccgagcgggaacaggaaattgtttctgatgacgaaagttctagtgcgctggaagtgtcagtgattgagaacctgcctcctgttgaaactgaacattctgtgcctgaagatatcttcgacacgcgaccgatttgggacgaaagtatcgagaccctcatcgaacgtatcccggatgagaacggccatgatcatgctgaggatcctcaggacgagcaagagaggatcgaggaaaggctcgcttatattgccgatcatttgggcttctcgtggacagagttagcccgggaactcgacttcacagaagaacaaatccatcagatcaggatagagaatcccaactctctccaggaccagtcgcatgcccttctcaagtactggctggagagagatggtaagcatgccacagacaccaacctggtggagtgcttgacaaagatcaatagaatggatatcgtacatctgatggagacgaacaccgaacccctacaggaaagaatctctcattcatatgccgaaatagaacagaccatcaccttggaccacagcgaaggttttagcgtcctgcaggaagaactttgtacagcccagcacaaacaaaaggaggaacaagcggtgtcaaaggagagcgaaacctgtgaccacccacccattgtctccgaggaagatatctcggtgggttatagcacttttcaagacggggttcccaagaccgaaggagatagttctgcaacagctctgttcccccagacccacaaagaacaggtccagcaggacttcagtggcaagatgcaagacctcccggaagaaagcagcttggaatatcagcaggaatactttgtaactacaccaggtaccgaaacctccgagacccaaaaagcaatgattgtgccctcctctccatcaaagacccctgaggaagtgagcacccccgcagaggaagaaaagttgtacctgcagactcccacttcttccgaacggggcgggtcacctatcattcaggaaccagaggagcctagcgaacaccgagaggagagctcccctaggaagaccagcctggttattgtagaatcagctgacaatcaaccagaaacatgtgagagactagatgaggacgcagctttcgaaaagggagatgatatgcctgagatacctcctgaaaccgttaccgaagaagagtatattgatgagcatggccataccgtcgtgaagaaggtgaccaggaaaatcatcaggcgttacgtttctagcgagggcactgaaaaggaggaaattatggtccagggtatgccacaagagcctgtgaatattgaggagggggacgggtatagtaaagtaattaagcgggtggtcctgaaaagtgacacagaacagagcgaggacaataatgagtag

SEQ ID NO: 179012 - DNA, 5619 bp, Artificial Sequence
  Description of Artificial Sequence: Synthetic coding sequence
atgatgaacgaggacgccgcccagaagagcgacagcggcgagaagttcaatgggtcaagccaacgtcggaagaggcccaagaagagcgattccaatgcttcctttctcagggccgccagagccggcaacttggacaaggtggttgagtatctaaagggtggcatcgatattaatacatgcaaccaaaatggtttgaacgcccttcaccttgcagcaaaggaaggccatgtcggcctcgtgcaagaactgttgggaagggggagctcagtggactccgccacaaagaagggaaataccgctttgcacatcgcatctctcgccggacaggctgaagtggtcaaagttcttgtcaaagagggcgccaatattaacgcacaaagccaaaacggatttacacctctttacatggccgcccaagagaaccacatcgacgtggtgaagtaccttctcgagaatggtgctaatcagtcaacagccactgaggacggcttcacccccctcgctgtggcgttgcaacagggacataaccaagcagtggcaatactgttggaaaacgatacaaagggcaaggtgagactgcccgccttacatattgccgcgcggaaagacgacactaagtcagccgctctgcttctgcagaatgaccacaatgcggatgtccagagcaaaatgatggtgaacaggaccaccgaaagcgggtttacaccactacatatcgctgcgcactatggcaatgtcaacgtcgcaaccttgctcctaaaccggggcgcggccgtcgatttcactgcgcgcaatggaatcacccccctgcacgtggcaagcaaacgcggaaataccaacatggttaagctcctgctcgacaggggaggtcaaatcgacgctaagacacgcgatgggttaacaccattacactgtgcagcacggtccggccacgatcaagtggtggagctgctcttggagagaggtgctcccttattggcgcggaccaaaaatggtctcagtccattgcacatggccgcccagggcgaccatgtggagtgcgtcaaacacctcctgcagcataaagctccggtcgacgacgttaccctggactacctgaccgctctccacgttgcggcccactgcggccattatagggtaaccaaattactcctcgacaaaagagcgaatccaaacgcccgggctctcaatggcttcacacccctccatattgcctgcaagaagaatagaattaaggtgatggagttgcttgtgaagtacggagctagcatccaagccatcactgagtccggcctgaccccgattcacgttgccgctttcatggggcacctgaatatagtcctgctactacttcaaaatggggcctccccagacgttaccaacatcaggggcgagaccgccctgcacatggctgctcgcgcagggcaggtcgaggtcgtgagatgcctgctgaggaatggcgccctcgtcgatgcacgggcccgcgaggaacagactccccttcacattgcaagccggttaggcaagactgagatcgttcagctgctgttgcaacacatggcacatcccgatgccgctactacaaatgggtacactcccttgcacatctcggcacgagaagggcaggtggacgtggcatcagtcctgcttgaggccggggcagcacatagcctagcgacgaagaaaggatttactcctttgcatgtggcagcaaaatatggatctctggatgtcgctaaactgctgctgcaaaggagggcggccgccgactccgcgggtaagaatggtctgacacctctgcatgtggccgcacactatgacaaccaaaaggtggctttgctgctgctggaaaagggcgcttcaccgcatgcgaccgccaagaacggctacacacccttgcatattgctgccaagaaaaaccagatgcagatagccagtacactccttaactacggcgccgaaacaaatattgtgacgaagcagggtgtgaccccactgcatctcgcctcacaagaagggcacactgacatggttacactcctactggataagggcgctaacatccacatgtccacgaagagcgggctaaccagtctgcatctggctgcccaggaggacaaagtcaatgtggcagatatcctgactaagcacggcgccgaccaggatgcccacacaaaactgggctatacacctctaatcgtggcatgccactacggcaacgtgaagatggtgaatttcttacttaaacagggggccaatgttaatgccaaaacaaagaatggctacaccccactgcaccaggctgcacaacaaggtcatacgcacattatcaatgtactattacaacacggagctaaacctaacgccaccacagctaatgggaacacagctctggctatcgcgaagagactgggctatatctcagtggttgacaccctcaaggtcgtgactgaagaggtcacgacgacaactactacgatcacagaaaaacacaaacttaatgtacccgaaaccatgacagaggtccttgatgtctccgatgaagagggcgacgatacaatgactggggatgggggggagtacctccggcccgaagacctcaaagaattaggcgacgactctctgcccagctcgcaattcctggatgggatgaactatctgaggtacagtctagaaggtgggaggagtgacagcctgcgatcattcagttcagatagaagccacactctttcccacgcttcctacctgcgagactccgccgtgatggacgattccgtggtcatcccttcccatcaggtgtctaccttagccaaggaggcagagagaaattcctatcggctttcttggggcaccgaaaatcttgacaatgttgctctctctagtagccccatccactccggattcctggtctcttttatggtggatgcaaggggcggggccatgcgtggctgccgccacaacggactccggattatcatacctcctcgcaagtgtacagccccgacccgggtcacttgccggttggttaagcgacatagacttgcaaccatgccaccaatggtagagggcgaagggctggcgtcccgtctcatcgaagtcggcccttcaggagcccaattcttagggaagctacacctccccaccgcgccgcccccgctgaacgagggcgaatctctcgtgtctaggatccttcagctggggcccccgggaaccaaatttctggggccagttatcgtggagatccctcacttcgctgctttgaggggaaaagaacgcgagctggttgtgctacgaagcgagaacggggactcatggaaagagcacttttgcgactatacagaggatgaattaaatgagattttgaatggaatggatgaagtgcttgactcaccggaggacctcgagaagaagcggatttgtcgaatcattaccagggactttcctcagtactttgccgtggtgagtaggattaagcaagactccaacctcatcggtcccgaaggtggtgtcttatctagcactgtggtgcctcaggtgcaggcagtgtttccggaaggcgctctgacgaagaggatcagagttgggctgcaggctcagccaatgcactccgagctggtgaagaaaattttagggaataaggcaacctttagtcccattgtgaccctggaacctagaagacgcaagtttcataaacctatcacgatgaccataccagtcccaaaggcatccagtgatgtaatgctaaacggtttcggaggcgatgcacccaccctccgactactatgttctatcacaggcgggaccactccagcacagtgggaagatatcaccggcaccaccccactgaccttcgtaaacgagtgtgtctcctttactactaacgtctcagccagattctggctgatcgactgccggcagattcaagagagtgtgacctttgcatctcaggtataccgcgaaataatctgcgtgccctatatggcaaaatttgtggtattcgctaagagtcatgatcccatcgaggcacggctgagatgtttctgcatgaccgacgacaaagtggacaagaccctagagcagcaagagaactttgccgaagtcgctcggagtcgggatgtcgaggtgctggagggaaagcctatttatgtggactgttttggcaatctggtccccctaaccaaatccggccagcatcatatattttccttcttcgcatttaaggagaacagactgcccctgtttgtgaaggtacgggatacgacccaagaaccatgtggacggttgtcttttatgaaggagcctaagagcactagaggattggtgcaccaagccatctgtaatctgaacattaccctaccaatttacaccaaagagagcgaaagtgaccaggagcaggaggaagagatcgacatgacgtccgaaaagaatccacaggatgaacaagaaaggatcgaagagagactagcctatattgccgatcacctggggtttagctggaccgaactcgcccgtgagctcgacttcacagaggagcagatccatcaaattcggattgaaaatcctaattctttgcaggatcagtcacatgccttgcttaaatactggctcgaacgggatggcaaacacgcaaccgatactaatttggtggaatgtctcacgaaaattaacaggatggatatcgtgcaccttatggaaactaatacagaaccactgcaggaacgaatcagtcatagctacgcagagattgaacagacaatcactctggaccactctgaagggttctcagttctgcaggaggaactgtgcaccgcgcagcacaaacagaaagaggagcaggccgtgtcaaaggaatcagaaacatgcgatcacccgccgattgtgagcgaggaggacataagcgttggttactccactttccaggacggcgtccccaagaccgagggcgatagctccgccacagccctctttccgcagacgcacaaggagcaggttcagcaggacttttccggaaagatgcaggacctgcctgaagagtcttcactggaatatcagcaggaatacttcgttaccaccccgggcactgagaccagcgagacacagaaagccatgattgtgcctagcagcccaagcaaaaccccagaggaggtgtccacacccgctgaagaggagaagctctacctgcaaaccccaacctcttcggaacgcggcggttccccaattatccaggagccagaggagccgtcggagcatagagaggaaagctctccgcgtaagacctccctggtcatcgttgagtcagccgacaatcagcccgaaacctgcgagcggctggacgaggacgccgcctttgagaagggcgatgacatgcccgaaatcccaccagagaccgtgaccgaggaagaatacatcgacgagcacggccacaccgtggtgaaaaaggtcacccgaaaaatcatccgacggtacgtcagctccgaaggcaccgagaaggaagagatcatggtccaggggatgcctcaggagcctgttaacattgaggaaggggatggctacagcaaagtgatcaaaagggtggtgttgaagtctgatacagagcaaagtgaagataataacgagtag

SEQ ID NO: 179013 - DNA, 2988 bp, Artificial Sequence
  Description of Artificial Sequence: Synthetic coding sequence
atggacgacagcgtggtgatccccagccaccaggtgagcaccctggccaaggaagccgagagaaattcgtacagactctcttgggggaccgagaatttagacaacgtggccctgtcatcaagccctatacattctggctttttggtgtccttcatggtggacgcccgggggggcgctatgcgtgggtgccggcacaacggcctgcggatcatcattcctccaaggaaatgcacggcgccgacgcgggtgacatgccggttggtgaaacgacacaggttggcgacgatgccccctatggtggaaggcgaagggttagcttcaagattgattgaggttggtcccagcggggcccagttcctcgggcccgtgattgtcgagatcccgcattttgccgcacttcgggggaaggagcgggaactcgtcgtgcttagaagcgagaacggggactcgtggaaggaacacttctgtgactatactgaagatgagcttaatgagatcttgaatggcatggatgaggttctggattctcctgaagatctggagaaaaagaggatttgcagaatcatcacacgggattttccacaatatttcgccgtagtgtctcgaatcaagcaggactctaaccttatcggtcccgagggcggggtgctctccagtacagtggtcccacaggttcaggccgtatttccggagggcgctcttacgaagagaattcgagtgggactgcaagcccagccaatgcattcagagctggttaagaaaatcctgggcaacaaggcaacattttcccctatcgtcaccctggagcctaggagaaggaagttccacaaacctattactatgacaattccggttccgaaagcctcaagcgacgttatgttaaacggcttcggcggggatgcaccgacgctccgtctgttatgctctatcaccggcggcaccacccccgcacagtgggaggacattacgggtactacccccctgaccttcgttaacgagtgcgtatccttcaccactaacgtaagcgcaaggttttggctgatcgactgtcgacagatccaggagtccgtgacattcgcttcacaggtgtatcgtgaaatcatctgcgtgccctacatggcaaagttcgtcgtgttcgctaagtctcacgacccaattgaagcccgcctgagatgcttctgtatgacagatgataaggttgataaaactctcgaacagcaggagaacttcgctgaagtggcccgatcgagggacgtcgaggtgctggaaggaaagcccatttatgtggactgctttggcaaccttgttcctcttaccaagtctgggcaacaccacatcttttcctttttcgcatttaaagagaacaggctcccactgtttgttaaggttcgagacactacccaggaaccctgcggaagactgtcattcatgaaggagcccaagtcaacaagggggttggtacatcaggctatttgcaacctcaacatcaccttgcccatctacaccaagacagaaactactaccgagatacatccacaggacgagcaggagcgaatagaggagcgacttgcttatatcgcggaccatctggggtttagctggacagagctggcccgagaactggactttactgaggaacagatccaccagatacgtattgagaaccccaactcacttcaagatcagagtcacgccctgctcaagtactggctggagagggatggaaagcatgcaacggacactaatctggttgagtgtctgaccaagataaatagaatggacatagtccatctcatggagacgaatacggagccactgcaggagcgaatctctcattcatacgcagaaatcgagcagactatcactctggatcattccgagggtttttccgtcctgcaggaggagctttgtacagcccaacataaacagaaagaggagcaggcggtcagcaaggaaagcgagacttgcgaccatcctcctattgtctctgaggaagacattagcgtcggatactctacttttcaggacggggtgcccaaaacagagggcgattctagtgctaccgctcttttcccgcagacccacaaagaacaggtgcagcaggatttctcagggaagatgcaagacttgcccgaggagtctagcctggagtaccagcaggaatattttgtcaccactcccggcactgaaacaagcgaaactcagaaggctatgatcgttccttcaagtcccagcaagacacctgaggaagtgtccacccctgcagaagaggaaaaactgtacctgcagacaccaaccagctctgagcggggggggtcacccatcattcaagagcccgaggaaccttccgaacatcgagaggaaagcagcccgaggaagacttccttggtcatcgtggaaagcgctgacaaccaaccagaaacatgcgagaggttggatgaggacgcagcgttcgagaaggagctcacggaagaacttggagaacttgaggcgtcctctgacgaggaagctatggtgaccaccagagtagtgcggaggagagtgattatccaaggggacgatatgcctgagatccccccagagaccgttacggaagaagagtatattgatgagcatgggcacaccgttgtgaaaaaggtgacccgcaaaattatccgtcgatacgtgtcgagcgagggcaccgagaaagaagaaattatggttcagggcatgccccaggaaccagtgaatatcgaggaaggagatggctactctaaggtgatcaaacgcgtagtactcaagagcgacacagagcagagcgaagttaccttgtgtgagcccagcattctctcttcgacctcccagttccaggccgagcctgtggaaggcagaagggtgagcaaagtggtgaagacaaccgtggtgctcggggagcgcatggaaaagcacttaggtgacagctcactcgctaccgatctgccttctgccaaagatgatttcgaggaatag

SEQ ID NO: 179014 - DNA, 3345 bp, Artificial Sequence
  Description of Artificial Sequence: Synthetic coding sequence
atgaccaccatgctgcagaagagcgacagcaacgccagcttcctgcgcgccgctagagccggtaatctagacaaagttgtagagtacctcaagggggggatagatattaacacatgcaatcagaatgggctgaacgctctgcacctcgctgcaaaggaggggcatgtagggttggttcaagaactccttggcaggggaagctcagtggattctgccactaagaaggggaacacggctctgcacattgcatccctggctggccaggctgaggtcgttaaagtcttggtgaaggaaggagccaatatcaacgctcagtcacaaaacggctttacccctctatacatggcagcccaggaaaaccacatagacgtggtgaaatatctcctagagaatggcgccaatcagtccactgctaccgaagacggttttacaccattagccgttgctctgcagcagggtcataaccaggcagtcgccatcctgctcgaaaatgataccaagggaaaagtccggctgcctgcccttcacatagcagctagaaaagacgacactaaatctgcagctctgcttctgcagaacgatcataatgctgacgtccagagtaagatgatggtaaacagaaccacagaatccggctttacgcccctgcatattgccgcccattacggcaacgtcaacgttgctactctgttgctgaatcggggagcggccgtcgattttaccgcaagaaacgggataacccccctgcatgtagcctcgaaacgcggaaacacaaatatggtgaagttactcctcgaccgggggggacagatcgatgccaagaccagggatggattgactccccttcactgtgcagcccgcagcgggcacgatcaagtagtagagttgttgctcgaaaggggagccccactgttagctagaaccaagaacggcttgagcccactgcacatggcagcccagggagatcacgttgagtgcgtcaaacacctgctgcagcataaagcacctgtggatgacgtgactcttgactatcttacggcgctccacgtagccgctcattgcggccactatcgtgttaccaaactgctgctggataaacgtgccaaccccaatgctagagccttaaacggtttcactccactgcatattgcctgcaagaaaaataggatcaaggtgatggagttgttggtgaaatacggtgcctctatccaagccattactgagtctgggctgacccccatacatgtggctgcttttatgggacatctgaatatcgtgttgctgctcttgcagaatggcgcatctcccgatgttaccaacattaggggggaaacagcccttcacatggccgccagagctggccaggtcgaggtagtacgctgtttgctcagaaatggggcccttgtggatgcgcgagcacgggaagaacaaacacctcttcacattgccagtagactagggaagaccgagattgtacagcttctactgcagcatatggcgcaccctgacgcggccactaccaatgggtacacaccattacatatcagcgcaagggaaggtcaggtggatgtggcctccgtgctgctcgaggctggagcagctcattcactggccacgaaaaagggattcacgccacttcacgtggcggctaagtacggttccctcgatgtggccaagctcctactgcaacggagagcggccgcggacagtgcaggcaaaaacgggcttactccactgcatgtcgcagcccattacgacaaccagaaagtggccctgcttctactagaaaagggcgccagcccccacgccaccgccaagaacggttacactccactgcacatcgcagcgaagaagaaccagatgcaaattgcctctaccctgttgaactatggggcagagaccaacatagtcacaaagcagggcgtgactcctctgcatttagcatctcaggagggacacactgatatggtgaccctgttgctggataagggggcaaatatccacatgtctacaaagagtggacttactagcttacacctcgccgcacaggaagacaaagtgaacgtagctgatattctgacaaaacacggcgctgatcaggatgctcataccaaactcggatatacaccactgattgtggcctgtcactacgggaacgtcaagatggtgaactttctacttaaacaaggggctaacgtcaatgccaaaactaagaatggatatactcccctgcatcaggctgctcagcagggacacacccacattattaacgtgctgctacaacacggagcaaaacctaatgctaccaccgctaacggaaataccgccctcgcaatcgccaaaagactaggttacatcagtgtcgttgacactctgaaagtcgtgacagaagaggtgacaacgacgactacaactatcacagaaaaacacaaattgaatgtgcctgaaactatgactgaagttctggatgttagtgacgaagaaggagatgacaccatgactggcgacggtggagagtacctaaggcccgaagacctcaaagaacttggagacgattcgctccctagctcgcaatttctcgacggcatgaattatcttcggtatagccttgagggaggcagatccgactcccttagaagctttagcagtgatcgatcccacaccttgagccatgcctcttatctgagggactccgcagtgatggacgactccgttgtgatcccctcccatcaggtcagcacactggcaaaggaggcggagcgcaactcgtacaggctttcatggggtacagaaaacctagataatgtggctctgagctcaagtcccatacacagcggttttctcgttagcttcatggtggatgccagagggggggccatgagggggtgtcgacataacggactgcggataattatacccccacgtaagtgcaccgctcctacgcgtgtgacctgccgcctggttaagaggcaccgcctggccactatgccaccaatggtcgaaggagaaggtctggccagcagactgattgaagtcgggccatccggggctcagtttctgggcaagctacatcttcctactgcaccaccacctcttaatgagggcgaatcattggtgtctaggattctgcagctagggcctcccggcaccaagtttctcggtcctgttatcgtcgaaattcctcactttgccgcactacgcggtaaggaacgtgagctcgtggtgctgagaagtgaaaacggcgactcctggaaggaacacttctgtgattacacggaagatgagctcaatgaaattttgaacgggatggacgaggtcctggacagccctgaggacctggaatag

SEQ ID NO: 179015 - DNA, 5193 bp, Artificial Sequence
  Description of Artificial Sequence: Synthetic coding sequence
atgatgaacgaggacgccgcccagaagagcgacagcggcgagaagttcaatggcagctcccaacgtcggaaacggccaaaaaaggtgacatgcccacagatgaagcccgaagccgcaaatatcgaaaaaagtgattctaatgcctccttcctccgggctgctcgggctggcaacctcgacaaggttgtggaatacctgaagggtggcattgatattaatacctgcaatcaaaatggattaaacgctctgcacctggcagcaaaggagggccatgtcggcctcgttcaagaattgctgggacgcgggtcaagcgtggactcggccacaaagaagggcaacactgcactgcacatcgcgtcacttgcaggccaggctgaggtcgtaaaagtactggtgaaggagggcgctaatatcaacgcacagagccaaaacgggtttacgccattatacatggcagcccaagagaaccacattgacgtagtcaaatatttattggagaatggcgctaatcagtcgacagcaacggaagatggtttcacaccactggctgtcgcccttcagcagggccacaatcaggctgtggcaatactcctggagaatgataccaaggggaaagtcagacttcctgctctgcatatagctgcgcggaaggatgacacaaagtcggcagcactgttgcttcaaaacgatcataacgccgacgtgcagagcaaaatgatggtgaatcggaccacggaatcggggtttacaccactgcacatagctgcccactacggcaatgtgaacgtggcaaccctgctgctgaatagaggggctgccgtggactttaccgcgaggaacgggattacgcctttgcacgtggccagcaagagaggcaatacaaacatggttaagcttctgttagaccgcggcggccagattgatgcaaaaactagagacggcctgacccctctccactgtgcagccagaagcggtcacgatcaagtcgtagaactgctgctggagagaggcgcgcctttgttggcacgtaccaagaatggcttgtcccctttgcacatggctgctcaaggagaccatgtggagtgcgtcaagcatctgcttcagcataaggcacctgtggacgatgtaactctggactacttgacggctctgcacgttgcagctcattgcggccattatagggtcaccaaacttctcctggacaaacgggccaaccctaacgcccgggccctcaacgggttcactccccttcacatcgcatgtaagaaaaaccgaatcaaagtgatggagttactggtcaaatacggtgcttccatccaggcgatcacagaaagcgggctcactccaattcatgttgccgcattcatgggtcatctgaacattgtacttctgcttctccagaacggagccagccctgacgtgacaaatatccggggggagacagctcttcacatggccgcccgcgccggccaggtcgaggttgtccggtgtctcctgcgtaatggtgccctcgtggacgctagagcccgggaggaacagacccctctgcatatcgcctctcggctcggaaaaaccgagattgtgcagctgctgctgcagcatatggcccaccctgatgctgccacaaccaatggttatacacctttgcacatcagcgcgcgtgaaggccaggtagatgtggcatctgttctgctggaagccggagccgcgcacagcctcgcgaccaagaagggatttacaccgctacacgtggcagcaaagtacgggagcctggatgttgctaaactactgctccagcgtcgcgcagctgccgatagtgccggcaagaatggactgacgcccctgcacgtggctgcccactacgataaccagaaagtcgctctacttctgttggagaaaggggcctcgccgcacgcaactgcaaaaaatggctatactcccttgcatatcgcagccaagaagaaccagatgcagatcgccagcacgctcttgaactacggcgccgagacaaacatcgtgactaagcagggcgtcactcccttacatctcgcgtcacaagaaggacataccgacatggtgacactccttctcgataaaggcgccaacatccatatgtcaacaaagtccggactgacctcactccatttggcggcccaagaggacaaggtgaatgtcgcagatatcctgaccaaacacggggccgaccaggacgcgcacactaaactgggatacacccccctaatcgtcgcttgccattatggaaatgtgaagatggtgaactttctattaaagcagggcgctaatgtcaatgccaaaacaaaaaacggctacacacctcttcaccaggctgcacagcagggccacactcacattattaacgtcttgttacagcatggcgctaagccaaacgccaccaccgccaatggtaacaccgctcttgccatcgcgaaaagactgggttacatcagtgtagttgacacgttgaaggttgtcactgaggaggtgacaacaacaaccacgacaataactgaaaaacataaactcaacgtcccggaaactatgactgaagtgcttgacgtgtccgacgaagagggcgacgatactatgacaggcgacggcggcgagtatctacgccctgaagacctaaaagaactgggcgacgactccctgccgtccagccagttcctcgacggcatgaattacctacgttattctctcgagggaggccgctccgactccctccggagcttctctagtgacagaagtcataccctgagtcatgcgtcttatctacgagacagcgccgttatggatgactccgtcgtgattccgtctcatcaggtatccaccttggccaaggaagccgaaagaaacagctatcgcctgagctggggaacggaaaacctggacaacgtcgcactgtcgagcagcccaatccatagcggttttttagtaagctttatggtggacgcccgaggtggggctatgagagggtgccgacataatggcctccgtatcattattcctccccgcaagtgcaccgcccctacaagggtgacctgccgactggtcaagcgtcatcggcttgctactatgccaccgatggtcgaaggagagggtttagcttctaggcttatcgaagtggggccaagcggagcgcagttccttgggaagcttcatctccctaccgctcctccacccctgaacgaaggtgaatctttagtcagtaggatactccagctcgggccccccggcacgaaatttctcggacccgtaatcgtcgaaatcccccacttcgccgctctccgaggaaaagaacgtgagctggtcgtgttacgatctgagaacggggattcatggaaagagcatttttgcgactatactgaagacgaactgaatgaaattctgaacggtatggacgaggtgctggattccccagaggatctggaaaaaaaacggatttgccgaatcatcacaagggattttccgcagtatttcgccgttgttagccgcataaaacaggacagtaatctgattggccctgagggaggtgtgctgtcgtcaactgtggtgccccaggtgcaggccgtgttcccagagggagccctgacaaaaaggatcagggttggactgcaagcccagcccatgcactctgagctcgtcaaaaaaattctgggtaacaaggccactttcagcccgattgtcactctggagcctaggaggcgcaagtttcacaagcctatcacgatgaccatccccgttccgaaggcctcttctgacgtgatgctgaatggtttcggaggggacgcgccgaccctgcgtctcttgtgctcaatcaccggaggcactacaccagcgcagtgggaggacataaccgggaccacacccctcacctttgtgaatgagtgcgtcagcttcaccaccaatgtgtccgctcgcttctggttgatcgattgtcgtcagatccaggaatcagttacctttgcctcccaggtgtatagggagatcatttgcgtgccatatatggcaaagttcgtcgtattcgcgaagagtcacgaccccattgaagctaggctccggtgcttttgcatgaccgacgacaaagtcgacaaaacactggaacaacaggagaactttgctgaagtggctcgatctcgcgatgtggaagtactcgaaggcaagcccatttacgtggattgttttggtaatctagtgccactgacaaaatctggacagcaccatatattttccttttttgctttcaaggaaaacaggctgccgcttttcgtgaaagtaagggacacaacacaggagccatgtggtaggctgtcctttatgaaggaacctaagtctactagaggcttagtgcaccaggctatttgcaacttgaatattaccctgcccatctacaccaaggaaagtgaatcagatcaggagcaagaggaagagatagatatgacttctgagaaaaacgatgaaacagagagcactgagacttcggtacttaagtcacatttggtaaacgaggttccggtgctggcaagccctgatctgttatcagaggtctcagagatgaagcaggatttaatcaaaatgacagccattctcacaactgatgtctctgataaggccggctctataaaggtaaaagagctagttaaggcagccgaggaggagccgggagaacccttcgaaattgtcgagagggtcaaagaggacctggagaaggttaatgagatcctgagaagcggcacctgtactagggatgaaagcagcgtgcagagcagccgcagtgagcgaggcctagttgaagaagagtgggtaatcgttagcgatgaggaaatcgaagaagcaaggcaaaaggctccccttgaaatcaccgaatacccttgtgtagaagtccggattgataaagaaattaagggcaaggttgagaaggacagtactggtctggtgaattacttgaccgacgatttgaacacttgtgtacctctgcccaaagagcagttgcagactgttcaggacaaggccgggaaaaagtgcgaagcgctcgccgtggggagaagtagtgaaaaagaaggtaaggacatccctcctgatgagacacagtctacacagaaacagcacaagccaagtttgggaataaaaaagcctgtgcgtcgaaaactcaaggagaagcaaaagcagaagtag

SEQ ID NO: 179016 - DNA, 5592 bp, Artificial Sequence
  Description of Artificial Sequence: Synthetic coding sequence
atgaccaccatgctgcagaagagcgacagcaacgccagcttcctgcgcgccgcccgggctggaaatttagataaagtagttgagtacctgaaaggtggtatcgatattaacacttgtaaccagaatgggctgaatgccctgcatctggcggctaaagagggacatgtggggctggtgcaggagctccttggcaggggaagcagtgtggattcagctacgaaaaagggtaacactgcactgcatatcgcttcgctcgccggccaagccgaagtcgtaaaggtgctggtcaaagagggcgccaacatcaatgctcagagccagaacggtttcactcctttgtatatggcagcacaggagaaccatattgacgtcgtaaagtaccttctcgagaatggcgcgaaccaatctacggctacagaagatggcttcactcccttagccgtggcgttacaacagggccacaaccaagccgtggcaatccttttggagaatgacacaaagggcaaagtccgcctgcctgctctccacattgcggctagaaaggatgatacgaaaagcgctgcccttcttctccagaatgaccataatgccgatgtgcagagcaaaatgatggttaacagaactactgagtctggcttcacccccttgcacatcgccgcacactacggtaatgtcaatgtagctaccctgctgctgaatagaggagccgctgtcgattttaccgcccgaaatggtatcacccccttacatgttgcaagcaaacgcggaaatactaatatggtgaagctgctccttgaccgcggcggacagatcgacgccaaaactcgagatgggctgacccctttgcattgcgccgctcggtccggtcatgaccaggtcgtcgagttactgctggagagaggagccccgctgctagcgaggaccaagaatggcctctcgccactgcatatggcggcacaaggcgatcacgttgaatgcgttaagcatctccttcagcacaaggcccctgttgatgatgtcacactggactacctgaccgccctgcacgtggccgcccattgtggtcactatcgggtaacaaagcttttgctcgataagcgggcaaacccaaatgctcgggcactgaacggatttacccccttgcacatcgcctgtaaaaagaatagaatcaaggtgatggaactcttggttaagtatggggcctctatccaggcgattacagaatctggtcttacacccatccatgttgctgcctttatggggcacctcaatatcgttcttttgttgctacagaatggtgcttctcccgatgtgaccaatataaggggcgaaacggccctgcacatggcagccagagccgggcaagtggaggttgtgcggtgtcttctgagaaacggggcattggtcgacgcacgggcgcgcgaagaacagacacccttacatatcgctagtcggttaggaaagaccgagatcgtgcagcttctcctgcaacacatggcacatccagatgccgccacaacgaacggttatacacccctgcacatttccgcccgagagggccaggttgacgttgcctctgtacttctggaagcaggcgcggcacacagcctcgccacaaagaaagggttcacccctttgcacgtcgcagctaaatatggatccctggacgtggctaaactgctgctccaacggagagccgcggcggattcagccggtaagaacggacttaccccgctccacgtcgccgctcattatgacaaccagaaagtagccttattgctgctagagaagggcgcatctccacatgctaccgccaagaacggttatacgcccctacatatcgcggccaagaagaatcaaatgcaaatagcatcaacactgctgaactacggtgctgagactaacattgtgaccaagcagggcgttaccccattacatttagcgtcacaggaagggcataccgatatggttaccctgctgctcgacaaaggagcgaatatacatatgtccacaaagtcagggctgacctcgctccacctcgctgctcaggaggataaggtaaacgtagccgacattttaaccaaacacggcgccgaccaggacgcccacactaagctggggtacacaccacttatcgtggcgtgtcattatggaaacgtgaagatggtcaacttcctgcttaagcagggcgctaacgtgaacgcaaagactaaaaacggatataccccacttcaccaggccgcacaacaaggacatacccacatcattaatgtccttttgcagcatggagctaaacctaacgctactactgccaatgggaataccgctctggctatagcaaagcgcctgggttacatcagtgtcgtagacaccctcaaagtcgtgactgaggaggtcacgactaccactacaactattaccgaaaagcacaaacttaacgtccccgagaccatgaccgaagtgctagatgtctcagatgaggagggagacgatacaatgactggcgacggtggcgaatatctgaggccagaggatctcaaggagctcggagatgacagcctgccctcctctcaattcttggacggtatgaattatctcaggtactctcttgaaggaggtcgctctgacagcctgcgaagcttcagcagtgaccgttcccacaccctctcccacgcctcctacctgcgtgatagcgcagtcatggatgactctgtcgtgataccgagccaccaggtctcaaccttggccaaggaggcagaacggaacagttatcggttaagttggggaaccgaaaatctggacaacgtggccctctccagcagccctatccactcaggccgagctagcccatgcctggaaagagacaacagctccttcctcgtcagcttcatggtcgacgctaggggaggagcaatgcgtggttgccgtcacaacggtctaagaatcattatcccgcccaggaagtgtacggcacctacccgggtgacctgtagattggtcaaacggcacaggttagccactatgccacccatggtcgaaggagagggcctggcatcccgcttaattgaggtaggaccaagtggggctcagttccttggcaaacttcacctccccacagctccaccgcccctcaacgagggcgagtccctggtaagtaggattctgcagctcggccctcctggtacaaagtttttgggccctgtgatcgttgagattccccacttcgctgccctgcgtggaaaagaaagagaacttgtcgtgctacggagtgaaaacggagattcttggaaggaacatttctgcgattacaccgaggatgagcttaatgaaatcctgaacggtatggacgaggtgttagattccccggaagatctggagaagaagcgaatttgcagaattatcacacgcgatttccctcagtattttgccgttgtgagccggatcaaacaggattctaatttgatcgggcccgaaggtggtgtgctcagcagtacggtagtaccccaggtccaggcagtgtttccagagggcgccttgacaaaaaggattcgagtcgggctccaggcccagcctatgcatagtgaactcgttaagaaaatcctcggcaataaagccacattcagtccaatagtcacgcttgaaccaaggagaagaaagttccacaaacctatcactatgactattcctgtgcctaaggcttcttctgacgttatgctcaatggcttcgggggtgatgcccctacgctgcgcctgctctgtagcattaccggaggcactactccggctcagtgggaagacatcacaggcaccacccccctgacttttgtcaatgagtgcgtgtctttcacgaccaacgtgtcagctcggttttggctcattgactgcagacaaattcaggaatcagtcacctttgcgtctcaggtttatcgcgaaatcatctgtgtgccctacatggccaaatttgtggtcttcgctaagtctcatgacccaattgaggcccggttgagatgcttttgcatgaccgatgataaggtagataagactctggaacagcaggagaattttgcagaggttgcacgatcacgggatgtagaggttctggagggaaaaccaatctatgttgattgcttcggcaacttggttcccctcacaaagtccggacagcaccatattttctcctttttcgcctttaaggagaaccgccttcccctgtttgtgaaggtgcgcgacacaactcaggagccgtgcggccgcctgtcattcatgaaggaaccaaaatccactagaggcttggtgcatcaggctatctgcaacctcaacatcaccctgcccatctataccaaggaatcagaatcggaccaggaacaggaagaggaaatagatatgacaagcgagaagaacccgcaggacgagcaggagcgaattgaggaacgcctagcctatatcgctgaccacctggggttctcatggaccgagctcgcaagggaacttgacttcactgaagagcagattcaccagattagaatcgaaaatcctaacagcctgcaggatcagtcccatgctctgctgaagtactggctcgagcgcgacggtaagcacgccactgatactaacctggttgaatgtttgacaaaaatcaataggatggacatcgtgcacctcatggagactaacacagaaccgttgcaagagcgaatttctcacagctatgcagaaatcgaacagactatcaccctggatcattctgagggattctccgtgctgcaggaagagttgtgtacagcccagcacaagcagaaagaagagcaggccgtctccaaagagagtgaaacctgcgaccatccacccatcgtgtcagaagaggacatctctgtggggtatagtaccttccaggatggtgtgcctaagactgaaggcgatagctccgcgacggccctcttcccccagacccacaaggagcaggttcagcaggacttctcaggaaagatgcaagatcttcccgaagagagttctctggagtatcagcaggaatatttcgtgacaactcccggcaccgagacctcagagacacaaaaagccatgatcgtgccaagctctcccagcaaaacccctgaggaagtgtccactcccgctgaggaagagaaactttacttgcagacgccaacttcaagtgagcgcggcggatccccgatcattcaggaacccgaggagccttctgagcatagagaagagtcctcgccccgcaagacttcacttgtgattgtcgagagtgccgacaatcaaccagaaacatgcgagagactggacgaagacgccgcttttgaaaagggtgatgatatgccagaaatcccccctgaaacagtaacagaggaggaatacattgatgagcacggccacacggtggtgaagaaggttaccaggaaaatcattagacggtacgtatcatctgagggtactgaaaaggaggagataatggtccagggcatgccacaggaacctgtaaatatcgaagagggcgatggatacagtaaagttattaagagagtggtgttgaagtccgacactgagcagtccgaagacaacaatgagtag

SEQ ID NO: 179017 - DNA, 5586 bp, Artificial Sequence
  Description of Artificial Sequence: Synthetic coding sequence
atggccagcagcgccagcagcagccccgccggcaccgaggacagcgcgccagctcagggaggtttcggctccgattactctcgttcctcacgcaagagcgatgcgaatgcaagttacctccgtgccgcgcgtgcaggccacttggagaaagcccttgactacatcaaaaatggggtggacatcaacatttgcaaccagaacggcctcaatgcattacatctggcttccaaggagggtcacgtggaagttgtgtccgaactcttgcagagggaagcaaacgtggacgcagcaacgaagaagggaaacacagctctgcacatagcatcgctggcaggtcaagccgaagtagtaaaggtgcttgttaccaacggggctaacgtaaacgcccaatcgcagaacgggtttactcctctgtatatggcagcacaggagaaccatctcgaagtggtcaaatttctcttggataacggcgcttcccagtctctcgccacagaagacgggttcaccccactggctgtcgcactgcagcagggccacgaccaggttgtgagcttgctgctcgagaacgatactaaaggtaaggtaagactgccagcacttcacatcgccgccagaaaggatgacactaaagccgccgcactgctccttcaaaatgacaataacgcagacgtagagtctaaatcaggatttaccccgcttcatattgccgcacactacggaaacataaacgtggctaccctcctgctcaaccgcgccgccgccgtggacttcactgccaggaatgatattacacccctgcacgtcgctagtaaaagaggaaacgcgaatatggtcaagctcctgctcgatcggggggctaaaattgatgcgaagacccgagatggcctgacacccttgcattgtggcgctagatccggtcacgaacaggtggtcgagatgctactcgacagagcagcaccaatcctgagcaagacaaaaaacggactgtcccccctacacatggccacacagggagaccacctcaattgcgtgcagctgctcttacaacacaatgtgcctgtggacgatgtcacaaacgactacttgacagccctgcatgtggccgcgcattgtggacactacaaagtggccaaggtgttgctggacaagaaagccaaccctaatgcgaaggctctgaatggattcactccactgcacatagcatgcaagaagaaccgcataaaagtgatggagctgctactgaagcatggagccagtattcaagccgtgaccgagagcggactcacccctatccatgtggcggcttttatggggcacgttaatattgttagtcaacttatgcaccacggagctagccccaacacaacaaatgtgaggggcgaaactgcactgcacatggccgcaagatcagggcaggccgaagttgtaaggtatctggtgcaggacggggcgcaagtggaggccaaggccaaagatgaccagacacccctgcacatctctgccagactgggcaaggctgacattgtgcaacagctgctgcagcagggcgcatcccccaacgcagcaacaacaagcggctacacccctctccatctgtccgccagagaaggccacgaggatgtggctgccttccttctggatcacggcgcctcactgtcaattactacaaagaaaggctttaccccacttcacgttgctgcaaaatacggcaagctggaagttgccaacctgctgctgcagaaaagcgcgtctcctgatgctgctggtaaatccggcttaacccccctccacgtggctgctcattacgacaaccaaaaggtggcgctgctcctcctggatcaaggcgcctctccccacgcagctgccaagaacggatacacacctctccatattgctgccaaaaaaaaccagatggacatcgccacaacgctgctggaatacggggccgacgccaacgcagtgaccaggcagggcatcgcctctgtacatctcgcagcccaggaaggacacgtggacatggtgagtttgttactcggaaggaatgcaaacgttaacctaagcaataagtccggtcttacaccacttcatttggcagcgcaagaagatagagtgaatgtcgccgaggtcctcgtaaaccagggagcccacgtagacgcccagacgaagatgggatatacccccttacacgtcggatgtcattacgggaacatcaagatcgtgaacttcctcctgcaacactctgctaaagttaatgccaagacaaaaaacggatataccccgctccatcaggcagctcaacaaggacacacacacattataaacgtgctgctccagaacaacgcctcacctaacgaactcacggtcaacggcaacacggcccttggcatcgcacggcggttgggctatatcagcgtggttgataccctgaagattgtcactgaggaaactatgaccaccaccacggtcactgagaagcacaagatgaacgttccggagactatgaacgaagtgttggacatgtcagatgacgaagtgcgaaaggcaaatgcgcctgaaatgctctcagatggtgaatatatcagtgatgtggaagagggagaggatgctatgacgggagacactgacaagtacctgggcccacaagatctgaaggagctgggagacgatagccttccagctgaaggatatatggggttctctctgggggcccgttccgcaagtctgcggagtttctccagtgaccgatcctacaccctcaaccgatcttcgtacgccagggattcaatgatgatagaagaactgttggttccttctaaagaacagcatctgacttttactcgggagtttgactccgattcgctgagacactactcctgggccgcagatactcttgacaacgtgaatctcgttagctccccaatacacagtggttttctcgtgtcgtttatggtggacgctcgcgggggctccatgagaggctcccggcaccacggtatgagaataattataccacctcgtaagtgcaccgcgccaacgcggatcacctgcaggctggtgaagaggcacaaactcgccaaccctccaccaatggttgagggggaaggcctcgcgagtcggctggtggaaatgggaccagcaggcgcccagtttttaggaccggttatagtggagattccccacttcggttctatgagggggaaagagcgggaactgatagtccttcggtcagagaatggagagacctggaaagaacaccagtttgattctaaaaacgaagacctgacagaacttctcaacggcatggacgaagaacttgattctccagaggaactgggtaaaaagcgaatttgcaggatcatcaccaaggattttcctcagtattttgcagttgtcagcaggatcaagcaagaaagcaaccaaattggcccagagggaggcatcttgagcagcacaaccgttccgctggttcaggcttcattccccgaaggtgccctcactaagcggattagggtaggcctccaggcccaacccgtgcccgatgagattgttaagaaaattctgggcaacaaggccactttctccccaatcgtgaccgttgagccgaggcggaggaaattccataagcccataacaatgaccatcccggtgccacccccaagtggcgaaggcgtctctaacgggtataagggcgataccactcctaacttaagattgctttgttccattactggcgggacaagcccagcacaatgggaggacatcacaggcacaacacctttaacattcatcaaagactgtgtgtcattcacaacgaatgtgagcgcaagattctggctcgctgactgccaccaggtgctggaaacagtcgggctagctacacagctctaccgggagctcatttgtgtgccttacatggcaaagtttgttgtgttcgccaagatgaacgacccggtcgagtcaagcttaagatgtttctgcatgaccgatgataaggttgacaagacactcgaacaacaggagaatttcgaagaagtggccagaagcaaggacattgaagttctcgaaggtaaacctatttacgtcgactgctatggtaacctcgcccccctgactaaagggggccagcagctggtcttcaacttttacagtttcaaggaaaataggctacccttcagcattaagattagagatacatcccaggagccctgcggaagattaagctttctcaaagagcctaagactacgaaggggctgcctcagaccgccgtttgtaacctcaacatcaccctgccagcgcataaaaagattgaaaagacggataggaggcagtccttcgcctccctggccctcagaaaaagatactcctacctaacagagccagggatgagccctcaatctccctgtgaacggaccgatattaggatggctattgtggccgatcacctgggactgtcatggaccgagctcgcccgcgagttgaacttttctgtggatgagatcaatcaaatacgagtcgagaatcccaattctctcattagtcagagcttcatgcttctcaagaaatgggtgaccagagatggcaaaaatgccaccacggatgccctcaccagcgtgctgaccaagatcaatcggatcgacattgtcactcttctggaagggcccatcttcgattacggcaatatcagcgggacccggtctttcgcagatgagaacaatgtgtttcatgacccagtggacggatacccttcacttcaggtggagctggaaacacctacaggtctgcactacaccccaccaactcccttccagcaggatgactacttctccgacattagctccatcgaaagtcccctgagaacgccttctcgcctatcggacggcctggtgccttctcaaggcaatatcgagcactccgcggacggtccaccggtggtgaccgccgaagacgcttccctagaagactccaagctagaagactccgttcctcttacagagatgcccgaagccgtggatgtcgacgagagccaactggagaacgtctgtctctcctggcagaatgaaacctcttccggcaatctggaaagttgcgcgcaggccagaagggtgacgggtgggctcctcgacagactggatgatagcccagaccaatgtcgtgactcaattaccagctacctcaagggagaggctgggaaatttgaggcaaacgggtcccacacggaaattacacccgaagccaagacaaagtcctactttccagagagccaaaatgacgtggggaagcagagtactaaagagacactcaaaccgaagatccatggcagtgggcatgtagaggaacctgcatctccccttgccgcttaccaaaagtctctagaagaaacgagcaagctgataattgaagagaccaagccctgcgtccccgttagcatgaagaagatgagccgcacttctccagccgatggaaagcccaggctgtccctgcatgaggaggagggtagtagcggtagtgagcagaagcaaggggagggcttcaaggtgaaaactaagaaggagatccgacatgtcgagaagaagtctcacagctag

SEQ ID NO: 179018 - DNA, 5607 bp, Artificial Sequence
  Description of Artificial Sequence: Synthetic coding sequence
atgagcgaggagcccaaggagaagaacgccaagcccgcccaccggaaacgtaagggaaaaaaaagcgacgccaatgccagttacttacgcgcagcgcgggcaggtcatttagaaaaagccctcgattatatcaagaacggagtcgatataaacatttgtaatcagaacgggctcaatgcactgcacctggcctctaaagaggggcacgttgaagtggtgtcagaattgctccaacgagaggccaacgtagacgcagctactaaaaaggggaacacagccctccacatcgcatctttggctgggcaggctgaagtcgtgaaggtacttgtaacaaacggcgcaaacgtgaatgctcagtctcaaaacggcttcacacctctgtacatggcagctcaggagaatcaccttgaggtagttaaatttcttctggacaatggcgcttctcagagcctagcgaccgaggacggttttactcccttggccgtggctctgcagcagggccatgatcaggttgtgtccctgctgcttgaaaatgatactaaaggcaaggtcagattgcctgctctgcacattgctgccagaaaagatgatacaaaagcagccgccctcctgcttcagaatgataataacgccgacgtggaaagcaaatcaggcttcactccactccacattgccgcacattatggcaatatcaatgtggccaccctgttgctgaatcgggccgctgcagtggacttcactgccagaaatgacatcactccccttcatgtcgctagtaaaagaggcaacgctaacatggtgaaactgcttctagaccggggtgcgaaaatcgatgctaagacgagggacgggttgactcccctccattgcggggcccgttccggccatgagcaggtggtggaaatgctgctggaccgggccgccccaatactgtcaaaaactaagaacgggctctctcctctgcacatggccacgcagggggaccatttgaactgcgtacagctcttactgcagcacaacgtgccagtggatgatgtcacgaatgattatctcacagccctgcacgtggcagcccactgcggacactacaaagtagccaaggtgctgctcgataagaaagcgaaccccaacgccaaggcactgaacggcttcacacccttgcacatcgcttgtaaaaagaacaggataaaagtaatggagctgctgctaaagcatggagcctcgattcaggccgtgactgagtcggggttaacccctatccacgtggctgctttcatggggcacgtcaacattgtcagccagctaatgcatcatggggcctcccctaatacgactaacgtccgcggggaaaccgccttgcatatggcggctcgttcaggccaagctgaagtggtccggtacctcgtgcaagacggcgcccaagttgaagctaaggctaaagatgaccagacgccgctgcacatcagcgctcggcttggaaaggctgatatcgttcagcaacttctgcagcagggcgctagtccaaacgccgcgaccacatccggctacactcctctccacctcagtgcacgcgaggggcatgaagatgtggcggcattcctgctggaccacggggctagcctgagtattactacaaagaaagggtttactccgctgcatgttgccgccaagtacggcaaactggaggtcgccaacctcctcctacagaagagcgccagcccagatgccgcaggtaaaagcgggctgacgcctctgcacgtcgctgcccactacgacaaccaaaaagttgccttactgcttcttgaccaaggcgcaagccctcatgcggccgcaaagaacggatatacgcccctccacatagccgcaaagaagaatcaaatggacattgcaacaacactgttggaatatggcgcagatgccaacgccgtgacgcgccaagggatcgcatctgtgcatctcgcagcccaggaaggccacgtcgatatggtttccctgctccttgggcggaacgccaacgtgaatttgtcaaataaatccggattgacccctcttcacctcgctgcacaggaggatcgagtcaatgtggccgaggtgctcgtgaatcaaggcgcccacgtggatgcccaaacaaagatggggtataccccactgcacgtggggtgtcactatggaaacatcaaaattgttaattttctgttacagcattctgcgaaagtgaatgcgaaaactaagaacggctacacaccacttcaccaggcagcccagcaaggacatactcatatcattaatgttctgctgcaaaataacgcctcgcccaacgagttaacagttaatggaaataccgctctgggaattgctagaaggctggggtacatctctgtcgtagacactttgaaaatagttactgaagagacaatgaccaccaccacggtaaccgaaaagcataaaatgaatgtccctgaaacaatgaatgaagtcctggacatgtctgatgacgaggtgcggaaggcgaatgcccctgaaatgctgagtgacggtgaatatatctctgatgtggaggaagggaatcggtgtacttggtacaagattcctaaggtccaagaattcactgtgaagtcagaggacgctatgaccggcgatacagataaatatctgggacctcaggacctgaaggagctgggggatgactcgctccccgccgagggttacatgggtttcagtctcggtgctcgtagcgcttcgctcagatccttctcttcagacaggtcatatactctcaaccggtcatcatacgctagggactctatgatgatcgaggaactcctcgttccctctaaagaacaacatttaaccttcacacgcgagttcgactctgactcactgagacactactcgtgggcagccgataccttagacaacgtgaatctggttagttctcctatccatagcggtttccttgtttcattcatggtagacgcgcggggcggaagtatgagaggatcaaggcaccatggaatgaggataattattccgccacgcaagtgtaccgccccaacgaggataacctgccggttagtgaaaaggcataaactcgcgaacccaccacctatggtggaaggggaaggccttgcgagtcggttggtcgaaatgggcccagccggggctcagtttctgggcccagtcatcgtggagattcctcatttcggatccatgcgaggtaaggagcgggagcttattgtgttacggagcgagaacggagagacctggaaagaacaccagttcgacagcaagaacgaggacctgacagagttactgaatggaatggacgaagagctggattctcctgaggagctgggcaaaaagcgcatttgcagaatcatcaccaaagactttccacaatacttcgcagtagtgtcacgcatcaagcaagaatcaaaccagataggccccgagggcggtattcttagtagcacgactgtgcctctggtacaagcgagtttccccgaaggagctctgacgaaaaggatcagagtaggtttgcaagcacaacccgttcccgatgaaattgtcaagaaaattctgggcaataaggcgaccttcagtcctattgtgaccgtggaaccaagaaggaggaaatttcacaagccaataaccatgacgatcccggtccctcctccgagcggggaaggtgtctctaacggatacaagggtgatacgaccccaaacctccggctgctttgttccattaccggaggcacctctcctgctcaatgggaggacattacgggaacaactcccctgactttcatcaaagactgtgtcagcttcacaaccaatgtgtccgcccgattctggttggctgactgccaccaggtccttgaaactgtaggcttggcgacacagttgtaccgggaattgatctgcgtaccgtacatggctaagtttgtggttttcgccaagatgaatgaccctgtggagtcgtcactacggtgtttctgcatgactgatgacaaggtggacaaaacgctcgaacagcaggagaactttgaagaagtcgccagaagcaaagatatcgaggtactcgaaggcaaacccatctacgtagactgctacggaaacctggctccactcactaaaggagggcagcaattagtgttcaatttctacagttttaaggagaataggttgcccttcagcataaagatacgggatacttctcaggaaccctgtggaagattgtctttcttgaaagaacccaagactaccaaagggcttcctcagaccgcagtgtgcaacctgaatatcactctgcctgcccataagaagatagaaaaaaccgatagaagacaaagtttcgccagtttagctctcaggaaacgctattcctacctgacggaacctggaatgtcacctcagtccccatgtgaacgtactgacatcagaatggccattgtggccgaccatttgggattatcatggaccgaactcgcaagagaacttaactttagcgtggacgaaataaaccaaatacgagtcgagaacccaaactctctcatatcccagtcatttatgttactgaaaaaatgggtgacccgagacggtaagaacgccacaactgatgccctgactagcgttctgaccaagatcaaccgtatagatatagtaaccctgctggagggaccaatcttcgattacggaaatattagtggaacaagatcatttgccgacgagaataacgtctttcatgatccggtcgatgggtacccttctctgcaggtagagctggaaactccaaccggtctgcattatactccacctaccccatttcagcaggacgactacttttcagacattagctcaattgagagccccctacggacgcccagccgattgtctgacggactggttccaagtcagggcaacattgaacacagtgcagacggtccgccagttgttactgccgaggatgctagtctggaggactccaagctggaagattctgttccactgacagagatgcccgaagccgtagacgttgacgaaagccagcttgagaatgtgtgtctttcttggcagaatgagacctcatccggaaacctggagtcgtgtgcacaggctcgacgggtcacggggggtctcttagatcggctggacgattctccagaccagtgtagggacagcattacctcctatctcaagggcgaggcaggcaagttcgaagctaacggaagccacaccgaaataacgccagaggcaaagaccaagtcttacttcccagagagccagaatgatgtgggcaagcagtccaccaaagaaaccttgaaaccgaaaatccatggcagtggacacgtggaggagcccgcttctccactcgcagcatatcagaagtctctggaggagacttcaaagttgataattgaggagacgaagccctgcgtgccagtgtcaatgaagaagatgagcaggacgtctcccgccgacggtaaacctagactttctctgcatgaggaggagggctcctccggatcagaacaaaagcagggagaaggcttcaaagttaagacaaaaaaggaaatcaggcatgtagagaagaagtcccacagttag

SEQ ID NO: 179019 - DNA, 13134 bp, Artificial Sequence
  Description of Artificial Sequence: Synthetic coding sequence
atggcccacgccgccagccagctgaagaagaaccgggacctggagattaatgccgaagaagagccagaaaagaaaagaaagcacagaaagaggtcaagggaccgcaaaaaaaaatccgatgctaacgcctcctacctacgggccgcccgagccgggcatttggaaaaggcccttgattatataaaaaatggggttgacatcaacatttgcaatcaaaatggcctcaacgctctacatctggcttctaaggagggacacgtggaagtagtatctgagctgctacagagggaggccaatgtcgacgccgccacaaaaaaagggaacacagctctgcatattgccagccttgctggtcaggcggaggtagtgaaagtcctggtcaccaatggtgctaatgtgaatgcccaatctcagaacggcttcacacctttgtatatggccgctcaggagaaccacctcgaggtggtgaaatttttattagataatggggcctcccagtccctcgcgactgaggacggctttacacctctggccgtggctttacaacagggacacgatcaggtagtgagtcttctgttggagaacgacactaaaggaaaagtgagactccctgctctccatatcgctgcccgcaaggatgatacaaaggctgctgccttactcctgcagaacgataacaacgccgacgtcgaaagcaaatccgggtttactcctctgcacatcgcagcgcactacggcaacattaacgtcgccacacttctgcttaatagggctgctgctgtcgatttcacggcccgtaatgatatcactccactgcatgttgcctccaaacgcggtaacgccaacatggtcaagcttctgcttgacagaggcgccaaaatcgatgccaagacacgcgatgggttgacacctctgcattgcggcgcgcggtccggtcacgaacaggtagtcgagatgctgctggaccgagctgccccaatcctctcgaagaccaagaacggactgtcacccctccatatggccactcagggcgaccaccttaactgcgtgcagcttctgctccagcataatgtgccagtggacgacgtgactaacgactatctgactgctttgcatgtggccgcccactgcggacattacaaggtcgcaaaggttcttctcgacaagaaggcgaatcctaatgctaaggctttgaacggattcacccctctccatattgcctgtaaaaagaacagaattaaagtgatggaattgttgctgaagcatggggcatcaattcaagctgtaaccgaaagcgggctgactcccatccacgtggccgcatttatgggccatgtgaatattgtctctcagctgatgcatcacggggcaagcccaaacaccacaaatgtgaggggcgagacagccttgcatatggcggctcgatctggccaggccgaggtcgttcggtatctggtgcaggatggggcccaagtggaggcgaaagccaaagacgaccaaaccccactgcacatctccgctcgccttggtaaggctgatatcgtacagcagctcctgcagcaaggagcatcacctaatgccgcgactacttctggatatacacctctgcacctctcagccagggagggacatgaagacgtggctgcattcctactggatcacggagcctcgctatcaatcaccaccaagaagggatttactccactccacgtggcagccaaatatggcaagctcgaggtcgcaaatctgctcctccagaagagtgcaagtcccgatgccgccggcaagtccggcttaactccattgcatgtcgctgcgcactacgacaaccagaaggtcgctctgctgctcctagaccaaggggcgagtccacatgccgccgctaagaacggatatacaccactacacatcgccgctaagaagaaccagatggacatcgccaccacccttctggagtacggagccgatgctaatgcagtaaccagacagggaattgcatccgtccatcttgcagcgcaggaaggacacgtggatatggtttccctgctcctcggaagaaacgctaacgttaacctgtcgaacaaatccggcctcactcccctccatctggctgcacaggaagacagagtaaatgtggcagaggtgctcgttaaccaaggagctcacgtggacgcccagaccaagatgggctataccccattgcatgtgggctgtcactacggcaacatcaagatcgtcaacttcttattgcaacattctgctaaggtgaatgcaaagacaaaaaacggatataccccactacaccaggctgcacagcaggggcacactcatatcataaacgtgctcctgcagaataacgcaagtccaaacgagttgactgttaatggcaacaccgcacttggaatcgcccggaggttgggatatattagcgtagtcgatacgctgaagattgtgaccgaggagaccatgacaactaccacagtcactgaaaaacacaagatgaacgtgcctgaaactatgaatgaggtgcttgatatgtcggatgatgaagttcgcaaggcgaacgctccagaaatgctcagtgacggcgagtatatttcggacgtcgaagaaggtgaggacgctatgacgggggacactgacaagtatctgggcccacaggatctcaaagaactgggtgatgactcgttaccggctgaagggtacatggggttttcccttggtgcgcgatcggccagccttaggtcattctcttcggacaggagctataccctcaaccgttcatcctacgcccgtgactccatgatgattgaagaattgctcgtgccgagtaaggaacagcacttgacctttactagagaatttgactccgactcactgagacactattcctgggccgctgatactctggacaacgttaacctcgtgagctcacctatccactccggatttctcgtgtcctttatggtagatgctagaggcggcagcatgagaggaagccggcaccacggcatgaggattatcatcccgccccggaaatgcacggctccaacccggattacttgtagactggtgaagaggcacaagctagccaacccacctccaatggtggaaggagaaggtttggccagccggctggtggagatgggtccagcaggggctcaattcttaggcccagtgatcgttgaaataccgcactttggatcaatgaggggcaaagagcgggagctcatcgtgctacgctctgaaaatggagagacctggaaggagcatcagttcgactcaaagaatgaggacctcacggagcttcttaatggcatggatgaggaactagacagtcctgaggagttagggaaaaagcggatttgcagaatcattaccaaagattttcctcaatacttcgcagtggtgtcccggatcaagcaggagtcaaatcagatcggaccggaggggggtattctcagctctacaacagtgcctttagtacaggcatcattccctgagggagcgctgaccaaacgcattcgggtgggcctccaagcacagcccgtccctgatgaaatagtaaagaagatcctaggtaacaaggctaccttcagtcccatcgtaacagttgaacctcggcgacgtaagtttcataaaccaattaccatgaccatccccgtgcctccaccctctggggagggtgtttccaacggttataagggagacactactcctaaccttagattgctctgcagcatcacaggagggacaagccccgcacagtgggaggatataactggcaccactcccctgacattcataaaggactgcgtttcctttaccaccaatgtgtctgcacggttctggcttgctgattgccatcaagtcctcgagacagtgggattggcaactcagctgtatagggaactcatctgcgtgccttacatggccaaatttgtggtgttcgccaaaatgaacgaccccgtggaatcatccttacgatgcttttgcatgactgacgacaaagtcgacaagaccttagagcagcaggagaattttgaggaggttgctagatccaaggacattgaagttctggagggtaagcccatatacgtggattgctatgggaacctcgctcctctcaccaaaggtggtcaacaactcgtattcaatttctacagttttaaagaaaatcggctcccattctcgattaaaataagggacacaagtcaggagccttgtggcaggctctccttcctgaaagagcccaaaactacaaaggggctaccacagacagccgtgtgcaatttgaacattaccctgcctgcccacaaaaaagagacggagagcgaccaggacgacgaaattgagaaaacagatcgcagacagtccttcgccagcctggccctaaggaagcgctacagttatctgacggagcccggcatgattgagcggtccacaggcgctacacggtccttacccacgacctattcatataagccattcttcagcacaaggccctaccagagctggaccaccgcccccattacagtccccgggcccgctaaatccgggttcaccagcctgtcatcaagctcaagcaatacaccatccgccagtcctttgaaatcaatctggagtgtctctacacccagcccgattaagtcaacccttggagcctcgacaacgagctccgtaaaatcaatttcagacgtagcgagtcccatcagatcatttagaaccatgtctagccctataaagacagtggtgtcacaatctccatacaatatccaggtatcctctggcaccctggcacgtgctcctgctgtaacagaggccacacccctcaaggggctggcgagcaacagtacattttccagtagaacatcacctgtgaccacagccgggagtctgttggagcggtccagcatcaccatgacgccccccgcttcacccaagagcaacatcaatatgtactcctctagtcttcctttcaagagcatcattacgtccgccgctcccctgatatccagcccgttaaaaagtgtcgtatcacccgtcaaatctgcagttgacgtgatctcgtccgcaaaaattaccatggcatcttcactcagcagcccggtaaagcagatgccaggccacgccgaggtggccctggtaaacggatccatctcccctctgaaatacccaagcagcagtaccctgatcaatggctgtaaagccactgctacccttcaagaaaagatctcaagtgctactaactctgtgtcgtcagtcgtctcagcagccaccgatacagtggagaaggtattttctactacgaccgccatgcctttcagtcccttgagatcttatgtgagcgccgcacctagcgcttttcagagtctccgcacacctagtgccagcgccctttacacttccttggggtcctccatcagtgcaaccaccagctcagtgacctcatcaattataacagtgccagtctactcagtcgtaaacgttctgcccgagccagccctcaaaaagcttcccgacagcaatagctttacaaagtcggccgctgcacttttgagccccataaagacccttacgaccgaaactcaccctcaaccacatttctctaggacatctagccctgtcaagtcttcactgtttcttgcgccgtccgcattaaaactgtccactccttcctcactgagctccagccaggaaattttgaaagatgtggccgaaatgaaagaggacctgatgaggatgacagctattttgcagacggacgtgcctgaagaaaagccatttcagcccgagttaccaaaagaaggacgaatcgatgacgaggagccttttaagatcgtcgagaaagtcaaagaggatttggtgaaggtttccgaaattctgaaaaaggacgtgtgcgttgacaataagggcagccccaagtcgcctaaatctgataaagggcatagcccagaggatgactggattgagttttcatctgaagaaatccgcgaagcacgacagcaggccgccgcgagccagtccccctcattaccagagcgggttcaggtaaaagcaaaagccgccagcgagaaggactacaacctcacaaaggtgattgactatctgactaacgatatcggaagtagtagcttgacaaatctgaaatacaaattcgaagatgcaaaaaaagacggtgaagagcgccagaagagggtgctcaagcctgcgatcgccctccaggaacacaagttgaaaatgccacccgcaagtatgaggacgagtacaagcgaaaaagaactttgcaaaatggctgatagtttctttggcaccgacaccatcctcgagtccccagacgacttctcccagcatgaccaggataaatctcccttgagtgacagcggcttcgagaccagaagcgagaagactcccagtgccccccaaagcgctgaaagcaccggtccgaagccgctttttcatgaagtgcctatccctcctgtgattaccgaaaccagaactgaggtcgtgcatgttatacgatcctacgatccttccgccggcgacgtcccacagactcagcccgaagaaccggtgagcccaaagccctcaccgaccttcatggaactggagccgaagccgaccaccagtagcatcaaggaaaaagtgaaggcattccaaatgaaggcaagttcggaggaagacgatcacaacagagtactctccaaggggatgcgcgtgaaagaggagacccatattactacaactacacggatggtctaccattcacctcccggtggcgaaggcgcctcggaacgaatcgaggaaaccatgtcagtgcatgacattatgaaggcctttcagtcaggccgggatccttcaaaggagctggcggggctgtttgaacataagtctgcagtctctccagatgtgcacaagtcagccgcagaaaccagcgcgcagcacgcagaaaaggataatcagatgaaaccgaagctggagcgcatcatcgaggtccatatcgagaaaggcaatcaggccgagccgaccgaagtcataattcgagagactaagaaacatcctgaaaaagaaatgtatgtgtaccagaaagatctgagccggggggacattaacctgaaagacttcctgccggaaaagcacgatgccttcccgtgctccgaggaacaagggcagcaggaggaagaggaactgaccgccgaagagagtctccccagttacctggagagctcgagagtcaacactcctgtctcacaggaagaggattcgagaccctcatctgcccagctgatctccgacgacagctacaaaacgttgaagctgctttcacaacactcaatcgaatatcacgacgacgaactatccgagttacgtggcgagtcctatagatttgccgagaaaatgctgctcagcgagaaactcgacgtgtcacactccgacacggaagagagtgtgactgatcatgccgggccaccatcctctgaactccagggttcagataagagatcccgcgagaaaatcgctaccgcaccaaaaaaggagattctatccaagatctacaaagatgtgagtgaaaatggggtaggcaaggtgagtaaagacgagcattttgacaaagttactgtcctccattattctgggaacgtgagctcccccaagcacgctatgtggatgcggtttacagaagatcggctggaccggggaagagagaaattgatctatgaggatagagttgacagaaccgtcaaagaggccgaagagaagctgactgaggtgtcccagttttttagggacaaaactgagaaactgaacgacgagctgcaaagccccgagaagaaggctcggccaaagaacggcaaagaatactcttctcagtcacccacatccagtagtccagagaaggtcctccttacagaactactggcatcaaacgatgagtgggtcaaagccagacaacacggtcctgatggccagggtttccctaaggccgaggagaaagcaccttccctgccctcatcgcccgagaagatggtgctgagtcagcagaccgaggattccaagtccaccgtggaggcaaagggctctatctcacagtctaaggccccggacggcccccagtctggttttcagctgaagcagtcaaaactcagctctatcaggcttaagttcgagcagggtacccatgctaaatctaaggacatgtcccaggaagatagaaaaagtgatggtcagtcaaggattcccgtgaagaagatccaggagtccaaactgccggtttaccaggtatttgcaagggagaagcaacagaaggcaatagacctgcccgacgaatcagtgtccgtgcagaaagactttatggtccttaagacaaaggacgaacacgcacagagcaatgaaattgtggtgaatgattccggctctgacaatgtgaaaaaacagcgaaccgaaatgtcttcgaaagcaatgccggatagtttctctgaacaacaagccaaggacctggcatgtcatattacaagcgacctggctacgcgcggcccatgggacaaaaaggtgtttcgcacctgggaaagtagcggtgctacaaataacaaatcgcagaaggagaagttgagtcacgtgctggtgcacgatgttcgggagaatcatataggccaccctgagagtaagagcgtagaccagaagaatgagtttatgtctgtgactgagcgcgaacgcaagctgctaaccaacggaagcctgtcggaaatcaaggaaatgacagtgaagtccccatcaaagaaggttttgtatagagaatacgtggtcaaagaaggagaccacccgggcggattgctcgatcaaccttccaggagatccgagagcagcgcggtgtcccacattcccgtgagggtggccgatgagcgccggatgctgagcagtaacatccccgatgggttttgtgaacagagtgcgtttccaaaacatgaactatctcagaaactgagccagagctctatgtcaaaggagaccgtcgaaactcagcactttaacagcatagaagacgaaaaagtcacctactccgaaatctcaaaggtgtcaaaacaccagtcttatgtcggtctgtgtccacccctggaggagaccgagacaagtcccaccaaatcaccagactcactggaattctcccctggcaaggagtctccctcgtcagatgtcttcgaccattctccaatcgacggcttggagaaacttgctccgttggcacagacagagggcgggaaagagattaagacactgccagtgtacgtctcgtttgtgcaggtgggcaagcagtatgaaaaagaaatccagcagggaggagtaaagaagattatttcccaggagtgtaagacagtgcaggaaactcggggcactttctatacaaccaggcagcagaagcagccacctagcccacagggctctcctgaagacgataccttagaacaggtaagtttcctcgattcttcgggaaaaagccccctgacaccagagacacccagcagtgaggaggtgagctacgagttcacctcgaagacgccagacagcctgattgcttacattccaggcaagccttcaccgatccccgaagtctccgaggagtccgaagaagaggaacaggcaaagagtacgtcactgaagcagactacggtcgaagaaacggccgtggaacgcgagatgcccaatgacgttagcaaagattctaaccaaaggcccaaaaataatcgcgtggcatacatagaattccccccacccccacctctggacgctgaccaaatcgagagcgacaagaaacaccattacctccccgaaaaagaggtggacatgatcgaagtcaacctacaggatgagcacgataaatatcaattggccgagcctgttatccgggtgcaaccaccctccccagtgcccccaggggccgatgtgagtgattcctcggatgatgaatctatctaccagccagtacccgtgaaaaaatatacgtttaaactgaaagaggtcgatgacgaacaaaaggagaaaccgaaagcctctgcagagaaagcctctaatcagaaagaacttgagtcaaatggaagtggcaaggacaatgaattcgggctgggattggactcccctcagaatgaaatcgctcagaacggcaataacgaccagtcaatcaccgagtgttccatcgctaccaccgcagaattctcacatgacacagacgctaccgaaatagatagcttagatggatacgacttacaggatgaagacgatggtctgaccgagagcgattctaagctgccaattcaggcaatggagatcaagaaggacatctggaacacggaaggaattcttaaacctgccgaccgctcatttagtcagagcaagctagaggtgattgaggaagaggggaaagttggtccggacgaggataaacccccctctaaaagctcgtctagcgaaaagactcccgacaagaccgaccagaaatctggtgctcagttctttactctcgagggtcgccatccagacaggtctgtattccccgatacttatttcagctacaaagttgacgaggaattcgctaccccgttcaagaccgtagccaccaaaggactcgactttgatccctggtctaacaacaggggggacgatgaggtgttcgattctaagtcgcgcgaggatgaaacgaagcccttcggactggcggtggaggacagatcacctgctacgacacctgacaccactcctgcgaggaccccgaccgatgagtccacaccaacgtccgaacctaacccctttcccttccatgagggaaaaatgtttgaaatgacacgaagcggcgccatcgatatgagcaagcgcgacttcgtcgaagagcggcttcagttcttccaaattggcgaacatacttctgagggaaaatctggcgatcaaggggagggcgacaaatcgatggtcacagccactccacagccccaatcaggtgatacgaccgtcgagaccaacttggaacggaatgtggagacacctacagtggagccaaatccttcgattcccacttctggcgagtgccaagaaggcacttccagttctggaagcctcgaaaaaagcgcagccgctacgaacacctccaaggtcgatcccaagctcagaacaccaatcaaaatggggataagtgcatcaaccatgactatgaagaaagagggaccaggagaaattacggacaagatcgaggctgtgatgacctcatgccaggggttagagaatgagacgatcactatgatctccaacactgccaatagtcagatgggtgtaaggcctcacgagaaacatgatttccagaaggacaacttcaataacaataacaatttagattctagtactatccagacagataacataatgtcgaatattgtacttacagagcacagcgcaccaacctgtaccacggagaaggacaacccggtgaaagtgtcttccggaaaaaagaccggcgttttgcaaggtcattgtgtccgcgataagcagaaggtgcttggcgagcagcagaagactaaggaactgattggaattcggcagaaatccaagctgcctattaaagccacaagccctaaggacacctttcctcctaatcatatgagtaatacaaaggcgtccaagatgaaacaggtgagtcagtcggagaaaaccaaggccttaacaacctcttcttgcgttgatgttaagtcccggataccagtcaaaaatactcaccgggacaatatcattgccgttcggaaggcctgcgcaacacagaagcaagggcagcctgaaaaggggaaggcgaagcagctgccctctaagctgccagtaaaggtgaggtccacctgcgtgactactaccactaccacagctaccaccacgacgaccaccactacaacaacaaccacaagctgtaccgtaaaagttagaaagtcccaacttaaagaagtgtgcaaacattccattgaatattttaaagggatttcaggagaaacattaaaactagtagatcgcctatctgaggaagaaaaaaaaatgcaatcagagctgtcagatgaggaggaaagtacctcccgcaacaccagcctgtcggagacaagccgggggggccaaccatcagtgactaccaaatctgcccgagataaaaaaacagaagctgccccgctgaagtcaaagagcgagaaggctgggtccgagaagaggagctcaaggaggactggcccgcagtctccatgcgaaagaacggacatccggatggcaatcgtggcagatcatttgggtctgagttggactgaactggctcgagaacttaacttctcagtcgacgagataaaccaaatcagagtggagaacccaaattcccttatttcccaaagctttatgctgcttaaaaagtgggtaacaagggacggcaagaacgcaacaacagacgcactcacgtcagtgctgactaagatcaataggattgacattgtgaccctgctggagggcccaatcttcgattacggtaacatatccggcacccgttctttcgcagatgaaaacaatgtttttcacgacccggttgatggctggcagaatgaaacctctagtggaaatcttgaatcgtgtgcgcaggcccgcagagtgaccggtggtctgctcgacaggttagacgattcgcctgatcaatgccgagacagtattacatcgtatctaaagggagaagcagggaagttcgaggcgaacggctctcacactgagatcaccccagaagcgaagactaaatcttactttcccgagtctcaaaacgacgttgggaaacaatctaccaaagagacgcttaaacctaaaattcacggatcaggacacgtggaagagccagcctcccctttagccgcctaccagaaaagcctggaagaaactagtaagttaatcatcgaggagacaaagccctgcgtaccagtttccatgaaaaagatgtctcgcacctctccagccgacgggaaacccagactctcccttcacgaggaggagggtagttcgggctccgagcagaagcaaggcgagggcttcaaggtgaagacgaagaaggagattagacacgttgagaaaaaaagccatagttag

SEQ ID NO: 179020 - DNA, 3006 bp, Artificial Sequence
  Description of Artificial Sequence: Synthetic coding sequence
atggccctgccccagagcgaggacgccatgaccggcgacaccgacaagtaccttggtccacaggatctgaaagagcttggagacgactctctcccggctgaaggttacatgggattttctcttggggccaggtcagctagtctgagatccttcagttctgacagatcatatacactgaatcggagtagctacgcccgagactcaatgatgatagaagaattactggtcccttcaaaggagcagcatctgacctttactagagagtttgattcagattcactaaggcactactcatgggccgccgacaccctggataatgtgaacttagtgtcttcccccattcactctggctttctcgtctcatttatggtggacgcaagagggggttctatgcgaggtagccggcatcatggaatgcgcatcataatacctccccgcaagtgtacagcacctaccagaatcacgtgccggctcgtgaaaagacataaacttgctaacccaccacccatggtcgagggtgagggcctggcttccagactggtggagatgggcccggccggtgcgcagttcctgggtcctgtgatcgtcgagatccctcattttgggagcatgagaggtaaggagagggagctcatcgttttacggagtgagaatggagagacatggaaagaacatcagttcgatagcaagaacgaggacctcacagagctcctcaatggaatggatgaagagctggatagccctgaagaactaggcaagaagaggatatgccggattatcactaaggatttcccacagtacttcgccgtggtctcacgcataaagcaggaatccaatcagatcggcccagagggtggaatcctatccagcaccactgtgcctttggtccaggcaagcttcccagagggcgcgctaactaagcggatccgcgtcggactgcaggctcaaccagtaccggacgaaattgtcaaaaagatattgggcaataaggccactttctcccctattgttactgttgaaccacggcgcaggaaattccacaaaccaatcacaatgaccattcccgttcccccaccatctggcgagggagtcagtaatggatataagggtgatacaaccccgaacctcagattgctgtgttccatcacaggtggcacatctcctgcccagtgggaggatatcactggcactacaccactgacattcatcaaggattgcgtcagtttcaccaccaatgtttctgcacgcttctggctcgcagactgtcatcaggtgctcgagaccgttggcctcgcaacgcagctgtatcgggaattgatctgcgtgccctatatggcaaaattcgttgtgttcgccaaaatgaatgacccagtggagtcatcactgcgatgtttttgcatgaccgacgacaaggtggacaagaccctggaacagcaggagaatttcgaagaagtggcccggagcaaggatatcgaggttctggaaggcaaacctatttatgttgattgttacggtaatctggctcccctgactaaaggtggccagcagctggtattcaacttttactcatttaaggagaaccgcttacccttctcaatcaagattcgagacacttcacaggagccatgcgggagattaagcttcctgaaagaacccaaaactaccaagggactccctcagactgccgtgtgtaatcttaacattaccttgcctgctcacaagaagatcgagaagactgacagaaggcaaagctttgcaagcttagctctaaggaaaagatactcgtacctgactgaaccaggcatgagtcctcagagtccttgtgagagaaccgacataagaatggcgatcgtggcggaccacctaggactgtcctggaccgagttggcccgcgaactgaacttttcagtcgacgaaattaaccagatacgggtggagaatcccaactcgctcatctcccagagctttatgctgctcaagaaatgggtgaccagagatggtaagaatgctactacagatgcactcacatctgtcctgaccaaaattaacaggattgacatcgtcactttgctcgagggaccgatttttgactacggcaacatctccggcaccaggtcttttgccgacgagaacaacgtctttcatgatccagtagacggctacccatcccttcaggtagagctggagactcctactggtttgcactacacacccccaacccccttccagcaggacgattacttttcagatatttcctccattgaatcgcctcttcggactcctagtagactgagcgacgggcttgttccctcccagggtaacattgagcactccgcagacggtccacccgtcgtgaccgctgaagacgcgtcactggaggatagtaagctagaggactccgtgccccttaccgaaatgccagaagctgtagatgtggatgagagccagctggagaatgtctgcctgtcctggcagaacgagacaagcagcggcaacctggaatcttgtgcacaggccaggcgtgtgactggcggcctcctcgaccggcttgacgacagtcccgaccagtgtcgcgattctatcacatcttatctgaagggcgaggcaggaaaattcgaagccaacggatctcacaccgagataaccccagaggccaagacaaaatcttatttccccgaatcacaaaacgacgtgggtaagcagtctacaaaagaaaccttgaagccaaagatacacggatctggccacgtagaggagcccgcttctcccctcgctgcctatcagaagtctctcgaggagacctctaagctcattattgaagagacgaaaccttgcgtgcctgtttccatgaaaaaaatgtcacggacttcccccgcggatggcaaaccgcgtctgtccctgcatgaagaggaagggtcaagtgggtctgagcagaaacagggagagggcttcaaagtaaagactaagaaggaaatccgtcacgttgaaaaaaaatctcacagttag

SEQ ID NO: 179021 - DNA, 3306 bp, Artificial Sequence
  Description of Artificial Sequence: Synthetic coding sequence
atgagcgaggagcccaaggagaagaacgccaagcccgcccaccggaagaggaagggtaagaagagcgatgctaatgcttcttacttgagagctgcccgggctggtcacctggagaaagccttggactatatatccgtggttgatacactgaagatcgtgaccgaggagactatgacaactactaccgtcacggagaagcataagatgaacgtgccagaaacaatgaacgaagtcttggatatgtctgatgacgaagtcagaaaggccaacgcccccgagatgctttcagacggggagtatattagcgatgtagaagagggcgaagatgcaatgaccggagacactgacaagtacttgggcccacaggatctaaaagaactcggtgacgactctctgcccgctgaaggatacatggggttctcactcggagctagatctgcaagtctgcgctccttttcctcagatcgctcctatacactcaaccggagctcctatgccagggattccatgatgatcgaggagctcttggtaccttctaaagagcagcatctcacttttacccgggagttcgacagtgactctctgcgacattattcctgggcagctgatacacttgataacgtaaatctggtctccagtccgattcacagcggcttcctcgtctcttttatggtggatgcccggggcggctctatgagagggagccgacaccacgggatgaggattatcattcccccccgcaagtgcacggctccgactcgaattacctgtcggttggttaaacggcataagctggcgaacccacccccaatggtggagggggagggcctggctagcagactggtggaaatgggcccggccggagctcagttcctcgggcctgtgattgttgaaatcccccactttgggtccatgcgtggaaaggagcgagaactaattgtgctgagatcggagaatggcgagacctggaaggagcaccagtttgatagcaagaacgaggacctaaccgagctgttaaacggcatggatgaagaactggattccccagaggagttgggcaagaagcgtatctgtagaattatcacaaaagatttcccccaatactttgcagtggtgtcacgcatcaaacaagagtccaaccagatcggaccagaagggggcattttgtccagcaccaccgtgcccttagtgcaggcatctttccctgagggagccctgacaaagcgaattcgcgtgggcctgcaggcccagcccgttcctgacgaaatcgtgaagaagattctggggaataaggctactttttctccaatcgtaaccgtggagccacgtcgaagaaagttccacaaacccattacgatgaccatcccggtcccccctcccagcggagagggagtgagcaatggctacaaaggagatactactcccaacctgcggttgctgtgttcaatcaccggcggaactagtccagctcagtgggaagacattacagggaccacccctttgaccttcatcaaagattgcgtgtcgttcacaacaaacgtgtctgcccggttctggctggctgattgccatcaggtgctggagaccgtcggcctagcgacccagttgtacagagaattgatttgtgttccttatatggcaaagtttgtagtgttcgcgaagatgaatgaccccgttgagtcatctctacgttgcttctgtatgacagacgataaggttgacaagaccctcgagcagcaggagaactttgaggaggtggcaagatcaaaagatattgaggtcctggaagggaagcctatctatgtcgactgctacggcaatctggcccctcttacaaaaggcggccagcagcttgtgtttaacttctacagtttcaaggaaaaccggctccccttctcgatcaagatcagggataccagtcaggagccctgtgggagactgtctttcctaaaggaaccgaaaactacaaaaggtttgccacaaaccgcggtttgcaatctgaacatcacactccccgctcataagaagatcgagaagactgatcgacggcagtcttttgccagccttgctttgcggaagagatatagctatctcaccgaaccggggatgagtccccagtctccatgcgagagaactgatattcgcatggcgatcgtggctgatcatttaggcctgagctggacagagcttgctcgggagctgaacttttcagttgacgagatcaaccagattagagtggaaaatcctaattctctgatttctcagtcattcatgttgctgaagaagtgggtaactagagacggcaagaacgctactaccgatgcactgacctccgtgttgaccaagatcaataggatcgatatagtgactctcctagagggaccaatcttcgattatggtaacattagcggaactcggtcgtttgccgacgaaaacaacgtctttcacgaccctgtggacgggtacccctcactgcaggtggaattagaaactcctacgggactacactacaccccccccacaccgtttcagcaggatgattatttctctgacatttcctcaatcgaatcgccgctgcgcacaccgtctaggctcagcgatgggttggtccccagtcaaggaaatattgaacacagcgctgacggtcctccggtcgtaaccgccgaggacgcctccctggaggacagcaaattagaggacagcgtgccactcaccgaaatgcctgaggccgtcgatgtggatgaatctcagttagaaaacgtgtgtctgtcctggcagaatgaaacatcaagcgggaacctggagagttgcgctcaagccaggagggttaccggtgggctgctggaccggttggatgatagtcccgatcagtgtagagacagcataacatcttacctgaaaggggaagctggcaaatttgaagccaacgggtcccatacagagattacaccagaagccaaaaccaagagttacttccctgaatcccagaatgatgtaggaaaacagtctaccaaggagactctgaagccaaagatccacggatctggacatgtggaagagccagcctctccgctggccgcatatcagaagtctctcgaagaaacttccaaactgatcatcgaagaaaccaagccttgcgtgcctgtctcaatgaaaaaaatgtctcgtaccagcccagcggatgggaagcctaggctatcgctccacgaggaggaaggcagctctgggtccgaacagaagggggaaggattcaaggttaaaaccaagaaggaaataagacacgtggaaaaaaaatcacactcatag

SEQ ID NO: 179022 - DNA, 3387 bp, Artificial Sequence
  Description of Artificial Sequence: Synthetic coding sequence
atggccacccagggcgaccacctgaactgcgtgcagctgctgctgcagcataacgtcccagtggatgatgttacgaacgactatctgaccgccttgcacgtggccgcccattgcggccactataaggtcgcaaaggtcttgttggataagaaggccaaccccaacgcaaaggccctgaacggctttacaccacttcatattgcgtgcaagaaaaaccgaatcaaggtaatggagctacttctgaagcacggggcgagtatacaggccgttactgaatccggactcacgcctatacatgtcgccgcctttatggggcacgtcaatattgtgagtcaactcatgcatcacggggccagccccaacacaacgaatgtacggggggagaccgctctacatatggccgcccgctctggccaggctgaggtcgtgagatacctggtgcaagatggagctcaggtggaggctaaagccaaggacgatcagacccccctgcatattagtgcccgcctgggaaaggcagatatcgtgcagcagctcctgcagcagggcgctagccccaacgctgcgactacatcaggctatacccctctgcatctaagtgcccgcgaaggacatgaggatgtggccgcgttcctgctcgaccatggcgcttccctgtccattaccacaaaaaagggatttacacccctccacgtggcagccaagtacggcaagctcgaggtagccaatcttctgttgcaaaagtccgcttcacccgatgctgccggcaaaagcggcctcactcctctgcatgtggctgcccattacgacaatcagaaagtcgcacttttactgctcgatcagggtgcctcccctcacgcagccgcaaagaacggctatactccgctgcatattgcagccaaaaagaatcagatggatatcgctacgaccctgctggaatatggcgcagacgcaaatgccgttactcgccaggggatcgcctcagtgcatctcgccgcgcaggaagggcatgtcgacatggtgtccctcctacttgggcgcaacgcgaatgtaaatctgtccaacaaaagcgggctaacaccccttcacttagccgcccaggaagaccgagtgaacgttgcagaagtattagttaatcagggtgcccacgttgacgcacagactaagatgggctacactcccctgcatgttggctgccattatgggaatattaagatcgtgaatttcttattgcagcactctgcaaaagtcaacgctaaaacaaagaatggatatactcctttgcaccaggccgcccagcagggacatacacatattatcaatgtgttgcttcagaataacgcttcccctaatgaacttacagtcaacgggaataccgcactggggatcgcacggcgcctcggctacatctcagtcgtggatactctcaagatagttacagaagagacaatgacaactacgacagtgactgagaaacacaaaatgaatgtgccagagacaatgaacgaggttctggatatgagcgacgatgagggtgaggatgccatgactggtgatactgacaagtacctgggcccccaggatctcaaggaattgggggacgactctcttccagcggaggggtacatgggctttagcttaggcgctcgctctgccagtagtgatcgctcatatactttgaatcgatcctcatatgccagggattctatgatgattgaagagctgctagtgccaagtaaggagcagcatctgacatttaccagagagttcgacagtgattctttgcgacactacagttgggccgccgacacactggacaacgtcaatctggtgtcctccccaatacactctggatttcttgtgtcatttatggtggatgcccgaggaggctccatgcgtgggagtcgtcaccatggcatgcggatcataattcccccaaggaagtgtacagcaccaacgcgaattacctgtagattagtcaagagacacaagctcgccaacccaccaccaatggtggaaggggaggggctcgcaagcagactcgtggagatgggaccggccggcgctcagttcctcggaccggtgatcgttgaaatcccacatttcggaagcatgagggggaaggaaagagagctcattgtgttgcgcagtgagaatggggagacatggaaggagcatcaatttgattctaaaaatgaagacctgacagaacttctgaacggcatggatgaggagcttgacagccccgaagagctgggtaaaaagaggatttgtaggatcattacaaaggattttcctcaatattttgccgtggtgtcccgcattaagcaggagtccaaccagattggacctgaaggcggaatcctgagttccactacagtgccccttgtgcaggcttccttccccgagggggccctgaccaagaggattagagttgggctgcaggcgcagcctgtgcccgatgaaattgtaaaaaaaatcctgggcaacaaggccacattttctcctatcgttactgtggagccccgcagacgcaaattccacaaaccaataacaatgaccatccccgtgccaccaccctccggggaaggggtcagtaacggttacaagggtgatactaccccaaatttgcgacttctgtgctctatcaccggcggaacctccccagcccagtgggaagatatcaccggcacgactccacttacgtttatcaaggattgcgtgtcctttacgaccaacgtgtcagccaggttttggttggccgactgccaccaggtactcgagactgtgggcctagctactcagctgtaccgggagctgatctgtgtgccctatatggctaaatttgtggtattcgccaagatgaatgaccccgtggaatcctctctccggtgcttttgcatgacagacgataaggtcgacaagacactcgaacagcaggaaaatttcgaggaggtggcccggagcaaagatatcgaagtgcttgagggcaagccaatctacgtcgattgttacggaaatctggctccactgacgaaagggggtcaacaactagtgttcaacttttacagctttaaggagaaccggctacccttctccatcaaaattcgcgataccagccaggagccctgcggacggttaagcttcttgaaagagccgaagaccactaagggtctaccccaaaccgcagtctgcaatcttaatatcacactgccagctcacaaaaaaatcgagaaaaccgatagacgccagtcatttgctagtctcgccctcagaaagagatactcctacctcacagagcccggaatgtccgagtttcctaataccttcacgaatacatggatttttattcggagagatatttttagtatacaaaccaagttttag

SEQ ID NO: 179023 - DNA, 5544 bp, Artificial Sequence
  Description of Artificial Sequence: Synthetic coding sequence
agcgacgccaacgccagctacctgcgggccgcccgggccggccacctggagaaggcgcttgactacattaaaaatggagtcgatatcaacatttgtaatcagaatggattaaatgccctacacctggcatcaaaggaggggcatgtcgaggttgtttctgagctgctgcagcgcgaggccaacgtggatgccgcaactaaaaagggtaacaccgctcttcatatagcctctctggcagggcaggccgaggtcgtcaaggtgctggtcaccaacggtgctaacgtgaacgcccagagtcagaacggattcacaccactgtatatggccgctcaggaaaaccatctcgaagtggttaagttcctcttggacaatggcgcttcacagtcactggccaccgaagacggctttacccccttagccgtggcactccagcaaggccatgatcaggtggtgagccttctgcttgaaaacgatacgaaaggcaaagtgcgactgcccgccctgcacatcgcagcacgcaaagatgataccaaggccgcggcgcttctgctccagaatgataataatgcggatgtggagtctaaatcaggattcactccactgcacatagcagcccactatgggaatattaacgtcgccacgcttctccttaacagggcagctgcagtggacttcacggcccgcaatgatattacaccgctgcatgttgcctccaagcgaggcaatgcaaatatggtgaagctacttctcgaccgcggagctaagatcgatgctaaaactcgggatggccttacaccattacactgtggtgccagatccggccatgagcaggttgtagagatgctcctcgaccgcgcggcccccattttgagcaagacgaagaacggactgtcccctctgcatatggcaacacaaggagatcatttgaattgtgtgcaactgctgctgcaacataatgttccagtcgatgatgtgactaacgattatcttacagcactccatgtcgccgcccactgtggtcactataaagttgcgaaggtgctcctcgacaagaaagccaaccctaatgctaaggccctgaatgggttcacgcccctgcacatcgcgtgcaaaaagaataggattaaagttatggaattactgctgaaacacggcgcatccatccaggccgttaccgaaagcgggctgaccccaatccatgtggctgcgttcatgggacacgtgaacatagtgtcacagttaatgcatcacggggccagtcccaacactaccaatgtgaggggggaaaccgccttgcacatggctgcaaggtcaggacaggccgaggtggtgcgctacttagttcaggatggagcccaggtggaggcgaaggctaaagatgaccaaacgccgctgcacattagtgcccgcctcggcaaggccgacattgttcagcaactccttcagcagggggcttcccctaatgcagcaaccactagtggatacactccactccacttgagtgcgcgagagggccacgaagatgtggctgctttcttactcgaccacggagctagcttgtctataaccactaaaaaagggttcaccccccttcacgtagccgccaaatacggaaagctagaggtggccaaccttctgctgcagaaaagcgcctcacctgacgccgctgggaagagcggtctaacacctctgcatgtcgccgcccactacgacaatcagaaggtggctctgttgctcctcgaccagggggccagtccacacgccgccgccaaaaatggctacacgcctcttcatatcgctgccaagaagaatcagatggacatcgccaccacattactcgaatatggagctgacgctaatgcagtcacgcgccagggcatcgcctccgtgcaccttgctgcgcaggaaggtcacgtggacatggtgagcctcctgctcggccgcaatgcaaatgttaatctcagtaacaaatctggcctgacaccgctgcacctagcggctcaggaagatagggtgaacgttgctgaagtccttgtcaatcagggtgcccatgtcgatgctcaaacgaagatggggtacaccccactgcacgtggggtgtcactatggtaatattaaaattgtgaatttcctcctgcagcatagcgccaaggtgaacgcaaagacaaaaaatggctacacccccttgcatcaggctgctcaacagggccacacccatattattaacgtgctgctgcagaataacgcctctccaaacgagctgaccgtcaacggcaataccgcgttggggatagcccgtcggcttgggtatatctctgtcgtcgatacattaaagattgtaactgaagagaccatgacaacaactaccgtgactgagaaacacaagatgaatgtgccagagactatgaatgaagtgttggacatgtccgatgacgaagtgcggaaggcgaacgcgcccgaaatgctgtcagatggagaatatatttctgatgttgaggagggaaatagatgtacctggtataagatccccaaggtgcaagaattcacggtaaaaagcgaggatgcaatgacaggagacacagacaagtacctggggcctcaggacttgaaagaactcggcgacgatagcctgccagccgagggatacatgggctttagcttaggtgcccggtcagctagtctgaggagcttctccagcgaccggtcatataccctgaaccgatcctcttacgcccgtgactcaatgatgatcgaggagctgttggttccctccaaagaacagcatcttacatttacccgggagttcgactctgactctcttaggcactattcctgggctgcggacacattggataacgtgaatttggtatccagtccaatccatagtggcttcctggtctcgtttatggtggacgcacgaggtgggtcgatgcgggggtcacgccaccatgggatgcgaattattatcccgcctagaaagtgcacagcacctacaaggattacgtgtaggctggttaagaggcataaactggcgaacccccctccaatggtggagggtgaaggtttggcctctcgcctggtggaaatggggcctgctggagcccagtttctgggacccgttatcgttgagatccctcacttcgggagtatgagaggcaaggagagagaacttatcgtgttaaggagtgagaatggcgagacctggaaagagcaccaattcgattcaaaaaacgaagacttgactgaattactgaacggcatggacgaggagttggacagtccagaggagctggggaaaaagcgtatatgccgcattatcaccaaagacttcccacaatactttgcagtggtttcccgcatcaaacaggaaagcaatcaaattgggcctgaagggggtatcttgtcttcgaccaccgtgcccctggtgcaggcatcattccctgaaggcgccctgacgaaaagaatcagggttggtctgcaagcgcagcccgttccagacgaaattgttaagaagattcttggcaataaagctacgttctctccaatcgtgacagtggagccgcgcagacgcaaattccataaaccaattacgatgacaattcctgtacccccgccaagcggggaaggcgtgagcaacggatacaagggggacaccaccccgaacctccgcctgctctgtagtatcactggggggacgtccccagcccaatgggaagatatcaccggcaccacgccactgacatttatcaaggattgcgtatcctttaccactaacgtgtccgctagattctggctcgccgattgtcaccaggtgcttgaaactgtgggtcttgccacccagttgtatagggaactgatatgtgtgccctacatggctaaatttgtggttttcgccaaaatgaatgacccggtggaaagctcacttcgctgtttttgtatgactgacgataaagtggacaagaccttagaacagcaggaaaattttgaagaggtggcccgatctaaggacattgaggtcctggaggggaaacccatatatgtggattgttatgggaacctggctcctctgaccaagggtggccagcagcttgtgttcaacttttactcattcaaggagaacagactgcccttttccattaaaattagagacactagccaggaaccctgcggaaggctgagtttcttaaaggagccaaagactacaaagggcctcccacaaacggcagtgtgtaacctgaacatcacactgcctgcacacaagaaaattgaaaagacagatcgaaggcaatccttcgcgtcgctggccttaaggaaacggtactcatacttgaccgaacctgggatgtcaccacaatccccgtgtgagcgaacagatatccggatggcaatcgttgcggatcatctgggactctcgtggaccgaacttgcaagagagctaaacttctcagtcgatgagatcaatcagatccgtgtggaaaatcccaactcgctcataagccaaagcttcatgctactcaagaagtgggtcacacgcgacggcaagaacgcaaccaccgacgccctgacctctgtgttaactaaaattaaccgaattgatatcgtgactttgctagagggccctatcttcgactacggcaacatcagtgggaccaggtctttcgccgacgagaacaatgttttccatgatccagtggacgggtacccttctttacaggtagaactggaaactccaaccggtctgcactataccccacctacacctttccaacaagacgactacttctctgacattagctctatcgaatccccattacggactcctagcagactcagcgatgggctggtcccatcccagggcaacattgaacattccgcggatgggccacccgttgtgacagccgaagacgcctccctggaagacagcaagctcgaagattccgtgcctttgaccgaaatgcctgaggcagttgacgtggacgagagccagttggagaatgtatgtcttagctggcagaatgagacttccagcggaaacctggagagttgcgcccaggcgaggagagtgactggcggactgctggatcgcctcgacgactccccggaccagtgcagggactctataacctcctatttgaagggggaggccgggaagttcgaagcaaacggctcccacactgagatcacccctgaggccaagactaaatcatactttcctgaatcacagaatgacgtagggaagcaaagcacaaaagaaaccctgaagcctaaaatccacggcagcgggcatgtggaggagccagcttctcccttagctgcctatcagaagtcactggaggagacctcgaagttgattatcgaggaaaccaagccctgcgtgcctgtgtcaatgaaaaagatgtcccgcacttctcctgctgatggcaagcctaggctttcattgcatgaggaggagggaagcagcggttccgaacagaagcagggagaaggatttaaagtgaagaccaaaaaggaaataagacacgtcgaaaaaaagtcccattcctag

SEQ ID NO: 179024 - DNA, 3354 bp, Artificial Sequence
  Description of Artificial Sequence: Synthetic coding sequence
atggccacccagggcgaccacctgaactgcgtgcagctgctgctgcagcataacgtgcccgtagatgatgtaaccaacgactacttaaccgcacttcacgtggctgcccactgtggacattacaaggttgcaaaggtcctacttgacaaaaaagcaaatcctaacgccaaggctcttaatggctttactcccctccatatcgcttgcaagaagaaccgcattaaggtgatggagctgctgctgaaacacggggcctccattcaagcggtgaccgagagcgggctgacacccatccatgtggccgcatttatgggccacgtgaatattgtttctcagctgatgcatcatggtgcttctccgaacacaacaaacgtgcgtggagagactgcactccatatggctgcgagaagcgggcaggcagaggtggtgagatatctggtgcaagacggagcccaggtggaggccaaggctaaggatgaccagacccctctgcacatatctgctcgcctggggaaggccgatatcgtgcagcaactgctgcaacagggcgcctcgccaaacgcagctactacttctggatacactccattacacctctccgctagggaaggacacgaagacgttgcggcctttctgctggaccacggtgcgtccctttccattactactaagaaaggattcacgcctctccatgttgcggcaaagtatggcaaactggaagtggcaaacttgttgctgcagaagagtgcctctcctgatgcggctggcaagtcgggactgacccccctgcacgtcgcggcccattacgataaccaaaaagtcgccctgctacttctggaccagggtgcttccccacatgccgccgctaagaatggctacacccctctgcacatagctgctaaaaaaaatcaaatggacatcgctacaactctccttgagtacggtgccgacgccaacgccgtcacacgacaaggcatcgccagcgtgcatctcgcagcccaggaaggtcatgtagatatggtgtctctgctgttggggagaaacgcaaacgatagcgggctcactcccctccatcttgctgcgcaagaagatagggtaaacgttgcagaggtgctggtcaatcaaggcgcccatgtggacgcacagacgaagatgggatacacccctttacatgtaggatgccattatggcaacattaagatcgttaattttcttcttcagcattctgccaaagtcaacgctaaaactaaaaacggctatacccccctgcaccaagcggcacagcagggccacacccatataattaacgtactgctgcaaaataacgcgagtccgaatgagctaaccgtgaatggtaacacagcacttggcatcgctagacgattaggctacatctccgtcgtagataccttgaagatcgttaccgaagagacgatgacaactacaactgtaacagagaagcacaagatgaatgtgcctgagactatgaacgaagttttggatatgagcgacgatgaaggagaggacgctatgacaggcgacactgataagtatctcggacctcaggacctgaaggaattgggcgacgatagcctgccagccgaaggttatatggggttttctttaggagcccgatctgccagtttacgctcctttagcagcgacagatcctacacactgaataggagctcatacgcccgggactctatgatgattgaggaactgctggtgccaagtaaagaacagcacttgaccttcacacgggaatttgatagtgattccctgcgacactatagttgggctgccgacactctggataatgttaacctggttagcagtcctattcactccggctttcttgtgtcattcatggttgacgcacgcggtgggagcatgagagggtctaggcaccatggaatgcgaattatcattccaccccgaaaatgtacggcccctactcgtattacctgtcgcttggtcaagaggcacaagctggctaaccctccccctatggtcgaaggagagggcttagcctcaaggctggttgagatggggcctgccggggctcagttcctgggtcccgtcatcgtcgagatcccccacttcggcagcatgaggggtaaagagcgagagctcatagtcctgaggagcgagaatggtgagacctggaaagaacatcagttcgactccaaaaatgaggacttaaccgagcttctgaatggaatggacgaggagctggattctcctgaagaactcggaaagaaacgcatctgcagaatcattacgaaggatttccctcagtacttcgcagttgtgtcaaggattaagcaggagtctaaccagattggccccgagggtggtatcctgagtagcacgactgttccgcttgttcaagcatcctttcccgaaggtgcacttactaaacgtatccgggtaggattgcaggctcagccagtccccgatgagatcgttaaaaagatattgggtaataaggcgacgttcagtccaatagtgaccgtggaacctagaagacgcaagtttcataaacctataactatgaccattcccgttccccctccatctggagaaggtgtaagtaatggctacaagggggatactacacctaacctgcgcctgctgtgctcaatcacgggcgggacctccccggcccagtgggaagacattacaggaacgacccctttaacctttattaaggactgtgtttcctttaccaccaatgtgtctgcccgattctggttggctgactgccaccaagtcctggagactgtgggactcgccacgcagctgtaccgagagttgatttgcgtgccttacatggccaaattcgtggtattcgctaagatgaatgatccggttgagtcttctctgaggtgcttctgtatgaccgatgataaggttgataaaacactcgagcaacaggagaatttcgaggaggtagccagaagcaaagacatcgaagtcctcgagggcaagcccatctacgtcgattgttacgggaacttggcccctctcactaagggggggcagcagttagtatttaacttctactcgtttaaggagaataggctgcctttttctatcaaaatccgtgacactagtcaggagccctgtggcagactgagttttctaaaagaacccaagacaaccaaagggctccctcagaccgccgtatgcaacctgaacataacattacccgcacacaagaaaatcgaaaagactgatcgcagacagagcttcgccagcttagctttgcgcaaaaggtatagttacctgaccgaacccggtatgtcagaatttccgaacacatttactaaccttcgtgggttctcatag

SEQ ID NO: 179025 - DNA, 2436 bp, Artificial Sequence
  Description of Artificial Sequence: Synthetic coding sequence
atggccctgccccagagcgaggacgccatgaccggcgacaccgacaagtatcttggccctcaagacctgaaggaactaggtgatgactcacttccagccgaaggatacatgggcttctcactcggcgcccggtccgcatccttgcggtcctttagttctgacagaagctatacacttaatcgcagctcatacgcacgcgactccatgatgattgaggagctgttggttccgagtaaagagcagcacctgacatttacacgggagtttgattctgacagtctgaggcactattcttgggcagccgataccctggataacgtgaatctggtctccagtcctatccacagcgggtttctggtgagcttcatggtggacgccagaggagggagtatgaggggttccaggcatcacgggatgcgcattattattcctccgagaaagtgtacagctcctacaaggatcacttgccggctcgtcaagaggcacaaactcgccaacccccctcccatggttgagggagaaggcctggcatctcggctggtggagatgggccccgccggcgcccagtttctggggcccgtgattgtcgaaattccacacttcggatcaatgcgcggtaaagaacgtgaactcattgttttacgtagtgagaacggcgagacatggaaggagcaccaattcgactcgaaaaacgaggatctgacagagctgctcaatggcatggacgaggaactcgatagccctgaggaacttggtaaaaaacggatctgtcggattataactaaggacttcccacagtattttgcggtcgttagtcgaattaagcaggaaagtaatcagatcggccctgaaggcggaattctcagctcaacgactgtgcccctggtgcaggcatccttccccgaaggtgcccttacaaagcgtattcgggttggcttgcaagcacagccagtgccagatgaaattgtgaagaagattttaggaaataaggccacattttcccccattgtcaccgttgagcctcgccgccgcaagtttcataaacctatcaccatgactatcccagtgccaccaccatccggagaaggtgtctcaaacggatacaaaggcgacactacccccaatcttagactgctgtgttccatcactggaggaacaagtcctgcccagtgggaagacatcaccgggaccacacccctcacgttcattaaggattgtgtaagttttaccaccaacgtgtccgccaggttttggctagccgattgccatcaggtgctagagacggtcggcttggcaacacaactctatagggaactgatctgcgtgccatacatggccaagttcgtggtcttcgcgaagatgaatgaccccgtggagtcttcgctgcgatgcttctgcatgacagacgacaaggtggataaaaccctggaacagcaagaaaactttgaagaggtggccaggagcaaggatatcgaggtgcttgagggcaagccgatctacgtggactgttatggtaacctggcgccacttacaaagggagggcagcagttggtctttaatttctactcttttaaggaaaacagactgcccttctccatcaagatcagagatacatctcaggagccgtgtggcagactgagttttttgaaagaacccaagactaccaagggactcccacagaccgccgtgtgcaacttaaatatcactctccccgcccataagaagatcgagaagactgatagacgacagagtttcgcatcattagctctgaggaagaggtacagctatctcacagagcctggcatgagtcctcaatctccgtgtgaacgaaccgacatccgcatggctattgtggccgatcatttgggcctgtcttggacagagctggccagagagttaaatttttccgtggacgagatcaaccaaattcgagttgagaaccctaattcccttatctcccaatctttcatgctcctaaagaagtgggttaccagggatgggaagaatgctacaacggacgctctgactagtgtgcttacaaaaatcaataggatcgacatcgtcactctgctcgaggggcccatctttgactacggcaatattagcgggactaggtctttcgccgatgaaaacaacgtgtttcatgatcccgttgatggctacccatccctccaggtcgagcttgagacccccaccggtctccactatactccccccacacctttccagcaagacgactatttttcagacatcagcagcatcgagtcacctctgaggacaccctcaaggttaagtgatgggttggtcccgtcgcagggtaatatagaacatagtgcggacggccctcccgtcgtgactgctgaagatgcctccctggaggatagtaagcttgaggacagtgtaccactgaccgagatgcccgaagcggtgatgtag

SEQ ID NO: 179026 - DNA, 2796 bp, Artificial Sequence
  Description of Artificial Sequence: Synthetic coding sequence
ttcaccctggcccacgtgccccagcggggcgagaccgccctgcacatggccgcaagaagcgggcaggccgaggtagtcagatatttagtccaggatggggcgcaggttgaggccaaggccaaagatgaccaaacacctcttcatatcagtgcaagactgggaaaagctgatattgtacagcagctgctgcagcaaggtgcgtcacctaatgccgccacaacgtccgggtacactccactgcatttgagtgcaagagagggccacgaagatgtcgcagcctttttactggaccacggtgcaagcctgagtattaccaccaagaaagggttcactccacttcacgtggctgccaaatacggaaagctggaggtggccaacctgctgttgcaaaagtctgcaagcccagatgccgccggaaagtccggcctgactcccctacatgtggccgctcattacgacaaccagaaggtggcccttttactcctggatcagggtgcatcccctcacgctgccgccaagaatgggtacacgcccctacacatagctgccaagaagaaccagatggacattgccacgacacttctggagtacggggcggacgcgaatgcagtgaccaggcaaggcatcgcatccgtccaccttgcagcccaggagggacatgtcgacatggtatctctgctgcttgggaggaatgccaacgtgaacctcagcaataagtccggcctcaccccattacatctggccgctcaagaggatcgcgtcaatgtcgctgaagtcctggtgaatcaaggtgcccacgtggacgcccagactaagatgggctataccccactgcatgtggggtgccactacggcaatataaagatagtgaactttctattacagcattcagcaaaagtaaacgccaaaacaaaaaacggttatacgcccttgcatcaagccgcccagcagggacatacacacataatcaacgtgctgctgcagaataacgcatctccgaatgaactgaccgtgaacggaaatactgccttgggaatcgcccggaggctaggctacatttcagtcgtcgacactcttaaaattgttaccgaagagacaatgaccaccaccaccgtgaccgagaagcacaaaatgaatgtgcccgaaaccatgaacgaggtgctcgacatgagcgatgatgaaggcgaggacgccatgacgggcgacactgacaaatatctcgggccacaagatcttaaagagcttggagacgactcactacctgctgagggttatatgggatttagcttgggcgcgcgttcagccagccgctccttttcctcagatcgctcctacacattgaacagatcatcttacgcgcgagatagtatgatgatcgaggagttgctggtgccatcaaaagaacaacacctgacctttacaagggagttcgattctgacagcctgcggcactactcttgggcagcagataccctagataacgtgaacctggttagttctcccatccattctggttatagcagcccactgccacagtatgattcaaggtttcttgtaagtttcatggttgatgcaagaggaggatctatgcgggggtcgcgtcatcatgggatgcgcatcataatcccaccgagaaagtgtaccgctcccaccaggatcacttgccgcctggtaaagaggcataagctggcaaacccccctcccatggtggagggcgaagggttggcttcccggctggtggaaatgggccctgcgggggcacaattcttaggtcctgtgatagttgaaatcccgcacttcggatccatgaggggaaaggagagggaattgattgtgctgcggagcgagaacggtgagacctggaaagagcatcaatttgactcaaagaatgaagatctcaccgagctgttgaacgggatggatgaagaactggatagtcctgaggagctgggcaagaagcggatttgccgcattatcacgaaagactttccacaatacttcgctgtggtctcaagaattaagcaggaatctaaccagatagggcctgaggggggcattctgagttccaccaccgtacccctggtccaggctagttttccggaaggcgccctaacaaagaggatcagagtcgggttgcaggcacaaccagttcctgacgagatagtcaaaaagatactgggaaacaaggccacgttcagccctatcgtgaccgtcgaaccccgccggaggaaatttcacaaacccatcacgatgaccatccctgtcccaccccctagtggagagggggtgagcaacggttacaagggtgacactacccctaaccttagactattgtgttctattaccggtggcacctcacccgcacagtgggaggatatcacaggaacgacacccttaacttttatcaaagactgcgtcagctttactaccaatgtatccgcacgcttctggctcgccgactgccatcaggtgctggaaaccgttggactagctactcagctttatcgcgaactcatttgcgtcccatatatggctaagttcgtggtttttgccaagatgaatgatcctgtcgaaagcagccttcgttgcttctgtatgaccgatgataaggttgacaaaacgctagaacagcaggagaatttcgaggaggttgcccgttccaaagacatagaggtaccatgcagtcagaaacaggtgcacttcattacatatagtagatacgaggttttattctgtggtctcaacagcacacactacaagattccctctgccctgcttatattgctgctattgtag

SEQ ID NO: 179027 - DNA, 1647 bp, Artificial Sequence
  Description of Artificial Sequence: Synthetic coding sequence
agcctgcccgagagcgaggacgccatgaccggcgacaccgacaagtatttgggccctcaggatttgaaggagctgggggacgatagtctccctgctgagggctacatggggtttagcctgggggctaggtctgccagccttagatccttctcttcagatagaagctacacattgaacaggagctcttacgcacgagatagcatgatgatcgaggagttgctcgtcccctccaaagagcagcacctgacctttacccgggagtttgattctgatagtcttcgccattacagttgggctgcggacaccctggacaatgtcaatctggtgagctctcctattcacagcggttttctggtctcttttatggtggacgctagaggagggtccatgcgcggatcacgccaccatgggatgcgcattatcatccctccgagaaaatgcacagcacccacccgcatcacctgtcgactggttaaaagacacaagctggccaaccctccgccaatggtggaaggagaaggactggcatctcgcttagtggagatgggccccgccggagctcagtttcttggccctgtgattgtggagattcctcatttcgggagcatgagggggaaggagagagagcttatagtccttcggagcgagaacggcgaaacttggaaggagcaccagttcgacagtaagaatgaggacctgaccgagttgcttaatggcatggacgaggagctcgattcccccgaggagctcgggaaaaagagaatctgtcggatcatcacgaaagatttcccacagtacttcgctgtggtatctcgcatcaaacaggagtcaaaccagatcggtccagagggcggaattctgtccagcacgaccgtccccctggtgcaggcgtccttccctgaaggagccctgactaagcgtatcagggtcgggcttcaagcgcagcccgttcccgacgaaatcgttaaaaagatccttggtaacaaagctaccttcagccccatcgtaacggttgagcccaggagacggaaattccataaacccataacaatgacaattcctgtaccgcctccaagcggtgagggagtgtctaatggatataaaggggacacaacacccaatctgagactgctgtgttccattacgggaggtacttctcccgctcagtgggaagatataacagggaccactcccctaactttcattaaggactgtgtgtcctttacaaccaatgtgtccgcacgattttggctggcggactgtcaccaagtcctcgaaactgtcggcctggcaacccagctctacagagaactgatctgtgttccttatatggcaaagttcgtcgtatttgcaaaaatgaacgacccagtggagagctctttgcgatgtttttgtatgaccgatgataaagtggataagactctcgaacaacaagagaactttgaggaggttgcacgctctaaagatatagaggttctcgaggggaagcctatttatgtcgattgctacgggaatttagcccccctgactaaagggggccagcagttggtcttcaatttctatagtttcaaggagaacagacttcctttcagcattaagatccgtgacaccagtcagaatatcgtccaactgagctgcttactttag

SEQ ID NO: 179028 - DNA, 1443 bp, Artificial Sequence
  Description of Artificial Sequence: Synthetic coding sequence
atggccgtggcccgggccgccctgggccccctggtgaccggcctgtacgacgtacaggcctttaagtttggagattttgtgctgaagtccggcttgtcttctcccatctacattgatctgcggggcatcgtctctaggcctcggttgctctcccaggtggctgatatactgtttcagactgcccaaaacgcaggcatcagttttgacacagtgtgcggcgtaccttacacggcactcccacttgcaactgtcatatgtagcacaaaccagatccccatgctcatccgcaggaaagaaactaaagactacggcaccaagagattggtggagggaacaattaacccaggggagacttgtctcattatcgaagacgttgtcacctctggtagttccgtgctcgaaacagtagaagtactacagaaggagggcttgaaggtgactgatgccattgttctgctagatcgcgaacagggaggaaaggataaactccaggctcacgggatcagactacattcagtgtgcaccctcagcaagatgcttgagatactggagcagcagaaaaaggtggatgctgagacagttggacgagtcaagcggttcattcaagagaacgtctttgtcgccgcgaatcataatgggagccccctgagcatcaaagaggcccctaaagagctttcatttggagccagagctgagcttcccaggatccatcctgtggcaagtaagctgttgcggttaatgcagaagaaggaaactaacctctgcctgtccgccgacgtgagccttgcgcgcgaactcttacagcttgccgatgccctgggcccctcaatctgcatgctcaagacacacgtggatattctcaatgattttacactggatgtcatgaaggaactcatcacacttgctaagtgccatgaatttctaatcttcgaggatcgaaagttcgccgatatagggaatacagtcaagaagcagtacgagggagggatatttaagattgcctcctgggctgatctcgtgaacgctcacgtggtgccaggctctggggtggtcaaaggactgcaagaggtaggtctcccgctgcaccggggttgtctgctaatcgcagagatgtcgtccacaggctccctggccacgggagactatacccgagccgcagtacgaatggcagaggagcactccgaatttgtggtaggctttatcagtggaagccgcgtttctatgaaacctgagttcctccacctgacccccggggtccaactggaagctggtggtgacaacctggggcaacagtataacagtccacaggaggttattggtaagagaggaagcgacattatcattgtggggcgggggataatatctgctgctgatcgtctggaagcagcggagatgtaccgtaaagccgcttgggaggcctacctctcaagactcggcgtttag

SEQ ID NO: 179029 - DNA, 1218 bp, Artificial Sequence
  Description of Artificial Sequence: Synthetic coding sequence
atggacaccagcgacctgttcgccagctgccggaagggcgacgtgggcagggttaggtacctcctcgagcaggtcctgtaccttctagctaatggtgcgcggtgtgaagcaaacacgtttgatggcgaacggtgtttgtacggggctcttagcgacccaatacggagagccctgcgcgattacaagcaccctttattatgggacctgctgtcagatcttgaggccaagtgcgagaaagtgtctgagtttgttgcttctaagcccggcacctgtgtgaaggttcttactatcgagccacctccagctgacccacgcctgcgggaagatatggccctgctagccgactgcgctctcccccccgagctacgcgcttttttctgcggtagaagtgactactttcgcgcactgcttgacgatcacttccgtgaatccgaggaaccagcaaccagtggaggcccccccgccgtaactctgcatggtatatcaccagatgtattcacccacgtcctatattacatgtactctgatcatacggagcttagccctgaagcagcatatgatgtactatctgttgcagacatgtacttactacccgggttaaagcgcttgtgcggccgatctctggctcagatgcttgacgaggacacagtggttggcgtatggagggtcgcaaagctctttcgactggcgagattggaggatcagtgtaccgagtatatggcaaaggtgatcgagaaattggtggaaagggaggattttgtggaggcggtcaaagaggaagctgcggctgtcgccgctcggcaggagacggattcaatcccactggtcgacgacattcgctttcacgtggcaagtacagtgcaaacatactccgcaatagaagaggcacaacagcggctgcgagccctcgaggatacatcaatgtgtatgaggctttgcgccgcgctcctcccagccccctgcaccctgcgggcaagctggggcgttcggggggctcagtggggattcagtagccttcacgaacccggcgacccccgaggtggatccatttgggacgagccacccccaccgaatgcgcaggcgagcccacaggatcctggcggaggacaccacagcggtaagccaggtgtgggtgtgggatttggtttgagtacattcctgctgcagattccacccactcacccatctcccaaatcttcaccactcgcactcgcttag

SEQ ID NO: 179030 - DNA, 1011 bp, Artificial Sequence
  Description of Artificial Sequence: Synthetic coding sequence
atgctggacaccaagtggaagggcaagagcgtggtggtgctgcggcacccacttataaatccagttgcgttcggcgctctgctccagtatttgtacacggggaggttagacatcggggtcgagcacgtaagcgattgcgaacggcttgcgaaacaatgtcagctgtgggacttgctgtctgaccttgaggccaagtgcgagaaggtatctgagttcgtcgcctcgaagccaggcacttgcgtgaaggtcctgacaattgagccaccccccgccgatcccaggctcagagaagacatggctcttctcgcagactgtgccctgccccccgagctgagaggggacttgtgggagttgcccttcccttgccctgatggcttcaactcttgcccagacatttgcttccgagtggcgggctgctcttttctgtgccacaaggccttcttttgtggaaggtccgattattttcgcgcactccttgatgatcattttagggaaagtgaggaaccagccaccagtggagggccccctgcggtaactctgcacgggatcagccctgatgtgttcacccatgtactgtattacatgtatagcgatcatactgagctgagccctgaggcggcttacgacgtgttaagcgtggcggacatgtacctgctgcctgggttaaaaagactctgtggtagatcccttgcgcagatgctcgatgaagatacagtagtaggcgtttggcgtgtggctaagttgttcaggttagccaggttagaagatcaatgtactgagtatatggcgaaggttatcgaaaagctggtggaaagggaagacttcgtcgaggccgtcaaggaggaggcggccgcggttgcagcccgccaggaaactgactccatcccactggtcgacgacatccggtttcacgtagccagtactgtacagacatattctgcaatcgaggaggcccaacaacgtctgcgcgccctggaggaccttttggtttccatcgggctggactgctag

SEQ ID NO: 179031 - DNA, 1011 bp, Artificial Sequence
  Description of Artificial Sequence: Synthetic coding sequence
atgctggacaccaagtggaagggcaagagcgtggtggtgctgcggcaccccctaattaaccctgttgccttcggcgctttgctccagtatctctacactggacgcctcgatattggagttgaacatgtcagcgactgtgaacgcctcgcaaagcaatgtcaactgtgggatctactatcagacttggaggctaaatgtgagaaggtgagtgaattcgtggcctccaaaccaggaacttgtgtcaaggtgctgaccatcgagccgcctcccgccgatccacgccttagagaggatatggctcttctggccgattgcgctctccctcccgaactgagaggggacctgtgggagctgccgtttccgtgccctgatggattcaatagttgtccggatatttgcttccgtgttgccggctgctcttttctgtgccataaggcttttttttgcggcagaagcgactacttccgggctttgctggatgaccacttcagggaatcagaggaacctgcaacttccggcggccctcccgccgtgactttgcatggcatctccccggacgtgttcacacatgtcctgtattacatgtattctgaccacactgaactctcccccgaagccgcttacgacgtgcttagcgtggccgatatgtaccttctaccaggtctcaagcggctgtgcggcaggtccctggcccagatgctagacgaggacaccgttgtcggagtctggcgcgttgcaaagctgttcaggctggcgcgtcttgaagaccaatgcaccgagtatatggctaaagttattgaaaaactagttgaaagagaagatttcgtggaggcggtgaaagaggaggctgccgctgtggccgcaagacaggagaccgactccattccattggtcgacgacattcggtttcatgtggcatctacagtgcagacctactctgcaatcgaagaggcacaacagcgccttcgggccctggaggatctgctggtcagtatcgggctcgattgttag

SEQ ID NO: 179032 - DNA, 1011 bp, Artificial Sequence
  Description of Artificial Sequence: Synthetic coding sequence
atgctggacaccaagtggaagggcaagagcgtggtggtgctgcggcacccgcttattaacccagtcgcctttggggcgctgctgcagtacctgtacactggccgactcgacatcggtgtcgagcatgtgagtgattgcgagagattggccaagcagtgccagctctgggatctgctgtccgacctggaagcaaaatgcgagaaggtgagcgaatttgttgcttccaaacctgggacatgcgtgaaagtattgaccatagagccaccacctgctgatccaagattacgtgaggacatggctctgctggccgactgtgccttgcctcccgaacttagaggcgatttatgggaactcccctttccctgccctgacgggttcaatagttgcccagacatttgctttcgcgtggccggctgttctttcctgtgtcataaagccttcttttgcggcaggtctgattatttcagggccctgctcgatgatcattttagggaaagcgaagaaccagccaccagtggaggcccgccggccgtaaccctgcacggaatcagcccagacgtcttcacccacgttctctactatatgtacagcgatcatacggaattatcccctgaggctgcgtatgatgtactgtcagtggcagacatgtatttattgccgggcctaaagcggttgtgtggacggtccttggcgcagatgttagatgaggatacagtagtaggcgtttggagagtggctaagctattcaggctcgcaaggttagaagatcagtgtactgaatatatggcaaaagtaatcgaaaagctcgttgagagggaggactttgttgaggctgtgaaggaagaggccgctgcagtggctgcccgccaagagaccgattcgattccccttgttgacgatattaggtttcacgtggcgtctactgtccagacatatagtgcaatcgaagaggcccagcagaggctccgcgcacttgaggatctcctggtgtccatcgggcttgattgttag

SEQ ID NO: 179033 - DNA, 2061 bp, Artificial Sequence
  Description of Artificial Sequence: Synthetic coding sequence
atggaggccagccaggagggccacctggagctggtgaagtacctgcttgccagcggagcaaacgtccacgccaccacggcaacaggcgacactgccctgacctacgcttgcgagaacggccacacggacgtggcagatgtcctgctacaggcgggcgctgacttggataagcaggaagatatgaaaacaattttagaaggcatcgaccctgcaaagcaccaggaacatgaatcggagggcgggcggacgcctttaatgaaagctgccagggctggacacctttgcactgtgcagttcctgatctctaaaggagccaatgtgaaccgagctaccgccaataacgaccacactgttgtttctttggcttgtgccggaggacaccttgcggtggtggagctgctgctcgcccatggcgccgaccccacccaccgactcaaagacggctcaaccatgttaatcgaggctgcaaaaggaggtcacacgaacgtcgtgagctatttactggactatcctaataatgtcctgtccgtcccaactacggatgtgtcacagcttcctcccccttctcaagatcagtctcaggaaccagatcgcacctctcaggagaacagccctgcactcttgggtgtgcaaaaggcagtgagcactagagtccccacagggagtaacagttcaagccagacgacggaatgccttaccccagagtcatgttcacagaccacatctaatgtggcaagtcaaagtatgccgcctgtctatccaagcgtcgatatcgacgcccacacggaatcgaatcatgacactgccctgaccctcgcgtgcgctggggggcacgaggagttagtctctgttcttattgcacgcgatgccaagattgagcacagggacaagaaagggtttacgccactgatactggcagcaacggccggacacgttggtgtggtggaaatattactggataaaggcggtgacatcgaagctcaaagtgagcggactaaagacacaccccttagcctggcatgctcggggggcaggcaggaagtagtggatctcctgctagcgcgaggcgccaacaaagagcacagaaacgtgagtgactatacccctttgtccttggcagcctctggcggatatgtgaacattatcaagattctgctgaacgcaggggccgagataaacagccgcacaggtagcaagttgggaatcagtccactcatgctggcggccatgaatggacacgtgccagctgttaaactcttattggacatggggtcagatataaacgcccagattgagacaaataggaacacagccctgaccctagcctgctttcagggcagggccgaggtcgtttcgctcctactggaccggaaggcaaacgttgaacatagggccaaaacgggcctgacgcctttaatggaagccgcttccggcggatatgccgaggtgggtcgtgtcctcttggacaaaggggcggatgtaaacgctccgcctgtaccaagcagtcgcgatacagcactgactattgctgctgacaagggtcactacaagttctgtgaactgcttatccaccgcggagcccacattgatgtgagaaacaagaagggaaacactcccctgtggttagccagtaacggcggacatttcgacgtggtacagctgctcgtccaggctggggcagatgtggatgcagcggataaccgcaagatcactcccttgatgtcagcattccgtaagggacatgtcaaggtggtgcagtatttagtaaaagaagtgaaccaatttccctctgatatagagtgcatgcgttacattgccacaattacagataaggaactcctaaagaagtgtcatcagtgcgttgagaccatcgtgaaggcgaaggatcaacaggccgcggaagccaacaaaaatgctagtatactcctgaaggaacttgacctggaaaagtctagagaggaatctagaaagcaggcattggcagccaagagagaaaagcggaaagagaagcggaagaaaaaaaaggaggagcagaagcggaagcaagaagaggatgaatag

SEQ ID NO: 179034 - DNA, 7623 bp, Artificial Sequence
  Description of Artificial Sequence: Synthetic coding sequence
atgctgaccgacagcggcggcggcggcaccagcttcgaggaggacctcgactccgtcgccccaagaagcgccccagcaggagcttccgagcctcctcctcccggaggagtgggcctcggtatacgtacggtgcggcttttcggcgaagctggcccagcaagcggggttgggagctcaggcggcggtggatccggatccggcacgggaggcggggatgccgccctcgactttaaactcgctgccgctgtcctgcggacaggtgggggcggaggggcttctggctcagacgaggacgaggtgagtgaagtggagagttttattctcgatcaagaggacctcgataacccagtacttaagacaacctcagaaatcttcctgtcatccactgctgagggcgcagacctgcggacagtggatccagagacacaggcacggcttgaggcacttctcgaggctgcagggatcgggaaactctcaactgctgatggaaaggccttcgctgatccagaagtgctgcgccgcctgacgagctccgtaagttgcgcattagacgaggcggctgcagccctcacgcgcatgaaagccgaaaacagccataacgcgggccaagtcgacacgagaagtctggccgaagcttgctctgacggcgacgtcaacgccgtccgaaagctgctcgacgaaggacgttctgtcaacgagcacaccgaggaaggagaaagcctgctgtgcctggcctgtagcgcaggatactacgaactcgcacaagttttgctggccatgcacgccaacgtggaagacagaggcaataaaggcgacataacacctctgatggccgcgtcgagcggaggctacctagacatcgtgaagctacttctgttacacgacgccgacgtaaacagccagtctgccaccggcaataccgcactgacttatgcctgcgctggcggatttgtcgacattgtcaaggtgttgctcaacgagggtgctaacattgaggatcacaacgagaacggccacacccccctgatggaagcggcctcggccggtcacgtggaggtggcaagagtcctcttagatcacggcgcaggcattaatacccacagtaacgaattcaaggagtcagctctgaccctggcttgttacaaggggcatctggatatggtgaggttcttgttggaagccggagctgatcaagagcacaagacggatgagatgcacaccgccctgatggaggcttgcatggacggacacgtggaagtcgctaggcttcttctagatagtggagctcaggttaatatgccagccgattcttttgagtcaccattgactctggcggcttgcggcggtcatgtggagctggccgcattgctcattgagcgaggagccaatctcgaggaggtcaacgacgaaggatatacccctctaatggaagccgccagagaagggcatgaggagatggtggcattgctgcttgcccaaggagcgaacataaacgcacagaccgaagagacacaagaaaccgccctgacactggcctgctgcggaggcttcagtgaggttgctgacttcctcatcaaagccggagctgatattgaacttggttgctccacccccctgatggaagcaagccaggaaggccatctagaacttgtgaagtatctactcgcctcgggggccaacgttcacgccactacagcaacaggggacacagccttgacgtacgcgtgcgagaacggccatacggacgtggctgacgtcctgctgcaggctggtgcagacctggaacatgaatcagagggaggtagaacgccactgatgaaggcagcccgggccgggcatctttgtacagtgcagttcttaatttccaagggtgctaacgtgaacagagcaaccgccaataatgaccacacagtggtttccttagcatgtgctgggggccatcttgcagtggtcgaactgctgctggcacacggggccgatcccactcataggctgaaggatggatccaccatgttaattgaagctgcaaaaggtggccacacaaatgtggtgtcgtacctgctagactatccgaataacgtcctctccgtccccaccaccgatgtttcacagctgccgccaccctcccaagaccaaagccaagtccctcgagtgcccacgcatacactcgcaatggtggtgcctccgcaggagccggatagaacgagtcaggagaattctccagcactgctgggcgtgcagaagggtacatcgaaacaaaagagctccagtctgcaggtggcagatcaggatcttctgccatcctttcatccctatcagcctctagaatgtatcgtcgaggaaactgagggcaagcttaatgaattgggccagagaatctccgcaattgaaaaagcccagttgaaatctctggagttgattcaaggggagcctctcaacaaggataagatcgaggagctgaaaaagaaccgggaagaacaggtccagaaaaagaagaaaatccttaaggaactgcagaaagttgagcgccaactgcagatgaagacacagcagcagtttactaaagagtatcttgaaactaaggggcaaaaggatactgtctcattacatcagcaatgctcacaccgcggtgttttcccggaaggcgaaggcgatggttccctgccagaagaccactttagcgagttgccacaggtcgacacaattctgtttaaggacaacgacgtcgacgatgaacaacagtccccacccagtgccgagcagatcgactttgtccccgtccaacccctatcttcccctcaatgcaacttcagcagcgatctgggctctaacggtacaaattcactcgaactgcaaaaggtgtctggcaatcaacaaatcgttgggcagcctcaaattgccatcacaggacatgaccagggcctgctagtgcaagagcctgacggactgatggtggccacaccggcccagaccttgaccgacaccctagatgaccttatcgctgctgtgagcaccagggtccccaccgggagtaattcatcaagccaaaccaccgagtgtcttacccccgagtcctgttcccaaactacctccaacgtggcctcacagagcatgcctccagtatacccctctgtagacatcgacgcacataccgagtcgaaccatgacactgctcttacattggcctgcgctggcggccatgaggagttggtcagcgttctgatagcacgagatgctaaaatcgaacatagggacaagaaaggattcactccactcatcctggccgccacagccggtcatgtcggggtggtggagattttactggacaagggaggcgacatcgaggcccaaagcgagcgtactaaggatactccattgtcactcgcttgtagcggaggtcgccaggaggtggtggacctgcttctggctcgcggggctaataaggagcataggaacgtaagcgattatacacctctgtccctcgctgcttccggcgggtacgtgaatattataaagattcttcttaatgcaggtgccgagatcaacagcagaacgggtagtaagcttggcatctctcccctgatgctcgctgccatgaatggacatgtgcccgccgttaagctcctgctggacatggggtcagatatcaacgcacagatcgagacgaatcggaacaccgcattaacccttgcctgttttcagggccgagcagaggttgtctcccttctcttggaccgcaaggccaacgtggaacaccgtgctaagaccggtcttacccccctcatggaagccgcgagcggaggctatgcagaggtggggcgggtgctactggataaaggggctgacgtaaacgctccacctgtcccttcctcacgcgacacagccctgaccatcgcagctgataaaggtcattacaaattctgcgagctgctcattcaccgcggggcacatattgatgtgagaaataaaaaaggaaacacccccctatggctggcgagtaatggcgggcattttgatgtggtgcagctcctcgtgcaggcaggagcagacgtggacgccgctgataaccggaaaattactccactcatgtctgcattccggaagggtcacgtcaaggtcgtgcaatatttggtaaaagaggtgaaccagtttcccagcgatatcgaatgtatgaggtatatcgccactatcacagataaggagctcttgaaaaagtgccatcagtgtgttgaaactatcgtgaaggccaaggatcagcaggcagctgaagccaataagaatgcaagcatcctgttgaaggagctcgacctggagaagtcaagggaggaatcaaggaagcaggctctggccgccaagagggaaaaacgcaaggaaaagaggaaaaagaagaaagaagagcagaagagaaaacaggaggaagatgaggagaataaacccaaggagaactccgagctgcccgaggatgaagatgaagaggagaatgacgaggacgtggagcaggaggtgcccattgagcctccctcggccaccacgaccactacaatcgggatttcagccacctcagcaactttcacgaacgtctttggcaaaaagcgtgccaatgtggtaacaacacccagtactaaccggaagaataaaaagaacaaaactaaggaaactcctcctaccgcccacttaatcctacctgagcaacatatgtcactggcacagcagaaagcggataaaaacaaaatcaatggcgagcccaggggtggcggcgctggtgggaactccgattcagataacctggacagtacagattgtaatagcgagtcatcatccggggggaagagtcaggagttgaacttcgtaatggacgtaaattcatctaaatatccgagcttactgttgcattcgcaagaagaaaagaccagcaccgctacatcaaaaacgcagacccgcctcgagggtgaagtgactccgaacagtctgagcacaagctacaaaactgtcagcctgcctttgtcatcacccaatattaaactgaacctgacctcccccaagaggggacagaagagagaagagggttggaaagaggtggtccgccgatcaaaaaagctgagtgtaccagctagtgtggtcagcagaattatgggacggggggggtgtaacattacagctattcaggacgttaccggtgcgcacatagacgtcgacaagcaaaaagataagaatggtgaaaggatgattaccatccgtggaggtacggagagtacacgctatgccgtccagctgatcaatgcattaatccaagacccagccaaggagcttgaggatctcatcccaaagaaccacattcgcaccccagcatcaaccaagagcatacacgccaacttcagcagcggagttgggacgactgcagcgagtagcaagaacgcatttcctcttggagcgccaacactggtgacatcacaagcgacaacactttcgaccttccaaccagccaataaactgaacaagaatgttcccactaacgtcagaagtagcttccctgtgtccctgccgctggcgtatccccacccacacttcgcccttctggccgcacaaaccatgcagcagatcagacacccacggctccctatggcccagttcgggggaacgttcagtcctagtccaaacacatgggggccctttcctgtacggcccgtgaaccccgggaacacaaattccagtccaaagcataataataccagccggctcccaaatcagaatggaactgtgttgcccagtgagtctgccggtctggctacggcctcttgtcctatcactgtgtcctcagtcgtagccgcctctcagcagttgtgtgtaaccaacacacggaccccaagctccgtgagaaaacaacttttcgcctgcgtgcctaaaacatccccccctgcgaccgttatttcctctgttacctctacctgctcctccctgccgagcgtgtccagtgcgcccatcactagcggacaggctccaactacgttcctgcccgcttccacctcacaggcccagttgagctcacagaagatggaatcttttagcgctgttccacctaccaaggagaaggtatctactcaagatcagccaatggccaacctgtgtacaccctcttccaccgccaacagttgttcctctagtgcttccaacactcccggtgctccggagacccaccccagcagctctccaacacccacatcaagcaacacccaagaagaagctcagccttcaagcgtgtctgatctgtcgccaatgtctatgccatttgcctcgaacagcgagccggccccacttacacttacctctccacgcatggtggccgcagataatcaagacacgtcaaacctaccccaactcgccgtgcctgcccctagagtgagccacagaatgcagcctagggggagcttttactccatggtcccaaacgcaactatccatcaggaccctcagtccatcttcgtaacaaacccggtgaccctgacaccaccccaaggcccacccgccgctgtgcagcttagtagcgctgtcaatattatgaacgggagtcaaatgcatatcaatcccgctaacaaaagcctcccccccaccttcggacccgcaaccctgtttaatcattttagttcgctcttcgacagcagtcaggtccccgctaaccagggatggggtgacggccctctgagctctcgcgttgcaacagacgccagcttcacagtgcaatcagcgtttctcggcaacagcgtgctcggacatctggaaaacatgcaccccgacaactcaaaggcccccggatttagaccccctagccagagagtgtccacgagccccgtggggctgcctagcatcgacccttctgggtcctcgcctagcagcagctcagcaccactggcctccttttctggaatccctgggacccgggtctttctgcaggggcctgctcccgttggcaccccaagcttcaatcggcagcactttagcccacacccttggactagtgcttccaattcttgtgattcaccaatcccttccgtaagctctgggtcctcctctccactgtctgcaacctcagctcccccaactctgggccagccaaaaggtgtgtcagctagccaagaccgaaaaatccctcccccaatcggaacggagagactcgcaaggatccgccaggggggaagcgtcgcccaggctcccgcagggacaagctttgtggccccagtgggccactctggtatttggtcgtttggggtcaatgccgtctccgagggactgtctggatggtctcagagcgtgatgggaaatcaccctatgcatcagcagcttagcgatccatccacattcagccagcaccaaccaatggaaagggacgacagtggtatggtggcaccatcaaatatcttccaccaaccgatggcgagcggcttcgttgacttctctaagggattacctatttcaatgtatggggggaccattataccatcccacccccaactcgcagacgttcccggcggtcctctgtttaacggactgcataaccccgaccccgcttggaaccctatgattaaagtgattcagaatagtactgaatgcacagatgcgcaacagtag

SEQ ID NO: 179035 - DNA, 7854 bp, Artificial Sequence
  Description of Artificial Sequence: Synthetic coding sequence
atgctgaccgacagcggcggcggcggcaccagcttcgaggaggacttggactcagtggccccaagatctgcgccggcaggtgcgtctgagccacccccacccggaggggttggactcggaatcaggaccgtgcggttatttggtgaggccggccctgcttccggcgtggggtcatcaggcgggggcggttccgggagcggaacgggtgggggtgacgccgctctggacttcaaattggcggcagctgtactccggaccggcggcgggggaggtgcatccggatctgacgaggacgaggtcagcgaggtcgaaagttttattctggaccaggaagatctggacaaccccgtgcttaagactacgagtgaaatcttcctgtccagcactgcagagggagctgatctccgcaccgtggatccggagacgcaggctcgactcgaggccttgcttgaggctgccgggatcggtaagctgagcacagctgacgggaaagcattcgcagatcctgaggtgctcaggcggctgacctcaagtgtttcttgcgccctggacgaggccgcagccgccctcacccgaatgaaggccgagaattcccataatgccgggcaggtcgacactcgatctctggccgaggcgtgtagcgacggcgatgtgaatgccgttaggaagctactcgatgaggggcggtcggtgaatgagcacacagaagaaggggagagcttgctctgcctcgcctgctcagccggatattatgagttagctcaggtgttgctcgctatgcacgctaatgtcgaggacaggggaaataaaggagatattacaccgctgatggctgcatcaagcggcggatatttggatatcgtgaaactgctcctgctgcatgacgccgacgtcaatagccagagcgccacaggcaacactgcattgacttacgcttgtgcaggaggatttgtggacatcgttaaagtgcttttgaatgagggggcaaacattgaagaccacaacgagaatggtcataccccactcatggaggctgccagcgctggccatgtcgaggtcgcccgcgtgctcttggatcacggggcgggtatcaacacccactctaacgagttcaaggaaagcgcgctaaccctggcctgctataaaggacacttagatatggtacgcttcctcctggaagccggcgccgatcaggagcacaagaccgacgagatgcatacagccttaatggaggcctgcatggatggtcacgttgaagtggccaggctgttattagattccggggctcaggtgaacatgccggccgactccttcgagtctcccctgacactcgcagcttgcggcggtcacgttgaactggcagctctgctcatcgagcggggggcaaatctggaagaggtgaatgacgagggctacacgcccttgatggaggccgctagggaaggacacgaggaaatggtggctctgctgctcgcacagggagccaacattaatgctcagacagaggagactcaggaaacagcccttacgcttgcttgctgcggaggcttctccgaggtagcggactttctcatcaaagccggagccgatatcgaattaggctgttctacacctctgatggaggcctctcaagaggggcacctggaactggtcaagtacctactggccagtggcgccaacgtccacgctacaaccgccacgggggacaccgctctcacatatgcctgcgaaaatggacacaccgacgtagccgatgtgctcctgcaggctggagcggacctggaacatgagagcgaggggggcagaacacccctcatgaaagccgccagggccggccatctgtgcacggttcaattcctcatatcaaaaggtgccaatgtgaaccgcgcgacagcaaacaacgatcacaccgtggtgtccctcgcttgcgccgggggccacctggctgtggtcgagctgttgcttgcacacggcgctgatcccacccacagacttaaagatggcagcactatgctcatcgaggcagccaaaggaggccatactaacgtggtgagctacttgctggactatccgaacaacgttctgagtgtgcctacaaccgacgtttcacagctgcctccacctagtcaggaccagagccaggtgccccgcgtgccgactcataccttggcaatggttgtgccaccacaggagccagaccggacaagccaggaaaactcccccgccctactgggcgtgcagaaaggcacctctaaacagaagtcctcctctttgcaggttgccgatcaggatctgctaccctcatttcatccctatcagcctctggaatgcatcgtggaggagacggagggcaagctcaacgagctgggacaacgaatctccgccatcgaaaaggcacagctgaagagtctggaactcatccagggagaaccgttaaataaagataaaatagaagagttaaaaaaaaaccgtgaggagcaggtgcaaaagaaaaaaaagattctcaaggagttgcagaaggttgaaagacagctgcagatgaagactcagcaacagttcactaaagagtacttggaaacaaaagggcagaaggatacagtatctctgcaccaacaatgctcccaccggggggtctttcccgaaggggaaggcgacggctccctgcctgaggaccactttagcgagctgccacaggttgacacgatcttatttaaagacaatgacgtggacgatgaacagcagtccccaccctcagccgagcagattgatttcgtcccagttcagccgctttcctccccacagtgcaatttctcatctgatctcggatcaaacggaactaactcactggagctgcagaaagttagcggcaaccagcaaattgtcgggcagccacaaatcgccattactggtcacgaccaggggctcctggtacaggagccggacgggctcatggttgccactccagcacagacacttacagacaccctggacgacttaatcgctgcggtctccactcgcgtacctaccggctcgaatagcagttcgcagaccacagaatgtctcactcctgaaagctgtagccaaacgaccagcaacgtggcttctcagtcgatgcctcctgtgtatccttcagtggacattgacgctcatacggaatcaaatcacgacactgcgctgacacttgcctgcgctggtggccatgaggagctggtgagtgtcctaatcgcaagggatgccaaaattgagcatagggataaaaaagggttcacccccctcatattagctgctacggccggccatgtgggggtcgtggaaatactgcttgataaaggcggggacatcgaggctcagagtgagcgcactaaagatacacctttgagccttgcgtgttcaggtggccggcaagaagtcgtcgatctcctgcttgccaggggggccaacaaagaacaccgcaatgtctcagactatacacctctctccctggcggcttctgggggctacgtaaacatcatcaaaatcctccttaatgccggcgcagagattaactctcgcactggtagtaaattaggcatttcgcctctcatgttggctgccatgaacggacacgtccccgccgtgaaacttttgctggacatgggatcagatataaatgcccagattgaaaccaaccgcaatacagctttgaccctcgcttgcttccagggtagagctgaggtggtctccctgctcctggataggaaagccaacgtggagcacagggccaagactgggctgactcccctgatggaggccgccagcggcggttatgccgaggtaggacgggtgctactggacaagggtgctgatgtaaatgcaccgcctgtgccgagttcacgggataccgccttgacaatcgccgccgataagggccactacaaattttgtgaattactgatccaccggggcgctcacatagatgtcagaaacaaaaagggcaatactcccctttggttagctagcaatgggggccacttcgatgtggtgcagttgctcgtgcaggccggggctgatgtagatgccgccgataatcggaagattacgcctttgatgtctgcgttcaggaagggacacgtgaaggtggtacaatacctagtaaaagaggtgaatcagtttcccagtgatattgagtgcatgagatatatcgcgacgatcactgacaaggagctgctgaagaaatgtcaccagtgcgttgagaccattgttaaggctaaggaccagcaagccgccgaggccaataagaacgcatccatcctgttgaaggaattggaccttgaaaaaagtcgggaagaaagccggaaacaggccctggcggccaaaagagagaagagaaaagagaagagaaagaagaaaaaagaggaacagaagagaaagcaggaggaagacgaggaaaacaagcccaaggagaattctgagctgccggaggatgaagatgaggaagagaacgacgaggacgtggagcaggaggtgccaatcgagcctccctccgccactaccaccaccactatcggtataagtgcaaccagtgccacattcaccaacgtcttcggcaaaaaacgggccaatgttgtgactaccccctctaccaacaggaaaaataagaaaaacaagacaaaagagacaccgcccacagcacatcttatcctgccagagcagcatatgagcctggctcagcagaaggcagataagaataaaattaacggagagccccggggtggtggcgcgggtggcaattcagacagtgacaaccttgactctactgattgcaattccgaatcatcttctggaggaaaatcccaggagctgaatttcgtgatggacgtgaacagcagtaagtatcccagcctgctgctccactcacaggaagagaaaacatccaccgccacctccaagactcagactagattggaaggcgaagtcacccctaacagtctctccacctcctacaaaaccgtgtcactccctctgtcaagtcccaatattaaattgaatcttacatccccaaagaggggccaaaagcgggaagagggatggaaagaggtcgtgaggagaagcaagaagttgtccgtcccagccagcgtggtcagcaggatcatggggcggggtggttgtaacatcacagcgattcaggacgtcactggggcccacattgacgtggacaagcagaaagacaagaacggagaaagaatgatcactattcgaggaggtactgaaagcactcggtacgcggtgcagcttataaacgccttgatccaggacccagcaaaggagctggaagacctgatccccaagaaccacatcaggacccccgcttcgacaaaatctattcacgccaacttttcctccggggttggaaccaccgccgcaagcagtaagaatgcattccctctcggggccccaacactagtcacgagtcaggcaaccaccctgagcacattccagcctgccaacaagctgaacaagaatgtgcctactaacgtccgctcttccttcccagtgtcccttccattggcctatccacacccccacttcgctctcctggctgcacaaaccatgcaacagatcaggcatcctcggctgccgatggcgcagttcggcggaaccttctccccaagccctaatacttgggggcccttccctgtgagaccagtcaatccaggtaatacgaattcgtcccccaagcacaataatacctctcggttgccaaaccagaatggaactgttttaccctccgaaagtgctgggttagcgaccgcctcatgcccaatcacggtctctagcgtagttgctgctagccagcagctgtgtgttaccaatacaaggacaccctccagcgtgcgtaaacaactgttcgcttgcgttcctaagacctccccaccggcaactgtgattagctccgtgacctctacatgttctagcctgccgtcggttagcagcgcccccatcacttcagggcaggcaccaaccacttttctgcccgcctctacttcacaggcgcagctgtcctctcagaagatggagtccttctctgccgttcctcccacaaaagagaaagtctccacacaagaccagcccatggccaacctctgcactccctcttccactgccaactcgtgctcctcaagcgccagcaatacgccgggcgcccctgagacacatcccagcagttcacctacaccaacaagcagcaacactcaggaagaagcccagccaagttcagttagcgatttgtcgcccatgtccatgccgtttgcgtccaattccgagcccgcaccgcttacactcaccagtcctcggatggttgctgctgataatcaagatacgtcaaacctgccacaacttgccgtcccagctcccagagtatctcatcggatgcagccacgcggatccttctactcaatggtcccgaatgctacaatccatcaagacccccagtcaattttcgtgacaaatcccgtgacactgacacctccgcaggggcctcccgcggccgtacagctctcaagtgccgtaaacatcatgaatggtagccaaatgcacattaatcctgccaataaaagtctgccacccaccttcggtccagctactctgttcaatcatttttcaagcctctttgacagctctcaggtcccggctaaccagggctggggagacgggccactctcctctagggtcgctaccgacgccagctttactgtgcagagtgccttcctcggcaactctgtcctaggacacctagagaatatgcatccagacaactctaaggcccccggttttcgcccgccctcgcaaagagtatccacctcgccagtgggattaccgagcatcgaccctagtgggtcatcccctagtagttcttctgcacctcttgcatcattctccgggattcccggtacccgggtattcctgcagggccccgcccccgtcgggactccctccttcaacaggcaacacttcagtcctcatccatggacctctgcaagcaattcctcgacttctgcccctccaactttgggccagcccaaaggtgtgtctgcttcacaggaccgaaagatccctcctcccattggaactgaacgactggccagaatcagacagggcggctcagtcgcccaggcaccggccggcacgtccttcgtagctccggtcggccactcggggatctggagcttcggggtcaacgccgtctccgagggcctgtccggctggagccagtccgtgatgggcaaccaccccatgcaccagcagctatcagatccaagcaccttttctcagcaccagcccatggaacgcgatgacagcggtatggttgcaccatctaatatcttccatcagcctatggcctctggattcgtagacttcagcaaaggtttgcccatttctatgtatggcggaactattattccatcacacccccaactggcagacgtgccggggggaccactgttcaatggtctgcataaccctgatcccgcctggaatcccatgataaaggtgatacaaaactccacagaatgtacggatgcccagcaagcatccctcctcccctcagtccctgctctgaagggagagatcccctcgccccaactgacgaggcccaaaaagaggattggccggcccatggttgcgtcaccaaaccagagacaccaagaccatttgcgccccaaggtgcctgctggagtgcaggagctgacccattgccctgacacgcccctgctgcccccaagcgattcccggggacataatagcagcaacagcccttcattacaggccggcggggccgagggggcgggcgatcgtgggcgcgatacgcgctag

SEQ ID NO: 179036 - DNA, 3024 bp, Artificial Sequence
  Description of Artificial Sequence: Synthetic coding sequence
atggtggccctgctgctggcccagggcgccaacatcaacgcccagactgaagagacccaggaaaccgccctcacattagcatgttgcgggggcttcagcgaggtcgccgacttcctgatcaaggctggagcagatatagaactcggatgcagcacaccactgatggaggcctctcaggaaggccacctagaactggtcaagtatctgctggcctcaggagccaacgtgcacgcgaccaccgcaactggcgataccgcgctcacttatgcctgtgagaatggccataccgatgtggctgacgttctgttacaggccggcgcggatctggacaagcaggaagatatgaaaacgatacttgagggaatcgatcctgccaaacaccaggagcacgaatccgaagggggccggacacctctgatgaaagccgctcgcgcaggccatctctgcaccgtgcagttcttgatatctaaaggagcaaatgttaaccgtgccaccgccaataatgaccacaccgttgtgagcctcgcgtgtgctggcggacacctggccgtggtggagctcctgctagcccacggggccgatcctactcacaggctcaaggatgggagcacgatgcttatcgaggcagccaaaggtggccacaccaatgtggtctcgtatctactcgactacccgaataacgtactgtccgtaccaactactgatgtctcgcaattgcctcccccgtcgcaggaccagagccaagttccccgcgttcctacccacacacttgctatggttgtgccgccccaggagccggatcggacatcacaggagaactcacctgcgttgcttggtgtgcagaagggaacaagcaaacagaagagctcctccctgcaggtggccgaccaagatctcctcccctcatttcatccttatcagcccttggagtgtattgtggaggagaccgaggggaaactaaatgagcttggtcagaggatcagcgctatcgagaaggcccagctgaagtcattggaactcattcagggcgagccacttaacaaggacaaaattgaggagctgaagaagaatagagaggaacaggtgcagaagaagaaaaagatcctcaaggagctccagaaagtcgagcgccagctccagatgaagacccaacaacaatttactaaggaatacttggaaaccaaaggtcaaaaggatacggtgagcttacaccagcagtgctctcatcggggagtttttccagagggcgaaggcgacggctcgttacccgaagatcatttcagcgaattaccgcaggtggacactattttgttcaaggacaatgatgtggacgatgaacagcagagcccaccaagcgctgaacagatcgatttcgtcccagtgcagcccctgtctagtccacagtgtaatttctcaagtgacctcggtagtaatggaaccaactcactcgagcttcagaaggtatcgggcaaccagcagattgttggccagcctcagattgcgatcacaggacatgaccagggcctactcgtccaggaacccgacggcctaatggtcgccacccccgctcagacactcacagacaccctggatgacctcatcgctgcagtgtcaactagggtacccaccggtagcaattcgtcaagtcaaacaaccgagtgtcttaccccggagtcatgttcacagacgacaagcaatgtcgcttctcagagcatgccgcctgtctatcccagcgtcgacattgacgcccacaccgagtcaaatcacgatactgccctgacattggcctgcgctggtggacacgaagaactcgttagtgtgctgatcgctcgggatgccaagattgaacaccgcgacaaaaaagggttcaccccgcttattctggctgccaccgccggtcatgtcggtgtcgttgagatcctgttggataagggaggcgacatcgaagcacagtctgaaagaacgaaggacacaccactgagcctcgcgtgctccggagggagacaagaagttgtcgacctcctcctggcaagaggggcaaataaggagcatcggaacgtgtccgactacacgccactttctctggcggctagtggcggttatgtgaacatcataaagatattactgaatgctggcgctgagatcaacagcagaaccggctccaaactcggaatttcccctctcatgctcgctgcaatgaacggtcacgtgccagcagttaaactccttttagacatggggtcagacatcaacgcccagatcgagactaaccgcaacacggcactgacccttgcctgtttccaggggagggctgaggtggtgtcgctattgcttgatagaaaggcgaatgtagaacatagggctaagacggggctcactccattgatggaagccgcctccggaggttatgctgaagtcggcagggtgcttcttgacaaaggtgctgatgtgaacgccccccctgtgccttcgagtagggatactgctctaacaatcgcagctgacaaaggccactacaagttctgtgaactcttaatccaccggggcgctcacatagacgtgcggaacaagaaaggcaacactccgctgtggctcgcttcaaatggcggccatttcgacgtcgtgcagctgctcgtccaagccggggcagacgtggatgccgccgacaaccgcaagatcactccactgatgagtgctttcagaaaagggcacgtcaaggtagtgcaatatctggtcaaggaggttaaccaatttcccagtgacattgaatgtatgaggtacatcgccaccataaccgacaaggagttattgaagaagtgccaccaatgcgtggagaccatcgtgaaagcaaaggaccagcaggccgcagaagcaaataagaatgcaagcattttactcaaagagctagaccttgagaagtccagagaagagtccaggaagcaggccttggccgctaagagagaaaaacgaaaggagaagagaaaggagaaacgcggtactgagaaggaaactgggcgccgatag

SEQ ID NO: 179037 - DNA, 7629 bp, Artificial Sequence
  Description of Artificial Sequence: Synthetic coding sequence
atgctgaccgacagcggcggcggcggcaccagcttcgaggaggaccttgactccgtggcccctaggtccgcccctgccggcgcgtccgagcccccacccccgggtggcgtcgggcttggcataaggaccgtgaggctctttggcgaggccggacctgcttctggtgtgggcagctccggcgggggaggttcaggatcgggaaccggcgggggagacgcagcactggacttcaaactcgccgccgccgtcctacgtaccggaggaggtggcggggccagcgggtccgacgaggatgaggtgtccgaggttgaatcattcattctggatcaagaggacctggataatcctgtgctcaaaactaccagcgagatatttctgtcctccacagcggagggtgccgatctgcgcacagtcgaccccgagactcaggcccgcctcgaagctctccttgaagccgccgggataggaaaactttctactgcagatggtaaagctttcgcagacccagaggtgctgcgccgtctgactagcagtgtgtcttgtgccctggatgaggccgccgctgccctgacaagaatgaaggccgagaactcccataatgctgggcaggtggatacacgaagcctagccgaggcttgttctgacggtgatgtcaatgccgttaggaaacttcttgacgaagggcgctctgtcaatgaacatacagaggagggcgaatctctcttgtgtctcgcctgctccgccggatactacgaacttgctcaggtgctgctagctatgcatgccaacgtggaggaccgcggaaacaagggcgacatcacccccctcatggccgcctctagcggcggatatttagatatcgtgaagctgctcctgctacacgacgccgatgtcaatagtcagtcagcaacaggtaacacagcattgacctacgcttgcgctggcggtttcgtggacatcgtaaaggtcctcctcaacgagggcgctaatatcgaggaccataatgagaatggccatacacccctgatggaagctgcaagtgcgggacatgttgaggtggcccgggtgcttcttgaccacggggccggcatcaatacacacagcaatgaattcaaagagtctgctctcacgctcgcgtgctataagggccacctggacatggtgcgatttctgcttgaggccggagcagatcaggagcataagacagatgaaatgcacacagccctgatggaggcctgtatggacgggcatgttgaggtcgcaagactgttgttggatagcggggctcaggtaaacatgcccgctgactcttttgagtcccccttgaccctagccgcttgtggtggtcacgttgaactcgctgccttgctcatcgagcggggcgctaacctggaagaagtgaatgacgaagggtacacacctctgatggaggcggctagggagggccacgaagaaatggtggctttgctgctggcgcaaggcgccaatataaacgcccagacggaagaaacgcaggagacagcattaacactggcatgttgtgggggtttttcagaggtggccgattttttgatcaaggccggcgctgatatcgagctcggatgttccacgcctctcatggaagcctctcaagagggacatctcgaactggtgaagtacctactggcctcaggagccaatgtacatgccactactgccacaggggatactgctctgacttacgcttgtgaaaacggacacaccgacgtcgcagatgtgctcctccaggccggggcagatctcgagcatgagtccgaggggggccgcacaccactcatgaaagctgcaagagccggacatctctgtaccgtccagtttcttatatctaaaggagcgaacgtcaaccgagccactgccaataatgatcacaccgtggtatccctcgcctgtgcaggtggccacctcgcagtggtcgagttgttattagcacatggcgctgaccctacgcatcggttaaaagatggcagcaccatgttgattgaagccgctaagggcggtcacacaaatgttgtctcctacttgctggattatccaaataacgtgctgtctgtgccaaccacagacgtgtcccagctgccaccccctagtcaggatcagtcccaagttcctcgggttcctacccatactctggccatggtggtgcctcctcaggaacctgaccgcacgagtcaagaaaactctcccgctctgctgggcgtccaaaaagggacgtccaagcagaagagctcttcccttcaagtggcggaccaggatctgctgccatcctttcacccatatcagcccttagaatgcatcgttgaggagaccgaaggcaaactgaacgagctgggtcagaggatatctgcaatcgagaaagcccagttaaaatccttggagctgattcagggcgaacctctgaacaaggataaaatcgaagaactgaaaaaaaacagggaagagcaggtgcagaagaagaaaaaaatcctcaaagagctccagaaagtggagcgtcagttgcagatgaaaactcaacagcaattcacaaaggagtacctggagacaaaaggccagaaagacaccgttagtctccatcagcagtgctcacataggggcgtgttcccagagggcgaaggcgacgggtctttgcctgaagaccacttttccgaactgcctcaggtcgatacaatactcttcaaggacaatgacgtggatgatgagcagcagtctccgccctctgctgagcagattgactttgtgcccgtccagccgctgtccagcccccagtgcaatttctcgtccgacctggggtccaacggaaccaatagtctcgaattgcagaaagtgagcggaaatcagcaaatcgtgggccagccacagatcgccatcacgggccacgatcaaggcctgctcgtgcaggagcctgacggcctcatggtggctacaccagcccagaccctcaccgatacactcgacgatctgattgccgcggttagcaccagagtgccgaccggctctaatagtagctctcagactacggagtgcctgacacctgagagctgctctcaaactacgtcaaatgtcgcctcccagtcaatgcctcccgtgtacccatcagtagacattgacgctcacacagagtcaaatcacgataccgccctcacactcgcttgtgccggaggacacgaagagctcgtttccgtcctgatagctcgagacgccaagatcgaacatcgcgacaagaaaggattcaccccgcttatcctggccgccacagcaggccacgtgggagtcgtggaaatccttttggataaggggggggatatcgaggcccagagtgaaaggactaaggacacccccctgagcttggcatgctcaggcgggcgtcaagaggttgtggacctgcttctggcccgcggggccaacaaggagcatcgcaatgtgtctgattatacgccactctcactagctgcaagtggcggctacgtgaatatcataaagattcttctgaacgccggagccgagatcaatagtcggacagggtctaagttagggatcagccccctcatgcttgcagccatgaacggacacgtaccagcggtcaaacttttgctcgacatggggtctgatattaacgcccagatcgaaaccaatcgcaacaccgcactgactctggcctgcttccagggacgcgctgaggtcgtatccctcctgttagataggaaggcaaacgtggaacacagagccaagactggactgacaccattgatggaggctgcgagtggcggatacgcagaggtggggcgggtcctgcttgacaagggagcggacgtgaacgcaccaccagttccgtccagccgcgacacggccctgacaatcgcagctgacaagggccactacaaattttgcgagctgcttattcatcgtggcgctcacatcgacgtgcgcaacaaaaagggaaacacaccattgtggttggctagcaatggagggcactttgacgtagttcagctgctggttcaagccggggcagatgtggatgcagctgataaccgcaaaatcacaccactgatgtcagcttttcgaaagggacacgtgaaggtggtccagtacctagtcaaggaggttaaccaattcccctccgacatcgagtgtatgagatacatcgccaccataactgataaagaactcctgaaaaaatgtcatcagtgcgtggagaccatcgttaaggccaaagatcagcaagctgctgaggccaacaagaacgcaagtattctgctcaaagagctggacctggagaagtctcgtgaggagagtcggaagcaggccttggccgctaagagagagaaacgcaaagaaaagcggaagaaaaaaaaggaagaacaaaaacgcaagcaggaagaggatgaagagaataagcctaaagagaacagcgaattgcctgaggatgaggatgaagaggaaaacgacgaggatgtggagcaagaggttccgatagaaccacccagcgccactactacaaccactatagggattagcgcaacaagcgccacttttactaatgtgtttggcaagaaaagggccaatgtggtcaccacgcctagtactaataggaaaaacaaaaagaataaaaccaaagaaactccccctaccgctcaccttattctgccggaacagcacatgagtctagcacagcagaaggcagacaagaataaaattaatggagagcccagaggagggggcgctggggggaatagtgacagcgataacctcgatagtaccgattgcaacagcgaatctagcagtggaggcaagtcacaagagctgaacttcgtaatggacgtcaactcctccaaatacccatccctgctgctgcattcccaggaggaaaagactagtacggcaactagtaaaacccagaccagactggagggggaggtgacccctaacagtttgtcaacctcctacaaaacagtcagccttcccctctctagtcccaacatcaaactgaacttgacgtccccaaaacgcgggcagaagagggaagagggctggaaggaagtcgtgcgtcggtccaagaaactttccgtgccagcctcagtcgttagccggattatgggacgggggggatgcaatattactgctattcaggatgttaccggcgcacacatcgacgtggacaagcagaaggataagaatggggagagaatgatcacaatccgtgggggcaccgaaagcacccggtacgccgtccagttgatcaatgccctgattcaggaccctgcaaaggagctggaagatctgattccaaaaaaccacatccgcacccccgcatcgactaagagtatacacgcaaacttctcttcaggcgtcggaacaacggctgccagttccaaaaacgccttcccccttggcgccccaactctggtgacatcccaggcaacaacccttagtaccttccagcctgccaataaactaaacaaaaatgttcccactaacgtccgatcctccttccctgtgtcactcccgctggcatacccccacccccacttcgcacttctggcagcgcaaactatgcagcagataaggcaccctaggctgcctatggcgcagttcggaggtacgttcagtccatctccaaatacctgggggccattccctgtgcgaccagtcaatcctggcaacaccaattctagccctaagcataataataccagcagattgcctaaccaaaacgggactgtcctgccctcagagtcggcaggcctcgccacagcatcgtgtccgattaccgtctcttctgtggttgccgcctcccagcagctctgcgttaccaatacaagaactccttcttccgtgaggaaacagctattcgcatgcgttcccaagacatcaccacctgccacggtcatcagctccgtgacctccacttgcagttccctgccatctgtctcatcggcgcccattacatctggccaggcaccaaccacctttcttcctgcgagcacttcacaggcccagctaagttctcagaaaatggaatcattcagcgctgtgcctcctacaaaggagaaggtgtccactcaggaccaacctatggctaacctttgtactccatcttccacagcaaattcttgctctagttcagcctcgaataccccaggagcacccgaaactcatccaagttcatcccctacacctacatccagcaacactcaggaagaggctcagccttccagtgtgagcgatctttctccgatgagcatgcccttcgcttccaatagcgagccagccccactcacccttacctcaccgcggatggtggccgccgataatcaagacacctctaacctgccccagctggccgttcccgctccaagagtgtcccaccgtatgcagccgcgcggcagtttctacagcatggtacctaatgccactatccaccaggacccacagagtattttcgtcactaatcctgtgaccctgactcctccgcaaggaccacctgcagccgtccagctatcctccgccgtgaacataatgaacgggagtcagatgcatatcaatcccgcaaacaagagtttgccgcctacattcggtcccgccactcttttcaatcacttttcaagcctattcgactctagtcaagtccctgctaatcagggctggggggacggccccctgtcatcccgggtagccacagacgccagtttcaccgttcagagcgcctttctaggaaacagcgtccttgggcacctcgaaaatatgcaccccgacaatagtaaggcgccagggttcaggcccccgtcccagagggtgtctacgagccctgtcggcctgccgagcatcgacccatcaggttctagtccttcaagtagctcagccccgctcgcctcatttagcggaattccaggtacaagagtgttcctgcaggggcctgcccccgtcgggacaccaagcttcaataggcagcatttttctccacatccgtggacttcagcctctaattccagcaccagcgctccaccaaccctgggccagcccaaaggcgtgagcgctagccaggacagaaaaatccccccacctattggaaccgagcgattggcacggatccgacagggaggatctgtcgcccaggcacctgccgggaccagtttcgtggctccggtgggacattctggaatttggtccttcggggtgaacgcagtgagtgagggattatccgggtggtctcagtctgtcatggggaaccatcctatgcatcagcagctgtcagaccctagcacattctctcagcatcagcccatggaacgagacgacagtggaatggtggcgccctctaacatattccatcaaccgatggctagcggttttgtcgatttttctaagggacttccaatcagtatgtatggggggacaattatcccatcccaccctcagctggccgacgtgcccggcggccccctgttcaacggactacacaatcccgaccccgcttggaacccaatgatcaaggttatccagaactctactgagtgtaccgatgcgcagcaaatctggcccgggacgtgggccccacacattggtaatatgcacctcaagtatgtcaattag

SEQ ID NO: 179038 - DNA, 1851 bp, Artificial Sequence
  Description of Artificial Sequence: Synthetic coding sequence
atgctgaccgacagcggcggcggcggcaccagcttcgaggaggacctcgattccgtcgccccccgatccgccccggccggtgcttcagagcccccacctcccggaggagttggcctgggcataaggaccgttaggctgtttggtgaggctggccctgccagcggagttggcagtagcgggggtggaggtagcggctccgggaccgggggtggggatgcagccctggacttcaagctcgctgcggcagtgctgcggacaggtggaggagggggcgcttcagggtctgacgaggacgaggtgtctgaggttgaaagtttcatcctcgaccaggaagatctcgacaatcccgtgctgaagaccacatccgaaatctttttgtctagtacggccgagggggccgacctgaggacagtggaccccgagactcaggctcgtctagaggcgcttttagaggcagcagcattcgccgaccctgaggtccttagacgcctgacttcctccgtctcgtgtgcactcgatgaggctgctgctgccctaacccgcatgaaggctgaaaattcacacaatgcaggccaggtcgatacccgctccttggccgaagcctgctcagatggagacgttaacgccgtgcgaaagctcctcgatgaagggcggagcgtaaacgaacataccgaagagggagagtccctgctgtgcctggcctgtagcgcagggtattacgaactggcacaggtgttgctcgctatgcatgcaaatgtggaagacagggggaataaaggcgacattactcccttgatggctgcttcctccggaggctatctggatatcgtcaagctgttactgctacacgatgccgatgtgaattctcagtccgccaccgggaatacggcgttgacatatgcatgtgccggagggttcgtggatatagtgaaggtgttgctcaacgaaggcgcaaatattgaagaccacaatgaaaatggacatactcccctgatggaggcagctagcgcagggcatgtggaagtcgcgcgcgtattactagaccacggggcagggatcaacacacattccaatgaattcaaggaaagcgctctgacgctggcctgttacaaggggcacctcgatatggttcgatttcttttggaggccggggcggaccaggagcataagaccgacgaaatgcacaccgccttaatggaagcttgtatggatgggcatgtcgaagtcgcacgtctcctgttagattcaggtgcccaagtgaacatgcctgccgattccttcgagtcccctctcacactggccgcttgcggaggacacgtcgagttggcagcactattaatcgagagaggggcaaatcttgaggaggtgaacgacgagggctacacccccttgatggaggccgccagagagggacacgaggaaatggtcgcccttctgctcgctcaaggtgccaatataaacgcccagacggaggagacccaggaaactgccttaaccctagcctgttgtggcggtttctctgaggttgcagattttctaatcaaagctggtgccgacatcgagctagggtgtagtacgcctttaatggaagcctcccaagaggggcacctcgagctggtcaaatacctgttggcctctggagcaaatgtccacgctactacagccactggggataccgctcttacatacgcctgcgagaacggccataccgatgtggccgacgtgctactccaggccggtgcggacctcgacaaacaagaagacatgaaaactatcttggagggaatcgatcccgctaagcaccaagttagggttgctttcgatgcttgtaagctgttgcgaaaagagtag

SEQ ID NO: 179039 - DNA, 1884 bp, Artificial Sequence
  Description of Artificial Sequence: Synthetic coding sequence
atgctgaccgacagcggcggcggcggcaccagcttcgaggaggacctggattcagtcgctcctagatctgcaccagcaggtgctagtgagcccccaccaccgggaggcgtgggcctgggtatcaggaccgtgcgtctgttcggtgaggctggtcccgcctccggcgtcggttcctctggggggggaggttctggaagtggcaccggaggaggcgatgctgccctggatttcaagttggcagccgcggtacttcgaaccggtggggggggaggagcctccggatctgacgaagatgaggtgagcgaagtggaatcgttcatactggaccaggaggacctggacaatcctgttctgaaaaccacatcagagatcttcctgtctagcaccgccgagggcgccgacctcaggactgtggaccccgagacccaggcgagactcgaggcccttctggaagcagcaggaattggaaaactgagcacagccgatggaaaggcttttgccgacccggaggtcctgagacggctgaccagctccgtgtcctgcgcgctggacgaggccgctgcagccctgacaaggatgaaggccgaaaattctcacaacgctggacaggtggacaccagatctctggccgaagcatgcagtgatggcgacgtaaatgctgtgcggaagctcctggacgaggggaggagtgtcaacgagcacacagaagagggcgagtccctcctgtgccttgcctgttccgccgggtattatgaattagcgcaggtgctgttggcaatgcacgcaaacgtggaagaccggggtaacaagggcgatatcacaccccttatggcggcttcgtccgggggttacctcgacatcgtcaaactgcttctgctgcacgatgcggacgtaaacagccaatcagctactgggaacacagcgctcacgtatgcttgtgcgggcggctttgttgatattgtcaaggtcctgctcaacgagggagcgaatatcgaggaccataacgaaaacgggcacactccactcatggaggcagcgtccgctggtcatgttgaagtggcaagggtgctactagaccatggggcgggtatcaatacgcatagcaatgagtttaaagagtcagcgctgacgctggcgtgctacaaaggtcatctggatatggtccggttcctgcttgaagcaggggcagaccaggagcataagacagacgagatgcacactgccctgatggaggcatgcatggacggacacgtggaggtggctcgactcctgttggacagcggcgcccaagttaatatgccggctgattctttcgaatcccccctgactctggccgcctgtgggggacacgtggaactggctgctctgttgattgagcggggcgctaatttagaagaagtgaatgacgaaggctatacccccctgatggaggccgcccgggaaggccacgaagaaatggtggccctcctgttggctcagggagcaaatataaatgcccagacggaggaaacacaagaaactgcactaaccctggcctgttgtggcggctttagtgaagtcgcagactttctgattaaagctggggctgatatcgaactggggtgcagcacccctttgatggaagcctcgcaagaggggcacttggagctggttaagtatttgctcgcctctggcgcaaacgtccacgctaccacggccacaggcgatacagccttaacgtacgcatgcgagaatggccacacagacgtggcagacgttcttctgcaggccggggcagacctggacaaacaggaggacatgaaaacgatcctggagggaattgatccagccaaacatcaggttagagtggcattcgacgcctgtaagctgcttaggaaagaatag

SEQ ID NO: 179040 - DNA, 4461 bp, Artificial Sequence
  Description of Artificial Sequence: Synthetic coding sequence
ccccgggtgggccggcaccggctgcggctgcgggtgcggaccatgttgacagacagcggagggggcggcaccagcttcgaagaggatttggactcagttgctccccgatccgccccagctggggccagtgagccccctccccccggtggggtaggcttaggcatcagaaccgtgcgcttgtttggcgaggctggtcccgcctccggtgtcggcagctccggaggtggaggaagcggctcggggaccgggggaggagatgcagctctcgactttaagctcgctgctgctgttctccgcactgggggcggggggggggcctccggtagtgacgaagacgaggtctcagaagttgaatcatttatcttggatcaggaagacctcgacaatccagtcctgaaaactacttccgagatcttcctaagctctaccgccgagggcgcagatttacggaccgttgaccccgaaacacaggcacgattagaggcacttctcgaggccgctgggatcggcaagctttccacagccgatgggaaagccttcgccgaccccgaggttctcagacggctgacctccagtgtgagttgcgctctggatgaagccgctgccgcactgactcggatgaaggccgaaaatagtcacaacgccggccaagtcgatactcggtcactggcagaggcctgcagtgacggcgacgtgaatgctgtcagaaagctgctcgacgaggggaggagcgtgaacgagcacactgaggaaggggaatcactgttgtgcctggcttgcagcgcaggatattacgagctggcacaagtcctgctggctatgcatgcaaacgtcgaagaccgtggaaataaaggagacatcacgcctttgatggccgctagcagtggtggctaccttgacatagtgaagttgttacttctccatgatgctgatgtgaactctcaaagtgctacgggaaatacggcgctcacatatgcttgtgctggaggatttgtcgacattgtgaaagtcctcctcaacgagggcgctaatattgaagaccacaacgagaacgggcacacgcctctcatggaggctgcctccgcaggccatgtggaagtggctcgcgtgttattggaccacggtgccgggatcaacacccattctaacgagtttaaggagagcgctctcacgctggcatgttataaggggcacttagatatggtacgattcctgttggaagccggggcagatcaggaacacaagaccgatgagatgcacaccgcactgatggaggcatgtatggatggacacgtcgaggttgctagattgctcctggactcgggggcacaagtaaacatgcccgcagattcatttgaatcgccgcttactctggctgcttgcggcggacatgtcgaactggccgccctccttatcgaaagaggggctaatttggaggaagtgaatgacgaagggtatacccctctgatggaggctgctagagagggtcatgaggaaatggtggctctgctgctcgcgcaaggggcgaacataaatgctcagactgaagagacccaagagactgctttgaccctggcttgttgtggcggcttcagcgaagtggcagatttccttatcaaggccggagccgatatcgagcttggctgctccaccccactgatggaggcatcccaagagggccacctggaactggttaaatacctgctagccagcggcgctaatgtgcacgcaactactgccactggcgatacagccctgacctacgcatgcgagaacggccacacggacgtagcagatgtgcttctgcaggcaggagccgatctggacaagcaggaagatatgaagaccattctggagggaatagatccagcgaagcaccaggagcacgagtctgagggcgggcgtaccccccttatgaaggccgctcgtgcagggcatttatgcacagttcagttccttatctccaagggcgcaaatgtgaaccgggctacagccaataatgaccacacagtggtctcactagcttgcgccggcggccacctggcagtggttgagctcttattggcacatggcgcagatcctactcacaggctgaaggatggcagtaccatgctgattgaagccgccaagggaggccataccaacgtggttagctacctgctcgattacccaaacaacgttctcagtgtgcccacaactgacgtgtcccagctgccccccccttcgcaggaccagagccaggtgccccgggtgcccacacacacgctggccatggtggtgccgccacaggagcccgacagaacaagtcaggagaactcgccagccctgctgggggtgcagaaaggtacgagtaagcagaaaagctcctcattacaggttgccgatcaagatctccttccaagcttccatccttatcaaccactggagtgcatcgtggaggaaactgagggcaagctgaacgaactgggtcagaggatttcggccatcgagaaggcacaacttaagagcctggagctcatacagggcgaacctttgaataaggacaaaatcgaggaactaaagaaaaacagggaggagcaggtccagaagaaaaaaaaaattctgaaggagttgcaaaaggtcgagagacagcttcagatgaagacccagcagcaatttacaaaagaatacctggaaaccaaggggcaaaaagacaccgtgtctcttcaccagcaatgctcccaccgcggagtctttccagagggggagggggacggcagcctgcctgaggatcactttagcgaactccctcaggtcgacacaatcttgtttaaggacaatgatgttgatgacgaacaacaatcccccccgtccgctgagcaaattgatttcgttcctgtgcagcccctctcctctccacagtgcaacttctcatcggacttgggaagcaatggcaccaatagtcttgagctgcagaaagtcagtggaaaccagcagattgtcggacagccccagattgccatcaccgggcatgaccagggtctgttagtacaggagcctgatggtctgatggtcgccacccctgcccagaccctgaccgatactctggacgatctcattgccgcggtcagtacacgagtccctactggaagcaacagctctagccaaaccacggagtgtcttacacccgagtcatgcagccagacgacaagcaatgtggcatcccagtcgatgccacctgtctacccaagtgtggatatcgacgctcacactgagagcaaccatgatactgccttgacgctggcatgtgctggaggacacgaagaactggtgtcagtgcttatagcaagagatgccaaaatcgaacatcgggataaaaagggcttcaccccccttatcctcgcggcgacggccggccatgtgggggttgttgagatcttgctcgataaaggcggcgatattgaggcccagagcgaacgtacgaaggatactcctctcagccttgcttgtagtggcggtcggcaggaagtggtggacttattgctcgctagaggagccaacaaagagcataggaatgtctcggactatacacccctctctctggcagcctccgggggttacgttaacattataaagatactcctcaatgccggcgcagagatcaattcacgaacaggtagcaaattagggatatcaccgctgatgttagccgccatgaatgggcacgtgcctgcggtgaagctgctgctagacatgggtagtgatataaacgcccagatagagaccaataggaacacagcactgactctggcctgctttcaaggccgcgcagaggtggtgagcctgctactggacagaaaagcaaatgtggagcaccgggccaaaaccggactgacccctctcatggaggctgcttctgggggatacgcagaggtagggcgcgttctgctggataagggcgcagatgtgaatgccccccccgtgccaagctctagggacacggcgctaacaatcgcggcggataaggggcactacaagttctgtgagcttctgatccatcggggggcgcatatcgacgtaagaaataaaaagggcaacacccctctttggctggcaagcaatggaggccacttcgacgttgtacaactgctggtgcaagcaggcgcggatgtcgatgcggccgacaatcggaagatcactcctctaatgagcgcgtttaggaaggggcatgtcaaagtagtccaatacctcgtgaaggaagtgaatcagttcccatccgacatagaatgcatgaggtatatcgcgacgattactgacaaagagttactcaaaaaatgtcaccagtgtgtcgagaccatcgtcaaagctaaggaccagcaagcagcagaggccaataagaatgccagcattctgctgaaagagctggacttggaaaaaagcagagaggagtcccgaaaacaggccctggcggccaaacgctag

SEQ ID NO: 179041 - DNA, 1863 bp, Artificial Sequence
  Description of Artificial Sequence: Synthetic coding sequence
atgagcctggcccagcagaaggccgacaagaacaagatcaacggcgagccccgtggcgggggggctggtggcaattctgactctgacaatttagattctacggactgcaactcagaatcaagctcgggcgggaaatcccaggagctgaacttcgtgatggatgtcaacagtagtaaatatccatcactgctgttgcactcacaggaggagaagacaagtactgctacttctaagactcaaactagacttgaaggcgaggtgacgcctaacagtttgagcaccagttataaaaccgtgtctctgccactgagttcacccaatatcaaactgaacctgacctcgcctaagcgcggccagaagagagaagaaggatggaaggaagtggtccggcgctcaaaaaagctgagtgtcccagcctccgtcgtgagtcggatcatgggaaggggagggtgcaacatcacggccatccaggatgttaccggagcgcacattgacgttgataaacagaaggataaaaatggcgaacgcatgatcaccattagaggcggaactgagagtacaaggtacgctgtgcaactgatcaatgctttgatacaggatccggcaaaagaactggaagacctgattccaaagaatcatatccgtacacctgcatccacgaaatccatccatgccaatttttcctcaggcgtgggtaccacagccgcctcttccaagaatgccttccctctgggggcacccaccttagtgacttcacaggctacgactctcagtaccttccagcctgccaacaaacttaacaagaacgtccccaccaatgtacgatccagtttccctgtctccttgccactcgcctaccctcaccctcatttcgccctcctggccgcccagacgatgcagcagatccgccacccccgtttgccaatggcccagttcggtggaacgtttagtccttcacctaacacatggggtcctttccctgttcggcccgttaacccaggaaacacaaacagttctcctaaacataacaacacttcccgacttccaaatcagaacggtacggtgttgccttcagagagtgctggactggctaccgctagttgccccattacagtgtccagtgtagtagcggcgagccagcagctgtgtgttacaaacaccaggaccccctcgagcgtcagaaaacagctgtttgcctgcgttcccaaaacttcacctcccgcgactgtgatcagcagtgtgacaagcacatgttcctctctgccaagcgttagctccgctccaattaccagcggacaggcacccaccacttttctccctgctagcactagtcaggctcagctcagttcccagaagatggaaagcttttccgcagttccccccacaaaagagaaagtctccacccaagaccagccaatggccaacttgtgtaccccttcctcaactgccaatagttgctcctcgtccgccagcaacacaccaggagcccccgaaacccatcccagctcctcccccaccccaacctcaagtaacacccaggaggaagcacagccatcatccgtatctgacttatctcctatgagcatgccatttgccagcaattccgagcccgcaccgcttactctcacctcccctcgaatggtggcagccgataaccaggacacttcgaatctaccccaattagccgtacccgcccctagggttagtcataggatgcagcctcggggaagcttttatagcatggtgccgaatgccaccatacatcaagacccgcagtcaatcttcgtcactaaccccgttacactttgggaagccgaagcctcaggactgcacgaggtgaggagccttcggcaggcatggtag

SEQ ID NO: 179042 - DNA, 2601 bp, Artificial Sequence
  Description of Artificial Sequence: Synthetic coding sequence
atggacgtgaacagcagcaagtaccccagcctgctgctgcacagccaggaggaaaagacctccaccgctaccagtaagacccagacacggctggaaggcgaggtgactcccaacagtctgagcacaagttacaagacagtcagtctgcccctatcatcaccaaacatcaagctaaacctgacttcaccaaaaagggggcagaagagagaggagggatggaaggaggttgtccgccgtagcaagaagctgagcgtcccagcgagcgtggtgtcgcgtattatgggtagaggagggtgcaatattactgctatccaagatgtgacaggggctcatatcgacgtggacaagcaaaaagacaagaatggcgaacggatgattacaattaggggagggaccgagtccacgaggtatgccgtgcaactgatcaatgctttgatccaagatccagctaaggaattagaggacttaatccctaagaaccacatccgcacccctgcctctactaaatctatccatgctaatttctcttctggcgtcggaaccactgccgcgtcctccaaaaatgccttccctctcggcgcacctacccttgtgacatcgcaggctacaaccctgagcaccttccagccggccaataagcttaacaagaacgtgccaacaaacgtccgctcctcttttcctgtcagcctgcccctggcctacccccaccctcacttcgcacttctggctgcccaaactatgcagcagattcggcacccacgtctgcccatggctcagtttgggggaactttcagccctagccccaacacgtggggcccgttccccgtgagaccagtcaaccccgggaacacaaactcatccccaaagcacaacaacactagcagactgcctaatcagaacgggactgtgcttccctctgaaagcgcaggcttagcaaccgccagttgccccatcaccgtcagctctgtggtcgcagccagccagcaactctgcgttactaatacccgtaccccatcaagcgtgcgaaagcaattatttgcgtgcgttcccaaaaccagcccccccgccacagtgatttcgtctgtaacctctacatgtagttctcttccatctgtctcttctgcacccatcacatccgggcaggccccaaccaccttcttgcctgcctcaaccagtcaggctcagctgtcttctcagaagatggagagcttctcagccgtgccacctactaaggaaaaagtcagcacacaagaccaaccgatggccaatctatgtactccttcctccaccgcgaactcttgttcatctagtgcctcgaacacccccggggcacccgagactcaccccagcagttccccaacccccaccagctctaacacacaggaggaggctcagccctccagtgtgagtgacctttcaccaatgtccatgccatttgcgtccaattccgagcctgcccctctcacactgacatcgccacggatggtggcagctgacaaccaggatacctctaatctgccacagttggctgtgcccgccccccgcgtgagccatcggatgcaacctcgtggcagcttctacagtatggtgccaaatgccacaattcatcaggacccacaatccatttttgttactaatcccgtgaccctcacccctcctcagggacccccggctgccgttcaactgtcctccgccgtcaacataatgaacggaagtcagatgcacattaatcccgctaacaagtccctcccacctactttcgggccagctacattgttcaatcatttcagcagcttgtttgatagttctcaggtccccgctaatcaaggatggggcgacgggccactgagctccagagtcgccacggatgcatccttcaccgtgcagagtgccttcctgggcaactctgtcctggggcaccttgagaacatgcaccctgacaactcgaaggcacccgggtttcggcctccaagtcagcgtgtttctacatcacctgtagcgaccagcgccccccccacactgggccaaccaaagggcgtgagcgccagccaagaccgtaagattccacctcctatagggaccgaaaggctggctagaattagacaaggaggctccgtagcccaggcccccgcagggacctcatttgttgcccccgtgggtcactccggaatctggagttttggagtaaatgccgtgtcagagggactgagcggatggtcccagagtgtaatgggcaatcatcctatgcaccaacagttgtctgatccttctaccttctcccagcaccaacccatggagcgcgacgactcaggaatggtggctccctctaacatttttcaccagcctatggcatcgggatttgttgattttagcaaaggcctccctatctctatgtatggcggaactatcattcccagccatccccagcttgctgatgtgcctggcggcccgctgtttaatggcctgcacaacccggaccctgcttggaaccccatgatcaaggtgatccagaactctacggaatgcacagatgcccagcagatatggcctggcacctgggcacctcacattggaaacatgcatctgaagtatgttaactag

SEQ ID NO: 179043 - DNA, 2298 bp, Artificial Sequence
  Description of Artificial Sequence: Synthetic coding sequence
atggccgccgaccccaccgagctgcggctgggcagcctgcccgtgttcacgcgcgacgactttgagggcgattggcggctggtggcatccggcggattctctcaagtttttcaggcacggcatcgccggtggcggaccgagtacgctataaagtgcgcgccctgcctgccgccggatgccgcttccagcgacgtgaattacctcattgaagaagcagcgaaaatgaaaaaaatcaagttccagcatatcgtgagcatctatggagtatgcaaacagcccctgggcatagtgatggaatttatggcgaacggctccctggagaaagtgctcagcacccattctctgtgctggaaactccgctttcgaattattcatgagacaagcctcgcgatgaactttcttcacagcatcaagcctcctttgctccacctggacctaaagccgggcaatatcctcctggatagcaacatgcacgtgaaaatttctgactttggcctgtccaagtggatggagcaaagtaccagaatgcaatacattgaaaggtcagcattgagaggaatgctcagttacattcccccagagatgttcctggaatctaacaaagcacccggcccaaagtatgacgtctatagttttgcaatcgtcatctgggaactgttgacgcagaagaaaccttactctgggtttaatatgatgatgattattattcgggtggctgctgggatgcgaccgtcccttcaacccgtgagtgatcaatggccctccgaggcccagcaaatggtggatctcatgaaacgctgttgggatcaagatcctaaaaaaaggccttgcttcctcgacatcaccattgagacagacattctgctgtctctcctgcagtccagagtggctgtgcccgagagtaaggccctcgcgcgtaaagtaagttgcaagcttagcctacggcaaccgggtgaagtgaacgaggacattagtcaggaattgatggacagcgattcggggaattacctcaagcgcgccctgcaattgtctgataggaagaatctagttccccgcgatgaggagctgtgcatttatgaaaacaaagtgactcctcttcacttcctggttgcacagggatccgtagaacaggtgcggttattactagcccatgaggtggatgtcgactgtcagaccgcatcagggtacactcctctgctcattgctgcccaggaccagcagcctgacctttgcgctctactgctggcccatggtgccgatgccaaccgggtggatgaggacggctgggcaccactccatttcgccgctcaaaatggagacgatggcactgcgcgactgctcctagaccatggcgcatgcgtagatgcgcaggagcgtgaaggttggaccccgttacatctggcagctcagaacaattttgaaaatgtcgcacgcctcttagtgtcgagacaggccgaccccaacttgcacgaggctgaggggaaaacacccctgcacgtggcagcctacttcggacacgtgagtctagtgaagttgttgacatcgcaaggcgcagaactcgatgcccaacaaagaaaccttcgtacccccctccacttggctgttgagcggggcaaagtgcgcgctatccaacatttattaaagagcggcgctgtgcctgatgcattagaccagtcaggatacgggcctttgcatactgccgctgccaggggaaaatatctgatttgcaagatgctgcttcggtatggcgcatctctagagctgcccacccaccaaggctggaccccactccacctggcggcttataaaggacacctggaaattatacaccttctcgccgagagtcacgccaacatgggggcgttgggtgccgtgaactggaccccacttcaccttgcagcgagacacggagaggaggccgtagtatctgcactcctccagtgtggagctgaccccaacgctgcggaacagtcaggctggacgccactgcatttagcagtccagcgctccaccttcttatccgttatcaatcttctagagcaccatgccaatgtccacgcccggaataaggtgggctggacaccagcccatctcgctgctcttaagggcaataccgcaatcctgaaagtcctggtcgaggctggtgcacagctagacgtgcaggatggcgtctcttgcacgcctctgcaacttgctttacgctcacggaaacaggggattatgtcctttttggaggggaaggaaccctccgtagccaccctaggcggatcaaaaccaggtgctgagatggaaatctag

SEQ ID NO: 179044 - DNA, 1008 bp, Artificial Sequence
  Description of Artificial Sequence: Synthetic coding sequence
atggccgagggcggcagccccgacggccgggccggccccggcagcgccgggagaaatctgaaagaatggctgcgcgagcaattttgtgaccacccgctggaacactgcgaagacacccgtttacacgatgccgcctatgttggagatctccagaccctgcggtctttgctgcaggaagagtcgtacaggtcccggattaacgagaaaagtgtgtggtgctgcggatggttaccatgcacccccttgaggatagccgccacagccggccacggctcttgcgttgactttttgatccgcaaaggcgccgaagttgatttggtggacgtgaagggtcaaacagctctttacgtggccgttgtgaacgggcaccttgaatctacccaaatccttctggaggcaggtgctgacccaaatgggtcacggcaccaccgctctacacccgtatatcacgcttctagagtggggcgagcagacatacttaaagcactgatccggtacggggccgacgttgacgtcaatcatcatctaaccccggatgtgcaaccgagatttagtcgccggcttacatcactggtcgtctgtccgctatatatttctgcggcctaccataacctgcagtgtttcagattgctgcttctggccggagcaaacccagatttcaactgcaatggcccagtgaatacgcagggcttttatcgtggctctcccggttgcgtaatggacgcggttctccggcacgggtgtgaggccgcgtttgtgtcattgctggtagagttcggggcaaaccttaatctagtcaaatgggaatccctgggacctgaatcgcggggcaggcgtaaggtggaccccgaggcgttgcaagtgtttaaggaggcgcggagcgtgccccggacccttctgtgtctgtgccgcgtggccgtgaggcgcgctctgggcaagcacagattgcatttgattccgagtctccctctgccagatcctatcaagaagtttctgctccatgagtag

SEQ ID NO: 179045 - DNA, 909 bp, Artificial Sequence
  Description of Artificial Sequence: Synthetic coding sequence
atgctgcagctgaccggcgagaacgagaagaactgcgaggtgagcgaacgcatcaggcggtcaggcccctggaaagagataagcttcggagattatatttgccacaccttccagggagattgttgggcggatcggagcccactccacgaggctgctgcccagggtcggctattggcgctcaaaactctaattgcccagggggttaatgtgaacctcgtgacaatcaatagagtgtcatctctgcacgaagcatgtttggggggacatgtggcatgcgcgaaagctctcctggagaatggagctcacgtgaacggagtaactgtgcatggcgctacgcccttatttaacgcgtgctgctccggtagcgcggcctgcgtcaacgtcctgttggagttcggagccaaggcgcaactggaggttcacctggcgtcaccgatccatgaggctgtcaagaggggccaccgagagtgtatggagattctgctggccaacaatgtcaacatagaccacgaagttccccagttgggcacccccctgtatgtggcatgcacctaccaacgggtggattgcgtaaagaagttattggaactgggtgcatccgtagaccatggacagtggctagatactccccttcatgccgctgctaggcaaagtaacgtcgaagttatccacctgctgaccgactacggggccaatttaaagagaaggaatgcgcagggaaaaagcgcactagatctagcagcacctaagtcctccgtggagcaggctttacttttacgagagggtccccccgccttatcccagctgtgcagactctgcgtccggaaatgccttggtcgagcctgccatcaggctattcacaaactgcacttgcccgagcctctagagcggttcctcctgtatcagtag

SEQ ID NO: 179046 - DNA, 972 bp, Artificial Sequence
  Description of Artificial Sequence: Synthetic coding sequence
atggaggacggccccgtgttctacggcttcaagaacatcttcatcacaatgtttgccaccttttttttctttaaactgctcattaaggtgtttctggctctactgacccatttttatattgtgaagggaaataggaaggaggccgcacgcatcgcagaagagatatatgggggcatctccgattgctgggctgaccgttcacccctccatgaggcggccgctcagggcagactgctggccttgaagaccttgatcgcccaaggagttaacgtgaatcttgtcactatcaacagagtctctagcttgcatgaagcttgtttaggcggtcatgtggcatgcgcaaaggcccttctcgagaacggagcccacgtgaacggcgtgactgtgcacggtgctacaccgctgttcaatgcttgttgttctggctctgctgcttgcgtgaatgtgctcttagagtttggggctaaggctcagctcgaggtacatctggcttctcctatccacgaagctgtgaagagggggcatagagagtgcatggaaatcctgttggctaataacgtaaacatcgatcacgaagtgccacagctgggcacgcctctatacgttgcctgtacgtaccagagggtcgattgtgttaagaaattattggaattgggagcatcagtggaccacggacagtggctggacacccccctacatgccgcagctagacaatccaacgtggaagtgatacacttgctgactgattatggagcaaacctgaaaaggcgaaatgcgcagggcaagtccgctctggatctggctgcgccaaagtcttcagtggaacaggcgctgctgctacgcgagggtccaccggccctgtctcaactgtgtaggttatgtgtgagaaaatgccttggaagggcctgccatcaggcgattcacaaattacacctccctgaaccgctggaacgctttcttttatatcagtag

SEQ ID NO: 179047 - DNA, 909 bp, Artificial Sequence
  Description of Artificial Sequence: Synthetic coding sequence
atgctgcagctgaccggcgagaacgagaagaactgcgaggtgagcgagaggatccggcggtcgggcccttggaaagagatttccttcggggattacatttgtcacacctttcagggcgactgctgggccgatcgctctccactgcacgaagccgccgcacagggccgcttgctggccctcaagacattgatagcccagggcgtaaatgtgaacttagtcaccattaatcgcgtttcttccttgcacgaggcctgcctgggtggacatgtggcctgtgccaaggccctgctagaaaatggggcacacgtgaacggggtgaccgtccatggtgctacaccgctgtttaatgcttgttgtagtggaagcgcagcctgtgtcaacgtactcctggagttcggggctaaagcccagcttgaagttcacctggcttcccctattcacgaggctgtgaagaggggccacagggagtgcatggagattctgttggcaaataacgtgaacatagaccacgaagtgccccagctggggaccccgctgtacgtggcttgtacatatcagagggtcgattgtgtaaagaaactcctggaactgggcgccagcgtggaccacgggcagtggctcgacacccccttacacgcagctgcccgccagagcaatgttgaggtgattcacctccttaccgattacggggcaaatttaaaaaggagaaatgctcaggggaagtccgcgctggacttggccgcacctaagagcagcgtcgagcaggctctactcctgcgcgaaggaccacccgccttgtcacaactctgtcggctttgtgtgcgcaaatgccttggtcgtgcatgccaccaggcgattcacaagctgcaccttcccgaaccgttggagcgcttcctgttgtatcagtag

SEQ ID NO: 179048 - DNA, 921 bp, Artificial Sequence
  Description of Artificial Sequence: Synthetic coding sequence
atggaggacggccccgtgttctacggcttcaagaacatcttcatcaccatgtttgcgacattctttttctttaagttgctgattaaggtctttctggctctgctgacccacttctatatcgtaaaaggcaaccgcaaggaagccgctcgcatagctgaagagatttacggcggtatatctgattgttgggctgaccgatcccctttgcacgaggccgccgcccagggcagattactcgccctaaaaacactcattgcccaagcctgtctgggggggcacgttgcttgtgcaaaggccctcctggaaaatggcgcccacgtcaatggggtgacagtgcacggtgcaactcctctatttaacgcttgttgcagcggctccgcagcgtgcgttaatgtgctcctcgagtttggcgccaaggcccagctggaggtgcatctggcctcccccatccacgaggcggttaagagaggccacagagaatgcatggagattctgctggccaataacgttaatattgatcatgaggtgccacagctcggcaccccactgtatgtagcctgcacatatcagagagtcgattgtgtcaagaagctgctcgaattgggggcaagcgtggaccatggccaatggctggacacaccactacatgcggcggcacgccagtcgaatgtggaagtcatccacctgctgacagattatggcgccaacctgaaaaggcgcaacgcccagggcaagtccgcgctagacctagcagccccaaagagctctgtggagcaggctctcctgttgagagagggacctccagcgctgtcacagctgtgtagactgtgcgtgcgcaagtgtttaggtcgtgcttgccaccaggctatacataaattacacttacccgagcctctcgagcgcttcctcctgtaccaatag

SEQ ID NO: 179049 - DNA, 1764 bp, Artificial Sequence
  Description of Artificial Sequence: Synthetic coding sequence
atgacccggttcagctacgccgagtacttcagcctgttccacagctgcagcgcaccttcacggagcacggcccctccagagagctcacctgccagggcccctatgggcctctttcagggggtcatgcagaagtattcatcttcactgtttaagacatcccaacttgcccccgccgatccgttgattaaggccatcaaagatggagatgaagaggccctgaaaacaatgatcaaggagggaaagaatctcgccgaaccgaataaagaggggtggctgccactgcatgaggcagcctattacggccaggtggggtgcctgaaggttctgcagcgcgcctaccccggaacgattgatcaacgcacgcttcaggaagaaacagcggtatacttggcgacatgccgaggacacttggattgtttgttgtctttgttacaggctggagccgagcctgatattagcaacaagagccgggagacacctctgtacaaagcctgcgaacgaaagaacgctgaggccgtgaagatccttgtacaacacaacgccgacacaaaccatcgctgtaacaggggatggaccgctctccacgagtccgtgtcacggaatgacctcgaagtgatgcagatcctagtgtcgggcggggcaaaggttgagagcaaaaatgcctatgggataactccactctttgtcgccgcccaaagtgggcagcttgaggccctccgctttctggcaaagtacggggctgatataaacacgcaggcctccgataacgctagcgccctctatgaagcctgtaaaaacgagcatgaggaggtggtagaatttctattatctcagggtgcagatgctaataagaccaataaggacggactgctgccactccacattgcaagcaaaaagggcaactacagaatcgtgcagatgctgttgccagtgacaagccggactcggattaggaggtccggcgtctccccattgcacctggctgcagagcgtaaccacgacgaggttttagaggctctcctgtcggctcgcttcgatgttaacacgcctctggcaccagagagggcacgactctacgaagataggcgcagtagcgcgctgtactttgctgtggttaataataacgtgtacgccactgaattgctgctgcagcacggggcagacccaaacagggatgtgataagccccctcctggttgcaatccgacacgggtgcctcagaactatgcaattactgctggaccacggggccaatatcgacgcatatatcgctacacacccgactgccttccccgcaaccatcatgttcgctatgaagtgcctctcactcctgaagtttcttatggatctgggctgtgacggagaaccctgcttcagctgcctgtacggcaacggaccgcacccacccgcccctcagcctagctctcgcttcaatgatgcccctgccgcggacaaagagccctctgtggtgcagttttgcgaattcgtctcagcacctgaggtttccagatgggcaggacctatcattgacgttttattagattacgtgggcaatgtacagttgtgttctaggttaaaggaacacatcgattcttttgaagactgggccgtaatcaaggagaaggcagaaccaccacgcccccttgctcacctctgccgccttcgagtgagaaaagctattggtaaatataggatcaagctgctcgataccctccctctgccaggcaggcttataagatacctcaagtacgaaaatacccagtag

SEQ ID NO: 179050 - DNA, 1812 bp, Artificial Sequence
  Description of Artificial Sequence: Synthetic coding sequence
atggccatcgagcagagcctggccgacaagacccggggccccaccaccgccgaggcaactgcaagtgcctgcaccaaccgccagcctgcgcacttttacccgtggacccgctcaacggctccaccagagtcctccccagcccgtgctcctatgggactgttccagggagtcatgcagaagtacagcagctctttgttcaaaacctctcagttggcacctgctgaccctctcataaaagccataaaggatggcgacgaggaagctttgaaaaccatgataaaagagggtaagaacctcgcagagccgaataaggagggttggttgccattacacgaggctgcttactatggccaggtcggctgcctcaaggtgttacaacgcgcgtatcctggtaccatagaccagcgcacgttgcaagaagaaactgcggtttacctagcgacgtgtcggggacaccttgattgcctgctgtctctgctccaggctggggctgaacctgacatctcaaacaagtctcgcgagacccccctttataaggcctgtgaaaggaagaacgcagaggctgtgaagatcctggtacagcacaatgccgatactaaccatagatgtaacagaggttggacagccctccacgaatccgtgagtcgcaacgatctggaggtaatgcagattctggtctccggtggtgctaaggttgaatccaaaaacgcatacggaatcactccattgtttgtcgccgcccagtccggacagctggaggcgctgaggtttctggctaaatatggagccgacatcaatactcaggcctccgacaatgcttcagctttgtatgaggcatgcaagaatgaacatgaggaggttgttgagttcctccttagccaaggggccgatgcgaacaaaaccaataaggacggtctgttgcccctgcacatcgcgtccaaaaaggggaactaccggattgtgcagatgcttctgcctgtgacaagtaggactcggattcgcagatctggcgtgtccccccttcacctggccgccgagcgaaaccatgacgaggtgctggaagcactgttgtcagctaggttcgatgtgaacacacctctggccccggagagagcccgtctgtacgaggatcgaaggtcaagtgcactgtacttcgccgtggtcaacaataatgtgtacgctacggaacttctgctacagcacggcgccgacccaaatagggatgtcatcagccctctcctcgttgccatcaggcatggatgcctccggaccatgcaactgcttttggaccacggagccaacattgacgcttatattgccacacatcctacagctttccctgccactattatgtttgcaatgaagtgcctgtccttgctcaagttcctgatggatctgggatgtgatggcgagccatgtttcagctgcctctacggaaatggccctcaccccccagcaccacagccctcatcccgatttaacgacgctcctgctgctgataaggagcccagcgtcgtgcagttctgtgaattcgtgtcggctccagaggtctctcggtgggccggacctatcatcgacgtacttctcgattacgtggggaatgtccagctgtgttctcgcttgaaggagcatatagatagctttgaagattgggcagtaatcaaagaaaaagcagagccacctcggcccctggcccacctatgccgactgcgagtccgtaaagcaatagggaaataccggatcaagcttctcgatactctgcccctgcccggcagacttatcagatacctcaaatacgagaatacccagtag

SEQ ID NO: 179051 - DNA, 1470 bp, Artificial Sequence
  Description of Artificial Sequence: Synthetic coding sequence
atgcggcccgccgaccccctgatcaaggccatcaaggacggcgacgaggaggctctcaagaccatgattaaggaggggaagaacctggctgagcccaacaaggaaggctggctgccacttcacgaggccgcctactacgggcaggtgggctgtcttaaagtgctccaacgtgcttaccctgggaccatcgaccaacggactttacaagaggaaaccgcagtttacttggccacgtgtcgtgggcacctggattgtcttctatccctactgcaggctggcgctgaacccgacatatctaataaatcaagggagacccccctatacaaggcttgcgaacgtaaaaatgccgaggctgttaaaatcctggtccagcacaatgccgataccaatcacaggtgtaacagggggtggacagctttacatgaaagtgtgagtcggaacgacctggaggttatgcaaatactcgtctccgggggcgcaaaggtggagtcaaagaacgcgtacggaataaccccgctgtttgtggccgcccagtccggacagcttgaagcgctgcgctttctggctaaatatggcgctgacatcaatactcaggccagtgataacgccagcgcactatacgaggcctgtaagaacgaacacgaagaagtcgtagagtttctactgtcccaaggtgccgacgccaacaaaacaaataaagacgggctgctgcctctgcacattgccagcaagaagggcaactaccgaatagtgcagatgctgctgccagtcacttcccgaacccggattcgaaggtccggagtgtcccccctgcacctggcggcggaaaggaaccatgacgaagtcctcgaagcactcctctctgcacgcttcgacgttaacacaccactcgctccggagagggcaaggctgtacgaagacaggagatcctccgccttgtatttcgcagttgttaataataacgtttatgccactgaactgctgcttcaacatggcgcagatcccaacagggacgtcataagcccactgctggtggctatacggcacggatgcctccgaacaatgcagctgctgctggaccatggtgcgaacatcgacgcctatatcgccacacaccccacggcctttcctgctacaataatgttcgccatgaaatgcctctccctgctgaagttcctaatggatcttggttgtgacggtgagccttgcttctcctgtctatacgggaacgggccccaccctccagccccacagcctagttcacgcttcaacgacgcccccgccgccgacaaagaaccttccgtggtgcagttttgtgagtttgtatccgctcccgaagtgtctcggtgggcaggcccaataatcgacgttctcctcgactacgtgggcaacgtgcagctctgttctcgcttgaaggaacacatcgactcttttgaagactgggtgctcgaaggattcgtcaaatactag

SEQ ID NO: 179052 - DNA, 1908 bp, Artificial Sequence
  Description of Artificial Sequence: Synthetic coding sequence
atggccacccagatcagcacccggggcagccagtgcaccatcggccaggaggagtattccttgtattcctcactgagtgaagacgagttggtccagatggccatcgagcagagcctggcagataaaacgagggggcccaccaccgcagaggccaccgcgagcgcatgtacaaatcggcagcccgcccacttctacccttggactagaagtactgcaccgccggagtcctctcccgctcgggctcccatggggctcttccagggggtgatgcaaaagtactcgtctagcctgttcaagacaagccagttagcccctgccgaccctctgatcaaagcaattaaggacggtgacgaagaagctttgaagaccatgattaaagaaggaaaaaatctggcagagcctaacaaggagggttggctgcctttacacgaggccgcatattacggtcaggtagggtgtctgaaagttttacagagggcatatcctggcacaatcgatcagagaaccctgcaggaggaaactgctgtgtaccttgcaacatgccggggccatctggactgcctattgtccttgctccaggcaggggcggaaccggatatttccaataaatccagggagacgccactgtacaaagcttgcgaacggaagaacgccgaagctgtgaaaatcctggtacagcacaatgctgacaccaaccatcgatgcaatcgcggctggacagcgctccacgagtcagtgagccggaatgatttggaggttatgcagattttagtatccgggggggccaaagtggagagcaaaaatgcctacggaattacaccacttttcgttgccgcccagagtggccagctcgaggcactccgcttcctggccaagtacggcgccgatattaacacccaggcttctgataacgcgagtgctctctacgaggcctgtaaaaatgagcacgaagaagtggtggagtttctcttaagtcaaggcgcagatgctaacaagacaaacaaagacggtttgctccctctccacatcgctagcaaaaaaggcaattacagaatcgtgcagatgctgttaccagtaacatcccggacacggatcaggcggtccggcgtctctccccttcacctggctgcagagaggaaccacgatgaggtgttggaagccctgctgtccgctaggtttgatgttaacactcctctggctccagaacgcgcccggttgtacgaagaccgccgttcatcagccctgtattttgcggtcgttaataacaacgtctacgcgactgaactgctgctgcaacatggggccgatcctaatagagacgtgatttccccactattggttgcgattcggcatggctgcctgcgcactatgcagctcttattagatcacggagctaatatcgacgcctacatcgccacacacccaacagcctttcctgccacaataatgttcgccatgaagtgtctgtctctgttaaaattcctgatggatctgggatgcgatggcgaaccctgtttcagctgtttgtatggcaatggccctcaccccccggccccgcagccttcctcaagattcaacgatgcaccagcagccgacaaagagccgtctgtggtgcaattttgcgaattcgtatcagcccccgaggtgtctcgctgggccggacccattatcgatgtgctcctcgattacgtgggcaatgtgcagctctgcagccgtctgaaggaacacatagactcttttgaagactgggcggtcatcaaagagaaagccgagcctccgcgcccattggctcacttgtgcagactccgggtgcggaaggctataggtaagtaccgtatcaaactgctcgatactttaccacttcctggaagactaatccggtatttgaagtacgaaaatacacagtag

SEQ ID NO: 179053 - DNA, 1557 bp, Artificial Sequence
  Description of Artificial Sequence: Synthetic coding sequence
atggacttcaccgaggcctacgccgacacctgcagcaccgtgggcttggccgctcgagaagggaacgtgaaggtgctgcggaaactactgaagaaaggtcgtagcgtggatgtggccgacaaccgggggtggatgccaattcacgaggcggcttatcataatagcgtggaatgtctccagatgctgattaacgccgacagctcagaaaactatatcaagatgaaaacattcgaaggcttttgtgctcttcatcttgccgcttcccaggggcactggaagatcgtgcaaatcttgctggaggccggagcagacccgaatgccactactttggaggagacaacccctttgtttttggcagtagagaacggccagatagacgtgttgcgcctgttgctgcagcatggggccaatgttaatggtagtcatagcatgtgtggatggaatagcctgcatcaggcctccttccaggagaatgccgaaatcataaaattactactgcgaaaaggggccaataaagagtgccaggatgatttcggcattactccgctgtttgtagcggcacagtacggaaagctagaaagcttgagcatcctaatctcctcgggggctaacgtcaactgtcaagcattagataaggccactcccttgtttatagccgcacaggaggggcataccaagtgtgtggagctccttctctcctccggggcagaccctgacctttattgtaacgaggatagctggcagttgcctattcacgccgcggctcagatggggcacacaaaaatcctggacctacttatccccctgacgaatagggcttgcgacactggactgaacaaggtgagtcccgtatattctgccgtgtttggcggacatgaagactgcctcgagatcttactccgcaacggatattcaccagatgcgcaggcttgccttgtctttggatttagcagccctgtatgcatggcctttcagaaggactgtgaattcttcggtatagtgaacatacttctgaaatacggcgctcaaatcaacgagttacaccttgcctactgcttgaaatatgagaagtttagcatattcagatatttccttagaaagggctgttcactgggaccttggaaccatatctatgagtttgtgaaccatgctattaaagcccaggccaagtacaaagagtggctcccccacctgcttgtggcaggattcgatcccctcattctcttatgcaacagttggatcgactctgtgtctatcgacactctgattttcactttggaatttacaaactggaaaaccctcgcgcctgccgtggagcggatgcttagcgctagagccagcaacgcctggattctgcagcaacacattgctaccgtgccctctttaacgcacttatgtcggcttgagatccgctcctccttaaaatctgagaggctgcgctccgattcctatatttcccaactcccgctccccaggtccctgcacaactatctgctctatgaggatgtgttaagaatgtatgaagtccccgaactggcagcaattcaagatggttag

SEQ ID NO: 179054 - DNA, 1671 bp, Artificial Sequence
  Description of Artificial Sequence: Synthetic coding sequence
atggccatgatgcccctggtgctgcaccaccccgagcggcaggccgagttaggctctggtcttagggatggagggggcgctgccctgcgcccacctgggagattggtgaaacaaatggactttacagaggcttatgccgacacatgttctacggtaggcctggcagcgcgggaggggaatgtgaaggtgctccgcaaacttctgaaaaaaggccgctctgttgacgtggccgacaaccgcggatggatgcctatccacgaagcagcctaccataactcagtggagtgcctgcagatgctcatcaacgcagactcatccgagaactacattaagatgaaaacgttcgagggcttctgcgcattgcatctcgcagcctctcagggtcactggaagattgtgcagatactgctcgaggctggggccgatcccaatgccaccacccttgaggagaccacaccactgttcctagcagttgagaatggtcagatcgatgtgctcaggctcctgctgcagcatggcgctaatgtgaacgggtctcactctatgtgcggctggaactcactccatcaggcctcttttcaggagaatgccgagattattaagctcctactacggaaaggcgccaataaggaatgccaggatgactttggcatcacccccctgttcgtcgcagctcaatatggaaagttggagagtctcagcatcctgatttcatcaggcgcaaatgtgaattgtcaagccctcgacaaagccactccactctttatcgccgctcaggaaggacacactaagtgtgtagagctgctgctctcctctggcgcagatcctgatctgtactgcaacgaggattcatggcaactgcccatccatgccgccgctcagatgggtcacacaaaaatactcgacctcctcattcctctcacaaacagggcctgcgacaccgggcttaataaggtgtccccagtgtactccgcggtgttcggaggacatgaagactgtttagaaatcttgttgcggaacgggtatagcccagacgctcaggcctgcctagtcttcggattctcatcaccagtgtgtatggcttttcagaaagattgtgaatttttcggcattgtaaatattctgctgaagtatggcgcacagatcaacgaactgcacctggcctattgtctcaaatacgagaaattttcaatatttcgttattttctgaggaaaggctgcagcttggggccttggaatcacatctacgagttcgtcaaccatgctattaaggcacaggccaagtataaggagtggttaccacacctgcttgtggccggatttgatccactcatactgttgtgcaactcctggatcgacagtgtgtccattgacaccctcatctttacactggaattcactaactggaagactctggcccccgccgttgagcggatgctcagtgccagagccagcaatgcctggatactgcagcagcatatcgcaactgtgccttcgctgacccatctatgcagacttgagattcgttcaagtctcaaatccgagagacttcgctcggacagttacatctctcagctcccattgccaagatcgttacacaattatctgctctatgaggacgtgcttaggatgtacgaagttccagagctagctgcaatacaagatggatag

SEQ ID NO: 179055 - DNA, 1338 bp, Artificial Sequence
  Description of Artificial Sequence: Synthetic coding sequence
atgaagaccttcgagggcttctgcgccctgcacctggccgccagccagggacattggaaaatcgtccagattcttctggaagccggcgcagatcccaacgccaccacccttgaagagaccacgcccctcttcttggcggtcgagaacggccagattgatgtactgaggctgcttctccagcacggggctaatgtgaatggttcacactctatgtgtggttggaatagtcttcaccaggcttcctttcaggaaaatgccgagatcattaagctgttactgcggaaaggggcgaataaggagtgccaagatgattttggaatcactccacttttcgtggctgcacaatatgggaagctggagagtctgtccatactaatctcttccggagccaatgttaactgccaggcgctggataaggctacacctttattcatcgccgcccaggaaggacatactaagtgcgttgagctgctcctgagtagtggggccgaccccgatttgtattgcaacgaggatagctggcagctccccatacatgctgccgcccagatgggccatacaaagatcttggatctgcttattcctctgaccaaccgggcctgtgacaccgggctgaacaaagtgtcacctgtgtacagtgccgtcttcggaggacacgaggactgtttggaaattttgctacgtaatggttatagccccgacgctcaagcctgcctagtatttggattcagttcccccgtctgcatggcctttcagaaagattgcgagtttttcggaatagtcaacatactcctcaaatacggagcacagataaacgagctgcatctcgcctattgtctgaaatacgagaaatttagtatatttagatactttctgcgcaagggctgctcacttgggccgtggaatcatatatatgagttcgttaatcatgctattaaggcacaggccaaatacaaggaatggcttccgcatctgctggttgctggtttcgatccactgatactgctatgcaactcttggattgactccgtgtccatcgacactctgatctttacgcttgagttcactaactggaagactctcgctcccgctgtagagcgcatgttaagcgcaagggcatcaaacgcatggattctgcagcagcacatcgccacagttccgagtttgacccacctatgtcgcctggaaattcggtcctccctgaaatccgagagacttagaagtgactcttatataagtcaactgcctctgccccggagcctgcataactatcttctgtacgaagatgtgctaagaatgtacgaggtgcccgaactggccgctattcaggacggatag

SEQ ID NO: 179056 - DNA, 1662 bp, Artificial Sequence
  Description of Artificial Sequence: Synthetic coding sequence
atgcccctggtgctgcaccaccccgagcggcaggccgagctgggctcaggtctgagagatgggggaggagcggccttgagaccaccgggaaggctggtgaaacagatggatttcaccgaagcctacgcggatacatgcagcaccgtgggtctggctgctcgcgaaggcaacgttaaggtccttcgaaagctgctgaaaaaggggcgcagcgtagacgtcgctgacaaccggggctggatgccaatacacgaagctgcgtaccataattccgtggaatgccttcagatgctaattaacgcggactcctcagaaaactatattaagatgaaaaccttcgaaggcttttgcgctctgcatctagctgcttctcagggccattggaagattgtccaaatcctgttggaggccggggcggaccccaatgccacgacattggaggaaaccacaccgctgtttttggccgtggagaacgggcagatagatgtattgcggctgttgcttcaacacggtgccaatgttaatggctctcattccatgtgcggatggaactcacttcaccaagcctctttccaggaaaacgctgagattattaagttgctcctgaggaaaggggcgaataaggaatgtcaggacgactttggcattacacctttgttcgtggctgcccagtacggaaagttggagagtctaagtatacttatctcctcgggagccaatgttaattgtcaagcgttagacaaggcaacacccctgtttatcgcggctcaggagggtcacactaaatgtgtagaactgttactgagctctggtgccgacccagacctgtactgtaacgaggactcatggcagctgcctattcatgccgccgcccagatgggccatactaagatactcgacctgctaatcccgctaacaaatcgcgcttgcgacacgggcctgaacaaggtgtcgcccgtgtactcagccgtgtttggtggacacgaagactgcttagaaattttactgagaaacggctactctccagacgctcaggcctgccttgtgttcggcttctcttcgcccgtctgcatggctttccagaaagactgcgaatttttcggcattgtgaacattctattgaagtatggggcccagatcaacgagctccacttagcctattgtctgaaatatgaaaaatttagcatatttaggtacttcctgaggaaggggtgctctctcggtccttggaatcatatctatgaattcgtgaaccacgcaatcaaagcacaagccaagtacaaagagtggttgccccacctcctggtggcaggattcgacccattgatcttgctgtgcaattcttggattgactccgtgagtattgatactttaatatttacgctggagtttaccaactggaaaaccctcgcgccagccgtggagaggatgctcagcgcaagggcgtctaacgcttggattctgcagcagcacatcgcaacagtgcctagccttacccatctgtgtcggctggaaatcaggagttcacttaaatctgagcggctgagatccgactcttacatcagccagctgccactgcccaggtcattacacaattacctcctgtacgaagacgtgctcagaatgtatgaggtcccggaactagcagcaattcaggacggttag

SEQ ID NO: 179057 - DNA, 1338 bp, Artificial Sequence
  Description of Artificial Sequence: Synthetic coding sequence
atgaagaccttcgagggcttctgcgccctgcacctggccgccagccaggggcactggaaaatcgtgcagatactattggaagcaggcgcagatcccaatgccacaactctcgaagagacaacccccttgtttctcgcagtggagaacggacagattgacgtgctaagactcctgctgcagcatggcgccaacgtgaacgggtcacactctatgtgcggttggaactccctgcaccaggccagcttccaggagaatgcagagattattaagctgctgttgcgcaaaggcgcgaataaagagtgccaggacgacttcggaattaccccactgtttgtggcggctcagtacggcaaattggaaagtctttcaatcctcattagctccggcgcgaacgtcaattgtcaggcgcttgacaaggcaacacccctgtttatcgcagcccaggagggacatactaagtgtgtggagctgctgctctcttctggggctgatcccgatctctattgcaatgaggattcatggcagctgccgattcacgctgctgcccagatggggcacacaaagattttggatctgcttattccgctgaccaatagggcctgcgacactggcttaaacaaagtctccccagtgtacagcgcagtttttggaggtcacgaggactgcctggagattctgctacggaatggttatagcccagacgcccaggcttgcctggtttttggattctcttcccccgtgtgtatggctttccagaaggattgtgaattcttcggaattgttaacatcctgcttaaatacggagcccaaatcaatgagttgcacctcgcctactgtctgaaatatgagaaattctcaatcttccggtatttccttaggaaaggctgctctctaggcccctggaatcacatatatgagtttgtgaatcatgctataaaagcccaggctaagtacaaagagtggcttccacaccttcttgtggctggcttcgacccactgattctgctatgtaactcctggattgattccgtttccatcgatacattaatcttcacgctggagtttactaactggaagaccctagcccctgccgtcgaacggatgttgtcagcgagggcttcaaacgcttggatcctccagcagcacattgcaaccgtacccagtctcacccacctctgcaggctcgagatccgcagctccctcaagagcgagcgcctacggtcagattcttacatatcccaattacccttgcccagaagcctgcacaactacctgctctatgaagatgtgctgcggatgtatgaggtgccagaactcgcagccattcaggacggatag

SEQ ID NO: 179058 - DNA, 1314 bp, Artificial Sequence
  Description of Artificial Sequence: Synthetic coding sequence
atggacttcaccgaggcctacgccgacacctgcagcaccgtgggcttggcggcccgcgagggtaacgttaaggtcctgcgtaaactgctaaagaaaggtcgttccgtggacgtagccgacaaccggggctggatgcctatccacgaagccgcctatcacaactccgtggagtgcctgcagatgctgattaacgctgactccagcgaaaattacatcaaaatgaagaccttcgaaggcttctgtgcgttgcacttggcagccagccaaggccattggaaaattgtgcagatccttctggaagctggggccgaccctaacgccacgacactggaggagacaacccccctgttcctgggagcaaatgtgaactgtcaggctctggacaaagctactcccctcttcatcgcagcgcaggagggccacacgaaatgtgtcgagctgttactctcttccggcgcagatcctgacctttactgtaatgaagactcttggcagttgcctatccacgcagccgctcaaatgggacatacaaaaattctggacctgctaatccccttgacaaatagagcttgtgacaccggcctcaataaggtgtctcctgtttactctgctgttttcggaggccatgaggattgccttgaaattttattgagaaacggctacagccctgacgcccaggcatgtctcgtgttcggctttagtagccctgtctgcatggcctttcagaaggagtggtcttgcgagttcttcggcatagttaatattctgcttaagtacggcgcacagatcaatgaattacacctggcatactgtctgaaatatgaaaagttttctatttttcgctatttcttgcgcaaaggctgttcactgggcccttggaatcatatttacgagttcgtgaatcatgccatcaaggctcaggccaagtacaaagagtggctccctcatctcttggtggcaggcttcgatccgctcatactcctgtgcaacagctggattgattccgtgtcgattgatacgctaatcttcacacttgagtttaccaattggaaaacattggctcccgccgtcgaaagaatgctgtcagcccgggccagcaatgcatggatcctgcagcagcatatcgccaccgttccttctctaacacacctgtgtcgcctggagatccggtcgagtctgaagtcagaacgtctgcggtcggacagctatatatcccagctgccccttccacgatccctgcacaattaccttctatatgaagatgtcctgcgaatgtatgaggtcccagaactcgctgctattcaggatggctag

SEQ ID NO: 179059 - DNA, 1281 bp, Artificial Sequence
  Description of Artificial Sequence: Synthetic coding sequence
atggacggcaccaccgcccccgtgaccaagagcggcgccgccaagcttgtgaagagaaactttttggaagcacttaagtctaatgattttggaaagctgaaggcgatcctgattcaacgtcagatagacgtcgatacagtattcgaggtagaagatgaaaacatggtcctggcatcttacaagcaaggttactggctgccttcttacaagttgaaaagctcttgggccacaggtttgcacctgtccgtgctgtttggccatgtggaatgtctcctcgtgctgttagaccacaacgcgaccatcaactgtaggccaaatggaaaaacccccctgcatgtcgcctgcgagatggcaaatgtcgattgcgtgaagatcctgtgtgacagaggggctaaactgaattgttacagcctctcaggtcacactgccctgcacttctgtaccaccccatctagcatactgtgtgccaaacaattagtctggcggggcgctaacgttaacatgaagacaaataaccaggatgaggagactccattgcacacagcagcacactttggtctctcggaattagtagcgttttatgttgaacatggcgcgattgtcgattcagtcaatgcccatatggagactccactcgctatcgccgcatattgggccctgcggtttaaggagcaagaatacagcacagaacaccatttagtgtgtaggatgttgctggactataaggccgaagttaacgctcgagatgacgacttcaaaagcccactgcacaaagcagcttggaactgcgatcatgtcctgatgcatatgatgctcgaagcaggcgccgaagccaaccttatggacatcaacggatgcgctgcaatccagtacgttctgaaagttacctccgtgaggcctgcggctcagcctgagatctgctaccagttgctccttaaccacggtgctgcccgtatatatccgccacaatttcataaggttattcaagcatgccactcgtgtccgaaagcgattgaggtcgtcgtcaatgcctacgagcacataagatggaacaccaaatggaggagggccattccggatgacgatctggaaaaatactgggacttttaccactccctgttcaccgtgtgttgcaattcgcctaggactctgatgcacctgtccagatgtgcaatccgaagaactctgcacaaccgctgtcatcgagccatccctttactttccctgcccctgtccctgaagaagtatctcctccttgaaccggaaggcattatctattag

SEQ ID NO: 179060 - DNA, 1050 bp, Artificial Sequence
  Description of Artificial Sequence: Synthetic coding sequence
atggacggcaccaccgcccccgtgaccaagagcggcgccgccaagctggttaagagaaactttctagaagcactaaaatctaacgatttcgggaagcttaaagctattctgatacagcgtcagattgatgtagatacagtatttgaagttgaggatgagaacatggtgctcgcatcttataaacagggctactggttgccctcttacaaattgaaatcgtcgtgggctaccggtcttcatttaagcgtcctctttggacacgttgagtgcctgctggttcttctggatcacaatgctactatcaactgtagacccaacggcaagactcccttacacgtggcatgtgagatggcaaacgtagactgtgttaagatcttgtgcgacaggggggctaaactgaactgttacagcctgtctgggcacactgctttgcacttctgcactacccctagctccattctgtgcgcaaagcagctggtgtggcgcggggcgaatgtgaacatgaagactaataatcaggacgaagaaactccactgcatactgcggctcactttgggttaagtgaactggttgccttctacgtggagcatggggcaatcgttgacagtgtgaacgctcacatggagacacccctggcaattgcagcttattgggccctccggttcaaagagcaagaatatagcacagaacaccacctggtttgtcgtatgcttcttgattataaagccgaggttaatgctagggacgacgattttaagagtcctttgcataaggccgcttggaattgcgatcatgttcttatgcatatgatgctggaggccggcgcagaggctaacctgatggatattaacggctgtgctgccatacagtatgttctgaaagttacatcagttcgccctgccgcccagccggagatttgttatcagctgctgctaaaccatggggccgcgaggatttatcctccacagtttcacaaggtccgactgtgccccgtggtctccaggttgaggaaaattcagatggctgctctgtctgagatctcaaagtag

SEQ ID NO: 179061 - DNA, 3747 bp, Artificial Sequence
  Description of Artificial Sequence: Synthetic coding sequence
atgggcaaggaccaggagctgctggaggccgcccggaccggcaacgtagccttagtagagaagctcctctccggacgcaagggcgggatactgggtggagggtctggacccctgcctctctcaaatctgctgagcatttggagaggtcctaatgtgaattgtaccgatagcagtgggtatactgccctccatcacgcggctctgaacggccacaaagatatcgtcttgaagctgcttcagtacgaggctagcactaatgtggcggataacaagggatacttcccaatacacttggctgcttggaaaggggatgtcgaaatcgtcaagattctgattcaccatggcccaagccactcaagggtgaatgagcagaacaatgagaatgagaccgcattacattgcgcagcccagtacgggcactccgaggttgtggccgtgctgcttgaagagttgaccgaccctaccataaggaattccaaattagagacaccgctggacctggcggctctttatgggcggttgcgcgtcgtgaagatgattatcagcgcccacccaaaccttatgagctgcaacacacgcaaacatacgccactgcatctagctgcccggaatggccacaaggccgtggttcaggtgctccttgaggccggcatggacgtctcttgtcagaccgagaaaggctccgccttgcatgaggccgccttgttcggaaaggtcgacgttgttcgcgtgctcttggaaaccggtatcgatgctaatataaaagacagcctcggacgcaccgtactagatatcttgaaagaacacccctcccagaaatccctccagattgccactctgctgcaggagtatctggaaggggtggggcgttcaaccgttctggaagagcccgttcaggaagatgctacacaggagactcatatctcctcgcccgtggaatcaccaagccagaagaccaaatctgagaccgttactggggaattgtccaagctgctcgacgagataaagttgtgtcaggaaaaagattatagtttcgaagacctctgccataccataagcgatcactatttagacaacctttcaaagatcagcgaggaggagctggggaaaaacggctctcagagcgtgcgaacttccagcactatcaatcttagtcccggcgaagtggaggaagaggatgatgatgagaacacctgcggtcctagtggcctgtgggaggccttaactccttgtaatggatgtcgtaacttgggatttcccatgttggctcaagagagctatccgaagaaacggaattacacgatggagatcgtgcccagtgctagccttgatacgtttccaagtgaaaatgaaaatttcttgtgtgacctgatggatactgccgttaccaaaaaaccttgctcgctagaaattgccagagccccaagtccacggaccgataatgcttctgaagtagccgtgacgacccccggcacaagcaaccaccggaacagttccactggcccgacaccagactgctctccaccctcgcctgacactgccctgaaaaacattgtgaaggtgattcggccacagcctaagcaaaggacatcgatcgtaagcagcttagattttcataggatgaaccacaatcaggagtactttgaaattaatacttcaacagggtgtaccagcttcactgcttcccccccggcttctcctcctacctcttccgtagggactaccgaagtgaaaaacgagggtacaaaccacaccgacgacctgtccagacaggatgataatgacccgcctaaggaatatgaccccggtcagttcgctggcttgctgcacgggtcttctcccgcctgcgaaagtccagaaaacccatttcacctgtatggaaaacgagaacagtgtgaaaaaggtcaggatgaagttagcctggcaaactctccgctgcctttcaaacaaagtcctattgagaataactctgagccactcgttaaaaagatcaagcccaaagtcgtatctagaaccatctttcacaagaagtcaaatcagctcgagaaccacaccatcgtgggtactaggagcacacgctcgggctctaggaatggcgaccagtgggttatgaatgccggtggctttgtggaaagggcttgtaccctcggaagaattaggtccctccccaaagctctgatcgatatgcatttgtccaagagtgtttctaaatcggatagcgacttgattgcctatccttccaatgagaaaactagccgcgtgaattggagcgagtctagtacagccgaacatagctcgaaggggaattctgaacgtacaccaagtttcacctcagaatgggaagagatcgacaagattatgtcttctatagatgtcggcatcaataatgagttgaaggaaatgaacggcgaaactactcgaccccgatgccctgtgcagacagtcggccagtggctggagagtattgggctgccccagtacgaaaaccatctcatggctaatggttttgacaatgttcaattcatggggagcaatgtgatggaggatcaggacctcctcgagattggaattttgaacagtggccatagacagagaatcctgcaggctatccagttattaccaaaaatgcgccccataggccatgacggataccatcccacttcggtcgcagaatggttggatagcatcgaacttggtgactacactaaggcttttctaattaatgggtacacaagtatggatctgctcaaaaagatctgggaagtggaactgattaatgtcctcaaaataaacctgattggacaccggaaaaggattttagcatccctgggcgaccgcttacacgacgacccccctcaaaagcctccaaggtctatcaccctgcgagagcccagtggtaaccacaccccaccacaactgagtccgagtcttagccaatcaacatatacaaccggaggatccttggacgtgcctcatatcattatgcagggagacgcaagacggcgacgcaatgagaattatttcgacgacattccccgatctaagctggaacggcagatggcccagactggggactggggcgagccttccataaccctcagaccccctaacgaagctactgcgagtacacccgtgcagtactggcaacaccatcccgagaagttgattttccagtcatgtgattacaaagcattctatctgggaagcatgcttattaaagaactccgcggtacggagagtacacaagacgcatgtgcgaagatgcgcgtgatgtgcgttaaaagcacagaacagatgaagaaggttccaactatcatcctctcggtgagttacaaaggcgttaaattcatagatgccactaacaagaacatcatcgcagaacacgaaattcgtaacattagctgtgccgcgcaggaccccgaggatctgtccacttttgcctatataaccaaggacctgaagtccaatcaccactattgccatgttttcacagcatttgatgtgaatctggcttatgaaattatactcaccctgggccaggccttcgaggtggcctatcagttggctctccaggctaggaagggtggccactcttccacgctgcccgagagtttcgaaaataagccctcgaaaccaatccctaaaccaagggtgtctatccggaaatctgttgatctgttgcacgcctcccacaccggacaggagccatccgagcgccacaccgaggaggcacttaggaagttctag

SEQ ID NO: 179062 - DNA, 1353 bp, Artificial Sequence
  Description of Artificial Sequence: Synthetic coding sequence
atgatgtggcagtgccacctgagcgcccaggactaccggtactaccccgttgacggatactctctcctaaaaagattccccctccaccctctcacaggcccaagatgtcctgtgcagaccgttggccagtggctggagagcatcggattaccccagtacgaaaaccatctgatggccaatggattcgacaacgtgcagttcatgggtagcaacgtaatggaagatcaggacttgcttgagattgggattctgaactccggccatagacaaaggatcctgcaggccatccaactcctcccaaagatgaggccaattggtcatgatggctaccatcctacgtccgtggcagagtggcttgacagcatagaactgggcgactacactaaggccttcctgatcaacgggtacacctcaatggatctccttaaaaagatttgggaagtggagctgatcaatgtcctcaagattaatctgattggacaccgaaaacgtatcttggctagcctgggagatagattacacgacgatcctccacagaaacccccccggtcaataaccctgcggtcatccgtgtgtgaaatctggaccaaccagaatgcgggctttccatttagcgccatccatcaggttcacaatacaggcgactggggggagcccagtattacacttcgcccaccaaatgaggctactgcttccacccccgtccagtattggcagcatcacccagagaaactaatctttcagtcatgcgactacaaggccttctacctcggatccatgctaattaaagaactgaggggcactgaatctacccaggacgcgtgcgccaaaatgagggcaaatatacagaagtctacagagcagatgaagaaggtcccgacaataatcctgtcagtcagctacaaaggcgtaaagtttatcgacgctaccaataagaacataatagccgaacacgaaattagaaatatctcatgcgcggcacaggatcccgaggacctctcaacgtttgcctacatcaccaaagatctgaaaagcaaccatcattattgccacgtcttcaccgcttttgacgtcaatctggcttacgaaattatactcactctcggccaggcatttgaggttgcctaccagctagccctgcaggcacgaaagggagggcactcttctaccctcccggaatcgttcgaaaataaaccctcaaaaccaatcccaaaacctagagtatcaattcgaaagtctgtgcaaattgaccccagtgagcaaaaaaccctagccaacctgccatggatcgtcgagccaggccaggaagcaaaacgaggcatcaataccaaatacgagaccactatcttctag

SEQ ID NO: 179063 - DNA, 765 bp, Artificial Sequence
  Description of Artificial Sequence: Synthetic coding sequence
atgcagggcgacgcccggcggcggcggaacgagaactacttcgacgatattccaaggtccaaactcgagcgccaaatggcccaaaccggcgactggggagaaccttccatcaccctgcggccgcctaacgaggcaacagcctcaacacctgtgcagtactggcagcaccatcctgagaaactcatatttcagagctgtgactataaagccttctacctagggtctatgctcattaaggaactccgggggacagagtcaacccaggatgcttgcgcaaaaatgcgagcaaactgtcagaagtcgacagagcaaatgaagaaggtccctactataattctctctgtgagttacaaaggcgtaaagttcatcgatgcgacgaataagaacataatagccgaacacgagattaggaacatctcttgtgcagcgcaggaccccgaggatttatctactttcgcctatattaccaaagatctgaaatccaatcaccactactgtcacgtttttactgcctttgacgtcaatctggcctatgagatcattcttaccctgggccaagcctttgaagtggcctaccaactcgccctccaggctcgaaaagggggccattctagtaccctccccgaatcttttgagaataagccctccaagcccattcctaagcctagggtctcaatcagaaaaagcgtggatttactgcatgctagtcataccgggcaggaacctagtgagcggcacaccgaagaagcactgcgtaagttttag

SEQ ID NO: 179064 - DNA, 1053 bp, Artificial Sequence
  Description of Artificial Sequence: Synthetic coding sequence
gtgctgttccagggcagcaacgtgatggaggaccaggacctgctggaaatcggaatattgaacagtggacatagacagaggattctccaggccattcagttattgcccaaaatgcgcccgattgggcatgacgggtaccatcccacctcagttgccgaatggctagattcgatcgagctgggtgactacactaaagcattcctaataaatgggtatacaagtatggatctgctaaaaaagatttgggaggtggagctgattaatcaatcctcagtttgcgagatctggacgaaccagaacgctggctttccgttttcggccattcatcaagtccataatactggtgactggggggaaccttcaattaccttgaggccacccaatgaggcaacagcatctacacctgtacagtactggcagcatcatccagagaagctgatattccagtcctgcgactacaaagctttctacctggggtccatgcttattaaggaactgcgcggtacagaatctacccaagacgcgtgcgctaaaatgcgcgccaacattcagaagtctacggaacagatgaaaaaggtgccgacaattatactctccgtaagctataagggcgtcaagttcattgatgccacaaacaagaatattatcgcagaacatgagattaggaatatttcctgcgccgctcaggatcccgaggatcttagcactttcgcctacattaccaaggatctgaagtctaaccaccactactgccacgtcttcactgcattcgacgtaaaccttgcatatgagatcatcctaacactcggacaagcgtttgaagtggcgtaccagcttgctctgcaggctcgcaagggggggcattcatccacgctgcctgaaagtttcgagaataagccctccaaacccatccccaaacctcgagtgagtattagaaagagcgtcattgacccctcagagcagaagacgctggccaatctgccttggatcgttgagcccgggcaggaggcgaaacgggggattaacaccaagtacgaaacaacaattttttag

SEQ ID NO: 179065 - DNA, 2292 bp, Artificial Sequence
  Description of Artificial Sequence: Synthetic coding sequence
agcttccaggagagctaccccaagaagcggaactacaccatggagatagtgcccagcgccagcctcgacaccttcccgtcagaaaacgaaaatttcctgtgcgacctgatggacaccgcagtgacgaagaagccatgtagccttgagattgcacgtgcgccttctccgcgaactgacaacgcaagtgaagtggcagtcactacacctggtacaagcaatcaccgcaacagttctaccgggccaacacctgactgcagtcctccgagtccagacacagccctgaaaaatatcgtgaaggtcatccgcccacaacctaaacagcggacatctatcgtgagttccttggattttcacagaatgaatcataaccaggagtattttgagatcaacacctctaccggttgcacctccttcaccgcttccccgcccgcttccccccccacgtcgagtgttggcacgacagaggttaaaaatgaggggactaaccatactgatgacctgtctcgacaggatgacaatgaccccccaaaggaatacgatcccggccagttcgctgggcttcttcacggcagcagccctgcttgtgagtcaccagaaaatccattccacctctacggaaagagagagcagtgcgaaaaggggcaggatgaagtgtcacttgctaacagcccgctgcctttcaagcaatcaccgattgagaacaactcggagccgctggtgaaaaaaatcaaaccaaaggtcgtgtcccgcacaatatttcataaaaagtccaatcagctggagaaccacacaatcgtgggcacaaggtctacacgatccggaagcaggaacggagaccagtgggtgatgaacgccgggggattcgtggagcgcgcctgcacactcggtagaatacggagtctgccaaaagccctcattgatatgcatctctctaagtccgtgtctaaatcagacagcgacctgatagcttacccaagtaacgaaaagactagtcgcgtgaactggagtgaaagttctaccgcagagcacagctctaaaggaaactcagaaaggacaccttccttcacttccgaatgggaagagatcgataaaatcatgagtagcattgatgtggggattaacaatgagctgaaggaaatgaacgggccacgttgccccgtacagaccgtaggccagtggctggaaagcataggcctgccccagtacgaaaatcacttaatggctaacggctttgacaatgtccagttcatgggaagtaacgttatggaagatcaggacttgttagaaattgggattctgaatagcggacacagacagcgaatcttacaggctatccagctgctgccgaagatgcgtccaatcggacacgatgggtaccacccgacaagtgtggccgagtggttggacagtattgagttaggcgactacaccaaggcctttctaatcaacgggtataccagtatggacctgcttaaaaaaatttgggaggttgagctgataaatgttttaaagatcaatctaatcggtcacagaaagaggatactggcatcgcttggcgaccgactacacgacgatcctccacagaagccccccaggtcgattaccttgaggacaggggattggggagaaccgtctattactcttcggccgccaaacgaggccaccgcttcaacccccgttcagtactggcaacaccatcccgaaaagctcattttccagtcttgtgattataaggcattctatctcggaagcatgctgataaaagaactgagggggaccgaatcaacccaggacgcctgcgctaagatgagggtgatgtgtgtgaaatctaccgagcagatgaagaaagtgcctaccattattctgtctgtgtcctacaaaggagtcaaattcattgatgccacgaacaagaacatcatagcagagcacgaaattagaaacattagttgtgctgcacaagacccagaggatctcagtaccttcgcttatattacgaaggacctcaaaagtaaccatcactactgccatgtgttcaccgcctttgatgtgaatttagcttatgagattatcctcactcttgggcaggcgttcgaggttgcgtatcagttagcactgcaggcacggaaaggaggccactctagcacgctacctgaatcgttcgagaacaagcccagcaagccaattccaaaaccccgcgttagcatcaggaaatccgtcgacttgctacacgccagccatactggccaagagcctagtgagagacacaccgaggaagctttaagaaagttttag

SEQ ID NO: 179066 - DNA, 1281 bp, Artificial Sequence
  Description of Artificial Sequence: Synthetic coding sequence
atgatgtggcagtgccacctgagcgcccaggactaccggtactaccccgtcgatggatactcccttctgaagaggtttccgcttcatccacttactgggccaagatgcccagtgcagaccgtgggacagtggttggagtcaatcggtctgcctcagtacgaaaatcatctgatggctaacgggtttgacaatgtgcagttcatgggtagtaatgtcatggaagatcaggatctgcttgaaatagggatcctgaactccggtcaccgccagcgcattttacaggccatacaactccttcccaagatgcgacccatagggcacgacggataccatccgacaagcgttgctgaatggttggatagcatcgagttgggggattacacgaaagcgtttttaattaatggttacacttcaatggatttgctcaagaagatctgggaggtcgagcttatcaacgtcttaaaaatcaatctgatcggccatagaaagagaatcctagcttcccttggagataggctgcacgacgatccccctcagaagccaccgagatccataacacttcggacgggtgattggggagaaccttctattacacttcgtcctcccaacgaagctacagcctcaactcccgtacagtactggcaacatcaccccgaaaaactaatctttcagtcctgcgactataaagcgttctacctgggatcaatgcttatcaaagagctgagagggaccgagtccacccaggacgcgtgcgcaaaaatgagagctaactgccaaaaatcgacagaacagatgaagaaggtgcctaccataatcctgagtgtgtcatataagggtgtcaagttcattgacgccactaacaaaaatattattgcggagcacgagatccgcaatatttcctgcgcagctcaggatccggaagatctttcaacctttgcttacattaccaaggacctgaaaagcaaccaccactattgccatgtgtttactgcattcgacgtcaatttggcctacgaaattattctgactctgggccaagccttcgaggtagcctaccagctggctctgcaggctagaaagggaggacattcatccacgctcccggaatccttcgagaacaagcctagtaagcccatacctaagcctcgggtgagcattagaaagagtgtccagatcgacccgtcagagcagaaaacattggcgaacctgccgtggatagtggaacccggacaggaggcaaaacgcggcatcaacacgaagtatgagactaccattttttag

SEQ ID NO: 179067 - DNA, 1383 bp, Artificial Sequence
  Description of Artificial Sequence: Synthetic coding sequence
atgatgtggcagtgccacctgagcgcccaggactaccggtactaccctgtcgacggttactctctcctcaagaggtttcctttgcatcccttgaccggacctagatgtccagttcaaaccgtggggcagtggctggaatccattggattaccacagtacgagaatcatctcatggctaacggctttgataacgtgcagtttatgggctcaaacgtcatggaggaccaagacctgctggaaatcggcattcttaattccggccacagacagaggattcttcaggctatccagctgctgccaaaaatgaggcccattggacacgatggctatcatcctacttctgtagccgaatggcttgattctatcgaactgggggactacacaaaagcttttctgataaatggctacacgtctatggatctgctgaaaaaaatatgggaagtggagcttatcaacgtcctgaagataaatctgatcggccacagaaagaggatcctggcatccctgggcgaccggctgcatgatgatcccccccagaaaccacctaggtcaataactctgcgggagccaagtggaaaccacacaccgcctcagctatctcctagcctttcccagagcacttacactaccggcggtagcctcgacgtcccccatatcatcatgcagggcgatgcccggagacgcaggaatgagaattactttgatgatatcccaaggtccaaattagaacgccaaatggcacagactggcgactggggggagccttctatcacactgagaccccctaacgaggccacagcttctacacccgttcaatactggcaacatcatcccgaaaaattaatcttccagtcttgtgattataaagctttttaccttggcagtatgttgatcaaagagcttagaggtaccgagagtacgcaggatgcttgcgccaagatgcgggccaattgtcagaagagcacagagcagatgaaaaaagtccctacaattatcttgtctgtttcatataagggagtaaaatttatagacgccaccaataagaatataatcgcagaacatgaaattaggaacatctcatgcgccgcccaagacccagaagacctttcaaccttcgcctatatcacaaaagatctaaaatccaaccaccattactgtcacgttttcactgcttttgacgtcaacctggcctacgagatcattctaacactcgggcaagcgtttgaggtggcctaccagctggctcttcaagcacgcaaaggggggcactcatcgacactgcccgaaagcttcgagaataagccctctaaacctattcccaagccacgggtgagtattagaaagtccgttcccttctgctttaaggcagatcggccgatttag

SEQ ID NO: 179068 - DNA, 2295 bp, Artificial Sequence
  Description of Artificial Sequence: Synthetic coding sequence
atgctggcccaggagagctaccccaagaagcggaactacaccatggaaatcgtcccgtccgccagtttggatacattcccttccgagaacgaaaactttctgtgtgacctgatggacacggcagtcactaagaagccctgttcgctcgagatcgctcgggcgccttcacctcggactgataacgcctcagaagtggctgtcacaactcctgggactagcaaccacaggaacagctcgaccgggcccacgccagactgttcaccccccagccccgataccgccttaaagaacattgtgaaggtaattcgtccccagcctaagcagcggacctccatcgtctcctcacttgatttccacagaatgaaccacaaccaagagtatttcgaaatcaatacaagcacaggctgcacatcttttaccgcatccccacccgcaagcccacctacgagctcggtgggaaccacggaagtgaaaaatgaaggcactaaccatacagacgacttgtctcggcaagacgataacgatccgcccaaggagtacgaccccgggcagtttgctgggttgcttcacggtagctccccagcctgtgagtccccagagaatcctttccacctctacggcaaaagagagcagtgcgaaaaaggccaggatgaggtctcgctcgctaacagtcccctcccgttcaagcagtcccctatcgaaaataacagtgagcctttagttaaaaaaataaagcccaaggtggtgtcccgcaccattttccacaaaaaaagtaatcagctggaaaaccatacaattgtgggtactcgaagtaccagatcaggaagtcggaacggagatcaatgggtgatgaacgccggagggttcgtggagagggcgtgtacattgggacgaattcgcagcctaccgaaggcgctaatcgatatgcatctaagtaagagcgtttcaaaatctgattcagatctgattgcctatccgtccaatgaaaagacctctagggtaaattggtccgagtcttctaccgctgagcattcttcaaaaggcaatagcgagagaacgccctccttcaccagtgaatgggaggagatcgataaaatcatgtcttctattgatgtcggaatcaacaacgaactaaaagagatgaatggtccacgatgccctgtccagactgtcggccagtggctcgaaagtatcggactgcctcagtacgaaaaccatctgatggctaacgggttcgacaatgtgcaattcatggggtcaaatgtgatggaggaccaggacctcctggagattggtattctgaatagtggtcatcgccaacgcatcctccaggccatccagctcctgcccaagatgcgtccaattggccatgatgggtatcaccccacgtccgtggctgagtggttagatagcattgaactcggcgattataccaaggcgttcctgattaatggctacacatcgatggatctgctgaagaagatctgggaagtggaacttattaacgtgctgaagattaacctgatcgggcaccgaaagaggattctggcctccctgggcgatagactccatgatgacccacctcaaaagccccctaggtctattacactccgcactggggattggggggagccgagtattactctgagaccccccaacgaggcaaccgcaagtacccccgtgcaatattggcagcatcaccctgaaaaattgattttccaatcatgcgactacaaagcattttatctagggtccatgctgataaaagagttgagggggaccgagtccacccaggacgcctgtgcgaagatgcgagccaattgtcaaaaaagtaccgaacagatgaaaaaggtgcctacgatcattctgtccgtctcctacaagggagtgaaatttattgacgccactaacaaaaacataatagcagagcatgagatccggaacatctcttgcgccgctcaggaccctgaagatctgagtacatttgcctacatcacaaaggatctcaagagtaaccatcactactgccacgtgttcactgcctttgacgtgaaccttgcctatgaaatcattttaactctaggacaggcattcgaagtggcatatcagctcgcgttgcaggccaggaagggtgggcactcctctacccttcctgagagttttgaaaataagccgagcaaaccaattccaaagcccagagtatccatccgcaaatccgtggaccttctgcatgccagtcatacaggtcaggaacctagtgagcggcacactgaggaggccctccgtaaattctag

SEQ ID NO: 179069 - DNA, 3747 bp, Artificial Sequence
  Description of Artificial Sequence: Synthetic coding sequence
atgggcaaggaccaggagctgctggaggccgcccggaccggcaacgtcgcactggtggagaagctcctgtctggacgaaagggcggcattctaggcgggggatccgggcctctcccactgtccaaccttcttagtatttggagggggcccaatgtgaattgcaccgacagtagcggttacactgccctgcaccatgccgcccttaacggccacaaggacatcgtcttaaagttgctccagtatgaggcatccactaacgtggctgataacaaaggctatttccctattcacctggctgcgtggaagggcgacgtggagatcgtcaagatcctaatccaccacggaccgtctcacagtagggtgaatgagcagaacaacgaaaacgaaacagctttacactgtgctgcccagtacggccattcagaggtcgtggcagtcctgctggaagagctgactgacccaaccatcaggaatagtaagctcgaaacacccttagacctggcagcgttgtatggcagactacgcgttgttaaaatgataatctcagcccaccctaaccttatgagctgtaacacccggaaacatacacccttgcacctggcggctaggaatggccataaggccgtcgtgcaggtgctgctggaagccgggatggatgtgtcttgccagactgagaagggctccgccctgcacgaggctgcactgttcggtaaagtcgacgtcgtgagagtcctcctagagaccgggatagacgctaatatcaaggacagtctcggaaggacggttctcgatattttaaaggagcatccttctcagaagtcgctgcagattgctaccctcctgcaagaatacttagagggagtcggtagatctaccgtcctggaggagccagtacaggaggatgccactcaagaaactcacatatcaagccccgtggaatcaccctctcagaaaaccaaaagtgagaccgtaacaggagaactctcaaagctacttgatgaaattaagctgtgccaggagaaggactacagctttgaggacttgtgccatacaatctccgaccactatctcgataatctatccaaaatttctgaggaagagctgggcaagaacggctctcagtcggttcgtacatcgagtaccatcaatctgagtcctggggaggtcgaagaggaggatgatgacgagaacacctgtgggccctctggcttgtgggaagcactgaccccatgtaatggatgtcggaatctcggcttcccaatgctggctcaggaatcctaccccaagaagagaaactatactatggaaatagtccccagcgcttcgctcgacacctttccatctgagaatgaaaattttctttgcgatctgatggataccgccgtcactaagaagccatgcagcttagaaatcgctcgtgccccttcaccgaggacagataacgcctctgaagtggcagttactacccctggtacctcgaaccacaggaactccagtactggtcccactcctgactgtagcccaccatctccagacacagctcttaaaaacatcgtgaaggtgattaggccacagcctaaacagaggacgtcgattgtgagttcactcgacttccaccgcatgaaccacaatcaggagtactttgaaatcaacacaagcaccggctgcactagctttacggcctctcccccagcaagtccaccaacctcaagcgttggaactacagaggtgaaaaacgaaggcactaaccacacggatgacttgtcgagacaggacgataacgatccccccaaagaatatgaccctggacagtttgctgggttactgcatgggagctctccggcatgtgagagtccagaaaatccattccacttgtacggaaaacgagaacagtgcgagaaagggcaggacgaagtttctctagcaaactctcctcttccctttaaacagtccccaattgagaataatagtgagccactagtgaaaaagatcaaaccgaaggtggtatcaagaactatctttcataagaagagcaatcagctagagaaccatactatagtgggcacacgctctactagatcaggctcaaggaatggggaccaatgggtaatgaatgctggaggcttcgtcgagcgcgcctgtactcttggccgcattagatcacttccgaaagcgctgattgacatgcatctcagtaagtcagtgtcaaaatctgattctgacctgattgcctatccaagcaatgagaagactagtcgggtcaactggtccgagagttctaccgccgaacattcctccaaaggaaactcagagcgaaccccaagtttcacttccgagtgggaagaaatagacaagatcatgagttctatcgatgtgggtatcaacaacgagcttaaggagatgaatggcgagacgacccgcccacgctgccctgtacaaaccgtgggtcagtggttggagagcattggcctgcctcagtacgagaaccacctaatggccaatggattcgataacgtgcaattcatgggctccaacgtcatggaagaccaagatctgctagagatcgggatcctgaactcaggtcaccgccagaggatactgcaagccatccagctgttacccaaaatgcgtcctattggccacgacgggtaccacccaaccagcgtggccgaatggctggactcaattgaattgggtgactatacaaaggcgtttctgattaatggctacaccagtatggacctgcttaaaaaaatttgggaggttgagttaattaacgtactgaagatcaacctgattggacaccggaagagaattctggcttccctcggagaccgccttcacgatgaccctcctcagaagccgccccggagcatcacccttcgggagcctagcggtaatcatactcccccccaacttagcccctccctgagtcagtcaacgtacaccacaggggggtcacttgacgtcccgcacatcataatgcagggagacgcacggagaagaaggaatgagaattatttcgatgatatacctcgcagcaagcttgaaagacagatggcgcagacgggtgattggggtgaaccctcaattacactgcgccctccaaatgaagctaccgcatccaccccggttcagtactggcagcaccatcccgagaagctaatttttcagtcttgcgactacaaggccttctatctgggtagcatgctcattaaagagctccgtggcacggagtcaacccaggatgcctgcgccaaaatgcgagccaattgtcagaagagcacagagcaaatgaagaaggtgccgacaatcatattgagtgtctcttacaaaggggtcaagtttatcgatgctacgaataagaatataatcgcagagcacgagatcagaaacattagctgtgccgctcaagacccagaggatttgtccacctttgcatatattactaaggacctcaaaagtaaccaccactattgtcatgtgtttacggcgttcgatgttaacttagcgtatgaaattatcctgacgttaggccaggcgttcgaagtggcatatcagctggctctgcaggcgcgtaaaggtgggcactcaagcactttgcccgaaagcttcgagaataaaccttccaaacccatccccaaacctcgagtcagcatccgcaagtccgttgacctgttgcatgcttctcacactggccaagagccttctgaacggcataccgaagaggctcttcggaagttctag

SEQ ID NO: 179070 - DNA, 1074 bp, Artificial Sequence
  Description of Artificial Sequence: Synthetic coding sequence
atggccaacggcttcgacaacgtgcagttcatgggcagcaacgtgatggaggatcaggatctgctggaaataggtattcttaactccggccatcgtcagcgcatcctgcaggcaatccaacttcttccaaagatgagacctattggccacgatggatatcaccctaccagtgtcgctgagtggctagatagtatagagctcggggactataccaaggcatttttgattaacggctatacctcaatggacttactgaagaagatctgggaggtagagctaattaaccagtcaagtgtatgcgaaatttggactaatcaaaacgcggggtttcctttcagcgccattcaccaggtgcacaataccggggactggggagaacctagcattactctacgcccccccaacgaagccaccgccagcactccagtgcaatactggcaacaccatccagaaaaattgatattccaatcttgcgattataaagcattttaccttggttccatgctcatcaaagaattgcgcggaaccgagtctacgcaggatgcttgcgcaaaaatgagggctaactgccaaaaatcaacagagcagatgaagaaagtgccgactattattttgagcgtaagttacaaaggcgtgaaattcattgacgccaccaataaaaacatcatcgcagaacacgaaatccgcaacatttcatgtgccgcccaggaccccgaggatctttccactttcgcatacatcaccaaggaccttaaatccaaccaccactactgtcatgtgttcaccgcttttgatgtaaacctcgcttacgaaatcattctgaccctgggccaggccttcgaggtcgcctaccaactggctctgcaggctcgtaaaggtggacactcctcaacattacccgagagctttgagaataaacctagcaagccaatcccaaagccacgcgtcagcattcgaaagtctgtgattgacccctcagaacagaaaacacttgccaacttaccatggatcgtcgaacctggccaggaggccaagaggggcataaataccaagtacgaaacaactattttctag

SEQ ID NO: 179071 - DNA, 1533 bp, Artificial Sequence
  Description of Artificial Sequence: Synthetic coding sequence
atgatgtggcagtgccacctgagcgcccaggactaccggtactacccagtcgacggttacagcttactgaagcgatttccgcttcatccactgacaggaccacgatgccccgtccaaaccgtaggacagtggctagagagcattggcttaccacaatatgagaatcatctgatggctaatggctttgacaacgttcaattcatggggagcaacgtcatggaggaccaggacctgctcgaaattgggattctcaacagcggtcacaggcaaagaattctgcaagcaatacagcttctgcccaagatgaggccaatcggccatgatggctaccacccgacatccgtggccgagtggttagattctatcgagttaggcgactacaccaaagctttcctgattaacggctacacatctatggatctactcaaaaagatatgggaggtcgagctcataaacgtgctcaagatcaacttgatcggccacaggaagcgcatcctggcatccctgggagacaggctgcatgatgatcccccgcagaagccgccaagatcaattactctgagggaaccctccggtaaccacacaccccctcagttaagtccatccctgtctcaatccacctacactacaggcggctctttggacgtgccccacattatcatgcagggagatgcccgccgtcgtcgaaacgaaaactacttcgatgatatcccacggagtaaactcgaaagacagatggctcagtccagtgtctgcgagatctggacaaaccaaaacgccgggttccccttttccgcgatccatcaggtccataacactggcgattggggtgaaccaagcatcactctcagacctccaaatgaggcgacggccagcacaccagtgcaatattggcagcatcatccagaaaaactcatcttccaatcatgcgattacaaagccttttacctggggtcgatgctcatcaaggaactgagaggcactgagagtacacaggatgcgtgtgctaagatgcgtgcgaattgtcagaagagcactgagcagatgaaaaaggtgccaaccataatcctctccgtctcatacaaaggggttaagttcatcgacgccactaataaaaacatcatcgctgagcatgagattaggaatatttcatgtgcagcccaggatcctgaggacctcagcacttttgcatatatcactaaagacctcaaatccaaccaccactattgtcatgtgttcaccgcttttgatgtgaatctggcctacgaaattattctaacgctcgggcaagctttcgaggtggcataccagctggccttgcaggcacgtaaaggtggacattcttccaccctgccggagtcattcgaaaataaaccaagcaagcctatccccaaaccccgcgtgtccattagaaaaagtgtgcagattgacccaagtgaacagaagacactcgccaatctcccttggatagtggagcccggccaggaagccaagagaggaattaatactaaatacgagactaccatcttttag

SEQ ID NO: 179072 - DNA, 1245 bp, Artificial Sequence
  Description of Artificial Sequence: Synthetic coding sequence
atgatgtggcagtgccacctgagcgcccaggactaccggtactacccagtggacggttactctctgttaaagcgctttcctttacatccattaacaggccctagatgcccagtgcagacagtgggacagtggttagagtccattggtctaccacagtacgagaatcatctgatggcgaacggatttgacaacgtccagtttatggggagtaatgtcatggaggatcaggacttattagagatcggaattttgaactccggtcatagacagcgtatcttacaggcaatccaactgctaccgaaaatgcggcctatcggccatgatgggtatcacccaacgtctgtggcggagtggttggactctatcgagctgggagactacactaaagccttcctgataaacggttacacctcaatggatctgctgaagaagatctgggaggtggagctgatcaacgtgctgaaaatcaacctcatcggacatcgcaaacgcatcttggcttcactgggagaccgcctacacgacgatcctccacagaagccgccgcggagcataacacttcgtactggtgattggggggaaccctctattaccctcaggccgcctaacgaggccactgcatccactccagtccagtactggcagcatcacccagagaagctcatcttccagtcctgtgactacaaagcattttatctaggctcaatgctgattaaggaactcagggggactgagtcaacccaggacgcctgtgcaaagatgagggccaattgccagaagagtactgagcagatgaaaaaagtgccaaccattattcttagtgtgagctacaaaggcgtcaagttcatcgacgcaaccaacaagaacattatcgccgagcacgaaatcaggaacatatcgtgcgctgcgcaagaccctgaagacttatcaacctttgcttatattacaaaggacttgaaatcgaaccaccattactgtcacgtgtttacagccttcgacgtgaacctagcgtatgaaattatactcacgctcggtcaggcttttgaagtcgcctaccaattggctctgcaggcccgcaagggcgggcactcatccactctacccgagtctttcgagaacaaaccaagcaagcctatccctaaaccccgggtttccattcgcaagagcgtcgatctgcttcacgccagtcacaccggccaggagccctctgaacggcatacagaggaagcccttaggaaattttag

SEQ ID NO: 179073 - DNA, 1353 bp, Artificial Sequence
  Description of Artificial Sequence: Synthetic coding sequence
atgatgtggcagtgccacctgagcgcccaggactaccggtactaccccgtggatggctactccctgttgaagcgattccctctgcatcctttaactggcccgcgctgcccggtccagactgtgggccaatggttagagtctattggtcttccacaatacgagaatcacctaatggctaacggtttcgataacgtgcagttcatgggctctaatgtgatggaagatcaggacctcctcgagatagggatcctcaattcagggcacagacagcgaatcctgcaggccattcagctgctccccaaaatgagaccaattggccacgacggttatcatcccacgagtgtggccgagtggctggactctatagaacttggagattacactaaagcttttcttatcaatggctatactagcatggacttgctcaagaaaatctgggaggtggaactgattaacgtgctgaagataaatctgatagggcaccgtaaacgcatcctggcaagcctgggcgacaggctgcacgatgatcctccacagaagcctcccaggagtatcactttgagaagttccgtgtgtgagatttggaccaatcagaatgctggattcccattttcagcgattcaccaggtgcacaatactggtgactggggagagccctcaattactctgaggccccccaatgaggcaacggcatccacacccgtgcagtattggcagcatcatccagaaaaattgatattccagagctgcgattacaaagccttttacctgggcagtatgcttatcaaagagctgcgcggaaccgaaagcacacaggatgcctgtgccaaaatgcgggctaattgtcaaaagtctacagagcagatgaagaaggtgcccactatcattctatccgtgagctataaaggggtgaaattcatcgacgctaccaacaagaatataattgcagaacacgaaatccgtaacatatcctgcgccgctcaagatcccgaggaccttagcaccttcgcttacatcaccaaggatctcaaaagtaaccaccattactgtcacgttttcaccgctttcgatgtcaatcttgcctatgaaataattctaaccctcggccaggcatttgaagtggcttaccagctcgcactacaggccagaaagggtgggcattccagcaccttgccggaatcttttgagaataagccatctaagcccatcccaaagcccagggtctccatccgcaagtccgtccagattgacccttctgagcagaagactctggccaatctcccatggatcgtggagccaggacaagaagccaaacggggcatcaatacaaagtatgagacaaccatcttctag

SEQ ID NO: 179074 - DNA, 1185 bp, Artificial Sequence
  Description of Artificial Sequence: Synthetic coding sequence
atgggcccccggtgccccgtgcagaccgtgggccagtggctggagtcgataggcctccctcagtacgaaaaccaccttatggctaatggcttcgacaacgtgcagttcatgggttctaatgttatggaagaccaagacttgctcgagatcgggatcctgaattcaggccaccggcaaaggatactgcaggctatccagcttttacctaagatgagaccgatcggacatgacggttaccaccccacctccgtggcggaatggctcgacagcatcgaactgggggattacaccaaagcattcctgatcaacggctacacttccatggatctgctgaaaaagatctgggaagtggaactgatcaatgtactgaagatcaatctgatcggacatcggaagagaattcttgcaagtcttggagacagactgcatgacgaccctccccagaagccccccaggtctatcaccctgcgtaccggagactggggcgagccgagcattacactgcgaccccctaacgaagccacggcgtccactcccgtgcagtattggcagcaccatcccgaaaagcttatctttcaaagctgcgattacaaggccttttatctcgggagtatgcttatcaaagagcttcgtggaaccgaaagtacacaggacgcctgcgccaagatgcgggctaattgccagaagtccaccgagcagatgaagaaggtccccacgataatcctttcagtcagctacaaaggcgttaaatttatcgatgcaaccaataaaaatatcatcgcagaacacgagatacggaatatcagttgcgccgcccaagatcctgaagacctgagtacattcgcatatataactaaggatttgaaaagcaaccaccactattgccatgtattcacagctttcgacgtgaatcttgcgtatgagattatattaacactcggtcaggctttcgaggtggcgtaccaactggccctacaagcaagaaaaggaggccattccagtactttgccagaatcatttgaaaataaaccttccaagcccatcccaaagccacgagttagtatacgtaagtcagttattgacccaagcgagcagaagaccctagcaaacttaccatggattgtagaaccaggccaggaagcaaaaagaggcattaataccaagtacgagactaccatcttttag

SEQ ID NO: 179075 - DNA, 1254 bp, Artificial Sequence
  Description of Artificial Sequence: Synthetic coding sequence
atgagcacccggtaccaccaggccgccagcgacagctacctggagttgctgaaggaggccacaaaacgcgatttgaatctaagcgacgaagatggaatgactcctacgttgcttgctgcctaccacggaaacctcgaggcattggaaatcatctgctcacgaggtggggacccagatagatgtgatatctggggaaatactccactgcactttgcggcaagcaatggacacgcgcattgtgtgtcattccttgtgaattttggtgcaaatattttcgcgttggataacgacctgcagacaccattagatgccgccgcatcccgagagcaaaacgagtgcgttgctctgctcgataaggccgctacagcgcaaaatatcatgaaccccaagaaagtgactcgactgaaggaacaagctcagaagaacgctcgtcgacagattaaggagtgcgagcgccttcaggagaaacaccagaacaagatggcccacacgtacagcaaagaggagtccggtactctgtcatctagcaagggtacgttctccagaagctctccgtccaatgcctctgctcccggcaccttcggtagcctgagtaagggcataaaagatacctttaagattaaattcaagaagaataaggacacagccgaacaggttggtaaggagggaaggtccggacagcggaacgtaatggaggtgtttagggaagaggaagaagactccttctcaggagacttcaaggagaagctgcagctctctgctgaggaagatggatccgttcatcatgagagcatcctgaaccgccccggtttaggctctatcgtgttccgcaggaatcggatcagcagccccgaagacatctccgatagcaagagagagttcggctttaagctgccctccgaacttttacaaagacagggggccagcgaagcggacgaaggggccgccgacgaagaaggagaggaaaatggcctaaaggacgatttgccatgggatgacgacgaagtagagtgggaagaggatgtggtggatgccactcccttggaagtatttcttctctcccagcacctcgaggagtttcttccgatcttcaaaagggaacagattgatttggaagccctgcttctgtgttcggacgaagacttacagagcattcagatgcagttgggccccagaaagaaggttttaaacgccatcaatagacgaaagcaagtgctgcaacagccggggcaattggtcgacacatctctgtag

SEQ ID NO: 179076 - DNA, 7992 bp, Artificial Sequence
  Description of Artificial Sequence: Synthetic coding sequence
atgcccaagggcggctgccccaaggccccccagcaggaggagctgcccctgagttctgacatggtggaaaaacagaccggaaaaaaggataaggacaaggtcagtctcaccaaaactcctaaactggaaagaggcgacggcggcaaagaggttcgagaacgtgcaagtaagagaaagttaccctttaccgctggcgctaacggcgagcaaaaagattcggacacagaaaaacagggtcccgagcgaaagagaatcaagaaggaacctgtgacaagaaaagcagggctgctttttggaatgggcctgtctggcatccgtgctggctaccccctcagcgaaagacaacaggtcgcactgctcatgcaaatgacagctgaggaatcagctaacagtcctgtggatacgacccccaaacacccgagccaaagcactgtctgccagaaaggaactccaaactcagcctccaaaaccaaggataaagtaaacaaacggaatgagcgcggagagacccgtttacatcgcgccgccattcgtggtgacgcgcgccgcatcaaggagctcataagcgaaggagccgatgtgaatgttaaggacttcgccgggtggacagcactgcacgaagcatgtaaccgtgggtactacgatgtggctaaacaactactggcagccggcgccgaggtgaataccaaaggcctggatgacgacaccccgctgcatgatgctgctaataatgggcactataaagtggtcaaactcttgctgcgatacggtggcaacccccagcagtctaacagaaagggggaaacaccgctgaaagtcgccaattcacctactatggtcaacctcttgctgggaaagggcacatacacaagcagcgaggagtctagcaccgaatcatctgaggaagaggacgcaccatcgttcgcccctagttcttccgtggatggcaataatactgatagcgagtttgaaaaagggctgaagcataaagccaaaaatccggagcctcagaaggccacagccccagtgaaagacgaatatgagtttgacgaagatgatgaacaggacagagttccgcctgtcgatgacaagcatttgcttaaaaaagactaccggaaggagacaaagtctaatagctttatcagtatacctaagatggaagtcaagagttacacaaaaaacaataccattgcgcccaagaaagcatcccacagaatactctcggacacatccgatgaagaggatgctagcgtcaccgtcgggacaggggaaaaactgaggttgtctgcccacaccatcctgccaggctctaagacaagggagccctccaacgctaagcagcagaaggagaaaaataaagtgaagaagaaaagaaaaaaagaaaccaagggtagggaagtaagatttggaaaaagatcggacaaattctgttcttctgagtcagagtctgagtcatccgagtcaggggaagacgacagagattctttaggaagttctggctgtctgaaggggtcaccactggtcctgaaggacccatcactattttcatccctcagtgcaagctctaccagctcacatgggagttctgccgcacagaagcagaatccctcacacacagatcagcacaccaagcactggcgcacagacaactggaaaactatttcctcgccagcttggagcgaggtcagttctctgtccgattctactagaacgcgccttacttctgagtccgactactcaagtgaaggatcatcagtcgaatcactcaagccagtgcgaaaacgccaggagcaccgcaagagggctagtttaagtgagaaaaaatccccctttctctcttcagcagagggtgcagtccccaagctggataaggaggggaaggtggtgaagaagcataagactaaacacaagcataagaataaggagaaaggccagtgctcgattagccaggaactcaaacttaaaagtttcacatatgaatacgaagactcaaagcagaaaagtgataaagcaattctgcttgagaacgatctcagcacagaaaacaagctcaaggtgctgaagcatgaccgggatcatttcaaaaaagaggagaaactgtccaagatgaaactggaggaaaaggaatggctgttcaaggatgaaaaaagcctgaagcggatcaaggatactaacaaagatattagcaggagctttagggaagagaaagacagaagtaataaggcagagaaggagaggtcactgaaggagaaaagccctaaagaagaaaagcttaggctctataaggaagaacgcaagaaaaagtccaaggacagacccagtaaactggaaaagaaaaatgatttgaaagaggataagattagtaaggagaaggaaaagatcttcaaagaggacaaggaaaagctgaaaaaggagaaggtgtatcgggaagattctgcctttgacgagtattgcaacaaaaaccagtttcttgagaacgaggacaccaagtttagcctcagtgatgaccaacgagacagatggttctccgacctcagtgatagtagttttgacttcaaaggagaggattcatgggactccccagttacggattaccgcgacatgaagagcgactctgtggcaaaactgatcttggagacagtgaaggaggactcaaaggagaggagaagagattcccgagccagggaaaagcgcgattacagagaaccgtttttcaggaaaaaagatcgcgactacctggacaaaaatagcgagaaacggaaggaacagaccgagaaacacaaatctgtaccaggctatctttctgaaaaggacaagaaaagacgcgaatcagcagaagccggcagagaccgcaaagacgccttggaaagttgcaaagagagacgggacggtagggccaagcctgaggaagctcatcgcgaagagctgaaggaatgcggatgtgagtccggctttaaagacaaatcagacggcgacttcggtaagggcctagagccctgggaaaggcatcacccagcccgagagaaagagaagaaggatggcccagataaggagcgtaaagagaagaccaagcctgagcgctacaaggagaaatcatctgacaaggataagtcagagaagagtattttagagaaatgtcaaaaggacaaagagttcgataagtgttttaaggaaaaaaaagacaccaaagagaagcataaagatacacacggaaaagacaaagagaggaaggcctccctggaccaaggtaaggaaaagaaggagaaggccttccctggaatcatttcagaagatttcagtgaaaaaaaggacgacaagaaaggcaaagaaaaatcctggtatattgccgacatatttacagacgagagcgaggatgacagagattcctgtatgggaagcggattcaaaatgggcgaagcctctgatctgccacggactgatggtctccaagagaaggaggagggtcgagaggcttacgcctctgaccgacaccgcaagtcttctgataaacaacaccctgagcgacagaaggataaagaaccgcgagacagacgaaaggaccggggcgcagctgacgcaggccgggataagaaagaaaaggtgtttgagaaacacaaagagaagaaagataaagagtcaacagagaaatataaggaccggaaagatcgggcctcagtcgactcaacgcaagacaagaagaataagcagaaacttccagaaaaagccgaaaagaaacacgccgccgaggataaggcgaaatccaagcataaagagaaatccgacaaggaacattctaaagaacgcaagtctagcagatctgctgatgccgagaagtcactgctcgaaaaactcgaggaagaggctctgcacgaataccgggaagacagcaacgataagatctcagaggtgtcctccgatagttttaccgatagagggcaagaaccgggcttaacagcgtttctggaggtgagcttcaccgaaccccccggggacgataaacctcgtgaatcagcctgtctgcccgaaaagttgaaggaaaaggagcgccacagacactcttcatcatcatccaaaaaatcacacgacagggagcgggcaaaaaaggaaaaagcagaaaagaaggagaagggagaggattacaaagaaggaggcagcagaaaagactcagggcagtatgagaaggactttctcgaagcagatgcttacggtgtttcttataacatgaaagctgacatcgaagacgagctggacaagaccattgagttgttcagtaccgagaaaaaggacaagaacgactccgagcgagagcctagtaagaagatcgagaaagaacttaagccttatggttctagtgcaataaacattcttaaagaaaagaagaaacgtgagaagcacagggagaagtggagggatgagaaggagcggcacagggatcgccacgcagatgggctcctcagacatcacagagacgagctgctgcggcatcatagggacgaacagaaaccggcgacgcgagacaaggattcgcctccaagagtcctgaaggataagtcaagagatgaaggaccccgactaggcgacgccaagttgaaagaaaagtttaaagatggcgccgagaaggagaagggggacccagtcaaaatgtctaatggcaacgacaaagttgctccctctaaagatcccgggaaaaaggatgcgagacctcgggagaaactgctgggagacggcgacctgatgatgaccagctttgaacggatgctatcacagaaagacctcgagatcgaagaacggcacaaaaggcataaggaacggatgaagcagatggaaaagctgcgccataggtcaggcgatcctaagctgaaagagaaggccaagccagccgacgacggaaggaagaagggtttggatatcccagctaaaaagcctcctggtcttgaccccccgtttaaggacaaaaagttaaaggagagcactcccatacctcctgccgctgagaacaaactgcacccagcgtctggcgccgatagcaaggattggctcgccggaccacacatgaaggaggtcctcccagcaagccctcgaccggatcagagcagacctactggagtgccaacccctacctctgtgctatcttgtcctagttatgaggaagtcatgcacaccccccgcacacctagctgctcagccgacgactatgctgacctggtgtttgactgcgcggatagccagcatagcactcccgtgcctacagctcctacatctgcatgctctccttccttttttgaccgtttctctgttgcatcttccgggttgtcagagaacgccagccaggctcccgcgcgtccactgagtacaaatctgtacaggtcagtatctgtcgatattagacgaacccccgaagaggagtttagtgttggagacaagctgtttaggcagcaaagtgtccctgccgccagttcctatgactccccaatgcccccaagcatggaggaccgcgctccattgccccctgtgcctgctgagaaatttgcatgtctcagccctggttattacagtccagattacggactaccctcaccaaaggtcgacgccctgcattgcccccctgccgcagtggtcaccgttactcccagccctgaaggtgttttcagtagcttacaggcaaagccctccccgagccctagagcagagttgctggtgccatccttagagggtgccttgccgcctgacctcgatacctcggaggatcagcaggctaccgccgcaatcataccccccgagcctagttatctggaacctctggacgaaggcccatttagcgctgtgattactgaagagcccgtggagtgggcacacccaagcgagcaggctctcgcctccagcctcattggggggacctctgagaatcccgtctcatggcccgtggggtctgacctgctgctgaagtctcctcaacgttttcccgagagcccgaaacgtttctgcccagctgatcccctgcactccgctgcaccggggcctttctcagcctcggaagccccctaccccgccccacccgcatccccagccccctatgctttgcccgttgccgagcccggccttgaagatgtcaaggacggcgtcgatgccgtgccagctgcaatttcaacgagcgaagctgccccatatgccccaccttcagggctcgagtcttttttttccaactgcaaatcgttgcccgaagccccgctggacgtcgcacccgagcccgcctgcgttgccgccgtggcccaggtcgaggccctgggccctctggagaatagcttcctggacggttcgaggggactgtcccatttgggacaggtggaaccagtgccatgggctgacgcattcgcggggccagaagacgatctggacctgggaccattttctttacccgagttgccccttcagaccaaggatgcggcagatggcgaagctgaacctgtggaagagagccttgcacccccagaggagatgccccctggagcccccggtgtgattaatggcggcgatgtctccacagtggtggccgaggaaccaccagccctcccccctgaccaagccagtactaggctcccagcagagctggagcctgaaccctctggagagccaaaacttgatgtagccctcgaagccgcagtagaggccgagactgtccctgaagagcgcgctagaggagacccagatagtagcgtggaaccagccccagttcccccggagcaaaggccactcggatcaggtgaccagggtgcggaggcagaggggccgccggcagcaagcttgtgcgctccggatggtcctgcgcctaatacagtggcacaggcgcaggcagcagacggcgccgggcccgaggatgataccgaggcctccagggctgccgccccggctgagggtcctccgggaggcatccagcccgaagctgccgagccaaagccaaccgcggaggcccccaaggcgccgagggtagaagaaattccccaacggatgacacgcaatcgggcacagatgctcgccaatcagtctaagcaaggccctccaccaagcgagaaagagtgcgccccaacccctgccccagttacacgggccaaggcccggggctccgaggacgacgacgcgcaggcacagcaccccaggaaacggagatttcaacggtcgacacaacagcttcagcaacagttgaatactagtactcaacagacaagagaggtcatccagcagacactggctgccattgtggatgctatcaaactcgatgctatcgaaccctaccatagtgaccgagctaatccttacttcgaatatcttcagattcgcaaaaagatcgaagaaaagaggaagattctctgctgcattacaccccaggccccccagtgttacgccgagtatgtaacctacactggctcttatctgctcgacgggaagccgctctcgaaactgcatatacccgttatcgctccaccaccatcccttgcagaaccactgaaggagttgttccggcagcaggaggcggttagaggcaaactgcggttgcagcactccattgagagggagaaacttattgtgtcgtgcgagcaagagatcctgcgagttcattgtagggccgctcgaacaatagcaaaccaggccgtcccattcagcgcctgcaccatgttgttggatagcgaagtgtataacatgccacttgagtcacagggcgatgaaaacaagagcgttagagataggttcaatgcacgtcagttcatcagttggctgcaggatgtggacgataagtatgatcgaatgaaaacttgtttgttgatgcggcagcaacacgaagcagcagccctgaacgctgttcagcgaatggagtggcagctgaaggttcaagaacttgatcctgctggccataaaagtctgtgcgtgaacgaagtgccttcgttttacgtgccaatggtggacgttaacgatgactttgttctactgccagcttag

SEQ ID NO: 179077 - DNA, 1836 bp, Artificial Sequence
  Description of Artificial Sequence: Synthetic coding sequence
agcatccccaagatggaggtgaagagctacaccaagaacaacaccattgcacctaagaaagccagtcatcgcatcttatccgatacgtccgatgaggaggacgcatcggtaacagttggtacaggagaaaaactgaggctgagcgcccacaccattctgccgggatcaaagactcgggagccctccaacgcaaaacagcaaaaggagaagaataaggtgaagaaaaaaaggaagaaggaaactaagggccgcgaagtcaggttcgggaaacggtcagacaagttttgctcatcagagtctgaaagtgagtcctctgaatctggtgaggacgaccgcgactccctcggttcttcgggttgcttgaaggggagtcctctggtgctaaaggacccctcactgttctcttccctcagtgccagctctacttccagtcacggatcctctgcggctcaaaagcagaaccctagccacacagatcagcacacgaaacactggcgcaccgacaattggaagaccatcagctcacccgcctggtccgaggtgtcatcgctgtcagactccactagaactcgactgacatccgagagtgattactccagtgagggaagctccgtggagagtcttaaacccgtgcggaagcggcaggagcaccggaagcgcgccagcctgagcgaaaaaaagtctccctttttgtcgtcagcagagggcgctgtgccaaagctggataaggaaggcaaggtggtcaagaaacataagaccaagcacaaacataaaaacaaggagaagggccagtgtagcatcagccaggagcttaagttgaaatccttcacctatgaatatgaggatagcaagcaaaaatctgataaagctattctgctggaaaacgatctctccactgagaataaacttaaggtgctgaagcatgatcgagatcactttaagaaagaggaaaagctctcgaaaatgaagttggaagagaaagagtggcttttcaaggacgagaaatccctgaaaaggatcaaagacaccaataaggatatctcaaggtcatttagagaagagaaggatcggagcaacaaggcagaaaaggagaggagcctgaaagaaaagtctcccaaggaagaaaagctgagactgtacaaggaggagaggaagaagaagtcaaaggaccggccaagcaagctcgagaagaagaatgacctcaaggaagacaaaatctccaaggagaaagagaagattttcaaggaggataaggagaagctgaaaaaggagaaggtttaccgagaggacagcgcctttgacgagtactgtaacaagaatcagttcctagagaatgaagacactaagttcagcttgtcggacgaccaaagagaccgatggttctcagatctcagcgacagcagctttgactttaaaggtgaagatagttgggattcacccgtcacagattatcgtgacatgaaatccgatagtgttgctaagctaatcctggagaccgtgaaggaggattccaaagagcgcagacgagacagccgtgctcgcgagaagagggactatcgagagcctttttttcggaaaaaggatcgcgactatctggacaagaatagtgagaaacgcaaggagcagaccgaaaaacataaatccgttcctggttatctgtcagagaaacatgaaaggcgcagaagacgaatggcccccattagaaaaggaaggaggcggcagaatcagaaggacactaaaagaaatcctgtcacccgcacaaaggtgcgaaatcagagttggaaaaatgtgaggcgcaccaaaaaccttatcaatgtgctcaaaaggaaaaagtag

SEQ ID NO: 179078 - DNA, 7992 bp, Artificial Sequence
  Description of Artificial Sequence: Synthetic coding sequence
atgcccaagggcggctgccccaaggccccccagcaggaggagctgccactgagtagtgacatggttgagaagcagactggcaagaaagataaagacaaagtctctttgacaaagacccccaaactcgagaggggcgatggaggaaaagaagtccgtgagcgagcatccaagcgcaaacttccgttcaccgccggcgccaatggagagcagaaagactctgataccgagaaacagggccccgagcgcaaacgtatcaagaaggagccggtgactcggaaagcgggactacttttcggtatgggactttccgggattagagctggttaccctctgagcgaacgccagcaggtggcactcctaatgcagatgacagctgaggagagcgctaattcgcctgtggacaccactcccaaacatccgagccagtcaaccgtctgtcagaagggtacccctaactcagcgtctaagacaaaggacaaggttaacaaacgaaacgaacgaggggaaacgcggctgcatcgggcagcgattagaggcgacgctagacgaatcaaggaactgatctccgagggtgctgatgtgaacgttaaggacttcgccggttggactgcgctacacgaggcctgtaaccgggggtactatgacgtggctaagcagcttctagctgctggtgcagaagtgaacactaaggggcttgacgacgatactcccctgcacgatgcggctaacaacggacactacaaggtcgtgaagcttctacttagatacggtggaaacccccagcagagcaataggaagggagaaactccacttaaagtagccaattctccaactatggttaaccttttactggggaaaggtacatacacaagctctgaagagtctagtacggagtcttccgaggaggaagacgcgccgtctttcgctccctcttcttccgtcgatgggaataacaccgactccgaattcgaaaagggtctcaaacacaaggcaaaaaacccagagcctcagaaagcaactgccccagtcaaagacgaatatgagtttgatgaggacgacgagcaagatcgggtcccacccgtggacgataaacacctactgaagaaagattatagaaaggagaccaaatctaacagcttcatatctatccccaaaatggaagtgaagtcatatacaaaaaacaacacaatcgccccgaagaaggcttctcataggatactttcggatacttcggacgaggaagatgccagcgtgacggtgggtaccggtgaaaagttgcgactgtcagctcacactatcttacccggatctaaaactagggaacccagcaacgccaagcaacagaaggagaagaacaaagtcaaaaaaaaacggaaaaaggaaacaaagggccgcgaagtgagattcggaaaaagatctgacaagttttgcagttccgaaagcgaatctgagtcctcagaatccggcgaagatgatcgggattctttgggatccagtgggtgcttaaaaggatctcctcttgtactgaaagaccccagtctgttctcatcacttagcgccagcagcacctcttcccacgggagcagcgcagcccagaaacagaacccatcgcatacagatcagcataccaaacattggagaactgacaattggaagaccatcagtagccctgcttggagcgaggtgagctctctgtcagatagcactaggacaagactgaccagtgagtccgattatagcagtgaaggttcatcagtggagtcactcaagcccgttcggaagagacaagagcatagaaaaagggcatctctgtcagagaagaagagccccttcttgtcttccgccgagggggccgttcccaagctcgacaaggaaggaaaggtggtgaaaaagcataaaactaaacacaagcacaaaaataaagaaaaagggcagtgctcaatctcgcaggagctgaagctgaagtcattcacctacgagtatgaagatagcaaacagaaatctgataaggccattcttctggagaacgatctttctaccgagaacaaactaaaggtcttgaaacacgaccgggaccattttaagaaagaagaaaagcttagcaagatgaaactcgaagaaaaagagtggctattcaaagatgaaaaatctctgaaacggattaaagacacgaacaaggacatttcgagatcttttcgcgaggaaaaagatagaagtaacaaggctgagaaagagcgctcactaaaggaaaagtcccccaaggaagagaagctgcgactgtacaaagaagaacggaagaagaagagcaaggacagaccaagtaagcttgagaagaagaatgatctcaaagaggataaaatctcgaaagagaaagagaagattttcaaggaagacaaagaaaagttgaaaaaggagaaggtgtatcgcgaggattctgcattcgacgagtactgcaataagaaccagtttctggagaatgaagacacaaaattttccctgagtgatgatcagcgagacagatggttttcagacctgagcgactcaagtttcgacttcaagggggaggatagttgggatagccccgtcaccgattaccgggacatgaagtccgatagcgtggctaagttgattttggaaaccgttaaggaagacagtaaagaacggaggcgcgactccagggccagagaaaaacgggattaccgcgaaccattcttcagaaagaaagaccgcgactacctggacaagaactctgaaaagcgtaaggaacaaactgaaaagcataagtccgtccctggatacttgagcgagaaagacaagaagaggcgcgagagtgcagaggccggccgagaccgcaaagatgcccttgagtcttgcaaagagcgtcgcgacggaagggcaaagcctgaggaagcccatagggaggagctgaaggagtgtggttgtgagtcaggattcaaagacaagtcggatggggattttggaaagggtttagagccgtgggaacggcaccaccccgctcgcgaaaaagagaagaaagacggtccagacaaggagagaaaggagaaaactaaaccggaacgatataaagaaaaatctagcgacaaggacaagagcgagaagtccatcttagagaagtgccaaaaagacaaggaattcgacaaatgttttaaggaaaagaaagatacgaaggaaaagcataaggatacacacggaaaagataaggagcgaaaggcaagtctggatcaaggaaaggagaagaaggaaaaggctttccctggcatcatcagcgaggacttcagcgaaaaaaaggatgacaagaaaggcaaggaaaagagttggtacattgcggatatctttactgatgaatctgaagacgatagggactcctgcatgggttcaggattcaagatgggagaggcttcagatctgccccgtaccgacgggctgcaggaaaaagaggaaggcagggaggcatacgccagcgaccgtcatcggaaaagctcggataagcagcatccagagcggcaaaaggataaggagccacgtgaccggagaaaggaccggggcgcagccgatgccggacgggacaagaaggagaaagtgttcgagaaacataaggaaaagaaagacaaggagagtaccgagaagtataaagaccgcaaagaccgcgcgtccgtcgactctacccaggacaagaaaaacaagcagaagcttccagaaaaggctgaaaagaagcacgccgctgaggataaagcgaagtccaaacacaaagagaagtcagacaaggaacactccaaggagcggaagtcgtctagatcagcggatgctgagaaatctctgttggagaaattagaagaagaggcccttcatgagtatagggaggactccaatgacaaaatcagcgaggttagctctgactcatttacagataggggccaagaacctggcctgaccgccttcttagaagtctcatttactgaaccccctggggatgacaagcctcgcgagagcgcgtgcttgccagagaaactcaaggagaaggaacgccatcggcatagctcatcctcctctaagaagtcacacgaccgcgagagggcaaagaaagagaaagcagaaaagaaggagaaaggagaggactacaaagagggaggttcccggaaagacagcgggcagtacgaaaaagacttccttgaagccgacgcctatggtgtgagctataacatgaaggctgacatcgaggacgaactcgacaagactatcgagctgttttctacagaaaaaaaagataaaaacgatagcgaacgagaaccttctaagaagattgagaaggaactcaaaccttacggcagctcagcaattaatatcctcaaagagaaaaagaagcgggagaaacacagggagaagtggcgtgatgaaaaggagcgccacagggataggcacgctgatggactccttagacaccaccgggacgaactgttgagacaccatcgcgacgagcagaagcctgccacacgtgacaaagacagcccaccccgagtcctgaaggacaaaagtagggacgaggggcctagattgggtgatgccaaactgaaggagaagtttaaggacggtgcagaaaaggagaagggagatcctgtgaaaatgtccaacgggaacgataaagtcgccccatcgaaggaccctggaaaaaaggatgctcgcccccgtgagaagctgttaggggacggcgaccttatgatgaccagctttgagcgcatgctgagccaaaaagacctcgaaatcgaagagagacacaagaggcataaagaacgtatgaagcagatggaaaagctgcgacacaggtccggggatccaaagctaaaggagaaagccaaaccggcagatgacggacggaagaaaggcttggacatccctgccaagaagccacccggcctagatccaccttttaaggacaagaaactgaaggaaagcacccccattcccccagcagccgagaataaactccaccctgccagcggcgcagactcgaaggattggcttgccggcccacatatgaaggaggtcctgccagcctcgcccaggccagaccagtcgaggccgaccggggtccctacccctacctccgttctgtcgtgtccttcatacgaggaagtgatgcatactcccagaacccccagctgcagcgcagatgactatgccgatctggtttttgactgtgccgattcacagcacagcacacccgttcctacggctccaacttccgcttgctcgccttcattttttgataggttttcagtggcctcttccgggctcagtgagaatgcctcacaggctccagctaggccactttcaacgaacctgtataggtcggtttctgtggacattaggaggacccctgaggaagaattttctgtaggcgacaagctcttcaggcagcagagtgtgcccgcggcctcatcatacgactcaccaatgccgcctagcatggaagacagagcaccattgccaccggtgcctgctgagaagtttgcttgcctatcacctggctactacagtcctgattatgggcttccttcacccaaggttgatgctctgcactgccctcctgccgccgttgtgacggttacaccttccccggagggagtattctcatcattgcaggctaaaccatctccatcaccccgggccgagttgcttgttccctccctggaaggagcgctgccccccgatctcgacacatctgaggatcagcaggccacagcagcgatcatccccccagagccctcgtacttggaaccattggatgagggcccattctccgccgtgattaccgaagagccagttgaatgggcgcatcctagcgagcaagcattagccagcagcctcatcggaggtaccagtgagaatccagtgagctggccagtgggctcagacctgttactcaagtctcctcagcgttttcccgagtctcccaaaaggttctgcccagccgatcccctgcattccgcagcgcccggaccttttagcgccagtgaggcaccttaccccgccccgccagcttctcctgccccttacgcactacccgttgcggaacccgggttggaggacgtgaaggacggtgttgatgccgttccagcggctatcagtaccagtgaggccgcaccttatgccccaccttcaggtttagagtcctttttttccaattgcaaatcactgccagaggcccctctcgacgtagcgcccgagcccgcatgtgtagccgcggtcgctcaggtcgaagcacttggtcccctagaaaacagttttctagatggttccagaggcctctcccacctggggcaggttgaaccagtgccctgggctgatgccttcgccgggcctgaagatgatcttgacctcggcccatttagcctccctgagctgccgttacaaacaaaagatgcagccgatggtgaggccgagccagtagaggagagtctggctcctcccgaggaaatgcccccgggcgcgccaggcgtcatcaatggtggggatgtcagcacagtggtggccgaagagcccccagccctcccgccagaccaggcatccacaaggttgccagccgagcttgagcccgagccttccggagagccaaaactggacgtggcattggaggccgcagtcgaagccgagactgtgcccgaagagcgggcccgaggggatcccgacagctccgtggaacctgctccagtaccccccgagcaacgtcctcttgggagcggagatcagggcgcagaggcggagggaccccctgccgcgtctctttgcgcacccgatggacccgctcctaataccgtcgcccaagctcaggcggcggatggagctggccctgaagacgacacagaggcaagcagggcagccgcacccgccgaggggccacccggcgggatccagccggaagcagcagagcctaaaccgacagccgaggctcccaaagcccccagggtggaggagattccccaaagaatgacccgcaaccgagctcagatgttagcaaatcaatccaaacagggcccgccgccctcagagaaagaatgcgctcccacacccgccccagtgacccgggccaaagccagaggctccgaagatgacgatgcccaggcccagcaccctagaaaacgcagatttcagcggtctacccagcaactgcaacaacaactgaacacaagcacccagcagaccagggaggtgatacagcagacgctggcagccatcgtggacgccatcaagttagacgccatcgaaccttaccattctgatagagccaacccctactttgagtacctccagataagaaagaagatcgaagaaaagcggaaaatcctttgttgtattaccccccaggccccacagtgctatgccgagtacgtaacttatactggaagctacctgctggatgggaaacctctctcgaagctacacatccctgtcattgcccctccccctagtctggctgaaccacttaaagagctgtttcgccagcaagaagctgtcaggggaaagctgaggttacagcattccatcgaacgagaaaaacttatcgtatcatgcgagcaggagatccttcgggtccattgtagagcagctcggaccatcgcaaaccaggctgtcccctttagcgcttgtacaatgcttctggacagcgaagtatataacatgccactggaatcacagggcgacgagaataagtccgtcagggataggttcaacgccaggcaatttatcagctggctgcaggacgtggatgacaaatacgatcggatgaaaacttgcctcttgatgagacagcagcacgaggccgcagcattaaacgctgttcagcggatggaatggcagctgaaggtccaggagctagaccccgcaggccacaagtcactttgtgtcaacgaagttccttcattctacgtaccaatggtggacgtgaatgacgacttcgtcctcttacccgcttag

SEQ ID NO: 179079 - DNA, 1317 bp, Artificial Sequence
  Description of Artificial Sequence: Synthetic coding sequence
agcgccggccgggtgaacgaggaccgggtgcggagccggaccatgcccaaggggggctgccctaaggcacctcagcaggaggagttgcctctcagttctgacatggtggagaaacagaccggaaaaaaggacaaagataaagtgtctctcacgaagactccaaaactggagcgcggcgatggcggcaaggaagttcgggaaagagcctctaaaaggaagcttccatttaccgccggagccaacggcgagcaaaaggattccgacactgagaaacagggacccgagcgtaagcgcataaagaaggagcccgtgacgagaaaagccggcctcctctttggcatgggtttatcaggaatcagggcggggtaccccctttctgagcgtcaacaggtggccctgcttatgcagatgactgctgaggaatcagccaactcacccgttgatacaactcctaagcatcctagccagtcgactgtttgccagaagggaacgccaaattccgcttctaaaactaaagacaaagtcaacaaaaggaacgaacgaggcgagacaagactgcatagagccgccatcaggggcgacgcccggcgaatcaaggaattaatctccgaaggggcagacgtgaacgtgaaagacttcgccggatggaccgctctgcacgaggcttgcaatagaggctactatgacgtggcaaaacaactactggccgctggagctgaagtgaatacaaaaggactggacgacgatacacccttgcatgatgccgccaataatggacattacaaggttgtcaagcttttattgcggtacggcggaaacccacagcagtctaaccgaaagggagagacccctctgaaggtcgctaatagcccaacaatggtcaatttattactcggtaaggggacatacacttcttccgaggagtcatccaccgaaagctccgaggaagaagacgccccttcatttgcaccatctagttcggttgacggtaacaacaccgattcagagtttgagaaaggactcaagcataaggctaaaaaccctgaaccccaaaaagccacagcgccggtgaaggatgagtatgagtttgatgaagacgatgagcaggatcgggtcccacccgtggacgacaagcacctcctcaagaaagactaccggaaggaaaccaaaagtaacagctttatcagtatacccaaaatggagaaggttactttgaagatcacaagactgcaccagcggaagcggcctatagtttcgtgccagacccgcagaacgcggcgcacacgggtaagtccatggggccaggagcggtcctag

SEQ ID NO: 179080 - DNA, 6189 bp, Artificial Sequence
  Description of Artificial Sequence: Synthetic coding sequence
atgcccaagagcggcttcaccaagcccatccagagcgagaacagcgactccgatagcaacatggttgaaaagccttacggccgaaagtcgaaggacaagattgcctcctatagcaaaactccaaagatcgagcgatccgatgtcagtaaggagatgaaagaaaaatcctcaatgaaacggaagctccctttcaccattagtccatctcggaacgaggagcgcgactccgacactgacagtgaccctggtcacacgtctgagaactggggtgagcgtttgataagttcttaccgaacctactctgaaaaggaagggccagaaaaaaagaaaaccaaaaaggaagcagggaacaaaaaatctacacccgtcagtattctgtttggctaccctctgagtgaaaggaaacagatggccctgctgatgcagatgacagcaagggacaattcacccgactccactcctaatcatccatcccagactaccccagcccagaagaagacccccagctcatcttccagacagaaggataaagttaacaaaaggaatgagcgaggcgagacgccacttcacatggccgccattcgcggtgacgtgaaacaggtcaaagagttgatcagcctgggagccaatgttaatgtaaaagactttgcaggatggacaccactgcacgaggcatgcaatgtgggatactacgatgtggccaagatacttattgcggcaggtgctgacgtcaatactcagggtcttgatgacgatacaccccttcacgattctgcttcctcaggccatagagatatagtgaagctgctgttacggcacggaggtaatccattccaggctaacaagcatggtgagaggccagtggacgtcgccgaaaccgaagagctggaactgctgttaaaacgggaagtgcccctgagcgatgacgatgaaagctacacagatagcgaggaggctcagagtgtgaacccaagcagcgtagacgagaacatcgacagcgagactgagaaagattcattgatctgtgaatcaaagcagatccttcccagcaagacacccctgccgtcggctttggacgagtatgagttcaaagatgacgacgacgaggaaatcaataagatgatcgacgatcgccacatcctcagaaaggagcaaagaaaggagaacgaaccagaggctgaaaaaacgcatctcttcgctaagcaagaaaaggctttctacccgaaatcttttaagtctaaaaaacagaagccatccagagtactgtattcttctacagagtcaagcgacgaggaggccctgcagaacaagaaaatctctacttcatgtagcgtgatccccgagacaagtaattcagacatgcagacaaaaaaagaatacgtggtctctggcgagcacaaacagaagggcaaagtcaaaaggaaactcaaaaatcagaataaaaacaaggaaaaccaggagctgaagcaggagaaggaaggaaaggaaaacactcgtatcaccaacctaaccgttaatacaggccttgactgctcagaaaagacaagagaggaaggcaacttcaggaagtcgttcagccccaaggatgacacttcactccacctgttccacatctctaccggaaagtcccctaagcattcatgcgggctctccgagaagcagagtactcccctgaaacaggagcataccaagacctgcctttctcccgggtcttcagagatgtctctgcaaccagatctggtccggtatgataatacagagagtgaatttctgcccgagtcgtccagcgtcaaatcatgcaagcataaggaaaaaagtaagcaccagaaggatttccacttagaattcggagagaaatcgaacgctaaaataaaagacgaggatcactcaccaaccttcgaaaactccgactgtactctaaaaaagatggataaggagggtaaaacactgaaaaaacacaagctgaaacataaagaacgggagaaagaaaaacacaagaaggagatcgaaggcgaaaaggagaaatacaagaccaaagatagcgccaaggagctgcagcgtagcgtagaatttgacagggagttttggaaggaaaacttcttcaagtccgacgaaaccgaggatcttttcctcaatatggagcatgagtcgcttacccttgagaagaaaagcaaactcgagaagaatattaaagacgataagtcgacaaaagagaagcacgtgtcaaaagaacggaacttcaaggaagagagagacaagataaaaaaagaaagcgagaaaagctttagagaagaaaaaatcaaggacctgaaagaagaacgcgagaacattccaactgataaggacagcgaatttacctccttgggtatgagtgcaatcgaagaaagcattggtttgcatctggttgagaaagagattgacatcgaaaagcaggaaaagcacatcaaggaatctaaggaaaaaccagaaaagcggagccagattaaggaaaaggatatcgaaaagatggagcggaagacctttgaaaaggaaaagaagatcaagcacgaacacaagtctgagaaagacaaactcgacctgtccgagtgcgtcgacaagatcaaggagaaggataagctgtattcacaccataccgaaaagtgccacaaggagggcgaaaagtccaagaataccgccgccattaagaagaccgatgatagggagaaatcacgcgagaagatggatcgcaagcatgacaaggaaaagccggaaaaggaaagacatctggccgaaagtaaggagaagcacctcatggagaaaaaaaataaacaatcagataactccgagtactcgaagtcggaaaaaggcaaaaacaaagagaaggaccgagaattggacaagaaagaaaagtcccgtgacaaggaatctattaatataacgaacagcaagcatatccaagaggaaaaaaagtcttcaatagtggacggtaataaggcccagcacgaaaaaccactgtccctgaaggagaagaccaaggacgaaccattaaagacaccggatgggaaggagaaggacaagaaggacaaggacatcgatcgatataaagaaagggataagcataaggacaagattcagattaacagtcttctgaagctgaagtctgaggccgataaacccaagcccaagagtagccccgcatctaaggacactaggcctaaggaaaagcggctggttaatgatgaccttatgcaaaccagtttcgaaagaatgctcagtctgaaggacttggaaattgagcagtggcacaaaaaacacaaggaaaaaattaaacagaaggaaaaggagcggctgcgaaatcgtaattgcctggaactgaaaattaaggataaagaaaaaactaagcacactcccactgagagtaagaacaaggaattaacccgcagcaagtcatcagaggtcacggatgcatatacaaaagagaaacagcccaaggacgcagtttctaacaggagccagtctgttgacacaaagaacgtgatgactctgggaaagtctagcttcgtgtcagacaatagcctgaacaggtcccctaggtcagaaaacgaaaagccaggcctgtctagcagatccgtatccatgatttctgtggcttcttcggaagacagttgccacaccactgtcacaacgccacgccctcctgtggagtacgactccgacttcatgttagagagctccgagtcccagatgagtttcagccagagtccatttctgtctattgcaaagtctcctgcgttacacgagagggaacttgacagcctggctgatctccctgaacgaattaaacccccgtatgccaatcgcctgtccactagccacttgcgcagctcttcagtggaggatgtcaagctgatcatttccgagggccgacctactatcgaggtgagacgctgcagcatgcctagcgtgatctgcgagcacacaaaacaatttcagactataagcgaagagtctaatcaaggaagcttactcacagttccaggcgatacctccccctcacctaaaccggaggtgttctcaaacgtgcctgagcgcgatcttagtaatgtctccaatattcatagctcattcgcaacttctcctaccggcgcatccaactcgaaatacgtttccgctgatcgaaatttaatcaaaaacacagcccccgttaacacggtaatggacagccctgtgcacctggaaccgtcctctcaagtgggggttatccagaacaagtcctgggagatgcccgtcgaccgtctcgagacactcagcactcgggacttcatctgtcctaacagcaacataccagaccaggaaagctccctgcaatccttttgcaattccgaaaacaaagtcttgaaggagaatgccgactttctatctcttcgacaaacagagctcccagggaacagttgcgcccaggaccctgcgagtttcatgcctccacagcagccttgttcctttccttctcagtctctgtccgatgccgagtcaatttccaaacacatgtctctcagttacgtggcaaatcaggagccaggaatcctgcagcaaaagaatgccgtgcagatcatttcatcagccctggacaccgacaatgaaagtactaaggataccgagaatacttttgtgctaggcgatgtgcagaaaaccgatgcattcgtccctgtgtatagcgatagcacaattcaagaggcttccccgaattttgagaaggcctacacgctgccagtactgccttccgagaaggactttaatggatcagatgcctccactcagctgaatacccactacgccttttccaagttgacttacaaatcttctagcggtcacgaggtggagaattccactacagatacacaagtgatcagccacgagaaggaaaataagctagagtccctcgttctcactcatttgtctcgctgtgactctgatctgtgtgaaatgaatgccggtatgccgaaaggcaacctgaatgaacaggatcccaaacactgtccggagtccgagaaatgtctgttatccattgaagacgaggagagtcaacaatctattctcagcagcctggaaaaccattctcagcagagcacccagccagagatgcataagtacgggcagctggtgaaagtcgagctggaagagaacgctgaagatgataaaacagaaaatcagattccccaaagaatgacaagaaacaaagccaacacaatggcgaatcagagtaaacagatcctcgcttcctgcactcttcttagtgagaaggattccgagtcatcttctccaagaggtcgtattaggctgactgaggacgacgatccacagattcaccacccaagaaaacgaaaggtgtcacgggtcccgcagccggtgcaggtgtcccctagcctcctacaggccaaagagaagacacagcagagcctggctgccatcgttgatagtcttaagctcgatgagattcagccatattcttccgaacgagctaacccatacttcgaatacttacacatccgcaagaagattgaggagaagagaaagctgctgtgcagcgtgatcccacaggcccctcagtattacgacgaatatgtgaccttcaacgggtcctatcttctcgacggaaatccgctatcgaaaatatgtatcccaactatcactccccccccctccctctcggatcccctgaaggagctcttccgtcagcaagaagtagttaggatgaagctgcgccttcagcattccattgagcgagaaaagctcattgtcagcaatgagcaggaagtacttagggtccattatcgggccgccaggaccctggccaaccagaccttaccgttcagcgcctgtactgtgctattagacgcggaagtgtacaatgtcccactagactcccagtcggatgattcaaaaacctccgtcagggatcggttcaatgccaggcagtttatgtcttggctccaggatgtcgatgataaattcgataaactcaaaacctgcctgctcatgaggcaacagcacgaagccgctgcactgaatgccgtgcagcgacttgagtggcagcttaaactgcaagaactggaccccgctacgtataagtctattagtatttatgaaatccaggaattctacgttccgttggtcgacgttaacgatgactttgagctcacacccatttag

SEQ ID NO: 179081 - DNA, 1317 bp, Artificial Sequence
  Description of Artificial Sequence: Synthetic coding sequence
atggtgaacgtgcccgagctgctgctgggccagagccccagccggaacgacacaaaaattattaattccgaggaagcgcagagcgtcaacccatcttcagttgacgaaaacatagactctgaaactgagaaggacagcttgatctgtgaatctaaacaaattctgccttccaaaactcctcttccgtcagcactggacgagtacgagttcaaggacgatgatgacgaagagatcaacaagatgattgatgacaggcatattctacgcaaggaacagcgtaaggagaatgagcccgaggccgagaaaactcatctatttgccaagcaggaaaaggcgttttatccgaaatctttcaaatctaaaaagcagaagcctagccgggtgttatactccagtacagaatcttcggacgaagaggccttgcaaaacaagaagatatctacctcatgctctgtgattcccgaaaccagcaacagcgatatgcagacaaaaaaggagtacgtggtctctggggagcataaacaaaaggggaaagtgaaacggaagctaaagaatcagaacaagaacaaagaaaaccaggagcttaaacaggagaaagagggcaaggaaaatacacggatcactaacttgaccgtgaacacagggcttgactgctcagagaagacaagagaggagggcaatttcaggaagtctttttcaccaaaagatgatacatcgctgcacctcttccacattagtacaggaaagtcccctaaacatagctgtggactctctgagaagcaaagtacgcctctcaaacaagaacacactaaaacatgtttgtctcccgggagttccgagatgagcctgcaaccagatctggtgcgctatgataacaccgaaagtgaattcctacccgagtctagcagcgtgaaaagctgcaaacacaaggagaagagtaaacatcagaaggattttcatttagagttcggcgagaaatctaacgcaaagatcaaggatgaagatcattcccctacatttgagaactccgattgcacgctgaagaagatggacaaagagggtaaaaccctgaaaaaacataaactaaaacacaaagaacgcgagaaggaaaaacataagaaggaaatcgagggcgagaaggaaaaatacaaaactaaggactccgcgaaggaattacagcgaagtgtggagtttgatcgcgagttctggaaggagaacttttttaagtctgacgagaccgaagatctgttcctgaatatggaacacgaatccctcaccctggaaaagatcaagatcggcaaaaaacaccagcgttag

SEQ ID NO: 179082 - DNA, 6120 bp, Artificial Sequence
  Description of Artificial Sequence: Synthetic coding sequence
atgcccaagagcggcttcaccaagcccatccagagcgagaacagcgattcagactcaaatatggtcgagaagccgtacggcagaaagagcaaggataagatagcctcttattctaaaacacccaagatcgaaaggagcgatgtaagcaaggaaatgaaggagaagtcttctatgaagcgcaaactgcccttcactatctccccttcccgtaacgaggaaagggactccgacacagaaaaggagggccccgagaaaaaaaaaaccaagaaagaagcaggtaataagaaatcaacacccgtttcaattctttttggctaccccctgtccgagcggaaacagatggccctgctcatgcaaatgacagcccgcgacaactcccccgactctacacctaaccaccccagtcaaaccacgcctgctcaaaaaaagacaccctcttcctcctcacgccaaaaggacaaggtgaacaagaggaacgagcgcggcgagaccccactccacatggcagcgattaggggcgacgtgaagcaagtcaaggagttgatcagcctcggagccaacgtgaatgttaaggacttcgctgggtggactcccctgcatgaggcctgtaacgtcggttattatgacgtggctaagatattgatagctgctggcgcggatgttaacacacaggggctggacgatgatacccccctgcatgattccgcttcgagtgggcatagagatattgtgaaacttcttctccgacatggcggtaacccttttcaagctaataagcatggggagcgccctgttgacgtcgccgagacggaggagctggagttgctcttgaagagggaagtgcccctttccgatgatgatgagagctacaccgatagtgaggaggctcagagcgtcaacccctcttccgttgatgagaacatagattctgagacagagaaggactccttaatatgtgaaagtaaacaaatcctccccagcaaaacccccctgcctagcgccctcgacgagtatgaatttaaggatgacgatgacgaggagattaacaaaatgatcgatgacaggcacattctgagaaaagagcagaggaaagagaacgagcctgaagcggagaagacccacttgttcgccaagcaggagaaagcattttaccccaagagtttcaagtccaagaagcaaaaaccatctagagttttatactccagtacggaatcaagcgatgaggaagcacttcagaacaagaaaattagcacttcatgcagtgtcattcctgaaacctctaatagtgacatgcaaacgaagaaggagtatgtggtctcgggggaacataagcagaagggaaaagtcaaacggaagttgaaaaatcaaaacaagaacaaagagaaccaggagttgaagcaggaaaaagagggtaaggaaaatacacgcattaccaacctgaccgtgaacaccggccttgactgctccgagaaaacacgggaggagggaaatttcagaaagtctttttcccctaaagatgatacgagtctccatcttttccatataagcacaggaaaatcacccaagcactcatgcggcttatcagagaaacaatcaacccccctcaagcaggaacacacaaagacatgcctctcccctgggtcttctgaaatgtccctccagcctgacctcgtgcggtacgataataccgagagcgagttcttgccagagtcatcctcagtgaagagctgcaaacacaaggagaaaagcaaacaccagaaagatttccacctggagttcggcgagaaaagtaatgccaagattaaagacgaggaccatagccctaccttcgagaatagcgactgtaccctaaagaagatggacaaggaggggaagacacttaagaaacataaactgaaacacaaggagagggaaaaagaaaagcacaagaaagagatcgagggtgagaaggagaagtataaaacaaaagattccgctaaagaacttcagcggagcgtggagttcgatagagagttttggaaagaaaattttttcaaaagcgacgagactgaagatctcttccttaacatggagcatgagtccctgaccctggaaaaaaaaagcaagctggaaaaaaatatcaaagacgataagtccaccaaggaaaaacacgtatccaaagagcgcaatttcaaggaggaaagagataaaatcaaaaaggagagcgagaagtccttcagggaagagaaaataaaggatcttaaggaagagagggaaaacatccccactgacaaggacagtgagttcaccagcctggggatgagcgcaatcgaggagtctatcggcttgcatctcgttgagaaggagatcgatatcgagaagcaggaaaagcatatcaaagagagcaaagagaaacccgaaaaaaggtcccaaattaaagagaaggacatcgaaaagatggagcggaagacatttgagaaggagaaaaagattaaacacgaacataagagcgaaaaagataagctggatctgagtgagtgcgttgataaaattaaagagaaggacaaattgtattctcatcataccgaaaaatgccacaaggaaggggaaaagtccaagaatacagccgccattaagaaaacggatgaccgggagaagtcccgagagaagatggatagaaaacatgataaggagaagcccgaaaaagagaggcatctggccgagtccaaggagaagcatctgatggagaaaaaaaataagcagtcagataatagtgagtacagcaagtccgagaaaggaaagaataaagagaaggatcgcgagctcgacaaaaaggaaaagagtcgagacaaagagagtataaacatcaccaactccaagcacatccaggaggaaaagaaatcgagcatagtggacgggaataaggcccagcacgagaaacctctgtcgctaaaggaaaagacaaaagacgagcctctaaagacccccgacggtaaggagaaagacaaaaaagataaggatatcgacaggtacaaggagagagacaagcataaagacaagatccaaataaacagtctgttgaagctgaagtctgaggccgacaaacctaagccaaaatcgtcacctgcttccaaagacacgcggccgaaagagaaacgactggttaacgatgacctgatgcagacctcattcgagcgaatgttatctcttaaggatctggagatagagcaatggcataagaaacataaggagaagattaaacagaaagaaaaagaacgtctgcgaaacaggaactgtctggaactcaaaatcaaggacaaagaaaagactaagcacactccgaccgaatctaagaataaggagcttaccaggtcaaagagtagcgaggtgacggacgcctacacaaaagaaaaacagcctaaagacgctgttagtaatagaagtcagtcagtggacaccaagaacgttatgacgctagggaagtcatcattcgtatccgataattcccttaaccggtcacctcggagcgaaaatgaaaaacctggcctgtcctcccggtctgtgagtatgatttccgttgcgtcatccgaggactcgtgtcatactaccgtgactacaccaaggcccccagtcgaatacgatagcgacttcatgctggaatcctcggaatctcagatgagcttcagccagtccccttttctcagcatcgcaaaatcccctgcactgcatgaacgagagctcgattccctagctgatctgcctgaacgcatcaagccgccctacgctaatagactgtcaacttcccacctacgtagctcatccgtagaagatgtgaaactgatcatttctgagggccgacccactattgaagtgagacgctgtagcatgccctctgtgatctgcgagcacaccaaacagtttcaaactatcagtgaggaaagcaatcaaggcagtttactgaccgtccccggggatacttctcccagtccaaagccggaagtattctctaatgttccagagcgggatctgtcaaacgtatcaaatattcactcgagctttgcaacgagccctaccggcgcaagtaattcaaaatatgtctcagcggacaggaatctgatcaaaaatacagcacctgtgaatacggtgatggactctcccgtgcacctggagccatcctctcaggtgggggtaatccagaacaaatcgtgggagatgcccgtggatcggttggaaactctgtctactagagattttatatgcccgaactccaatattccagaccaggagtcctctctgcaaagcttttgtaatagtgagaacaaggtattgaaggagaatgccgatttcctgtccttacgacagacagagcttcccggaaattcctgcgcccaggaccccgcctcttttatgccacctcagcagccctgttcgttcccatctcagagtctctcagatgccgaatcaataagcaagcatatgtcgctgtcatacgtcgccaaccaggaaccaggtatcttgcagcagaaaaatgctgtgcagatcatttcaagtgcactggatacagataacgagtctaccaaggacaccgaaaacacatttgtgttaggagacgtccagaagacagatgcctttgtgcctgtctacagcgattccaccattcaagaggcctcgccaaatttcgaaaaggcctatactctgccagtgttgccatccgagaaagattttaatggctcagacgcaagcacacagctgaacacacactacgcattctccaagctgacttacaagagcagcagcggccacgaggtggagaatagcaccaccgacacacaggtcatctctcacgagaaggaaaacaagctcgaatcacttgttctgacacacctgagtcgatgcgattctgacctttgcgaaatgaatgcgggaatgcctaaaggcaatctaaacgagcaggatccgaaacactgtcccgagtctgagaagtgcctactaagtatcgaagatgaagaaagtcagcaatctatcctgtcatctttggagaaccactcacagcagagcacccagcccgaaatgcataaatacggccagctggtgaaggtcgagctggaagaaaacgctgaagacgacaaaacggagaaccagatcccacaaaggatgactcggaacaaagcaaatacaatggccaaccagagcaaacagattctggccagctgcaccttgctctccgagaaggacagcgagagctcaagcccccggggacggatccgactgaccgaggacgatgatcctcagatccaccacccgcggaaacgaaaggtctcaagggtgccacaaccagtgcaagtcagtccctcccttctacaggctaaggagaagacccaacagagtctcgccgccatcgttgattccttaaaattagacgagatccaaccctacagttcggagcgggccaatccctacttcgagtacctccacattcggaagaagatcgaggaaaaacgaaagcttttgtgctccgtcatcccacaggctccccagtattatgacgagtatgttaccttcaacgggtcatacctgctggacggcaacccactgtcgaagatctgtattcccaccatcactcctccaccgtcgctgtcagaccctttgaaggaactctttcgccaacaggaagtggttcgcatgaagttaaggctacagcatagtatcgagcgagaaaagctgattgtatccaatgagcaggaggttttgagggttcactatcgggcagcacgaacacttgccaatcagaccctccccttttctgcctgcactgtgctgctcgatgccgaggtgtataacgtgcccctggattctcagagcgacgactccaagacatccgtgagagaccgctttaatgcacgacagtttatgagttggctccaggacgttgatgacaagttcgacaagctgaaaacttgcttgctgatgagacaacagcacgaggccgccgctctgaacgctgtccagagactcgagtggcaactcaaactccaggagctggatcctgcaacttataagtccatttctatttacgaaattcaagaattctacgtgccactggttgacgtaaacgacgatttcgagctgacaccgatctag

SEQ ID NO: 179083 - DNA, 372 bp, Artificial Sequence
  Description of Artificial Sequence: Synthetic coding sequence
accgaggacctgttcctgaacatggagcacgagagcctgaccctggaaaagaagagtaagctggagaaaaacattaaggatgataagtccacaaaggagaagcatgtttccaaggagcgtaacttcaaggaagaaagagataaaattaaaaaagagagcgagaagagcttccgggaggggatgagcgcgattgaggagtctattggcctacatctagtcgaaaaagagattgacatcgagaagcaagaaaaacacattaaagagtctaaggagaagccagaaaagagatcccaaataaaggaaaaggacatagagaagatggaaaggaaaacctttgagaaagggacatcttacatcaggatcactcagtag

SEQ ID NO: 179084 - DNA, 993 bp, Artificial Sequence
  Description of Artificial Sequence: Synthetic coding sequence
atgcccaagagcggcttcaccaagcccatccagagcgagaacagcgatagtgattccaatatggtggaaaagccctacggtcggaagtccaaggataaaattgcatcctattcaaagacgccaaagatcgagaggagtgacgtgagcaaggagatgaaagagaaaagttcgatgaaaaggaaactgcccttcactatcagcccttccagaaatgaggaacgcgattctgatacagactccgatcccgggcacacatcagaaaactggggggaaaggctgatttcaagttatagaacatactctgaaaaagagggccccgaaaaaaagaagaccaagaaggaggccggcaacaaaaaatctacaccagtgtccattctcttcggctatcccctgtctgagcgcaaacagatggctttgttaatgcaaatgaccgctagggataattccccggacagcaccccaaaccatccaagtcagacaacacccgcccagaagaagactccaagctctagtagtcgccagaaggataaagtcaacaagcgcaatgaacgcggggaaacgccattgcatatggcggccatcagaggggacgtcaagcaggtcaaggagctgataagcctgggtgcaaatgtgaatgtaaaagactttgccggttggactccactccatgaagcttgcaacgtgggttactacgacgtagctaaaatactcatcgccgctggagctgacgttaatacccagggcctcgacgacgatacgcccctgcacgattcagcaagctcaggacacagggacatcgtcaagctccttctgcggcacggcggaaatcctttccaggccaacaaacacggcgaaaggccagtggatgttgctgagacagaagagttagagttattgcttaaacgcgaggttcctctgtctgacgatgatgagtcctacaccgggtcttcgtaccagttcgctggcaatgctaagctctcaggggctagctag

SEQ ID NO: 179085 - DNA, 1116 bp, Artificial Sequence
  Description of Artificial Sequence: Synthetic coding sequence
atgcccaagagcggcttcaccaagcccatccagagcgagaacagcgattccgacagcaatatggtggagaaaccctacgggagaaagagcaaagataaaatagctagttatagcaaaactcccaagattgagagatccgatgtcagcaaggagatgaaggagaagtcgagcatgaaacgcaagctgccttttaccatctcgccatccagaaatgaagagcgcgatagtgacaccgagaaggagggacctgaaaaaaagaaaactaaaaaggaggctggcaacaagaagtcaacccctgttagcatcctgttcggttaccctctgtccgagcgaaagcagatggcattgctgatgcagatgaccgccagagacaacagccccgattctacaccaaatcacccgagtcagacaacacccgctcaaaaaaagactcctagtagttcctccaggcagaaggacaaagtgaacaagcggaacgagcggggtgagacacccctgcatatggcggccattaggggagacgtgaagcaggtgaaagagctgatatctttaggggctaatgtgaacgtgaaggactttgccggctggacaccgctccatgaagcctgtaatgtgggctactacgacgtcgccaaaatccttattgctgctggagccgatgtaaacactcaagggttggacgacgacacaccgctgcatgatagcgcctctagtggacatcgggacattgtcaagttgctactgcgacacggaggaaaccctttccaggccaacaagcatggggagagaccagtcgatgtcgctgaaactgaagagttggaactgctactcaaaagggaggtgccactgtccgacgacgacgagagctacacagactctgaggaagcacaaagcgtgaatccaagctcagtggatgaaaacatcgacagcgaaacagaaaaggattccctcatttgtgaaagtaaacaaatcctgccctcgaagacacctctgccaagtgccctggacgagtacgagtttaaggatgacgatgacgaggagatcaacaagatgatcgatgatcggcatattctgaggaaggaacagaggaagaagaagcgaaaagagaaaaagtag

SEQ ID NO: 179086 - DNA, 984 bp, Artificial Sequence
  Description of Artificial Sequence: Synthetic coding sequence
atggccaaggcccccagctgggccggcgtgggcgccctggcctacaaggcccccgaagctctctggccggccgaggcagtcatggacggcaccatggaggatagcgaggctgttcagagggccaccgctcttatcgagcagcgcctcgcacaagaggaggagaatgaaaagttgcggggcgacgcgaggcagaaacttccaatggatttacttgtactggaagacgagaaacaccacggcgctcagagtgcagccctgcagaaggttaaaggacaggagcgagtgcgcaagacgtcgctggacctgagaagggagatcatcgacgttggggggatacaaaatcttatcgagctgaggaaaaagaggaagcagaagaagcgtgacgcgcttgcagcctcccacgagccaccgcccgagcctgaagagattacagggcccgtggatgaggaaaccttccttaaggccgctgtggaaggaaaaatgaaagtgatcgaaaagttcctggcagacggcgggtcggccgacacctgcgaccagtttcggagaactgctctgcacagggccagccttgaaggacacatggagatcctggagaagctgttggacaatggcgcaacagtcgacttccaggacagactggattgcactgcaatgcactgggcatgccgtggcggtcacctggaggtggtgaagcttctgcaaagtcacggtgcagacactaacgtacgggacaaagaaggggataccgccttgcatgacgccgtccggttgaaccgatataagattatcaaactacttctccttcacggcgcagacatgatgaccaaaaacctggccggtaagacacccaccgatcttgtgcagttatggcaggccgatacccgtcacgcactggaacatccggaacctggtgctgaacacaacggattggaaggccctaacgattctggccgcgagacgccacaacctgtaccagcccaatag

SEQ ID NO: 179087 - DNA, 1083 bp, Artificial Sequence
  Description of Artificial Sequence: Synthetic coding sequence
atggccaaggcccccagctgggccggcgtgggcgccctggcctacaaagcccctgaagctctctggcccgcggaagccgtcatggacggaaccatggaagactctgaggccgtgcaaagagccaccgctttgatcgaacagaggttagcccaggaggaggagaacgaaaaactgagaggtgatgcgcggcagaagctgccaatggacctgctggtcctcgaggacgaaaaacatcacggggcccagagcgctgccttgcaaaaagtaaagggtcaagagcgtgttcggaaaacttctctcgacttgcggcgggagattattgatgtgggaggaattcagaacctgatcgagctgcgcaagaagagaaaacagaaaaaaagagatgctctggccgcgagtcacgagccgccccctgagccggaggaaatcactggccctgttgacgaggagacgtttctgaaagcggctgtggagggtaagatgaaggtcattgagaagtttctcgcggatggtggctccgctgatacatgcgatcagttccggcgtacagctctccatagagcttctctcgaggggcacatggaaattttggagaagctgctggacaatggagcgaccgtcgattttcaggatagactggactgtaccgctatgcattgggcctgtaggggaggacatttagaagtggtgaaactgctgcagagtcacggagctgacacaaacgttagggacaagctcctgagtacaccacttcatgtagccgtccggaccgggcaggttgaaatcgtcgagcactttctgagtctagggctggaaatcaatgctagagatagagaaggggatacagctctccatgatgcagtacgattgaatcgctataagataatcaagctgttgttgctccacggtgctgacatgatgaccaaaaacctggccggcaaaacccctactgatttggttcagctgtggcaggccgacacaaggcatgcactggaacatcctgaaccaggagccgaacacaacggactagaaggtcctaatgacagcgggcgcgaaacgccacagcccgtgcccgctcagtag

SEQ ID NO: 179088 - DNA, 1002 bp, Artificial Sequence
  Description of Artificial Sequence: Synthetic coding sequence
atggacggcaccatggaggacagcgaggccgtgcagcgggccaccgccctgattgaacagaggctcgctcaggaggaagaaaatgaaaagctgcggggagatgcacggcaaaaacttcccatggacctcctggtgctggaagacgagaagcatcacggggcacagagtgcagcactgcagaaggtgaaggggcaggagcgcgtacgcaaaacttcgctcgacctcaggagagagattatcgacgtggggggcatacagaacttgattgaattgagaaaaaaaaggaaacagaagaaacgcgacgccctcgcagccagtcatgaacctcctccagagccagaggaaatcactggacccgtggacgaggaaacttttttgaaagcagccgtggaagggaagatgaaggtgatagagaagttcctggccgacggcggcagcgctgacacctgtgatcaatttagacggacagccctgcaccgcgcctcacttgagggacacatggagattctagaaaagctcctagataacggtgccactgtggactttcaggatcggctggactgtacggccatgcactgggcctgccgaggaggacaccttgaggtggtcaagcttctgcagtcccatggggccgacacgaacgtccgggataaactgttgtccactcctttacatgtggcagtacggaccggacaagtggagatcgttgaacattttctgtctctcgggctggaaatcaatgcaagggaccgcgagggcgacaccgcactacatgacgcagtgcgcttgaatcgatacaagataataaagctcctgctgctccatggcgccgacatgatgaccaagaatcttgctggaaagactcctaccgacctcgtgcagctttggcaggctgacacgagacatgcactggaacaccctgagcccggtgccgagcacaatggtctggaaggtccaaacgactcaggtagggagaccccacagccagttcccgcgcagtag

SEQ ID NO: 179089 - DNA, 903 bp, Artificial Sequence
  Description of Artificial Sequence: Synthetic coding sequence
atggacggcaccatggaggacagcgaggccgtgcagcgggccaccgcactgattgaacagcggctggctcaggaggaagagaacgagaaactgcggggggatgcacgtcagaaactgccgatggatcttctggtgctcgaagatgagaaacatcatggcgcccagtccgcggcacttcagaaagtgaaaggccaggagcgcgtgaggaaaacctctttggatctgaggagggaaattattgacgtaggtggtatccagaatctcatagagctcagaaaaaaaaggaagcagaaaaagcgcgacgctctcgctgcttctcatgaacctccgcccgaacctgaggagatcacaggccccgtagacgaagagacctttctcaaggccgctgtggagggcaagatgaaagtgatagagaagttcctggctgatgggggaagtgccgacacctgtgatcagttccgcaggaccgcgctgcacagagccagtttggaagggcatatggaaattctagagaagttattggataatggagccacggtcgacttccaagaccgactggattgtacagccatgcactgggcatgtcgcggcgggcatttagaagtggtcaaactactgcagagtcatggtgccgataccaacgtccgcgacaaagagggtgacaccgccctccacgatgcagtgcgcctcaaccggtataaaatcattaagctcttgcttctgcatggcgccgacatgatgaccaaaaatctggcaggcaaaaccccaactgatctggtacagttgtggcaagccgacactcgccatgctttggaacatccagagccaggcgctgagcataatgggttagaggggccaaacgattctggccgcgaaacaccacagccagtccctgctcagtag

SEQ ID NO: 179090 - DNA, 918 bp, Artificial Sequence
  Description of Artificial Sequence: Synthetic coding sequence
atggacttcatcagcatccagcagctggtgagcggcgagcgggtggaggggaaggtgctcggtttcggccacggagtgcccgatcccggtgcgtggccaagcgactggcgccgcggtccccaggaggccgttgccagggagaaactaaagctcgaggaggagaaaaagaaaaaactggagcggttcaacagtaccagatttaatctggataatctagccgacctggaaaaccttgtccaaagacgaaaaaaaagattgcgacatagggtaccgccccggaagccggaacctctcgtcaagcctcagagtcaggcacaggtggaacctgtgggtttagaaatgttcctgaaggccgccgccgaaaatcaagagtatctcattgacaagtacctgactgacggcggggatccaaacgctcacgacaaactccaccgcaccgccctgcattgggcttgcctcaaaggccacagccaactcgtgaacaagctgctcgtggcaggtgcaaccgttgatgctcgggatctattggatcggaccccggttttttgggcctgcagaggaggccatcttgtgattcttaagcagcttctcaatcagggcgcgcgcgtgaatgcaagggacaaaatcggaagtacaccgctgcatgtcgctgttcgaacccgacacccagattgtctagagcacctgatcgaatgtggggcccacctgaatgctcaggataaagagggagacacagcactgcacgaagcggtgaggcatggctcctacaaagccatgaaactgcttttgctatacggagccgagcttggagtacgaaatgccgcgtcagttacaccggtccaactcgctcgggattggcagcgtggcattagggaggccctgcaggcccacgtcgcccatccccgcacgcgatgctag

SEQ ID NO: 179091 - DNA, 792 bp, Artificial Sequence
  Description of Artificial Sequence: Synthetic coding sequence
atggacttcatcagcatccagcagctggtgagcggcgagcgggtggaaggaaaagttctcggctttgggcacggtgtgccagatccgggagcctggccgtccgactggcgtagaggccctcaggaggccgtcgcccgagagaaactcaaattggaggaagaaaagaaaaaaaaacttgaacggtttaattcgactaggtttaatctggataacttagccgatctggagaatttagtgcagaggcgaaaaaagcgcctccgacacagggtgccgccaagaaagcccgagccactagtcaaactgcatcgtaccgctttgcattgggcctgcttgaagggtcactcccagctagtgaacaaactgctcgttgctggtgccaccgtggatgcccgggatctgcttgaccggacaccagtgttttgggcatgccgtggaggtcaccttgtgatcctaaaacagctgcttaaccaaggcgcaagggtgaacgccagggacaaaattgggtccactcctttacatgtggcagtgagaacgcgacatccagactgtttggagcacctgattgagtgcggagctcatctaaatgcccaggacaaggaaggcgatacagcattgcacgaggctgtgagacatggcagctataaggctatgaagctgttgttattgtacggtgctgagcttggagtccgaaatgccgctagcgtgactccagtacaattagcgagagattggcaaaggggaatcagagaggccttgcaggcacacgtggcacacccaagaacaagatgttag

SEQ ID NO: 179092 - DNA, 918 bp, Artificial Sequence
  Description of Artificial Sequence: Synthetic coding sequence
atggacttcatcagcatccagcagctggtgagcggcgagcgggtggaggggaaagtattaggattcggacatggcgtccccgaccctggtgcatggccaagtgactggcgccgcggcccacaggaagctgtggctcgggaaaaactcaagctcgaggaggagaagaagaaaaagctggaacgtttcaactctacccgcttcaatctggataatctggccgatctggagaacctagtgcagcggcgtaagaaaaggctgcgacaccgagtgccgcctagaaagccagaaccgctcgtgaagcctcagtcccaggcacaggtcgagcctgtgggcctggagatgttcctcaaagccgccgcagaaaatcaggagtacctaattgacaaatacttgacagacggcggcgaccctaatgcccacgacaaactccatagaactgcactgcattgggcctgtctgaaaggacattcccagctagtcaataaacttctcgtcgctggagcaacggtcgatgctagggacttactggaccgaacaccggtattctgggcctgccgaggtggtcatttagtgatcctgaagcagctgcttaatcagggggcaagggtcaatgcccgtgataaaatcggaagcacaccactgcatgtggccgtgaggacgcgccatcccgactgccttgagcacctgatcgaatgcggggctcatctcaacgcacaggataaagagggcgatacagccctacacgaggccgtcaggcacgggtcatacaaggccatgaagctgttgctgctgtatggcgctgaactgggagtgcggaatgccgcaagcgtgactcctgttcagttagcgagggattggcagagaggcatccgggaggctttacaggctcacgtggcccatccgagaacccgctgctag

SEQ ID NO: 179093 - DNA, 3804 bp, Artificial Sequence
  Description of Artificial Sequence: Synthetic coding sequence
atgaaccacatgttccacatcaagcggcacagcatcagcgccggcaccgacgcttacaagaagaccaaacctatacagaacctgttccaaaaacccttgtacgatcactgctcagccaacaattataagtcgatggagcctgagctcgagaacgtcagatcatcccctcctaggggggatcgcacatctaaggtttctttaaaagaggaactgcagcaggatatgcaaaggtttaaaaatgagatcgggatgctgaaagtcgaatttcaggcattggaaaaagagaaggtccagctccagaaagaagtagaggaggagaggaagaaacatcggaacaacgagatggaggtgagcgcaaatatacacgacggcgcaacagacgacgccgaggatgatgacgacgacgatgggcttatccaaaagcggaagagcggagagaccgatcaccagcagttccctcgcaaggagaataaggaatacgcatcatcagggcctgccttgcaaatgaaggaagtgaagtcgacagaaaaggaaaaacgcacatccaaagaaagtgttaactctcctgtattcggcaaggcttccctgctcactggcgggctgctgcaggtcgacgatgactcctctctctcggagatagacgaggacgaagggaggccaacaaaaaagaccagtaatgagaaaaacaaggtgaagaatcagattcagagcatggacgatgtggacgaccttacccagtctagcgagactgcctccgaagactgtgaactgcctcactctagctacaaaaacttcatgctgctcattgagcagttgggcatggagtgcaaggactcggtgagtcttctaaagatccaggacgccgcccttagttgcgaacgcctgctggaacttaagaaaaaccactgcgaattgctgacggttaaaatcaaaaaaatggaagacaaggtaaatgtgctgcaaagagagctgtccgagacaaaagagattaagagccaattggaacatcaaaaggtggaatgggaacgcgaactctgctctctgagattctccctaaatcaggaggaagagaagcgccggaatgccgatactctttacgaaaagattagagagcagctgcgccggaaagaggagcagtatagaaaggaagtcgaagtgaagcagcagctggagctgagcctgcagaccctggagatggaactgcgcacagtcaagtccaatctcaatcaggtggttcaggaacgcaacgacgcacagcggcagctctcccgcgagcagaacgccagaatgctgcaggatgggatacttactaatcacttatccaaacagaaagaaattgaaatggcccagaagaaaatgaatagcgagaactcgcattctcatgaggaggagaaggacctgagccataagaattcaatgctgcaagaggagattgctatgcttcgactggaaattgataccattaagaaccagaatcaagagaaggaaaaaaagtgcttcgaagatctgaagattgttaaagaaaaaaacgaagatctgcagaagactatcaaacagaacgaagaaactctgacacagactatttcccaatacaacggcaggttaagtgtactgactgcagagaacgccatgcttaattccaaattagagaatgagaagcagtctaaggaacgccttgaggcagaggtcgaaagctaccacagtaggcttgccgccgcaattcacgacagggaccagtccgagacatcaaaacgcgaactcgagttggcctttcagcgggcgcgggatgaatgtagcaggttgcaggacaaaatgaactttgatgtgtcaaacctgaaagataataatgagatcctgagccagcagctttttaagactgaaagcaaattaaacagcctcgagatcgaatttcaccatacaagagacgctcttcgggagaaaaccctggggctagaaagggtgcagaaagacctaagtcaaacacagtgccaaatgaaggagatggagcaaaagtatcagaatgagcaggtgaaggtgaacaagtacatcggcaagcaggagtccgtggaggaacggctgagtcagcttcagagcgagaatatgcttctccgccaacagctagatgatgctcacaataaggctgataacaaggagaaaactgtgatcaacattcaggatcagttccatgcaatagtacaaaagctgcaggcagagagcgagaagcagagcctgttgctggaggagcgaaacaaggagctcatttccgagtgtaaccacctcaaagaaaggcaataccagtacgagaacgagaaagcggagcgggaggtcgtggtgaggcagctgcagcaggaactagctgacacactgaaaaaacagagcatgtcggaagcttcactagaggtgacctcaaggtaccggatcaatctcgaggacgaaacccaggacctgaagaagaagttggggcaaattcgtaatcagctgcaggaggcgcaggatcgtcacaccgaggcggtgaggtgcgcagaaaagatgcaagatcacaagcagaagctagaaaaggataatgccaaactgaaagttacagttaagaagcaaatggataagatcgaggagctgcagaagaatctgttgaacgctaacctgtccgaggatgaaaaagaacagctgaagaaactcatggaactgaaacagtcactagagtgcaaccttgatcaggaaatgaagaaaaatgtcgagctagagagggagatcacagggttcaagaatctactgaagatgacgaggaaaaagctcaacgaatacgagaatggggaattctccttccacggagatcttaaaacatcccagtttgagatggatatccagataaataaactgaaacataagatagacgacctcaccgctgaactcgagacggccggtagcaaatgcctacatttagacaccaagaaccagattctccaagaagagttgctaagcatgaaaactgtacagaagaaatgcgaaaagctccagaagaataagaagaagctcgaacaggaggtgattaacttgaggtctcacatagagaggaacatggtagagctcggacaggtaaagcagtataagcaggaaattgaggaaagggcacggcaagagatcgccgagaagcttaaggaagtaaatctattcctgcaagctcaggccgctagtcaagagaacctcgagcagtttcgcgagaataacttcgcctcaatgaagtcccagatggagctccgcatcaaggacttagaaagcgagctcagtaagatcaaaacttcgcaggaggactttaataagactgaactagaaaaatataaacaactatacctggaggagctaaaagtgcgaaaatccctatcgagcaaacttacaaaaactaacgaaagactggccgaagtgaacacaaagctgcttgttgaaaagcagcagtcccggagtctcttcacaacccttaccacaagaccagtcatggagcctccttgcgtgggcaaccttaataactccttagatttgaacagaaagctgattccgagggagaatctcgttatctcaacaagcaatccccgggcttccaataatagcatggagaactatctgagcaagatgcagcaggagctcgaaaagaatattacgagggagcttaaagaagccgccgctgagctggaatctggctccatcgcgtccccgctaggcagcacagacgaatctaacctgaatcaggatctcgtatggaaggcatcacgggagtacgtgcaggtgctcaaaaaaaactacatgatctag

SEQ ID NO: 179094 - DNA, 5133 bp, Artificial Sequence
  Description of Artificial Sequence: Synthetic coding sequence
atgaagaagatcttcagcaagaagggcgagagccccctgggcagctttgctagacgtcagcgcagcagtgccggcggtgggggcgaacctggagaaggggcgtacagtcagcccggctaccacgttagagacagggatctgggcaagatccacaaggcagcatccgctggaaacgtggctaaggtccagcagatcctgcttctgcgaaagaacggcctgaatgacagggataagatgaacaggactgccctgcatctcgcttgtgccaacggacaccccgaagtggtcacactcttagtggaccgcaaatgccagctaaatgtttgtgataacgagaaccgcaccgccctgatgaaagctgtacagtgtcaggaggagaaatgtgctacaatattactggagcacggagcagacccaaacctggcagatgtgcatgggaacaccgccctccactatgctgtctacaatgaggatattagtgtggcaactaaactactattgtacgatgccaacattgaggctaaaaacaaagatgaccttactcccctgctgttggcggttagtggaaaaaagcagcagatggttgagttcttaattaagaaaaaagctaatgtcaatgcggtcgataagctcgagagcagccaccaacttatcagtgaatacaaagaagagcgcatccctaagcatagcagccagaattctaatagtgtggacgaatcatctgaagattcactgtcccgcctgagtggaaagccaggggtcgacgattcgtggccaactagcgacgatgaagacctgaatttcgatacaaaaaacgtgccaaagcccagcctggcaaaacttatgaccgctagccagcagagccgtaaaaaccttgaggccacctacggcactgtgcgcacaggaaacagaacccttttcgaagatagagacagtgactctcaagacgaagtggttgtggaaagccttcctaccacttcaatcaaagtgcagtgcttctcccacccgacctatcagtcccccgatctgctgccgaagccttcacacaagagtcttgctaacccaggtttgatgaaagaggagcctacaaagcctggtattgccaaaaaggaaaatggcattgacatcatcgagtctgccccacttgagcagaccaacaacgataacctgacatacgtcgatgaggtacacaagaacaatagatctgatatgatgtcagctctcggcctgggccaggaagaagatatcgagtctccttgggacagcgagtcaattagtgaaaactttcctcagaagtatgtggacccactggctggcgcagccgacggcaaggagaagaacattggcaatgaacaggcagaagatgtgttctacataccgagttgtatgagcgggagtcggaattttaaaatggccaaactggaggacacccgcaacgttgggatgcccgtagcacacatggagtctccagaaaggtatttacacctgaagccgactattgagatgaaggactccgttccgaataaagccggaggtatgaaggacgtgcagacctcaaaggctgccgaacacgacctggaagtggcttctgaagaggaacaggagcgtgaagggtcagaaaataaccagccgcaggttgaggaggaacgcaaaaagcaccgtaacaatgaaatggaggtgtctgccaacatccacgatggggcaactgatgacgcagaggatgatgatgatgatgacggcctcatccagaaacgcaagtcaggggagacagaccatcagcagttccctcggaaggaaaacaaggaatacgcaagctctggacctgccctccagatgaaggaggtcaagagtacggagaaagagaaaagaaccagcaaggagagtgtgaattccccagtgtttggtaaggcctcgctgttgaccggaggtcttttgcaggtggatgatgactccagcttgtctgaaatcgatgaggatgaggggcggcctaccaaaaaaacgtcaaatgagaagaataaggtcaagaatcagatccaaagcatggacgatgtggacgacctgactcagtccagcgaaacagcctctgaagactgtgaacttccccactcaagctacaaaaacttcatgctcctgatcgagcagctcggcatggaatgtaaggacagcgtgagccttctgaaaattcaagacgctgctctgtcttgcgagagactactggaactcaagaaaaaccattgtgagcttctcaccgtgaaaatcaaaaagatggaagacaaagtcaacgtgctgcaaagggaattatcagaaaccaaggagattaagtcccagttggagcatcaaaaggtggaatgggagcgagaattgtgcagtctccgcttcagcctgaaccaagaagaggagaagagaagaaatgccgataccctgtatgagaaaatccgagaacagctgaggaggaaggaggagcaatacaggaaggaagtcgaggtcaagcagcagctggagttgtcgctgcaaactctcgaaatggagctcaggaccgtaaaaagtaacctgaatcaagtggtccaggagcgaaatgatgctcagaggcagttatcacgcgagcagaatgctcgtatgctccaggatggcatcctgacaaatcatctctctaagcagaaggagatcgaaatggcccagaagaaaatgaactctgagaactcgcactctcatgaggaggagaaggatctcagccataagaattcaatgctgcaggaagaaatcgctatgctgagattggagatagatactatcaagaaccagaaccaagagaaagagaaaaagtgctttgaagatttgaaaattgtgaaagagaaaaacgaagatctgcaaaagacgatcaagcaaaatgaagagacacttacccaaacaatctcccagtataacgggcgcctgtcagtccttaccgccgagaacgccatgcttaactctaaactagagaatgaaaaacagtctaaggagcggcttgaagcggaggttgaatcctatcatagtaggctcgccgctgccatccatgatcgcgaccaatccgaaaccagtaaacgggaactggagctggcttttcaacgtgcaagagacgagtgcagtcgactccaagacaagatgaactttgacgtcagtaaccttaaagataacaatgagatcttaagtcagcagctcttcaaaactgagtcaaagttaaatagtctggaaatcgaatttcatcatactagagacgctctccgggagaagaccctgggcttagagagagtccagaaggatctcagtcagacacagtgccagatgaaggagatggagcagaaatatcagaatgagcaggtcaaggtgaacaaatacattgggaagcaggagtcagtggaagagcgcctgtctcagctccagagtgaaaatatgctcctccggcagcagttggacgacgcacataacaaagcggataataaggaaaagaccgtgattaacatccaggatcagtttcatgcgatcgtacagaagctgcaggcggagtctgaaaagcagtcgctgctattggaggaacgaaacaaggagcttatttctgaatgcaatcacttgaaggagcggcaatatcagtacgagaatgagaaggccgaaagggaagtggtcgtccgacagctgcagcaggagctggccgatacattaaagaaacagtcaatgagcgaggctagcttggaagttactagtcggtaccgcataaacttggaggatgagacacaggatttgaagaagaaactgggccagatcaggaatcagcttcaggaagcacaggaccggcacactgaggcagtgagatgcgcggagaagatgcaggaccataaacagaagctagaaaaggacaatgccaagctcaaagtgacagttaagaaacagatggataagattgaggagttacagaaaaacctgctgaacgccaacctcagtgaggacgagaaagaacagctgaaaaaattaatggagctgaagcagagcttggaatgtaacctggatcaggaaatgaagaaaaacgtggagctggaacgcgaaatcacaggctttaaaaatcttttgaagatgactcggaagaaacttaacgagtacgaaaacggggagtttagctttcacggcgatctgaaaaccagccaatttgagatggacatccaaataaacaagctcaaacataagatcgatgatctcactgcagagctcgagaccgctgggtcaaaatgcttacatctggacacaaagaaccagattctccaggaagagttactttcaatgaagacagttcagaaaaagtgcgagaagttacagaagaacaaaaagaagcttgagcaggaggtgattaatctgagatctcatatcgaaaggaacatggtcgaactgggacaggtgaaacagtacaaacaggagatcgaggagcgggcgaggcaggaaatcgctgagaagctgaaagaagtgaacctgttcctccaagctcaggcagccagccaggagaatttagaacagtttcgagaaaataatttcgcctcgatgaaatcacagatggagctgagaataaaggatctcgaatccgagttaagtaaaattaagacctcccaagaggattttaataagactgagttggagaaatacaagcagctgtatcttgaggaattaaaagttaggaaatcactgagcagcaagctcactaaaacaaacgaaagattggccgaagttaataccaaactgttagttgagaaacaacagtctaggagcctgtttactaccctgacaacgaggcctgtcatggagccaccatgtgtcggaaatctgaacaactcacttgatttaaacaggaaactgatccctcgagagaacctagtgatatcaacctctaatcctagggcctcaaacaacagcatggaaaactatctctctaagatgcagcaggagctggagaaaaacattactcgggagctgaaagaggccgccgctgagttggagagtggttcgatagcctccccactggggtctactgacgaaagcaacctgaaccaggacctggtatggaaagcctcaagagagtatgtgcaagtcttgaagaagaactacatgatatag

SEQ ID NO: 179095 - DNA, 5181 bp, Artificial Sequence
  Description of Artificial Sequence: Synthetic coding sequence
atgaagaagatcttcagcaagaagggcgagagccccctgggcagctttgcccggcggcagagatcatcagcgggcggtggaggcgaacctggggagggagcatacagccagccaggatatcacgttagggatagagatctggggaaaatacacaaggccgcatcagctggtaacgtggcgaaggtgcagcagattctgttgcttcgaaaaaatgggctgaatgaccgagataaaatgaaccgtactgccttacaccttgcctgcgccaatggtcaccctgaggtcgttacacttctggttgaccgaaaatgtcagctgaatgtatgtgacaatgaaaacaggactgccctgatgaaagcagtgcagtgccaggaagaaaagtgcgccaccatcttgctagagcacggggcggacccgaatttggcagacgtgcatggaaataccgctctccactacgccgtgtataacgaagatatctctgtggcgacaaaactgctgctctacgacgccaatatcgaagctaagaataaagacgatcttacacctctgcttctggcggtgtccggcaagaaacagcaaatggtagagttcctcataaagaagaaagcgaatgtcaacgccgtcgataagttggaatcctcacaccaacttatctctgaatataaggaagagagaatcccgaaacacagtagccaaaattcgaattcagtagatgaatcttcagaggattctctgtcctccctgttttatttcatctttttcgaaacaaagagctgtactgtggcacaggctggggtattacagcacgacctctcatctcttcaaagtctgctgccggggtttactcagtttttctgcctacacctcccttcgagttgggaccatcggttgtccggcaaacccggagttgatgactcctggcccacctcagatgatgaggatctcaacttcgatacgaagaacgttcccaagccgtctttagccaaacttatgaccgcaagtcagcagtctcgaaagaatctggaagctacctacggcacggttcgaactggaaatcgaaccctcttcgaagacagggacagtgattctcaggacgaggtggtcgtggaatccttgccgactaccagcattaaggtgcagtgtttctcccatcccacttaccagagccctgatctgcttccaaagccttctcataaatcgcttgcgaaccccggcctgatgaaggaggaacccacaaaacccgggatcgctaagaaggaaaatggaatcgatatcattgagagtgcacctttagagcagactaataatgataacctgacctatgtagatgaagtacataagaataaccggtctgatatgatgtcagccctgggcctggggcaggaggaggatatcgagtccccttgggattctgaaagtatcagcgagaattttccacaaaaatatgtggacccactggccggtgcagctgatggtaaggaaaaaaatattggcaatgaacaggctgaagaatctccggaacgctacttgcacttaaagccgacgattgaaatgaaggacagcgtacccaataaagcaggaggaatgaaggacgttcaaacatcaaaagctgccgagcacgaccttgaggttgccagcgaagaggagcaagagagagagggcagcgaaaataatcagcctcaagtggaggaagagcgaaaaaaacaccggaataacgagatggaagtgagcgcaaatatacatgatggtgctactgacgatgccgaggacgacgacgatgacgacggtctgatccagaaaagaaagagcggggagaccgatcatcagcagtttcctagaaaggaaaataaggaatatgcatcatcgggacctgccttacagatgaaagaggtgaagtctaccgaaaaggaaaagagaaccagcaaagagtccgtaaacagtcctgtcttcgggaaggctagcttacttaccggtgggttgctgcaggtggacgatgactcctcactgagcgagattgatgaagacgaaggccgacccacgaagaaaacatcaaacgaaaagaacaaggtgaagaatcagattcagtccatggacgacgtggacgatctcacacagtcatccgagaccgcctccgaggattgtgaactcccacacagttcttacaagaacttcatgctcctgatcgagcagctgggtatggaatgcaaggactcagtctccctgttgaagatccaagacgctgcgctgtcttgcgagcgccttctggagctgaagaagaatcactgcgagttattgaccgtgaaaattaaaaaaatggaagataaagttaacgtgctgcagcgagagctgtctgaaacgaaggagatcaagagccagctggagcaccaaaaagtggagtgggagcgtgagctgtgcagtctgagattctctctgaaccaggaagaggagaaaaggcggaatgctgacacactctacgagaaaatcagggaacagctcagaagaaaagaggagcagtacagaaaagaggttgaggtgaagcagcaactggaactgtcactgcaaaccttggagatggagctgcggacagttaaatcaaacctgaaccaggtcgtccaggagcggaacgatgcccaaagacagctttcccgtgaacagaatgctcgcatgctgcaggacggcatcctgacaaaccacctgtcaaaacaaaaggaaattgaaatggcccagaaaaagatgaatagcgagaacagtcactctcacgaagaagagaaagacctcagtcacaagaacagtatgttgcaggaagagattgctatgttaaggcttgagattgacacgatcaaaaaccagaatcaggagaaggaaaagaagtgtttcgaggacttaaagatcgtgaaggagaaaaacgaagacctgcagaagacaatcaagcagaatgaagagactctgacacagaccatatcccagtacaatggacgcctgagcgtgttaaccgctgagaacgcaatgcttaattccaaattggagaacgagaagcagagcaaggagcgcctggaggccgaggtcgagtcttaccactcgaggctcgccgctgccatacacgatcgcgaccagagcgagacctctaagagggagctggagctcgcctttcaaagggcgagagacgaatgttcccgcctgcaggataagatgaatttcgacgtcagcaacctgaaggacaataatgagatcctgtcccaacagctcttcaagactgagtcaaaactgaactctttggagatcgagttccatcacaccagggacgccctgagggagaagacactgggacttgaacgcgttcagaaagacctctctcagacccaatgccaaatgaaggagatggagcagaagtaccagaacgagcaagtcaaggtcaacaaatacattggtaagcaggaaagcgtggaggagcggctctctcagttgcaatcagaaaatatgctcttgagacagcagctggacgatgcgcacaacaaggctgacaataaagagaagaccgtcattaacatccaggaccagtttcacgcaatcgttcagaaattacaggccgaaagcgagaaacagtcgcttctgctcgaagaacgaaataaggagttaattagtgagtgcaaccacctaaaagagcgacagtatcagtatgagaacgagaaagccgagagggaggtggtcgtgcgtcagttgcagcaggagcttgctgacactttaaagaaacagtccatgtcagaggcttctctagaagtaactagtaggtaccggataaatctggaggacgaaacccaagacctcaaaaagaaacttggccagatccgcaatcagttacaggaggcacaggacaggcataccgaggcggtgcgctgcgcggaaaagatgcaagaccacaagcaaaaactggagaaagataatgccaagctcaaggtcactgtaaaaaagcagatggataaaattgaggaattgcagaagaaccttctgaacgccaacctgtcagaggatgaaaaggagcagctgaagaagttgatggagcttaagcagagcctcgaatgcaacttggaccaagaaatgaaaaaaaatgtcgaactggagcgagagataaccgggtttaagaatctgctgaagatgacccggaaaaagcttaatgaatatgagaatggagagtttagctttcacggcgatctgaagaccagtcagttcgaaatggatatacagatcaataaactgaaacataagatcgacgacctgactgccgaactcgaaactgccggttccaagtgcctccatctcgacactaagaatcagatcctccaggaagagctgctcagcatgaaaacggttcaaaagaaatgcgagaaactgcagaagaataagaagaaactggagcaagaagtgattaacctccggagtcatatagagcgaaatatggtcgagttgggtcaagtcaaacagtataaacaagagattgaggagagagctaggcaggaaatcgctgaaaagctgaaggaggtgaatctgtttctgcaggcccaagctgccagccaggaaaatttagagcagtttagagagaacaattttgcttccatgaaatctcagatggagctgaggattaaagatctggagtccgagctctctaaaattaaaacttcacaagaagacttcaataaaacggagctagagaagtataagcagctttatctcgaagagctgaaagtccgtaagtctctgtcatccaagctgactaagacgaatgaaagattggccgaagtgaataccaagttgctagttgaaaaacagcagagtcgctccctcttcaccactcttacaacccggcccgtgatggaacctccgtgtgtggggaatctcaataattcattagacctcaatcgaaaactgatcccaagggaaaacttggtgatctccacctctaacccacgagcctcaaacaacagtatggagaactatctttccaagatgcagcaagagctggagaaaaatataactcgggagcttaaagaagccgctgccgagctggaatccgggagtatcgcatcgccccttgggtccactgacgaaagcaatttgaatcaggacctggtgtggaaagcttcacgcgaatatgtccaggtgctcaaaaaaaattatatgatctag

SEQ ID NO: 179096 - DNA, 642 bp, Artificial Sequence
  Description of Artificial Sequence: Synthetic coding sequence
tgattccgggagaacaacttcgccagcatgaagagccagatggagctccgcattaaagatctggaatccgaactgtcaaaaattaaaacttcccaagaggactttaacaaaacagagctcgaaaagtacaaacagctgtacttggaagagctgaaggttaggaagtccctgagctctaaactgactaagaccaacgagaggctcgccgaggtgaatacaaagctcttagttgaaaagcagcaatcaaggtcattgttcacgacattaactactcgtccagtgatggagcctccctgtgtggggaacctgaacaactctctcgatctgaacagaaaactaatacctcgagagaacttagttatctccacatcaaatccccgtgcatcgaataatagcatggagaattatttaagcaagatgcagcaggagctcgaaaaaaatattactcgggaactgaaggaagcggccgccgagttggaaagtggaagcatcgcaagtcctctgggctccacggatgaatctaacctgaatcaggatctggtgtggaaggcatccagggaatatggacccagtgacgagaccccacatgattacgtgctgatgacggaccaatgcctcacatcccggactgatctccagtag

SEQ ID NO: 179097 - DNA, 3261 bp, Artificial Sequence
  Description of Artificial Sequence: Synthetic coding sequence
atgagccgggtgtgcatcgtggtgctggaggaggtggaggacgagtcacccgcatttatctctaagctgcctcaggagaataaatcccttcattcacccccctcagggaacgttctcgtcaggtatccgtccctcgtgcaggcaatattcaatggcgacccggatgaagttcgggcattaatttttaagaaggaggacgtcaatttccaagacaacgagaagcggacccccctccatgctgccgcctatctgggcgatgctgagatcatcgaacttttgatcctgtccggggctcgggtgaatgcaaaagattctaagtggctgacgcccctccacagggccgtcgcctcttgttccgaagaggctgtgcaagtcctgctcaagcactcagccgacgtgaatgcgcgcgacaagaactggcaaacccctctgcacatcgccgcagcgaacaaggccgtaaagtgtgcagaggccctggtgccacttctgagcaatgtcaacgtctcagatagagcaggacggactgcattacaccacgctgccttctccggtcatggcgagatggtcaaactgctcctgagcagaggtgccaacatcaatgccttcgataaaaaggaccgaagggcgatccactgggcagcctacatggggcacattgaggtcgtgaaactgttagtgtcgcacggcgctgaagttacctgtaaagacaagaagtcctacacgccactgcatgctgcagccagctccggaatgataagtgtggtgaagtatttacttgatttaggagtcgatatgaacgagcccaacgcctatgggaacaccccccttcacgtggcctgctacaacggccaggacgtggttgtgaatgagttgatcgactgtggagccatcgtaaatcaaaagaacgagaagggattcacgcctctgcactttgccgcagcatcgacccacggagcactctgtctagaactgctcgtgggaaatggcgctgatgtgaatatgaagagcaaggatggtaaaactcccttacatatgaccgcactccacggcaggttctctaggagccagaccattatccagagcggtgccgtgatcgactgtgaggacaagaatggcaacactcctttgcacatagcagccaggtatggacatgaacttttgatcaatactctgataaccagcggtgccgacaccgcaaagcgtggcattcacggtatgtttccattgcatctggccgccttgagtggttttagcgactgctgcagaaagctgttatcgtccgggtttgacattgacacacctgatgactttgggagaacttgcttacatgccgcagcagccggtggaaatctggagtgcctgaatctcttgctgaataccggtgccgactttaacaagaaagacaaatttggaaggagcccgctgcattatgcggccgccaattgcaattatcagtgtctgttcgcactcgtaggaagtggtgcaagcgtgaacgacctcgacgaacgggggtgcacccctctgcactatgcagccacaagtgataccgacggaaagtgcctggagtatctgctgagaaacgacgcaaacccgggaattcgcgataagcagggctataatgccgttcattattccgctgcatacgggcataggctgtgcctgcagctaatcgcgagcgaaacacccttagacgtgttgatggaaacttccgggaccgacatgctttccgactctgataacagggccactatcagtccgctgcatctggctgcataccacggccatcaccaggccctggaggtcctggttcagtcacttttggatcttgacgtgagaaatagctccggaagaactcctctagacctagcggcttttaaaggccacgttgagtgtgtggacgtgctgatcaatcaaggggccagcattttggtcaaagactacatactgaaacgcacccccatccacgcagccgctaccaatggccactccgagtgtctcagacttctgattgggaacgctgaaccccagaacgcagtggacattcaggacggaaatgggcagaccccgcttatgctgagcgtcttaaacggtcacactgattgtgtgtatagtcttctgaataagggtgctaatgtggacgccaaggacaagtgggggagaacagccctgcaccggggggctgtgacagggcatgaagaatgtgtggatgccctgcttcagcatggtgcaaagtgcctgctgcgagatagccgcggcagaacccctatccatctgagcgccgcctgtggccatataggcgtgctgggcgcattactgcaatccgcagcttcaatggatgcaaatcctgctacagcagataaccatggctacaccgccctccattgggcctgctacaatggccacgaaacttgcgtggagctcctcctcgaacaggaagtcttccagaagactgagggcaacgccttctcccccctccattgcgctgtcatcaacgacaatgaaggtgccgctgagatgctcatagatactctcggcgcctccatcgtgaatgccactgactcaaaaggtcgcacaccgctgcatgcagcagctttcacagaccacgtggaatgtctgcagttacttctgtcccacaacgcccaggtgaatagcgtggattccaccggtaaaaccccattgatgatggcagcagagaacggacagacgaatactgtcgagatgctcgtcagctcagccagcgccgagctgactctgcaggacaactctaaaaacaccgccttgcacttggcctgctcaaaaggccatgagactagcgccttgctcatcctggagaagattaccgatcggaatctcattaacgcaactaacgcagctctgcagacaccactgcatgtagccgctcgcaacggcctcactatggtggtgcaggaattgctggggaagggagcgtcagtgctggctgttgacgagaatgggtacactcctgctctggcttgtgcgcctaacaaggacgtggcagactgcctggccctgatcctcgccaccatgatgccagtcagctctagcagtccacttagctccctgacattcaatgccatcaaccgctacaccaacacctccaagactgtctcatttgaggctctgcctatcatgcggaatgagcccagcagttactgttcatttaataacatcggcggagagcaggaatatctgtacactgacgtggatgagctcaacgattccgactccgaaacatattag

SEQ ID NO: 179098 - DNA, 3162 bp, Artificial Sequence
  Description of Artificial Sequence: Synthetic coding sequence
atggccttcctgaagctgcgggaccagcccagcctggtgcaggccattttcaatggcgaccccgatgaagtgcgtgctttgatattcaagaaagaggatgtaaatttccaggataatgagaaaagaaccccactgcatgccgccgcttatctgggagacgctgaaattattgaactcctgattttgagcggtgcgcgtgtgaatgcaaaagattcaaagtggctgacaccgcttcacagggctgtggccagttgcagtgaggaggcagttcaagttctgttaaagcactccgcagatgtgaatgcccgggacaagaattggcagacgcctcttcacatcgcggctgccaacaaagctgtcaaatgcgctgaagctctggtcccactgctcagtaatgtcaatgtgtccgatcgggccgggaggactgcactgcaccatgccgccttcagtgggcacggagagatggtgaagctactgctctcacgtggggctaatatcaatgcatttgacaaaaaagatagacgggccatacattgggcggcttacatgggccatatcgaagtcgtcaaattgctcgtgtcacatggagccgaggtcacctgcaaggataagaaatcttatacccccctgcatgctgcagcaagctcaggaatgatatcagtagtcaagtaccttttagacctcggcgtggacatgaatgaacctaacgcttacggaaatacacccctgcacgtggcatgctacaacggacaggatgtcgtagtcaatgagttgattgattgtggagcaattgtaaatcagaaaaatgagaagggcttcacaccactgcatttcgcggccgctagcactcacggtgctctgtgtttggaattgctagtcggaaatggcgctgatgtgaatatgaagagtaaggacggaaaaacacctctccacatgacagccttgcatggacggttctcaagatcacagacaataatccagagcggggcagtgattgattgcgaggacaagaacggcaacacacctctgcatattgccgcacggtacggtcatgaattactaatcaatacccttatcaccagtggagccgataccgctaaaaggggaatccacggaatgttccccctgcacctggcagccctctccgggttctccgactgttgtagaaagctgctgtccagcgggtttgacattgacactccagatgactttggaagaacctgtctccatgccgcagctgcaggcgggaacttggagtgcctcaacctcctgcttaacacgggggcagattttaacaagaaggacaaatttggcaggtctccacttcattacgccgccgccaattgcaattatcagtgtttattcgcccttgtcgggtccggggcttcagtgaatgatcttgatgagcgaggctgtacgccattacactatgccgcgacttctgacacggacgggaagtgtcttgaatacttgctgcggaacgatgccaaccccggcattcgggacaaacaggggtacaatgctgtgcactacagcgcggcttacgggcataggctctgcctgcagctcattgcaagcgagactcccctcgacgtgttaatggaaacatctggcactgacatgctatccgacagtgacaatcgcgccacaatttccccacttcatttggccgcgtatcatggacaccaccaggctttggaagtgctggtacagtctctcctggacctcgacgttcggaattcctctgggagaactcctctcgacctggctgcgtttaagggccacgtggagtgtgtggatgtgcttatcaatcaaggagctagcatcctggtgaaggattatattctgaagcgcacaccaatccacgcagcagctacaaatggacatagtgaatgcctaaggctgcttatcgggaacgctgagcctcagaatgcggtggacattcaggatggcaatggtcagacgccactgatgctttctgttttgaatggtcacactgattgcgtctacagtctcttaaacaaaggcgccaacgtggacgccaaagacaagtgggggagaacagccctgcaccgtggggccgtcactggccatgaagaatgtgtggatgctctcctccagcatggtgccaagtgcctgctgagggattcccgaggtcggacacctatccacctgtccgcagcatgtgggcacataggggttctgggcgcactgctacagagtgcggcctctatggacgctaaccccgctaccgcagataaccacgggtacaccgctctccactgggcctgttacaatggacacgagacgtgtgttgagctgctgcttgaacaggaggttttccagaagactgaaggaaacgcattttccccactgcattgcgccgtgataaacgacaacgagggtgccgccgagatgctgatagatacgctcggagccagcatcgtgaatgccacagattccaaaggcagaacccccttgcacgcagccgcatttaccgatcacgtggagtgcctgcagcttttgctgagccataatgcccaggtgaacagtgtcgactccacgggcaaaactcccttgatgatggcagcagagaatggccaaactaacaccgtcgagatgcttgtgtcctctgcctcggccgagctcaccttgcaggacaactccaagaacaccgctctgcacttagcttgctccaaaggtcacgagacctccgctctgctgattctggaaaaaatcaccgacaggaacctaattaacgctactaacgctgcactgcaaaccccactgcacgtcgccgccaggaatggcctgaccatggtggtccaggagttgctgggtaagggggcttctgtgcttgcagtcgacgagaacggatacactcctgccctggcctgtgcgccaaacaaggacgtcgccgattgcttggccctcattctggcaacaatgatgccggtgtctagcagcagtcctcttagcagcctgacattcaatgcaatcaatagatacactaatacatccaagactgtatcctttgaagcactgcccattatgcggaacgagccgtcttcatactgttcatttaacaatataggaggagagcaggaatatctctacacagatgttgacgaactgaacgattcagattcagaaacgtattag

SEQ ID NO: 179099 - DNA, 3162 bp, Artificial Sequence
  Description of Artificial Sequence: Synthetic coding sequence
atggccttcctgaagctgcgggaccagcccagcctggtgcaggccattttcaacggcgaccccgatgaggtgcgagcccttatctttaaaaaagaggatgttaatttccaggacaatgagaaacgcacaccccttcacgctgcggcttatcttggggacgccgagattatcgagcttctgatcctgagcggcgctcgcgttaatgcaaaggactccaaatggttaaccccccttcatcgcgccgtcgctagctgctcagaagaggcggtgcaggtgctccttaagcattccgccgacgtgaatgcccgtgataagaattggcagacaccgcttcatattgccgccgctaacaaagctgtgaagtgcgcagaagcactggtaccattgctgagtaatgtgaatgtgtccgaccgagctggtcgcaccgcactccaccatgctgctttttccggtcacggggagatggtaaagcttctcctgtctcgtggcgccaatatcaatgcatttgataaaaaagacaggagagcgattcattgggcagcatacatgggacacattgaagtggttaaactcctggtcagtcatggagccgaagtgacctgcaaagacaaaaagtcctacacaccactccatgcagctgcgagctcggggatgataagcgtggtgaagtacctgttggacctaggggtcgatatgaacgagccaaacgcctacggcaatactcccctccatgtggcatgctataatgggcaggatgtcgtggtgaatgaactgatcgactgtggagcaattgtcaaccagaagaacgagaaaggattcacccccctgcattttgccgctgcatccactcatggcgcactttgcctcgagctgttggtcgggaatggcgccgatgtgaatatgaagtctaaagatggcaaaacccccttacacatgaccgcattgcatggtaggtttagccggtcccaaaccatcattcagtcaggtgccgtgatcgactgtgaggacaagaacggaaacacaccactgcacattgccgctaggtatggtcacgagctgctgataaataccctgataacatccggcgcagatacagcgaaacgtggtatacatgggatgttccctctgcatctggctgccctgtccgggtttagtgattgttgccgaaagctgctttcctctggatttgacatcgacaccccggatgacttcggacggacttgcctgcatgccgccgccgccgggggcaaccttgaatgtctcaatcttctgcttaacaccggcgctgattttaataaaaaggacaagtttggcaggagccccctccactatgccgccgccaactgcaactaccagtgccttttcgccctcgtcggatccggcgccagcgtcaatgatctggatgagcgggggtgcacacccttgcactacgcggcgacatctgatacagacggcaagtgtttggagtacctgttacggaatgatgccaatcccgggataagagacaagcagggctacaatgcggtacactattccgcggcatatggccatcgcttatgcctccagttgatagcaagtgaaacccccctcgatgtgctgatggagacatccggaactgacatgttgtcggactctgataaccgggccactatctcccctctgcatctcgccgcctaccacggacaccatcaagctctggaggtgttagtgcagagtttgctcgacctggacgtcagaaatagctctggaaggaccccattggatctggctgcttttaaggggcacgtcgagtgtgttgacgtgctcataaaccagggcgcatctatcctggtaaaagattacattttgaagcggacccccatccacgctgccgctacaaatgggcactccgagtgtctcagactgctgatcggaaatgccgagccccagaatgcggtggacatacaggatgggaatgggcagacaccattaatgcttagtgtactcaatggccacaccgattgcgtgtattcgttgctgaacaagggtgctaatgtagatgctaaggacaaatggggtcgcacggctcttcatagaggtgctgtgactggacatgaagaatgcgtggatgccttattacagcatggcgccaaatgtctgctgagagacagccggggtagaacccccatccacttatctgcagcttgcggtcacataggggtcctcggagctctgctccagagtgcagcctctatggatgccaatcctgccactgccgacaatcacggctatacggctctgcattgggcatgctacaacggacatgaaacttgtgtcgagttactccttgagcaggaagtttttcaaaagaccgagggtaatgcgttttccccactccactgcgccgtgatcaacgataacgagggagccgcagaaatgttgattgatacactgggagccagtatcgtgaacgctacggattcaaagggtcgaacccccctgcacgctgccgccttcaccgatcacgtcgaatgcttgcaactgttactgagtcacaatgcacaggtgaactctgtggatagcaccggcaagacacccctcatgatggccgccgaaaacggccagactaacacggttgaaatgctcgtgtcttcagccagtgctgaactgactctccaggataactctaaaaacactgcactccacttggcctgttctaagggacacgaaacgagcgcactgctgatattagagaagataaccgacaggaatctgataaatgccactaatgccgccctgcagaccccactacacgtggcagctcgaaacggcttaacaatggttgttcaggagctgctagggaaaggggcttctgttcttgctgtggatgagaacggttacacgccagcccttgcctgcgctcccaataaagatgtagctgactgtctggcattgattctggccacaatgatgcccgtgtcttcaagcagccccctctcgtcattaacatttaacgcaattaatagatataccaacaccagtaaaactgtgtcatttgaggcattgccaatcatgagaaacgaaccctcctcatactgctctttcaataacataggcggagaacaggagtatctgtatacagacgttgacgagctgaatgattccgattcagaaacgtactag

SEQ ID NO: 179100 - DNA, 4026 bp, Artificial Sequence
  Description of Artificial Sequence: Synthetic coding sequence
atgaccaagcggaagaagaccatcaacctgaacatccaggacgcccaaaaaagaaccgctttgcattgggcctgcgttaacggccacgaagaggttgtgaccttcctagtagacagaaagtgtcagctcgacgtcctagacggagaacataggaccccccttatgaaggcacttcagtgccatcaagaggcctgtgccaacattctgatcgatagcggcgcagatattaacctggtagacgtgtacggtaacactgctctgcactatgccgtgtactccgagatactcagtgtggtggctaagctgttgagccacggcgcggtcattgaggttcataacaaagccagcctcacccctctgctgctgagcatcaccaaaagatctgaacagatcgtggagtttctgctgatcaagaacgccaacgccaatgccgtgaataagtacaaatgcacagccctcatgctggccgtatgtcatggtagctccgaaattgttggtatgctattgcagcagaacgtggatgtcttcgccgcagacatctgcggggtgactgcagagcattacgctgtcacttgtggttttcaccatatccatgagcaaattatggaatacatcagaaagctctcaaaaaaccatcagaataccaatcctgaggggactagcgccgggaccccggatgaggccgcccccctggccgaacgcacccccgataccgcggagtccctcgtggagaagacacctgatgaagccgctccgctggttgaaagaacgccggatacagccgaatcactcgtggagaagacgccagatgaagcggcctctctggtagagggcacaagtgacaagattcaatgcctcgaaaaagccacaagcggcaagtttgaacagagcgctgaggagaccccccgtgaaattacctcgccagccaaagagacgagtgagaaatttacttggcccgccaaaggccgacccagaaagatagcatgggagaaaaaagaggatactcctcgggagatcatgtcgcctgcaaaggagacgtctgagaaatttacctgggctgcaaaggggagacccaggaagatcgcttgggaaaagaaagagactcccgttaaaaccggttgtgttgctcgggtgacaagcaacaaaactaaagtgctggagaaaggccggagtaagatgatcgcttgtccaaccaaagaatccagtacgaaagcgtccgcaaacgaccagagattccctagcgaatccaaacaggaggaagatgaggagtatagttgcgattcccgatccctcttcgaatcctcagccaaaatacaggtctgcattcccgagagcatctaccaaaaagttatggagatcaaccgcgaggtcgaggaaccgcccaagaaaccatccgctttcaagcccgccatagaaatgcagaacagcgtacctaataaggcctttgaactgaagaacgagcagacattacgagcggaccccatgttccctcccgagtctaagcagaaagactacgaagaaaacagctgggacagtgagagtctgtgcgaaaccgtgtctcagaaggacgtttgtctgccaaaggctacccatcagaaggagatcgataagattaacggtaaactcgaggagtcaccgaacaaagacgggctgctgaaggctacttgcggcatgaaggtctctatccctacgaaagccctggaacttaaggacatgcagacctttaaggcagagcctcctgggaaacccagtgccttcgagccagctaccgagatgcagaagtccgtacccaacaaggcacttgagttgaagaatgaacaaacactacgcgctgacgagatccttccaagtgaaagtaagcaaaaagattacgaggagaattcttgggatactgaaagtttatgtgaaaccgtgtcccagaaggatgtgtgtctcccgaaggctgcacaccagaaagaaatcgacaagattaatgggaagctcgaaggcagtcctgtaaaggatggattacttaaggccaactgcgggatgaaagtttccatccctaccaaggcactggagcttatggacatgcagacctttaaggctgaacctccggaaaaaccctcagccttcgagcctgctattgagatgcagaagtccgttcccaataaagcattagaattgaaaaatgagcagactttacgggctgatgaaatacttccaagcgagagcaagcagaaagactacgaagaaagctcgtgggattctgagtccctgtgcgaaaccgtctcacagaaggacgtctgccttcccaaggctacacaccagaaggaaatcgacaagattaacggcaagctcgaggagtcaccagacaatgatgggtttcttaaggctccatgccgcatgaaagtcagcattccaacaaaagctttggagctgatggatatgcagacttttaaggccgaacccccagaaaaaccctccgcattcgaaccggccatcgagatgcaaaagtccgtgccaaataaggccctcgaactgaagaatgaacagacactgcgtgctgatcagatgtttccaagcgagtcaaaacagaagaaagtggaggaaaacagttgggactccgaatctctgcgtgaaaccgtctcacagaaagacgtgtgcgtccccaaagctactcatcagaaggaaatggacaaaatcagtgggaaactagaagacagcacgagcttatccaagatcttggacacagtgcactcttgcgagagggcaagagaacttcagaaggatcattgcgagcaaagaaccggtaaaatggagcaaatgaagaagaagttctgcgttctgaaaaagaagttaagtgaagccaaggagattaagtcacaattggaaaaccaaaaagtcaagtgggaacaggagctgtgctccgtgcggctgacgctgaaccaggaagaagaaaaaagaaggaatgcagatatcctcaacgagaagatccgcgaagagctgggcagaattgaagaacagcaccgaaaggagctcgaggtgaaacagcagctggaacaagccttaagaatccaagacattgagctgaaaagcgttgagtcaaatctgaaccaggtctctcatacacacgagaacgagaactatttgttacatgaaaactgcatgttgaaaaaggagatcgcaatgctgaagctagagatcgccactctaaaacatcagtatcaggaaaaggaaaacaaatacttcgaagatattaagatcctcaaggagaaaaatgcagagctgcagatgaccttaaaattgaaagaagaaagcctgacaaaaagagcttctcagtattccggtcagttaaaagtgctgattgcagaaaataccatgctgacgagtaagctcaaggagaaacaggacaaggaaattctggaggccgaaatcgagtcacatcaccctagactggcctctgctgtgcaagaccatgaccagatagttacaagtcggaagtctcaagagccagcgttccacatagcaggcgacgcttgcttgcagagaaagatgaacgtggatgtgtcaagtactatatacaacaatgaggtgttgcaccagcccctcagcgaagcacagcgcaagtccaaatcattgaagatcaacttgaactacgccggtgatgcattgcgtgagaacacccttgtgagtgaacatgcacaaagagatcaaagagaaacccaatgccaaatgaaagaagccgagcatatgtaccagaacgaacaggacaatgtgaacaaacatacagagcagcaggaaagcctggatcagaagcttttccagctacagtctaaaaatatgtggctgcagcagcagctggttcacgctcataaaaaagcagacaacaagagcaaaatcacaatcgatatacacttcctcgaaagaaagatgcagcaccacctgctgaaggagaaaaatgaggagatcttcaactataataaccatttgaagaatcgtatttaccagtatgagaaggagaaggccgaaacagaaaacagctag

SEQ ID NO: 179101 - DNA, 360 bp, Artificial Sequence
  Description of Artificial Sequence: Synthetic coding sequence
atgggcacccggaccctgcagttcgagatcagcgacagccacgagaaggaagaggatctgctacacaagaaccacttaatgcaggacgagatcgcacgcctgcgtcttgaaatccacactatcaaaaatcagatactagagaaaaaatatctgaaagatatcgaaataattaagcgcaaacacgaggatcttcagaaggcactaaaacagaacggagagaagagcaccaaaaccatcgcccactattccggacagctgacagccttaaccgatgaaaacacaatgctccgttctaagctggagaaagaaaaacaatctaggcagcgcctcacaaagtggaatcacacgatcgttgattag

SEQ ID NO: 179102 - DNA, 759 bp, Artificial Sequence
  Description of Artificial Sequence: Synthetic coding sequence
atgagccaggccgccaaggccagcgccagcgccaccgtggccgtgaatccagggcctgacacaaaagggaaaggtgctccgccggctggcacttctccttcaccaggaacaacattggcacctactacagtgcctatcacctcggccaaagccgctgagttgccccccggcaactatcgacttgtcgtgttcgagctggagaactttcagggacgcagggctgagttttctggagagtgttctaatctggccgatcgtggctttgatagggttcgctccattatcgtgtctgctggaccttgggtagcttttgaacaatcaaatttcaggggagaaatgttcatcctggagaaaggggaatatccgagatggaacacatggtcaagttcctataggagtgaccgcttaatgagctttcgcccaattaaaatggacgcccaggaacataaaatcagcctgttcgaaggggccaattttaagggcaacacgattgaaatccagggggatgacgcgccttctctatgggtttatggcttttccgatcgcgtgggatccgtgaaggtgtctagtggtacatgggtagggtatcaataccccggctatcgcggataccagtatctgctggagcccggcgatttccgacattggaacgaatggggggccttccagcctcagatgcagtctttgagaaggttgagagataaacagtggcatcttgagggttccttccctgtcttagccacagaacctccgaaatag

SEQ ID NO: 179103 - DNA, 627 bp, Artificial Sequence
  Description of Artificial Sequence: Synthetic coding sequence
tgacgggacgagctgcggtgcaagatccccgccggccggctgcggcgggctgctcgtccgcataggcggcttggccctactgggaaggaggtgcatgcactgaaaaggctcagggacagcgctaacgccaacgatgtcgagactgtccagcaattgctggaagatggggcagacccatgcgctgcagatgacaagggaagaactgcccttcattttgcatcctgtaatgggaatgaccagatcgtgcagctgctgctcgatcacggggccgacccgaaccaacgcgacggtctagggaatactccactacacctggagtgttctccacagcttgtaccagcgggggcacgtgtggacgctctcgaccgcgctgggcgaactcccctccatctggccaaaagtaagttgaacatccttcaggagggtcacgcacagtgtctggaggcggtcaggctggaagtgaaacaaattatccacatgctgagggagtatctggaacggttgggtcagcatgagcagcgagaacggctagacgatctgtgcacgaggcttcaaatgacttcgactaaggaacaggtcgacgaggtcaccgatctactggcctcctttacttcgctctccctctag

SEQ ID NO: 179104 - DNA, 2184 bp, Artificial Sequence
  Description of Artificial Sequence: Synthetic coding sequence
atgagccagcaggacgccgtggccgccctgagcgagcggctgctggttgccgcctacaaaggtcagactgagaatgtagttcagcttattaacaaaggcgcccgcgtcgccgtaaccaagcatggtcgaacaccactgcaccttgccgccaacaaaggccatctgcctgtcgtccagatcctgttaaaggctggctgcgacctggacgtgcaggacgatggcgaccaaaccgcgctccatcgtgccacagtggttggaaacaccgaaataattgccgcgctaatccacgagggctgcgcgctcgacagacaggataaagatggtaataccgcactacacgaggcctcgtggcacggctttagccagtccgccaagctgttgatcaaagctggggccaacgtcttggccaaaaataaagcaggcaatacagctctgcacctcgcctgtcagaacagtcactcgcaaagcacaagggtgttactactcgcgggatctcgagccgatctcaagaacaatgccggagacacttgccttcatgtggcagctaggtataatcacctcagcattatccgacttttgctaacagctttttgttctgtacacgagaaaaaccaggcgggcgataccgccctccacgtggccgccgccctgaatcacaagaaagtagcaaagatattgctcgaggcaggcgcggatacaacaatagtgaacaatgccggacaaactcccctcgaaaccgcccgctaccataataatcccgaggtggcgctgctgctgaccaaggcaccccaggttttgcgattctctcggggacggagtctcagaaaaaaacgcgagagactcaaagaggaacgccgagcccaaagcgtcccccgggacgaagtggctcagtctaagggctccgtcagcgccggggatactccaagcagcgagcaggctgttgcccgtaaagaagaggctcgggaagagttcttgagcgcttctcccgaaccgcgggccaaggatgatcgccggaggaaaagccggccgaaggtgtcggctttttcagatcctacgccacccgccgaccagcaaccaggccaccagaaaaacctgcatgcacacaatcaccccaagaagcggaaccgccaccggtgctcgtccccgcccccgccccacgagtttcgcgcgtatcagctgtacaccctgtaccgggggaaggatggaaaggtgatgcaggcacctattaacgggtgtaggtgcgagcccctgattaacaagctggagaatcagctcgaagctaccgtggaagaaataaaagcagagctaggctcagtgcaggataaaatgaacacaaagttagggcagatggaaaataaaacccagcatcagatgcgggttctggataaactcatggtcgaacgcctaagcgctgagcggacagagtgtttgaatagacttcaacagcatagtgataccgaaaagcatgagggcgagaaacggcaaattagtcttgtcgatgagctaaaaacctggtgtatgctaaaaattcagaatcttgagcagaagctcagcggtgactcacgtgcctgtcgcgccaagagtaccccaagcacttgtgaaagttcaacaggcgtagaccagttggttgtgacggcagggcctgcagccgcatcggatagcagtccccccgttgtgcgtcccaaggagaaagcactgaattccacagccacacagagattacagcaagaattatccagctccgactgcacaggcagccgacttcgtaacgtgaaggtgcaaacagccctgctgcccatgaacgaggcggcacgttcagaccagcaagccggcccgtgcgttaaccgtggtactcagactaaaaagtctggcaagagtggaccaactaggcaccgggcccagcagcccgctgcatcatctacctgcggccagccgccacctgccactggtagcgagcagactgggccacatatcagggatacctcccaggccctagagcttacacagtacttctttgaggcggtctctacccaaatggaaaagtggtacgagcggaaaattgaggaggctcgatctcaggccaatcagaaagcccagcaggacaaagctacactcaaggaacacatcaagagcttggaggaagagcttgctaaattgagaacaagagtgcagaaagagaactag

SEQ ID NO: 179105 - DNA, 2079 bp, Artificial Sequence
  Description of Artificial Sequence: Synthetic coding sequence
atgagccagcaggacgccgtggccgccctgagcgagcggctgctggtggcagcctataagggtcagactgagaacgtggtacagctgattaataagggggctcgtgtagccgttactaagcatggacgaacaccccttcacctggctgctaacaagggccacctgcctgtagtacagattttgctgaaggcaggttgcgatctggatgtgcaggacgacggtgatcaaacggccctccaccgggccactgtcgtggggaatacagaaataatcgcagccctgatccacgaaggatgtgctcttgatcgacaagacaaggacggtaatactgccctgcacgaggctagctggcacggattttcacagagcgcaaaacttctgatcaaggccggggcaaacgtccttgcaaagaacaaggctggcaacaccgcactccacttagcctgccaaaattctcattcccaatcaacaagagtcctcctgctagccgggtctagagccgacctgaaaaacaatgctggcgatacctgcttacatgtcgcggccagatataaccatctgtcaattatccggctccttctgaccgcgttctgttccgtgcacgagaagaaccaggccggcgatacagcgctccacgttgctgcagccctcaatcataagaaggtcgcaaaaatcttgctggaggctggcgccgatactacgatcgttaataatgccggacaaactcctctggaaactgcccgataccacaataatcccgaggtcgctctgttgttaacaaaggctccccaggggtccgtcagtgccggagacactccatcatctgagcaagcagttgctaggaaagaggaggccagggaagagttcctttccgccagtcctgagcctagggctaaggatgatcgccgtaggaagtctcgtccaaaggtctcagccttctcagatcccacccctcctgcagaccaacagccgggccaccagaaaaatttgcatgctcacaatcatccgaaaaaaaggaacaggcatagatgcagcagtccaccccccccacacgagtttcgagcatatcagctatacacactgtatagggggaaagatggcaaggttatgcaggccccaatcaacgggtgccgctgcgaacccttgatcaacaagctcgaaaaccagttggaggctaccgtagaggagattaaagccgagctgggctctgttcaggacaaaatgaatacaaaactcggacagatggagaataagacacagcatcagatgagagtgttagataagctgatggtcgagaggttgtccgctgaaaggaccgagtgcctcaatcgactgcagcaacattccgacaccgaaaagcacgagggcgagaaaagacagattagtttggtggacgaactgaagacctggtgtatgttgaaaatacaaaacctcgagcagaaactgagcggtgattctagagcgtgccgtgccaagagcacaccgtctacttgtgagagttccaccggcgtagatcagcttgtggtgacagctggaccggctgccgcctcggacagctctccccccgtagtgcggcccaaggaaaaggcattgaattctacagccacccaacggcttcaacaggagcttagcagctccgattgcacaggctcgagattgcgcaacgtgaaagtccagaccgctcttctaccaatgaacgaggcagcccgctccgatcagcaagctggaccctgcgtcaataggggcacccaaaccaaaaagagcggaaaaagtggtcccaccaggcatagagcccagcagcccgctgcaagctccacttgtggccagcccccacctgccactgggtctgaacagacgggtccccacatccgcgacacctctcaggcccttgagttaactcagtatttcttcgaagcggtgagtacccaaatggaaaagtggtatgaaagaaagatagaggaagcccgcagtcaggctaatcaaaaggcccaacaagacaaggccacactgaaagaacacatcaagtccctcgaggaggaactagccaagttacgcacccgcgtgcaaaaggaaaattag

SEQ ID NO: 179106 - DNA, 2169 bp, Artificial Sequence
  Description of Artificial Sequence: Synthetic coding sequence
atgagccagcaggacgccgtggccgccctgagcgagcggctgctggtggcagcctacaaggggcagaccgaaaacgtcgttcaactcattaataaaggcgcacgggtggctgtgactaagcatggcaggaccccactccacctggcagcaaataaggggcatctcccagtggttcaaatcctgctgaaggctggttgtgatcttgacgtgcaggatgatggcgatcagactgccctgcacagagcaaccgttgtaggtaatactgagattattgccgctctaatccacgagggctgcgcacttgataggcaggacaaggatgggaatacagcgctacacgaagctagctggcacgggttttcgcagtctgctaagttattgattaaggccggagcgaatgtgctggctaagaataaggcaggcaacacggcccttcacttggcctgccagaattcgcattcccagagtactcgagtgctgctattagccggttctcgtgccgatcttaagaataacgccggagacacatgcctccacgtggccgccaggtacaaccatctcagcataatcagactcctcctcactgctttttgttctgtgcatgaaaaaaatcaggcgggcgacactgccttgcatgttgctgccgcactcaatcataaaaaggtcgcaaagatcctgctggaggccggcgcagatactacaatcgtcaacaatgctgggcaaaccccactggagaccgcaaggtaccacaacaaccccgaggtcgccctgttattgacgaaagctccacaggttctacgctttagtcgtggacggtcattgaggaagaagcgcgaacggctcaaagaggagagaagggctcagagcgtgccaagggacgaagtagcccagtcgaaaggttctgtgtctgccggggatacaccctctagcgagcaggcggtcgcccgcaaggaagaggctagagaggaatttctgtcagcctccccggaacctcgggccaaggatgacaggagacgcaaatcacgcccaaaggttagcgccttctctgacccgaccccacccgcggaccagcaacctggtcaccagaaaaatctccacgcgcacaatcaccccaagaaaagaaatcgccatcgctgcagttccccgccacctccacacgaattccgggcttaccagctttacaccctctatcgaggcaaagatggaaaggttatgcaagcgcccatcaatggatgtcgatgtgagcctttaatcaataaactcgagaaccaactggaagccactgtggaggaaatcaaagcagagcttggctctgtgcaggacaaaatgaacaccaagctgggccagatggagaataagactcagcatcagatgcgggttctggacaaattaatggtggaaaggctttcagctgaacgcaccgagtgtttgaacagacttcagcagcactcagacaccgaaaagcacgaaggtgagaaacggcaaatcagtctggtggacgagctgaagacttggtgcatgctgaaaattcagaacctggagcagaaactttcaggggattcgagggcgtgccgcgccaagtctaccccctccacgtgcgtggatcaactggtggtgacagcaggacccgcagcggccagcgactcctccccccccgttgttcgacctaaggagaaagcgctcaatagtactgccacacaaaggctgcagcaggaattgtccagctccgactgcactggaagtagacttcggaatgtcaaagtgcagactgccctgctgccaatgaatgaagccgcacggtctgatcagcaggccggaccctgtgtgaatcgagggactcagactaaaaagagcggaaaatcaggcccgacacggcaccgggctcagcagcctgcagcctcctcgacctgcgggcagcctccaccagcaacaggtagcgaacaaaccggaccacacatccgcgatacctcccaggctttggaactgactcagtatttctttgaggctgtctcgacccagatggagaagtggtacgagcgcaaaatcgaagaggcccggtctcaagctaaccagaaggcccagcaagataaagctactctgaaagaacatatcaaatctctcgaagaagagctcgccaagttacgaacaagggttcagaaggaaaattag

SEQ ID NO: 179107 - DNA, 528 bp, Artificial Sequence
  Description of Artificial Sequence: Synthetic coding sequence
atgagccagcaggacgccgtggccgccctgagcgagcggctgctggtggctgcctataaggggcaaacggaaaacgtagttcagcttatcaacaagggcgctagggtcgcagtaacaaagcacgggagaactccactgcatctggccgctaacaagggacatctccctgtagtacagatcctcctcaaggcaggctgtgacctggacgtacaggatgatggagatcaaacggccctgcaccgcgccactgttgttggcaacaccgaaatcattgctgccctcatccacgaagggtgtgctctcgatcgccaggataaggatggcaacactgcactgcatgaagcctcatggcacggtttctctcagtctgccaagctgttaatcaaagccggcgccaacgttttggccaaaaacaaggctggtaatactgccctccatttagcatgtcagaattctcactcgcagtcaacacgcgtgttgctgctggctggctctcgggcggatctgaagaataatgccggtgattag

SEQ ID NO: 179108 - DNA, 243 bp, Artificial Sequence
  Description of Artificial Sequence: Synthetic coding sequence
atgagccagcaggacgccgtggccgccctgagcgagcggctgctggtagcggcgtacaaaggccaaaccgaaaacgtggttcagcttatcaacaagggggcccgagttgcagtcaccaagcacggtcggactcccctgcaccttgctgctaacaaggggcatcttcccgtggtgcaaatactactgaaggctggttgcgatctggatgtccaagatgatggcgaccagaccgcgcttcactag

SEQ ID NO: 179109 - DNA, 2184 bp, Artificial Sequence
  Description of Artificial Sequence: Synthetic coding sequence
atgagccagcaggacgccgtggccgccctgagcgagcggctgctggtggcagcttacaagggccagaccgaaaacgtcgtgcagctcattaacaagggtgcccgggtcgcagtcacaaaacacggccgcaccccgctccatctcgcagcgaacaagggacacctgcctgtagtacagatcctgttgaaagccggctgcgaccttgacgtccaggacgacggtgaccagaccgcactccatcgggctaccgttgtaggtaataccgaaattatcgctgcccttatccatgaagggtgcgccctcgatcggcaggacaaagacggcaacacagccctacatgaggcttcatggcatggatttagccagagcgccaaattgcttattaaagccggtgcgaatgttctggcaaaaaataaggctggaaataccgcactgcacctggcctgccagaacagtcactcccaatcgactagggttctgctactggccggaagccgcgctgatctaaaaaacaacgccggtgatacctgcctccacgttgccgccaggtataaccacctgagtataatccgtttacttcttaccgcgttctgcagtgtgcatgaaaaaaaccaggccggcgacactgctctacatgtcgctgccgctttgaaccataaaaaagtcgctaaaattctcctggaggccggagctgatacgaccatagttaacaacgccggccagaccccattggagaccgccagatatcacaacaatcctgaagtggctctgctgctgaccaaagccccccaggttctcagattctcaagaggaaggtcgctacggaaaaaacgcgagaggttaaaagaagaaaggcgggcccaatccgtccctcgcgatgaggttgcacaaagcaaagggtctgtctccgctggtgatacaccgagtagcgagcaggcagtggcacggaaggaggaagccagggaggaattcctaagcgcttcccccgagccacgtgcgaaggatgatagacgtcgtaagtcgagacctaaagtgtctgccttctctgatccgacccccccagcggaccagcagccaggccaccagaagaacctacacgcccataatcaccccaaaaaaagaaatagacaccggtgttccagtccacctcccccgcatgaatttagggcttaccagctctacacactgtataggggcaaagacggcaaagtcatgcaggctcctatcaacggttgccgctgtgaacccttaatcaacaagctggagaatcaattggaagcgacggtcgaggaaatcaaagctgagttgggttccgtccaggataaaatgaacacaaagcttggccaaatggagaacaaaacacagcaccagatgcgcgtcttggataagctcatggtcgagagattgtctgcagaaagaactgagtgcctgaatcgtctgcagcagcatagcgacactgagaagcatgagggtgaaaagcgacagatctcccttgtagacgaactgaagacctggtgtatgctgaaaatacagaatcttgaacagaagctgtcaggggatagccgcgcttgccgggccaaatcaaccccgtctacatgtgagagctctaccggagttgaccagttagtggtgacagccggaccagcggctgcttctgactctagcccaccagtggtgcgcccaaaggagaaggccctgaattcaacagccacccaacgactgcaacaggagctgtccagctccgactgtacaggctcacggctgaggaatgtgaaagtgcagactgcattgctgcccatgaacgaggccgcgcgatccgatcagcaggccggtccatgcgtgaacagggggacacaaactaagaaatctggcaaatccggccctactcggcacagggcacagcagcctgctgcgagtagcacctgcggccagccacccccagccaccgggagcgagcagacgggcccccacattcgcgatacgagccaagcgttagaactgactcagtacttcttcgaagctgtgagtacccagatggaaaagtggtatgagcgtaaaattgaggaagcaaggtcccaagctaatcagaaggctcagcaagataaggcaacgctgaaagagcatatcaaatcgctggaggaggagctggccaagctgaggacccgagttcagaaagagaactag

SEQ ID NO: 179110 - DNA, 357 bp, Artificial Sequence
  Description of Artificial Sequence: Synthetic coding sequence
atgagccagcaggacgccgtggccgccctgagcgagcggctgctggttgccgcttacaaggggcagaccgagaatgtggtgcagctgattaataaaggggcaagagtcgccgtcacaaaacacggcaggactccactgcacttggccgcgaacaaaggacacttgcccgtggtccagattcttctgaaggccgggtgtgacctggacgttcaggacgacggggaccagaccgcccttcaccgggcgactgtagtgggaaacactgagattatcgccgcgcttattcacgaagggtgtgctctcgatcgccaggataaagacgggaatactgccctgcacgaagctagctggcactag

SEQ ID NO: 179111 - DNA, 309 bp, Artificial Sequence
  Description of Artificial Sequence: Synthetic coding sequence
atgagccagcaggacgccgtggccgccctgagcgagcggctgctggtggcagcttataagggccagactgagaacgtggtccagctgattaacaaaggcgctcgcgtggccgttactaaacacggccggacgccactgcacttggcagcaaacaaaggccacctgccggtggtgcagatcctgcttaaggccggttgcgatttggatgttcaagatgatggcgaccaaacagcacttcatcgcgccacagtggtcgggaacaccgaaatcatagccgcactcattcacgaaggctgcgcacttgactag

SEQ ID NO: 179112 - DNA, 1992 bp, Artificial Sequence
  Description of Artificial Sequence: Synthetic coding sequence
atgagccagcaggacgccgtggccgccctgagcgagcggctgctggtggccgcctacaaggggcagactgagaatgtggttcagttgattaataagggcgctcgggtggcagtcactaaacatggtagaactccactccatttagctgcgaataaggggcaccttcccgttgttcagatactcttgaaagccgggtgtgacctggatgtgcaagacgatggggaccaaacagccctgcacagggccacggtggtgggaaacacagagattattgccgcactgattcatgagggttgcgcccttgatcgtcaagacaaagctgggaacaccgcactgcacctcgcttgtcaaaacagccacagccagagcacgcgggtgctgttgttagcaggatcccgcgccgatctgaagaataatgccggtgacacatgtctgcacgtggccgcccgctacaatcacctgtctattattaggctgctcctcacagcattttgtagcgtccacgaaaaaaatcaggccggggacactgctcttcacgtggccgcggctttgaatcacaagaaagtcgccaaaatactgctggaggccggggcggatacaaccatcgtcaataatgtgcttagatttagccgaggacggtctctgcgaaaaaaaagagagcgccttaaggaagaacgccgggcccaatccgtccccagggatgaggtagcccagagcaagggctccgtgtcagctggtgataccccgagcagcgaacaggctgtggcaagaaaggaggaagcccgagaagaattcctcagcgccagccccgagccccgagcaaaggacgaccgtaggagaaaaagtcgacctaaagttagtgccttctctgatcctacaccgcctgctgaccagcagcccgggcaccagaagaacctgcacgcccacaaccaccccaaaaaaagaaaccgccacagatgttcctccccccctcctccccacgagtttagggcctatcagttgtatacactgtacagaggtaaagatgggaaagtgatgcaggcacctatcaacgggtgccgatgtgagccactcatcaataaactggaaaaccagctcgaggcaactgtggaggaaattaaggccgagctgggaagcgtgcaggacaagatgaacaccaagctgggccagatggaaaacaagacacagcaccaaatgagggtgctggacaaattgatggttgagcggttgtcagctgaacgtactgagtgtttgaaccgcttacagcagcactcagacactgaaaaacacgaaggagagaaaaggcagattagcctcgtggacgaactcaaaacgtggtgtatgctgaaaattcagaacctggaacagaagctgtctggcgattcgcgtgcttgccgagccaagtccacaccgtcaacctgcgtcgaccagctcgtggtcaccgctggtcctgccgccgcctccgacagcagtcctcccgtagttagacctaaagagaaggccctgaacagcaccgccactcaacgactgcaacaggaactctcatcttcagattgtacaggatcgaggctgaggaacgtgaaggttcagacagctctgctacccatgaatgaggctgcacggtccgatcagcaagccgggccctgcgtaaacagaggaacccaaacgaaaaagtcaggtaagagcgggcctacaagacaccgggcacagcagcctgctgcctcatctacatgcggtcaaccaccccccgccacaggcagcgaacagactggcccccacatacgggataccagtcaggccctggagctgacgcagtatttttttgaggctgtgtccacgcagatggaaaaatggtacgaaaggaaaattgaggaagcccgcagccaagctaatcaaaaggcgcaacaggataaagccaccctgaaagaacacatcaagtctttggaggaggagctggctaagctcagaacacgcgtccagaaggagaactag

SEQ ID NO: 179113 - DNA, 765 bp, Artificial Sequence
  Description of Artificial Sequence: Synthetic coding sequence
atgaacaagctgttcagcttctggaagcggaagaacgagacccggtcgcagggctataaccttcgagaaaaagacctgaaaaagttacacagagccgctagtgtgggtgatctgaaaaaacttaaggagtacttacagattaaaaaatacgacgtcaatatgcaggataagaagtaccgtactcccctgcacctagcctgtgctaacggccatacagacgtggtcctgttcctgatcgagcagcagtgtaagatcaacgtaagagactccgagaataagagtcccttgatcaaagccgttcaatgccagaatgaggactgcgctacaatcctcctgaattttggcgctgatcctgacctgcgggacattagatacaatacagtgctgcattatgccgtctgcggccaaagcctgagcctggtcgagaaactcctagagtatgaggccgacctggaggctaagaacaaggatggatatactccgctcctggtggctgtcataaacaataacccaaaaatggtgaaattcctattggagaaaggtgcggacgtgaacgcatcagacaactatcaaagaacagctctaatcctcgcagtgtcaggggaacctccgtgcctggtcaagctgcttctgcagcagggcgtagagctgtgctacgaaggcattgtcgatagccaattgcgaaatatgtttatatcaatggttcttctccaccggtacccccagttcactgcgtcccatggcaagaagaaacacgctaagtag

SEQ ID NO: 179114 - DNA, 825 bp, Artificial Sequence
  Description of Artificial Sequence: Synthetic coding sequence
atgaacaagctgttcagcttctggaagcggaagaacgagacccggagccagggttacaacctgcgggagaaagacctgaagaagctgcaccgggcagcttcagtaggcgatctgaaaaagcttaaagaatacctgcagattaagaaatatgacgttaacatgcaggataagaaatactctgtggtgcaatcatcaagatggctgctatcttatacgacacccctgaatgattttatacgcactcccctgcatctggcctgtgcaaacggtcacaccgatgtggtactctttcttattgaacaacagtgcaagattaatgtaagagactcagagaacaagtctcccctaattaaagctgttcagtgccagaatgaggattgtgcaacaatactcctgaacttcggagctgaccccgatctcagggacatccgatataataccgttctccattacgcagtttgcgggcagagtctttccctggttgagaagctgcttgagtatgaagccgatctggaggccaagaataaggatggttatacacctttgctggtcgccgtcataaacaacaatccaaaaatggtgaagtttctccttgaaaaaggggcagatgtgaacgcaagcgacaactatcagcgaaccgcattgatcctcgccgtctcaggagagcccccatgcctggtgaagttgctgcttcagcaaggagttgagctctgctacgagggcatcgtcgacagccagctgcgtaacatgttcattagtatggtactgcttcataggtaccctcaatttacagcatcccacggaaagaaaaagcatgctaagtag

SEQ ID NO: 179115 - DNA, 606 bp, Artificial Sequence
  Description of Artificial Sequence: Synthetic coding sequence
atgcaggacaagaagtaccggacccccctgcacctggcctgcgccaatggacacactgatgtcgtactctttcttatcgagcagcagtgtaagattaatgtgcgcgactccgaaaacaaatcccccctcattaaagcagtccagtgccaaaacgaagactgtgctactatcttgttgaactttggcgcagatccagatctgagagatattaggtacaacaccgtgcttcattatgccgtgtgtggtcagtccttatcgctcgtagagaagctacttgaatacgaggccgatctagaggccaaaaacaaagatgggtatacacctttactcgtcgcggtaatcaataacaaccccaaaatggttaagttcctcctcgaaaagggtgccgacgtgaacgctagcgataattaccagaggaccgccctgatcctagctgtgtctggagaacctccttgcctcgtgaaactcctgctacaacagggcgttgagctgtgctatgagggaattgtcgacagccagctgcggaacatgtttatctccatggtcctgctgcacagataccctcagttcacggctagtcatgggaagaaaaagcatgcgaagtag

SEQ ID NO: 179116 - DNA, 942 bp, Artificial Sequence
  Description of Artificial Sequence: Synthetic coding sequence
atggacaccagcaccaacctggacatcggcgcccagctgatcgtggaagagtgtccgagcacttacagtcttaccggcatgcccgatattaaaatcgagcatccacttgacccaaacagcgaggaaggtagtgctcaaggcgttgcgatgggcatgaaatttattctccctaaccgtttcgacatgaatgtctgctcacgtttcgttaagtcactaaatgaagaagattccaaaaatattcaggatcaggtgaactccgacctggaagtggcttcagtgctctttaaggcggaatgcaacattcacacctccccttcaccgggcattcaggtccggcacgtctacacacccagtactacgaaacacttctcccctatcaagcagagtacgaccctcaccaacaaacaccgggggaacgaagtgtctactactccactgctcgccaactcactgagcgtccaccagcttgcggctcagggtgagatgctctacctggctactagaattgagcaagagaacgtaatcaaccacacagatgaggaagggttcaccccattgatgtgggccgccgcccacggccagatcgcggtggtcgagtttcttctgcagaacggcgccgatccccagcttcttgggaaaggcagggaatcagccctgagtctcgcttgctccaagggctacacagatatagtgaaaatgcttctcgactgcggcgtcgacgttaacgagtacgactggaacggaggtactccactgttgtacgcagtacatggcaatcatgtgaaatgcgtgaagatgctgctggagagcggagctgacccgaccatcgagacagatagtggatataactcgatggatttagctgtggctttagggtatagaagcgtacagcaggttatagagagccatttgctgaaactgttacagaatatcaaggaatag

SEQ ID NO: 179117 - DNA, 1428 bp, Artificial Sequence
  Description of Artificial Sequence: Synthetic coding sequence
atggccgccagcgccctgcggggcctgcccgtggccggcggcggcgagtcatcagaatccgaggatgacggttgggaaatcggctatctggaccgcacttctcagaaactgaagcggcttcttccaatagaagagaaaaaggaaaaattcaagaaagcaatgaccatcggtgatgttagcttggttcaagagctactggatagtggcatcagcgtagattcaaatttccagtacggctggaccccacttatgtacgccgccagcgtggccaacgccgagctcgtccgagtgttactcgatcgtggggctaacgcatcgttcgagaaggacaagcagtccatccttatcacagcttgttcggctcacgggtccgaggaacagattttaaaatgtgttgagcttctgctcagtcgcaacgccgaccccaatgtcgcctgcaggagacttatgacaccgattatgtatgcggctagggatggacacacgcaggtggtcgctctcttggtggcgcatggggcggaggtgaacacccaggatgaaaacgggtacaccgcactgacctgggccgcacggcagggtcacaagaatattgtactgaagttgttggaactgggcgccaacaaaatgttgcaaaccaaagatggcaagatgccgtctgaaattgcaaaacgaaacaagcatcacgaaatttttaacctgctaagcttcactttaaacccactggaagggaagttacaacagttaaccaaagaggatactatatgcaagattctaaccaccgactcagacagagagaaggatcatatcttttcctcttacactgcgtttggcgaccttgaagtgtttctccatggcttaggcctggagcatatgacagatttgctaaaggagagggatatcacacttaggcatctactgactatgcgtgaagacgaatttacgaaaaatggcatcacatcaaaggaccagcagaaaatcctagcagccctgaaggagctacaagttgaagagattcaattcggtgagctgtcggaagagaccaaacttgagatttcaggcgatgagtttctcaacttcctgcttaaactaaacaagcagtgtggacatttgatcacagctgtgcagaatgttataacggaactccccgtgaatagtcagaaaatcaccctagagtgggcaagcccccagaactttaccagcgtctgcgaggaactggttaacaacgtggaggacctgtccgaaaaggtatgtaaactgaaagatttgatccaaaaactccaaaatgagcgagaaaatgaccctactcacattcagctcagggaagaagtgagcacttggaatagtcggattcttaaacgaacggccatcaccatctgtgggtttggttttctgttatttatatgtaaactgactttccaacgcaaatag

SEQ ID NO: 179118 - DNA, 1041 bp, Artificial Sequence
  Description of Artificial Sequence: Synthetic coding sequence
atggccatggtgagcgagttcctgaagcaggcctggttcatcgagaacgaggagcaagaatacgtgcaaactgtgaaatccagtaaaggtggcccggggagcgccgttagcccttaccctaccttcaatccaagcagtgacgttgcagcgctgcataaagcaataatggtgaagggggtggatgaggcaacgataattgacattctgactaagcgcaacaacgcccaacgtcagcaaataaaagcagcctatctgcaggagaccggcaaacctctcgatgaaacattaaagaaagctttaaccgggcaccttgaggaggtagttctggctctgctgaaaaccccggcccagtttgacgccgatgagctacgggcagccatgaaaggcctaggaaccgacgaagacaccttaattgagattctggcgtctcggacaaacaaagagatcagggatataaacagagtataccgggaggaactcaagagagacttagcaaaagatatcaccagcgataccagcggggatttcaggaacgctctattgagccttgctaagggggatcggtctgaagacttcggcgtcaacgaagatctcgcagattcagacgctagagccctctatgaagctggggagagacggaaaggcacagacgtgaacgtttttaacacaatcctgacaactcgcagttatccacaactgcgcagagtgtttcaaaagtatactaaatactcgaaacatgatatgaacaaggtcttggacctagagctgaagggagacattgagaagtgcttgaccgcaattgttaaatgtgctacaagcaagccagctttcttcgcagagaaattgcatcaagcaatgaaaggggtggggaccagacacaaggcattaattcgcattatggtgagccgctctgagatcgacatgaacgacatcaaggctttttaccagaagatgtacggaattagtctgtgccaggccattcttgacgagaccaaaggagattacgagaagatccttgtggccctgtgcggaggaaattag

SEQ ID NO: 179119 - DNA, 1041 bp, Artificial Sequence
  Description of Artificial Sequence: Synthetic coding sequence
atggccatggtgagcgagttcctgaagcaggcctggttcatcgagaatgaggaacaagaatatgtgcaaactgtgaagtcttccaagggaggacctgggtccgccgtttccccatatcccaccttcaatccaagttccgatgtagctgctctccataaagctatcatggtgaaaggggtggatgaggccacaatcattgacattctgaccaaacgcaataatgcccagcgacagcaaattaaagcagcctacctgcaggaaactggtaaaccattggacgaaaccctgaagaaggccctgactggccacctggaagaggtggttctcgcactgctgaagaccccagcccagttcgatgctgacgaacttagggcagccatgaaaggactggggaccgatgaggataccctcattgagattctcgctagccgcactaacaaggagatccgcgacattaaccgcgtgtacagggaggagctgaaacgtgatctcgctaaagatatcacatccgatacctctggtgacttccggaacgccctgctctctctcgcaaaaggtgataggtccgaggatttcggggtgaatgaggacctcgccgatagtgacgccagggccctgtacgaagcgggagaaagaagaaagggtactgacgtcaatgtgttcaataccatactgaccaccaggtcatatccccaattgaggcgggttttccagaaatatactaagtattctaagcacgatatgaacaaagtgttggacctcgaactcaaaggagacattgagaaatgtctgacagccatcgtcaagtgcgctacttctaaaccagcattcttcgctgaaaagcttcaccaggcgatgaagggagttggaactcggcacaaagcccttattcgtattatggtgtctcgttctgaaattgacatgaatgacatcaaagctttctatcaaaaaatgtacggtatcagcctgtgccaggcaatcctcgacgagacaaaaggcgattatgagaagattctcgtggctttgtgcgggggaaattag

SEQ ID NO: 179120 - DNA, 348 bp, Artificial Sequence
  Description of Artificial Sequence: Synthetic coding sequence
atggccatggtgagcgagttcctgaagcaggcctggttcatcgagaatgaggagcaggagtacgtgcagaccgtcaaatcaagcaagggcggccctggctcagccgtgtctccataccccacctttaatccatctagcgacgtagccgctctgcataaagctatcatggttaagggagtggacgaggcaactatcatcgacatcttgacaaagcgcaataatgcccaacggcagcagatcaaggccgcatacctccaggaaacaggaaagccgctggacgaaactctgaaaaaagccctaaccgggcacttggaagaagttgtactggccctcctgaagactccttag

SEQ ID NO: 179121 - DNA, 615 bp, Artificial Sequence
  Description of Artificial Sequence: Synthetic coding sequence
atgaacctgatcctgcggtacaccttcagcaagatggccatggtgtcagaatttttgaaacaagcctggttcatcgaaaacgaagagcaggaatatgtccaaacagtaaagagtagcaaaggaggcccagggtctgctgtcagcccgtatcccacctttaacccttcgagcgatgtcgccgccttgcataaggcaataatggtgaagggtgtcgacgaagccacgatcatagacatcctaacaaagcggaacaatgcccagcgacagcagattaaggccgcctacttgcaggagacggggaagcctctagatgagaccttaaaaaaggccctgactgggcatctggaggaggtggtgctggcattactgaagacgcccgcccagttcgatgccgatgaactgagggcagcaatgaaggggttgggaactgacgaagacacattgattgagatattggcgtcacggacaaacaaggaaattagagatattaacagggtgtaccgtgaagagctgaagagagacctggccaaggatatcacatccgacacgtctggagatttcaggaacgcactgctgtcccttgcgaagggggaccgctcggaagattttggatag

SEQ ID NO: 179122 - DNA, 975 bp, Artificial Sequence
  Description of Artificial Sequence: Synthetic coding sequence
atgttctgcggcgactacgtgcagggcaccatcttccccgcccccaattttaatcctattatggatgcccagatgctggggggggctcttcagggttttgactgcgacaaagacatgctcataaatattttgacacagaggtgcaatgcccaacggatgatgatcgccgaagcttaccagagtatgtatggcagggacctgataggagatatgagggaacagctctctgatcacttcaaggacgtaatggccggactgatgtatcctcccccactatacgacgcacacgagctgtggcatgccatgaaaggtgtgggtaccgacgagaattgcttaatcgagattctcgcgagccgaacgaatggcgaaatcttccagatgcgggaggcatattgtttgcagtattctaataacctgcaggaggatatatacagcgaaactagtggccacttcagagataccctgatgaatctcgtgcagggaactcgcgaggaaggttatacagaccccgctatggccgcgcaagacgctatggtgctctgggaagcttgccagcagaagacaggagaacacaagacaatgctccagatgattctctgcaataaatcatatcaacagctgaggctggtgttccaggagttccagaacataagcggccaagatatggtggacgcaatcaatgaatgttatgacggctacttccaggaactactggtggcaatagtcctgtgtgttagagacaagcccgcgtacttcgcctatcggctctattccgctatccatgacttcggcttccacaacaagactgtcatccggatactgatcgcgcgctccgagatcgacttactcactatcaggaagcgctataaggagcgctatggaaagagtctgttccacgacattaggaacttcgcctcaggacactacaagaaagccctgcttgccatatgcgctggtgacgcagaggactactag

SEQ ID NO: 179123 - DNA, 975 bp, Artificial Sequence
  Description of Artificial Sequence: Synthetic coding sequence
atgttctgcagcaacctggtgcagggcaccatcttccccgcccccaattttaatcctattatggatgcccagatgttgggaggcgcattgcaggggtttgactgtgataaggacatgctgattaatatccttactcagagatgtaatgcccagaggatgatgatcgccgaagcttaccagagcatgtatggccgggatttgatcggcgacatgcgggagcaattgagcgatcatttcaaggacgttatggccggcctcatgtatcccccaccactgtatgacgctcatgaactgtggcatgctatgaaaggggtggggaccgatgagaattgccttattgaaattctggcttccaggacaaacggggagatctttcagatgagggaagcctattgcctgcagtattccaacaacctgcaggaggatatctactctgaaacctccggacactttcgcgacaccttaatgaatcttgtacagggaaccagggaggaaggctacaccgacccagcgatggccgcccaagacgccatggtactgtgggaagcgtgccagcagaaaaccggtgaacataaaaccatgcttcagatgattctctgtaacaagagttatcagcagctccgactagtcttccaggaatttcagaacatctccggccaggatatggtggacgccatcaacgaatgttatgacggttacttccaggagctgctcgtcgccattgtcctctgtgtcagagataaacccgcgtactttgcctaccgactgtactctgccatccacgatttcgggtttcacaacaagactgtgatccgtattcttattgccaggagcgaaatcgatctcctgaccatcaggaaacggtacaaagaacgctacggtaagagcttgttccacgacattagaaatttcgcttccgggcactataagaaggctctactggcaatatgcgccggagatgccgaggactattag

SEQ ID NO: 179124 - DNA, 1518 bp, Artificial Sequence
  Description of Artificial Sequence: Synthetic coding sequence
atgagctaccccggctacccccccccccccggcggctacccccccgccgctcctggtgggggaccttggggtggcgcagcctaccctcctcctcccagcatgccaccaatcggcctggataatgtggccacctacgcgggccagtttaatcaggactatctctcaggcatggccgcaaatatgagtgggacatttggcggcgccaatatgcctaacctgtaccccggggctccaggcgctgggtatcctccggttcctcctggtggttttgggcagcctccatccgcgcagcagccagtgccaccatacgggatgtaccctcctcccgggggtaaccccccttcccgtatgccatcttatcctccatatcccggtgccccggtcccgggtcaaccaatgccccctcccggccagcagccccccggtgcatatcctggtcaaccgccagtgacctacccaggtcagcctcctgtgccactgcccggacagcagcagcctgtgcccagctaccctgggtaccccgggagcgggacagtgactcccgcagttcctcctacacagttcgggtcacgagggaccattacggacgcaccggggttcgaccccctgcgggatgcagaggttctgcgcaaggcaatgaaagggttcgggacggatgaacaagctataatagattgtctgggatcaagatctaataagcagcggcagcaaatccttcttagcttcaagaccgcgtacggcaaagacctcattaaggatctcaagtctgagttatccgggaatttcgagaagaccattctggctttgatgaagacgcccgtcctgtttgatatctacgaaattaaagaggcgatcaaaggggtcgggaccgatgaggcctgcctgattgaaatcctggcaagccggagtaacgagcacatacgggaactgaatagagcctacaaggctgaatttaaaaaaaccttagaggaggccatccggtctgatacgtcaggccactttcagaggttgcttatcagtctctcacagggaaatcgagacgagtcaacaaatgtagatatgagcctggcccagagagatgcccaagaactgtacgccgctggtgagaatagactgggtactgacgaatcaaaatttaatgcggtcctctgctcccgatcccgcgctcacctcgttgccgtgtttaatgagtaccagcgaatgacaggccgtgatatcgagaaatcgatttgccgggaaatgtctggcgaccttgaagaggggatgctggctgtggttaagtgtctgaaaaatacacccgcattcttcgcggagaggctcaacaaagccatgcgcggcgccggaacgaaagatcggactctgatcagaatcatggtgtccaggtctgaaacggacctcctggacattcgcagcgagtataagagaatgtacggcaaaagtctctaccatgacatctccggtgatacaagcggggattaccgaaagatactgttgaaaatctgtggtggcaacgattag

SEQ ID NO: 179125 - DNA, 1518 bp, Artificial Sequence
  Description of Artificial Sequence: Synthetic coding sequence
atgagctaccccggctacccccccccccccggcggctacccccccgctgctccgggaggggggccgtgggggggcgccgcatatcctcccccaccttccatgccacctatcggactcgacaatgtggccacatacgcaggtcagttcaatcaagattatttgagtggcatggccgcgaacatgagcgggaccttcggcggagccaacatgccgaatctctatcccggagccccaggggcaggctacccccccgtgccgccagggggatttggacagcccccatccgcgcaacagccagtgcccccatatgggatgtacccccctcccggcggcaaccctccaagtagaatgcctagttaccctccgtaccctggcgcacctgtacccgggcagcccatgccgccccctggccagcagcctccaggagcatatccagggcagccacccgtgacttaccctggtcagccccctgtgccactgcctggacagcaacagcctgttccctcatacccaggttatccaggaagcggcaccgtgaccccagcggtcccaccgacccaatttgggagcagaggtaccatcaccgacgctccagggttcgaccccctccgggacgcagaggttctgaggaaggccatgaagggatttgggacggacgaacaggccatcatcgattgtttgggatctcgctccaataaacagcgtcagcagatactactgtcctttaaaacggcgtatggcaaggacctgataaaggacctcaagagcgaattatctggaaattttgaaaagacgattctggctcttatgaagactccagttctcttcgatatctacgagataaaggaagccatcaagggtgtgggaacagatgaggcttgtcttatagagatactggcctctcggtctaatgaacatattagagaactgaacagggcctacaaagccgagtttaaaaaaactctggaggaggccattcgcagcgacacttctggccacttccagagactgttgattagcttaagccaaggaaaccgcgacgagagcacaaacgtggacatgtctctagctcagagagacgcgcaggagctgtacgccgccggtgagaatcgccttggaacagacgaaagcaagttcaatgccgtgctgtgtagccgcagccgagcccatctggtggctgtgtttaacgaataccaaagaatgaccggccgcgatatcgaaaagagtatctgccgagagatgtcaggtgacctagaagaaggtatgctggctgtagtcaagtgcttgaaaaacacccctgccttctttgctgaacggctgaacaaggctatgcgaggggcaggtacaaaggacaggaccctgatcaggatcatggtcagcagatccgaaacagatctcttggacattcgttcagagtataagcgcatgtacggtaagagtctgtaccatgatatctcaggcgacacttctggtgattaccgcaaaatccttctgaaaatctgcggaggcaacgattag

SEQ ID NO: 179126 - DNA, 489 bp, Artificial Sequence
  Description of Artificial Sequence: Synthetic coding sequence
atgagcctggcccagcgggacgcccaggagctgtacgccgccggcgagaacagactggggaccgacgaatcaaaatttaacgccgtgttgtgttcccgcagtagagcgcatctggtagctgtgttcaatgagtaccaacggatgaccggacgggacatagagaagtcgatatgccgggagatgtcaggagaccttgaagaaggcatgctggccgtggtcaaatgccttaagaatacacccgctttcttcgctgaaaggctgaacaaagccatgcgcggtgccgggaccaaagatcggacactgatcagaatcatggtttcccgttccgaaaccgatctgctggacatccgctcagagtacaaaaggatgtatgggaaaagcttatatcacgatatctcgtccattagttgcatgcctgcctcttatggtcatctcgaggaggccacttgcctcgctctcaaactcttgcgagtggaaggcaatgattag

SEQ ID NO: 179127 - DNA, 1518 bp, Artificial Sequence
  Description of Artificial Sequence: Synthetic coding sequence
atgagctaccccggctacccccccccccccggcggctacccccccgccgcacctggcggtggtccctggggaggcgccgcctatccacccccaccttctatgccccccatcgggctggataatgttgcgacgtatgcaggacagtttaatcaggattacctgagcggcatggccgctaatatgtcaggcacttttggcggggctaacatgccgaatctttaccctggagcacccggagcgggctatcctccagtccctcccggcggattcggtcagcccccttcggcccaacagcctgtgccaccatacggaatgtacccacctccaggcggtaatccaccttctcgcatgccgagctaccctccatatccaggcgcaccggtgccggggcagccgatgccaccgcccggtcaacaacctccaggcgcttacccaggccagccccccgtgacttaccccgggcagccacccgtgccacttcccggtcagcagcaaccagttccctcttaccccggatatcccggctcaggcaccgtgacccccgcagttcccccaacccaatttggatcaaggggtactataacggacgccccaggattcgatccactccgtgacgccgaggtgctgcgtaaggctatgaagggtttcggtactgatgaacaggctatcatagattgcctcgggtcacggagcaataagcagaggcaacagatactgctaagctttaaaactgcttacgggaaggatcttatcaaggacctgaagtctgaattgtcaggtaatttcgaaaagaccattttggccctgatgaagaccccagtcctctttgacatctacgaaataaaagaggccatcaaaggtgttggaaccgacgaagcctgtcttatcgaaatactggcgagccgaagcaacgaacatatcagggaattaaaccgggcctacaaggccgaattcaagaaaacattagaagaagccatcaggagcgatacctctggccacttccaacgcctgctcataagcctgagccagggaaaccgggacgaaagtacaaatgtggacatgtctctggcgcagcgcgacgcccaggagctctacgctgctggggagaaccgattaggcaccgacgagtccaaatttaatgccgtgctctgctccaggtctcgtgcacacctggttgccgtgttcaacgaataccagcgcatgactggcagagacatagaaaagagcatctgccgtgagatgtccggcgatttagaagagggcatgttggcagtagtgaaatgcctcaagaatacccctgcattttttgctgagaggttgaacaaagcaatgagaggagctggcactaaagatagaaccctcattagaatcatggtgtcacgatcagagaccgatctgctagatatcagaagtgagtataagcggatgtacggaaagagcctgtatcacgacattagcggcgatactagcggtgactacagaaaaatcttactcaagatctgcgggggtaacgactag

SEQ ID NO: 179128 - DNA, 1518 bp, Artificial Sequence
  Description of Artificial Sequence: Synthetic coding sequence
atgagctaccccggctacccccccccccccggcggctacccccccgctgcccccggtggcggcccttggggaggagccgcataccccccgcccccaagcatgccacctatcggcttggacaacgtcgccacctacgctggacagttcaaccaggactatttgtccggcatggcagccaacatgtctggcaccttcggaggggcaaacatgccaaatttgtatccaggcgctcctggcgctggttatcctccagttccaccaggaggatttggccaaccgccatcagctcagcaacccgtgcccccctatggtatgtaccccccaccgggcggaaatcctcccagtcgtatgccttcttatcctccctaccccggagctcccgtgcccggacagccaatgcctcccccaggacagcagccaccaggcgcttatcccggacaacccccagttacatacccaggacagccccctgtgcctctgccgggccagcaacagcctgtgccctcctacccaggctatcccgggtctggcacagtcacaccagccgtcccacccactcaattcggttctcgtggaactatcactgacgcacccggatttgaccctctgagggacgctgaagttctccgcaaagcaatgaaaggatttggcacagacgagcaggcaatcatcgattgtctcggatcacggtctaacaagcagagacaacagatattactgtcttttaagacagcttacggcaaggacctcatcaaggatctgaagtcagaactgtccggcaacttcgagaaaacaattctggccttaatgaagacgcccgtgctgtttgatatatatgagattaaggaggccataaaaggggtgggaacagacgaggcatgcctcattgaaattctggcctctcggtctaacgagcacataagggagctcaaccgagcatataaggctgagttcaagaagaccctggaggaggccattcggagcgacacgagcggccactttcagaggctcctgatctcactgtcccaggggaatagggacgagtcaaccaacgtggacatgagtctagctcagcgtgacgctcaggaactctatgcagccggcgaaaatcgtttgggaactgacgagagtaagttcaatgcggtgctctgttcccgcagccgagcccacctggtggccgtctttaacgagtaccagcgaatgacagggagggacattgaaaaaagcatatgcagagaaatgagcggcgacctggaggaagggatgctggccgtcgtgaagtgcctgaagaatactcccgctttcttcgcggagcggttaaataaagccatgcgtggtgctggcacgaaggatagaaccttgatacggattatggtatcccggtcagagaccgacctgcttgatattcgatccgagtataagagaatgtatgggaagagtctataccacgacatttctggcgatacgtccggggactataggaaaatcctgctgaaaatctgcgggggcaatgactag

SEQ ID NO: 179129 - DNA, 1518 bp, Artificial Sequence
  Description of Artificial Sequence: Synthetic coding sequence
atgagctaccccggctacccccccccccccggcggctacccccccgccgctccgggcggaggcccatggggaggtgcagcatacccacctcctccgagtatgcctccaattggcctggacaatgttgccacatacgcgggacagtttaatcaggactatcttagtggcatggctgccaatatgtcgggtaccttcggaggagcaaacatgccaaacctctatcctggcgcaccaggggccggatacccacctgtcccacccggcgggttcgggcagcccccatctgcccagcagcctgtgccaccatatggtatgtatcctccacccggggggaacccgcctagtcggatgcctagttatccgccctaccctggagcccctgtgcccggccagccaatgccaccaccgggccaacaaccacccggcgcataccccggacagcctccagtaacatatccaggccagccgccagtccccttacccggccagcagcagccagtcccaagttacccgggatacccggggagcggaaccgtgacccctgccgttcctcccacccagtttggctcaagagggactatcaccgatgccccaggtttcgatcctttaagagacgccgaagtgctcagaaaagctatgaagggatttggaaccgatgaacaagccattattgactgtcttggaagtcgcagtaacaaacagcggcagcagattttactgtcctttaagacagcctacggcaaggatctcattaaggatttaaagtcagagctgtccggaaatttcgagaaaacgattctggctctgatgaagactcccgttctgttcgacatttatgaaattaaagaagccatcaaaggtgtcggcacggacgaggcgtgcctcattgagattcttgctagcagatctaatgagcacattcgtgaactaaatagggcgtacaaggctgaatttaagaagaccctagaagaagcaattagatcagacaccagcggacatttccagcgtttgctcatcagtctgagccaaggcaatcgcgacgagtctacaaatgtggatatgagcctggcccaacgggacgcgcaggagttgtatgcagctggggagaatcgcctcgggacagatgaatctaagttcaacgccgtgctgtgcagtaggagccgcgctcacctggtggctgtgttcaatgagtatcagcggatgaccggcagggacatcgaaaaaagcatatgtagagagatgtctggagatctggaagaggggatgttggccgtggtgaaatgtctgaagaatacccctgccttctttgccgagcgcctgaacaaggcaatgaggggggctggtactaaggacaggaccctgataagaattatggtgagcagatcagagaccgatctcctggatatccgatcggaatacaaacgaatgtatgggaaaagcctgtaccacgacatctctggcgacactagcggcgactatcgaaaaattcttttgaaaatctgtggaggcaatgattag

SEQ ID NO: 179130 - DNA, 1239 bp, Artificial Sequence
  Description of Artificial Sequence: Synthetic coding sequence
atgcggggcagcagcacccggaccatcagccgggagtgctggcggctgtgggcagcgccattgtgccccgccgcgtgcagtagcttatgggacgtgtcaactcccaggcggaagccgacattgcaggacgcacttatttcagcaatcccatatccgggccagccacccgtgacataccccggccaacctcccgttccattacctggccagcagcagcctgttcccagttaccccggatatcctgggtccggcacggtaacccctgcagtgccaccgactcaatttggctcacgcggaactatcacggatgcacccggcttcgacccactgagggacgccgaggtgctgcgtaaggctatgaagggctttggtaccgatgaacaggccattatagattgccttggcagtcgctcgaataagcaacggcaacagatacttctgtcattcaagacagcatacgggaaggatttaataaaagacctgaaatcggaactgagcgggaatttcgaaaagacaattttagcccttatgaagaccccagtactgtttgacatttacgagattaaggaagccatcaagggggtagggacggatgaagcgtgcctcatcgagatcctggcctctcggtccaatgagcacatcagggaactgaatcgagcctacaaggccgaatttaagaagacccttgaggaggcaattagatctgatacttccggccattttcagagattgctgatctccctcagtcagggcaaccgcgatgagtccaccaatgtggacatgagcctggcccagcgggatgcgcaggaactttacgctgcaggcgaaaataggctggggaccgatgagtctaaattcaacgctgtactctgctcccgtagccgcgcccacttggtggccgtcttcaatgaataccagcggatgaccggcagagacattgaaaagtctatctgccgcgagatgtctggtgacctcgaagaaggtatgctggcagtcgtgaagtgtcttaagaacacgcccgccttcttcgcggagagattgaataaagctatgcgcggcgcgggcacaaaggatcggacactcataaggattatggtgagcagaagtgaaaccgacctgctggacatccgctctgagtacaagcggatgtatgggaagtctttgtaccacgatatcagcggggacacttctggtgattataggaagattctccttaagatctgtggcggtaatgactag

SEQ ID NO: 179131 - DNA, 453 bp, Artificial Sequence
  Description of Artificial Sequence: Synthetic coding sequence
atgagctaccccggctacccccccccccccggcggctacccccccgccgcaccgggagggggtccctggggaggtgctgcgtatcccccccccccaagcatgcctcctatcggtctggacaacgtggccacttatgcaggccagtttaaccaggactatctctctggcatggcagcaaacatgtctggcaccttcggaggagccaacatgccaaacctctatcccggcgcgcccggcgctgggtaccctccagtacctcccggaggcttcggacagcctccttccgcccagcagcccgtgcctccttacgggatgtaccccccaccagggggcaacccacctagcagaatgccaagctatccaccctaccccggtgctcctgtgccgggccagcctatgcccccacctggacagcaacctcctggggcgtaccctggacaacctcccgtctag

SEQ ID NO: 179132 - DNA, 1518 bp, Artificial Sequence
  Description of Artificial Sequence: Synthetic coding sequence
atgagctaccccggctacccccccccccccggcggctacccccccgccgcccccggggggggcccatggggaggtgctgcctacccacctccccccagtatgccccctattggattggataatgtcgccacctacgcagggcaattcaatcaggactacttgtctgggatggccgccaacatgtcagggaccttcggaggtgctaatatgccaaatctgtatccaggcgcccctggagctggatatcctcctgtgccacccggtggattcgggcagccacccagtgcacagcagccggtaccaccttacggcatgtacccaccacctgggggcaatcccccttcccgaatgccttcatacccaccctatcccggggcgcctgtcccaggccagcccatgccgccacccggccaacagcctcccggcgcctaccctggtcagccacccgttacctacccgggccagccacccgtgcccttgccaggccagcagcaacccgtgccttcatatccagggtatccagggagcgggacagtaactcctgccgtacctccgacccaatttggttcccgcggcactatcaccgacgctcccggctttgacccgttacgcgacgccgaggtgctgaggaaggccatgaaaggcttcgggacggacgagcaagctatcatcgactgccttggaagcaggtccaacaagcaaaggcaacagattctcctctcgttcaaaacagcctacggaaaagacctgataaaggatttaaaatctgagctttccggcaactttgaaaaaacaatcctggccctgatgaagaccccagtgctgttcgacatatacgagatcaaggaggctataaaaggggtcggcactgatgaagcctgtttaattgagatactggcatccaggtctaatgaacatatcagagaattaaatcgcgcgtataaggccgagtttaaaaaaaccttggaagaagccattcgatcagataccagtgggcatttccaaagattacttatctcactgtcacaggggaaccgcgacgagagcactaacgtagacatgtcattggcccagagggatgcccaggaattatatgctgccggcgaaaacagactggggactgacgagtccaaattcaacgccgtattgtgcagccgtagtcgagctcacttggtggcagtattcaatgaataccagagaatgacaggtcgggatattgaaaagtccatttgcagggagatgagcggcgacctggaggaagggatgctggccgtggtaaaatgtcttaagaatactccagcgtttttcgctgagcggctgaacaaagcaatgcgcggggctggcacgaaagatcggactctgattcgcatcatggtttcacgctctgagaccgaccttcttgacatcagatcggagtacaagagaatgtacggcaaatccctctaccatgacatctcaggggacacatccggggactatcgaaagatcctccttaagatctgcggaggaaatgactag

SEQ ID NO: 179133 - DNA, 615 bp, Artificial Sequence
  Description of Artificial Sequence: Synthetic coding sequence
atgagctaccccggctacccccccccccccggcggctacccccccgcagcccccggtggcggcccgtgggggggggccgcctatcctcctccaccaagtatgcctccgatcggcctcgacaacgtcgccacctatgcgggtcagtttaatcaagactacctgtctggcatggctgctaatatgagcggaacgttcggaggagccaacatgcctaacctatatccaggggcccctggggccggctaccccccagtacctcctggcgggttcgggcagccacctagcgcccagcaacccgtgccaccgtatggaatgtaccctccaccaggcggaaaccccccctctcggatgcctagttatcctccctatccaggtgcccccgtgcccggccagccgatgcctccccctgggcaacagccaccgggggcctatcccggacagccacccgttacctatccaggtcaacctcccgttcccttgcccggccagcagcagccagtgccctcgtatccaggttaccctggatcaggcacagtgactccggccgtcccgcccacgcagttcggaagtaggggcacaatcactgatgctcccggtttcgatccccttcggtag

SEQ ID NO: 179134 - DNA, 447 bp, Artificial Sequence
  Description of Artificial Sequence: Synthetic coding sequence
tgagagaaccggctgggcaccgacgagagcaagttcaacgccgtgttgtgcagcagatcgcgtgctcacctggtggcagtgtttaacgaataccagaggatgacaggaagggatatagagaaatcaatttgcagggaaatgagtggtgacctggaggaaggtatgctggctgtggttaaatgtttaaaaaatacccctgccttctttgctgaacggctcaacaaggctatgcggggcgcagggactaaagacaggactctgattcggatcatggtgtctagaagtgagactgaccttctggacatccggagcgagtataagaggatgtacggaaaatctctttaccatgatatatcaagcataagttgtatgccagcaagttacggacatttggaggaggctacttgcttggcattaaaacttttgcgtgtggagggtaatgactag

SEQ ID NO: 179135 - DNA, 1518 bp, Artificial Sequence
  Description of Artificial Sequence: Synthetic coding sequence
atgagctaccccggctacccccccccccccggcggctacccccccgcagctcctgggggcggcccttgggggggggccgcgtatcctcctccaccctctatgccccctattggcctcgacaacgtggctacatatgcaggtcagttcaatcaggactatctctctggcatggctgctaacatgagcgggacctttgggggagcaaacatgcccaatctgtaccctggggccccaggtgccgggtacccccccgtcccccccggcgggttcggccagccaccaagtgcccaacaacccgtccctccttacggaatgtatcctcctcctggtggaaacccaccgtctagaatgcccagttatccaccataccctggtgcccctgttccagggcagccaatgccccctccaggccagcaaccgcccggtgcttacccagggcaaccacctgtgacctacccagggcagccacccgttcctctccctgggcagcaacagcctgtgccctcttaccctggctatcctgggtctgggaccgtgacgcccgccgtacctccgactcagtttgggtctcgcggcactattaccgacgcccctggatttgatccattgcgggacgcagaggttctacggaaggcaatgaagggatttggcactgacgaacaggccatcatcgactgtttaggcagtagaagcaataagcagaggcagcagatcctgctgagtttcaaaaccgcctatgggaaggacctcatcaaagaccttaaatcagagctatccggaaattttgagaaaacaatactggctttaatgaaaaccccagtgcttttcgatatctatgaaataaaagaggccattaagggggtagggactgacgaggcttgccttatcgagatcttggctagtcgctccaacgaacacattcgggagttaaacagagcctacaaagctgagtttaagaaaactttggaggaggcgattaggagtgacacaagtggccacttccaaaggctccttatttccctgagtcaaggaaatagggatgagagcactaatgtggacatgagcctggcccaacgcgacgctcaggagctgtatgcagcaggcgaaaataggttaggcaccgacgaatccaaattcaacgcagtgctgtgcagtaggagtagggcccatctcgtagctgtgtttaacgaatatcaacggatgaccggccgggacatcgagaagtcgatttgcagagagatgtctggagacctggaagaagggatgttggccgtggtgaaatgtctgaaaaataccccagcattctttgcagagaggttgaataaggctatgcggggagcagggactaaggatcgtacactgataaggattatggtgtccagatctgagacagatttgctagatatcaggtctgagtacaagagaatgtatggaaagagcctgtatcatgacatctctggggacacctctggcgactatcgcaaaatcctgcttaagatctgtggtgggaatgattag

SEQ ID NO: 179136 - DNA, 1419 bp, Artificial Sequence
  Description of Artificial Sequence: Synthetic coding sequence
atgccccccatcggcctggacaacgtggccacctacgccggccagtttaatcaggattacctctcgggcatggccgccaatatgtccgggactttcggaggcgcgaatatgccaaatctctatccaggggcacccggggccggatatccccccgtccccccaggaggatttgggcagcccccaagtgcccagcagcccgtgcctccctacgggatgtacccccctcccggcggtaaccctccttcaagaatgccttcttatcccccttaccctggcgctcccgtgccgggccagcccatgcctccccccggacagcaaccgccaggtgcttacccagggcagcctccagtgacctatcctggacagccaccagtgcctctacctggccagcaacagcccgtaccgtcttatcccgggtaccccgggagcggaacagttactcctgctgtgcctcccactcagttcggctcgcgagggaccattactgacgccccaggctttgaccccctgagagacgccgaggtgcttaggaaggccatgaaggggttcggaactgatgagcaggccattattgactgtttgggctcacggtctaataagcagcggcagcagatccttctctcttttaaaacagcctacggcaaggaccttatcaaagacttaaaatccgagttaagtgggaatttcgaaaagacgatcctagcactgatgaaaacaccggtgttgtttgacatttacgaaatcaaagaagctatcaaaggcgtaggaaccgacgaagcctgcttgatcgagatcttggccagcagaagtaatgaacatatcagggagcttaacagagcctacaaagcggaattcaaaaaaacactggaagaagcaattaggtcggacacatcaggtcacttccaacgactgttaataagcctgagtcagggcaatcgagacgaatccacaaacgtcgacatgtccctggctcagagagacgcacaagagctgtacgccgccggcgagaatcggttgggcaccgatgagagcaagttcaacgccgtcctgtgttccagaagccgcgcgcatctggtcgctgtgttcaacgaatatcagcgcatgactggccgggacatagagaagtctatttgtagggaaatgtccggcgatctagaagagggcatgctggccgtagtgaagtgcttgaagaacacacccgccttctttgcggagagactcaacaaagccatgcggggcgccggaactaaggaccgaaccctcattcggatcatggtcagcaggagcgaaaccgaccttctcgacattcggtccgagtacaagagaatgtacggtaagagcctgtaccacgatatcagcggcgatacttccggtgactacagaaaaattctgcttaaaatctgtggaggaaatgattag

SEQ ID NO: 179137 - DNA, 1074 bp, Artificial Sequence
  Description of Artificial Sequence: Synthetic coding sequence
atgggccggcagctggccggctgcggcgacgccggcaagaaggcctcattcaaaatgtccaccgtgcatgagatcctgtgtaagctgtctctagaaggggatcactctactccaccctctgcctatggaagtgtgaaggcctacacaaatttcgacgccgaacgagacgccctcaatattgaaaccgcgattaagactaaaggggtagacgaagtgacaatagtcaacatcctgactaataggtcaaacgcccagcgtcaggacattgcctttgcctaccagaggcggactaagaaggagctcgcctctgccctgaagtccgctctgtcaggacacttggaaactgtcattctgggactgttgaagacgcctgctcagtacgatgctagcgagctgaaagcgagtatgaaaggcttggggactgacgaagacagcctaattgaaataatctgctcaaggactaatcaggagctgcaggaaataaaccgtgtgtataaagaaatgtacaaaacagatcttgaaaaggacataatctcagacacctcaggcgacttccgtaagctgatggtcgcgctggccaaaggaaggagagccgaagacggaagtgtgatcgactatgaattgatcgaccaggacgctagggatctctacgacgcaggcgtcaaacggaaggggaccgatgttcctaaatggatatccatcatgactgagcgatccgtgcctcacttgcagaaagttttcgatcgctataagagctattctccctacgacatgctcgagtcaataaggaaagaggtcaagggcgacctggaaaatgcgttcctgaacctggttcagtgtatccaaaataagccactgtattttgctgatcggttgtacgactccatgaagggaaaggggacccgtgacaaggtcctaatcagaatcatggtctcacggtccgaagtagacatgttaaaaatcaggtcagaattcaagaggaagtatggtaagtccctctactactatattcagcaggacaccaagggggattatcagaaagcactcctgtatttatgcggcggtgacgattag

SEQ ID NO: 179138 - DNA, 1020 bp, Artificial Sequence
  Description of Artificial Sequence: Synthetic coding sequence
atgagcaccgtgcacgagatcctgtgcaagctgagcctggagggcgatcactcaacccccccaagtgcatatggatcagtcaaagcctatacaaatttcgatgctgagcgggatgccctaaacattgagactgccattaagacaaagggggtggacgaggtgaccatagtgaacatactgacaaatcggtccaatgcccagcgccaagatatcgcctttgcctatcagcgtaggactaagaaggagctcgcttctgcactgaaatcagcactgtctggacatctggaaaccgtcatcctcgggctgctgaaaacacccgcacagtatgatgcttctgaactaaaggcttccatgaagggcttgggcactgatgaagactcactgattgagatcatttgtagcaggacaaatcaggagctccaggagattaacagggtttacaaggagatgtacaaaaccgatctggaaaaggacattatctcagacacatccggagatttcagaaagctcatggtggcgttggctaaggggaggagggccgaggacgggagcgtgattgactacgaattaatcgaccaagatgcacgcgatttgtatgatgccggcgttaaacggaagggcaccgatgtgccaaagtggattagcatcatgaccgagagaagcgtcccccacctccagaaggtgttcgaccgctataagagctactctccatatgatatgttggaatcaattcggaaagaagtgaagggagacctggaaaatgccttcttgaacctggttcagtgtattcagaacaaacccctgtacttcgccgatagactatatgactccatgaagggcaaaggcacaagagataaagtgttgatcagaattatggtgtcgagaagcgaggtggatatgttgaagatacggtcggagttcaagaggaagtacggcaagtctctgtattattatatccaacaggacacaaaaggagattatcaaaaggccttgctgtacttgtgtggtggcgacgattag

SEQ ID NO: 179139 - DNA, 1020 bp, Artificial Sequence
  Description of Artificial Sequence: Synthetic coding sequence
atgagcaccgtgcacgagatcctgtgcaagctgagcctggagggcgaccactcaacaccaccttccgcttacgggagcgttaaagcatatactaatttcgatgccgaaagagatgcactcaatattgagaccgcaattaagactaagggagtggacgaagtaacaatcgtgaacatcctgaccaaccgcagcaatgctcaacggcaagatattgcctttgcctatcaacggcggacaaagaaggaactggccagcgcactaaagtctgcactgagtggtcatctggaaactgtgatacttggattgctgaagaccccagcccagtacgatgctagcgaactgaaagccagtatgaaggggttgggaaccgacgaagactcactcatcgagattatttgctcacgcaccaaccaagaactgcaggagatcaaccgcgtctataaggagatgtacaagaccgacttggagaaagacattatttccgatacaagcggagactttagaaagcttatggtggcactggccaaaggacggagagcggaagatggcagcgtcatagactatgagcttattgatcaggatgctagagacctctacgatgcgggcgtgaaacggaaaggaactgatgtgccgaagtggatcagcatcatgaccgagaggtcagtgccccacttacagaaagttttcgataggtataaatcatactcaccctacgacatgctggaaagcataagaaaggaagtaaagggtgacttggagaacgcttttttgaacctagtgcagtgtatccaaaacaaacccctgtacttcgccgaccgcctgtacgactctatgaagggcaaagggacaagggacaaagtgctgatcaggatcatggtttcacgaagcgaagtcgatatgctcaagatccgcagcgaatttaagaggaaatatggaaagagcttgtattactacatacagcaggacaccaagggcgactatcagaaggccttactgtatctgtgtggaggcgatgattag

SEQ ID NO: 179140 - DNA, 1020 bp, Artificial Sequence
  Description of Artificial Sequence: Synthetic coding sequence
atgagcaccgtgcacgagatcctgtgcaagctgagcctggagggcgatcattctacgccaccctcagcctacggatccgttaaggcctacaccaactttgacgccgagcgcgatgccctgaacatcgagaccgctattaaaacaaaaggtgtcgacgaagtgacgattgtcaatattctaacaaatcggagcaacgcacagagacaggatattgcatttgcctaccagagacgaaccaaaaaggaactggctagcgccttgaaatcagcgctctctggccacctggagacagtcattctcggtcttctcaagacccccgcacaatacgatgcatccgagctaaaggcctccatgaaaggattagggactgacgaagattccctgatcgagatcatctgttcacgaacaaaccaggaacttcaagaaatcaatcgtgtctataaagaaatgtacaaaaccgacttggagaaggacattattagtgacacaagtggagatttcagaaagcttatggtggccttagcaaaaggtaggcgggccgaggacggcagcgtgatcgattatgagctgatcgatcaagacgctagggacttgtatgacgcgggggtgaagagaaaaggaaccgatgtgcccaaatggatctccatcatgaccgagcgcagtgtgcctcatcttcaaaaagtgtttgaccgctataaatcctacagtccttatgacatgctggagtctatcagaaaggaagtgaagggcgatttagaaaatgcctttctgaacctcgtgcagtgcatccaaaataagccactgtattttgctgaccggctgtacgactccatgaagggcaagggcactagggataaggtccttatcagaatcatggtgagtcgcagtgaagttgacatgttgaaaatcagatccgagttcaagagaaagtacggaaaaagcctttactactacatccaacaggacactaagggcgactaccagaaggccctgctgtatctgtgtgggggagacgactag

SEQ ID NO: 179141 - DNA, 246 bp, Artificial Sequence
  Description of Artificial Sequence: Synthetic coding sequence
atgagcaccgtgcacgagatcctgtgcaagctgagcctggagggcgatcacagtactccaccttccgcatatgggagcgtaaaggcatacactaacttcgacgcagagagagatgctttaaacatcgaaaccgcaattaagaccaagggcgtcgacgaggtgactatcgtaaatatcctgactaaccgatccaatgcacagcgccaagatatagcattcgcatatcaacgaagaacaaaaaagtag

SEQ ID NO: 179142 - DNA, 531 bp, Artificial Sequence
  Description of Artificial Sequence: Synthetic coding sequence
atgagcaccgtgcacgagatcctgtgcaagctgagcctggagggcgaccactcgactccaccttccgcctacggcagcgttaaagcatacactaactttgacgcagaaagagacgccttgaatatagagactgccatcaagaccaagggagttgacgaggtgactattgtgaacattctgacaaaccgaagtaacgcacagcgccaggatatcgcttttgcctaccagcggcgcacgaagaaggaactggcatctgccctaaagagtgcattgtctggacatctagaaacagtcatcttaggcctgcttaagacgcccgcccagtacgacgcttctgagcttaaggcctcaatgaaaggcttggggactgacgaggattccctgatagaaatcatttgcagtagaacgaatcaggaactgcaggaaatcaatcgggtctataaagagatgtacaagacggacctggaaaaggatatcataagcgacacgtcaggtgatttccggaagttgatggtggccctcgctaagtag

SEQ ID NO: 179143 - DNA, 144 bp, Artificial Sequence
  Description of Artificial Sequence: Synthetic coding sequence
atgagcaccgtgcacgagatcctgtgcaagctgagcctggagggcgaccatagtacacccccatctgcttacgggagcgtcaaggcctataccaacttcgacgccgagcgggatgcattgaacatcgaaaccgccattaaatag

SEQ ID NO: 179144 - DNA, 405 bp, Artificial Sequence
  Description of Artificial Sequence: Synthetic coding sequence
atgagcaccgtgcacgagatcctgtgcaagctgagcctggagggcgatcattccaccccacccagtgcatatgggagcgtgaaggcctatactaactttgatgcagagcgagacgctctaaatatagaaaccgctattaagaccaagggagtggatgaagtgacaattgttaatatcttgacaaaccgttctaatgctcagaggcaggacatagcgtttgcataccagagacgaactaaaaaggaactggctagtgcgctgaagtccgccctgagtggtcatctggagacggtgatcctgggccttttgaagactcccgctcagtatgacgcctcggagctgaaagctagcatgaaggggctcggaaccgatgaagattcactcattgaaattatctgctcctag

SEQ ID NO: 179145 - DNA, 402 bp, Artificial Sequence
  Description of Artificial Sequence: Synthetic coding sequence
atgagcaccgtgcacgagatcctgtgcaagctgagcctggagggcgatcactctaccccccctagcgcctacggcagtgtaaaggcttacaccaactttgacgctgaacgggatgccctgaacatcgagactgcaattaagacaaagggagttgatgaagtgacaatcgtgaacatcctcaccaataggagtaacgcccagagacaagacatagcgtttgcatatcagcgaaggaccaagaaggaactggcatccgcacttaagagcgccttatccgggcatttggaaaccgttatattaggacttcttaaaacgccggcacagtatgacgctagcgaattgaaggcctcaatgaagggactgggcactgacgaagatagcctgattgaaattatttgttag

SEQ ID NO: 179146 - DNA, 450 bp, Artificial Sequence
  Description of Artificial Sequence: Synthetic coding sequence
atgagcaccgtgcacgagatcctgtgcaagctgagcctggagggcgatcacagtacacccccaagcgcctacggtagcgttaaagcgtacactaattttgacgccgaaagagacgcgttaaacatagagaccgcaatcaagaccaaaggcgttgacgaggtgacaatagtgaatattctgaccaatcgttctaatgcgcagcgacaggacatcgctttcgcttaccagcgtcggaccaagaaagagctggcgtccgctctcaagagtgccttatcaggacatctagagacagtcattctcgggctgctcaagactccagcgcaatatgacgcaagtgagctgaaggcttccatgaaagggctgggcaccgacgaggatagtctcatcgaaattatctgctcccgaactaatcaggagcttcaagagataaacagagtgtataaggaatag

SEQ ID NO: 179147 - DNA, 198 bp, Artificial Sequence
  Description of Artificial Sequence: Synthetic coding sequence
atgagcaccgtgcacgagatcctgtgcaagctgagcctggagggcgatcattctacccctcccagtgcgtacggcagcgttaaagcctacaccaattttgatgccgaaagagacgctcttaatattgagactgccattaaaacaaagggagtggatgaagttaccatcgtaaacattctgacaaatcggtccaactag

SEQ ID NO: 179148 - DNA, 360 bp, Artificial Sequence
  Description of Artificial Sequence: Synthetic coding sequence
atgagcaccgtgcacgagatcctgtgcaagctgagcctggagggcgaccactctacgcctccatcggcctacggctcagtgaaagcttatacgaactttgatgcggagcgcgacgcgctcaatatcgagactgcaataaaaaccaaaggcgtggacgaagtgactattgttaatatcctgactaaccgcagcaatgcccagagacaggacatcgcatttgcctatcagcgcaggaccaagaaagagctcgcctctgcacttaagagcgccctttctgggcatttggagacagtgatcctggggcttttaaaaacccccgctcaatatgacgccagtgagctcaaggccagtatgaaatag

SEQ ID NO: 179149 - DNA, 771 bp, Artificial Sequence
  Description of Artificial Sequence: Synthetic coding sequence
atgagcaccgtgcacgagatcctgtgcaagctgagcctggagggcgaccactctaccccaccaagtgcgtacggttccgtaaaggcgtacacaaatttcgatgctgagagggatgctttgaacatcgaaaccgcgataaaaaccaaaggcgtcgatgaagtgacgatcgtaaatatactgacaaaccgttctaacgcacaacggcaggacatcgcctttgcttatcaaaggcgaacgaagaaagaactcgcctccgcattgaagagcgccctgtctggacacttggaaactgttatcctgggcctccttaagacccctgctcagtatgacgctagcgagttgaaggcttcgatgaaagggctggggactgacgaagacagcctcatcgagatcatatgcagtcgcaccaatcaggaacttcaggagatcaaccgcgtctacaaagagatgtacaaaactgacctggagaaagatatcatctcagatacaagtggtgatttccgcaagctgatggtggccctggccaaaggacgcagagctgaggatggcagtgtaatagattatgagctgattgaccaagatgctcgtgatttgtacgatgcgggcgtgaaacgtaagggaactgatgttccaaaatggatctctattatgacagagaggtctgtaccccacctgcaaaaggtgttcgatcgatacaagtcgtatagcccatatgacatgttggaaagtatacgcaaggaggtcaaaggagatttggagaatgcattttag

SEQ ID NO: 179150 - DNA, 360 bp, Artificial Sequence
  Description of Artificial Sequence: Synthetic coding sequence
atgagcaccgtgcacgagatcctgtgcaagctgagcctggagggcgatcactctacccctccaagcgcctatggcagtgtcaaagcgtacaccaacttcgacgctgaacgcgacgcactgaatatagagacagcaattaaaaccaagggtgtcgatgaagtcaccatcgtgaacatactgacaaatcgttccaacgcccagcgtcaagatatagcctttgcctatcagcgtaggactaagaaagagctggcctccgcactgaagtctgccttatcaggacatctggagactgtgatcctaggacttctcaaaacaccggcccagtacgatgccagcgagctgaaagctagtatgaagtag

SEQ ID NO: 179151 - DNA, 531 bp, Artificial Sequence
  Description of Artificial Sequence: Synthetic coding sequence
atgagcaccgtgcacgagatcctgtgcaagctgagcctggagggcgatcattctacaccaccttcggcctacggaagtgtgaaggcctacaccaacttcgacgctgaaagagatgctctgaatatcgaaaccgcaataaagactaagggagtggatgaggtgactatcgtgaacatcttaacgaatcgttccaatgcgcagcgacaggatattgcatttgcatatcagagaagaacgaagaaggaactggcttctgccctcaagagtgctctttcaggacatcttgaaaccgtcatcctgggtttgcttaagacacccgcccagtacgacgcgagcgagttaaaagcgtctatgaagggtctgggcactgatgaggacagcctgattgagatcatctgcagcaggactaaccaggagcttcaggaaattaatagggtgtacaaggagatgtataaaactgacctggaaaaagatattattagcgacacatctggggatttccgcaaactgatggttgccctggctaagtag

SEQ ID NO: 179152 - DNA, 684 bp, Artificial Sequence
  Description of Artificial Sequence: Synthetic coding sequence
atgagcaccgtgcacgagatcctgtgcaagctgagcctggagggcgaccactccacacctccctctgcttatggcagcgtaaaggcatacacaaacttcgatgccgaaagagatgccctcaatatcgagacagccattaaaaccaagggagtggacgaggtcaccatagttaacatccttacgaatcgctcaaacgcccagcgacaagacatcgcatttgcgtatcaacgcagaacaaagaaggagctggcctccgcccttaaatccgccctaagcggccatctggaaactgtgattcttggtcttctgaagacccccgctcagtatgacgcatccgaacttaaggccagcatgaaaggcctcggcacggatgaggactcactcattgagatcatatgcagtcggaccaatcaagagctacaggagatcaatcgggtttacaaagaaatgtataaaaccgatctggaaaaggatattatttctgatacctccggtgactttagaaagctcatggtggccttggcgaaaggccgcagagccgaagacggatctgtgattgactatgaactcatcgatcaggacgcacgagatctgtacgacgcgggggtgaaacggaaggggacagatgtacctaagtggatctccatcatgaccgagcggtctgtgccacatctgcagaagtag

SEQ ID NO: 179153 - DNA, 531 bp, Artificial Sequence
  Description of Artificial Sequence: Synthetic coding sequence
atgagcaccgtgcacgagatcctgtgcaagctgagcctggagggcgaccacagcacccccccatctgcctacgggagtgtcaaggcctataccaattttgacgctgaacgtgacgccttaaatatcgaaacagccataaagacaaagggagtggacgaagtgacgatagtgaatatcctgacgaacagatccaatgcccaaaggcaggacattgcattcgcgtaccagagacggaccaagaaagagctagcctcagccctgaagagcgcactttcagggcacctggagacagtgattctgggactgctgaagacacctgcccaatatgatgcatctgagttaaaagcatcaatgaaggggctcgggactgatgaggactccctgattgagatcatttgctccaggacaaatcaagagctgcaagagattaatcgggtgtataaagagatgtataagacggatctggagaaggacattatcagtgacacttccggcgatttccggaagcttatggtggcacttgccaagtag

SEQ ID NO: 179154 - DNA, 333 bp, Artificial Sequence
  Description of Artificial Sequence: Synthetic coding sequence
atgagcaccgtgcacgagatcctgtgcaagctgagcctggagggcgaccactctaccccgccaagcgcctacggcagcgtcaaggcatatactaatttcgatgccgagagagatgccctcaatatcgagaccgcgattaagaccaagggagtggatgaggttacgattgtgaatatcctgacgaatcggtcaaatgcccagcgccaggatattgccttcgcctatcagcggcggactaagaaggaattggcatcggccctgaagtcggctctgagcggacatctcgaaaccgtgatcttaggcttgctgaagacacctgctcagtacgattag

SEQ ID NO: 179155 - DNA, 972 bp, Artificial Sequence
  Description of Artificial Sequence: Synthetic coding sequence
atggccagcatctgggtgggccaccggggcaccgtgcgggactaccctgacttttcgcccagtgtcgatgccgaggcaattcagaaagcaatcagaggaattggcacagacgaaaaaatgctcatatcaatcctgacggagaggtctaacgcacagcgccagctgatcgtcaaggaatatcaagccgcatacggaaaagagctgaaggacgatttgaagggcgacctatcgggccacttcgaacacttaatggtggccctggtaaccccacccgcagtgttcgacgctaagcaactgaaaaagagcatgaagggcgccggcaccaacgaagacgccctcatcgagatcctgacgactaggacttcacgccagatgaaggacatctctcaggcctattatacagtgtacaagaagagcctgggggatgacatttcatcagagacatctggcgatttccggaaagccctcctgaccctggctgacggacgacgcgatgagagtctaaaggttgacgaacacctggctaagcaggacgctcaaatcctgtacaaagcaggggagaaccgctgggggaccgatgaggataagttcacagaaatattgtgtctaaggtcattccctcagcttaaactgacctttgacgaatatcgtaatatctcacagaaagacattgtggacagcatcaaaggagaactgtcagggcacttcgaggacctcctgttggccatcgtgaactgcgtaaggaacactccagctttcttggctgagaggttgcaccgtgccctgaaggggatcgggactgacgagttcaccctaaatcgcatcatggtctcccgctcggagattgatttgttggatattcgcacagaatttaaaaagcattatggctattcgctttattccgccatcaagtctgatacctccggcgactacgaaattactctcctcaaaatatgcggaggtgacgattag

SEQ ID NO: 179156 - DNA, 405 bp, Artificial Sequence
  Description of Artificial Sequence: Synthetic coding sequence
atggccagcatctgggtgggccaccggggcaccgtgcgggactacccagactttagcccctcagttgacgccgaggctatccagaaagcaatccgcggaatcggaaccgatgagaagatgttgatttccatactgacagaaagaagcaatgcccagaggcagctgatcgtcaaggaataccaggcagcctacggcaaggagctcaaggatgatctgaagggcgaccttagcggccactttgaacacctcatggtggctctcgtcaccccgcctgccgtgttcgacgcgaaacaattaaagaagtccatgaagggggcagggacgaacgaggacgccttaatagaaattttgaccacacgcacaagtcggcagatgaaagacatcagccaggcctattacacgtag

SEQ ID NO: 179157 - DNA, 315 bp, Artificial Sequence
  Description of Artificial Sequence: Synthetic coding sequence
atggccagcatctgggtgggccaccggggcaccgtgcgggactaccctgattttagtcccagcgtagacgcagaggctattcagaaggccatccgaggtattgggacggacgaaaagatgcttatttccattctgaccgaaaggagcaacgctcagagacaacttatcgtcaaagagtaccaggcagcgtacggtaaagaattgaaggacgatctcaagggcgacctgtcaggacacttcgagcacttgatggtggccctggtgaccccccctgcagtctttgacgccaagcagctcaagaagtccatgaaatag

SEQ ID NO: 179158 - DNA, 465 bp, Artificial Sequence
  Description of Artificial Sequence: Synthetic coding sequence
atggccagcatctgggtgggccaccggggcaccgtgcgggactacccggatttcagtcctagcgtggatgcagaagccatccaaaaggccattcgcgggatcggtactgacgagaagatgctgatttccatactgactgaacgtagcaatgcacagaggcagttaatagtgaaagaataccaagctgcgtatggaaaagagctgaaagacgatctgaaaggtgatctatccggccacttcgaacacctcatggtagctcttgttactccccccgccgtctttgatgctaaacagctcaaaaaatccatgaaaggtgccggcactaatgaagacgccctgatcgagattctgaccacaagaaccagtaggcagatgaaagatatcagtcaggcatattatacagtctacaagaaaagcctcggtgacgacatctcttccgagacttcaggcgacttccggaagtag

SEQ ID NO: 179159 - DNA, 966 bp, Artificial Sequence
  Description of Artificial Sequence: Synthetic coding sequence
atggccatggccaccaagggcggcaccgtgaaggccgccagcggctttaacgccatggaagatgctcagaccctccggaaagccatgaagggtctgggaaccgacgaggatgccataatctctgtgctggcataccgcaatacggcccagagacaggagatccggacagcgtacaaatccaccataggccgagacctgatagacgacctcaagtctgaattaagcgggaacttcgagcaggtgatcgtgggcatgatgacgcctactgtcctgtacgacgtgcaggagttaaggcgggccatgaagggagccgggactgatgagggatgcctgattgagatcctagcaagcaggaccccagaagagatcagaaggattagccagacctatcagcagcaatatggtcgctccctggaagatgacataaggagcgatacgtcttttatgttccagcgagtgttggtctcgctgagtgctggaggcagagacgaaggcaattatctggatgacgcactcgtgcggcaggatgctcaggacctttacgaggctggggaaaagaagtggggcaccgacgaggtgaagtttctgacagtcctgtgctctcggaaccgaaatcatctgctgcatgtgtttgatgagtacaagcgtatttcgcaaaaggatattgagcagtcgattaagtcagagacatccggctcatttgaggacgccctgctagctattgtcaagtgtatgcggaataaaagcgcgtactttgctgagaaactgtataagtcaatgaagggcctgggaactgacgataacacattaatccgtgtcatggtctcccgcgctgagattgatatgttagatatcagggctcactttaagcgcctttatgggaagtccttgtactctttcattaagggagacacctctggagactatcgaaaggttttactggttctgtgcggaggtgatgattag

SEQ ID NO: 179160 - DNA, 900 bp, Artificial Sequence
  Description of Artificial Sequence: Synthetic coding sequence
atggccatggccaccaagggcggcaccgtgaaggccgccagcggctttaacgccatggaagatgcccaaacacttcggaaagcaatgaaagggcttgggacagacgaagacgcgattatctctgtgctcgcataccgtaacactgcacaacggcaggaaattagaacagcctacaagtctacaattggccgggatctgattgacgacttgaagagtgagctgagtggaaacttcgagcaaggtgccggcactgatgagggttgcctaattgagatactggcgtctagaacgcccgaggaaattcgaaggatctctcagacatatcagcaacagtacggacgaagcctggaggacgacatccggtctgacacctcttttatgttccagagagtattggtcagcctgagcgccggcgggagagatgagggcaattacctggacgacgccctggttcgacaagatgcccaagacctctatgaggcgggtgaaaagaagtgggggactgacgaggtgaagtttctgacagtgctatgctcccggaacagaaatcacctactccacgttttcgacgagtataagaggatatcgcagaaagacatcgagcagtccatcaagagcgaaactagcgggtcttttgaagacgccctcttggctatcgtgaagtgcatgcgcaataaaagcgcatacttcgccgagaaactgtacaagtccatgaagggacttggcaccgatgacaatacactgatcagggtgatggtgagccgcgccgagatcgacatgctcgatatccgggcccactttaaacgtctgtacgggaaaagcctctattcttttattaagggcgatacaagtggtgattatcgcaaagtgctgttagttctctgcgggggtgacgactag

SEQ ID NO: 179161 - DNA, 714 bp, Artificial Sequence
  Description of Artificial Sequence: Synthetic coding sequence
atgatgacccccaccgtgctgtacgacgtgcaggagctgcggcgggcaatgaagggggcgggcaccgatgagggatgcctcatcgagattctggctagccgaactccagaggagatcagaaggatttctcagacataccaacagcagtacgggagatcactagaagacgatatcagatccgatacctcctttatgtttcagcgagttcttgtttctctgtcagctgggggtcgagatgaaggaaactacctcgatgacgctctagttagacaagacgcacaggacctctatgaggctggagagaagaaatggggcacggacgaggtgaagtttctgactgtactgtgttcacgcaacagaaatcatctgttgcacgtattcgacgaatacaagaggattagtcagaaagatatcgagcagagcataaaatctgagacgagtgggtcctttgaggatgccttactagccatagtcaaatgtatgaggaacaaatctgcatacttcgcggagaagttgtacaaatcaatgaaggggctggggaccgatgataatactctgattcgcgtcatggtctcccgggcggaaattgacatgcttgatatccgagctcattttaaaagactctacggaaaatctctctatagttttatcaaaggcgacacaagcggcgactatcggaaggtgctcctggtgctctgcggcggggatgattag

SEQ ID NO: 179162 - DNA, 963 bp, Artificial Sequence
  Description of Artificial Sequence: Synthetic coding sequence
atggcccaggtgctgcggggcaccgtgaccgacttccccggcttcgacgaacgcgctgacgcagaaacacttcggaaggccatgaagggtctgggaaccgatgaagagtccatcttaaccctgctcaccagtaggtccaacgcccagagacaagagatttcagcagccttcaagacgttgtttgggcgggacctgctcgacgacctcaaatccgagctcacggggaagttcgagaagcttattgttgctctgatgaagccttcaagactgtacgatgcctacgagctgaaacatgctctcaaaggggctggcacaaacgagaaagtactgacggaaatcatagccagcaggaccccagaagaactccgcgctattaagcaggtttacgaggaggaatatggcagttcacttgaagatgacgtggttggggacacatcagggtactatcagcggatgctggtggtgcttctgcaggccaacagggaccccgatgcgggcatcgacgaagcacaggtggagcaggacgcccaggcactatttcaggctggtgaactgaagtgggggactgacgaagaaaagttcattaccatcttcggaacccgctctgtaagtcacctccggaaagtgtttgataagtatatgacaatctcagggtttcaaatcgaggaaaccattgatcgtgagaccagtggaaacttggagcaactcttgctggctgtggtcaaatcaattagaagcatacctgcttatctggcagagacactgtactatgcaatgaagggcgcgggtacagatgatcacacactgattcgggtgatggtgtcccgatccgagatcgatctgttcaatattcggaaggagttcagaaaaaatttcgctacaagcttgtacagcatgatcaagggggacacttctggcgattacaagaaggccctcctgttactgtgtggtgaggatgattag

SEQ ID NO: 179163 - DNA, 2022 bp, Artificial Sequence
  Description of Artificial Sequence: Synthetic coding sequence
atggccaagcccgcccagggcgccaagtaccggggcagcatccacgacttccccgggttcgaccccaaccaggacgcggaggccctgtataccgctatgaaaggattcggcagcgataaggaggcaatcctggacataattacctcccggagtaatagacagcgccaggaggtgtgtcagagttataagagcctgtatggcaaagacctcatcgcagatttaaaatacgaactgaccggcaagtttgagagactgattgtgggactgatgaggccacctgcttactgtgatgccaaggagatcaaggacgctatttcaggaattggcactgacgagaagtgccttatcgagatcctcgcctcacgtacaaatgaacagatgcaccaactggtggcggcctataaggacgcttacgagcgggatcttgaggctgatataattggagacacctctggccattttcagaagatgctggtggtactgctgcaaggtaccagagaggaagatgacgttgtgtcagaagacctcgttcagcaagatgtgcaggatctctatgaggctggagaactcaagtggggcactgacgaagctcagttcatatatattcttggcaaccgctcgaaacagcacctgaggctcgtgttcgatgaatatttaaagacgacaggtaaacctatcgaagccagtattagaggagagctgtcgggggatttcgagaagttaatgcttgccgtggtcaagtgcatccggagtacaccagaatacttcgcagagaggctcttcaaggcaatgaagggactgggcacccgggataacacactgatccgcatcatggtaagcaggagcgaactagacatgctagatatccgagagatttttcgcaccaaatacgaaaagagcttgtatagtatgattaagaatgatacatctggagaatacaagaagaccctgctgaaactatcaggcggagatgacgatgccgctggccagttttttcccgaggcagcccaggtggcttaccaaatgtgggaactctccgctgtggctcgggtggagttaaaaggaaccgtcaggcctgccaacgacttcaaccctgatgccgatgcaaaggccctgaggaaggccatgaaagggctgggtactgatgaagataccataatcgacattatcactcatagatctaacgtgcagcggcagcagatccgccagacattcaaatcacattttggacgggacttaatgacggatttaaaaagtgaaatttccggggacctagcccggttgatacttgggctaatgatgccgccagcgcactatgacgccaagcagcttaagaaagctatggagggcgcgggcaccgacgaaaaggcccttattgaaatcctagccacccgaacgaatgccgagattagggccataaacgaggcctacaaggaggactatcacaagagcctcgaggatgccctgagtagtgatacgagcggacactttagacggatactgattagcttggctaccggtcatagagaagagggaggggaaaatctagatcaagcccgtgaggatgcgcaggtggccgcagagatacttgagattgctgatactccgagcggtgacaaaacctccttagaaactaggttcatgactatcttatgcaccaggtcgtatccacacctgaggcgtgtattccaggagttcattaaaatgacaaactatgacgtagagcacacgattaaaaaggagatgtctggggatgttagagatgcctttgtggcgatcgtgcagtccgtcaaaaacaaacctctgttcttcgccgacaagctgtacaaatccatgaagggagctgggactgacgagaagacactcacacgcattatggtgagcagaagcgaaattgacttgttgaatattcggagggagttcattgagaagtacgacaaatcactacatcaagccatagagggcgacacttcaggcgactttctcaaagcgctcctggccctgtgcggtggtgaggattag

SEQ ID NO: 179164 - DNA, 2004 bp, Artificial Sequence
  Description of Artificial Sequence: Synthetic coding sequence
atggccaagcccgcccagggcgccaagtaccggggcagcatccacgattttcccgggttcgaccctaaccaggatgctgaggctctgtatacagctatgaaaggattcggctcagacaaggaagctatactcgatatcataacatcgagaagtaatcgtcagcggcaggaggtttgccagtcttataaaagtctgtacgggaaggacttaatagctgatctcaaatacgaacttactggcaagttcgagcggctgattgttgggctgatgagacctccagcctattgcgacgcaaaagaaataaaggacgcaatatctggtatcggcaccgatgagaaatgcctgattgagattcttgctagtcgcactaacgaacaaatgcaccagctggtcgccgcctataaggatgcttatgagagggatctagaggccgacatcatcggtgacacctccggccacttccagaaaatgctggtagtgctcctgcagggaacacgtgaagaagacgacgtggttagcgaggatctggtccagcaggacgtccaggatctgtatgaagccggcgaactgaaatggggtaccgatgaggctcagtttatttatatcctgggcaacaggtcgaagcagcacctgaggttggtgttcgacgagtatctcaagactaccggcaaaccaattgaggccagcataaggggagagctctcaggcgactttgaaaaattgatgcttgctgttgtgaaatgtattcggtcaacccctgaatactttgcggaacgcctatttaaggctatgaaaggtctcgggacacgcgacaacacactaatcaggatcatggtatctcggtcagaactcgacatgctggatattcgcgagatttttcgaaccaaatacgagaaatctctctactctatgatcaaaaatgatacatccggtgagtataagaagacactacttaagctgagcgggggcgacgatgatgctgccgggcagttctttccagaggccgcacaagtcgcatatcaaatgtgggagctgagcgcagtggcccgagtggaactgaaggggactgtacgccctgcaaacgatttcaacccagacgctgacgcaaaggccctccgaaaggcaatgaaggggctcggtaccgatgaagacaccatcatcgacatcataactcatagaagcaatgtgcaacggcagcagatccgtcaaacgtttaagtctcacttcggccgtgatctgatgactgatctgaaatccgagatcagcggagatctggctaggctaatcttgggcctcatgatgcctcccgctcattacgatgccaagcagcttaaaaaggcaatggaaggagcgggaaccgacgagaaggcgctcatcgaaatactggccacgcgcaccaatgctgagatccgcgcgattaatgaggcctacaaggaggattatcacaagtctctggaggacgcactctcaagcgacacttctggccacttccgccgcatattgatttctctggcgacaggccatcgggaggaaggtggagaaaatttggaccaggcccgcgaggatgctcaggaaatagccgatacacccagtggggacaagactagcctggagacccgattcatgacgatcctctgcacccgatcttacccacacctcaggcgcgtattccaagaatttattaaaatgacgaattacgatgtggaacatacgattaagaaggaaatgtcaggagacgtgagggatgcctttgtggctatcgtgcagagtgtgaagaacaagcctctgtttttcgcagacaaattgtataaaagcatgaaaggcgcaggcaccgatgagaaaaccctcactcgtatcatggtctctcggagtgagatcgatttgcttaatatcaggagagaatttatcgagaaatatgataagtccctccatcaagccatcgaaggtgatacaagcggagatttcttgaaagccctgctagccctatgtggaggagaggattag

SEQ ID NO: 179165 - DNA, 333 bp, Artificial Sequence
  Description of Artificial Sequence: Synthetic coding sequence
atggccaagcccgcccagggcgccaagtaccggggcagcatccacgacttcccgggttttgatcccaaccaagatgccgaagctttatacacggctatgaagggcttcggctctgataaagaagccatcctcgatataatcacctccagaagcaaccggcagagacaggaggtgtgtcagtcatacaagtcgttgtacggaaaggatctaatagcagacctcaagtatgaactgactgggaagtttgagcgtttgatcgtaggcctgatgcgtcctccagcctactgtgacgcaaaggagatcaaagatgctatatccggtattggcacatag

SEQ ID NO: 179166 - DNA, 1926 bp, Artificial Sequence
  Description of Artificial Sequence: Synthetic coding sequence
atgaagggcttcggcagcgacaaggaggccatcctggacatcatcacatcccggagcaacaggcagagacaggaagtgtgtcaatcctacaagagtctctacggcaaagacctgatcgccgatctgaagtatgagctgaccggtaagttcgaacgactgattgtcggcttgatgaggcccccggcttactgtgatgccaaggaaatcaaggacgctatcagcggaatcggaaccgatgaaaagtgtctgatcgagatcctcgccagcagaactaatgagcagatgcatcagctggtcgccgcatacaaggacgcctacgaaagggacttagaggccgacattatcggagatactagtggtcattttcagaagatgctggttgttctgctgcaaggaacaagagaagaggacgacgtggtctcagaagaccttgtccagcaggacgtgcaggacttatatgaagccggtgagctgaagtggggaacggacgaagcccagttcatctatatcctcggaaacaggtccaaacagcatctgcggttggtcttcgacgaatatctgaaaacgacagggaaacccatcgaggcctcaatccggggagaattatctggggacttcgagaaacttatgctggcagtggtcaaatgtatcagatccactccggaatacttcgctgaacggctcttcaaggccatgaagggactcggcacccgagacaacactctgatacggatcatggttagccggtcagaacttgacatgctcgacattagggagatctttcgtaccaagtatgagaagagtctgtatagcatgatcaagaacgacacgagtggagagtataagaagacattgctaaaacttagcggcggggacgatgatgccgcaggacagtttttccccgaggccgcacaggtagcctatcaaatgtgggaactcagtgctgtcgcgcgcgtggagctgaaagggaccgtgcggcccgcaaatgatttcaatccagacgctgacgcaaaagcattgcgcaaagcgatgaagggcctaggaacagacgaggacaccatcatcgacatcattacacatcgttccaacgtccagagacagcagatccgccagacctttaaaagtcattttgggagggacctgatgacagaccttaaaagcgagattagcggggatctggcgcgactcattctcggccttatgatgccccccgcccactatgatgctaagcagctgaagaaagccatggagggtgcaggcactgacgaaaaagctctgatcgagatccttgccacccggactaacgctgagattcgggccatcaacgaagcctataaggaagactatcataaatccctggaagatgctctgagtagcgacacctcaggtcatttcagacgtattttgatttcactcgcaaccgggcaccgtgaagaagggggagagaatcttgaccaggccagggaagatgcacaggttgctgccgagatactcgagattgccgatacccccagcggagacaaaaccagcttagaaacacggtttatgaccatcttatgcacgaggagttatccgcatctgagacgggtgttccaggagttcattaaaatgactaattacgatgtggaacacactatcaaaaaggagatgtccggggatgttcgcgatgccttcgtggccattgtgcagtccgtgaaaaataagccactcttctttgctgataaactgtataagtccatgaaaggcgcaggaactgacgaaaaaactctgacacggattatggtaagtaggtccgagatcgacctattaaacataagaagggaattcatcgaaaaatatgacaaaagcctgcaccaggcaattgagggtgacacttctggagatttcctaaaggcgctgctggccttatgcggcggagaggattag

SEQ ID NO: 179167 - DNA, 1644 bp, Artificial Sequence
  Description of Artificial Sequence: Synthetic coding sequence
atgcaccagctggtggccgcctacaaggacgcctacgagcgggacctcgaagctgacatcatcggggatacttccggtcacttccagaaaatgcttgtcgtcctgctgcagggaacacgcgaagaggacgatgtcgtgtccgaggatttagttcagcaggacgtccaggacttgtacgaggctggggaactgaagtggggcaccgacgaggctcaatttatttatatcttaggaaaccggtccaagcagcacctgcgacttgttttcgatgaatacctgaagaccacagggaagccaatcgaggctagcattcgcggcgagctcagtggggactttgagaagctgatgttggctgtcgtcaagtgtattaggtccacccccgaatatttcgccgagcggttgtttaaggcgatgaaaggcttgggcactagggataatacactgattagaataatggttagtaggtcagaattagatatgctggatattcgagagattttccgcaccaaatacgagaagtcactgtattctatgatcaagaacgacacctccggagaatacaagaaaacactcctcaaactgtctggtggcgatgacgacgccgctggacagttttttccagaagccgctcaggtcgcctaccagatgtgggaactcagcgcagtggcccgggtggaattaaagggcactgtgcggccagctaatgatttcaacccagatgccgatgcgaaggccctgcggaaagccatgaagggattagggaccgacgaggataccatcattgacattatcacgcacagatccaatgtacagcgtcagcagatccgtcagactttcaagagccacttcggacgtgatctgatgaccgatctcaagtccgaaattagtggagaccttgcacggctcattctaggcttaatgatgcctccggctcattacgatgctaagcaactgaagaaagcgatggagggagccggcacagacgaaaaggccctcatcgagatactcgctacaagaactaatgcggaaattcgagccatcaacgaggcatataaggaagactaccacaaatcactggaagacgctctgagcagtgatacgagtggacacttccggagaatcctgatttcattggcgaccggccatcgcgaggaaggaggggaaaacctagatcaggcgcgggaagatgctcaggtagcagctgagattttggaaatcgctgacaccccaagcggcgataaaacatcactggagactcggttcatgacaattctgtgcacacgctcttacccacatttgaggcgagtgttccaggagtttatcaaaatgaccaattacgatgtggagcacactattaagaaggagatgagtggtgatgtccgcgacgcctttgtcgctatcgtgcaatccgtcaaaaacaagccgctattctttgccgataaactatataaaagtatgaaaggtgcgggtactgacgagaaaaccctaactcgcatcatggtgtccagatctgaaatcgatttgcttaatatcaggagggaatttatcgagaaatacgacaagtccctccatcaggcgattgagggggacacaagcggcgatttcctaaaggcattgcttgctctgtgcggtggtgaagactag

SEQ ID NO: 179168 - DNA, 1467 bp, Artificial Sequence
  Description of Artificial Sequence: Synthetic coding sequence
atgagctaccccggctacccccccaccggctacccccccttccccggctatccccccgcagggcaggagtcaagctttcccccctctggacagtatccttatccaagtgggtttcctcccatgggaggcggcgcatatcctcaggtaccatcctcagggtaccctggagccggaggctaccctgccccgggggggtaccctgcgcccggcggctatcctggggcaccacagcctggcggagctccatcatatcctggcgtcccgccaggacagggctttggagtaccaccgggaggcgccggcttttccggttacccacaaccgccttcgcaatcctacggaggtggtccagctcaggtacccttacctggtggcttcccgggcggccagatgccatcccagtacccaggaggacagcctacctacccatcccagataaacaccgactctttttcaagctatcccgtgttctctcctgtgagcctggactatagtagcgaaccagctaccgtaacacaggtcacacaggggacaatccgcccagctgctaactttgatgcaatcagagacgcggaaatcctgagaaaggctatgaaaggatttggcacagatgagcaggctattgtagacgttgtcgcaaaccggagtaacgatcagaggcaaaaaatcaaggccgccttcaaaacgagctacggtaaggatctaattaaagatctgaagtccgagctgtccggaaacatggaggagctcatccttgccctttttatgccacccacatactatgacgcctggtccctccgtaaggctatgcagggcgctggtacgcaggaacgcgtgttgatcgagatcttgtgcaccagaactaatcaagagattagagaaattgtgcggtgctatcagtctgagttcgggagggatctggagaaagacatccggtcagacactagcgggcattttgaacgactcctggtgagcatgtgccaggggaaccgagacgaaaaccaaagtattaatcatcagatggcacaggaggatgcacagcgtctgtaccaggccggggaaggacgcctgggcactgatgaaagttgttttaatatgatcctggctactcgatcttttccacagctaagggctacaatggaggcatacagcaggatggctaaccgtgacctcctttccagcgtgagtagggagtttagcgggtacgttgaaagcggcctgaagaccattctgcagtgcgctctgaacagacccgccttctttgccgaaaggttatactatgccatgaagggggcgggaacggatgacagcactcttgtacgtattgtggttacccgctctgaaatcgatcttgtgcagatcaagcagatgttcgcccagatgtatcagaagaccctaggcactatgattgctggcgacacttcaggcgattaccgacgacttctactcgccatcgtgggccaatag

SEQ ID NO: 179169 - DNA, 1401 bp, Artificial Sequence
  Description of Artificial Sequence: Synthetic coding sequence
atgagctaccccggctacccccccaccggctacccccccttccccggatacccacccgccgggcaggagtcctcattccctccctccgggcagtatccatacccctcaggatttcctcctatgggagggggcgcttacccgcaggtgcccagttccggttaccctggtgcagggggatatcctgccccaggcggttatcctgcacctggaggatatccgggggctccccagcccggcggcgctccgtcctaccccggtgtgccccccgggcaggggttcggagtgcccccagggggtgccggttttagcggatatccacagccaccaagtcagagctatggaggcggacccgcccaagttcccctgcccggcggtttcccgggaggtcagatgcctagccaatatccagggggccagcctacgtatcccagccagcccgctaccgttactcaggtcacacagggcactataagacccgcagccaattttgacgccatccgcgatgcagaaatcctcagaaaagcaatgaaaggatttggcacggatgaacaggctatagtagacgtagtagctaataggagtaatgaccagaggcagaagatcaaagcagcattcaaaacttcctatgggaaagatctcatcaaagatctcaagagcgaattgtctggcaatatggaagagcttattctggctttgttcatgcctcctacttattacgacgcgtggtccttgcggaaagcaatgcaaggagcaggtacgcaagaacgcgtgctgattgaaattctttgcacacgcaccaaccaggagatccgcgaaattgtgcgatgctaccagtccgaattcggccgagatttagagaaagacatcagatccgacacaagcgggcattttgagcgccttctggtatctatgtgtcaaggaaaccgcgacgagaatcagtcgataaatcaccaaatggcccaggaggacgcacagagattgtaccaggcaggtgaaggacgactggggacagatgaatcttgtttcaacatgatcctggctaccaggtccttcccccaactaagggccactatggaagcttattcccggatggcaaatagagacctcctgtcatcggtgtcgcgcgagttctccggatacgttgaatctggactgaaaaccatactgcagtgcgcacttaaccgacccgccttcttcgcagagcgcctgtactatgccatgaagggtgccggcactgatgatagtaccctggtgaggatcgtcgtgacacgaagcgagattgacctcgttcaaatcaaacagatgtttgcccagatgtaccagaagaccttggggacgatgattgctggtgacacctccggagactaccggaggctcctactggctatcgtaggccagtag

SEQ ID NO: 179170 - DNA, 435 bp, Artificial Sequence
  Description of Artificial Sequence: Synthetic coding sequence
atgagctaccccggctacccccccaccggctacccccccttccccggctatcctccagccggacaagaatcgtcgtttccaccatccgggcagtatccataccccagtggctttcccccaatgggtggcggcgcatatccccaagtaccctctagtggctacccgggggccggcggctatcccgcccctggcggctacccggcccctgggggctaccctggcgccccccaacccggaggcgctccctcctatccgggcgtgccaccaggccagggctttggcgtgcctcccggcggggccggcttctcaggttatccacagcctccaagccagagctacggtggtggacctgcacaggtccctctcccaggaggatttcccggagggcagatgcctagccaataccctggtgggcagcctacctaccccagttag

SEQ ID NO: 179171 - DNA, 1011 bp, Artificial Sequence
  Description of Artificial Sequence: Synthetic coding sequence
atgcccagccagtaccccggcggccagcccacctaccccagccagccagctacagtcacccaggtgacacaggggacaattcggccagcagcaaacttcgacgccattcgtgacgccgagattttgagaaaagccatgaaaggctttgggactgatgagcaagcaattgtcgatgtcgtagcaaaccgcagcaatgatcagagacagaagataaaggcagcattcaagaccagttacggaaaggacctgatcaaagacttgaaatccgaactgagcggcaatatggaggagctcatcctggccttgtttatgcccccaacgtattacgacgcttggtccctacggaaggccatgcaaggggctgggacgcaagagagggttttgatagaaatcctgtgcacccgaacaaaccaagagattcgagaaatagtgagatgttatcagtctgaattcggcagggacctggagaaggatatccggtccgacacaagtgggcactttgaacgactgttagtaagcatgtgccagggaaaccgagatgagaatcagagtattaatcaccagatggcccaggaggacgcccagaggctctaccaggccggggagggtaggctgggcaccgatgaaagctgtttcaacatgatcctcgcgacacggtcatttccgcagttgcgagcaactatggaggcttatagccgcatggcaaatcgagacctgctgtcttctgtatcacgggagttcagcggctatgtggagagcgggctgaaaaccattctgcagtgtgcgcttaaccgtcccgcattcttcgccgagcgcctgtactacgctatgaagggtgccggcacagacgatagcacactggtacgcattgtggtcacgcggagcgaaattgacctggtacagattaagcagatgtttgctcaaatgtaccagaaaacactgggaacaatgattgcaggagatacaagtggtgattaccggcggctcctcctagcaattgttgggcagtag

SEQ ID NO: 179172 - DNA, 984 bp, Artificial Sequence
  Description of Artificial Sequence: Synthetic coding sequence
atggcctggtggaagagctggatcgagcaggagggcgtgaccgtgaagagctccagccatttcaatccagacccagatgccgagacactctacaaggccatgaaaggtatcgggacaaatgagcaggcgatcattgacgtactgacaaagcggtcaaatactcaaagacagcaaatcgcaaagtcctttaaggcccaatttggcaaagatctgactgagacactcaaatccgagctcagcgggaagttcgagcgtctcatcgtcgcactcatgtaccccccctaccgctatgaggcaaaggagctccatgacgccatgaagggactgggcaccaaggaaggggtgatcatcgaaatactggctagccggaccaaaaaccagctaagagaaatcatgaaggcgtatgaggaagactatggcagttccctggaagaagatatacaggccgacacctcagggtacctggaacggattctggtctgtctactgcaaggcagtcgagacgacgtgtcatcgtttgtagatcccggcctcgccctccaggacgctcaggacctctatgcagcgggtgagaagattcgtggaaccgatgagatgaagtttataactatcctgtgtaccaggagtgcaacacatctgctacgcgtcttcgaagaatacgaaaaaatagcaaataaatccatagaagatagtatcaaaagcgagacgcacggcagcctcgaggaagctatgctgaccgtcgtgaagtgcactcaaaacctgcatagctattttgcggagagactctactatgccatgaaaggggcgggtacaagagacggaaccctcattcggaacatcgtgtcaaggtctgagatcgacctgaacctcattaaatgtcactttaagaagatgtatgggaaaacattgtcctctatgataatggaagacacgtcaggggattacaagaacgcattactctcccttgttggttccgacccctag

SEQ ID NO: 179173 - DNA, 831 bp, Artificial Sequence
  Description of Artificial Sequence: Synthetic coding sequence
atggcctggtggaagagctggatcgagcaggagggcgtgaccgtgaagagcagctcgcacttcaaccccgaccctgacgccgaaaccctttacaaagctatgaaagggataggagtgggcagtcagttgcttagtcatcaggcagccgcctttgcgttccccagctctgccctgacatccgtatctccatgggggcagcaggggcatctgtgctgtaatcctgccggcactaacgagcaggcaattattgacgttctgactaagcggtctaatacacagagacagcagattgcgaaatctttcaaagcacagtttggaaaggacttgaccgagaccctgaagtccgaactaagcggcaaattcgaaaggctcattgttgcactaatgtaccctccataccgatacgaggcgaaagagctgcatgatgccatgaagggatccagagatgatgtctccagctttgtggaccctggactcgccctccaggacgctcaagatctgtacgccgccggcgaaaaaataagaggcacagacgagatgaaattcatcacaatcctgtgcactaggagtgcaacacacctgctgagagttaagtgcacacagaacctgcattcatatttcgcagagcgactgtactacgccatgaaaggcgcagggactcgagatggtactctgattcggaatatagtgtcccgcagtgagattgacttgaacttaataaagtgccacttcaagaaaatgtacgggaaaactctgtcctccatgattatggaggacacgagtggagactacaagaacgctctcttgagtcttgtgggaagcgacccttag

SEQ ID NO: 179174 - DNA, 798 bp, Artificial Sequence
  Description of Artificial Sequence: Synthetic coding sequence
atggcctggtggaagagctgggacctgaccgagaccctgaagagcgaactttcgggaaaattcgaacggctcattgttgccctgatgtacccgccatatcggtacgaggcaaaggagcttcacgacgctatgaaaggcctggggacaaaagagggggttatcatcgaaatactggcttctcgaaccaagaatcagctgagagaaataatgaaagcctatgaagaggactacggctccagcctggaggaagatattcaagccgacacttccggctacctcgagcgcattctggtgtgtctgcttcaggggagtagggatgacgtgtccagctttgttgatcccggcctcgccttacaggatgcccaggacttgtatgcagctggagaaaaaattcgagggaccgacgaaatgaagtttattactatactctgcacaaggtctgctacgcacctcctgcgggtgttcgaggagtacgagaagattgcgaacaagtccatcgaagattcaatcaaaagcgaaacccacggatctctagaggaagccatgcttactgtagtcaaatgtacgcagaatcttcattcttactttgccgaacggctttattacgccatgaagggggcagggacccgagatggaacccttatacggaacattgtttcccggtccgagattgacttgaacctgattaaatgtcattttaaaaaaatgtacgggaaaactcttagctcaatgattatggaggacacttctggcgactataagaatgctctgctctctctggtgggttctgacccctag

SEQ ID NO: 179175 - DNA, 426 bp, Artificial Sequence
  Description of Artificial Sequence: Synthetic coding sequence
atggcctggtggaagagctggatcgagcaggagggcgtgaccgtgaaaagctcttcccatttcaatcccgatcctgacgcagagaccctgtacaaagcaatgaaaggaattgggaccaacgagcaagcgattattgatgtcctgactaagagatccaacactcaacgacagcaaatcgcaaagtcgtttaaggctcaattcggtaaggacctcacagagactcttaaaagcgagttaagcggaaaatttgaaaggctgatagtggctttgatgtacccaccctataggtatgaggctaaagagctgcacgacgccatgaaaggactcggtacgaaggagggcgtgatcatcgagatactggctagccggacaaagaaccagctgcgagaaatcatgaaggcgtatgaagaaggccagcagggctag

SEQ ID NO: 179176 - DNA, 1038 bp, Artificial Sequence
  Description of Artificial Sequence: Synthetic coding sequence
atgagcgtgaccggcggcaagatggcccccagcctgacccaggagatcttaagccacctgggcctagcaagtaagacggcagcctggggcactctgggtacgcttagaacattccttaatttctctgtggacaaagacgcacaacgcttgctgagagcgattaccggacagggcgtcgaccgctcagccatagttgacgtgttaactaacaggtcaagggagcagagacagctgatcagccggaacttccaagagcggacccagcaggatctcatgaaaagcctccaggcagcactctcgggcaaccttgaacgcatagtgatggcactgctgcagccgactgcacagttcgacgcgcaggagttgcgaacagcattgaaagcctccgacagcgccgtggatgtcgcaattgaaatcctggctaccagaacacctccccagttacaggagtgcctcgctgtctataaacataactttcaggtcgaagccgtggatgacattacatctgaaaccagcgggatcttgcaggatctgctgcttgctttggccaaaggaggaagagatagctatagcggcattatcgactacaacctggccgaacaggacgtccaggccctccagagggctgaaggcccttcacgcgaggaaacatgggttccggtcttcacacagcggaacccagagcacctgattcgggttttcgaccagtatcagcgatccacaggacaggaactggaggaagcagtacagaacaggttccacggagatgcccaggtcgcactgctgggactggcttcagtaattaagaatactccactgtacttcgccgacaagttgcaccaggctttgcaggagacagaacctaattatcaagttctgattaggattttaatctctagatgcgagacagaccttctctcaattagggccgaatttcgcaagaaattcggcaaaagtctctactcatctctgcaggatgctgtgaaaggagattgtcagtcagctctgctggcattatgccgtgccgaagacatgtag

SEQ ID NO: 179177 - DNA, 1929 bp, Artificial Sequence
  Description of Artificial Sequence: Synthetic coding sequence
atgctgacccggcccagccaggtgctgctgaacagcctgagcgtggaccccgatgctgagtgtaagtatggcctctacttccgtgacggacgacggaaggtggactacatcctcgtgtaccatcacaagaggccttcaggcaatcggacccttgtgcgtcgggttcagcactctgataccccatcaggggcccgtagtgtgaagcaagaccaccccctgcctggaaaaggcgcatcactggacgccggctcgggcgaacctcccatggattaccacgaagacgataagagatttcgcagagaggagtacgaaggcaatctgctggaggcaggtctggagctagaacgagacgaggataccaagatacacggagtcgggtttgttaaaatccatgcaccatggaacgtgctgtgtcgagaagcggaattcctgaaactgaaaatgcccaccaagaaaatgtatcacatcaatgagacccggggccttctgaaaaagatcaactcagtccttcagaagattacggatcccatacagcctaaggtggccgagcacaggccccagacaatgaaacgattgagttatccattttctagggaaaagcaacacctgtttgacttgagcgataaggacagcttcttcgatagcaaaacaagatcaactatcgtgtatgagatcctaaagaggactacttgcacaaaagccaaatatagtatggggattacctctctcctcgctaacggcgtatacgcggccgcttacccactgcacgacggtgactacaacggggaaaatgtggaattcaatgaccgcaaactgctctacgaagaatgggctcgttacggagttttttataagtaccagccgattgatctcgtcagaaagtacttcggcgagaagattggcttatattttgcatggctgggcgtgtatacacagatgctcatccccgccagcatcgtgggtattatcgtgttcctgtatggatgcgctactatggatgaaaacattccatccatggagatgtgtgatcagcgccataatatcactatgtgtcctctgtgcgacaaaacatgcagctattggaaaatgagtagcgcttgtgcgacagccagggcctcgcacctcttcgacaaccctgccacggttttcttctccgtcttcatggccttatgggccgcgacattcatggagcattggaagcgcaaacaaatgcgcctgaattatcgatgggacttgaccgggttcgaggaggaggaggaccaccccagagccgagtacgaggcgagggttcttgagaagagcttgaagaaggagtcaagaaacaaggaaacagataaagtgaaactaacctggcgagatagatttcctgcatacctcacaaatctagtttccattatttttatgattgctgtgactttcgctatcgtgttaggggtgataatctatagaatttctatggcggcggcactggccatgaactcttcgccatcggtgcgaagtaacatccgcgttactgtgactgcaacggctgtcattatcaatctggtagtcattatcctactggacgaagtttatgggtgcattgccagatggctaaccaaaatcgaggttccaaagacagagaaatctttcgaggagagactaatttttaaagctttcctcctaaagttcgtgaacagttacacaccgatattctatgtagccttctttaaaggtcgattcgtgggacgccctggcgattacgtgtacatttttcggagttttaggatggaagaagtcaccgagatcctgtttatcagcggctcccctttctgtttggcgtacgacctctcaacaccctgcacctgggagaagcaactgcagcacatatgctccgctaagagctctcgcttcttgtcttttctgctggaaacgtttctattcccttag

SEQ ID NO: 179178 - DNA, 2961 bp, Artificial Sequence
  Description of Artificial Sequence: Synthetic coding sequence
atgcgggtgaacgagaagtacagcaccctgcccgccgaggaccggagtgttcacatcatcaacatctgcgctatagaagacattggctaccttccttccgagggcactctcttgaattcactaagtgtggacccagacgccgaatgcaagtacggattgtatttccgggacggcaggaggaaagtggattatattctcgtctaccatcacaagcgacccagcgggaaccgaaccctggttcgccgtgtgcagcactcggatacaccttctggcgcccgcagcgtgaaacaggatcatcccctgcccggaaagggagcgagtctcgacgcaggtagcggagaaccccccatggactaccacgaagacgacaaaaggttcaggcgcgaggaatacgagggcaacctgctggaggccgggcttgaattggagcgagatgaagacacaaagatccacggagtggggttcgtaaagattcatgccccctggaacgttctgtgtagggaggcagagttcctgaaactgaagatgcctacaaagaagatgtatcatataaacgagactaggggcctgttaaaaaagataaacagtgttctgcaaaagattaccgatcctatccaacctaaagtggctgagcatagaccacagacaatgaagcgtctctcatatcccttttcccgggagaagcaacatctctttgatctctctgacaaggatagcttcttcgattcaaagacacgttccacgatagtgtacgagatacttaagcggacaacttgcactaaagctaaatactctatgggtatcactagtctgttggccaatggagtctatgccgccgcctaccccctgcacgacggagattataatggggagaacgtggagtttaacgataggaagttgctctatgaggagtgggccagatacggcgtattttacaaatatcaaccgatcgacttggtgcgaaagtactttggggagaagatcgggttgtatttcgcatggctgggagtgtacacccaaatgctgatcccagctagcattgtggggatcattgtgttcctctacgggtgtgcaacaatggatgaaaatatcccaagcatggaaatgtgtgaccagaggcataacatcactatgtgtccactgtgtgacaagacatgtagctactggaaaatgtcttcagcgtgtgctaccgcaagagcatcccacctgttcgataatccagccacggtgttctttagcgtgtttatggctctgtgggcagctacattcatggagcattggaagcgaaaacagatgcgcttgaactacagatgggacctgaccggcttcgaagaagaagaggaggctgttaaggaccacccccgggccgaatacgaggcccgagtcctggaaaagagtcttaaaaaggaaagccggaataaagagaagcgacggcacattcctgaggaatctactaacaaatggaagcagcgcgtcaaaacggccatggccggggtgaagctgaccgataaagttaaactgacctggcgggacagattccccgcttatctgactaacttggtgagcattattttcatgattgccgtgaccttcgcaattgtactgggggtgattatctaccgcatctctatggcagctgctctggccatgaattccagtcccagtgtacgtagcaatatcagggttaccgtcacagccaccgcggtgatcattaaccttgtggtgattatattacttgatgaagtgtatggttgcatcgctcgctggctgacaaagattgaagttccgaaaacagagaagtccttcgaggagcgacttatattcaaagcattcctcctgaagttcgtaaactcttatactcccattttttatgtggctttcttcaaaggacgctttgtggggagacctggggattatgtctatatatttcgatcatttcgaatggaggagtgcgcaccagggggttgtctcatggagttatgtatccaactctcaattatcatgttggggaagcagctgatccaaaataatttgtttgagattggcattccaaagatgaagaaattgattcgctaccttaagctgaaacagcagagcccccccgaccacgaggaatgcgtcaaacggaagcagagatacgaggtggattacaatctggagccgtttgctggcctaactccagagtacatggagatgattattcagtttgggttcgtgacgctttttgtggcctccttccctctagcacctctctttgctctgcttaataatatcattgagattaggttggacgctaaaaagttcgtgacagaactgcgccgcccggtcgcagtccgggctaaggacatcggtatttggtataacattttacgggggatcggcaaactcgctgtcattattaacgcattcgtgatttcatttaccagtgatttcattccaagactcgtgtatttgtatatgtatagcaaaaatggaactatgcatggctttgtgaaccacacactgtccagtttcaacgtgtctgatttccagaacggtaccgcacctaacgatcccctggatctggggtatgaagttcaaatctgccgatacaaagattatagagaaccaccttggtccgaaaataaatacgatatcagcaaggatttctgggccgttctcgctgctaggcttgcctttgtaatagttttccaaaatctggtgatgttcatgagtgacttcgttgactgggtgatccccgacataccaaaagacatcagccagcagattcataaagagaaagtgcttatggtggagctgtttatgagggaggagcaggacaagcagcagttgcttgaaacatggatggaaaaggagcgccagaaggatgagccgccctgcaaccaccacaacacgaaggcgtgtcccgactctctggggtcaccagcaccttcccatgcttatcatggaggtgtgctgtag

SEQ ID NO: 179179 - DNA, 2523 bp, Artificial Sequence
  Description of Artificial Sequence: Synthetic coding sequence
atggactaccacgaggacgacaagcggttccggcgggaggagtacgaaggcaacctgctcgaagctggcttggaattagaaagagacgaagacacaaagattcatggggtgggttttgtgaagattcatgccccctggaacgttctgtgtcgagaggctgagttcctgaagcttaaaatgccaaccaaaaagatgtatcacatcaacgaaacacgcgggcttcttaagaagatcaattctgtcctccagaagatcaccgaccccatccagcctaaagtcgcggagcaccggccccaaactatgaaacggctgtcctacccctttagccgggagaagcagcatttattcgatctcagtgacaaggactccttcttcgactccaagactcggtctaccattgtgtatgaaatcctcaagcggacaacatgcacgaaagcaaagtactctatgggcatcacaagcctgttggcaaatggagtatacgctgctgcatatcctctccatgacggtgattataacggcgagaacgtagagtttaacgatcgtaagctactgtacgaagagtgggctcgatatggcgtgttctacaagtaccagcctattgacctcgtacggaagtactttggagaaaagattggtctgtatttcgcttggctgggagtgtacacacagatgctaattccggcctcaatcgtgggaatcattgtcttcttgtatggctgcgccactatggacgagaatattccttctatggagatgtgcgaccaaaggcacaacattactatgtgccctctgtgtgacaaaacatgcagctattggaaaatgagttccgcctgtgcaacggccagggccagtcacttgttcgacaatcctgcaaccgtgttcttcagtgtgttcatggctctgtgggctgccacatttatggaacactggaagcgcaagcagatgcgcctcaactaccgatgggacttaaccggtttcgaagaggaggaggatcatccccgtgctgagtacgaagcccgtgtgttggaaaagtcacttaagaaggaaagccgcaataaagaaacagataaagtcaagcttacatggagggataggttcccagcgtacttgacaaatctggtgtccattattttcatgattgcggtcacatttgctatagtgcttggagtgatcatttaccgcattagtatggccgccgctctggctatgaactcttctccaagcgtcaggtccaacattagagttactgtcactgcaacagccgtgataatcaatcttgtggttatcatcctgctcgacgaagtgtatggatgtattgcaaggtggctgaccaagatcgaggtacccaagacagaaaagagcttcgaggaaagactcatttttaaagcgttcctcctgaaatttgtgaacagttatacccccatcttttacgtggcgttcttcaaaggtaggttcgtgggaagaccaggagactatgtgtacatctttaggtcgttccggatggaggagtgcgccccaggggggtgtttgatggagctatgcatccaactctccattatcatgctcgggaaacagctgatccaaaacaatctctttgagatcggaatccctaaaatgaagaagctcatcaggtacctcaaactgaaacagcagtcaccacctgaccatgaggaatgcgtcaagaggaaacagaggtatgaagttgattataacctggagccgtttgccggtctgacgcccgagtatatggaaatgatcatccagttcggattcgtgacgttgttcgtcgcctccttccctctggccccattatttgctcttctaaacaacataatcgagataagactggatgccaagaagtttgtgacagagttgagacgtcccgttgccgtcagggcaaaggatatcggaatttggtataacatccttcggggcattggcaagcttgccgtgatcattaatgccttcgtgatcagcttcacaagcgattttatcccgcggctggtgtatctttatatgtattccaaaaatggcacaatgcacggctttgttaaccatacattgagttcctttaatgtcagcgatttccagaatggcactgctcccaatgatccacttgatctcggctacgaggttcagatctgcagatataaggattacagggaaccaccatggtccgaaaacaaatatgacatctctaaggatttttgggccgtgctcgccgcacgactggcattcgttatcgtcttccagaatctggtgatgttcatgtcagactttgttgactgggtcataccagacatacccaaggacatctcacaacagatccataaggagaaggtactgatggtcgagctgttcatgagagaagaacaagacaaacaacagctgctggagacttggatggagaaagaaagacagaaagatgaaccaccgtgtaatcatcacaacaccaaggcgtgcccagacagcctcgggtcacctgcgccatcgcatgcctatcatggcggcgtgctctag

SEQ ID NO: 179180 - DNA, 2523 bp, Artificial Sequence
  Description of Artificial Sequence: Synthetic coding sequence
atggactaccacgaggacgacaagcggttccggcgggaggagtacgaagggaatctcttggaagcaggcctagaactcgaacgcgatgaggatactaaaatacacggggtgggattcgtgaaaatccacgccccctggaatgtcctgtgtcgggaagctgagtttttgaagctgaaaatgcctacgaaaaagatgtatcatattaacgagacacgcggactgctgaaaaagattaatagcgtcctccagaagattactgaccccatccagccgaaggtggccgaacacagaccccaaaccatgaagcggctgagttaccctttcagccgcgaaaagcagcacctgtttgacctgagcgacaaggactctttctttgattccaagacgagatctactatcgtatatgagatcctcaaacgcacaacgtgcaccaaagctaagtacagcatgggcatcacgtctctcttggccaatggggtctacgctgcagcttaccctctgcatgacggcgactataacggcgagaacgtcgaattcaatgatagaaagctcctgtatgaggagtgggctaggtatggagtcttctataagtatcagcctattgacctggtgcgtaagtattttggcgagaaaattggactatactttgcttggctgggcgtatacactcagatgctcatcccagcgtcgatcgttggcataatagtgtttctctatggatgcgcaactatggatgagaacattccttccatggagatgtgcgatcagcggcataatatcacaatgtgtcctctttgcgacaagacctgcagctattggaaaatgagcagcgcctgcgcgacggcccgggcttcccacctcttcgataacccagccaccgtgttcttctccgtatttatggcactctgggcggccaccttcatggaacattggaagcggaaacagatgcgcctcaactataggtgggacctgacaggcttcgaggaagaagaagaccatccccgtgccgaatacgaggcccgcgtcttggaaaagagtctgaaaaaggaatctaggaataaggagaccgacaaagtgaagctaacttggagagaccggtttccagcatacctaacgaatctagtgtccattattttcatgattgcagtgacatttgccatcgttctcggggtcatcatctacaggatttccatggctgcggctctggctatgaactcgtcaccgtcagttcgctccaacatcagggtcactgtcaccgctacagccgtgatcataaacctggtggtcatcatcctgctggatgaggtttacggttgcattgcccggtggctaacgaaaatcgaggtgcctaagaccgaaaagagcttcgaggaaagattgattttcaaggccttcctgctgaaatttgttaatagctataccccaatcttttatgtggccttttttaagggccgatttgtgggccgacctggagattatgtttatatcttcaggtccttccgtatggaagaatgcgcgccgggaggctgtttgatggaactttgtatccagttgtcaattattatgttaggaaaacagctgattcagaacaatctgttcgagataggcattcctaagatgaagaagctgataaggtatctcaaactaaaacagcaatctccacctgaccacgaggaatgtgtcaagcgaaagcagcgctacgaggtggattataaccttgaacctttcgccgggttaacccctgagtatatggagatgattatccagttcggtttcgtaaccctcttcgtcgcgtcttttcctttggcacctttgtttgcactgctgaataacataatagagattagacttgacgcaaagaaattcgtgacagaacttcggaggccggtcgctgtccgagcgaaggacatcgggatatggtacaatatcctccgaggcattggaaaactagctgtcataattaatgcctttgtgatctcctttacatctgatttcatacccagactagtatacttgtacatgtattccaagaacggaactatgcatgggtttgtgaaccataccctgagttctttcaacgtgagtgatttccagaacggaactgcccccaacgaccccctggacctcggatacgaagttcagatctgccggtacaaagactatagggagccaccctggagcgaaaataagtatgatattagtaaggatttttgggccgtgctggccgctcgcctggcattcgtcatcgtctttcagaacctcgtgatgttcatgagcgacttcgtggattgggtaatccccgacataccaaaagacatctcacaacaaattcacaaggagaaagttctgatggtcgaattgtttatgcgggaagagcaagacaagcaacaactgttggagacctggatggaaaaggagagacagaaggacgagccaccttgcaaccaccataacacaaaggcctgccctgattcattaggaagccctgccccatcccacgcataccacggaggcgtgctgtag

SEQ ID NO: 179181 - DNA, 2961 bp, Artificial Sequence
  Description of Artificial Sequence: Synthetic coding sequence
atgcgggtgaacgagaagtacagcaccctgcccgccgaggaccggtccgtgcacattatcaatatctgcgccattgaggatatcgggtaccttccctcagaggggacactcctgaactctctgtcagtggatcctgacgccgagtgtaagtacggtttgtactttcgggacggcagacggaaggtggactacatacttgtataccatcacaagagacccagcggcaacagaactcttgtgagaagggtgcagcattccgacactcccagcggagctcgttccgttaagcaggaccaccccttgccaggcaaaggggccagcttggatgcgggaagcggcgaacccccgatggactatcacgaggatgacaaacggttcaggagagaagaatatgaggggaatctgctcgaagctggattggaactggagcgcgacgaggacaccaagattcatggggttggctttgtcaaaatccacgccccgtggaatgtgttgtgcagagaggccgagttcctcaagctcaagatgcccaccaaaaagatgtatcacataaatgaaaccagaggcctactaaagaagattaattccgtattacagaaaatcaccgacccaatccagcccaaagtagctgagcaccggcctcagactatgaagcggctgtcttatccatttagcagagaaaagcagcaccttttcgaccttagcgacaaagattcttttttcgactccaagacgcgaagtactattgtatacgaaattctgaagcgaaccacttgcactaaagctaagtacagcatgggcatcacttcactgctggccaacggagtctatgcagccgcttatcctcttcacgacggggactacaatggggagaatgtcgaattcaatgaccggaaactcctatacgaggagtgggcccgatacggggtcttttacaagtaccagcctatcgacctggtcaggaagtatttcggagaaaagattggtctatactttgcttggctcggcgtgtacacccaaatgcttattccagcttctatcgtgggcatcattgtgtttctgtatggttgcgccaccatggacgaaaatattcctagtatggaaatgtgcgatcaacgacacaacattacgatgtgcccattatgtgataagacctgttcctactggaagatgagttcagcctgtgccacagctcgcgcgtcccatctttttgacaaccctgccacagtgttttttagcgtgttcatggcattatgggccgcgacattcatggaacattggaagagaaagcaaatgcgactgaattataggtgggatctgacaggatttgaggaagaagaaaaagcccttcttgatcacccaagagcagaatacgaggctcgggttctcgagaagtcacttaaaaaagagagcaggaataaggagaagagaaggcatatccctgaggagagtactaataagtggaaacaaagagttaagaccgcaatggcaggagtgaaactcacggacaaagtgaaattgacgtggcgagatagattcccagcttacctgacaaatctggtatccataatcttcatgatcgcagtgacgttcgctatcgtcctgggcgtaatcatttaccgcatctcaatggcagctgcactggctatgaacagtagccctagtgtgaggagcaacattcgtgtgacagtgactgctaccgccgttatcatcaacttagttgttataatattactggacgaagtgtacgggtgtatagcacggtggctgaccaagatcgaagtacccaagacagagaagagttttgaagagcggcttatatttaaggcatttctgctaaagtttgttaattcctatacacctatcttctacgtggccttttttaaaggtaggttcgtgggtcggccaggcgactatgtttacatattccggagctttcggatggaggagtgcgctcctggcgggtgtctgatggaactctgcatccaattatctatcattatgttagggaaacagcttattcagaacaatttatttgagattggcataccaaagatgaagaagctcatccgatacctcaagttgaagcaacagtctccacccgaccacgaggagtgcgtgaaacgaaagcagcgctatgaggtggactataacctggagcccttcgccggacttacaccggaatacatggaaatgatcatccagttcggctttgtaactttgttcgttgcaagcttcccattggctcctctgttcgccttactcaacaatatcatagaaatacgcctcgatgctaaaaagttcgtgacagaactaaggcgccccgtggctgttagagcaaaggacattggcatctggtacaacattctgagagggattggcaaactcgctgtaatcattaatgcttttgtcatttccttcacatccgattttattccaagattggtgtacctctacatgtatagcaagaacggaaccatgcatggatttgtgaatcatacccttagcagcttcaatgtgtccgactttcagaacgggaccgcccctaatgatcccctggacctgggctacgaggtgcaaatttgtaggtacaaggactaccgtgagcctccttggtccgagaacaagtatgacataagcaaggatttctgggcggtcctcgccgcaaggttggcctttgttatcgtcttccagaacttagttatgtttatgtcagactttgtggattgggtgattccagatattcctaaagacatatctcaacagatccacaaggaaaaggtcctgatggtcgagctttttatgcgggaagaacaggacaaacagcagctgctggagacctggatggagaaggagcgccagaaagatgagccaccgtgcaaccaccataacacgaaggcttgtcccgactccttaggcagtcctgcccccagccacgcttatcatgggggtgtcctttag

SEQ ID NO: 179182 - DNA, 942 bp, Artificial Sequence
  Description of Artificial Sequence: Synthetic coding sequence
atgctggacgccgccagcaaggcccgggaggcccccgaggccgccccaggttgggacgaccctcaaggggaggggcgacgggggagaggagaaggtctcagttgggcagtgggaccccaccccgatccaggcgttcttatgcagggcgaagtctggagtggcagattctcacatgccgttatccagttcgggttcgtaacattgtttgttgcgagttttcccctcgctccccttttcgccttactcaataacatcattgagatccgactggacgctaagaaatttgtgacagagctcagacgcccagtagccgtccgtgctaaagacattgggatctggtacaacatcctgcggggcatcggcaagctcgcagttattattaatgcgtttgtgatcagcttcacatctgacttcattccacgcttagtgtacctgtatatgtacagcaagaacggcactatgcatggctttgttaaccatactctttcctctttcaatgtgagtgacttccaaaatggcaccgctccaaacgatcccctggacttgggatacgaagtccagatatgtagatataaagactacagggagcccccttggagcgagaacaaatacgacatttccaaagacttctgggctgtcctggcagcaaggctggcctttgtgattgtgtttcagaacctggtgatgttcatgagtgatttcgtagattgggtgataccagatattccaaaggatattagtcagcagattcataaggaaaaggtactgatggtcgaactgttcatgagggaggaacaagataagcaacagttgctggaaacttggatggagaaagagagacagaaagacgagcccccctgtaatcaccacaacaccaaggcatgtcccgattccctgggctcgcctgccccatcccacgcctatcatgggggcgtgctgtag

SEQ ID NO: 179183 - DNA, 2235 bp, Artificial Sequence
  Description of Artificial Sequence: Synthetic coding sequence
atgaagcggctgagctaccccttcagccgggagaagcagcacctgtttgatctgtccgacaaagattcttttttcgattccaagacacgctctaccattgtgtatgagatcctgaagcgtactacctgcactaaggctaaatatagcatgggtatcacctctctgctcgccaacggcgtgtatgccgctgcctaccccctgcacgatggtgattataacggtgagaacgtggaattcaatgatagaaagttgctgtacgaagagtgggccagatatggcgtgttttataagtaccagcccatcgatctcgtgcggaaatacttcggcgaaaaaatagggctgtattttgcttggttgggcgtatatacccagatgctcatccccgcatccatcgtcggcataatcgtatttttgtacggctgcgccacaatggatgaaaatatccctagtatggaaatgtgcgaccagcgtcataatatcactatgtgccctctgtgcgacaagacatgctcgtactggaagatgtcaagtgcttgcgctaccgctagagctagtcacttattcgacaaccccgccaccgtctttttcagtgtgtttatggccctgtgggctgccacctttatggagcactggaagcgaaaacaaatgcgtctgaactacaggtgggatttgacgggtttcgaagaggaagaaaaggccctgttagatcatccccgtgcagagtatgaagcccgcgtactggagaagagtcttaagaaagagagccgcaacaaagagacagacaaggtgaagctgacctggagggataggttccccgcttatctaactaacctggtcagcatcattttcatgattgcagttacctttgctatcgttctgggagttattatctacagaatctcgatggcagctgctctggctatgaatagcagcccaagcgtgcgttccaatattagagtcacggttactgcgacagcagtgatcatcaatcttgtggttatcatccttctagatgaagtatacggctgtatcgcccgctggctaaccaagattgaagtgcccaagaccgagaagtcattcgaggagcgcctgatattcaaggctttcctactgaaattcgtcaactcatacactcctatcttttacgtggcattctttaaaggcaggttcgtgggacgcccgggcgactatgtctatatcttcaggagctttaggatggaggagtgtgcaccaggcgggtgcctgatggagctctgcatccagctttccattattatgttaggcaagcagttgattcagaataacctgtttgaaattggaatccccaagatgaagaagcttattagatatctgaaattgaaacagcaatctccccccgatcacgaagagtgtgttaagcgaaaacagcggtacgaggttgactacaatctagaaccattcgcgggcctgacacctgagtacatggaaatgatcatccaatttggtttcgtgactctgttcgttgcgagctttcccctggccccccttttcgctctgctgaataatatcatagaaatacgactcgacgctaaaaaatttgtgactgaactcaggagaccggtggcagtgcgggcaaaagacattgggatttggtataatattctgcggggcattgggaagctggccgttatcatcaacgccttcgtaataagtttcacatccgatttcatcccccggctggtttatctctacatgtactcaaaaaatggaaccatgcacggtttcgtgaaccacacgctctcctcatttaacgtatcagacttccagaatggtaccgctcccaatgaccccctagacttgggatacgaagtgcaaatttgtagatacaaggattaccgggagccaccctggtcggagaacaagtacgatatctcgaaggatttttgggccgttctcgcggctcgtttggcttttgtgatagttttccagaacctggtgatgttcatgtccgacttcgttgattgggtgattcctgacatcccaaaggatatctcgcagcagatccataaagaaaaggtgctgatggtggaactatttatgcgtgaagagcaagataaacagcaactcctggagacttggatggagaaggaacgccagaaggatgaacctccctgtaatcatcacaataccaaggcgtgccctgatagcttggggagtcctgccccttcccatgcctatcacggaggcgtgctgtag

SEQ ID NO: 179184 - DNA, 1983 bp, Artificial Sequence
  Description of Artificial Sequence: Synthetic coding sequence
atgaaggtgaccctgagcgccctggacaccagcgagagcagcttcacacctctcgtggtcatcgagctggcccaggatgtgaaagaagagaccaaagagtggttgaagaatcgtatcatcgccaaaaagaaggatgggggggctcaactgctttttaggcccctgcttaataaatacgagcaggagacccttgaaaaccagaacctttaccttgttggcgcctctaagattcgaatgcttctgggggctgaagccgtaggcctggttaaagagtgcaacgacaataccatgcgggccttcacctacagaacgcggcaaaattttaagggattcgatgacaataacgatgatttcctcacgatggctgaatgtcaatttatcattaaacacgaacttgaaaacctgagagcaaaggatgaaaaaatgatccctggctatccgcaggcaaaactttacccaggtaaatcccttctccggcgattgctgacaagcggaatcgttatacaagttttccccttgcacgacagcgaagcactcaagaaattagaggatacctggtacaccaggttcgccttgaagtatcaacccatcgattcgatccggggatactttggcgagacgattgcactgtattttggatttctggaatatttcacctttgcgttgatccccatggctgttattgggctgccctactatctcttcgtttgggaagactacgataagtacgtgatcttcgcgtcttttaacctgatttggtctaccgtgatactggagctctggaagaggggctgtgccaatatgacgtacagatggggaactttactgatgaaaagaaaattcgaggagcctaggccagggttccacggtgtgctgggtattaacagcatcacagggaaagaggaacccctctacccttcgtacaagagacaacttcggatttacttagtgtctctgcctttcgtgtgcctttgcctgtattttagcctttacgtcatgatgatctattttgacatggaggtgtgggcgctgggactgcacgaaaattctggaagcgagtggacgtcagtgctcttgtatgtgccttcgattatttatgccattgttatcgagataatgaacaggctgtatagatatgcagctgaatttctgacgagttgggagaatcacagattagagtctgcatatcagaatcacctgatcctgaaagttctggtgttcaatttcctgaattgcttcgcatccctcttttatattgcctttgtcttgaaagatatgaaacttctgagacaaagccttgctacacttctgattacatcacagatactcaatcaaataatggaatcctttctgccctactggctgcagagaaagcacggagtgagagtcaagaggaaagttcaggccctgaaagccgacattgatgccactttatatgagcaggtgatcctggaaaaggagatggggacgtacctgggcacctttgacgactacttggagctgtttctgcagttcgggtatgtcagcctgttctcctgcgtgtaccctctcgccgcagcgtttgccgttctcaacaacttcaccgaagttaatagcgatgctttgaagatgtgcagagtcttcaagagaccattttccgagccctctgcaaacattggcgtgtggcaactggcattcgaaaccatgtcagtcatctctgtggttaccaattgcgccctgatcggtatgagcccgcaggttaatgcagtgttcccagagtctaaggccgatcttattttaattgtggttgcggtagagcacgccttgctggctctgaagttcatattggctttcgccattcctgataagccaagacatatccagatgaaactggcgaggctagagttcgaatccctggaagccctgaagcagcagcagatgaagttagtgaccgagaacctgaaggaggagccaatggagtcaggcaaagagaaggcgacatag

SEQ ID NO: 179185 - DNA, 1413 bp, Artificial Sequence
  Description of Artificial Sequence: Synthetic coding sequence
atgaaggtgaccctgagcgccctggacaccagcgagagcagcttcacccctctggttgtgattgaacttgcccaggacgtgaaagaagagactaaagaatggcttaagaaccgcataatagccaaaaagaaagacgggggcgcccagctgctattccgtcccctcctcaacaagtacgagcaagagaccctggagaatcagaacctgtacctggttggcgcttcaaaaatcaggatgttactgggcgccgaagctgttggcctggttaaggagtgcaacgacaatacaatgcgggccttcacctataggacccgtcagaacttcaagggctttgacgacaataatgatgattttctgaccatggccgaatgccagttcattattaaacatgagttagagaatttgagggccaaggatgagaagatgatccctggataccctcaggcaaagttgtaccccggaaagtcattgcttagaaggctcttaaccagtggcattgtgattcaggtctttccactgcacgactctgaggccctgaagaagctggaagatacatggtatacacgttttgcacttaaatatcagccaatcgaaaatcaccggcttgaaagcgcctatcagaaccatctgatcttaaaggtattagttttcaacttcttgaactgtttcgcctctctgttctacattgccttcgtcctgaaagacatgaagctgttgcgccagtccctcgcaacacttctaataacatctcaaattctcaatcagattatggaatctttcttgccgtattggcttcagcgcaaacatggtgtgagagtgaagaggaaagtgcaggctctgaaggctgacatagatgctaccctgtacgaacaggtaatcttggaaaaggagatgggcacctacctgggaaccttcgacgattacctcgagttattcttgcagttcggatacgtgtccttgttcagttgtgtgtaccctctcgcagcagcctttgccgtactcaataactttacagaggtaaactcggacgccctcaagatgtgtcgtgtgttcaaacgaccgttttcagaaccaagcgcgaatattggggtgtggcagctggcctttgagacaatgagtgtgatctctgtcgtcaccaattgcgccctgattgggatgtcaccgcaggtgaacgccgtcttcccggaatctaaagccgatttaatcctgatagtagtagctgtagagcatgcattgctggctctgaagttcatccttgctttcgccatacccgataagccaagacatatccagatgaagctggctcgactggagtttgagtcattagaagctctaaaacagcagcagatgaaactggtcacagaaaatctaaaagaggagccaatggaatctggaaaagagaaggccacttag

SEQ ID NO: 179186 - DNA, 423 bp, Artificial Sequence
  Description of Artificial Sequence: Synthetic coding sequence
atgaaggtgaccctgagcgccctggacaccagcgagagcagcttcacaccactagtagtcattgagctcgcgcaggacgtgaaggaagaaactaaagaatggctgaaaaatcgtatcatcgccaagaagaaagatgggggcgcccagctgctgttccgacccctactaaataaatatgagcaagaaaccctggaaaatcagaatttgtacctggtcggggcctcaaagatcagaatgctactcggcgccgaggctgtaggcctcgtgaaagaatgcaacgataacaccatgcgcgcttttacctacagaactagacagaattttaagggtttcgatgacaataacgatgacttcctgaccatggccgagtgccagtttatcataaaacatgagctggaaaacttgcgggcaaaagatgaatag

SEQ ID NO: 179187 - DNA, 339 bp, Artificial Sequence
  Description of Artificial Sequence: Synthetic coding sequence
atgaaggtgaccctgagcgccctggacaccagcgagagcagcttcacccccctggtggtgatcgaactggctcaggatgtgaaagaggaaaccaaagagtggctgaaaaaccgcatcattgctaaaaagaaggatggtggtgcccaacttctgttccggcctctgctgaataagtacgaacaggagacactggaaaatcagaatttatacttggttggtgcttctaagattaggatgttacttggcgctgaggcagtgggccttgtcaaagagtgcaacgataataccatgcgagcatttacgtaccggacccggcaaaacttcaaggggtttgactag

SEQ ID NO: 179188 - DNA, 117 bp, Artificial Sequence
  Description of Artificial Sequence: Synthetic coding sequence
atgaaggtgaccctgagcgccctggacaccagcgagagcagcttcacgcccttagttgtcatcgaattggcccaggacgtgaaggaggagacaaaagagtggctgaagaacagatag

SEQ ID NO: 179189 - DNA, 405 bp, Artificial Sequence
  Description of Artificial Sequence: Synthetic coding sequence
atgaaggtgaccctgagcgccctggacaccagcgagagcagcttcactcccctcgtggtgattgaactggcccaagatgtgaaagaagagacaaaggaatggcttaagaaccgcataatcgccaaaaagaaggatggaggggctcaactactgtttaggcccctgttaaataagtatgagcaagaaactctggagaatcaaaatctctacctggtaggtgcttccaagatacggatgctgctgggagctgaggccgttgggctggtgaaggaatgtaatgacaatactatgagagcctttacgtacaggacaaggcagaattttaagggcttcgacgataacaatgatgacttcctgacgatggcagagtgtcaatttatcatcaaacacgaactggaaaattag

SEQ ID NO: 179190 - DNA, 441 bp, Artificial Sequence
  Description of Artificial Sequence: Synthetic coding sequence
atgaaggtgaccctgagcgccctggacaccagcgagagcagcttcacgcccctcgtcgtgattgaactcgcacaagacgttaaggaggaaaccaaggaatggctcaagaacaggataatcgcaaagaagaaggatggtggagcacagttgctcttcagaccactgctgaataagtatgaacaggaaaccctggagaatcaaaacctgtacttggtcggcgcctccaagattagaatgctgttgggcgcggaggccgttgggttggtcaaggaatgtaatgacaacactatgagagcattcacatacagaacacgccagaattttaagggctttgatgataacaacgatgattttcttacaatggccgaatgtcagtttattatcaagcacgaactggagaacctaagagcaaaggacgagaagatgatccccggctattag

SEQ ID NO: 179191 - DNA, 426 bp, Artificial Sequence
  Description of Artificial Sequence: Synthetic coding sequence
atgaaggtgaccctgagcgccctggacaccagcgagagcagcttcactccactggtggtgatcgagctggcccaagacgttaaagaggaaacaaaagagtggttgaaaaatcgcatcatcgccaagaaaaaggacgggggcgcgcagttgctgttccgtcctctgctgaataagtacgagcaggagaccctggaaaaccaaaacttatacctggttggtgcatcaaagataagaatgctgctgggggcggaggctgtgggtctggtaaaagagtgtaacgacaacaccatgcgggcgtttacgtaccggacacggcagaacttcaaaggctttgatgacaacaacgacgacttcttgaccatggccgagtgccagttcataattaaacatgaactagagaaccttcgcgctaaggacgaaaaatag

SEQ ID NO: 179192 - DNA, 1785 bp, Artificial Sequence
  Description of Artificial Sequence: Synthetic coding sequence
atgaaggtgaccctgagcgccctggacaccagcgagagcagcttcacccccctggttgtcatcgaactggctcaagatgtgaaggaagaaaccaaggagtggctcaaaaaccgcatcatcgccaagaagaaagatggggacaataatgacgatttcctaaccatggccgagtgtcagttcatcattaaacatgaattggaaaatctgagggcgaaagacgaaaagatgattccaggctacccccaggccaaactctatcctggaaaaagcctcctgaggcggctgctgacatccgggattgtcatacaggttttccctctgcatgattcagaagctctgaaaaaactcgaagacacttggtacaccagatttgctctgaaatatcagcccatagattccatcaggggctactttggggaaactatagctctttacttcggctttctggaatatttcacatttgccctgatcccaatggctgtaatcggcttgccttactacttgttcgtgtgggaagactatgataagtacgtgatttttgcttcctttaacctcatatggagtacagtgattcttgagctgtggaaacgtggttgcgccaacatgacataccgctggggcaccctgctgatgaagagaaagtttgaggaaccccgccctggcttccacggtgtgttgggcatcaattctattacggggaaagaggagcctctatacccatcctataagcgacagctgcggatatatcttgtgagcctgcctttcgtctgcctgtgcctatacttcagcttatacgtgatgatgatctacttcgatatggaagtgtgggctctgggcctccacgagaattccggctccgagtggacttccgtgctactctatgtcccttccatcatctacgcaattgtgattgaaattatgaacagactgtaccggtacgctgctgaattcctcactagctgggagaatcaccggctcgaatctgcataccaaaatcatttgatcctgaaagtgctggttttcaacttcctgaactgtttcgcttcattattttatatcgcattcgtcttgaaggatatgaagcttctgcgtcagtcgcttgctaccctactgatcacatctcagatcctgaaccaaattatggaatcttttctgccttactggttgcagagaaagcatggagtgcgggtgaagaggaaggtccaagctctcaaggcagacatcgacgctacgctctatgagcaggttatcctggagaaggagatgggcacctacctgggtacatttgatgattacctggagttattcctgcaatttggctacgtcagcctctttagttgtgtttacccattagcagctgcattcgctgttttgaataatttcaccgaagtgaactcagacgccctgaagatgtgtcgagtgtttaagcggccattcagtgagccaagtgccaacattggagtctggcagctggcatttgaaacaatgtcagttatcagcgtggtaactaattgtgccctgattggtatgagtccacaggtgaatgcagtttttccagagagcaaagccgatctgattcttatcgtggtcgccgtcgaacacgctttgctcgccctgaagttcatccttgcctttgctatcccagacaaacctagacacatccagatgaagctagctaggctggaattcgaatcactagaggctctcaaacaacaacagatgaaactcgtcacagagaacctaaaagaagagccgatggagtcaggtaaagaaaaggcaacctag

SEQ ID NO: 179193 - DNA, 1884 bp, Artificial Sequence
  Description of Artificial Sequence: Synthetic coding sequence
atgaaggtgaccctgagcgccctggacaccagcgagagcagcttcacccccctggtggtgatcgagctggctcaggatgtcaaggaagagaccaaggagtggctcaagaaccgtatcatagcgaaaaagaaggatggtggagcacagctccttttccggccactcttaaataagtatgaacaagaaactctggagaatcaaaatctatatttggtgggtgcatctaaaatccgtatgctcctgggggctgaggcagttggcctggtgaaggagtgtaacgacaacaccatgcgcgcgtttacctatcgaacacgccaaaacttcaagggctttgatgataacaatgacgactttctgacaatggcagaatgtcagttcatcatcaagcacgaactggaaaatctgcgggccaaggatgagaagatgatcccaggataccctcaggccaaactttatcctgggaagagtcttctcaggcgactgctgacttccggcatcgtgattcaagttttcccgctccacgattccgaggccctgaaaaagctcgaggacacatggtatacgcgattcgccctgaaatatcagcctattgacagtatccgtgggtacttcggagagactattgctttgtacttcggctttttggaatatttcacattcgctcttatccctatggccgtgattggtctgccgtactatcttttcgtgtgggaggattacgacaagtacgttatctttgcttccttcaaccttatctggagcacagtgattctcgaattgtggaaacgagggtgcgccaacatgacttaccgctgggggactctgctgatgaagcgcaaatttgaggaaccacggcccggattccacggcgtgctcggaattaattccatcacaggtaaggaagagccgttatacccctcatacaaaaggcaactccggatctacctcgtgagtctcccctttgtgtgtctctgtctctacttttccctctacgtgatgatgatctacttcgacatggaggtttgggccctgggcctgcacgaaaactcaggttccgagtggacatcggtgctcctttatgtaccaagcattatttatgccattgtaattgaaataatgaatcggctttacaggtacgctgcggagttcctgacctcttgggagaaccatcgcctggagtcagcctatcagaaccacctgattctaaaggtgctagtgtttaattttctgaattgttttgctagcttattctacattgcttttgttctaaaagatatgaagcttttgaggcagtctttagctacactcctgattaccagtcagatcttaaaccaaatcatggaatcctttctaccgtactggctgcaaaggaaacacggggtgagggtgaagagaaaggtacaggctttgaaagccgacatcgacgccacactgtacgagcaggtgattctggaaaaagagatgggcacatacctaggtacctttgacgattatctcgaactatttctgcaatttggatatgtctctctcttctcctgcgtgtatccattagctgccgccttcgcagtgctgaacaactttacagaggtcaattcagatgcgctcaaaatgtgccgagtgtttaaacgtccttttagcgagccatcggcgaacattggagtgtggcagctggcttttgagactatgagtgtcatcagtgtagttacaaactgcgcactcattggcatgtcgccacaggtcaacgccgtcttccccgaaagtaaggctgacctgatactcatcgtcgtcgccgtggaggctgcctcgtgcaaactggtctcactgcctcgttatagctggagtaccaattcagtgcctggcactgttatcgggccaggtgtttag

SEQ ID NO: 179194 - DNA, 1650 bp, Artificial Sequence
  Description of Artificial Sequence: Synthetic coding sequence
atgaaggtgaccctgagcgccctggacaccagcgagagcagcttcactcccctagttgtcatagaattagcccaggacgtaaaggaggaaaccaaagagtggctgaagaacagaatcatagctaaaaaaaaggacggggtccggagactgttaacttccggaatagtgatacaagtcttcccactgcatgattctgaagccctgaagaaactcgaggacacgtggtacacccgctttgccctgaaatatcagcctatcgactctatcagaggctacttcggagaaacgatagcgctgtactttggatttttggaatacttcactttcgctttaattcccatggctgtgattggcttgccctattaccttttcgtgtgggaggactacgataaatacgtgattttcgccagcttcaatcttatttggtccactgtgatattggaattgtggaaacgtggatgtgccaatatgacctatcggtgggggaccttgcttatgaagcggaagttcgaagaaccacggcccggttttcacggtgtgcttggcataaattctattaccgggaaagaggaacctctttacccaagttacaagcgtcaattaaggatctacctggtgtctctcccgttcgtctgtctatgtttgtactttagcctgtatgttatgatgatttacttcgatatggaagtgtgggctctgggcctgcacgagaattccggcagtgagtggacttctgtgttgctgtacgtgccatcgattatctacgctatcgtgattgagatcatgaatcggctgtaccgatacgccgccgaatttttgacatcttgggagaaccaccgcttggaaagtgcctaccaaaatcacctgattttgaaggtcctcgtgtttaacttcctgaactgtttcgcctctctattctatattgcattcgtgttgaaagacatgaaattactaagacagtcgctggcaactctgcttataaccagtcagattctcaatcagattatggagtctttcttgccttattggctgcaacggaagcatggcgtgagagtaaagcggaaagtgcaggccctcaaggccgacatagacgctaccttgtatgagcaggtgatccttgagaaggagatgggcacttacctggggacattcgacgactaccttgagctgtttttgcagtttggatatgtcagccttttctcctgtgtctatcccttggccgccgcttttgctgtcctgaataactttacagaagtcaatagcgatgcactcaagatgtgccgtgtgtttaagcggcctttttctgagccttcagctaatattggtgtgtggcagctggcgtttgagaccatgtctgtaatcagtgtggtgacgaattgcgcactaatcgggatgtcacctcaagtcaacgccgtattcccagaatcgaaggcagacttgattctgatcgttgtggctgttgagcatgctctgttggcactgaagttcatcctggccttcgcaattcctgacaaacccagacatatacagatgaagctggctcggttggagttcgaatctctggaagctttaaaacagcagcagatgaagcttgtgactgaaaatctcaaggaagagccaatggagtcagggaaagaaaaggctacatag

SEQ ID NO: 179195 - DNA, 2997 bp, Artificial Sequence
  Description of Artificial Sequence: Synthetic coding sequence
atgcccgaggacatccccctgctgcccggcagcccccggcggctgtccccacaagcaggtagcaggggcgggcagggaccaaaacacggacagcaatgcctaaagatgcctggtcctagagcaccggggctccagggtgggtcaaatcgtgacccagggcagccctgcgggggcgagtccacacgttccagttctgtgatcaataactacctcgatgcgaatgagccagtttccctcgaagcccggctttccagaatgcactttcatgactcacagcggaaagtagactacgtcctcgcttatcactatagaaagaggggggtgcatctggcccaaggattccctggccacagtctcgccattgtgtccaacggtgagacaggcaaagaacctcacgccggaggacctggggacatcgaactcggccccctggacgctctcgaggaagaacggaaggagcaaagggaagagttcgagcacaacctgatggaggctgggctggagctcgagaaggatctagaaaacaagtctcagggctctattttcgttagaattcatgccccatggcaagtcctcgcgagggaagccgagttcctgaagatcaaagtgccaaccaaaaagatgtatgagataaaagcaggcggtagcatagcgaagaagttttccgccgctctccagaaactctcatctcatctccagcccagagttccggagcattctaacaacaagatgaaaaacctcagctaccccttttctagagaaaaaatgtatctctataatatccaagaaaaggataccttttttgacaacgctactcgctccagaattgtgcatgagattttgaagcggacagcatgcagccgggccaataacacgatgggtattaattctctgatcgcgaataacatttatgaggcagcctaccctcttcacgatggcgaatacgactcacccgaagacgacatgaatgaccggaaactgctttaccaggagtgggcaaggtatggggtgttttacaagttccagcctatagatctgattaggaagtactttggcgagaagattggcctttatttcgcttggctcggcctgtacacatccttcctgatcccgagttcggtgatcggtgtaattgtatttctgtatggctgtgctactattgaagaagatatccccagtcgcgaaatgtgcgaccagcagaacgccttcaccatgtgtccgctctgcgataaaagttgtgactattggaatctctctagcgcctgtggtacggctcaagcgtcacacctttttgacaatcccgccacggtctttttcagcatttttatggccttgtgggcaactatgttcttagagaattggaagagactccagatgaggctgggatatttttgggacctgactggaattgaggaggaggaggaaagggcccaggaacactcccgacctgagtacgagaccaaggtacgcgaaaaaatgcttaaagagtctaaccagagtgcagtccagaaattggaaaccaataccaccgagtgcggcgacgaagacgatgaagacaaactgacttggaaggatcgattccccggctacctgatgaatttcgcttccatactgtttatgatcgccctcacctttagcatcgtgtttggagttattgtttaccggatcacaacagccgccgcgctctccctaaataaggcaacaaggagcaacgttcgcgtgacagtaaccgcgaccgccgtgattataaacttggtggtgatactgatactcgacgagatatacggggccgtggccaaatggctgacaaaaattgaggtccctaagaccgagcagacattcgaagagcgacttatcctcaaggccttcctgctgaagtttgttaatgcttattctccaatcttctatgtggcgtttttcaaagggagattcgtgggccggcccggctcttacgtgtatgtcttcgatggctataggatggaagagtgcgccccagggggctgtttgatggaactgtgcattcagctatctattattatgctcggaaagcagctgatccagaataacatctttgaaatcggcgtgccaaagcttaaaaagcttttccgaaagcttaaggacgagaccgaagccggcgagacagactcagcccactccaaacaccctgagcagtgggatctggactattcgttagagccgtacacagggttgactccagagtatatggagatgatcatacagtttggattcgtgacactgttcgtggctagctttcccctcgcaccagtcttcgccctgctaaacaacgttatcgaggtgagactggatgctaagaagttcgttacagagctgcgtaggcctgacgctgtgcggactaaggatatcggcatctggttcgacattctcagcggtatcggaaagtttagcgtgatttcaaatgcctttgtcatagccataacctcagactttataccgcggttggtttatcagtacagctacagccataacggaacgctgcatggctttgtgaatcacactctgtcgttcttcaatgtcagtcagttgaaagaagggacacagcctgagaactcacaatttgaccaggaagtgcagttctgccgctttaaagactaccgtgaaccaccttgggctcccaacccctatgagttttcaaagcagtactggttcattttaagcgcacgacttgcctttgtgatcatattccagaacctggtcatgttcctgtccgtactggtggactggatgatccccgacatccccaccgatatcagtgaccaaattaaaaaagaaaagagtttattagtggatttttttttaaaggaagaacacgaaaaactgaaattgatggacgaacctgccctgcgttcccccggggggggggaccgcagtaggtcacgcgctgcgtcaagtgctccatctggccagagtcaattaggctcaatgatgagctctggtagccagcatactaacgtgtag

SEQ ID NO: 179196 - DNA, 3000 bp, Artificial Sequence
  Description of Artificial Sequence: Synthetic coding sequence
atgcccgaggacatccccctgctgcccggcagcccccggcggctgtctccgcaggcagggagcagaggaggtcaaggacctaagcatggtcagcaatgcctgaagatgccaggacccagggcaccaggcctgcagggcggtagcaatagagaccctggtcagccatgcggtggcgagtcaaccaggtccagctcagtgattaataattacctcgatgccaatgagccagtcagcttggaggccaggttgtcaagaatgcactttcacgattctcagcggaaggttgactacgtgctcgcatatcactaccgcaaacgtggagttcatttagcccagggatttcctgggcactctcttgctattgtttccaacggtgagactggcaaggaaccacacgccggtggccccggcgatatagaattaggccccctggatgccctggaagaggagcgtaaggagcaacgggaagaattcgaacataacctaatggaagccgggctggagctagagaaagatctcgaaaataaaagccagggcagcatctttgtcagaatccacgccccatggcaggtactggcgcgagaagcagagttcttgaaaattaaagtcccaacaaaaaaggaaatgtacgagatcaaagcaggcggatcaatcgctaagaagttttcagctgctctgcagaagttgtcaagccatctgcagccacgcgttcccgagcacagcaataacaagatgaagaacctgtcatacccatttagccgagagaaaatgtacttgtacaacatccaggagaaggatacgttctttgacaacgccacgcgatcgcggatcgtgcacgaaattctgaagcgcactgcctgcagcagagctaataacacgatgggtatcaatagcctaatcgcaaataacatatacgaagccgcttatcctctccatgacggggaatacgactcacccgaagatgatatgaacgacagaaagctactgtaccaagagtgggccaggtacggagtgttctacaaattccaacctatagatctcatacggaagtatttcggcgaaaaaatcggtctctactttgcatggctgggcttgtacacatcttttctcatcccctctagcgttatcggagtaatcgtctttttgtatggctgtgctacaatcgaagaagacatccctagcagagagatgtgcgatcagcagaatgcgttcaccatgtgcccactgtgtgataaaagctgtgactattggaacctaagctccgcgtgtggcacggctcaagcgtcacacctctttgataacccagctacagttttcttttctattttcatggcgctttgggctacaatgttcctagaaaactggaagcgcttgcagatgcggcttggctacttctgggatctcactggcatagaggaagaggaagaacgcgcgcaggagcacagcagacccgaatacgaaaccaaggtcagggagaagatgctcaaggagagcaaccaatcagccgtgcagaaactggaaaccaatactacagagtgtggcgatgaggacgacgaagataaactgacttggaaggatcgcttccctggctacttaatgaacttcgcctctatcttattcatgattgcgctgactttttccatagtcttcggcgtgattgtgtatcggattaccaccgctgcggcactgagcctgaacaaagcaacgcgctccaacgtgcgagtcaccgtgactgcaactgctgtcatcataaacctcgttgtgattctcatcttggacgagatctacggggcagtcgctaaatggttgaccaaaatcgaagtcccgaagaccgagcagactttcgaggagaggctgatcctgaaggcttttctgttaaagttcgtgaacgcttatagcccaatcttctatgtggctttcttcaagggccggttcgtcggccggccaggtagctacgtttatgtgttcgatggctatagaatggaagaatgcgcccctggtggctgcctcatggagttatgcatccagctttccataataatgctgggaaagcagctcatccagaacaacatctttgagatcggggttcccaaacttaaaaagctctttagaaaactgaaggatgaaaccgaggccggggagaccgatagcgcccactcaaagcatccagaacaatgggacctcgactattccttggagccctacacaggtctgacaccggagtacatggaaatgatcatacagtttggcttcgtgactctgtttgttgcatccttccccctggccccagtattcgctctcttaaacaacgtcatcgaggtgcgcctggacgccaagaaatttgtgaccgagctgcgccgtccagacgccgtgcgcactaaggatatagggatatggttcgatatcttgagtggcataggcaagttctctgtcatttctaacgcgtttgtaattgccatcacatccgactttataccaaggctggtctaccagtattcctactcccacaatgggacactgcatggttttgtaaaccacaccctgagcttttttaacgtctcacaacttaaagaggggacacagcctgagaatagtcagtttgaccaggaggttcagttctgccgctttaaggattacagggagcctccatgggctcccaatccctatgaattttcaaaacagtattggtttattctgagcgccaggctcgccttcgttattatctttcagaatttggtaatgtttttgagcgttctagtagattggatgattcctgacatacccactgatatcagtgatcagatcaagaaggaaaagagcttgctggtcgacttttttctgaaagaggagcacgaaaaacttaagttaatggatgagccagccctgagatcaccggggggcggggatcggtccagaagtagggcagcctcaagtgctccctctggccagagccagttaggctccatgatgtcctctggatcacaacatactaatgtatag

SEQ ID NO: 179197 - DNA, 3012 bp, Artificial Sequence
  Description of Artificial Sequence: Synthetic coding sequence
atggccacccccggcccccgggacatccccctgctgcccggcagcccacgcagactgagcccacaggctggctcacgtggtggccagggtccgaaacacggccagcagtgcctcaaaatgcctggaccaagagctccaggcctgcagggtggatccaaccgcgatccagggcagccctgcgggggagaatctacgaggtcctcatcagttattaataattatctcgatgctaacgaacctgtcagtctcgaggctaggttgagcaggatgcactttcacgacagccagagaaaggtagattatgtgttggcgtaccattacagaaaaaggggcgtgcatctggcccagggttttccaggccattctctggccatcgtttcgaacggagagacaggaaaggaaccgcacgccggagggcctggagatattgaactaggaccactggacgccctggaggaagaacgcaaagagcagcgcgaagagtttgagcacaacctgatggaagcaggcttagagttggagaaagatttggagaacaaaagtcagggatccatctttgtaagaattcacgctccctggcaggtgcttgcacgcgaggccgagttcctcaagatcaaggttcccacaaaaaaggagatgtacgaaattaaggcaggaggatctattgcgaagaaattctcagccgcgttgcagaaactgtcctcacacctgcagccaagggtcccggaacattctaacaacaagatgaagaacctaagctacccgttttcccgtgagaaaatgtacctctataacatccaggaaaaagataccttttttgataatgcaactaggagccgaattgtacacgagatactgaagaggactgcatgctccagagcgaacaatacgatgggcataaactctctgattgctaataatatctacgaagccgcttatccactgcacgatggcgagtatgattccccggaagatgacatgaacgacagaaagttgctgtatcaggaatgggcgagatacggcgtgttttataagttccagccaatcgacctcattcggaagtatttcggagaaaaaatcggcctgtatttcgcttggctcggcctgtacacatcctttttaataccaagttcggtgataggcgtgattgttttcctgtatggctgtgccactatcgaggaggatattccgtcccgcgagatgtgcgatcagcagaacgccttcactatgtgccccttatgtgataagagctgtgattactggaacctcagtagtgcctgcgggaccgcccaggcaagtcacttatttgataacccagctacggtctttttctctattttcatggccctctgggctaccatgttcttagagaactggaagcgcttgcaaatgcgcctgggttatttttgggatctgactggtatcgaagaagaggaggaaagagctcaggaacatagccgtccagagtacgaaactaaggtaagagagaagatgctgaaggaatcaaaccagtccgcggtccaaaaattggaaacaaacacaacagaatgtggcgacgaagacgatgaggacaagctgacctggaaggatagattccctggctatctgatgaatttcgcctccatcctcttcatgattgctctcactttctcaatcgtctttggagtgatagtgtacaggatcactacagctgctgctctcagcctcaataaagctacaaggagtaatgtccgcgtgactgttaccgcaaccgccgtcatcatcaacctggtggttatattgatcctcgatgagatttacggggccgtcgccaaatggttgaccaagatcgaagtccccaagactgagcagaccttcgaagagcgcttaattcttaaagccttcctactgaagttcgtgaatgcctacagccctattttttacgttgctttctttaaaggccgtttcgtgggcagacccggcagctatgtgtatgttttcgatggttatcgcatggaagaatgtgcaccaggcggatgtcttatggaactatgtattcagctgtcgataattatgctggggaaacagcttatacagaacaacatcttcgagattggtgtgcccaagctaaagaagctgtttcggaagctgaaggatgagaccgaggcaggtgagactgactcagcccacagtaagcaccccgaacagtgggatcttgactattccctggagccttacactggtctgactcccgaatacatggaaatgattattcagtttggcttcgtcacactgttcgtcgcatcctttccactagcaccggtgttcgccctcctgaacaacgtgatcgaggttagactggacgctaaaaagttcgttactgagttacggcgacctgatgctgtgagaaccaaggacatcggaatctggttcgacattctgtcaggcataggcaaattctccgtgatttctaacgccttcgtgattgccatcacttccgacttcattcctaggctggtctatcagtattcatatagccataatggaaccctgcacgggttcgttaaccacacgctgagcttctttaacgtgagtcaattgaaggagggcactcagccagagaattcccagttcgaccaggaagtgcaattctgtagatttaaagactacagggagcccccttgggcgcctaatccttatgaattttcaaagcagtactggttcattctttccgctagactagcgttcgtcatcatatttcagaatctagttatgtttctgtccgtgctggtggactggatgatacctgacataccgaccgacatttcggaccagatcaagaaagaaaagtcactcctggtggacttctttctgaaagaggagcatgaaaaacttaagctcatggatgaacccgcattgcggtcaccgggcggaggcgaccggagccggtccagggccgctagttctgcccctagcggccagagccaactgggaagcatgatgtccagtggtagtcagcataccaacgtttag

SEQ ID NO: 179198 - DNA, 261 bp, Artificial Sequence
  Description of Artificial Sequence: Synthetic coding sequence
atgttcctgagcgtgctggtggactggatgatccccgacatccccacggacattagtgaccagatcaagaaagagaagtccttgctggtagatttttttcttaaggaagagcacgaaaagttgaaactgatggacgagcctgcgctccgaagccccggggggggggatcgatctcgtagccgagcggcgtccagcgcacccagcggtcaaagccagctgggcagcatgatgtcctctggatcccaacacactaatgtgtag

SEQ ID NO: 179199 - DNA, 3000 bp, Artificial Sequence
  Description of Artificial Sequence: Synthetic coding sequence
atgcccgaggacatccccctgctgcccggcagcccccggcggctgtccccacaggcaggaagcagaggcgggcagggacctaaacacggccagcagtgtttgaagatgcccggaccgcgcgcacccgggcttcaagggggcagcaacagggacccgggacagccctgtggcggggaatcaactcgatcatcctccgtaataaataattatctcgatgctaacgaacccgttagccttgaggctcgcctgagccgtatgcattttcacgattcccagagaaaggttgactatgttctcgcttatcattatcgaaaacgcggcgtccacctcgcccagggtttcccaggccatagcctcgctattgtgtcaaacggcgaaactgggaaggagccacacgctggcggcccaggcgacatagagctggggcccttagacgcgctggaagaggagcggaaggaacagagagaggagtttgagcacaatctgatggaggcaggacttgagttggaaaaggatcttgaaaacaaatcccaggggagcatattcgttagaatccatgccccatggcaggtgctagctagagaagcagaatttctcaagattaaagttcccacgaagaaagagatgtatgaaataaaagccgggggatcaatcgctaagaagtttagcgccgcactccagaagctctcctcgcacctccagccccgagtgcctgagcactccaacaataagatgaagaatctgtcttacccattttcgagggaaaagatgtacctttataacattcaagagaaagatacttttttcgacaacgctacccggagtagaatcgtgcatgaaatcctgaagagaaccgcctgctcaagggccaataacacaatgggtataaattccctaatcgccaataatatttacgaggcagcatatccactgcacgacggagaatatgatagtccagaagatgacatgaatgatcggaaattgttgtatcaagagtgggctcgctatggggtgttctacaagttccagcctatcgatttgattcgaaagtactttggtgaaaagattgggctttatttcgcatggctcgggctgtatacctccttcctgattcccagcagcgtcatcggcgtaatcgtgtttttgtatggctgtgctactattgaagaggacatcccaagccgcgaaatgtgtgatcagcaaaatgcctttaccatgtgccccctgtgtgacaaaagctgcgattactggaacctcagttccgcctgtggaacagctcaggcgtcccatctgttcgataatcccgcaaccgtgtttttttctattttcatggctctgtgggcgacaatgtttttggaaaattggaaacgtctccagatgcgacttgggtacttctgggatctgaccggcatcgaagaagaagagcctcgagtgcaggagcatagtcgtcccgagtatgaaaccaaggtcagagagaagatgctgaaggagagcaatcagtctgctgtgcaaaagctggagacaaacacaacagaatgcggcgatgaagacgacgaggataagctaacttggaaagatagattccctggctacctcatgaacttcgcaagcatactgtttatgatcgccttgactttcagcatagtgttcggggtaattgtctacagaattacaactgctgccgccttgagtctgaacaaggccaccagatccaatgttcgggtcactgtcacagccacagccgtgataataaacctggtcgtcattctcatccttgacgaaatctacggagcagtggcaaagtggctgacaaaaatcgaggtacctaaaaccgagcagacattcgaggaaaggctgatcctgaaggctttcttactaaagttcgtcaatgcttactcacctattttttacgtggcattctttaagggtagattcgtcggtcgcccaggaagctatgtttatgtattcgatgggtacaggatggaagaatgtgctccaggcggatgcctgatggagctttgtatccaactctccattattatgctcgggaaacagctgatacaaaataatatttttgaaatcggcgtgcccaaacttaagaaactgttcagaaaactgaaggacgagactgaggccggcgagaccgactcagcccactccaaacatccggagcagtgggatttagactactctcttgagccttacaccgggcttacccccgagtacatggagatgattatccagtttggctttgtgacactgttcgtagcctcctttccattggcccccgtgtttgccctgctgaacaatgtgatagaagtgcggctcgacgctaaaaaatttgttactgagttaagacggcctgatgctgtaagaaccaaagatattgggatctggtttgacatcctgtccggcataggaaaattctccgtgatttctaacgcattcgtgatagccataaccagcgattttatcccacgtctggtttaccagtacagctattctcacaatggcactcttcatggcttcgtcaaccatacactctcattcttcaatgtgtcccagctgaaagagggtacacagcctgaaaacagtcagtttgaccaagaggtgcagttctgccgcttcaaagactaccgtgagcctccatgggcccccaacccgtacgaattctcaaagcagtactggtttatcctgagtgcacgcctggcttttgtcattatttttcagaatttggtaatgtttctctcagtgctcgtggactggatgatccccgacatcccgacggatatcagcgaccaaatcaagaaggaaaaatccctgttagtggatttctttctcaaagaggagcacgagaagttgaaattaatggatgaacccgcactccggagtcccggcggaggggataggagtcgcagccgagctgcatcctcagctccgagtggccagtctcagctaggctctatgatgtccagtgggagtcagcacaccaatgtttag

SEQ ID NO: 179200 - DNA, 2742 bp, Artificial Sequence
  Description of Artificial Sequence: Synthetic coding sequence
atgggcgaccccgacctgctggaggtgctggccgaggagggcgagaaagtgaacaagcatatagactatagcttccagatgtctgaacaaagtctaagcagtcgagagacctcgttccttatcaatgaggaaacaatgcctgctaagcgatttaatctgttcctcagacggaggctgatgtttcagaagaatcagcagagcaaagactctatcttcttccgcgatggaatccggcagatcgattttgtgctgtcatacgtggatgacgtcaagaaagacgccgaattgaaggctgagagaaggaaggagtttgagacaaacctgagaaagacaggcctggaattggaaatagaggataagcgggattccgaagacggtcgaacttacttcgtgaaaatccacgcaccctgggaggtgctggttacctatgcagaggtgcttggaattaaaatgcccataaaggaaagcgatattcctcggcccaagcatacaccaatctcatacgtgttgggacccgtaaggcttccgctgtcagtgaaatacccacaccccgagtacttcaccgctcagttcagcaggcaccgacaggagttgttcctgattgaagatcaggcgaccttttttcctagctcctctcgcaatcggatcgtatactacatcttaagccgctgcccatttggtattgaggacggcaagaaacggttcggcatcgaacggctgcttaacagcaatacctacagctccgcgtatcctctccatgacggccagtattggaaaccatctgaaccaccaaacccgacgaacgaaaggtataccctgcaccagaattgggcgaggtttagctatttttataaggagcagccgttggaccttatcaagaactattacggcgagaaaatcggcatctatttcgtctttttgggtttctataccgaaatgctgttcttcgccgcggttgtaggactggcctgctttatttacggactcctcagcatggaacacaacacctcttccacagaaatctgtgatccggagatcggagggcagatgatcatgtgccctttgtgtgatcaggtgtgcgattattggcgcctgaatagcacatgtctcgcgtctaaattttcacatctgtttgataacgaatctaccgtctttttcgcgatatttatggggatctgggtaacactatttctcgaattttggaaacaaagacaggcccggctggaatacgagtgggaccttgtggattttgaggaggagcagcagcagctccagctgcggccggaattcgaggcgatgtgcaaacataggaagttgaatgcggtgactaaggaaatggagccctatatgcccctgtatacccgcatcccttggtactttttgtctggcgccacggtgaccctgtggatgagcctcgtggtgacgtctatggtcgcagtgatcgtgtacaggctcagcgtgtttgccacgtttgcgtccttcatggaatccgacgccagcctcaaacaggtgaaatcctttctgaccccacagattacaacttctctgacgggatcatgcctcaacttcatcgtcatcctgatcctcaactttttttacgaaaagatttccgcatggattacgaagatggagatacctcgcacctaccaggagtatgaatccagcctgacgctgaagatgtttttattccagtttgtaaacttttactcatcatgtttttatgtagcgttcttcaaaggaaaattcgtcggctacccaggcaagtacacttacttgtttaatgaatggcgtagcgaagagtgtgatccaggggggtgtctgatcgagttgacaacccagctcacaattataatgacaggaaagcagatatttggaaacatcaaggaggccatatatccacttgctctcaactggtggcgacgtcggaaggcacggactaacagtgagaaattatattcgcgatgggagcaggaccatgatctggagtcctttgggcccctgggtctgttttatgaatatctcgagactgttacccagttcgggtttgtgactttattcgtagcgagcttcccattggctcctctcctggcattaatcaacaacattgtcgaaatcagagtcgacgcctggaaactgactacccaatatcgtcgtaccgtggcgtctaaggcacactccattggcgtttggcaggacatcctttacggaatggcggtgttgtccgtggcgactaacgctttcatagtagctttcacctcagatattattccaagacttgtttattactacgcttactcaactaacgctacacagcctatgacggggtatgtgaacaattccctctccgtttttttaatcgctgacttcccgaaccatactgctccaagcgaaaaacgagacttcattacgtgcaggtaccgcgactaccgctatcccccggacgatgagaataagtatttccacaatatgcagttttggcatgtcttggcagccaagatgacattcattattgttatggagcatgtagtgttcctagtcaagttcctattagcctggatgattccggatgttccgaaggatgtggtagagcgaattaaacgcgagaagttaatgaccatcaagatcctgcatgatttcgaattgaataaattaaaagagaatcttggcataaactctaatgagttcgctaagcatgtcatgatagaggagaataaagcacagctggctaagtcgactttgtag

SEQ ID NO: 179201 - DNA, 2733 bp, Artificial Sequence
  Description of Artificial Sequence: Synthetic coding sequence
atgaagaagatgagccggaacgtgctgctgcagatggaggaggaggaggatgacgatgatggcgacatagtgcttgagaatttaggacagacaatcgtgcctgatctcggttctctggaaagtcagcatgatttccgaacaccagaattcgaggagttcaacgggaaacctgatagcctgttctttaacgatgggcagagaagaattgattttgtgctggtgtacgaggatgagtctaggaaggagacaaataaaaaagggactaacgaaaagcagagacgaaagagacaggcgtacgaaagcaatcttatctgtcacggcttgcagctggaggcaacacgctcggtactggacgataaacttgtatttgtgaaggttcacgcaccttgggaggtcttatgcacatatgccgaaataatgcatatcaagctgccacttaagcctaatgaccttaagaaccgcagctctgctttcggaacattaaattggttcactaaggtgctcagtgtggacgagagtatcatcaagcccgagcaggaattcttcacggctccctttgagaaaaataggatgaacgacttctatatagtggaccgcgatgcattcttcaacccggcaacgcgttccaggatcgtctattttatccttagccgggtgaagtaccaagtgataaacaatgtgtccaaattcggcatcaacaggcttgtgaactctggtatatataaggctgcttttccattgcacgattgcaagtttcgccgtcagagtgaggatccaagctgccccaatgaacgctatttgctatatcgcgaatgggctcacccccgttccatctataaaaaacagccactggacctgatcaggaagtactacggcgagaaaatcggcatttactttgcctggttgggctactatactcaaatgctgctcctggcagccgtggtgggcgttgcttgttttctgtacggctacctcaatcaggacaattgtacctggtccaaagaagtgtgtcaccccgatattggtgggaaaataatcatgtgcccacagtgcgacaggctctgccctttctggaagttgaacatcacatgtgagagttcaaagaaactgtgtatatttgacagttttggcacactggtttttgccgtgttcatgggcgtgtgggtgacactattcctagagttctggaagcgacgtcaagctgagcttgagtacgaatgggatactgtggaactgcagcaggaggaacaggcaaggcccgaatatgaagcccgctgcacccacgtagtgattaatgaaatcacacaagaggaagaacgcatccctttcaccgcttgggggaaatgtattagaatcactctctgcgcctctgccgtgttcttctggatcctgctcatcatcgcgagcgtgattggcatcatcgtgtataggttaagtgtgtttattgtcttcagcgccaaactcccaaagaacattaatggaaccgacccaatccaaaagtacctcactccccagaccgccacttcgataacagcttctattatttcctttattatcatcatgattttgaacacaatctacgagaaggtggccattatgatcacaaattttgaactccctcggacacagacagattatgagaactcattgactatgaagatgttcctttttcagtttgtaaactattactcatcttgtttctatattgcgttcttcaaaggtaagtttgttggataccctggcgatcccgtttattggttaggtaaatatcgcaatgaagaatgcgatccgggtggttgcctccttgagttgacgactcagctgacgatcatcatgggtgggaaggcaatctggaataacattcaagaagtgctgctcccgtggattatgaacctcattggcaggtttcacagggtgtctgggtcggaaaagatcacccctcgttgggagcaggactaccaccttcaaccaatggggaaacttggattgttctacgaatacctggagatgatcatacagttcgggttcgtgacattatttgtggcatcctttcccctggccccccttctcgctctggtgaataacatactcgagatccgggtagatgcctggaagttgacaacccaattccggagattagtgccagagaaagcgcaggatatcggggcttggcaacctataatgcaaggaattgctattttggctgtggttacaaacgccatgatcattgcctttacatccgacatgattccccgtttagtgtactactggtcattctctgttccaccctatggcgatcacacttcatacaccatggaaggatatatcaacaacacattaagtatattcaaggtcgccgatttcaaaaataaaagtaaaggcaacccttactccgacctgggtaatcacacaacttgtagataccgcgactttagatacccaccaggccacccacaggagtataagcataatatctattactggcacgtaattgctgctaagttagcatttataatagtgatggaacatgttatctattcagtgaagtttttcatctcttatgctattcctgacgtcagcaaacgcactaagtctaaaatccagcgggaaaagtacttgacccaaaaattgctccatgagaatcacctgaaggatatgaccaagaacatgggggtgatagccgagcgtatgatcgaggctgtcgacaataacctcagacctaagtcggagtag

SEQ ID NO: 179202 - DNA, 2790 bp, Artificial Sequence
  Description of Artificial Sequence: Synthetic coding sequence
atgaagaagatgagccggaacgtgctgctgcagatggaggaggaggaagatgacgatgacggcgatattgtgcttgagaacttaggccagactattgtgccagatctcgggtcactggagagccagcacgactttaggacgcccgaattcgaggaatttaatggaaagccggatagcctattcttcaatgacggccagcggagaattgattttgtgctggtgtacgaggatgagagtcgcaaggaaacaaacaaaaaaggcaccaatgagaaacaacgccgcaaaagacaagcatatgagagcaatctcatctgccatgggttgcaactcgaggccactcggtcggtgctggacgacaaactcgtgttcgttaaagtgcacgccccatgggaagtcctctgtacttatgccgagatcatgcacatcaaacttccgctcaagcccaatgatctaaaaaaccgcagttcagcttttggcacactcaattggttcaccaaagtgctcagtgtcgacgaatcgatcatcaagcctgagcaggagttcttcacggcgccttttgagaaaaatcgcatgaacgatttttatattgtcgacagagatgccttcttcaaccccgcaaccagatctcggatcgtgtacttcatattgagtagagtgaagtatcaggtgattaataatgtcagcaaatttggtatcaaccgtctggtgaactccggcatctacaaagcagctttcccacttcacgattgcaagtttcgccgtcagtctgaagacccatcatgtccgaatgagcgctacctcctctatagagaatgggcgcatcccaggtcaatttataagaagcagcccctcgatctcattcgcaaatattacggcgagaaaatcgggatctacttcgcctggttgggctattatacgcagatgctgttgctggccgccgtagtgggagttgcttgtttcctgtacggttatctgaatcaagacaactgtacttggagcaaggaggtttgtcatccagatattgggggcaaaattatcatgtgtccccaatgcgataggctatgtccattctggaaactgaatatcacatgtgagagttctaaaaagctctgcatttttgactcctttgggacgctcgtctttgcagtatttatgggagtgtgggtcactctgtttcttgaattctggaagaggcgccaggccgagctggagtacgaatgggataccgtggaattgcagcaggaagagcaggcacgtccggagtacgaagcacgttgcacgcacgtcgtcatcaacgagataacccaagaagaggaacgaatcccattcacagcctgggggaagtgcattagaatcactttatgcgctagtgccgtgttcttttggatcctgctgattattgcgagcgttatcggtatcattgtataccgcctctccgtgttcatcgtgttcagcgctaaattacccaaaaacataaatggcactgaccctatccagaaatacctgacgccccagaccgctaccagtataactgcgtcaataatttcttttatcatcattatgatattgaatactatttacgagaaagttgctataatgatcacaaacttcgagttgccaaggacacagacagactacgagaactcactgaccatgaagatgtttctgttccagttcgtgaactattattcaagctgtttttatatcgcatttttcaagggaaagttcgtcggatatccgggcgacccagtctattggctcggcaagtatcgaaacgaggagtgcgacccaggtggctgcctcctggagcttactacgcagctgacaattatcatgggcgggaaagctatatggaacaatatccaggaagtgcttctgccttggatcatgaacctgataggtagatttcatcgggtgtccggcagtgagaaaatcaccccgagatgggagcaggattaccatctgcagcccatgggtaaacttggtcttttctatgaatacctcgaaatgatcattcagtttgggttcgtgaccctctttgtggcttcttttccactggcacctctcctggcactggtgaacaatatcttggagatcagagtcgatgcatggaagcttacgacccagttcagaaggctagtcccagaaaaagcacaggacatcggggcctggcagccaattatgcaaggcatcgcaattctggccgtggtgacaaacgccatgatcatcgctttcacaagtgacatgataccccgactcgtatactattggtctttctctgttcctccttacggtgaccacacatcatatacaatggagggttacattaataacaccctcagcatttttaaggtagccgactttaaaaacaaatccaagggcaacccatacagcgatctagggaatcacaccacatgcagatacagagattttcgatatcctcccgggcacccacaggagtataagcacaacatctattattggcacgtgatcgcagcaaagctcgcctttataattgtgatggaatacctcgcactcctacctcgcttgggtcattctggtatgatcttggcccattgcaatctccgtttacctgttgactgttgtatgtgctatcgatttgtcgacgagattaggctgctggagcagctaacttccgacttcatagattcactctactacatctttagcatctccataataagtatttttttctctgtcacctttttcttcctcctgcttagcctggggcccactccttgtttttctgtttctaactttctgtcctag

SEQ ID NO: 179203 - DNA, 2790 bp, Artificial Sequence
  Description of Artificial Sequence: Synthetic coding sequence
atgaagaagatgagccggaacgtgctgctgcagatggaggaggaggaagacgatgatgatggcgatatagttctcgagaatctgggccagaccatcgtgcccgatttaggatctctggagtcacagcatgactttcgaacaccagaatttgaggaatttaacggaaaaccggattcacttttctttaacgatggacagcgcagaatcgacttcgtgttagtgtatgaggacgagagtcgtaaagagacaaacaagaagggcaccaatgagaagcaacgccggaaacgacaagcttacgagagcaacctaatctgtcacgggctgcaattagaggccactcgttcagtgttggacgataaattggtgttcgttaaggtacatgccccttgggaagtgctgtgtacgtacgcagaaataatgcacataaagttaccgctgaaacccaatgacctcaagaaccgtagcagtgctttcgggactcttaattggtttacaaaagtgctcagcgtggatgagagtattatcaaaccagagcaagaatttttcaccgccccgtttgagaaaaacaggatgaacgatttttacattgttgatcgcgacgcatttttcaatcccgccacccgctctagaatcgtatatttcatcttatctcgcgttaaataccaggtcattaataacgtaagtaagttcggaattaacaggctggtgaactcgggcatttacaaggctgcttttcctttgcatgactgtaaatttcgacgccagtctgaagacccttcttgtcctaacgaaagatatctgttgtaccgtgagtgggcccaccctaggtcaatctataagaaacaacccctggacttgattcgaaagtactatggcgagaaaatcggtatctacttcgcatggttggggtattacacacaaatgttactgctagcggccgtagtcggagttgcttgttttctgtatggctacctcaaccaggataattgcacgtggtctaaagaggtttgccatcctgacattggaggaaagattatcatgtgcccccagtgcgaccgattgtgtccattttggaaattgaacatcacatgcgagagctctaaaaaactttgtatcttcgacagctttggaactctggtttttgccgtgtttatgggggtgtgggtgactctgttcctggagttctggaagagacggcaggctgagcttgagtacgaatgggacacagtggagctgcagcaagaagagcaggccaggcccgagtatgaagctagatgtacccatgttgtgatcaatgagatcactcaagaagaggagcgcatccctttcaccgcatgggggaagtgcatccggataaccttgtgcgcaagcgcagtctttttctggatactgttaatcattgcatcagtgattgggattatcgtgtatagactgagcgtgtttatcgttttttctgctaagctccccaagaacatcaatggtactgaccccatccagaaatacctgactccacagactgccacttccataacggccagcatcatctccttcatcattattatgattctgaacacaatttacgaaaaagtggcgatcatgattaccaatttcgaacttccccgtacccagacggactacgagaacagcctgacaatgaagatgtttctgttccagttcgtgaattattacagcagctgtttctatattgcttttttcaaaggcaagttcgtggggtatcctggggatcctgtgtattggctcgggaaataccgtaacgaagaatgtgaccccgggggatgtctacttgaactgactacacagctcaccatcattatgggtggtaaagcaatctggaataatattcaggaagtcctgcttccttggatcatgaatctcattgggagattccaccgagtgtccggatcagagaaaataacccctaggtgggagcaggactaccatctccagcctatggggaagctgggcttattttatgagtatttagagatgatcatccaatttggcttcgtcaccttatttgtcgctagttttccactggccccccttttagccctagttaacaacattctggaaatacgcgttgatgcttggaagctcaccacccagtttaggagattggttcccgaaaaagcccaggatattggcgcttggcagccaatcatgcagggcatcgcaatcctagccgttgtgactaatgccatgataattgcttttacttcggacatgattccacgtcttgtttactattggtcctttagtgtgccaccctacggcgaccatacatcctacaccatggagggttatatcaacaatacactgtcaatcttcaaggtcgccgatttcaaaaataaatcgaagggcaacccttatagtgacctcggcaaccacacaacgtgtagatatagggacttcaggtatcctcccggccacccgcaggaatacaagcataacatttactactggcatgtaatcgccgctaagctggcttttattattgtgatggagtatctggcactattgccgagactgggacacagcgggatgattctagctcattgcaacctgcgtctgcctgtggactgttgtatgtgctatcggttcgtcgatgaaatccgtctcctagagcaactaacgagcgactttatcgatagtctttactacattttttctatcagcatcatctcaatttttttctctgtcactttcttttttctactcctgtcccttggccctactccatgtttttctgtgtcaaatttccttagctag

SEQ ID NO: 179204 - DNA, 2679 bp, Artificial Sequence
  Description of Artificial Sequence: Synthetic coding sequence
atgttctgcgccgccgtgctggagaacctgggccagaccatcgtgccagatctaggtagccttgagtcccagcacgactttcggacaccagagtttgaagaattcaatggaaagcccgattcattattttttaatgatggccagagacggatcgattttgtgcttgtctacgaggacgaatcccgaaaagagactaacaaaaagggcacgaatgaaaagcaaagaagaaagcgacaggcttatgaaagcaacctcatttgtcatggcctgcagcttgaggctactagaagcgtcctcgacgataagctcgtattcgtgaaggtccacgccccatgggaagtgttgtgtacctatgcagaaatcatgcatatcaaattacctctgaaacccaatgacctcaaaaatcggagtagcgcattcgggacccttaactggtttacaaaagtgctgagtgtggatgaatccattatcaaacctgaacaggagtttttcaccgcaccttttgaaaaaaaccgcatgaacgacttctatattgtggacagagacgcctttttcaacccagctacaaggtcccggatagtctacttcattctatctagggtgaaatatcaggtgattaataacgtctctaaatttggaattaaccggctggtcaatagcggaatttataaggcagcgtttcctttgcacgactgtaagtttaggcggcaatcagaggacccatcttgccccaacgagcggtatcttctgtacagagaatgggcccacccacgatcaatttataaaaaacagccactggatctcatccgaaaatattacggagagaaaatcggtatttacttcgcttggctgggctattatacacagatgctgttgctggcagcggtggttggcgtcgcttgcttcctgtatgggtatctcaaccaggacaactgcacatggtcaaaagaagtctgtcacccagacataggcgggaagatcatcatgtgcccgcagtgcgacagattatgccctttctggaaactgaatataacttgcgaaagctctaagaagctatgtatcttcgacagcttcggaacgctggtcttcgcggttttcatgggagtgtgggttacccttttcctcgagttctggaaaaggaggcaggcagaactggagtacgagtgggacaccgtagagttgcagcaggaagagcaggcaaggcctgaatatgaggcccgttgtactcacgtcgttatcaacgagattacccaagaagaggaacggatccctttcacagcatggggaaagtgcatcaggatcaccctctgcgcaagcgcggtgttcttctggattcttcttatcatcgcctctgttatcggaatcatcgtctaccgcctgtcggtgttcatcgtgtttagcgctaagctgccaaaaaacattaatggcaccgacccgattcagaagtatctgaccccccagacagccactagtattacggccagcattatctctttcatcataattatgattctcaatacaatttacgagaaagtagctataatgattacaaacttcgaactcccgcgaacacagaccgactatgagaatagtctgaccatgaaaatgttcctctttcagtttgtgaattactactcaagctgtttctacatcgcgttctttaaaggaaagtttgtgggatatcccggggacccagtatactggctgggtaaataccggaacgaggaatgcgatcctggaggctgcctgctcgagttaactacccagctgaccataatcatgggcggaaaagctatttggaataatattcaagaagtgctactcccctggataatgaaccttatcgggcgctttcatcgggtgagcggctccgagaaaatcacccctagatgggaacaggattaccatcttcagccaatgggaaaactgggcctcttttacgaataccttgagatgattatccaattcggattcgttactctgttcgtcgcaagttttccccttgccccgcttcttgccttggtgaacaacatactggaaattagagtagatgcctggaaactcacaacacagtttaggaggttggtgccggagaaggcccaggacatcggcgcttggcaacccataatgcagggaatcgcaattctggccgtagtcaccaacgccatgattatcgccttcactagcgacatgattccaagactagtgtactactggtccttcagcgtcccgccctatggggatcacacctcctataccatggagggttacatcaataacactttgtctatatttaaggtggccgactttaaaaataagtccaagggtaacccttatagcgacctggggaaccacacaacttgcaggtatcgagatttccggtatccaccaggccatccacaggagtataagcataatatatattactggcacgttatcgctgctaagctcgcgtttattatagtcatggaacacgttatttactcagtgaagttctttatctcttacgccatacctgatgtcagcaaaagaaccaagagcaagatccagcgggaaaagtatttaactcagaaactactgcacgagaaccatctgaaagatatgaccaagaacatgggcgtgatcgccgagcggatgattgaggctgtagacaacaatctgagaccaaagtcggaatag

SEQ ID NO: 179205 - DNA, 2796 bp, Artificial Sequence
  Description of Artificial Sequence: Synthetic coding sequence
atgaagaagatgagccggaacgtgctgctgcagatggaggaggaggaggacgatgacgatggtgacattggcgatgtacctgcttcaaggcgaccttttttgaccccgcacacccacctgcccagttccttggtgcttgaaaacttgggtcagacaatcgtgccggacctcggaagcctcgagagccagcatgacttcagaacaccagagtttgaagaattcaatgggaagcccgatagcctcttttttaacgacggtcaacgtaggatcgatttcgtgctggtgtacgaggatgagtcaaggaaggaaactaataaaaaaggaactaacgaaaagcagcgccgcaaacgacaagcgtacgagagtaatctgatttgccacggactgcagcttgaggcaacacgcagcgttttggacgacaagctggtcttcgtgaaagtgcacgccccctgggaagtgctttgcacctacgctgagatcatgcatatcaaactgcccttaaaacccaacgacttaaaaaacaggtctagcgctttcggaactttgaattggttcaccaaggttctttccgtggatgaatctattattaagccggaacaggagtttttcaccgcaccctttgagaagaatagaatgaatgacttctatattgtggaccgggatgcattcttcaatccagcaacccggtcaagaatagtgtatttcatcctgtccagggtcaaataccaggttataaataatgtgagcaagttcgggatcaatagactcgtgaacagcggaatatacaaagcggcattcccattacacgattgcaaattcagacgccagtcagaggatcctagttgcccgaacgaacggtacttactgtatcgagagtgggctcacccgaggtcgatatacaagaaacagcccctcgacctgattaggaaatattatggggagaagattggtatttacttcgcatggctggggtattacacccagatgttactgctcgccgcagttgttggagtcgcgtgctttctgtacggttaccttaaccaggacaattgcacttggtcaaaagaggtgtgtcatcctgacattggaggaaaaattatcatgtgtccccagtgcgaccgtttgtgtcctttttggaaacttaacatcacctgcgagagtagtaagaagctatgcattttcgactccttcggtaccctggtcttcgcagttttcatgggggtgtgggtgactttattccttgaattttggaaacggagacaggccgagctcgagtatgaatgggatacagttgagctccagcaggaagaacaggccaggcctgagtatgaggcacgatgcacacacgtcgtgattaatgagattactcaagaggaagaacggattccctttactgcttggggtaagtgcattcgcattaccctgtgcgcctcggctgtgttcttttggattctgctaatcattgccagcgtgatcgggataatcgtctaccgcctatctgtcttcattgtcttctcagcaaagctccctaagaacattaacggtaccgatcctatccagaagtaccttacccctcagacggccacttctatcaccgcaagcatcatctcctttatcataattatgattctcaatactatctacgagaaggtcgccattatgattacaaatttcgaacttccaaggacacagacagattacgagaactcactcacgatgaagatgttcctgttccagttcgtgaactattattccagctgcttttacatcgcatttttcaaaggtaagtttgtcggatatccgggggacccagtctattggttgggcaaatacaggaacgaagaatgtgaccccggcgggtgtctcttagaactgacaacccagctgacaatcattatgggcggcaaggccatctggaacaacatccaggaagtgctcctgccttggataatgaacctaatcggacgcttccaccgcgtatcagggtccgaaaagatcaccccccgttgggaacaggattaccatctgcagccaatgggaaaattgggtctgttttacgagtacctggaaatgattatccagtttggtttcgtgacgctttttgtggcctcctttccattggccccactgctcgccctcgtgaataatatcctcgagattagagtggacgcgtggaaactaaccacccagtttcgccgtcttgtgccggaaaaggcccaagatattggagcctggcagcccataatgcagggtattgccatccttgctgtggtgaccaacgccatgattattgcctttacctccgacatgattcccagacttgtttattactggagcttcagcgtcccaccatacggcgatcacacatcatacaccatggagggatacattaataatacactgagcatcttcaaagtcgcagattttaagaacaaatctaaggggaatccttatagcgatctcggaaatcacacgacatgtcggtacagggatttcagataccctcctggccacccacaagaatacaagcacaacatctattactggcacgtgattgccgccaagttggccttcattattgtcatggaacacgtcatttatagtgtgaagttcttcatctcctacgccatccccgacgtcagcaagcgcacgaaaagcaagattcagagagagaaatatctcactcaaaagttgcttcacgagaatcatctcaaagatatgacaaaaaacatgggggtaatcgccgaaaggatgattgaggctgtcgataataaccttcggcctaagagcgagtag

SEQ ID NO: 179206 - DNA, 501 bp, Artificial Sequence
  Description of Artificial Sequence: Synthetic coding sequence
atgatgctgcacagcgccctgggcctgtgcctgctgctggtgaccgtgtcttccaatctggctatagcaatcaaaaaggaaaagagaccacctcagacgttatctcgcggatggggggatgacatcacctgggtccaaacctatgaagaaggactgttctacgcccagaaatccaaaaaacccctgatggtcattcatcacttagaagattgccagtacagccaggctttgaagaaggtgtttgcgcagaatgaagagatccaggagatggctcagaacaagtttatcatgttaaacttaatgcacgaaactactgataaaaacctgtcaccagatggccagtacgtaccacggataatgttcgttgacccttccctaactgtgcgcgctgacattgccgggcgatactctaatcgcttatatacctatgagccacgggacctgcctctgctaatcgaaaatatgaaaaaggccttgcgactgattcagtccgaactgtag

SEQ ID NO: 179207 - DNA, 453 bp, Artificial Sequence
  Description of Artificial Sequence: Synthetic coding sequence
atgggcgccgccgtgttcttcggctgcaccttcgtggccttcggccctgcatttgcgctttttttaatcaccgtggctggtgaccccctccgcgtaatcatcctcgtggcagggaaggcagatgagggactagccagcctgtcagaagacggcagatctcccatcagcattcgccagatggcctacgtgtctggcttgtctttcggcattatctcaggagtcttctcagtgattaacatactagccgacgccctgggaccaggagtcgtgggaattcatggtgacagcccttattattttctgacaagcgcattcctgactgccgccatcattctcctgcacacattttggggcgtggtgttcttcgatgcgtgtgagcgcaggcgctattgggcactcggactggttgtgggatcccatcttctgacatctggtctgaccttcctgaattag

SEQ ID NO: 179208 - DNA, 744 bp, Artificial Sequence
  Description of Artificial Sequence: Synthetic coding sequence
atgggcgccgccgtgttcttcggctgcaccttcgtggccttcggcccagccttcgccttgttcctaatcactgtagccggcgaccccctccgcgttattatattggtcgccggcgctttcttttggttggtgtctcttctgttggcttcagtagtgtggtttatcctggtgcacgtgaccgaccggtccgatgctaggctccaatatggcctactaatcttcggagccgccgttagcgttctgctgcaggaagtatttaggttcgcctattacaagctgctcaagaaggccgacgaagggctagcctccttgagtgaagatggaaggtctcccatcagtattcggcagatggcttacgtgtcaggcttaagcttcggaattatctccggggttttcagtgtcattaacattttagctgacgcattgggaccaggcgtcgttggcattcatggcgattccccttactattttctgacatcagcatttctcacggcagcaattatactccttcacaccttttggggagtagtcttcttcgatgcgtgcgagcgccggcgttactgggccctggggcttgtggtgggttctcatttactaacctctggcttaacttttctcaatccgtggtacgaggcctctttactgcccatctacgccgtgacagtgtctatgggcctgtgggctttcattacagcaggcggctccctgcgatccatccaacggagcctcttgtgcaaggattag

SEQ ID NO: 179209 - DNA, 798 bp, Artificial Sequence
  Description of Artificial Sequence: Synthetic coding sequence
atgggcgccgccgtgttcttcggctgcaccttcgtggccttcggcccagccttcgcgctcttccttatcactgtggcgggggatcccttaagagtgattatactcgttgcgggagcttttttttggctggtgagcctgcttttagcttcagtcgtttggttcattctcgttcacgttacggatcgctccgacgctcgactccagtatgggctccttatcttcggagccgccgtgagtgtcctgctccaggaggtgttccgatttgcctattataagcttttgaaaaaagccgacgaaggcctggcatcactctccgaagacggccggtcccccatttccattaggcagatggcttatgtctccggcctgtcgttcggcataatcagtggtgtttttagtgtgataaatatactggccgacgccctgggcccaggggtggtgggaattcacggggattcaccctactactttctgaccagcgcattcctgacagccgctattattctcctccacacgttctggggtgtagtcttctttgatgcttgtgaacgacggcggtattgggcactgggcctggttgttggttcccacttactcaccagcggcctcacgttcctaaatccgtggtacgaggctagcctgttacccatatacgccgtgaccgtgagtatgggcctctgggctttcattacggcaggaggcagcctaaggtcgatccagcgtagtttactgtgccggagacaagaagattctcgggtgatggtttacagtgccctcagaataccccccgaggactag

SEQ ID NO: 179210 - DNA, 588 bp, Artificial Sequence
  Description of Artificial Sequence: Synthetic coding sequence
atgggcgccgccgtgttcttcggctgcaccttcgtggccttcggccccgcatttgccttgtttctaatcaccgtcgccggcgaccctctgcgggtgattatccttgtggccggaaggtgcagcgctctgccgacaacctcttgcctgatcagcggcctgagtttcggaataatttccggcgtgttcagcgtcattaacatactagcagacgccctggggcccggagtagtgggaatccatggcgactcaccgtattatttcctgacatccgcgtttctgacagccgccatcatactcctccataccttctggggcgtggtgttttttgatgcgtgtgagcggcggcgctattgggcacttggccttgtcgtcggcagtcatcttctgactagcggactgacattcctgaacccttggtacgaagcctctctgctgcccatatacgcggtgacagtctcaatggggctgtgggcgtttattacagcgggtgggagccttaggagcatccagcgctccctcttatgtagaaggcaggaggattcaagagtaatggtttactccgccttgcgaatacctccagaggactag

SEQ ID NO: 179211 - DNA, 774 bp, Artificial Sequence
  Description of Artificial Sequence: Synthetic coding sequence
atgaccgccgccgtgttcttcggctgcgccttcatcgccttcggcccagccctggcactctacgtgttcaccatagcaaccgaaccgctgcgtatcatattcctgattgccggcgcatttttttggcttgtctccctcttgatctcatctcttgtctggtttatggcacgggtgatcatcgacaacaaagacggccctacccagaaatatttgctcatcttcggggcattcgtgtccgtgtacattcaggagatgttccgattcgcgtactacaagctgctgaaaaaagcgagcgaaggccttaagtcaatcaacccaggagagaccgcccctagtatgagactgctggcctacgtcagcgggcttgggttcggaatcatgagcggagtattcagtttcgttaacacgctgtccgattcattagggcccggcactgtgggaatccatggcgattccccgcagttttttttgtattctgcatttatgactttagtgattatcctgctgcacgtgttctggggaattgtcttcttcgacggctgtgagaagaagaagtggggcattctcttgattgttttgctcacccatcttctggtgtctgcccaaacattcatctctagctactacggaatcaatttagcgagtgcgttcatcattctggttttaatgggcacctgggcttttctggccgccggtggatcttgcagaagcttaaagctgtgcttactgtgtcaggacaagaatttcctgctgtacaaccagagatcccgatag

SEQ ID NO: 179212 - DNA, 246 bp, Artificial Sequence
  Description of Artificial Sequence: Synthetic coding sequence
atgaccgccgccgtgttcttcggctgcgccttcatcgccttcggccctgctttagctttatacgtgtttacaatcgccactgaacctcttcggattatcttcctgatagctggtaggcgagtggaaacctgcaagaacaccgaagctcccgactgtgccagtccctcagggtcactctcctttctgctggttggggtgagcaccgacttcgtgccctgtctggtacacggtaagagccactattag

SEQ ID NO: 179213 - DNA, 651 bp, Artificial Sequence
  Description of Artificial Sequence: Synthetic coding sequence
atgaccgccgccgtgttcttcggctgcgccttcatcgccttcggccctgcccttgccttgtacgtttttacaattgcaacagaacccctgcgtatcatatttcttatcgccggcgcatttttctggttggtaagcctgttgattagctctctggtgtggttcatggctcgcgtgattatcgacaacaaggatggccctactcagaaatacttgcttattttcggggctttcgtgtccgtgtacatccaggaaatgttccggtttgcttactataaactcctgaagaaggcgtcggaaggattaaaaagtattaatcctggcgaaaccgccccctctatgaggctcttagcttatgctttcatgaccctagtcatcatcctgctccatgtattttgggggattgtgttctttgacggatgcgagaaaaaaaaatgggggattctccttattgttctgctgacgcacctcctggtgtcggcacagaccttcatatcgtcctactacgggatcaacttggccagtgcttttattattctggtgcttatgggaacatgggcgttcctcgccgctggtgggtcctgtcggtcccttaaactttgtctgctgtgccaagataaaaatttcctgttgtacaatcagcgatccaggtag

SEQ ID NO: 179214 - DNA, 1695 bp, Artificial Sequence
  Description of Artificial Sequence: Synthetic coding sequence
atggccaccgccgagcggcgggccctgggcatcggcttccagtggctttctttggccacccttgtgttgatctgtgctggacagggcgggaggcgggaggatgggggaccagcatgttacggagggttcgacctgtatttcatactggataaatccggcagtgtattgcaccattggaacgagatatactacttcgtggaacagctcgctcataaatttatttcaccccagctgcgcatgtccttcatagtgttcagtacacggggtaccacactgatgaagctgacagaagacagagaacagatccgccagggcttggaggagctgcagaaagtactacctggcggcgatacatacatgcacgaggggttcgagcgcgcaagtgagcagatatactacgagaatagacagggctaccgcacagcctcagtgataatcgccctaaccgacggcgaattacacgaagacttgttcttttatagcgagcgagaagctaacaggagtagagaccttggggctatcgtgtactgcgttggtgtgaaagactttaatgaaacacagttggccagaatagccgattcaaaggatcacgtgtttcccgttaatgatggtttccaggcactccagggaataattcactcgatcctgaagaagagctgtattgagattctggcagctgagccctccacaatttgcgcaggcgagtcattccaggttgtcgtcagggggaacggcttccgacatgcaaggaatgtggatcgtgtgctctgctcttttaagatcaatgatagtgtaaccctaaacgagaaacctttctcagtcgaggacacatatctgctttgtcctgcaccaatcctgaaggaagtggggatgaaagcggctctccaggtgtccatgaacgatggattgtctttcatctcgtcatcagttataattacaactacacactgcagcgacggaagcattttggccatcgcgctcctcatcctgtttctcctccttgcgcttgccctgctttggtggttctggcctttgtgttgcaccgtaatcataaaagaggtgccacccccaccggcggaggaatcggaagaggaagatgacgacgggctccctaagaagaaatggccaactgtggacgcctcctactacggtggacgtggtgtcggtggcattaaaagaatggaagtgcgttggggagagaaggggtcaaccgaagagggcgccaagttggagaaagctaagaacgcccgtgtgaagatgccggagcaagaatatgagttccctgaaccgcgaaatctgaacaataacatgaggcggccaagtagtcccagaaagtggtactcccccatcaagggcaaactagacgctctgtgggttctactgaggaaaggctatgacagagtatcagtcatgcgtccccaacccggggacaccggccgttgcattaacttcactcgagtgaaaaacaaccagcctgctaaatacccgctcaataacgcataccacacctccagccctccgccggctccaatatatactccgcctccacctgcgccgcattgcccccctccaccccctagcgctcctacacccccgattccctcaccaccctctactcttcctccgcctccccaggccccacctccgaatagggctcctcccccgtctcgcccccctccacgtccatcagtatag

SEQ ID NO: 179215 - DNA, 1107 bp, Artificial Sequence
  Description of Artificial Sequence: Synthetic coding sequence
atggccaccgccgagcggcgggccctgggcatcggcttccagtggctctcactagcaacattggtgcttatctgcgccggtcagggtggccgtcgcgaggatggaggtccagcgtgctatgggggttttgacctgtattttattttggataaatcgggaagcgtcctccaccactggaatgagatatattattttgtcgagcaattagctcataaatttatctcaccacagctgaggatgtcatttatcgtgttctctacccggggtaccacgctgatgaagctcactgaggatcgggaacaaattcggcagggcctggaagaactgcagaaggtgctgcctggtggtgatacctatatgcacgaaggctttgaacgtgcctctgaacagatctactacgagaacaggcaaggctacaggaccgcatctgttatcatcgctctgacagatggcgaattgcatgaagatctgtttttctatagcgagagagaagccaatcggagtcgtgatctgggggctattgtgtactgcgttggggtgaaagatttcaatgagacacagctggcacgaattgctgactctaaagatcatgtgtttcctgtaaacgacgggttccaggcgctgcagggcattattcactccattctgaagaagtcttgcatcgagatcttagcagctgagccctctactatctgcgcaggagagagcttccaggtcgtggtcagaggcaatggcttccgccacgcccgcaacgtggaccgcgtcctctgcagctttaaaataaatgattcagtgaccttgaacgagaagcctttcagcgtagaggatacgtacctcctctgcccagccccaattcttaaggaggtcggcatgaaagccgccttacaagtctccatgaatgatgggctcagcttcatcagcagctccgtaataattaccacgacacattgcagcgacggttctattctggcaatagcactgctcattctgttcctgctgctcgcattggcgctgctgtggtggttctggcctttgtgttgtaccgtgattattaaagaggtgcctcccccgcctgccgaagagagcgaagaaaacaaaatcaaatag

SEQ ID NO: 179216 - DNA, 1002 bp, Artificial Sequence
  Description of Artificial Sequence: Synthetic coding sequence
atggccaccgccgagcggcgggccctgggcatcggcttccagtggcttagtctggcgacactggtactcatttgtgccgggcaggggggccggcgagaagatggagggccggcctgctacggtggcttcgatctgtactttatcctggacaaaagcgggagcgttctccaccactggaacgagatttactacttcgtggagcagctcgctcacaaatttatatcaccacagctacggatgtcttttattgtattttccacaagagggaccacacttatgaagttaaccgaggatagagagcagattcgccagggcttggaggagctccagaaggtcctcccaggcggagacacttacatgcacgagggcttcgagagggcatctgagcaaatctactatgaaaacagacaaggctaccgtaccgcttcagtgattatcgcactgacagatggagaactacacgaagacctctttttctactccgaacgtgaagctaatagatcacgcgacctcggtgcaattgtctattgcgtcggcgtaaaagattttaacgagacgcagcttgcccgcatcgctgactctaaggaccacgtctttccagtgaacgacggttttcaggccctccagggcatcattcattcgattctgaaaaagtcctgcattgagatcctcgccgctgagcctagcacaatctgtgccggagagagtttccaggtagtggtacgaggtaacggcttccggcatgctaggaatgtggatagagtcctctgctcctttaagattaacgattccgtcacactgaatgagaagccgttcagtgtcgaggacacctatttactgtgtccagcccctattctgaaagaggtgggcatgaaagccgccctccaagtgtccatgaatgatggtcttagctttatctcaagcagcgtgatcatcactaccacacattgctctcttcacaagatcgcttctggtcctactactgctgcatgtatggagtag

SEQ ID NO: 179217 - DNA, 969 bp, Artificial Sequence
  Description of Artificial Sequence: Synthetic coding sequence
atggtggccgagcggagccccgcccggagccccggcagctggctgttccccggcctatggttgctcgtgctttccgggccgggtggtctactgcgagctcaggaacaaccaagctgccggagggcattcgatctgtacttcgtcctggacaagtcaggctccgtggccaataactggatagagatctacaatttcgttcagcaactggccgagcgctttgtcagccccgaaatgcgcctgtcctttatcgtcttctcatctcaggctacaatcatcctgcctctgaccggagatcggggtaagatcagtaaaggactggaagatctgaagcgcgtttcaccggttggagaaacatacatacatgaaggtttgaagctggcgaacgagcagatccagaaggccggcggcttaaaaacgagcagtatcataatcgccctgacagacggcaagctcgatggcctggtacctagctacgccgaaaaagaggccaagatatctagatcactgggggccagtgtgtattgtgtgggtgtcctcgacttcgagcaggcccagcttgagcgcatcgctgacagcaaagagcaggtgtttccagtgaaaggggggtttcaggctcttaagggaatcattaattccatacttgcccagagctgcaccgaaatcctggaactgcagccgagcagcgtctgtgtgggagaggagtttcagattgtactgtctggccggggatttatgttgggatcacggaatggatccgtcctctgcacttacaccgtcaacgagacatacacgacatcagtcaaaccggtctcagtgcagcttaactctatgctgtgccctgctcccatactgaacaaggctggtgagtggggacttacagttacacaggcaggagttaagtggcacgacctcacgcactgcacttttggtctatcaggtagcggtgacccccccacctctgcatcatag

SEQ ID NO: 179218 - DNA, 1470 bp, Artificial Sequence
  Description of Artificial Sequence: Synthetic coding sequence
atggtggccgagcggagccccgcccggagccccggcagctggctgtttcccggtctgtggctgttggtgctgtccggacctggaggcctgctgcgggcccaagaacagcccagctgccggcgggccttcgatctgtacttcgtgctggacaaatccggctcagtggctaataactggatcgagatttataatttcgtgcaacaattggctgagagattcgtgtcaccagaaatgaggctgtctttcattgtgttttcctcgcaggccacaataatcctgcccttaacaggagatcgaggcaagatttcaaaggggctggaagatctgaagcgcgtttcccctgtcggcgaaacatacattcacgaggggcttaagctggccaatgagcagattcagaaagccgggggtttgaaaacgtccagcatcatcatcgcgttgacagatggaaagttagatgggttagtgccgtcctacgccgagaaggaggcaaaaatttccaggtccttgggtgctagcgtctattgtgtgggtgtgctcgacttcgagcaggcccagcttgaaaggattgccgactctaaggagcaggtctttcccgttaaagggggatttcaagcacttaaaggtattattaatagcatcctggcccagagctgtaccgagatcttagaactgcagccctccagcgtgtgcgtcggtgaggaattccaaatcgtcctttcagggcgcgggttcatgcttggatcgagaaacgggtctgtgttgtgcacatacactgtaaatgagacgtatacgacgtctgtcaagccagtgtctgtgcagctgaattccatgctgtgtcccgcgcccatcctgaacaaggccggggagacactggatgttagcgtgtcttttaacggcggtaaaagcgtcatctcaggtagtctgatcgttactgctaccgaatgttcgaacggcatagcagctataatcgtcatactggttctgcttctgctgttgggcatcggactgatgtggtggttctggccattatgttgtaaagtcgtaataaaggatcccccgcccccacccgcccccgcccccaaagaagaggaggaagagcccctgcctacgaagaagtggcctaccgtggacgcctcgtattatggtgggcggggtgtgggcggaataaagcgaatggaagtccggtggggagataaaggatccactgaggagggcgccagattagagaaagccaaaaacgctgtcgtaaaaattccggaggagacagaggagcccatacggccaaggccccctcgacctaagcccacacaccagcccccacagaccaaatggtacacccccatcaaaggccgattagacgctctatgggcacttctgagaaggcagtacgaccgcgtgagcctgatgagaccccaggaaggcgatgaagtctgtatatgggaatgtattgagaaggagcttactgcatag

SEQ ID NO: 179219 - DNA, 1161 bp, Artificial Sequence
  Description of Artificial Sequence: Synthetic coding sequence
atggtggccgagcggagccccgcccggagccccggcagctggctgttccctggcctctggttgctcgttctcagtggtccaggtggattactcagagcacaggaacagccaagttgcagaagggcctttgacctatacttcgtgttggataaatcaggctccgtggccaacaactggatcgagatttacaactttgtgcagcagctggcagagcgctttgtttcgcctgaaatgaggctgtcatttattgttttctcctcacaggccaccattatattgccccttactggggatagaggtaagatctcgaaagggctggaggacctgaagcgcgtgtcgcctgtgggcgaaacctacattcacgagggcctcaagctggcgaatgagcaaatacagaaagcggggggcctgaaaacaagttctattatcattgcactcactgacggcaagctggacggcttggtgccaagttacgccgaaaaagaagccaaaatctcgaggtccttgggggcgagcgtctactgcgtcggtgtcctggattttgagcaggcacagctggaaaggattgcagactccaaggagcaagtgttccccgtgaaagggggatttcaggctttaaaaggaattatcaactcatccaatggcatcgccgcaattattgttattctcgtcctcttgctgctgctaggaatcggactaatgtggtggttttggcccctgtgctgtaaagttgtgataaaggaccctccgcccccccccgcgcctgcccctaaagaggaggaggaggagccgctacccactaagaaatggcccacagtcgatgcaagctactacggaggccggggggttggcggaattaagagaatggaggtccgatggggggataaaggctcaaccgaagaaggagccaggctcgagaaggccaagaatgctgtcgttaagatcccagaggaaactgaggagcctattagacctcgacccccaagacccaagcccacccaccagccaccgcaaacaaaatggtatacacccataaaaggacggcttgacgccttatgggctttactgaggaggcaatatgatcgcgtgtcccttatgcgaccccaggagggagacgaggtgtgtatttgggagtgcatcgagaaagagctcaccgcatag

SEQ ID NO: 179220 - DNA, 1467 bp, Artificial Sequence
  Description of Artificial Sequence: Synthetic coding sequence
atggtggccgagcggagccccgcccggagccccggcagctggctgtttccaggcctgtggcttctagtgctgtctggcccaggtggcttgttacgcgcacaggaacagccatcatgtcgccgggcctttgatctttactttgtgttggataagagtgggagtgtagcgaacaattggatcgagatctacaattttgtacaacaattagcggaaagattcgtctctcctgagatgaggttgtcctttattgtgttttcaagtcaggctaccattatactgcctctaaccggggatcgtggcaagataagcaaagggttagaagatctaaaacgggtgtcacccgttggtgagacatatattcacgaaggcctaaaactagccaatgagcaaattcagaaggctggtggactgaaaacttcttcaatcatcattgcgctgaccgacggcaagctggacggcctggtgccgtcctacgccgaaaaggaagctaagatatcccgctcactaggagcttccgtttactgtgtgggagtcctggactttgagcaggcccagctcgagagaattgccgactccaaggagcaggtgttccctgtgaagggcggctttcaggctttgaaaggcatcatcaactccattctggcgcagagttgcacggagattctggaactgcagccttcgagcgtatgcgttggtgaggagttccagatcgtactgtccggcagaggcttcatgctgggaagccggaatggtagcgtcttgtgcacttataccgtgaatgaaacctacacaacctccgtgaaaccggtgagtgttcagctaaattccatgctctgccccgcgccaattctgaacaaggcaggcgaaacactggatgtgtccgtcagttttaacgggggcaagagcgttatttccggttcactgatcgttaccgcaacggaatgttcaaacggcattgctgcaattatcgttatcctggtgctgctgctgctcctgggcattggactgatgtggtggttttggcctctctgttgcaaggttgtgatcaaggacccaccgcccccgccagcaccggcccccaaagaggaggaggaggaaccactgccaacaaagaaatggcccactgtcgatgcgtcatactatggtggccgcggcgtgggcggaattaaacgtatggaggtgcgctggggcgacaaggggtctacagaagaaggtgcaagattggagaaggccaagaacgcggtggtcaaaatccccgaggagaccgaagaaccaattcgaccacggccaccaaggcctaagcccacccatcaaccccctcaaacgaaatggtacacgccaatcaagggacgcctagatgcactctgggcccttctccgtagacaatatgacagagtttcactaatgcgaccacaggagggggatgagggccggtgcatcaacttttcgcgggttccatcacagtag

SEQ ID NO: 179221 - DNA, 2217 bp, Artificial Sequence
  Description of Artificial Sequence: Synthetic coding sequence
atgcggggccccagcggcgccctgtggctgctgctggccctgcggactgtcctcggcggcatggaggtacggtggtgtgccacgtccgatcccgaacaacacaagtgcggaaacatgtccgaagcgttcagagaggcgggaattcagccttctctcctgtgcgtacgtggaacttcagctgaccattgtgtccaattgatcgcagcccaggaagcggatgctatcacactggatgggggagcaatctacgaggccggtaaagagcacggactgaagcccgtcgtgggcgaagtatacgaccaagaggttgggacctcttattatgctgtggcagtggtgcgacgctcttcgcatgtcaccatagacacgctgaaaggagtcaagtcatgtcatacaggcataaataggactgtgggctggaacgtgccagtcggctacctggtggaatcgggtagattgagtgtaatgggctgcgacgtcctaaaggcagtgagtgactatttcggggggagctgcgtgcctggagccggggagacgtcgtactctgagtcactttgccgcctgtgtagaggcgacagctccggcgaaggcgtatgtgacaaatcccctctcgaaagatactacgattacagtggcgcctttcggtgtctggccgaaggcgccggtgatgtagcattcgtcaagcactccacagtgctggaaaatacagacgggaaaactcttccttcttgggggcaggccctgctcagccaggacttcgaattactttgtagggacggtagccgagcagatgtcacagaatggagacaatgtcacctggcacgggtgcctgcccacgctgtggtcgtaagagctgatacggatggaggcctgatcttccgtctgttgaatgaaggccagaggctgttctcacacgaaggttctagctttcaaatgttttcgagcgaggcttatggtcaaaaggatctgctgtttaaagattctacgagcgagttagtgcccatagcgacccagacctacgaagcttggctaggccacgaatacttgcacgccatgaagggcctattatgcgaccccaacaggctgcctccctacctcaggtggtgcgtgctgagcaccccagagatccagaagtgcggagatatggccgttgcctttcgcaggcagcgacttaaacccgagatccagtgtgtctcagctaagagcccacagcactgtatggaacggatccaggctgagcaagtagacgctgttaccttaagtggtgaagatatctatactgcgggtaaaacctacggattggtgcccgccgcaggcgagcactacgctccggaagattctagcaattcctattacgtggtggcagtcgtgcgcagagattcaagccatgcattcacgctcgatgaactgcggggaaaacggagctgtcacgctggatttggctctcctgcgggatgggatgtgccagtgggcgctcttatccaacgaggctttatccgacctaaagactgcgatgtacttacagcagtctccgaatttttcaatgcatcttgcgtgccagttaataatcctaaaaattatccttcttctctgtgtgccttatgcgtaggggatgagcagggcagaaacaagtgcgtcgggaatagtcaggagagatactatggctatcggggggcattcagatgtctcgtagaaaacgcgggggacgtcgctttcgtgcggcatactacggtctttgacaacactaatggacacaattcagagccttgggccgctgagctgaggagcgaggactacgagctgctgtgccccaacggagccagagctgaagtatcacaattcgctgcgtgcaacctagctcagattcccccccacgccgtgatggttcgccctgatactaatatattcacagtgtatggtttactggataaggcgcaagacttgtttggcgacgaccacaacaagaatggctttaagatgttcgattctagtaattaccatggccaagaccttcttttcaaagacgcgacagtgcgcgctgttcccgtcggggaaaagaccacctatcgcgggtggctgggcctggattacgttgcggctttggaaggtatgagctcccagcagtgtagcggagcggccgcgccagcacctggagctccactgctgcctttattgttaccggcccttgccgccagactcctccccccagcactttag

SEQ ID NO: 179222 - DNA, 909 bp, Artificial Sequence
  Description of Artificial Sequence: Synthetic coding sequence
atgcggggccccagcggcgccctgtggctgctgctggccctgcggaccgttttgggcggcatggaagtgcgatggtgtgctacaagcgaccccgagcagcacaagtgcggcaatatgtccgaggcatttagagaagctggtatccagccatctctcctttgtgttcgaggaaccagtgccgaccactgtgtgcaactgatcgctgcccaagaggcagatgccattacattggatgggggggctatttacgaggccggtaaagagcatggcctgaagccagttgttggagaggtgtacgaccaggaggtcgggacgtcttattatgccgtcgcagtagtgcgaagaagttcccacgttaccatcgatacccttaagggcgtcaagagctgtcacacgggcattaaccgcacagtgggatggaacgtcccagtgggctatttggtcgagtccggcagactgtccgtcatgggatgcgacgtgctgaaggccgtgagtgattacttcggcgggagttgcgtcccaggcgctggcgaaactagttactctgaatccctctgtaggttgtgtcggggggacagctcaggagagggggtctgcgacaagagtcccctggagcggtattatgactatagtggcgcctttcggtgcctcgctgagggtgccggagatgttgcatttgtcaaacatagcacggtactggagaacaccgacgagagcccgtcacggcgccaaacctggaccaggagcgaagaagaggagggcgagtgcccagctcacgaagaggcgagaaggacgatgagatcatctgccgggcaggcatggaaatgggctcctgtacaccgcccgcaagacgagagcgataagggtgagttcgggaaaagagccaaaagccgggacatgctgggttag

SEQ ID NO: 179223 - DNA, 1395 bp, Artificial Sequence
  Description of Artificial Sequence: Synthetic coding sequence
atggacttccagcaccggcccggcggcaagaccggcagcggcggcgtggcaagctcatcagagagtaatagagaccgccgggagcgtctccgtcagctggctcttgagacaatagacatcaataaagacccctatttcatgaaaaaccatctgggcagttatgagtgtaagctttgcctcacactgcataataacgagggatcctatctggcccatacccagggaaagaagcatcagactaacctggcgcggagggccgcgaaggaagcaaaggaagctccagcccagcccgccccagaaaaggtcaaagtcgaagtgaaaaaatttgtcaagatcggacgtcctggctataaggtcactaagcagagggacagtgaaatggggcaacaaagtctgctcttccagatcgactacccagagatcgccgaggggatcatgcctcgacacagatttatgtccgcctacgagcagagaatagagccacctgatcggagatggcagtacctcctcatggcagccgagccctatgagactattgcgtttaaggtgcccagtcgagagatcgacaaggctgagggcaaattctggacccactggaatcgggagacaaagcagtttttcctgcagtttcatttcaaaatggagaaaccacccgcccctcctagcctgcccgctggcccccctggagtgaaaagacctccacctcctctgatgaatggtctaccgccgcgccccccactgccagagtccctccctccgccgccacccgggggtctcccactgccgccaatgcctcccaccggtcccgcgccctcaggccctccaggccctcctcagctcccccccccggcaccaggcgttcacccccccgcacccgtagtccatccaccggccagcggcgtccacccacccgcccctggcgtgcaccccccagcacctggtgtacacccccctgcacccggagtccatcccccaaccagcggcgttcacccaccggctcctggggtgcatcctccagcgcccggagtgcacccaccagcccctggtgtgcatccacctgccccgggtgtccaccctccagcacccggagtccatcctccaccatcagcaggcgtgcatccccaggccccgggagttcaccctgctgcaccagccgtgcatccacaggcaccaggcgtgcacccccccgcaccaggtatgcaccctcaggccccgggtgtccacccccagccgccaggggtgcacccgagcgctcccggtgtgcaccctcaaccaccaggagtgcatccatcaaatcctggggtccatcccccaacccctatgcctcccatgctccgcccaccgcttccatctgaaggcccgggtaacatcccccccccgcccccaacaaactag

SEQ ID NO: 179224 - DNA, 1437 bp, Artificial Sequence
  Description of Artificial Sequence: Synthetic coding sequence
atgctgggcagcctgggcctgtgggccctgctgcccaccgccgtggaggctccacccaacaggcgcacgtgtgtgttcttcgaagcacctggcgtgcgcggcagcactaagacccttggggagctgctcgacacaggtactgaacttccccgcgccatcaggtgcttgtacagcagatgttgtttcgggatctggaatcttacccaagaccgagcgcaggtcgaaatgcaaggctgtcgggattcagatgagcctgggtgtgaatccttgcattgtgacccatcccctcgcgcacatccatctcctgggagcaccctgtttacgtgttcctgtggtacagatttctgtaacgcaaactatagccatttaccacccccagggtctcctggaaccccgggttcccaaggccctcaggccgcaccaggcgagtctatttggatggcacttgtgttgctaggcctgttcctgctgctattactgctcctgggaagtattatcctggcattacttcaacgcaaaaactatcgagttcggggggagccggtccccgagccacgcccagattctggtagggactggtccgtggagctccaagaactcccagagctgtgcttcagccaggtgattagagagggcggccatgccgttgtgtgggcggggcagcttcagggaaaattagtggccattaaagcctttcccccgcgaagcgttgctcaattccaggcggagcgcgctctctacgagctgccaggactccagcacgatcacattgtccggttcataacagcatcccgcggaggccctggaaggctcctgtccgggcctctgttagtgctcgagctccaccctaaggggtcactgtgtcattacctgacacaatatacatcagactggggaagctctcttcggatggccctgtccctcgcgcagggattggcttttttgcacgaagagagatggcagaacggacagtacaagccaggcattgctcaccgggacttgtcttcccagaatgtgctcatcagagaggacggctcatgtgccatcggcgatttgggtttggcgttggtgctgcccggtcttactcaacccccggcatggaccccgacacagcctcagggaccagcggcaatcatggaagaccctgacggactacgggagctcttagaggactgctgggatgctgacccagaagcccggctgaccgccgaatgcgtgcagcaacggttagccgccctggcacacccccaggagagccacccctttcctgaatcttgtcccagagggtgcccgccgctgtgtccagaagactgtacctcaatccctgcccccactatccttccatgccgtccccaaagatccgcttgccattttagtgtgcagcaaggaccttgttcacgtaacccacagcctgcctgcacgctctcacctgtctag

SEQ ID NO: 179225 - DNA, 1437 bp, Artificial Sequence
  Description of Artificial Sequence: Synthetic coding sequence
atgctgggcagcctgggcctgtgggccctgctgcccaccgccgtggaggcgcctccaaataggcggacctgtgtgttctttgaggcacccggcgttcgggggagtacgaagactttaggagagttacttgacaccggcactgaactgccccgtgcaatcaggtgcctctatagtaggtgttgctttggcatttggaatcttacccaagatcgcgcccaagtggaaatgcagggttgtcgggatagtgacgaaccgggttgcgaatcccttcactgtgacccctcccccagggctcacccgtcaccgggcagcacactcttcacatgcagctgcggcacagatttctgcaacgcaaactattctcacttgcctccacccggcagcccaggaacaccgggcagtcaaggaccccaggcagctccaggtgagagcatctggatggctttggtacttttgggcctgttcctcctgcttcttctgctcttgggaagcatcattctggctctattgcagcgcaagaattatcgggtcaggggggagccagtgccagagccaagaccagattccggacgcgactggtccgtggaacttcaggaactgcccgagctgtgtttcagtcaagtcattagggaaggcggacatgccgtcgtttgggcaggacagctgcaagggaagttagtcgccatcaaagccttccccccccgttccgtggcacagttccaggctgaacgtgcactttatgagcttcctggtttgcaacatgatcatatcgtccgctttattaccgcctcccggggagggcccggcagacttttgtctggtccccttctggtgctggagctgcacccaaagggctctctatgccactacctgacacagtacacttctgactgggggtcctcattaagaatggcactgtcgcttgctcagggtctggcgtttcttcatgaagaacgatggcagaacgggcagtataaaccaggtatcgctcatagagacctgtcatcccagaatgtcctgatcagggaggacggcagctgcgccattggcgatctgggcctggctctggtgctgccaggcctgactcagccaccagcctggactccgacacagccccagggcccagctgcaattatggaggccggtacacaaaggtacatggccccagagttactcgacaagaccttggatcttcaggattgggggatggctctccgtcgggcagatatctactcgctggccttgctgctgtgggaaatcttatctcgttgccctgacctgaggcccgcagtccatcacccctccaactggcccatgcggcagaattgggcaatcccacttccattaatgtcatatggtccatggcaatgccgccgcggaggcgtgcctaccagtcatcctcctggtgccgcacttccgcagactctcatggggtag

SEQ ID NO: 179226 - DNA, 1722 bp, Artificial Sequence
  Description of Artificial Sequence: Synthetic coding sequence
atgctgggcagcctgggcctgtgggccctgctgcccaccgccgtggaagcccccccgaaccgacggacatgcgtgtttttcgaggccccaggcgtgcgcggctccacaaaaacacttggcgaactgctcgacactggcacagagcttcctcgtgcaatccggtgtttatactccaggtgttgtttcggaatctggaatcttacgcaggaccgcgcacaggtggaaatgcagggatgtagggattcagacgaacccggctgcgaatccttgcactgcgacccttctcctagagcccacccgagcccaggcagtactctgtttacttgttcgtgcggtactgacttttgcaatgcaaactacagccacttacctcctcctggcagtccagggacccctggcagccaggggcctcaagccgcacctggggagtctatttggatggctcttgtgttgctagggctgttcttgctgctgctgctgctgctcgggagtatcatcctcgccctgcttcagcgtaagaattacagagtgagaggggaacccgtacccgaaccgagaccagactctggacgcgactggtccgtggagctgcaggagttgcccgaactgtgcttctcacaggtcattcgcgagggggggcatgccgtggtgtgggctggccagcttcaaggaaagctggtggccatcaaggccttccctccacgatctgttgcccaattccaggcagagcgggccctatatgaactccccggactgcagcatgaccatattgttaggttcatcacagcaagccgtggcggtccgggacgtttgttgagtggaccactgctcgtgctggagttacaccctaaaggctcactctgccactacctgacccaatataccagcgattgggggtccagcctgagaatggccctcagcctggcacaaggactggcttttctgcacgaggaacggtggcagaacggtcagtataagccagggatagctcacagggatctgtcatcccagaacgtcctgatcagggaggacggctcttgcgccataggggacctgggtctcgctttggtgctcccaggcctcactcaaccacccgcctggacaccaacccaaccacaggggccagcagccatcatggaggcgggcactcagagatacatggcccccgagctgttggataaaacccttgatctccaggactgggggatggccctccggagggccgacatctactctctggccctcttgctgtgggagatcctgagtcgttgtcctgacctgagaccagactcatcacctcccccatttcagctcgcctatgaagctgaacttgggaatactccgaccagcgacgaactctgggctctggctgtgcaggagcgccgacgcccctatataccctcaacctggaggtgcttcgccacggaccctgacggcttgcgcgagcttttggaagactgttgggacgctgacccagaagcaaggctaactgctgagtgcgtgcaacaaagactcgcagctctagcccatccccaagagtcccaccccttccctgaatcatgcccacgaggatgtccacccctttgccccgaggactgcaccagcattccagcaccaacgattctgccttgcaggcctcagagatccgcgtgtcatttttccgtccagcagggtccatgctcccggaatcctcagcccgcgtgcacactcagtccggtgtag

SEQ ID NO: 179227 - DNA, 1347 bp, Artificial Sequence
  Description of Artificial Sequence: Synthetic coding sequence
atgaagggcttcatcgacgacgccaactacagcgtgggcctgctggacgaaggtacaaatctcgggaacgtcatcgacaattacgtttatgagcacactctcaccggcaagaacgctttttttgttggtgacctgggaaaaatagtaaaaaaacatagtcagtggcagaatgtcgtagcccaaatcaagccattttacacggtgaagtgcaactcagcgcctgctgtgcttgagatactcgccgcgctgggcactggttttgcctgtagctcaaagaatgagatggccctggtacaggaactgggggtgcctcctgagaacataatctatatttcaccttgtaagcaggtaagccagattaaatacgccgccaaagtaggcgtaaacattctgacctgcgacaatgaaattgagctgaagaaaatcgccaggaatcaccctaatgcgaaggtgttattgcacatcgctacagaggacaacatcgggggagaggagggaaacatgaagtttggcaccacccttaagaattgcaggcatctgctggagtgtgcgaaggagctcgatgtgcaaatcatcggagtgaagtttcacgtgtccagtgcctgtaaggagtcccaggtgtatgtccatgcactgtcggacgctcggtgtgtcttcgacatggctggcgagataggttttaccatgaatatgctggacatagggggtggttttaccggtaccgaatttcagttagaggaagttaaccatgtgattagcccgctgctcgacatctattttccagaagggtctggggtaaagataataagtgagccaggatcttattacgtgtcatccgctttcacgcttgcggtaaatatcatcgcaaagaaggttgttgagaatgacaaattcccctcgggcgtggagaagactgggagtgacgaacccgcattcatgtactatatgaacgacggcgtctatggtagttttgcatcaaaactgtccgaggacctaaacactattcctgaggtgcataagaagtataaggaggacgaacccttgttcacttcatccctttggggaccatcctgcgacgagcttgaccaaatagtcgaatcctgcctcctgcctgaactgaacgtgggggactggctaatttttgataacatgggggccgattctttccatgagcccagcgctttcaatgatttccagcggcccgccatctattatatgatgtccttctccgactggtatgaaatgcaagacgctgggatcacgtccgacagcatgatgaagaattttttttttgtgccaagctgcatacaattgagccaggaggactctttctccgcagaggcttag

SEQ ID NO: 179228 - DNA, 1347 bp, Artificial Sequence
  Description of Artificial Sequence: Synthetic coding sequence
atgaagggcttcatcgacgacgccaactacagcgtgggcctgctggatgagggtaccaatctgggcaatgtgattgataactacgtgtatgagcacactcttactgggaagaacgcgttcttcgtgggagacctcggcaagattgttaagaagcactcacagtggcagaacgtggtggcccagatcaagccattttatactgtgaaatgtaacagcgcaccggcagtgctcgagattttggcagctcttgggactggcttcgcttgttccagtaagaatgagatggccttggtccaggaattgggcgtccctccagagaatatcatctacatttcgccttgcaagcaggtgtctcagattaaatacgcagctaaggtcggagttaacatactgacttgcgataacgagatcgaactcaagaagattgctcgtaaccatcccaatgccaaagtgttgctgcacattgctacagaggataatattggcggagaagaagggaatatgaagttcgggacgaccttgaaaaattgcagacacctgttggaatgcgctaaagaactggacgtgcagattatcggggtgaagtttcatgtgagctctgcatgtaaggagtcacaggtgtacgttcatgccctttcagacgctcggtgcgtgttcgatatggccggggagatcggctttactatgaacatgcttgatatcggaggtggcttcaccgggactgaattccagctggaagaggtcaatcacgtgatttctccattactcgatatctactttccagaggggtcgggtgtgaagattattagtgaaccaggctcctactatgtgtcgtccgctttcacactggcagtcaacattatagctaaaaaggtcgtggaaaatgataaatttccttccggcgtagagaaaacggggtccgacgagcctgcatttatgtattatatgaacgacggtgtttatgggtcattcgccagcaaactcagcgaagacctgaatacaatcccagaagttcacaagaagtacaaggaggatgaaccccttttcacaagctcactgtggggtccatcttgcgatgaactcgaccagatcgtggaatcatgcctgcttcccgagctgaacgttggagattggctgattttcgacaatatgggagctgattcattccacgagcccagtgccttcaatgacttccagcgcccggccatctactatatgatgagcttctctgactggtacgaaatgcaggatgccggaatcacaagcgattcaatgatgaaaaacttcttctttgtcccatcctgtatccagttgagtcaggaggattccttttctgccgaggcctag

SEQ ID NO: 179229 - DNA, 102 bp, Artificial Sequence
  Description of Artificial Sequence: Synthetic coding sequence
atgaagggcttcatcgacgacgccaactacagcgtgggcctgctggacgaaggtactaacctgggaaatgtgattgacaactacgtgtatgaacatacatag

SEQ ID NO: 179230 - DNA, 294 bp, Artificial Sequence
  Description of Artificial Sequence: Synthetic coding sequence
atgaagggcttcatcgacgacgccaactacagcgtgggcctgctggacgaggggacaaatctcggaaacgtgattgataattatgtctatgaacataccctgaccggcaagaatgcctttttcgtgggggaccttggcaagattgttaagaagcactctcagtggcagaacgtggtggcgcagataaagcctttctatactgtcaaatgtaattccgccccagccgtgctcgagatactggcggccttaggcactggattcgcttgttcctccaaaaatgagatggccttatag

SEQ ID NO: 179231 - DNA, 780 bp, Artificial Sequence
  Description of Artificial Sequence: Synthetic coding sequence
atgcggcgggccgtggcctacatggccatcaagatcgaggtgcaggggcatcaaagcttcgctataccctcaggaactttctggctgtggcggagcctcctaagccaggacaaggagcatcccaggtatctgatcccggagctgtgcaaacagttttatcacttaggctgggtaaccgggaccggaggaggcatcagcctcaagcacggcgacgagatttatattgccccttccggtgtgcaaaaagaacgtatacagcctgaagatatgttcgtttgtgatataaacgaaaaagatatttccggacccagcccttccaagaagctgaaaaaatctcagtgtacaccactctttatgaacgcatataccatgagaggcgccggggccgtcattcacacacatagcaaggccgccgtcatggccactctgctgtttcccggccgagaattcaagattacgcaccaggaaatgatcaaggggatcaaaaaatgcacgtccggcggctactaccgatacgacgacatgctcgtagtgcctattatcgaaaacacccccgaggagaaagatctgaaggacagaatggctcacgcgatgaacgagtatcccgactcctgtgcagtgctggtacggaggcacggagtgtatgtatggggagaaacttgggagaaagccaagactatgtgtgaatgttatgactatctgttcgacatagcagtcagtatgaagaaagtgggtctggacccctcacagttacctgtgggggaaaacgggattgtctag

SEQ ID NO: 179232 - DNA, 729 bp, Artificial Sequence
  Description of Artificial Sequence: Synthetic coding sequence
atgagcggctgcgacgcccgggagggcgactgctgcagccggcggtgcggagcgcaggacaaggagcaccccagatatctgatcccagagctgtgcaaacagttttaccacctgggctgggtgaccggcacaggaggcggcataagtctcaagcacggcgacgaaatttatatcgcacctagtggagttcagaaagagagaatccaaccggaagacatgttcgtgtgtgacatcaatgagaaagacatcagcggtcctagtcccagcaagaagcttaagaagagtcagtgcaccccgctgttcatgaatgcatatactatgcgaggggctggggcagtaatccatactcattcaaaagcggccgtgatggcaacattgctttttcctggaagagagttcaagattactcaccaggaaatgattaagggcatcaagaagtgtacctctggagggtactatagatatgatgacatgctcgtggtacctattatcgagaacacgccagaagagaaggacttgaaagaccggatggcccatgccatgaacgagtatccagacagttgcgccgtgcttgtgcggcggcacggggtgtatgtctggggcgaaacttgggagaaggcgaaaacaatgtgcgaatgctatgactatctgtttgacatcgctgtgagtatgaagaaagtgggactggacccttcccagctgcccgtaggggagaatggcatcgtgtag

SEQ ID NO: 179233 - DNA, 234 bp, Artificial Sequence
  Description of Artificial Sequence: Synthetic coding sequence
atgaacctgcggctgtgcgtgcaggccctgctgctgctgtggctgtctctgacggctgtctgtggcgggagtctgatgcctcttccggacgggaatggattggaagatggcaatgtgcgacacctagttcaaccgcgcgggagccgaaatggccccggcccatggcaaggcggccggcggaagtttaggaggcagaggcctcgattgtcgcataaagggcccatgcctttctag

SEQ ID NO: 179234 - DNA, 369 bp, Artificial Sequence
  Description of Artificial Sequence: Synthetic coding sequence
atgagcgccacctggtgcagccccgagggccagggcatgggccagggacctggccgggaggtcggcggcaactcggcggcttctggacctgccagccccatccgagatccctgcctgtctgaagctgggctcaagggacctccatccgcacaccctaggagactgtgtctgctccatcgcctggtctgcttttccggtggactgaccagcatccagctgagcccgagaacctgttgcagccaccaatgggctcagctgttctctcccgcctgcttcccccaatggagggccccggggtgttctctggacgacagccggtcactgacgcggatcagacccgtgcacctgccaggcccgtcacttgactag

SEQ ID NO: 179235 - DNA, 369 bp, Artificial Sequence
  Description of Artificial Sequence: Synthetic coding sequence
atgagcgccacctggtgcagccccgagggccagggcatgggccaggggcccgggcgcgaggttggggggaactctgccgcgtcggggcccgcgtcacctattcgggatccctgcctctccgaggcagggcttaaagggccaccttccgctcacccacggaggttatgcctgttgcaccggctggtgtgcttttcgggtggtctgacaagtatccagctgagccccagaacctgctgctcccaccagtgggcacagctgttctctcccgcttgttttccacagtggcgagcgcccggctgttcactagacgactcaagatctctgacaagaatccgacccgtgcacttacccggacctagtcttgattag

SEQ ID NO: 179236 - DNA, 303 bp, Artificial Sequence
  Description of Artificial Sequence: Synthetic coding sequence
atgaagctgctggccgccaccgtgctgctgctgaccatctgcagcttggagggtgctctggtgcggcgacaggccaaagaaccctgcgtggagagcctggtttcccagtactttcaaacggtgaccgactacgggaaggatctgatggaaaaggttaagagtccagagctccaggccgaagcaaaatcatacttcgagaaatccaaggagcagttgacacccttgattaaaaaggcagggacagagctcgtgaatttcttgtcatactttgtggagctaggcacacagccagccacgcaatag

SEQ ID NO: 179237 - DNA, 1191 bp, Artificial Sequence
  Description of Artificial Sequence: Synthetic coding sequence
atgttcctgaaggccgtggtgctgaccctggccctggtggccgtggcgggagctcgagcggaggtgtccgccgaccaggtggctaccgtaatgtgggactactttagccagctcagcaacaacgctaaggaggctgtggaacacctgcaaaagtccgaactgacacagcagcttaacgcactattccaggacaagcttggggaagtcaatacatatgcaggagatctgcagaagaagctggtccccttcgcaacagaactacacgaaagactggcgaaggacagcgaaaagctcaaagaggagattggcaaagaactggaggaactgcgggcgcgcttgttaccacacgcaaatgaagtatcacaaaaaatcggtgacaacttaagagagctgcaacagagactggaaccatatgctgaccagctgcgaactcaagtgtctacccaggccgagcagctccggcgccaacttacgccttatgcccagcggatggaacgtgtactgcgagaaaatgccgattccctgcaggcaagcctgagaccgcatgcggacgagctgaaagccaaaatcgaccaaaacgtggaggagctgaaaggtagactgaccccgtacgctgatgagttcaaagttaagatagatcaaacagtcgaagaattgcgccggagtctcgctccatatgctcaggatactcaggagaaactgaaccaccagctagagggccttacatttcagatgaagaagaacgctgaggaactgaaagcgagaatctctgctagtgctgaggagttgcgccagaggcttgcaccactagcagaagacgtgcggggcaatctgcggggtaacactgaagggttacagaagtccttagctgagttaggaggtcatcttgatcagcaggttgaagaattcagacgtagagtcgaaccctacggcgagaattttaataaggcgctggtacagcaaatggagcagctgcgacaaaagctcggaccccacgccggcgatgttgaagggcatttgagcttcctcgagaaagatctgagagataaggtcaacagcttcttctctaccttcaaggagaaggaatctcaggataaaaccctgtctctgcctgagctggagcagcagcaagaacaacagcaggaacaacagcaagaacaggttcagatgctagcccccttggagtcttag

SEQ ID NO: 179238 - DNA, 1281 bp, Artificial Sequence
  Description of Artificial Sequence: Synthetic coding sequence
atggccatcgcccagctggccaccgagtacgtgttcagcgacttcctgctcaaagagccgacagagccgaagttcaagggtctgaggctggagttggccgtggataaaatggtcacctgtatcgcagtcggcttgccattattgttaataagtttggcgtttgcgcaagagatatctatcgggactcagatctcttgtttctcgcccagctccttctcttggaggcaagccgccttcgtcgacagttattgctgggcggcagttcagcagaagaattccctgcaaagtgagtctggcaatcttcccctttggctccataagtttttcccctacatcttgctcctgttcgcaatcctgctatacctcccgcctctcttctggcgcttcgctgctgcaccccatatctgttcggatcttaagttcatcatggaggagctcgacaaagtatataatcgcgctatcaaagcagcaaagagtgccagagatctagatatgagggacggggcttgttccgtgccaggcgttacagagaatctggggcaatcactctgggaggtttccgagagccacttcaaatacccaattgtcgagcaatatctgaaaactaaaaagaacagcaataatcttataattaagtatatctcttgccgcttgctcacgctcatcataattctccttgcttgcatttatttgggctattattttagcttatcatcattgagtgatgagttcgtatgtagtataaagtcagggattctccggaatgactcgacagtgcccgatcagtttcagtgcaaattgattgcagtgggaattttccaactgctcagcgtgattaacctggttgtatatgtgcttcttgcgcccgtggttgtttataccctcttcgtccccttcagacagaagacggacgttctgaaagtttacgagatactacccacattcgatgtcctgcatttcaagagcgaaggatataacgacctgtccttatataacttattcttagaggaaaacattagcgaggtgaagtcctacaaatgtttgaaggtgctggaaaatatcaagtcgagcggtcaggggatagaccctatgctgctcctgacgaacctggggatgattaaaatggatgtcgttgacggaaaaaccccaatgagcgcagagatgcgtgaagaacaaggcaaccagacagctgaactgcaagggatgaacattgactcagagacaaaagccaacaacggtgagaagaacgcaagacagagactcctggatagcagctgctag

SEQ ID NO: 179239 - DNA, 489 bp, Artificial Sequence
  Description of Artificial Sequence: Synthetic coding sequence
atggccagcatggccgccgtgctgacctgggccctggccctgctgagcgccttttccgccacccaggcccggaaaggcttctgggattacttctcccagacatctggagacaaagggcgggtagagcaaattcatcagcagaaaatggctcgtgaacctgcgacactgaaggactcgcttgaacaagatttgaataacatgaacaaatttttggagaagttgcgcccgttaagcggaagcgaagcgccccgtctgcctcaagatccagtgggaatgaggagacagcttcaggaggagcttgaagaagtcaaggcccgcctgcaaccctacatggcagaggcacacgagcttgtgggttggaatctggagggcctgcgccagcagctcaaaccttacacaatggacctgatggaacaggttgccctgagggtccaagaactgcaggagcagttgcgggtcgtgggtgaagacactaaggcgcaactttag

SEQ ID NO: 179240 - DNA, 1101 bp, Artificial Sequence
  Description of Artificial Sequence: Synthetic coding sequence
atggccagcatggccgccgtgctgacctgggccctggccctgctgtccgctttcagtgctacacaggccaggaaaggattctgggattatttttcccaaacgtctggagacaaagggcgggtggagcagatccaccagcaaaaaatggctcgggagcccgcaactctgaaagactctctggaacaggacctcaacaacatgaacaagtttctcgaaaaactcaggccactgagcgggtccgaagcgcctagactgccacaagacccagtaggcatgagacgtcagctgcaggaagagctagaggaagtaaaggctcgcttgcaaccctacatggccgaggctcacgagctcgtcggttggaatctggaaggattacgccagcagctgaaaccttataccatggacttaatggaacaggtggctctccgcgtccaggaactgcaagaacagttgagggtagttggggaagacaccaaagcgcagttgctgggtggagttgatgaggcttgggccctccttcaagggttgcaatctcgcgtggtacaccacaccggccgatttaaggagctgtttcacccgtacgccgagtccctggtcagtggcatcggccgccatgtgcaggaactgcatagatccgtagcacctcatgctcccgcttctccggcccggctgtctcggtgcgtgcaggtgcttagccggaagttgactctgaaggccaaggcgttgcacgctcggatccagcagaacttagaccagttacgggaggagctaagcagggccttcgcaggcacaggcacagaagagggcgccggacccgatccccagatgctatccgaagaagttagacagcgattgcaagcattccggcaggacacgtacctccaaatcgctgccttcactcgggctattgatcaagagactgaagaggtgcagcagcagctcgccccgcccccacccggacacagcgctttcgcgccagaattccagcagacagatagtgggaaggtgttgtctaaactgcaagctaggctggacgacctgtgggaagacatcacacacagcctgcacgatcagggtcacagccatctcggcgatccttag

SEQ ID NO: 179241 - DNA, 1074 bp, Artificial Sequence
  Description of Artificial Sequence: Synthetic coding sequence
atgaacccccagatccggaaccccatggagcggatgtaccgggacaccttctatgacaactttgagaatgagcccatcctctacggtaggtcatacacctggctgtgctatgaggtaaaaatcaaacggggtcgaagcaacctgctctgggataccggggtgtttcgtgggcaggtttacttcaaaccgcagtaccacgccgaaatgtgcttcctttcttggttttgtggaaaccaactccccgcctataagtgtttccagattacctggtttgtctcttggacgccgtgccccgattgcgtggccaaactggccgaattcctgagcgaacacccaaacgttactctaactatcagcgcagctagactctactattactgggaaagggactatcggagggcactttgtagactgtcacaggccggtgccagggttactattatggactatgaggaatttgcttactgctgggaaaattttgtgtacaatgaggggcagcaattcatgccgtggtacaaattcgacgagaactacgcttttttgcacagaactctcaaagagatcctgcgctaccttatggaccccgatacgttcacatttaatttcaataacgacccgctcgtgttgagaaggcgtcagacctatctatgttacgaggtagaaagactagacaatgggacatgggtgctgatggaccaacacatgggcttcctgtgcaatgagcttgaccccgcccaaatttacagggtaacgtggtttatctcatggtcaccatgtttctcctggggatgtgccggcgaggtcagagcgtttctacaggagaatacccacgtaaggttacgaatttttgcagccaggatatatgactacgatcctctctacaaggaagctctccaaatgctgcgggacgcaggcgcccaggtatccatcatgacttacgacgagtttgaatattgctgggacacgttcgtttacaggcagggttgtccgtttcagccctgggacggcctggaggagcactctcaggctctgtcgggtaggttacgcgccatactgcagaaccagggaaactag

SEQ ID NO: 179242 - DNA, 306 bp, Artificial Sequence
  Description of Artificial Sequence: Synthetic coding sequence
atgaagccccacttccggaacaccgtggagcggatgtaccgggacacattcagctataacttctacaaccggcccatcttaagcagaagaaacacagtttggctgtgttacgaagtgaaaactaaggggccgtctagaccccgactggatgccaaaatttttagggggcaggtgcctcggagctttatcagagcccctttccaggtgctgagctcacccttcggtcagtgcgctccacctcatggaaccgcccaagtccagtggcccccacagctgaccgcgggaagagagcagggtagaccttag

SEQ ID NO: 179243 - DNA, 381 bp, Artificial Sequence
  Description of Artificial Sequence: Synthetic coding sequence
atggccagcgccagcacccagcccgccgccctgagcgccgagcaggccaaggtcgtactcgccgaagtgatacaagcctttagtgcacccgaaaacgccgtccgcatggatgaagctcgcgacaacgcatgtaacgatatgggtaagatgctgcaattcgtgctcccagtggccactcagatccagcaggaggtgatcaaggcatacggcttctcctgcgacggggagggggtgctcaagtttgccagattggtgaagagctacgaagcccaagaccccgaaatcgcaagcttgtctggaaaactaaaagctctcttcctgccaccgatgaccctccctccacacggacctgctgcaggtggatcggtcgccgcctcctag

SEQ ID NO: 179244 - DNA, 675 bp, Artificial Sequence
  Description of Artificial Sequence: Synthetic coding sequence
atggcccagaaggaggaggccgccgtggccaccgaggccgccagccaaaacggcgaggatctagaaaatttggacgatcctgaaaagttgaaggaactgatagaactgccgccctttgagattgtcaccggggagaggcttcctgccaatttttttaagttccagttcaggaatgtggaatactccagtgggcgcaataaaacattcctgtgctacgtggtggaagcacagggaaagggagggcaagtacaggcctcaaggggatacttggaggatgaacacgccgctgctcacgccgaggaggccttctttaacactatactcccagcgttcgaccccgcccttagatataacgtgacctggtacgtgtcttccagcccctgtgcggcctgcgccgacagaatcattaagacactgtctaaaacaaaaaatctcagactgcttatcctcgtaggacgactgtttatgtgggaagagcccgagatccaggccgctctgaaaaagctgaaagaagctggctgcaagttgagaatcatgaaaccccaagacttcgagtacgtgtggcagaattttgtggagcaggaggagggtgagagcaaggccttccagccctgggaggacatacaggaaaatttcctctattatgaggagaagttagccgacatcctcaagtag

SEQ ID NO: 179245 - DNA, 393 bp, Artificial Sequence
  Description of Artificial Sequence: Synthetic coding sequence
atggcccagaaggaggaggccgccgtggccaccgaggccgccagccaaaatggcgaggacctggagaatctcgatgatcccgagaaactgaaggagctgatagagcttccaccttttgagatagtgaccggggaacggctcccagcaaacttttttaagttccagtttcggaatgtcgagtactcttctggccgaaaattgagttcgacaccctcctgtcagccctccacccaaccttgtggcacaatgtcccctggcatgtgtcccccagcacccgtgcagcgggtccttacagcgctttcgaaaccattagcccgcccaaggacttgcgtatgctcgttttggtgggtggactcctcatgtgggaggtcacgacggtcacgtctgctatag

SEQ ID NO: 179246 - DNA, 600 bp, Artificial Sequence
  Description of Artificial Sequence: Synthetic coding sequence
atggaggccagccccgccagcggcccccggcacctgatggacccccacattttcacttccaatttcaataatggcatcggtcgccataaaacctatctatgttacgaggttgagcggttggataatggtacatcggtgaagatggatcaacatcgggggtttctgcacaatcaggccaagaacctgctgtgtggattttatggtcggcacgcagagcttcgctttcttgacctggtcccctccctgcagttggatcctgcacagatttaccgggttacctggttcatctcatggtccccgtgcttctcctgggggtgtgccggagaggtaagggccttcctgcaagagaacacccatgttcggcttaggattttcgccgcaaggatttatgattacgatcccctgtacaaagaggcactacaaatgctgagagatgccggagcccaagtctctataatgacatatgacgagtttaaacattgttgggatactttcgtggaccaccaaggatgtccttttcagccttgggatggcctggacgaacacagccaagccctgagcggcagactcagggcaatcctccaaaatcaagggaactag

SEQ ID NO: 179247 - DNA, 600 bp, Artificial Sequence
  Description of Artificial Sequence: Synthetic coding sequence
atggaggccagccccgccagcggcccccggcacctgatggacccccacattttcacttcaaacttcaataatggcattggccggcacaaaacatacttgtgctacgaggtggaaagactagacaacggcacttctgtaaaaatggatcagcataggggcttcctccacaatcaagccaagaaccttttatgcggcttttacgggcggcatgccgagttaaggttcctggatctggtccccagcctgcagcttgatcccgctcagatctaccgggtgacgtggtttattagttggagtccatgtttttcttggggttgcgcaggggaagtgcgcgctttcctgcaagaaaatactcatgttcgtctgcgcatttttgcagctaggatttacgactacgaccccctgtacaaggaggcccttcagatgttacgagacgctggtgcccaggtcagcattatgacctacgatgagtttaagcattgttgggatacttttgtggaccatcagggatgccctttccaaccctgggatggactggacgaacattcccaggcactgtcaggacgcctgcgggctatcttgcaaaaccaggggaattag

SEQ ID NO: 179248 - DNA, 1149 bp, Artificial Sequence
  Description of Artificial Sequence: Synthetic coding sequence
atgaacccccagatccggaaccccatggagcggatgtaccgggacaccttctacgacaactttgagaacgagccaatactgtacggccgaagctacacgtggctgtgctatgaggtcaaaatcaagcgggggaggtcaaacctgctttgggacacaggagtctttcgcggacaggtatattttaaaccccagtatcacgcggaaatgtgctttctctcgtggttttgtggaaaccagctcccggcctacaagtgtttccagattacatggtttgtatcatggacaccttgcccggattgcgtggccaagctggcagagtttctcagcgagcacccaaacgtgacgttgacgatctcagccgcccgcctctactattattgggagagggattaccgaagagccctatgtcgattgtctcaggccggggcccgagtgacaatcatggattacgaagaatttgcctactgctgggagaacttcgtgtataatgaaggacagcaattcatgccctggtacaaattcgacgagaactacgcgtttcttcacagaaccctgaaagagattttacgttacctcatggaccccgatacatttacctttaactttaacaacgacccactggtgctccgacgaaggcaaacttatctttgttatgaagtggagcgactggacaatgggacctgggtgctcatggaccagcatatgggctttctgtgcaacgaggccaaaaacctgttgtgtggcttctacgggcgccacgcagaactgcgatttttggatctcgtccctagtcttcaattggaccctgcgcagatctacagagtgacatggtttataagttggtctccctgctttagttggggctgtgcaggtgaggttcgagcattcctgcaggaaaatacacacgtgcgtctgaggatttttgccgcccgtatttacgattacgatcctttgtacaaagaagcattgcaaatgttaagagatgctggggcccaggtctctatcatgacctatgatgagttcgaatattgttgggacacctttgtctaccgccagggctgtccgttccagccatgggacggtcttgaagaacacagtcaggccctgtctgggcggctgagagcaatactgcaaaatcagggaaactag

SEQ ID NO: 179249 - DNA, 573 bp, Artificial Sequence
  Description of Artificial Sequence: Synthetic coding sequence
atgaacccccagatccggaaccccatgaaggccatgtaccccggcactttctactttcagtttaagaatctgtgggaggcgaatgatcgtaatgagacatggctctgctttaccgttgaggggataaaacggcgttccgtagtgtcgtggaaaacaggcgtgttcagaaaccaggtggatagcgaaacccattgccacgctgaaaggtgcttcctgagctggttctgcgatgacattctgtccccgaacaccaaatatcaggtaacctggtatacttcttggagtccatgccccgattgcgcgggcgaagttgctgagttcctggcacgccattctaatgtaaaccttaccatctttacagcccgcttatactactttcagtatccgtgttaccaggagggccttagatccctgtcccaggaaggggttgctgtggagattatggactacgaagactttaaatattgttgggagaatttcgtgtataatgataacgagccatttaaaccttggaagggattaaagaccaatttccggttgctcaagagacggttacgtgagtctctgcaatag

SEQ ID NO: 179250 - DNA, 1122 bp, Artificial Sequence
  Description of Artificial Sequence: Synthetic coding sequence
atgaagccccacttccggaacaccgtggagcggatgtaccgggacactttcagctataatttttacaatcgacccatcctgagccgcaggaacaccgtgtggctttgctacgaggtaaagacaaaaggcccatctagacctcgtctcgacgccaagatctttagaggacaagtgtatagccagccagaacaccatgctgaaatgtgttttctgagctggttttgcggaaaccaactgccggcctataagtgtttccagataacctggttcgtctcctggacaccctgtcctgattgcgtagctaagctggctgagtttttagctgaacacccaaatgtcaccctcacgatctcagccgctaggctctactactattgggagcgagactaccggcgggcactgtgccggctgtcacaggccggcgcgagagtgaagataatggacgatgaggagtttgcctattgttgggagaacttcgtttattccgagggccagccgttcatgccctggtataagtttgacgacaactacgcttttctgcatagaacccttaaagaaatcctgcggaatcccatggaagccatgtatccccatatattctatttccactttaagaatcttcgtaaggcatacgggcgcaacgagagctggttgtgtttcacaatggaagttgtgaaacaccacagccccgtttcctggaagcgaggggtcttcagaaatcaggtcgacccagaaacgcactgtcacgccgagcgctgtttcctgagctggttttgtgatgatatcctatctccaaacacgaactacgaggtgacctggtataccagctggtccccctgcccagagtgcgctggggaagtggctgaattcctagcccgccatagtaatgttaacctcacaatttttacagctcggctctattacttttgggatacggattaccaggaaggactcaggtcactctcccaggaaggcgctagcgtcgaaattatggggtataaggacttcaagtactgctgggagaactttgtgtataatgacgacgagcccttcaagccctggaaaggactgaaatataactttctgtttctcgactctaaattgcaggaaatacttgagtag

SEQ ID NO: 179251 - DNA, 1155 bp, Artificial Sequence
  Description of Artificial Sequence: Synthetic coding sequence
atgaagccccacttccggaacaccgtggagcggatgtaccgggacaccttttcatataacttctacaatcgcccaattttgagccgacgcaatacagtgtggctgtgctatgaagtcaagaccaagggtccctcccgtcccccactcgacgctaagatctttcgaggccaggtttattccgagctcaagtaccaccccgagatgcgattctttcactggttttccaaatggagaaagctgcatcgcgaccaagaatatgaggtgacatggtacatttcctggtccccatgcacgaagtgcaccagagacatggctacatttctggccgaggatcctaaagtgactctgaccatatttgtcgctagactttactacttttgggatcccgattaccaggaggccttacggtccctgtgtcagaaaagggacggccctagagccaccatgaaaatcatgaactatgacgagttccagcactgctggtccaagtttgtttattcacaacgggagctcttcgagccctggaataatctgcccaagtattacatcctgttgcatatcatgttgggggagattttgcgccattcgatggacccaccgaccttcaccttcaactttaacaacgagccttgggttagggggcggcatgagacatatctttgctacgaggtagaacgaatgcataatgatacttgggttctcctaaatcaacggcgagggtttttatgtaaccaggccccccataaacatggtttcctggaaggacgacatgccgaactgtgttttctcgatgtcattcccttctggaagcttgatttggaccaggattatcgcgtgacgtgctttacatcctggtccccatgtttctcttgcgcgcaagagatggctaaatttataagcaagaataagcacgtatcactctgtattttcacagccagaatctacgacgatcaaggacggtgccaggagggcctccgtactcttgccgaagctggagcaaagatctctatcatgacctactccgaattcaagcactgttgggacactttcgtagaccaccagggttgtcctttccaaccctgggacggtctggatgagcattcacaggatctatcaggacgcctacgagcaattttacaaaaccaggagaattag

SEQ ID NO: 179252 - DNA, 1155 bp, Artificial Sequence
  Description of Artificial Sequence: Synthetic coding sequence
atgaagccccacttccggaacaccgtggagcggatgtaccgggacaccttctcatacaatttctacaaccgtccaatcctctctaggaggaataccgtctggctctgctatgaggtcaagacgaaaggcccaagcaggccgcctctcgatgccaaaatttttcggggacaggtgtacagcgaactcaagtaccaccccgagatgaggttttttcattggttttccaagtggagaaaactccaccgtgaccaggaatacgaagtaacttggtatatttcctggtccccctgcactaagtgtacccgggatatggcgactttcctggccgaagaccccaaagtcaccctcaccatattcgtcgcaaggctgtattacttctgggatccagattaccaggaggccctccggagcctgtgtcagaagcgcgacggaccccgcgctaccatgaagattatgaattacgacgagtttcaacactgttggtctaaatttgtgtactcacagagagagctttttgagccctggaacaatctgcccaagtactacattctcctgcatattatgttgggtgagatcctacggcactctatggaccccccgacatttactttcaacttcaacaacgagccctgggtacgcggacgccatgagacctatttatgttatgaggttgagcgcatgcacaatgatacatgggttctgctcaaccagcgcagaggtttcctctgcaaccaggccccacacaagcacggctttctggagggccgccatgcagaactctgtttcctcgatgtgattcctttttggaagctggacctagaccaagattaccgcgtgacctgctttacatcttggtcgccttgtttctcctgcgcacaagaaatggctaagttcatatccaagaataagcatgtgagtctctgcatttttacggcaagaatctatgacgaccagggcagatgccaggaaggactgcgaaccttggccgaggcgggtgccaagattagcattatgacgtattctgagttcaaacattgctgggacacttttgtggaccaccagggttgtcccttccaaccctgggacgggctggacgagcacagccaggacctcagcggtagacttcgcgctatactccaaaaccaagagaactag

SEQ ID NO: 179253 - DNA, 549 bp, Artificial Sequence
  Description of Artificial Sequence: Synthetic coding sequence
atggccctgctgaccgccgagaccttccggctgcagttcaacaacaaaagaagactccggaggccgtattaccctcggaaggccctgttatgctaccaactaaccccccagaacgggtctaccccaacaaggggctattttgaaaataaaaagaagtgtcatgcggagatctgcttcataaacgagatcaagtctatgggtttagacgaaactcaatgttatcaggtcacttgctacctgacctggagcccatgttcaagctgtgcatgggagctcgtcgacttcataaaagctcacgaccacctgaacttaggtatctttgcctcgcgactctactatcattggtgcaaaccgcaacagaagggcctgcgcttactgtgtggcagccaggtgcctgtggaggtcatgggatttcccaagtttgcagattgttgggagaatttcgtggaccacgagaaacctctgagcttcaacccttataaaatgctagaggagctggacaagaactcccgcgccataaagcgcagactagaacgcattaagtcttag

SEQ ID NO: 179254 - DNA, 603 bp, Artificial Sequence
  Description of Artificial Sequence: Synthetic coding sequence
atggccctgctgaccgccgagaccttccggctgcagttcaacaacaagagacggttaagaaggccttactacccaaggaaagcattgctgtgttaccagctcacccctcagaatggatccacccccacaaggggctacttcgaaaacaagaaaaaatgtcatgctgagatatgttttatcaatgagattaaaagtatgggcctggatgagactcagtgctatcaggttacatgctatctgacctggtcgccctgcagctcttgtgcctgggaactggtagatttcattaaggctcatgaccacctcaatctcggcatttttgcctccaggctctactatcattggtgtaagccgcagcagaagggactgaggttgctttgcggttcgcaggtccctgtggaagtcatgggcttccctaagttcgcagactgttgggagaatttcgtcgaccatgaaaaacccctgtctttcaatccttacaaaatgctggaggagttggacaaaaactccagggcaatcaagcggagacttgaacgcatcaagatccccggggttagagcccaaggcaggtatatggacatcctctgcgatgctgaggtgtag

SEQ ID NO: 179255 - DNA, 465 bp, Artificial Sequence
  Description of Artificial Sequence: Synthetic coding sequence
atggccctgctgaccgccgagaccttccggctgcagttcaacaacaagcgcagactgcgtagaccctattacccccggaaagccctgctctgttaccaactgaccccccagaatgggtcaacacccacgcgcggttactttgagaacaagaaaaagtgtcacgcagaaatctgcttcataaacgagatcaaaagtatggggctggacgaaacgcaatgctatcaagttacatgttacctcacatggtccccctgctccagctgcgcttgggagctcgtggacttcattaaggcacacgaccacctgaatttgggcattttcgcatctcgtctgtattatcattggtgtaagccacagcaaaaaggactgcgtttgctgtgcggttcgcaagtgcccgtcgaggtcatgggcttccccaatagtaggggcacatgtgccggctccctgcacggatatatcgtttag

SEQ ID NO: 179256 - DNA, 552 bp, Artificial Sequence
  Description of Artificial Sequence: Synthetic coding sequence
atggccctgctgaccgccgagaccttccggctgcagttcaacaacaagagacggttacgcagaccatattatcctcgaaaggcattgctgtgttaccagctcacaccgcaaaacggaagcaccccaactagaggctattttgaaaacaagaagaagtgtcatgccgagatctgcttcatcaatgaaattaagagtatgggcctggacgagacacaatgctaccaggtgacatgctacttgacatggtcaccatgctcatcatgtgcttgggagttggtggatttcatcaaagcccacgatcacctgaatctgggaatttttgcctctaggttatactaccactggtgtaagccccagcagaagggtctgcgacttctctgcggctcacaggtaccagtggaggtaatgggcttcccaaaatttgcggattgctgggagaatttcgtggatcacgagaagcctctatcttttaacccttacaagatgcttgaggagctcgataagaactcaagggccattaaaagacgtctagagcggattaagcagtcgtag

SEQ ID NO: 179257 - DNA, 1104 bp, Artificial Sequence
  Description of Artificial Sequence: Synthetic coding sequence
atggagcccatctacgaggagtacctggccaaccacggcaccatcgtgaaaccttattactggctttccttcagcttagattgtagcaactgtccatatcacataagaaccggcgaagaggccagagtgtccttaaccgagttttgccagatcttcggttttccgtatggcacaaccttcccgcagaccaagcacctgaccttctatgagctcaaaacttcttctgggagccttgtgcagaaggggcacgcttcgtcctgtactggcaattacattcacccagagagtatgcttttcgaaatgaatggttaccttgattcagccatctataataacgactcaattagacatataatcttgtactctaataactcgccttgcaatgaagccaatcactgctgtatatctaagatgtacaactttctcatcacctacccaggaatcactctttctatctatttctcccagttgtaccacaccgagatggatttcccagcgtccgcctggaaccgcgaagccctcagaagcctggcttccttgtggccccgcgtagtcctttcacctatcagcgggggaatttggcactcagtcctgcatagctttattagcggtgtctccgggagtcatgtgtttcaacccatcttaactggacgggccctggcagataggcataacgcctatgagatcaacgcaataactggtgtgaagccgtacttcacggacgtcttgctgcagacaaagagaaacccaaacaccaaggcacaggaggcgctggaatcctacccactcaataatgccttcccaggacagtttttccagatgccatctgggcagctgcagccaaatttgcctcccgatctgcgagccccggttgtgttcgtcctcgtgccattaagagacttgccaccaatgcatatggggcagaacccgaacaaacctagaaatatcgttcgccacttaaacatgcctcagatgtcatttcaggaaactaaagatttgggtcgcttaccaactggccgctcagtcgaaattgttgagattactgagcagtttgcaagtagcaaggaggctgatgaaaaaaagaaaaagaagggcaagaagtag

SEQ ID NO: 179258 - DNA, 252 bp, Artificial Sequence
  Description of Artificial Sequence: Synthetic coding sequence
atgcggctgttcctgagcctgcccgtgctggtggtggtgctgagcatcgtcctcgaggggcctgcgcccgctcagggtacgcccgacgtgagcagcgccctggataaactaaaagaatttggcaacacactcgaagacaaagcccgtgagttaatctcaaggatcaagcaatcagagttgtctgccaagatgcgtgagtggttcagcgagactttccagaaggtaaaagaaaagctgaaaatcgacagctag

SEQ ID NO: 179259 - DNA, 306 bp, Artificial Sequence
  Description of Artificial Sequence: Synthetic coding sequence
atgggcacccggctgctgcccgccctgttcctggtgctgctggtgcttggcttcgaagtacagggaacacagcaacctcaacaggatgagatgccttctcccacatttttaacacaggtgaaggagagtctctcttcatactgggagagcgctaagactgccgcacagaacctgtacgaaaagacatacttacccgccgtcgatgagaaacttagagatctctacagtaaaagcacagccgccatgtccacctacacagggattttcaccgatcaggtactctctgtcctgaagggtgaggaatag

SEQ ID NO: 179260 - DNA, 384 bp, Artificial Sequence
  Description of Artificial Sequence: Synthetic coding sequence
atgagcctgctgcggaaccggctgcaggccctgcccgccctgtgcctgtgcgtgctggtgctggcctgcatcggggcatgtcaacctgaggcccaggagggaacactctcccctcctcccaaactgaagatgtcaagatggtcgctggtgcgtggaagaatgaaggaactgctcgagacggtggtcaatagaaccagagacggttggcagtggttttggtctccgtccacttttcgcggttttatgcaaacatattacgacgaccacctccgcgacctggggcccctcacaaaggcatggtttctagaaagtaaagactctttgttgaagaagacccatagtctgtgtcctagactggtttgcggggataaagaccaggggtag

SEQ ID NO: 179261 - DNA, 1101 bp, Artificial Sequence
  Description of Artificial Sequence: Synthetic coding sequence
atggccagcatggccgccgtgctgacctgggccctggccctgctgagcgcattcagtgctactcaggctaggaaaggtttctgggattacttttcccagacaagcggcgacaagggacgcgttgagcagatacaccagcaaaagatggcccgggaacctgccaccctcaaggattcgctggaacaggacttaaataatatgaataagtttctcgaaaagctccgcccactctcaggctctgaagcgcccagattaccccaggaccctgtgggaatgcgtcgacagctccaggaagagcttgaggaagtgaaggcccggcttcagccatatatggccgaggcacacgaactggtagggtggaacttagagggcctccggcagcagctgaagccttacacaatggatctcatggagcaggttgctcttagggttcaggagctgcaggagcagctgagagtggtcggtgaggacaccaaggcccagctgctgggtggagtagatgaagcttgggcgctgttgcaggggctgcaatcaagggtagtgcatcataccggcaggtttaaagagctgttccatccatacgctgaatcactggtgagtggcattgggcgccacgtccaggagctacatcggagcgtcgcacctcacgcgcccgcttctccagcccgcctcagtaggtgcgtgcaggtcctctctcgcaaattgaccctgaaagcaaaggccttacacgcacgcatccagcagaacctggatcagctccgcgaggagctcagccgagcgtttgctggaacggggacagaagagggcgcgggacccgatccacagatgctcagcgaagaagtacggcaaagactgcaggccttccggcaggatacatatctccagatcgctgcttttacgagagcaatcgatcaggaaaccgaagaagttcaacagcagctggcaccacccccccctgggcattctgcatttgcgccagagttccagcaaactgattcaggcaaggtgctgagcaagcttcaagcacgccttgatgatctgtgggaagatattacacattcgttgcatgaccagggccactcccacttgggggatccctag

SEQ ID NO: 179262 - DNA, 354 bp, Artificial Sequence
  Description of Artificial Sequence: Synthetic coding sequence
atgggcacctggggcgccccccaccggaccctgccctgccggaacagaggggctatgcagccaagagtgcttctcgtcgtcgcacttctggcactgctggcctctgcccgcgcatcagaagctgaggatgcatcccttctgtccttcatgcagggttatatgaaacacgcaaccaaaactgctaaggatgccctttcaagcgtccaggagtctcaagtcgcacagcaggcaagaggctgggtcacagacggattttcttctctgaaggactattggtcgactgtcaaggacaaattctccgaattttgggatcttgaccccgaggttcgacccacttcggctgttgccgcatag

SEQ ID NO: 179263 - DNA, 168 bp, Artificial Sequence
  Description of Artificial Sequence: Synthetic coding sequence
atgcagccccgggtgctgctggtggtggccctgctggccctgctggccagcgctcgggcttccgaggctgaagatgcctcactcctgtcctttatgcagggatatatgaaacacgcgacaaaaactgcaaaagatgccctgagcagtgtccaggaaagtcaggtatag

SEQ ID NO: 179264 - DNA, 384 bp, Artificial Sequence
  Description of Artificial Sequence: Synthetic coding sequence
atgagcctgctgcggaaccggctgcaggccctgcccgccctgtgcctgtgcgtcctagtgttggcctgcatcggtgcttgccaacccgaagcacaggagggaacgctgagtccccccccgaagctcaaaatgtctaggtggtcgctggtccgggggcgcatgaaggagttactggagaccgtcgtcaatcgcacccgggatggttggcagtggttctggtcaccatcaactttccgtggatttatgcagacctattatgatgaccatctacgggatttaggtccccttaccaaagcttggtttcttgaaagcaaagacagcttgctgaagaagacccattcactctgccccagactggtgtgtggcgataaggaccaaggatag

SEQ ID NO: 179265 - DNA, 384 bp, Artificial Sequence
  Description of Artificial Sequence: Synthetic coding sequence
atgagcctgctgcggaaccggctgcaggccctgcccgccctgtgcctctgtgtgttggtcttagcgtgtatcggggcatgccagccggaagcgcaggaagggaccctgtcacctcctcccaaactcaagatgtcaaggtggagcctcgtccggggccgcatgaaggaattgctggaaaccgtggtgaacagaacaagagacggttggcagtggttttggagccctagcacttttaggggatttatgcagacctattatgacgaccaccttcgcgacctgggacctctgaccaaggcctggttcttggagtccaaggacagccttctgaaaaagacccactcactttgcccccgcctggtgtgtggtgacaaggatcagggctag

SEQ ID NO: 179266 - DNA, 570 bp, Artificial Sequence
  Description of Artificial Sequence: Synthetic coding sequence
atggtgatgctgctgctgctgctgagcgccctggccggcctgttcggagccgccgaaggacaggcatttcatctgggaaaatgcccaaatcctccagtccaagaaaactttgatgtcaacaagtatctgggcaggtggtatgagatagaaaagattccaacaacatttgaaaatggccggtgtatccaggcaaattattcattgatggaaaatggcaaaattaaagtgttaaatcaagaacttagggctgatggtaccgtgaaccaaatagaaggcgaggccactcccgtcaacttaactgaacccgccaagctcgaggtcaaattttcctggttcatgccgtctgcaccctattggattctcgccaccgattatgaaaactacgccctcgtgtattcatgtacatgcataattcaactgttccacgtggactttgcctggatcttggctaggaaccccaatctgccaccagagacagtggattctttaaaaaacattctgacatccaataacatcgatgtgaaaaagatgactgttacagaccaggtgaactgccctaaactcagctag

SEQ ID NO: 179267 - DNA, 450 bp, Artificial Sequence
  Description of Artificial Sequence: Synthetic coding sequence
atggtgatgctgctgctgctgctgagcgccctggccggcctgttcggagcggctgagggccaggcattccacctcggtaaatgccccaatccgcccgtgcaagaaaattttgatgtcaataaatacctcggtcggtggtatgagattgagaagattcccaccacctttgaaaatgggagatgtatccaggccaactatagtcttatggagaacggcaaaatcaaggtcttaaaccaggagttgagagccgacggcaccgttaatcagatcgaaggagaggcgacaccagtgaacctcacagagcctgccaaactcgaggtgaagttcagttggtttatgcctagcgcgccgtactggatcctggcaaccgattacgaaaactacgcactagtatactcctgtacgtgtatcatccaactgtttcacgtggattttgcatggattctgtag

SEQ ID NO: 179268 - DNA, 954 bp, Artificial Sequence
  Description of Artificial Sequence: Synthetic coding sequence
atgaaggtgctgtgggccgccctgctggtgaccttcctggccggctgccaggctaaggtggagcaggctgtcgagaccgagcccgaacctgaactccggcagcagaccgagtggcagagcgggcagcggtgggaactggccttgggcaggttttgggattacctcagatgggtccagactctaagtgaacaggtgcaagaggaactgctgtcatcacaggtaacacaggaactgagggcgcttatggatgagaccatgaaagagctgaaagcttataaaagcgaactagaagagcagctcacccctgtagccgaagagacaagggccagactgtcaaaggaattgcaggctgctcaggctcggttaggcgccgatatggaggatgtgtgtggtcgcctggtccagtatcgcggggaagtgcaggcgatgctggggcaatccacggaggagttgcgtgtgcgtctggccagccatttgaggaagctgcggaaacgtctgctgagggatgccgatgacttgcagaaaaggctagcagtgtaccaagcgggagccagagagggagcggagcgtgggctgagcgctatccgcgagcgcctcggcccactcgtagagcaagggcgcgtgcgcgctgctactgtggggagcttggctggccagccactgcaggaacgcgcccaggcctggggggagcgcctgcgggcccgcatggaggagatgggtagtagaacccgcgaccgtctcgatgaggtaaaggaacaagtggcagaagttagagccaagctggaggaacaggcccaacagatccgactccaagcagaagcattccaggcaagactgaagtcatggttcgaacccctggtagaagacatgcaaaggcaatgggctgggttagttgaaaaagtgcaggccgccgttggaacatccgccgcacctgtgccttctgataatcattag

SEQ ID NO: 179269 - DNA, 660 bp, Artificial Sequence
  Description of Artificial Sequence: Synthetic coding sequence
atgaaggtgctgtgggccgccctgctggtgaccttcctggccggctgccaagccaaagtagagcaggcagtggaaactgagcccgaaccagaattgcgacaacagaccgagtggcagagcggccagcgctgggagctcgctcttgggcggttctgggactatctccggtgggtgcagacgctttccgagcaggtgcaggaagaactgctttcaagccaggtaactcaggagttgcgggcactcatggacgaaaccatgaaggagctgaaagcttataaaagtgagctggaggagcagttgactccagtagcggaagagacacgagctcggctgtccaaggagctacaggccgcacaggcgcgtttgggggccgacatggaggatgtgtgcgggcggttggtgcagtatcggggagaagtgcaggcaatgttgggccaaagcacagaggagctccgagtgcgcctggctagtcacctgcggaaactgcggaagaggctccttcgcgatgcagatgacctgcaaaagagactggccgtgtaccaggccggggcccgcgagggggccgaacgcggcttgtctgcaatccgggagaggctgggaccgctagtggaacagggacgggtgagagctgccacagtggggagtctggcaggtcagtag

SEQ ID NO: 179270 - DNA, 867 bp, Artificial Sequence
  Description of Artificial Sequence: Synthetic coding sequence
gaggtgaaggacgtgctgccccaggagcccgtgcggagcgccgtgggggggacagggatgtcgtccggcgcttcccgaaagtcctgggatccaggaaatccctggccaccagattggcctatcaccggtagaaaaatgaaggtgctgtgggctgccctgctggtgaccttcctggcaggctgccaggcaaaggtggaacaggctgtggaaacggaacccgaacccgagctcaggcaacagaccgaatggcagtccggtcagcgctgggagcttgcactgggccgtttttgggactatctgcggtgggtgcaaacgttgtcggaacaagtgcaggaagaactgctttcgtctcaagtcacgcaagagctcagagccctgatggatgagaccatgaaggagcttaaggcatacaagtcagagctagaggagcagctgacccctgtcgcagaggaaacacgagccagattgagcaaagaactccaagcagcccaggcacggctgggagccgatatggaagacgtgtgcggtcgccttgttcagtacaggggcgaggttcaggcaatgttagggcagtcaacggaagagctccgggtccggttagccagtcacctccggaaattgaggaagcgtctcctgagagacgcagatgatctgcagaagcgacttgcggtttaccaagcgggtgccagggaaggtgctgaacgcggactgtctgccatcagagagaggcttgggcctttagtggaacagggcagggttcgggctgccactgtgggcagcctcgccggtcagccactccaggagcgggcccaagcttggggagagcgtttaagagcgcgtatggaggagatgggcagcagaacctag

SEQ ID NO: 179271 - DNA, 651 bp, Artificial Sequence
  Description of Artificial Sequence: Synthetic coding sequence
atgaaggtgctgtgggccgccctgctggtgaccttcctggccggctgtcaggctaaggtcgagcaggcagtagagactgagccagagccagaactgcgccagcagacagaatggcagagtggtcagaggtgggagttggctctcggaagattttgggattacctccgatgggttcagactctcagtgagcaagtgcaagaggaactccttagctctcaggtcacacaggagctgcgggccctgatggacgaaacaatgaaggaactgaaagcatataaaagtgaattagaagaacagctgacgccagtggcagaggagaccagggccagactgagtaaggaactacaggccgcccaagcaagactgggtgccgacatggaagatgtgtgtgggaggctcgtgcaatatcggggcgaggttcaggctatgctgggacaatcaacagaagaactgagagtccggcttgcgagccaccttcgcaagcttcgcaaacgcttattacgcgacgccgacgatctgcagaaaagactcgccgtgtaccaggccggtgcgagggaaggagccgagcgtggtctgtcagccatcagggaaaggttaggaccactagtggaacagggtcgggtccgagctgctactgtcgggtccctgtag

SEQ ID NO: 179272 - DNA, 10593 bp, Artificial Sequence
  Description of Artificial Sequence: Synthetic coding sequence
atggccaaggaggaggacgaggagaagaaggccaagaagggcaagaaggggaagaaagcccctgaaccggagaagcccaagcgaagcttaaaaggcaccagtcggctgttcatggggttccgcgaccgcacgccaaagatcagcaagaaaggccagttccggagtgcctcagccttcttttgggggctacatacgggcccacagaaaacaaagaggaagcgcaaggcgcgtactgtgctgaagagcacatcaaagctgatgacgcagatgcgtatgggaaagaagaaaagggcgatgaagggtaagaagccaagcttcatggtgattcgcttccccggacgaagaggatacggcagattacggcccagggcccgatctctgtccaaggcaagcacagccatcaattggctcacaaagaaatttctcctgaagaaagccgaggaatcgggctccgagcaggcaaccgtagacgcttggttgcagcgaagctcttctagaatgggttcgcgcaagctcccctttccatctggcgcggaaattctgcggccgggtggcaggcttcgccggtttccaagatcccgctctatttacgcctccggcgaacccctgggattcctgcctttcgaagacgaggctccctttcaccactcaggctcaaggaagtctctctatgggttagaagggttccaggaccttggtgagtattacgactatcacagagacggggacgattactatgatagacagtcacttcataggtacgaagagcaggagccctatcttgcagggctggggccgtattctccggcctggcctccttatggcgatcactattacggataccctcctgaagatccatacgactactaccaccccgattattacggcgggccattcgacccaggctatacttatggttatggatatgatgattatgagcccccctacgctcccccatccggctacagctctccatattcataccacgacgggtacgagggggaagctcacccttatggctactatctggatccctatgccccatacgacgccccataccccccttatgatttgccttatcatacgccatacgatgtgccatatttcgacccatacggcgttcactatactgtaccttatgctgaaggggtctacggtggcggcgatgaggctatctacccacctgaagttccctatttctaccccgaggaaagcgcctctgcattcgtttacccctgggttcctccccccattccttcaccacacaacccatatgcacatgccatggacgatattgctgagctggaagagcccgaggacgcgggcgtggaacgacagggaaccagcttcaggcttcccagtgccgcgttttttgagcaacaaggcatggacaagccggctcgttcaaagcttagtttgattcgaaagttccgactctttccccgcccgcaggtgaagttatttggtaaagagaaattagaagtgcctcttccgcctagtctggacattcccctgccattgggcgacgctgacgaagaggaagacgaggaagagctgccccccgtatccgcagtcccttatggacaccctttctgggggttcctcactcctcgtcaacgcaacctgcaacgagcgctgagcgcattcggcgcccaccggggcctcggcttcggacctgaatttggaagacccgtcccgaggccggctactagtctggcgcggttccttaagaaaacactgagcgagaaaaagcctatcgcccgattgaggggtagtcagaaggcccgcgctggcggaccagcagtgcgagaggccgcatacaaacgcttcggatacaagttggcagggatggaccctgagaagcccggcacgccaatcgtgctccggagagcccagcctagagctcgtagtagtaacgatgcacggaggcccccggctccgcagcccgcgcctcgcactctgagccactggtcagcgttactgtcacccccagtgcccccgaggccaccaagctctgggccgcccccagcaccaccactgagtccagcactgtcaggactgccccgtccggccagcccttatggttccttgaggcgacaccctcctccttgggctgcccccgcccatgtcccgcccgccccccaagccagctggtgggccttcgtagaaccacctgctgtgtcccccgaggtgcctccagatttacttgcatttccgggccctagaccctccttccgcggctcgcggagaaggggcgcagctttcggcttccctggagcttctccacgcgcatctcgtcgaagggcttggtcacccctcgcaagcccccagcccagtctccgcagctcccctggacttgggtactgctcccccctggcacctccctcacctcagctgtcattgagaactggaccctttcagccgcctttcctgccacctgcccggcgtccaagatctttgcaggaaagccccgcacctcgtagagccgccgggcgcctcgggccaccagggtcaccattgcctggaagcccccgcccgcctagcccccctttgggtctgtgccacagtccacgtagatcctccttgaaccttccgtcacggctgccccatacctggcgccgtctgagcgagccaccaactcgggccgtcaagccccaagttcggctgccttttcaccgtccccctcgggccggtgcctggcgcgccccactcgagcaccgggaaagccctagagagcccgaggactccgaaacaccctggaccgtgccccctttggcaccatcctgggatgtggatatgcccccgacccagcgacctcccagcccgtggccaggaggagcagggtctcgacgagggttcagccgcccccctccagtgcccgagaacccctttctacaactccttggccctgtaccctctccaacacttcagcccgaggacccggcagccgacatgaccagggtgtttctcggtcgccatcacgagccaggcccaggacagttgaccaagagtgccggacccacaccagagaagccggaagaggaagcgacccttggtgacccccagcttccggcggagacaaagccacccacacccgccccaccaaaggacgttaccccacccaaggacatcacccctccaaaagatgtactgccagaacagaagacccttaggccgtctctgtcttaccctctcgctgcatgcgaccagacccgggctacttggcctccctggcaccgctgggggaccttaccacaggccgccgccccccttgccccaatcagagcccccgaacccctgccaaaaggcggagaaagacggcaggcagcacccgggcgctttgccgtcgttatgcctcgcgttcagaagctctcttctttccagcgcgtggggccagcaaccctgaaacctcaagttcagcccattcaagacccgaagccccgcgcctgttctctgagatggtcttgcctgtggctgcgagccgacgcatatggcccctggccacgcgtgcatacccatccccaatcatgccatttaggccctggagccgcctgtcttagcctgagaggttcttgggaagaggtgggccctccctcttggagaaacaagatgcacagtatacggaacctccctagcatgcgtttccgggagcagcatggagaagatggggtggaggatatgactcagttggaggatctgcaagagacgaccgtgctgtcaaatctgaagatccggtttgagagaaatctgatctatacatatatcggcagcatccttgtgagcgttaacccatatcagatgttcgggatttatgggccagagcaggtgcaacaatacaacggacgcgcattaggagaaaacccaccccatctatttgccgttgctaatctggcctttgctaagatgttagacgcgaagcagaatcagtgcatcattatctctggcgagagcggctcgggaaagacagaagctaccaagttgattcttagatacttagctgctatgaatcaaaagcgggaggtaatgcagcaaatcaagattctggaggcaaccccgttactggagtctttcggcaatgctaagaccgtgcgcaacgacaatagcagccgtttcggaaagttcgtcgagattttccttgaaggcggcgtgattagcggagcgatcacctcacagtaccttctggagaagagccgaatcgtgtttcaggccaaaaacgagaggaactatcacatcttctacgagctcctcgccggactgccggcgcagctgagacaggccttcagtcttcaggaggccgaaacatactattatctgaaccagggagggaactgcgagatcgccggcaaaagtgatgctgacgatttccgacggttgctcgctgcaatggaagtgctggggttctcttctgaggatcaggatagtatttttcgaatactggcatccattctgcatctcgggaacgtgtactttgaaaagtacgagactgatgcacaggaggtcgcttccgtggtgtcggcaagggaaatccaggctgtggctgagctactacagatctctccggaagggttgcaaaaagctatcactttcaaggtgactgaaactatgcgcgagaaaatctttacgcccctgaccgtcgagtccgccgtcgacgcaagggatgccatcgccaaggtgctatatgcactcctatttagctggctgatcacacgcgttaacgccctcgtgtctccacggcaggatactcttagtatcgctatacttgatatctatgggtttgaggacctttcctttaattctttcgaacagctgtgtatcaactacgcaaacgaaaatctgcagtatttattcaataaaatcgttttccaagaggagcaggaggagtacatccgcgagcaaattgattggcaggaaatcactttcgccgacaatcaaccgtgtatcaacctcattagtttaaaaccgtacgggatactcaggatactcgatgatcaatgctgctttccacaggcaacggatcatacctttctgcagaagtgtcactatcatcatggcgcaaacccattgtacagcaagcccaaaatgccactgccagaattcacaatcaagcattatgccgggaaggtgacataccaagtgcataaattcctggataagaaccatgatcaggtgagacaggacgtactagacctgttcgttaggtccaggacacgggttgttgctcacttattcagctctcacgccccccaggccgccccccagagattgggtaagtcttcaagtgtgactcgcctgtacaaagcacacacggtggctgccaaattccagcaatctctcttagacttggttgaaaagatggagaggtgtaatcccctgttcatgagatgcctcaaacccaatcataagaaggaacccgggctttttgagccagatgtcgtgatggctcagttacggtattccggagtgctggagacggttcggatcagaaaggaaggatttcctgtgcggctgccctttcaaggttttattgacagatattgctgcctcgtggctctcaaacacgatctccccgctaacggcgatatgtgcgtgtctgtgttaagccggctttgtaaagtgatgcccaacatgtatagggtcggcgtgagtaagcttttcctcaaggagcacctgtaccaacttctggagtcaatgagggagcatgtcctgaacctggcggcattgacattgcaacgatgcctccgcgggttctttatcaagaggagatttaggtccttgagacacaaaataatcttactacaaagccgcgcccgggggtacttggccaggcagcgctaccagcagatgagacggtccctcgtgaagtttcgctcccttgtacatgcgtacgtatccagaagacgatatcttaaactacgggccgaatggcggtgtcaggtggaaggagcgcttctgtgggaacaggaagagctgtccaaacgcgaggtggtggcagtgggccatctagaggttcctgcagaacttgctggcttacttcaagcagttgccggtcttgggctggcccaggtgcctcaggtcgcccccgtacggactccacggctgcaagcagaaccccgggtgacattaccgcttgacataaataactatccaatggctaagtttgtacaatgccattttaaggagcctgccttcgggatgctgaccgtccctctgaggacacccttaactcagttgccagctgagcaccatgccgaggccgtcagcattttcaaactgattctccggttcatgggtgatcctcacctgcacggggctcgcgagaacatatttggcaattatatcgttcaaaagggactagccgtgcctgagctcagagatgagattctggcacagctcgccaatcaagtttggcacaatcataacgcacataatgccgaacgggggtggctgctgctagcggcatgcctgtcaggctttgcacctagtccctgttttaataagtacctcctaaagttcgtatccgactatggacgcaacggatttcaggctgtgtgccaacaccgcctgatgcaggccatggggagagcgcagcagcagggatctggcgctgcccggacccttcccccgactcaactagaatggactgccacatatgaaaaagcctccatggcacttgatgttggctgctttaatggcgatcagttttcctgccctgttcactcctggagcactggggaggaggttgcgggagatattttgcgacatagaggactggcagatggctggaggggctggaccgttgccatgaaaaatggagtgcagtgggccgaactcgctggtcacgattacgtactggaccttgtgagtgacctggagcttcttcgagactttcctaggcaaaagtcttatttcatcgtgggaacagagggcccagctgcctctagaggcgggcctaaggtcgtgtttgggaacagctgggacagtgacgaggacatgtcaacaaggcctcaacctcaggagcacatgcccaaggtgcttgattcagacggatacagttctcataaccaggatgggacgaatggcgaaacagaggctcaacggggaacagctactcaccaagagtcggactccctgggcgagccagccgtgcctcacaaagggctggactgctaccttgattcattgtttgaccccgtgctttcctacggtgatgctgacctcgaaaaacctacggctattgcttacaggatgaagggaggcggccagcctgggggaggtagctcctctgggactgaggacacacctaggcgcccgcccgaacctaagcccattccgggattggatgctagtaccctggccttgcagcaagcttttatccataagcaggcggtacttctggctagggaaatgactctgcaggcgactgctctacagcaacagccactgagcgccgcgttacgatctttacctgccgaaaagcccccggccccagaggctcagcctactagtgtgggtacgggcccacctgccaaacccgtgctgctgcgggccacccctaagccacttgcacccgctcctctcgcgaaggctccacgcctgccaattaaaccggtcgccgcacctgttttggctcaagatcaagcatcccccgaaacaacctcaccctcaccagagctggtgagatacagcactctgaactccgagcactttccccagcccacacagcaaattaagaatattgtgagacagtatcagcagccatttcgtggtggacggccagaagcgcttcgaaaggatggaggcaaggtgttcatgaagagacccgacccacacgaagaagcacttatgatcctaaaagggcaaatgacccatctggccgcagcacctggaacccaggtctcccgtgaagcggtggccctagtcaagcctgtgacaagtgctccccgcccatctatggcacccacaagtgctctgccatcacggtctctggagcctcctgaggagctgacccagactaggctgcaccgtctgattaaccccaacttttacgggtatcaggacgctccgtggaagattttcctgagaaaagaagttttctatcccaaggattcttattctcaccctgttcagctcgatctgttgttccgacagattttacatgacacactcagcgaggcctgtctgcgcatctccgaagatgagcggcttaggatgaaagccctcttcgcacagaaccagttggatacccagaagcccctcgtcacagaatccgttaaacgcgcggtcgttagcaccgccagagatacttgggaagtatacttctctaggattttccctgctactgggagcgtagggacaggtgtccagcttctggcagtgtcgcatgtgggcattaaactgctccgtatggtcaaaggcggtcaggaggccggcgggcaacttcgagtactgagagcatattcgtttgccgatatcctgtttgtcactatgccctctcagaatatgctggagttcaacctggcatccgaaaaggtgattctgtttagtgcaagggcccaccaagtgaaaacgctcgtggatgattttatcttggaactcaaaaaggatagcgattatgtcgtggccgtgcggaactttctgccggaggatccagctctgctagccttccataagggtgatattatccatttgcagcccctggagccccctcgggttggatactcggctggctgcgtcgtgcggcgaaaggttgtttacctggaggaattacgtagacgcggcccagacttcggctggagatttggcacaatccacggccgcgtcggacggttcccttctgagctggtccagcctgccgccgcccccgatttcctgcagcttccaaccgagccaggacgcggtagggcagccgccgtggcagccgcagtggcttccgcagcagcggctcaagaagtcgggcggcggagagagggccctccggtccgtgctcggtcagccgatcacggagaagacgccctcgccctgcccccttacaccatgttggaatttgcccagaaatactttagggaccctcagaggagaccccaggacggtctcagactgaagagcaaggaacctagagagagccgtactttggaggacatgctttgcttcacaaagacgcccctgcaggagagtttaatcgagttgtcggacagctccttgagtaagatggccacagacatgtttctggccgtcatgcggttcatgggtgacgcgccactgaaaggacagagtgacctggacgtactgtgtaacctgctgaagttgtgtggcgatcatgaagtgatgagggacgagtgctactgccaggtggtgaaacagatcaccgacaacacgtccagcaagcaagactcctgtcaaaggggctggaggcttctctacatcgtgaccgcataccattcttgctctgaggtcctccacccgcacctgacacgcttcctgcaggatgtttctcgaacccctggtttgcccttccagggaatcgccaaggcttgcgagcagaacttgcaaaagaccctgcgctttggcgggcggctagagttgccctcaagcatcgaactgcgcgctatgttggccggaagaagttcaaaaagacagctctttctgttaccgggaggcctggagcgtcaccttaaaattaagacgtgcactgttgctctggatgtcgtggaggaaatctgcgccgagatggccctgacacggcctgaagctttcaacgagtatgtcatcttcgtggttaccaaccgcgggcagcacgtgtgcccgctgagtagacgcgcctacattttagacgtagccagcgagatggaacaagttgacgggggatacatgctgtggtttcgcagggtcctgtgggaccagccactgaaattcgaaaatgaactgtatgtgactatgcactataaccaggttctccctgattatctgaaaggcttgtttagttcagtccctgcaagtcggccctcagaacagctgctgcagcaagtgagcaagctggcctcccttcaacaccgggcaaaggatcatttctatttgccctctgtcagagaggtgcaggagtatatccccgcacagttgtaccgaacaaccgctggtagtacgtggctgaatctggtgtctcaacatcgccaacagacccaagccctgtcaccccatcaggcgcgcgcccagttcctgggactgctgtcggccttacctatgtttggttcatctttcttttttatacagtcctgctccaatattgcagtgccggcgccctgtatcttagctatcaaccataatgggctgaatttcctgtccactgagacacatgagctgatggtgaaatttcctctgaaagagattcagagcactagaacccagcgaccgacggccaattcatcatacccttatgtggaaattgccctcggcgacgtcgctgcccaaagaactttgcaattgcagctggagcagggattggagctttgtagagtagtggcagtgcacgtggaaaacttattgtctgcacatgaaaagagattgactctccctcccagcgaaatcactctactctag

SEQ ID NO: 179273 - DNA, 840 bp, Artificial Sequence
  Description of Artificial Sequence: Synthetic coding sequence
atgttccgggccccctgccaccggctgcgggcccggggcacccggaaagccagggccggcgcttggcgcggatgcacttttccatgcctggggaaagggatggaacggcctgccgctcgggaaccccacgggcccgacgctctccgccgctttcagggcctcctcctggatcgaagaggcagactccatgggcaggtgctccggctacgggaggtggcgcggcgccttgaacgcctgaggaggcgttctctcgtggctaatgtggccggctcctctctgtccgctaccggagctctggcagcaattgtggggctgagtctctcacccgtgaccttgggaacatccctcctggtctccgccgttggcctcggtgttgccaccgccgggggggcagtgacgattacctccgacttgtcgctcatcttttgtaactctcgcgagctgcgaagagtgcaggaaatagcagcaacatgtcaggaccagatgcgggagatcctctcctgtcttgaattcttttgtcgatggcagggctgcggggacagacagttactgcagtgcggacgtaacgcaagcattgcattgtacaacagcgtgtacttcattgtattttttggatccagaggctttctcatcccaaggcgggcagagggcgacaccaaggtgtctcaggccgtacttaaggcaaagatacagaagctcgccgagtccctggagtcctgtacgggcgctctcgacgagctgagtgagcagctggagtctagggtgcagctgtgcacaaagtccagtcgaggacacgatctgaagattagtgcagaccagcgggccggactgtttttttag

SEQ ID NO: 179274 - DNA, 747 bp, Artificial Sequence
  Description of Artificial Sequence: Synthetic coding sequence
atgggcatggagcggcccgccgcccgggagccccacggccccgacgccttgagacggtttcagggcttactgctcgaccgaagaggtcgactgcacgggcaggtgctccggttgcgggaagtcgcacgaagattagagcgtctaagacgccgctccctggttgcaaacgtcgccggctcaagtttgagcgccaccggagccctcgcggcgattgtcggcctgagtctcagccctgtgactctgggtacaagtctgttggtcagcgctgtcggattgggcgttgcgacagctggcggggcggtgaccattacaagcgacctgtccttgatcttctgcaatagtagggagctccgccgagtgcaggagatcgcagcaacatgtcaggaccagatgagagagatcctgtcctgcctggagttcttttgcagatggcaggggtgcggcgaccgtcagctgttgcaatgtgggcgcaatgcaagcatagctttgtacaactccgtatattttatcgtttttttcgggtcgcggggattccttatccctcgccgcgcagaaggagatacaaaggtgagccaggccgtcttaaaggctaagattcagaaactcgccgaatctctcgaatcatgtaccggagctctggacgaactgtccgagcagttggaatcaagagtccaactgtgtacaaagagctcaaggggacacgacctgaaaatcagcgccgaccagcgagccggccttttcttttag

SEQ ID NO: 179275 - DNA, 1245 bp, Artificial Sequence
  Description of Artificial Sequence: Synthetic coding sequence
atgcggttcaagagccacaccgtggagctgcggcggccctgcagcgacatggaaggcgccgccctgctgagagtgtctgtgctgtgcatctggatgagcgccctctttctaggcgtaggggtcagagctgaagaggctggcgctagggtgcagcaaaatgtgccctcaggcaccgataccggagatccccagagcaaaccattgggcgactgggccgctggcacaatggacccagagagctctatcttcattgaggacgccataaaatacttcaaagagaaagtctccacgcagaacttgctgttgctcctgacagacaacgaggcttggaatggttttgtggccgctgcagaacttccgcgcaatgaggcagatgagctccgaaaggcactggacaacctggctcgtcaaatgatcatgaaggacaagaattggcatgataagggccagcagtaccggaactggttcttaaaagagttcccacggctgaaatcggaactggaggataatatccgtcggctccgcgcactggccgatggggtccaaaaggtgcacaagggtaccactatcgctaacgtggtgtccgggagtctttcaatttccagcgggatcctaacactagtagggatgggtctggcaccgttcacagagggaggctccctcgtgctgctcgagcccggcatggagcttggaatcactgcagcactgacaggaatcacaagctccactatggattacggcaaaaagtggtggacccaagcacaagcacacgacttggttatcaaatcccttgacaaactgaaggaagtccgcgagtttctgggggagaatatttcaaatttcctcagccttgctgggaacacgtaccagttaacccgtggcatcggaaaggacatacgcgctctacggagggccagagcgaacctgcagagcgtgccccatgccagcgcaagcagaccgcgagtcactgaacctatttcagctgaatcaggagagcaagtggaaagggtgaacgagccaagcatcctggagatgagcagaggcgtgaagctcaccgatgtagcacccgtctctttcttcctggtcctggacgtggtatatttagtgtatgagagcaagcaccttcatgagggcgcaaaaagcgagaccgccgaggaacttaagaaagtggcacaagaacttgaggagaagcttaacattcttaacaataactacaaaattctgcaggctgatcaggagctgtag

SEQ ID NO: 179276 - DNA, 834 bp, Artificial Sequence
  Description of Artificial Sequence: Synthetic coding sequence
atgatcatgaaggacaagaactggcacgacaagggccagcagtaccgcaattggtttctcaaagaattcccaagacttaaatctgaactggaggacaatatccgtcgtttgcgcgctctggctgacggggtgcagaaggtgcataaagggactactatagccaacgtggtttctggatctctctctatctcctcgggcatcttgacactcgtgggcatgggattggcaccctttactgaggggggctccttggtgcttctggagcccggaatggaactggggataacagccgctctgaccggcattaccagttccactatggactatggcaaaaagtggtggacacaagcccaggcccatgatttggttatcaaatcactggataagctgaaggaggtcagagagttcctgggcgaaaacatatcaaacttccttagtctggccggcaacacataccagctgacgcggggcataggcaaggacatcagagccctgcgccgggcccgggccaatctccagtctgtgccccatgccagtgcgtccagacctcgggtcacggaacctatctccgccgagagtggggaacaggttgaacgcgtcaatgagccaagcatcttggaaatgagcaggggtgtgaagttaacggacgtagcccctgtaagtttctttctcgtgctggacgttgtttacctagtgtatgagtcaaagcatctccatgaaggcgccaaatctgagacagctgaggagctaaagaaagttgcccaggagctcgaggagaagctcaacatcctaaataataattataaaatcctgcaagctgaccaggaactgtag

SEQ ID NO: 179277 - DNA, 1197 bp, Artificial Sequence
  Description of Artificial Sequence: Synthetic coding sequence
atggagggcgccgccctgctgcgggtgagcgtgctgtgcatctggatgtccgctctctttctaggagtgggcgttagggcagaggaggccggggctcgtgtgcagcagaacgtcccctccggaactgacaccggcgatcctcagtcaaagcccctgggcgactgggcagcgggaaccatggatccggaatcctcaatctttatagaagacgctattaagtactttaaggagaaggtgtcgactcaaaacttacttttgttgctgaccgacaatgaagcctggaacggctttgtcgccgccgccgaactaccgaggaacgaagccgatgagctccgaaaggccttagacaatttggccaggcagatgatcatgaaagacaagaattggcatgataagggccaacagtacaggaactggtttctgaaagagtttccgcgccttaaatcagagctggaagacaatatcagacgcctcagagcccttgcagacggtgtgcaaaaagttcacaaaggcactacaatagccaatgtcgtttcgggttcgctctctattagttccgggatcctgacgcttgtaggcatggggctggcccccttcacagaggggggttctctagtattactggaaccgggtatggaactcggcattaccgccgccctgacggggatcaccagctccaccatggattacggaaaaaaatggtggacccaggcacaggcgcacgaccttgtaattaagtccctcgacaaactaaaggaggttagagagttcttaggagagaatattagcaatttcttgagcttggctggtaacacctaccagctgacacgcggtatcggcaaggacataagagcactcagaagggcgcgcgcaaatctgcagtctgtaccccacgcatcagctagcaggccccgggtaacagagccaatatccgcagaaagtggcgaacaggtggaaagggtgaatgaaccttcaattttagagatgtcccgcggcgtaaagttgacagacgttgctccagtttcattttttttggtgcttgacgtggtctacctcgtgtacgaaagcaagcaccttcacgagggcgccaagagcgaaactgcagaggaacttaagaaagtagcccaagagctcgaggagaagctgaatattttgaataataactataagatcctgcaggctgatcaggaactgtag

SEQ ID NO: 179278 - DNA, 1197 bp, Artificial Sequence
  Description of Artificial Sequence: Synthetic coding sequence
atggagggcgccgccctgctgcgggtgagcgtgctgtgcatctggatgtccgcacttttcctaggcgtcggcgtaagggctgaagaggcaggtgctcgagtccagcagaatgtgccaagcggcacggatactggggacccgcagagcaaacccttgggtgattgggcagccggaacaatggatcccgaatccagcatttttatagaagatgccatcaaatatttcaaggaaaaagtctctacccaaaatttgctcctcctgcttacagataatgaagcatggaacggtttcgtggccgccgcagaattgcctcgcaatgaggccgacgagctgcggaaggctctcgacaatctggcacggcagatgatcatgaaggataagaactggcacgacaaaggccaacagtaccgaaattggtttctgaaagaattccctcgcctaaaatcagaattggaagataacatacgacgactccgcgcccttgctgatggcgtgcagaaggtgcacaaaggtactaccatcgccaatgttgtaagtgggtccctgtctattagcagtggcatactgactctggtgggcatgggactggcacccttcaccgaagggggttcactggttttgctggagcccggaatggaactgggcatcaccgctgcgctgaccggtattactagtagtacaatggattatggcaagaagtggtggacacaggcacaagcccacgatctggtgatcaagagtctggataagttgaaggaggttcgggagttcttaggtgagaacatctcaaactttctatcgctggccggaaatacataccagctgacacggggaatagggaaagatatccgcgcgctgagacgcgcaagagccaacctgcagtccgtccctcacgcatctgcttcccgccctcgggtaacagagccgatctcagccgaaagcggcgagcaggtggagcgggtgaatgaaccttcaatcctagagatgagcaggggggtcaagctgacggacgtagcccccgtgagcttttttctggtgctggatgtcgtttacttagtatacgaaagcaaacatcttcatgagggcgcaaaaagcgagaccgccgaagagctgaagaaagtcgcccaggagctggaagaaaagttgaatatcctcaataacaattacaagattctgcaggctgaccaggagctctag

SEQ ID NO: 179279 - DNA, 1197 bp, Artificial Sequence
  Description of Artificial Sequence: Synthetic coding sequence
atggagggcgccgccctgctgcgggtgagcgtgctgtgcatctggatgagcgcattattcctgggagtgggcgttcgggccgaggaggctggagccagagtgcaacagaacgtgcctagcggcactgacactggcgacccccagtctaaacccttgggagattgggcagccggtacaatggatcccgagagttccatcttcatcgaagatgccataaagtacttcaaagagaaggtttctactcaaaacctgctgctgctgctgacggataatgaagcctggaatggatttgtggcagccgcggaattgcctcggaatgaggctgatgagctgagaaaggcactggacaatttggccagacagatgatcatgaaagataagaattggcacgacaaagggcaacagtacagaaattggttcctgaaggaatttcctcgactcaaatctgagctagaggataacattcgcagattgagggctctggccgatggcgtgcagaaagtccacaagggcacgacaattgctaacgtggtgtcaggcagcctaagtatctcatctggtatcctaaccctggtcgggatggggttagcaccttttacggagggcggctccttggttctgctggaaccaggaatggagctgggaattactgctgctctgactggcataacgtcctccaccatggattacggaaagaagtggtggacccaggcacaggcccacgatcttgtgatcaagagcctggataaattgaaggaggtcagggagttcctgggagagaatattagtaatttcttaagtctggccggaaacacttaccagctgaccaggggaattggcaaggatattcgcgcgttaaggagggcccgagctaatcttcagtccgttcctcatgcaagcgcaagccggccccgcgtgacggagccaatcagcgccgaaagcggggaacaagtcgaacgggtgaacgagcccagtatcctcgaaatgtctcggggcgttaaattgacagatgtcgcacctgtcagcttctttcttgtgcttgacgtagtataccttgtttatgaatccaagcacttacatgagggggccaagtccgagactgccgaggaactcaaaaaagtggcacaagagctcgaggagaagttaaatattctgaacaataattacaaaattctacaggctgaccaggaactgtag

SEQ ID NO: 179280 - DNA, 1197 bp, Artificial Sequence
  Description of Artificial Sequence: Synthetic coding sequence
atggagggcgccgccctgctgcgggtgagcgtgctgtgcatctggatgtccgctttgtttctgggcgtgggggttcgtgctgaggaggcgggagctcgggtgcagcagaacgtcccgagcggaaccgacactggcgatccacaaagtaaaccactaggagactgggctgccggcactatggacccagaaagttccattttcatcgaagatgccattaaatactttaaggaaaaagtgagcacgcaaaacctgctgctgctgctgacagacaatgaggcctggaatggatttgtggccgctgctgagctgccacgaaacgaagcagacgagctgaggaaggccctcgataatctggctcggcagatgatcatgaaggacaagaattggcacgataagggtcagcaatatagaaattggttcttgaaggaattccctaggctgaaatccgaactggaggataatattaggaggctcagagccctggcagacggagtgcagaaggtgcacaaaggcactactatcgctaatgtggtgtcagggagcctctcaatcagcagcgggatcctgacattggtgggcatgggcctcgccccatttacagagggcgggagtctggtcctgctcgagccggggatggagcttggcataacagcggctttgactggcataacaagcagcacgatggactacggaaaaaagtggtggacccaggcccaggctcacgacctggtcattaagtcgttagataaactaaaggaagtgcgagagtttctgggtgagaacatctcgaatttcctctcactagcagggaacacctatcaactcacacgtggaatagggaaggatatcagagcactaagacgggcccgtgctaacttgcaaagtgtgccgcacgcctctgcatctcggccgcgtgttacagagcctatcagcgccgaaagcggagagcaagtggagcgggtcaacgagcccagtattctcgagatgtcaagaggtgtgaaactcactgacgtcgcacccgtatccttttttctggttctggacgtggtgtatctcgtgtacgaaagtaagcacttacacgagggggctaagtccgagactgccgaagagttaaagaaggtggcacaggagctggaggagaagctgaatatactgaacaataactataaaatactacaggccgatcaggagctgtag

SEQ ID NO: 179281 - DNA, 1143 bp, Artificial Sequence
  Description of Artificial Sequence: Synthetic coding sequence
atggagggcgccgccctgctgcgggtgagcgtgctgtgcatctgggtccaacaaaatgtccctagcggaacagataccggggatccacagagtaaacctctcggcgactgggctgcgggtaccatggatccagagagttctatcttcatcgaagatgccattaagtatttcaaggaaaaggtctccacacaaaacttactgttactgctcacagataacgaggcctggaatggattcgttgccgcagccgaactgccacggaacgaggccgacgagctcaggaaggcactggacaacctcgcccggcagatgatcatgaaagacaagaattggcacgacaaaggccagcagtataggaattggtttctcaaggagttccctcggcttaaaagtgaactagaagataatattcgtcgtctcagagcactggctgatggagtgcagaaggtccacaaaggcacaactattgctaatgtcgtctccggctcactctctatttcctctggaattctgacgcttgttgggatgggactggctccgtttaccgagggcggatccctcgtcttgctggagccaggcatggagctcgggattaccgcagctcttactggaatcaccagcagtactatggactacgggaaaaaatggtggacccaggcacaggctcatgacctggttataaagagcctggacaagctgaaggaggtgagggagttcctgggcgagaatatttccaacttcctatccctcgctgggaacacctaccagcttactagagggattggtaaagacattcgagcattaagaagagcccgcgcaaacctgcaatcagtacctcacgcgtccgcatccaggcctagagtgaccgaacccataagcgccgagtctggagagcaggtcgagcgggtcaacgaaccttctatcctggagatgagccggggagtgaagctgactgacgtggcaccagtgagctttttcctggtccttgacgtggtgtatttggtctatgagtcaaagcacctgcatgaaggcgctaagagcgagacagcggaggaacttaagaaggtggcccaggaactggaagaaaaactgaacatcttgaataacaattacaagattctacaggctgatcaggaactgtag

SEQ ID NO: 179282 - DNA, 483 bp, Artificial Sequence
  Description of Artificial Sequence: Synthetic coding sequence
atggagggcgccgccctgctgcgggtgagcgtgctgtgcatctggatgtcggcgctatttcttggggttggcgtccgggccgaggaagcaggagcgagggtgcagcaaaacgttcctagtgggactgacacaggagatccacagtccaaaccactgggcgactgggccgctggaacaatggaccccgaaagcagtatctttatcgaagacgccatcaagtacttcaaagagaaggtgtcgacccaaaacctgctccttctgttaaccgacaacgaggcatggaatggctttgtcgccgctgccgagctgcccaggaatgaggccgacgaactgagaaaggccctggataatcttgccagacagatgattatgaaagataagaactggcatgataaaggacagcagtataggaattggtttctgaaagagttccctaggctaaaaagcgagttggaagacaacattcgccgcctgagagcctag

SEQ ID NO: 179283 - DNA, 426 bp, Artificial Sequence
  Description of Artificial Sequence: Synthetic coding sequence
atggagggcgccgccctgctgcgggtgagcgtgctgtgcatctggatgagcgccctgttcctgggggttggcgtgcgggccgaagaggcaggcgctcgtgtacagcagaacgtgccttccggtaccgacaccggagatccgcaaagtaagccactgggcgactgggcagctggaactatggaccccggtccggccgggagccgcggagatagtggggagccatgcacccttaggcctgcatgcagaggccaacggcagcacggcggcgctagccgcattagtgctgagggcccagcacccatgccgagacggcgcacaccaagcaccgcccatcttcgcgtgcccaagaccagccgccgcaacctcctctgcatgcgagcagtaagccttctgaggatgccgctgtctatatctaggaagaagtag

SEQ ID NO: 179284 - DNA, 357 bp, Artificial Sequence
  Description of Artificial Sequence: Synthetic coding sequence
atgcggttcaagagccacaccgtggagctgcggagcaccctgagccaacccctgttctcttgtagccggcgccgaccatgctctgacatggagggtgccgctctgcttcgggtaagcgtactgtgtatttggatgtccgctctcttccttggtgtgggcgttagagctgaagaagcgggggcccgagtgcaacagaatgtccccagcggaacagacacgggcgacccccaaagtaaacccctgggggactgggcagccggcactatggatccggagtcttctatctttatcgaggacgccattaagtattttaaagagaaggtgagtacacagaatctcctcctcctcctgacctag

SEQ ID NO: 179285 - DNA, 426 bp, Artificial Sequence
  Description of Artificial Sequence: Synthetic coding sequence
atggagggcgccgccctgctgcgggtgagcgtgctgtgcatctggatgagcgcattgttcttaggggtgggtgtgcgggccgaagaggcgggtgcccgggttcagcaaaacgtgccttcggggaccgatactggcgacccccaaagcaagcctcttggtgattgggccgcaggtaccatggacccaggcccagccgggtctaggggagattcaggggaaccatgcacactgagacctgcttgccgtggccagcgacagcatggcggggcctcaaggatttcagcagaggggcctgccccaatgcctaggagaaggaccccgtctaccgcgcacttgagagttcctaagacttctaggcggaatctgctgtgtatgcgcgctgtgtccctgctgcgaatgcccctctctattagccggaaaaaatag

SEQ ID NO: 179286 - DNA, 1014 bp, Artificial Sequence
  Description of Artificial Sequence: Synthetic coding sequence
atgaaccccgagagcagcatcttcatcgaggactacctgaagtactttcaggatcaagtcagtcgcgagaatctgctgcaactcctgactgatgatgaggcttggaatggtttcgttgcagctgcggaacttccacgtgatgaagctgatgagcttaggaaggcactgaataagctggcgagtcacatggtcatgaaagacaaaaaccggcacgacaaggaccagcaacatcggcagtggtttttaaaagaattcccgaggctaaaacgcgaactggaggaccacatcagaaagttgcgcgccctggccgaggaagtggaacaagtgcaccgaggtacaacaattgccaatgtagtgagcaactccgttggcacaacttctggaatactcacgctattgggcctggggttagctcctttcacagaaggtatctcctttgtgctcctggacaccgggatgggcctcggcgctgccgcggctgtcgccggcataacgtgtagcgtagtggaattggtcaacaagctacgggcacgggcccaggctagaaacctcgaccagtctggtaccaacgtggctaaggtgatgaaggaattcgtgggcggtaacacgcctaatgtcctgacactagtggacaattggtaccaggtaacgcaggggatcgggcgaaacattcgcgcaatccggcgggcaagagccaaccctcagctgggcgcgtacgcaccacccccccacatcattggacgtatttcagcggaaggtggggagcaggtagaacgggtggtcgaagggccagctcaggccatgtcacgcggcacgatgatcgttggcgctgccactggagggatcctcctcctgttagatgtagtatctctggcctacgagtctaaacacctgctggaaggggccaaatcggaatccgcagaggaattaaagaaaagagctcaggaactcgaaggcaagctgaactttctgaccaaaatacatgagatgctgcaaccaggccaggatcagtag

SEQ ID NO: 179287 - DNA, 1014 bp, Artificial Sequence
  Description of Artificial Sequence: Synthetic coding sequence
atgaaccccgagagcagcatcttcatcgaggactacctgaagtactttcaggaccaggtctcacgagagaacctcctccagcttttgacagatgacgaggcttggaacgggttcgtggctgctgctgagctgcctagagatgaggctgatgagctgcgtaaggcattgaacaagttggcctctcatatggtcatgaaggataaaaacaggcatgataaggaccaacagcaccggcagtggttcctgaaagagttcccaagactgaagagagaactggaggaccacatccggaagttgagggcgctggccgaggaggtagaacaggtgcatagaggaaccacaatcgcaaacgtagtgtctaatagtgtagggacgacatcaggtatccttaccctcctgggcctgggattggctcctttcacggagggtattagtttcgtgctcctagacacagggatgggcctgggcgctgccgccgccgtagctggcattacctgtagcgtggtagaactggtaaacaagctccgagctcgcgcccaagctaggaatctggatcagtcgggtacgaacgtcgctaaagtaatgaaggaattcgttggaggtaatactcctaatgtcttgacactggtcgacaactggtatcaggtgacccagggcatcggtagaaatatccgtgccatcagacgtgctcgggctaacccacaactcggtgcctacgcccctcccccccatattatcggccgcatcagcgctgagggaggagagcaggtcgagcgtgtggtggaggggcccgctcaggctatgtcccgcggaaccatgattgtgggtgccgccaccggaggcattctgttactactagatgtcgtgtccctggcttatgaaagtaagcatctgcttgagggagcaaagtccgagagtgcggaagaactgaagaaaagggcgcaagagctggagggaaaacttaatttcctgactaagattcatgaaatgctgcagcctggacaggaccaatag

SEQ ID NO: 179288 - DNA, 1350 bp, Artificial Sequence
  Description of Artificial Sequence: Synthetic coding sequence
atgcacagctggacctgggacccccacagcagcgagcagctggacctagcccagtccctgtccgaagaagaccccttgagttccctgagagggtccatacagccccagccccccgcggaagcccccgataagggtgggagtcaagccaacaatgatcccggaggctgggatcccgggtgttcttcctcccaggtgctcggaaggaccagggggccctgcctgggagttcgggtccgggaggaggaagccggaacccgagtgaaggagaacttacctgtctggaccgtgaccggtgaactccaagggaagcccctgggaaaccccgccgccggcacaatgaatcctgaatcctctattttcatcgaggactatctcaagtatttccaagatcaggtgagtcgagaaaaccttctccagttactgactgatgatgaggcttggaatggctttgttgccgccgcagagctgccaagggacgaggccgacgaattaagaaaagccctgaacaaactggcatctcacatggtgatgaaagacaagaatcgccacgataaagaccagcagcaccgccagtggtttctcaaagagttcccacgcctgaaaagagagctggaagaccatattcgaaaacttcgcgccctggctgaagaagtggaacaggtgcatcggggaactaccatagccaacgtggtaagcaattcagtgggcaccaccagcggcatattgaccctgctcggcctgggccttgctccgtttactgagggcatctctttcgttctgttagataccggaatgggactgggagcagctgcagcagtcgctgggatcacctgttccgtggtggagttggttaataagctgagagccagagcccaagcacgaaacctcgatcaatccggaacgaacgtcgcaaaggttatgaaggagttcgtgggcggtaatactcctaacgttctcacgcttgtcgacaactggtatcaagtgacccagggaattggccgaaacatccgggctatacgccgggcacgagctaatccccagttgggagcctacgcccctccccctcacattataggccggatctctgccgagggaggagagcaagtggaaagggttgtcgagggccctgctcaggccatgtcacggggcacaatgatcgttggagctgctaccgggggaattctccttcttctcgacgtggttagtctggcttacgagtctaaacacctgttggaaggcgcgaaaagcgaatccgctgaggagctcaagaaaagggcgcaggaactggaaggtaaattaaactttcttactaagatccacgagatgcttcagcccggccaagaccaatag

SEQ ID NO: 179289 - DNA, 225 bp, Artificial Sequence
  Description of Artificial Sequence: Synthetic coding sequence
atgaaccccgagagcagcatcttcatcgaggactacctgaagtacttccaggaccaggtgtcccgagagaacctgctgcagctcctgactgacgacgaagcttggaacggctttgtagcggccgcagagctaccccgcgatgaagctgacgagctccggaaggcgctgaataagcttgcctctcacatggtcatgaaggataagaaccgtcatgacaaggattag

SEQ ID NO: 179290 - DNA, 387 bp, Artificial Sequence
  Description of Artificial Sequence: Synthetic coding sequence
atgaaccccgagagcagcatcttcatcgaggactacctgaagtacttccaggaccaagtctcaagggaaaatttattgcagctgctgactgacgatgaggcttggaacggtttcgtggctgccgcagaactgcccagggatgaagccgatgagctcagaaaagctctgaataagctggcatcccacatggttatgaaggacaaaaacagacacgacaaagaccagcagcacaggcagtggttcttgaaggagttccctcgcctgaagcgggagctcgaagaccacattcggaaacttagggccctggctgaagaagtagaacaggtccatagggggacaactatcgccaacgtggtctctaattctgttggaacaacttccggctag

SEQ ID NO: 179291 - DNA, 1209 bp, Artificial Sequence
  Description of Artificial Sequence: Synthetic coding sequence
atgggcctgggccagggctggggctgggaggccagctgcttcgcctgcctgattaggtcgtgctgccaggttgtgacatttacattcccattcggatttcagggaatcagccaaagcttggagaatgtgagcggttattatgccgacgcaaggcttgaggtaggctcaacccagctccggactgccggtagttgctcccacagcttcaagcgatcttttctggagaaaaagaggttcacagaggaggcaacaaaatactttcgagaacgcgtgagtccagtgcacctgcagatactgttgactaacaacgaagcctggaagagatttgtgactgccgccgaacttcccagagatgaggcagatgccctgtacgaagcgctgaaaaagctaagaacctacgctgccatcgaagacgagtatgtgcagcagaaagacgagcagtttcgcgagtggtttctgaaggaattccctcaggtcaaaagaaaaattcaggaaagcattgaaaagctccgggctctggccaatggcattgaagaagtgcatcggggatgtacaatttccaatgtcgtatcatcttccactggggccgcgagcggtatcatgtcactggccggcctggttctcgcaccgttcaccgcaggaacctccctggcgctgacagccgccggtgtgggcttgggtgctgccagcgccgtgacaggcatcactacttccatcgtggagcactcctatacttcctccgccgaagcagaggcgtcaaggctgacagccacttccatcgatagactaaaggtgttcaaggaggttatgcgggatatcacacccaatcttctcagtctcttgaacaattattacgaagctacccagaccatcggctccgaaatcagagcaatacgacaagctcgtgcgcgagccaggctgcctgtcaccacgtggcggattagtgctggctcaggaggtcaggcggaacgcactatcgcagggactacccgagccgtatctcggggggcacgcattctgtctgccactacatccggcatttttctggcacttgacgtagttaacctcgtatacgagagcaaacacctgcatgaaggagctaagtccgcttcagcggaggagctgagaaggcaggctcaggaactggaagaaaatctgatggagctgacgcagatttaccagcgattaaacccctgtcatactcactag

SEQ ID NO: 179292 - DNA, 609 bp, Artificial Sequence
  Description of Artificial Sequence: Synthetic coding sequence
atgagcctggccggcctggtgctggcccccttcaccgccggcacctccctggctctcaccgccgctggcgtgggtctcggcgccgcttctgcagtgaccggaatcaccactagcattgttgagcactcatacacatcatctgcagaagccgaggcgtccagactgactgcaaccagcatcgataggttgaaggttttcaaagaagtgatgcgcgatattacacccaaccttctgtctttacttaacaattattacgaggcaacccagactatcggcagcgaaatccgtgctattagacaagccagggcacgtgccaggctgccagtgacaacctggcgcatatctgccgggtctggagggcaagctgaacggaccattgcagggacgacacgcgccgtgagcagaggtgcacgaattctaagtgctacgacatccggaattttcctggccctcgatgtcgtcaatctggtttacgaaagcaagcacctgcacgagggggctaagtctgcttccgctgaggagctcagacggcaggcacaggagctcgaggaaaacctgatggagttgacgcagatctatcagcgcctgaacccttgccatactcattag

SEQ ID NO: 179293 - DNA, 609 bp, Artificial Sequence
  Description of Artificial Sequence: Synthetic coding sequence
atgagcctggccggcctggtgctggcccccttcaccgccggcacctcgctcgcgctcactgcggccggcgtgggcttaggcgccgcctcagccgtgactggtatcacaaccagcatcgtggaacacagttatactagtagcgcagaagccgaggcgtctcggctgacggccacatcaatcgacaggctgaaagtgtttaaagaggtcatgagggacatcacccccaacctgctgtctcttctgaataactactacgaagcaactcaaacaattggctccgaaattcgggccatccgtcaggcccgcgctagggcccgcctgcccgttactacttggaggatttccgccggatccggcggccaagccgaacgcacaatcgctggcaccacaagagccgtgtcaagaggcgcaagaattctgagtgccacaacatccggaatctttctggctctggacgtggtcaacttggtgtacgaaagtaaacacctgcacgaaggcgccaaatctgcctccgcagaagagctgcgaagacaggcccaggaactcgaagagaaccttatggagctgacacagatttatcagcggctgaatccgtgtcacactcactag

SEQ ID NO: 179294 - DNA, 996 bp, Artificial Sequence
  Description of Artificial Sequence: Synthetic coding sequence
atggacagcgagaagaagcggttcaccgaggaggccaccaagtacttcagagaacgcgtaagccccgtacatctgcagatcctgctgaccaacaacgaagcctggaaacgatttgtgaccgcagccgagctgccccgggacgaggctgacgctctgtatgaggccttgaagaagcttagaacctacgccgcgatcgaagacgaatatgtgcagcagaaggatgagcagttccgggaatggttcttaaaggagttcccacaggttaagcggaaaatccaggagtctatcgagaaactgagggcgctcgccaacggtatcgaagaggtccaccgcgggtgtactatctccaatgtggtgtcaagctccacaggcgccgcttctggcatcatgtccctggccggactggtgttagctccttttactgcaggcacctccctcgctctcactgcggccggggtaggtcttggtgcggcgtctgccgtgacaggtatcacgacaagcattgtcgagcactcttacacttcttctgcagaagctgaggcatcaaggctcactgccacctctattgacaggctcaaagtatttaaggaggtgatgcgcgacatcactcccaatttgctgtcactcctgaataactattatgaggcaacccaaactatcggttctgaaattcgggcgataagacaggccagagcccgggcgcggttaccagtgactacttggcggatctctgcagggagcggaggtcaggccgaacgaactatcgccggtacaacccgggccgtttccaggggagccagaattctgagtgcgacaaccagtggtatctttcttgcactcgatgttgttaatctggtttacgaatctaaacacctccacgaaggggccaagagcgcgtcggcagaggaactgcggaggcaggcgcaggaactggaggagaacctgatggaactgacccagatctaccagaggctaaatccgtgccacacccactag

SEQ ID NO: 179295 - DNA, 609 bp, Artificial Sequence
  Description of Artificial Sequence: Synthetic coding sequence
atgagcctggccggcctggtgctggcccccttcaccgccggcacctcattagcgctgacggccgcaggggtaggcttgggcgccgctagtgcagttaccggaatcacaactagtattgtggagcactcctatacaagctccgccgaggcagaggcaagccgtctcaccgccacatcaattgaccgtcttaaagtttttaaggaagtgatgcgcgacatcacgcctaacttgttgtccttactgaacaactattacgaagccacgcaaaccatcggtagcgagattcgcgctatacggcaggcaagggcccgcgctcggcttcctgtcactacctggagaatatcagccggatcaggcggccaggccgaaagaaccatcgccggaactacacgggctgtcagccggggagctagaatcctgagcgctaccacatcagggatattcttagctctggacgtagtgaacttagtctatgaaagtaaacacctgcacgagggtgctaaatctgcttccgctgaggagctacgcagacaggctcaggagctcgaagaaaatctgatggagctaactcagatctatcagcgtttgaatccgtgtcacacccactag

SEQ ID NO: 179296 - DNA, 324 bp, Artificial Sequence
  Description of Artificial Sequence: Synthetic coding sequence
atgggcagctgggtgcagctgatcaccagcgtgggcaccagcggcttgttcctaggggtgcgagtgagggaggagggggctggcatgagatgttccaagaccatccaggcaggacaatggctagactcttccaagggacctctgggaccttccccgccccccgtccccaccgccgggtattcctcgtcattttgcgtacactacgtaaacctgcttccgggggtgctggttctatcagtgactagccagtacccccacctttcgatggctctgtgtcagctggctgcacacgactggcctaggctctcctgtgtttgtgtttag

SEQ ID NO: 179297 - DNA, 1044 bp, Artificial Sequence
  Description of Artificial Sequence: Synthetic coding sequence
atgggcagctgggtgcagctgatcaccagcgtgggcgtgcagcagaaccatcctggctggactgtggctgggcagttccaggaaaagaaaagattcacggaggaggttatagagtactttcaaaaaaaagtttctcctgttcatttaaaaatacttttaaccagcgatgaggcctggaagcgcttcgtgcgtgtggcagagttgcctcgggaggaggccgacgcactgtatgaagccctgaaaaaccttacaccttatgtggcaattgaggacaaggatatgcagcagaaagaacagcaatttagagaatggtttctcaaattcccccagatccgctggaagatccaggaatccatcgaaagattgagagttatcgctaacgaaatcgagaaagtgcaccgtggatgtgtaatcgcaaacgtcgtctccggtagtaccggaatactgagcgtaatcggtgtcatgctggccccatttactgctggccttagcctgagcattacagccgccggcgtgggcttgggcatagcatcagctacagctggaattgcatcttctattgtggaaaacacgtatactcgatccgccgagttgacggcttctcggctcaccgccacttccaccgaccagttagaagccctccgggatatcctgcgtgacattacaccgaacgtcttgagctttgctttggacttcgatgaggctaccaagatgattgccaatgatgtgcataccctccggaggagtaaagctaccgtgggaaggcctttaattgcttggcggtacgtgcccataaatgtcgttgagactctacggactcggggggctcccactcgcatcgtgaggaaggtggctagaaatttaggcaaagccacctcaggggtcctcgtggtgctggatgttgtcaacctggttcaggactcactcgacctgcataagggggcaaagagtgagtccgccgagtccctgagacagtgggctcaggagttggaggagaacctcaatgagctcacccatatacaccagtccctaaaggctggatag

SEQ ID NO: 179298 - DNA, 1053 bp, Artificial Sequence
  Description of Artificial Sequence: Synthetic coding sequence
atggagggcgccgccctgctgaagatcttcgtggtgtgcatctgggtccaacaaaatcatcctggatggaccgtagccgggcaattccaagagaaaaagcgcttcacggaagaggttattgaatattttcagaagaaggtgtctcctgttcatttaaagatcctcctgacgtctgacgaggcttggaagcggttcgtgcgcgtcgctgagctgccaagggaggaggcagatgccttgtacgaagctctgaagaacctgacaccctacgtcgcgatcgaagacaaagatatgcagcagaaggaacaacagttcagggagtggtttctcaaatttccacaaattagatggaagattcaggagagcattgagcggttaagggttattgccaatgaaatcgagaaggttcaccggggctgtgtgatcgccaacgttgtgtcaggatcaacaggcattctgtcagtgattggcgtgatgctggccccttttacggccggattgtcgctcagcataaccgccgccggggtcggcctgggtatagcatccgctacagcgggaatagcaagcagtatcgtggagaacacatatacccgttctgccgagctgacagcctcaaggcttacagcgacgtccactgatcaacttgaagctttacgcgatatactccgcgatattacacccaatgtgttgtcctttgcactcgattttgacgaggcaacgaagatgattgctaatgatgtgcacacacttcgacgaagcaaggccactgtgggccggccgcttatcgcctggcgctacgtacctatcaatgtcgtggagacactgagaactcggggggcccccacacggatcgtccgaaaggtcgctagaaatctcggcaaagccacaagcggtgtgttggtcgtgctggacgttgtgaatctggtacaggactcgctcgacctccataagggggccaaatcagaatccgccgagtctctcagacagtgggcgcaggagctcgaggagaatctgaatgaattgacgcacatccaccaatcactaaaagctggctag

SEQ ID NO: 179299 - DNA, 393 bp, Artificial Sequence
  Description of Artificial Sequence: Synthetic coding sequence
atggagggcgccgccctgctgaagatcttcgtggtgtgcatctgggttcaacaaaatcaccctggctggaccgtagccggtcagttccaggaaaagaaaaggttcacagaagaggttattgagtactttcaaaaaaaagtatctccagttcacctcaaaatactgctgacgagcgatgaagcttggaaacggttcgtcagggtggctgagcttcccagagaagaagcggacgccctgtatgaggcgctgaaaaatctgaccccatacgttgcaattgaggacaaagacatgcagcagaaggagcaacaattcagagaatggttcttaaaggtgagcagcaaccaaatggaagattcaggcgttcataggaaggcttcctgccactgtaaatag

SEQ ID NO: 179300 - DNA, 384 bp, Artificial Sequence
  Description of Artificial Sequence: Synthetic coding sequence
atgggcagctgggtgcagctgatcaccagcgtgggcgtgcagcagaaccatcccggctggaccgtggccgggcagttccaggaaaagaagaggtttacggaggaggtcatcgagtatttccagaagaaagttagcccagtgcacttgaagattttactaacaagtgatgaggcatggaagcgctttgtcagggtggccgagcttccgagggaggaagccgacgctttgtatgaggccctgaagaatctcactccctacgtggccattgaagataaggatatgcagcagaaagagcaacaatttagagaatggtttcttaaagtgagtagcaaccagatggaggattccggcgtgcaccgaaaggcctcgtgtcactgtaagtag

SEQ ID NO: 179301 - DNA, 198 bp, Artificial Sequence
  Description of Artificial Sequence: Synthetic coding sequence
atgggcagctgggtgcagctgatcaccagcgtgggcgtgcagcagaaccacccggggtggactgtggctgggcagtttcaggagaaaaagcggttcacagaggaggttattgagtacttccagaagaaggtatccccagttcacctaaaaattctgcttaccagcgatgaagcctggaaacgttttgtgagagtgtag

SEQ ID NO: 179302 - DNA, 384 bp, Artificial Sequence
  Description of Artificial Sequence: Synthetic coding sequence
atgggcagctgggtgcagctgatcaccagcgtgggcgtgcagcagaaccaccctggatggacagtagctggtcagttccaggagaagaagagatttaccgaagaagtcatcgagtacttccagaaaaaggtctcacccgttcatctgaagattctgctgacatcagatgaggcctggaaacgcttcgtgcgcgtagccgaacttcctagggaggaagccgacgcactttatgaggctcttaagaacttgaccccatacgtggcaattgaggacaaggacatgcaacagaaagaacagcagttccgggaatggtttttgaaggtctcatccaatcagatggaagactctggtgtgcataggaaggcgagttgtcactgcaaatag

SEQ ID NO: 179303 - DNA, 183 bp, Artificial Sequence
  Description of Artificial Sequence: Synthetic coding sequence
atgggcagctgggtgcagctgatcaccagcgtgggcgtgcagcagaatcatcctggatggactgtggctggacagttccaagagaaaaagagatttacggaggaggtgatcgagtatttccagaagaaagttagccccgtgcatcttaagattttgttaacctctgatgaagcttggaagtag

SEQ ID NO: 179304 - DNA, 219 bp, Artificial Sequence
  Description of Artificial Sequence: Synthetic coding sequence
atgggcagctgggtgcagctgatcaccagcgtgggcgtgcagcagaaccatcctggttggaccgtggcaggacagttccaggagaagaagcgcttcaccgaggaggtgatcgagtattttcaaaagaaggtgtccccagttcatttgaagatcttactgacttctgacgaagcttggaaaagattcgtgagagttgcggagctgcccagagaagaatag

SEQ ID NO: 179305 - DNA, 213 bp, Artificial Sequence
  Description of Artificial Sequence: Synthetic coding sequence
atgggcagctgggtgcagctgatcaccagcgtgggcgtgcagcagaatcaccccggctggaccgtagcaggtcagtttcaggaaaaaaagaggttcactgaagaagtaatcgagtactttcaaaagaaggtgagccccgtccatctcaaaattcttttgacttccgatgaggcttggaaaaggttcgtgagagtggcagagttgccacgctag

SEQ ID NO: 179306 - DNA, 1302 bp, Artificial Sequence
  Description of Artificial Sequence: Synthetic coding sequence
atgccctgcggcaagcagggcaacctgcaggtgcccggcagcaaggtcctacctggtttaggtgaagggtgcaaagagatgtggttgcgcaaggtgatttacgggggggaagtgtggggtaagtcccctgaacccgagttcccaagtcttgtcaacctttgtcaatcctggaagatcaacaatctgatgtctactgtgcactctgacgaggcagggatgctctcttatttcctgttcgaggaacttatgaggtgcgacaaagatagcatgcctgatggtaatttgtctgaagaggaaaaacttttcctgtcttacttccccctgcacaaatttgagctggagcaaaacatcaaagaactgaataccctggccgatcaggttgacactactcatgaactccttacaaagacctccttggttgccagtagcagtggggccgtcagtggggtaatgaacatactggggctggccctcgcacctgtgaccgccggtggcagcctaatgcttagtgcaaccggaacagggctgggcgctgcagctgctataacaaacattgtgaccaacgtgctggagaacagatccaacagcgcagcacgcgataaggcatccagactcggacccctcacgacttctcacgaggctttcggaggaatcaactggtcagagatcgaggccgccggtttttgtgttaacaagtgtgtcaaggccatccagggcataaaggatctacatgcctaccagatggccaaaagtaactcaggattcatggcgatggtgaaaaacttcgttgcgaagcgccacattcccttttggaccgcacgcggtgttcaacgggctttcgaaggcactactttagcgatgacaaatggagcctgggttatgggagcagctggcgcggggttcctcctcatgaaggatatgtcctctttcctgcaatcctggaaacacttggaagatggtgcgcgtaccgaaacagccgaggagctgagggctttggctaagaaactggagcaggagctcgatcgactgactcagcaccaccggcatttaccccagaaggcaagccaaacttgctcttccagcaggggcagagctgttcgggggagccgcgtcgttaaaccagaaggatcaagatctccactgccctggcccgtcgtcgaacaccaacctcgcttagggccgggtgtcgctttacgaacgcccaaaaggaccgtctctgcgccaaggatgttgggtcatcaaccagcacctcctgccccggctaggaagggtcgccaggccccaggtcgacatcgacagtag

SEQ ID NO: 179307 - DNA, 1032 bp, Artificial Sequence
  Description of Artificial Sequence: Synthetic coding sequence
atggacaaccaggccgagcgggagagcgaggccggcgtgggcctgcagcgggacgaggatgatgcacccttgtgcgaggatgtggaactccaggatggcgacttgagccctgaggagaaaatatttttgagagagttccccagattgaaagaagaccttaaagggaatatcgataaattgcgggccttggctgacgacattgacaaaacccataaaaagttcactaaggccaacatggtggctactagtacggcagtcatcagtggcgtgatgtctctgcttggtctggcgctggccccagccacaggggggggctcactgctcttgtcaaccgccgggcagggccttgccaccgccgcgggcgtcacttctattgtctccgggacactggaacggtcaaaaaacaaggaggcacaggctcgagcagaggacatcttaccgacctacgatcaggaagaccgggaagacgaagaagaaaaagccgactatgtgaccgctgcagggaagatcatttataacctccgcaatactctgaaatatgccaagaagaacgttcgtgccttctggaagctcagggcaaacccaaggctggctaatgcgactaaacggttgctgactacaggccaggtgagctccaggtctcgggtgcaagtccaaaaagcctttgcgggaaccacccttgctatgacaaagaacgctcgcgtgcttgggggagtgatgtctgccttcagcctgggatatgatttggctacattgtcaaaggagtggaaacatctgaaggagggagcgcgcacaaaattcgccgaagaactgcgcgccaaggcgctggagctggagcgcaaactcacggaactcacccaactgtacaagagtctgcagcagaaggtgcgatcacgtgctaggggtgtggggaaggatctcactggaacatgtgaaaccgaggcatactggaaagaactccgggagcacgtatggatgtggttatggctttgtgtttgcctttgcgtttgcgtttacgtgcagtttacatag

SEQ ID NO: 179308 - DNA, 540 bp, Artificial Sequence
  Description of Artificial Sequence: Synthetic coding sequence
atgttcaaggtgatccagcggagcgtgggccccgccagcctgagcctgttgacctttaaagtgtatgccgctccgaagaaagactcaccccccaaaaatagcgtcaaagtggacgaactctcactgtatagcgtccccgaaggacaatcaaagtatgttgaggaggcccgcagccagctggaagaatcgatttcacagcttagacactactgtgagccatacactacctggtgccagaccgccatgactatatctaaaatgcacttgcttttttttcccaggcttggcgtcattgggttcgctgggctgatcggactgctcctagcaaggggatccaaaatcaagaagttggtgtacccacccggattcatgggtttggccgcttccctatattacccccaacaggcaattgtctttgcccaggttagcggcgaacgactgtacgattgggggctcagggggtacatcgtgattgaagacctttggaaagaaaatttccagaagccaggaaatgttaagaacagccctgggaccaaatag

SEQ ID NO: 179309 - DNA, 597 bp, Artificial Sequence
  Description of Artificial Sequence: Synthetic coding sequence
atgttcaaggtgatccagcggagcgtgggccccgccagcctgagcctgcttacctttaaggtatatgcagcccctaaaaaggacagtcctcctaaaaactcagtcaaagtggatgagctctcactgtactccgtccctgaaggccagtctaagtatgtggaagaggcaagaagccagctggaggaatccatatcccagctccgccattactgtgagccttacaccacttggtgccaagaaacatattcccaaaccaaaccaaagatgcaatctctcgtgcagtggggcctggattcgtatgattacctacagaacgctccccccggcttctttccgcggctgggcgtgattgggtttgccggtttaatagggctacttctcgcacgcggctccaagattaaaaaattggtttatcccccaggctttatggggctcgcagcgagtctgtactacccccaacaggcaatcgttttcgctcaggtcagcggggagcgtctttacgactggggtctgagaggctacatcgttatcgaagatctctggaaggagaatttccagaagcctggcaatgtaaagaactcacctggcaccaagtag

SEQ ID NO: 179310 - DNA, 537 bp, Artificial Sequence
  Description of Artificial Sequence: Synthetic coding sequence
gtgtacgccgcccccaagaaggacagcccccccaagaacagcgtgaaggtagacgaattgagtctgtactctgtgcctgagggccagtccaagtacgttgaagaagcccggtcacaactcgaagagagcatttcgcagctcagacattactgcgagccttacactacctggtgtcaagaaacctattctcagaccaagcctaaaatgcaaagccttgtgcaatgggggttagactcttacgactacctgcagaacgccccaccaggtttcttcccacggctgggcgtgataggcttcgcagggctcatagggctgctccttgctagagggtccaaaattaaaaagctggtatatccgcccggtttcatgggcctggccgcaagcctctactaccctcagcaggcaattgtttttgcccaggtgtccggcgaacgtctttatgattgggggctgcggggatacattgtaattgaggatctttggaaggaaaatttccagaagccaggtaacgttaaaaactcccctggcaccaagtag

SEQ ID NO: 179311 - DNA, 1332 bp, Artificial Sequence
  Description of Artificial Sequence: Synthetic coding sequence
atggaccggctgggccccttcagcaacgaccccagcgacaagcccccgtgcagaggctgctcgtcttacctcatggagccatacatcaagtgcgcagaatgtggtcctccccccttcttcctctgccttcagtgttttacacgggggtttgaatacaaaaagcaccagagcgatcacacctatgagattatgaccagtgacttccccgtactggatccctcttggaccgcccaggaggagatggctctgcttgaagccgtcatggactgcggcttcggcaattggcaggatgtggctaaccaaatgtgcaccaaaacaaaggaagagtgcgaaaagcactatatgaaacacttcattaataaccccttatttgccagcacgctgctcaatcttaagcaggcagaggaggctaaaacggctgacactgctatcccttttcacagtacagatgatccgccccgtcctacttttgacagcctcctgtctagagatatggccgggtacatgcctgcaagagcggatttcatcgaggaatttgataactatgccgagtgggacctgagggatattgactttgtagaggacgactccgacatcctgcacgctctgaagatggctgtggtcgacatttaccacagccggctcaaggagaggcagaggcggaaaaaaattattcgagaccatggattgatcaacctgcggaagttccagcttatggagcggaggtatcctaaagaagttcaggatctgtacgagaccatgagacggttcgcccggattgtgggtccagtggaacatgacaaatttatagaaagtcacgcactagaatttgaactgagaagagaaatcaagcgcctgcaagagtaccgcactgccggcatcacaaatttctgctcagcacgcacatatgaccacctgaaaaaaacgcgcgaggaggaaaggcttaaaaggacaatgctttctgaggtcttgcagtatattcaggactcttcagcatgccagcaatggctgcgacggcaggcggacatagactccgggttaagcccttccataccaatggcttccaacagtgggcggcgttccgccccacctctcaacctgactgggctcccaggtaccgaaaaactcaacgagaaagagaaggaactttgtcaaatggtgaggctcgtgcccggggcatacttagagtataaatcggctctactcaacgagtgcaacaaacaagggggtctcagactcgcccaggcaagggcattgattaaaatcgacgttaacaagacaaggaagatatatgattttctcatcagagagggctacattactaaaggatag

SEQ ID NO: 179312 - DNA, 978 bp, Artificial Sequence
  Description of Artificial Sequence: Synthetic coding sequence
atggtgccccgggaggcccccgagagcgcccagtgcctgtgcccctctctgactataccgaatgcgaaggacgttctccggaagaggcacaaacgacgcagcagacagcaccagcggttcatggcccggaaggcccttttgcaggaacagggcctcttaagtatgccacctgagccagggtctagcccgctccctacaccgtttggcgcagctaccgctaccgaagccgcgtctagcggcaaacagtgtctgagagctggttctggaagcgccccttgctcaaggagaccggctcccggcaaggcttctgggcctctgcctagcaaatgcgtggcgattgactgtgaaatggtaggcactgggccgcgtgggcgcgtgtcagaactggcgcggtgttccatcgtcagctatcacggaaacgttctctacgacaagtatatcagacccgagatgcctattgccgattaccgtacccgatggtccggaatcacaaggcagcatatgagaaaagcagtgcctttccaggttgcccaaaaggagattctgaagttgttgaaaggaaaggttgtggtcgggcacgcgctgcataatgactttcaggctttgaagtatgtccacccacgcagtcagacccgagacacaacatatgtgccgaattttcttagcgagcccggcctgcatacccgggcgcgcgtatctctcaaggatctcgccttgcagctgctgcacaaaaaaatccaggtcgggcaacatggtcactcgagtgtcgaggacgcaaccactgctatggagctctatcggttggtggaagtccagtgggagcaacaggaggccagatctttgtggacttgcccagaagacagggaaccagacagcagcaccgacatggagcagtatatggaagatcaatattggcctgacgacctagcacatggttcgaggggcggggctagggaggctcaggaccggcggaactag

SEQ ID NO: 179313 - DNA, 984 bp, Artificial Sequence
  Description of Artificial Sequence: Synthetic coding sequence
atggtgccccgggaggcccccgagagcgcccagtgcctgtgcccctcactgaccattcctaatgcaaaagatgtcctgaggaagcgccacaagcgacggtcgagacagcatcagcgcttcatggcccggaaagctctcctgcaagagcaaggtttactatcgatgcctccagagcccggaagcagccccttacccacccctttcggagccgcgactgccactgaagctgctagctccgggaaacagtgcctcagggccggctccggctctgctccatgttcccgccgtccagcaccaggtaaggcttcaggccccctgcctagtaagtgtgtcgcaattgattgcgaaatggttggaaccgggccacggggacgcgtttcagagctggcgaggtgctccattgtaagctaccacgggaacgttttatacgacaaatacatacggcccgaaatgccaattgcagactatagaactcgctggtccgggattacccggcagcacatgagaaaagccgtgccctttcaagtggctcaaaaggaaattcttaaactactgaaggggaaggttgttgtcggtcacgccttgcataatgacttccaagccctgaaatacgttcaccctcgatcacagacgcgtgatacaacgtatgtacccaactttctctccgaacccggactgcacacaagagctcgcgtgtctctgaaggatctggccctgcaactgcttcataagaagatccaggtcggccaacacgggcattcaagcgtagaggacgccactacagcgatggaactctacaggctcgtagaagtacaatgggagcagcaggaggcgaggtccctatggacatgtcccgaagaccgggaacccgatagtagcactgatatggagcagtatatggaagaccaatccacccaatactgggctttaaaacagaagagtgagaagcaggactccggtcttaattccggcgctttcgtatag

SEQ ID NO: 179314 - DNA, 1515 bp, Artificial Sequence
  Description of Artificial Sequence: Synthetic coding sequence
atgcccaccgtggaggagctgtaccggaactacggcatcctggccgacgctaccgaacaggtggggcagcacaaggacgcttaccaggtgattctcgacggtgtgaaggggggaactaaggagaagcgcctcgctgcgcagttcatccccaaattcttcaagcacttccctgagctggccgactccgctatcaacgcccagttggacctgtgcgaagatgaagatgtgtctatacggcgccaggctattaaggaactgcctcagtttgcgaccggcgaaaatctaccaagggtagcagacatcttgacgcagttgctgcagactgacgacagtgccgagtttaacctcgttaataatgcgttgctgtccatttttaagatggacgccaagggtacgctgggtggattgtttagccaaatactgcagggcgaagatatcgtgagagagcgcgcaataaagttcctctccactaagctcaagaccctcccagatgaagtgctcaccaaagaggttgaagaactgattctcacagaatctaaaaaggtgctggaagatgtgactggggaggagtttgtgctgtttatgaaaatcctgtctgggctgaagtccctgcaaactgtgagcggccgtcaacaactagtcgaacttgtggctgaacaggctgatctagaacagaccttcaacccatcagatcccgattgcgtagacagactcctccaatgcactcgtcaggctgttccactgttctccaagaacgtgcactctacccgcttcgtgacctatttttgcgagcaagtactcccgaatctgggcacactgaccacgcctgtggaaggactagatatacaactagaggtgcttaaactgcttgccgaaatgtcctctttctgcggcgacatggaaaaactggagacaaacttacggaagttgtttgataagctcttagagtatatgcccctgccaccagaagaagctgagaatggtgagaatgccggtaatgaagagcctaaattgcagttttcctatgtcgaatgtctgctgtattcattccaccagctcggacgcaagctccccgactttctgaccgccaagcttaacgccgagaaactcaaggacttcaaaattaggctacagtattttgcccgcggcttgcaggtctatattcggcagctgcggctggcgcttcaagggaaaaccggtgaggctcttaagacagaggagaacaaaattaaagtggtagcactgaaaatcacaaacaacatcaatgtgcttatcaaggatctgtttcacatcccacctagctataagtcaacagtaacattaagctggaaacctgtgcaaaaagttgagatcggacagaaacgggcctctgaagataccaccagcggtagtccgcctaaaaagtcgagcgccggccctaaaagagacgcccggcagatttacaatcccccgagcggcaagtattcaagcaatcttggaaactttaactatgagaggtctctacagggtaagtag

SEQ ID NO: 179315 - DNA, 1353 bp, Artificial Sequence
  Description of Artificial Sequence: Synthetic coding sequence
atgcccaccgtggaggagctgtaccggaactacggcatcctggccgacgccactgaacaggtggggcagatccgtcgacaagcaattaaagagctgcctcagtttgccacgggagagaatttaccccgtgtggctgacatcctgacccagctgctccagacggatgattctgccgagttcaatttggtgaacaacgcgctcctgagcattttcaagatggacgctaagggtaccttaggaggcttgttttcgcagatcttgcagggtgaagacatcgtgcgggagcgggccatcaagttccttagcacaaagctgaagacgttaccagacgaggtccttacaaaggaagtcgaagaactgatcctcacggagagcaaaaaagtccttgaggatgtaaccggcgaggagttcgtgctctttatgaagattctgtcagggttgaagtccctacaaactgtgtctgggaggcagcaactcgtggagctggtcgctgagcaggctgatctggagcaaaccttcaacccttccgacccggactgcgtagatagattactgcagtgcacacggcaggccgtccccctgtttagcaagaacgtccactcgactcggttcgttacgtatttctgcgagcaggtgctccccaatcttggaacccttacaaccccggttgagggcctggatattcagctcgaagttttgaagctgttggctgagatgagctcattttgtggcgatatggagaagctcgaaactaacctgcgcaaattgtttgacaagttgctcgaatacatgccactgcctccggaggaggccgaaaacggggagaatgctgggaacgaggagcctaaactccaattcagctacgttgagtgtctgctgtattcttttcatcagctggggagaaaactgcctgatttcctgactgccaaactgaacgcggaaaaactcaaggactttaaaatacgtctgcagtacttcgcacgcggtttacaggtatatatccgccaacttaggttggccctccagggaaaaacaggggaggctctcaaaaccgaggaaaataaaattaaggtcgtcgcccttaaaatcactaataatatcaatgtgttaataaaagacctgtttcacattccacccagctacaaatccactgtgacactctcctggaaacccgtgcagaaggtggagattggacagaagcgggctagtgaggacaccacatctggatccccccccaaaaagtcctccgcaggacctaaaagagatgccagacagatctataaccctccaagcggcaaatactccagtaacctcggcaatttcaactacgagagaagtttacagggaaaatag

SEQ ID NO: 179316 - DNA, 1575 bp, Artificial Sequence
  Description of Artificial Sequence: Synthetic coding sequence
atgcccaccgtggaggagctgtaccggaactacggcatcctggccgacgcaactgagcaggtgggccagcacaaagacgcgtatcaggttattctagacggtgtcaaggggggcactaaggagaaaaggttggcagcacaatttataccaaagttctttaagcacttcccagagctggcggactctgccattaatgcgcagctcgatctctgtgaggacgaggatgtatccattagacgtcaagccataaaggaacttccacagtttgcaactggggaaaatctgcctcgcgttgccgatatcttgactcaactgctgcagacagacgactctgctgaatttaaccttgttaacaacgctctcctttcaatttttaaaatggacgcgaaaggtacactaggcggtttatttagccaaatcttgcagggagaggatattgtccgggagagagcaattaaatttctgagcaccaaacttaagacattgcccgacgaagtgctgacaaaggaagtggaggagcttattttgaccgagtctaaaaaggtgcttgaggatgtcacaggcgaggaattcgttctgttcatgaaaatcctgtctggattgaagtccttgcaaactgtatcaggtcggcaacagctggtcgagctagtcgctgaacaggctgatctggaacagacattcaacccctccgatcccgattgcgtggacaggctcctgcagtgtacacgtcaagctgtgcctttgtttagtaagaacgtccactccacgaggtttgtgacctacttttgcgagcaggtgctgcccaacctcgggactttgacgacccctgttgagggcctcgatatccaattggaagtccttaaactgctcgctgagatgtccagcttttgcggtgacatggagaagttggaaactaacctgcgcaagcttttcgacaaacttctggaatacatgccactgccccccgaggaagcggagaacggtgagaacgccggcaatgaagaacctaaactccaattctcgtatgtagaatgcctgctctactccttccaccaactgggaaggaagttaccagattttttgaccgctaaactcaacgccgagaagctgaaggacttcaagattagactccagtattttgcccgaggcctgcaggtgtatatccgtcagctgcggctggccctgcaggggaaaaccggcgaggcccttaaaacagaagagaacaagatcaaggtagttgccctgaagatcacaaacaatattaatgtgctcatcaaagatctgtttcacataccacccagttacaagtctaccgttaccctttcttggaagccggtacagaaggtggaaatcggacagaagagagccagcgaagatacaacctcaggatcaccccccaagaaatcgagcgctggtccaaaaagagatgctcgacagatttacaatccaccatccggcaagtatagttccaatttggggaacttcaattacgagcagagaggggcttttcggggaagcaggggggggcggggatggggcacacggggtaaccgatccagaggccggctttattag

SEQ ID NO: 179317 - DNA, 1533 bp, Artificial Sequence
  Description of Artificial Sequence: Synthetic coding sequence
atgcccaccgtggaggagctgtaccggaactacggcatcctggccgacgcaaccgaacaagtcgggcagcacaaggatgcatatcaagtgatcctcgatggggttaaagggggaaccaaggaaaaacgccttgccgctcaatttatacccaagttcttcaaacattttcctgaactagcagacagcgccattaatgctcagctggatctatgcgaggatgaagacgtatctatccggcgtcaggctatcaaggagcttccccagttcgcaaccggcgaaaatttgcctcgggtcgccgatatcttgacacaattgctgcagacggacgactctgcagaattcaatctggtgaataatgccctgctgtccatcttcaagatggacgcgaaagggacattaggagggctcttctctcagattctgcagggcgaggatattgttagggagcgggctataaagtttctctcaacaaaactcaaaaccctgcctgacgaagttttgaccaaagaagtggaggaattaattctgactgagagcaaaaaggttcttgaggacgtgacgggtgaggagttcgttctgttcatgaagatactctccggcctgaagagcctccagaccgtttctggaaggcagcagctggttgagttggtcgccgaacaggcggacctcgagcagacttttaacccatcagaccccgactgcgtagacaggctcctgcagtgtacacgacaggctgtgcccttgttcagcaaaaatgttcacagcacaagatttgtgacctatttctgcgagcaggtcctcccaaacctagggactctgacaaccccagtcgaaggattagatattcagctggaagttctcaagctactggcggaaatgagttctttttgtggggacatggaaaagctggaaaccaaccttcggaaactgttcgacaagctgctggaatatatgcctcttcctcctgaagaagctgaaaacggggaaaacgccggcaatgaggagcccaaacttcaattttcctacgtggaatgtctgctttatagcttccatcaactgggcaggaaacttcctgattttctgactgcaaaactcaacgctgagaagttgaaagacttcaaaatcaggttacagtattttgccagagggcttcaggtgtacattagacaactcagattagccctgcaaggtaagacaggcgaagccctgaaaaccgaggagaacaagattaaggtggttgccttgaaaatcacaaataatatcaacgtgctcatcaaggacctgtttcatatccccccttcttataagagtactgtcacgctgagttggaagccagttcagaaggttgagattggccaaaagagggctagcgaggacactacatcaggctccccccctaaaaaaagttccgcgggccctaagagagacgccagacagatatacaatccaccctctggcaaatactctagcaatctgggaaactttaactacggcgaacgcttcaggctcggcacgagaaatatgcgtgactag

SEQ ID NO: 179318 - DNA, 1089 bp, Artificial Sequence
  Description of Artificial Sequence: Synthetic coding sequence
atgcaggccgagcggggcgcccggggcggccggggccggcggcccgggcgcggaagaccggggggggaccgtcactctgaaagacctggcgctgccgcggccgtggccagaggaggagggggtggcgggggaggcgacggcgggggcaggagagggcgtgggagaggccgcggatttcgaggcgctcgaggaggccgaggcgggggaggtgcgcccagggggtcaaggcgggagccaggaggttggggagcaggggcttcagcccccgtggaagacgactctgatgcagaaacctacggagaagagaatgacgagcaggggaactacagtaagagaaaaatagtgagcaattgggatcggtaccaggatatagagaaggaggtaaacaacgagtccggcgagagccagagggggactgatttcagcgttttactaagcagcgccggcgacagcttttcccagtttcgctttgccgaggaaaaagagtgggacagcgaggcttcctgccctaagcagaacagcgccttctacgtggatagtgaattacttgtgcgagccttacaggagctccccctttgcttacgattaaatgtagccgccgaactggtgcagggcacagtacctctggaagttccacaggtgaaacctaagcggacagacgatggcaaaggattgggtatgcagttgaagggaccacttggcccaggcggtaggggccccattttcgagctcaaaagcgtggctgccggctgtccagtcctcttgggcaaagataacccaagtccaggtcccagtagagactcccagaagccaacatctcctctccaatcagccggggaccaccttgaggaagagttggatctactgttgaacctggacgcccccattaaagaaggagacaacatactgcccgatcagacatcgcaggatctgaagtccaaggaagatggagaagtcgtccaggaggaggaggtttgtgccaagccgtccgtgacagaggagaaaaacatggaaccggagcagccatctactagcaaaaatgtgacagaagaggagttagaggactggttggactccatgattagctag

SEQ ID NO: 179319 - DNA, 4125 bp, Artificial Sequence
  Description of Artificial Sequence: Synthetic coding sequence
atgagcagcagcttcttcaaccccagcttcgccttcagcagccacttcgaccccgatggagcacctctgagcgagttgtcttggcctagttccttagccgtggtggcagtaagctttagtggcctgttcgccgttattgtgctcatgctggcatgtctgtgttgcaaaaagggaggaattggatttaaggagttcgaaaatgcggaaggtgacgaatatgctgccgacctcgctcagggttcaccagctactgccgcccaaaacggacctgacgtttacgtcctgcctctgacagaagtgtccctgccaatggccaaacagcccgggagaagcgtccaacttcttaaatcaactgacgtcggcagacacagtctgttgtatctcaaggagataggaaggggatggttcggcaaagtcttccttggcgaggtcaactccggcattagctctgctcaggtggtggtcaaagagctgcaggcttccgctagtgtacaagagcaaatgcagttccttgaggaagtgcagccttacagggcccttaagcacagcaatctgctccagtgcctcgcgcagtgtgctgaagtgactccttatctgcttgttatggagttctgcccgttgggtgatttaaagggatacctgaggagttgtcgcgtggccgaatctatggccccagaccccaggacccttcagcggatggcctgtgaagtggcatgcggcgtcttacacctgcaccgcaacaacttcgtacatagcgacctggccctgcgcaattgtttactaaccgccgacctcacagtgaagatcggagattatggattggcacattgcaaataccgggaagattactttgttaccgctgatcagctgtgggtgcctcttcggtggattgcccccgaactggtggacgaagtccactcaaatctgctggtcgtggatcagacgaagtctggcaatgtctggtcgttaggagttaccatttgggagctcttcgaactgggtacacaaccatatccacaacactcagaccagcaggtccttgcgtatactgtgagagaacagcagttgaaactccccaagccccagttacagcttacgctttctgatcgctggtatgaggtgatgcagttttgctggctgcagccagaacagcgccctactgcagaggaagtccatttattgctgtcctatctatgcgccaaaggagccacagaggctgaagaggaattcgagcggagatggagatccttgagacccggcggcggaggtgtcggccccgggcccggagctgccgggcccatgctcggcggggtcgtggagctggccgcagcctcgtccttcccattgttggagcagtttgcaggggatggattccatgccgacggcgatgacgtgctgaccgtgacagagacttctcgaggcctgaactttgaatacaagtgggaggcgggaagaggggcggaggcatttccagctaccctttcccctggaaggaccgctaggttgcaggaactgtgcgcacctgatggcgccccgccaggggtggttccggtgctctctgcccattcaccgtcacttggatcagaatacttcattaggctggaggaagcagctccggctgcagggcatgacccggattgtgctgggtgcgctccaagtccgccagccaccgctgaccaagacgacgacagtgacggtagcacagccgcatccttagccatggagccgctactgggacatggtccccccgtagacgtgccatggggccggggggaccactatccccgccgctcgctggcccgggatccactctgccccagccggtcccccagcccatccgcagggccgctgagtctggccgaggggggcgctgaagacgccgactggggtgtggctgccttttgccctgctttttttgaggatcccctcgggacaagtccactgggaagttccggcgctccccccctccccctcacgggagaggatgagcttgaagaagttggcgcacggagggcggcacagcgcgggcattggaggtccaacgtgagcgccaacaacaattcagggtcccggtgccccgaaagttgggatcctgtgagcgcaggggggcacgctgagggatgtccatcgcccaagcagactccgcgtgcttcccccgagcccggataccctggggagccacttcttggtttgcaggccgcctctgcgcaagaacctggttgttgccccggtctgcctcatctctgtagcgcacagggactcgctccagccccatgccttgtgacaccgagctggaccgagactgcctcctctggcggcgatcacccccaggcggagccgaagttagccactgaggcggaaggaacaaccgggccaagactgcccctgccctcagtcccatccccctctcaggaaggcgcacctctcccatctgaagaagcctccgccccagacgccccggacgccctgccggactcacctacacctgcgacagggggggaagtctccgctattaagcttgcatccgctctgaacggcagtagttcttctccagaggtggaggcccccagctccgaggacgaagataccgccgaagcaactagcgggatatttacagacacgagtagtgacgggttgcaggcccgccgtccggatgtggtgcctgccttccgctccctacagaaacaggtgggcacccccgattctctggatagcctcgatatcccaagttcagccagcgatggcggctacgaagtttttagccccagcgccacgggacctagcggcggccaaccacgagcactcgattccggctacgatacggaaaactatgagtctcctgagttcgtgctgaaggaggcacaagaaggctgtgagccacaagcctttgcagagctggcatcagagggagagggccctggcccagaaaccagactctccacttcactcagcggtctgaacgagaaaaatccctatcgcgatagtgcctactttagtgacctcgaggccgaggccgaggccacttcaggaccagaaaaaaaatgcggaggagaccgcgcccccggaccagaactgggactgcccagcactggccagccgtcagaacaggtatgtctgcggcccggagttagcggcgaggctcagggttccgggcctggagaagtattacccccactactgcaattggagggctcttccccagaaccctcaacctgtccatctggcctggtccccgagccacccgagccccagggacctgccaaggttcgccctgggccatcaccctcctgctcacagttctttttgctgacccccgttccactgaggtccgaaggcaactctagcgagtttcagggtccccctggcttactgtctgggcctgcgccacagaaacggatgggcggacctggcacgccacgcgctcccctacgactggcacttcctggtttgcctgcggcactagagggccggcccgaggaggaagaggaagactccgaggatagcgacgaaagtgatgaggaactcaggtgttactctgtgcaggaaccttccgaggactctgaagaagaggcccctgcggtgccggtagtggtggctgagagccagtctgctcggaatctccgcagtctgctgaaaatgcccagcttactgtccgagacgttctgcgaggaccttgagaggaagaagaaagcagtctctttttttgacgacgttacagtgtacctctttgaccaggaatcacctactagggaactcggcgagccattccccggggcgaaggagtccccacctacatttctgcgcgggagccccgggtccccaagcgcacccaacaggccccagcaagcagacggttcccctaatgggtcgactgccgaggagggcgggggatttgcttgggatgacgattttccattaatgaccgcaaaagccgcttttgctatggccctggaccctgctgctccagcccctgctgccccaacccccactccagcgccattcagccgatttactgtgagtcccgctcctacttctaggttctcaatcacacatgtgtccgatagcgacgcagaaagtaaacgcggtcccgaagccggagccggtggagaaagcaaggaggcctag

SEQ ID NO: 179320 - DNA, 2640 bp, Artificial Sequence
  Description of Artificial Sequence: Synthetic coding sequence
atgagcagcagcttcttcaaccccagcttcgccttcagcagccacttcgacccagacggcgccccgttatccgaattgagttggccatcctctctggccgttgtggccgtgtccttttcagggcttttcgctgttatcgttctgatgctcgcatgtctttgctgcaaaaaaggtggtattgggtttaaagagttcgagaacgctgaaggagatgagtacgctgcagatctcgcccagggctctccagctacagccgcacagaacggtcctgacgtatacgtgctccctctgacggaagtgtccttaccaatggcgaaacaacccggtcggtctgtgcagctcctcaaatcgaccgatgtgggtagacattccctgttgtatcttaaagaaatcggaagaggctggttcggtaaggtttttctcggggaggtgaatagcggcatttcatctgctcaggtggtggttaaggagctccaagccagcgcctccgtgcaagaacagatgcagttccttgaagaggttcaaccctaccgggccctaaagcattccaacctgctacagtgtcttgctcagtgcgcagaggtgaccccataccttctggtcatggaattctgtcctttgggagatctgaaggggtatctgcgaagctgtagggtcgctgagtccatggcccctgatccaaggaccctccagaggatggcttgcgaagtcgcatgcggtgtgctccatctccacagaaacaacttcgtacattctgatctcgcactccgcaattgtctgctgactgcagatctaacagtgaaaatcggggattatggcctggctcattgtaaatatagggaggattactttgtaacagccgatcagttgtgggtgccattgcgttggatcgctccagagctagtcgacgaagtgcacagcaacttgctggttgttgaccaaactaagtcaggcaatgtttggtcgctgggggtcacaatatgggagctcttcgaattgggcacccagccctatccccaacactctgaccagcaggtgctggcctacactgtccgagaacagcaactgaaactgccgaaaccccagctgcaactgaccttgtcagacaggtggtatgaagtaatgcagttctgttggttacaacctgagcaacggcccaccgctgaggaggttcacctgcttttaagctacctgtgtgcaaagggtgcaaccgaagcggaggaggagtttgaacggaggtggaggagcctcagacctggtggtggaggagttggaccagggcctggagcagccgggccaatgctgggcggagtggtggaattggctgccgccagttccttcccactgctggagcaatttgccggcgatggctttcacgcagatggggacgatgtgctgaccgaactgtgcgccccagatggggcccctccaggagtagtgcctgtgctcagcgcccattcccctagtctaggttccgagtacttcatcaggcttgaggaagcagcccctgccgcaggtcacgatcccgactgtgcaggttgtgccccgagcccccccgcaacagccgatcaggatgacgactccgacggctctacggcagcgagcctggcgatggagcccctcttgggacatggtcctcccgtggacgtcccttgggggagaggcgatcactacccaaggagaagtctggcccgtgaccctctctgtccgtccagatccccttcccccagtgccggaccactctctctggcggaaggcggcgcagaggatgccgactggggagtcgccgcgttttgccccgcgttttttgaggaccctctcgggactagtcccctcggaagcagtggcgcccctcctctgccattgacaggcgaagatgaactcgaggaagtcggagctagacgggccgctcagcgggggcactggcgtagcaatgtgtccgccaacaacaacagtggttcccgctgtcctgagtcatgggaccccgtctccgccggcggccacgcagaaggttgtccatcacccaagcagacaccccgggccagccccgagccggggtatccgggcgagccattgctcggcctgcaggccgccagtgcccaagagccaggctgctgtcctggacttccacacctgtgttcggcacagggcctcgctcctgctccgtgcttagtgacaccttcatggacggaaacagcatcatccggaggggaccatccacaagccgagccaaagctggccaccgaggccgagggaacgaccgggccaaggctcccgctgccttccgttccatcccctagtcaggagggcgctccactcccctcagaggaagccagtgcccccgacgctccagacgcactgcctgatagccccactccagccactggcggtgaagtgtctgctatcaaactggccagtgccctgaatggcagctccagcagcccagaggtagaggccccaagcagcgaagacgaagatactgcagaggcaacctcaggaatcttcacagacacctctagtgatggcttgcaggcccggcgcccggacgtggtccccgcttttcgctctcttcaaaagcagtggccccagagagaagaatctctgcctcgtctgtgtttgctcctgcggcccagagggtag

SEQ ID NO: 179321 - DNA, 3984 bp, Artificial Sequence
  Description of Artificial Sequence: Synthetic coding sequence
tgacaccaggtgaaggtgcagggctgctggggccggtggcggtggcaggagtttgaaaatgctgagggtgacgaatatgccgccgatctggctcaggggtcacctgcgaccgctgcccagaacggtcccgacgtatatgtcctccccctgaccgaggtgagcctacccatggctaagcaacccgggagatctgtccaactgctgaagtctacagacgtgggacggcactccctcctgtacctgaaagaaatcggcagaggctggttcggaaaggtctttttgggagaggttaactctggaatcagtagcgctcaggtggtggtgaaagagctccaagcttcagcttccgttcaagaacagatgcagtttctggaggaggtccagccctacagggccctcaagcactccaatttgctgcagtgtctagctcaatgcgccgaagtgaccccatacctgctagtcatggagttttgtccactgggcgatttaaagggctaccttaggagctgccgggtggcagaatccatggcaccggacccccggacgctgcagaggatggcatgcgaggtcgcttgtggcgttctgcacctccatcgaaacaactttgtgcactccgacctcgctctgaggaattgcctactgactgccgatttgacagtgaagatcggagactacgggttggcccactgcaaatatcgcgaggactacttcgtgactgccgaccagctatgggtgcctctgaggtggatcgcccccgagctggtggatgaggtgcattccaatcttctggtagtagatcagaccaagtcaggcaacgtatggtccctgggcgtaaccatctgggagctgttcgaacttggcacgcagccctaccctcagcacagtgaccagcaggtactcgcctataccgtaagggagcagcagctcaaacttccaaaaccacagctgcagttaaccctcagcgatcgctggtacgaagtgatgcaattttgctggttgcagcccgaacaaagacctaccgcggaggaagtccacctgctgcttagctacttatgtgccaagggcgccacagaagcggaggaagaatttgagagaaggtggcgcagcctccggcccggtggcggcggagtgggccctggtccaggcgcggccggacctatgcttgggggggttgtcgagctggcagccgcctctagtttccccctcctggagcagtttgcaggcgatggatttcatgcagatggagatgacgtgctcaccgttactgagacatcccgcggcctaaactttgaatataaatgggaagccggtaggggagctgaggcatttcctgccacactgtctcctggcagaacagcacggcttcaggagctgtgcgcccccgacggtgctccccctggggttgtgcccgttctgtcggcccactccccttcattagggagcgagtattttattcggcttgaggaggctgccccggcagccggccatgaccctgactgtgctgggtgtgctcctagcccccctgcaactgctgatcaagatgacgactctgacggatctactgccgcaagcttggccatggagccattgctgggccacggaccacccgttgacgtcccctggggccgaggcgatcactatccccggcgatcactggcccgcgacccactgtgtccaagcagatcaccaagtccctccgcaggacccctgagcctcgcagaggggggagccgaggatgcagactggggggtggctgctttctgcccagcctttttcgaggatccgctcggaacaagcccacttggttctagtggagccccacccttgcccctcacaggtgaggacgagctggaagaggtgggcgctcgacgggctgctcagaggggtcactggcgatcaaacgtgagtgctaacaacaacagcgggtcacggtgcccggagagctgggaccccgtaagtgcaggtgggcatgccgaggggtgtccttctcccaagcagacccctagggcaagccccgagcctggatatccaggcgagccactattggggctccaggctgccagtgcccaggagcccgggtgctgtccagggctgccacatctatgtagtgcccaaggcctggctcctgctccttgtctagttacgccatcttggacggagacagcaagttcaggtggcgatcatccgcaagccgagcccaagctggccaccgaagccgaaggcactactggtccacgcctaccactgccgagcgtgccatctcctagccaggaaggcgcccccctgccaagtgaggaggcatccgcccctgacgcaccagacgccctgcctgactctcctacacccgcaacaggaggggaggtctccgctatcaagttagcaagcgcgctgaatggatcatcatcatccccagaagtggaggccccctcctctgaagacgaagacactgctgaggccacttctggtatcttcaccgacacgtccagcgacggcttgcaggcgcgtcgacctgacgtcgtgcctgcatttcgctcccttcagaaacaagtaggaactcctgactcattagattccctggatatcccttcctcagcctcagacgggggctacgaggtcttctcaccaagcgccacaggacccagcggggggcagccccgagccttagactctggatacgacacggaaaactatgagagccctgagttcgtcctgaaagaagcccaagagggttgcgaaccccaagccttcgccgaactcgctagcgaaggagagggacctggccctgaaacccgtctttccaccagtcttagcgggcttaatgaaaagaacccctatagggatagtgcttacttttccgatctggaagccgaggctgaggccaccagcggccctgagaagaaatgtggtggggacagggcccctggccctgagctgggattaccctccacaggtcagccgtccgagcaggtgtgtttgagaccaggggtctccggggaagcacagggctccggacccggagaggttctccctcccctgctccagttggaggggtcaagtcctgagcccagcacatgcccatctggactagtccccgagccgcccgagccccagggacctgccaaggttcgacccgggccttctcccagctgcagtcagttttttctgctcacaccagttcccctgcgctccgaaggcaattcaagtgagttccaggggcctcccggtttgttgagcggcccggcaccccagaagaggatgggtggacccgggaccccccgcgcccctctgagactggcccttcctggcctcccagcagctctggaaggcagaccagaggaggaggaagaggactctgaagattctgacgagagcgatgaggagctgcggtgctatagtgttcaggaacccagcgaagattctgaggaggaggcccccgcagttcctgtcgttgtcgctgagtctcaatccgccaggaacctaaggtctttgctgaaaatgccatcactgctgtccgaaacattctgcgaggatctcgaaagaaagaagaaagcagtgtctttctttgatgacgttacggtctatttgtttgatcaggaaagccctactcgcgagttgggggaaccattcccaggagccaaggaatcgccccccactttcctgagaggcagccctgggagccctagtgcacctaatcgcccacagcaagccgatggctcccccaatggcagcaccgctgaggaggggggtggattcgcctgggacgacgacttccccctgatgactgcaaaagcggcatttgcaatggcgttggatcctgctgcccccgcgcccgccgcccccactcccacccccgcccctttctcacggtttactgtgtcgccagctcccacatctcgcttttcgatcactcacgtatccgattctgacgcggagtcaaaacggggcccagaggcaggcgctgggggtgagtcaaaagaagcctag

SEQ ID NO: 179322 - DNA, 417 bp, Artificial Sequence
  Description of Artificial Sequence: Synthetic coding sequence
atggaggaggaggccgagaccgaggagcagcagcggttcagctaccagcagcggctgaaagcagccgttcactacactgtcggctgtctctgtgaagaggtggctctggacaaggagatgcagttttcaaagcagactatcgcagctatatctgagctgacctttcgccaatgcgaaaactttgccaaggacttggagatgttcgcccggcacgctaagcgcaccactatcaacacggaggatgtaaaactgctggcccggcgatctaattcattgctgaagtatataaccgataagtctgaggagatcgctcagataaatctggaacgaaaggctcaaaagaagaaaaaaagtgaggatggcagcaaaaactctaggcagcctgccgaggccggtgtcgtggagtctgagaattag

SEQ ID NO: 179323 - DNA, 495 bp, Artificial Sequence
  Description of Artificial Sequence: Synthetic coding sequence
atggaggaggaggccgagaccgaggagcagcagcggttcagctaccaacagcgactgaaggcggctgtgcactatactgtcggctgtttgtgtgaagaggttgcattagataaggagatgcagttctccaaacagactatagccgctatctcggaactaacattcaggcagtgtgagaatttcgcaaaggatttggagatgtttgcacggcatgctaagagaaccaccattaacaccgaagacgtgaagctgctggcgcggcgttcaaactctctccacatgcaggaggctgccggcatccgaaaatcctccttattgacctttctggcctggtggtttgagtggacatctcaggccagcgccggcccactgattggggaagaggccagagaggtggcgcggagacaggagggagcccccccccagcagtccgctcgccgggatcgaatgccgtgccggaatttcttctggaaaacattctcttcctgcaagtag

SEQ ID NO: 179324 - DNA, 234 bp, Artificial Sequence
  Description of Artificial Sequence: Synthetic coding sequence
atggaggaggaggccgagaccgaggagcagcagcggttcagctaccagcagagattgaaggccgccgtacactacacggtgggatgcctctgcgaagaggtggcgcttgacaaggagatgcaattctctaaacagaccattgcggcaatctcagagctgacctttcgtcaatgtgagaattttgccaaagatctcgagatgtttgcctctatatgccgaaaacgacaggagtag

SEQ ID NO: 179325 - DNA, 921 bp, Artificial Sequence
  Description of Artificial Sequence: Synthetic coding sequence
atgagcaacgtgaacctgagcgtgagcgacttctggcgggtgatgatgcgggtgtgttggcttgtgcggcaggatagtagacatcagaggatcaggctccctcatttggaggccgtggtgatcggcaggggcccagagacgaagatcaccgataaaaaatgtagccggcagcaggttcaactaaaagcagagtgcaacaaggggtatgtcaaagtaaagcaggtcggcgtgaatcccacaagtatcgactccgtggttatcgggaaggatcaggaagtgaagctccagccgggccaagtcttgcacatggttaatgaactctatccatatatcgttgagtttgaggaagaagcgaagaacccaggcttagagactcacaggaagcgaaaaaggtctgggaacagcgacagcatagagcgggatgcggcacaagaagcagaagccgggaccggactggagcccggatctaattctggacagtgctctgtgcccctgaagaagggcaaggatgcgccaatcaagaaggagagtctcgggcattggagccagggcctgaaaatttccatgcaggatccaaaaatgcaggtttacaaggacgaacaagtggtggtgatcaaggacaaataccctaaagctaggtaccactggttggtcttgccttggacaagtattagctctctcaaagccgttgctcgtgaacatcttgagcttttgaaacatatgcacaccgtaggagagaaggtcatcgttgacttcgccggaagtagtaaactgaggtttcggctcggctaccatgcgatccccagcatgagccacgtgcacctgcacgtgatctcacaagacttcgactcaccctgccttaaaaataaaaaacactggaatagtttcaacactgaatacttcctggagagccaggaatag

SEQ ID NO: 179326 - DNA, 1014 bp, Artificial Sequence
  Description of Artificial Sequence: Synthetic coding sequence
atgagcaacgtgaacctgagcgtgagcgacttctggcgggtgatgatgcgagtttgttggctggttcgccaggactcgcggcatcagcggatccgcctcccccatcttgaggcggttgtgattggaagggggccagagaccaagatcacagacaaaaagtgtagtcggcaacaggtccagttaaaggccgaatgtaataagggttatgtcaaagttaagcaagtgggagtgaacccaacctccatcgacagtgtggtgattggcaaagatcaagaagtcaagctgcagccagggcaggttcttcacatggtgaacgagctctacccttacatcgtggagttcgaggaagaggcaaaaaatccaggattggaaactcaccgtaaacgtaagcgcagcggcaattctgacagtatcgagagggacgcagctcaggaggccgaggccgggacaggcctggagcccggctctaactccggacaatgctcagtgccattgaaaaaggggaaagacgcacccatcaaaaaaaaagtgtacaaagacgaacaagtcgtcgttatcaaagataagtacccgaaagcacgctatcactggctggtcctcccctggaccagcatttcatcattgaaggccgtagccagggagcacctggaactgttgaaacacatgcacaccgtgggtgagaaagtcatcgtcgattttgcaggttccagcaagctgcgttttcggctgggctatcatgctattcctagcatgtcacatgtgcatcttcacgtgatcagccaggactttgattccccctgcctgaagaataagaagcactggaacagctttaataccgaatattttctggaatcccaagctgtgattgaaatggtgcaggaggcggggcgggtgacagttcgcgacggtatgcccgagctgctcaagcttccactgcgctgtcatgaatgtcagcaactcttacccagcataccacaactgaaagagcatttaagaaaacactggactcaatag

SEQ ID NO: 179327 - DNA, 1029 bp, Artificial Sequence
  Description of Artificial Sequence: Synthetic coding sequence
atgatgcgggtgtgctggctggtgcggcaggacagccggcaccagcgaataaggctacctcatctggaggccgttgtgattggccgagggcctgagactaagatcactgataaaaaatgctcaagacagcaggttcagctgaaggcggaatgtaataagggctacgtgaaggtgaagcaggtgggggtgaatcccacttctattgatagcgttgtaattggcaaggatcaggaggttaagctccagcctggacaggttttgcacatggtcaatgagttgtacccatacatcgtggaatttgaggaggaagccaagaatcccgggctggaaacccatcggaagcgaaagaggagcggcaattccgattcaatagagagggatgctgctcaggaggcagaggccggtactggtctcgaaccaggttcaaactcaggtcagtgctctgtgccactgaaaaaaggcaaggacgccccaattaagaaggaatccctgggccactggtctcagggccttaagattagcatgcaagaccccaagatgcaggtctacaaagacgaacaagtggtggtcattaaggacaaatatcctaaagcccggtaccactggctggtgctaccatggaccagtatcagctccttgaaggccgtcgcacgcgaacaccttgagctgttgaagcacatgcacaccgtcggcgagaaagttattgtggactttgcaggcagttctaagctgaggttccgacttggatatcatgcaatcccatcgatgtcccacgttcacctgcatgtgatctcacaggatttcgactctccttgtctcaagaacaaaaaacactggaattcttttaacactgaatatttcttggaatcacaggcagtaattgaaatggtgcaggaggcaggccgcgtgactgtgcgggatggtatgccggaattgctcaagcttccattgcgatgccacgaatgccagcagctgctacccagtatccctcaactcaaggagcatttgcgtaagcactggacacagtag

SEQ ID NO: 179328 - DNA, 1071 bp, Artificial Sequence
  Description of Artificial Sequence: Synthetic coding sequence
atgagcaacgtgaacctgagcgtgagcgacttctggcgggtgatgatgagagtgtgttggctagtacgccaagatagcaggcaccagcggattcgactgccgcacctggaagccgtggtgattggccggggcccagagactaaaattactgacaaaaaatgttcacgccagcaagtgcaactgaaggctgagtgcaacaaggggtatgtgaaggtcaagcaggtaggagttaatcctacctccatcgactctgttgtgatcggtaaagatcaggaagtaaagctgcagccgggccaggttctccatatggtaaacgaactgtacccctatattgtggagttcgaggaagaagctaaaaatcccggactggaaacccacagaaaacgcaagcgctccggtaacagtgacagtatcgagcgcgatgccgcccaggaggcggaagcgggtacaggcctcgaaccaggctccaacagcggtcaatgctcagtgcctctgaagaagggcaaagacgctccaattaaaaaagagtctttaggtcattggtctcagggtctgaagatctccatgcaagatccgaagatgcaggtttacaaggatgaacaggtggtggttattaaggataagtacccaaaggctaggtaccactggctggtactaccatggacgagcatttctagcctaaaagccgttgctcgggagcacctcgaattattgaagcacatgcatactgtcggagaaaaggtcatagttgacttcgccggctcgagtaagttaaggttcaggttgggataccacgctataccaagtatgtcacacgtccaccttcatgtgatcagccaggattttgattcaccttgccttaaaaacaagaaacattggaacagcttcaacacggaatattttctggaaagtcaagccgtcatagagatggtccaggaggctggcagagtaaccgtgagggatggcatgccagaactgctcaaactacctttgcgttgccatgagtgccagcagctgctcccaagtatcccgcagttaaaggagcacctccggaagcactggacccaatag

SEQ ID NO: 179329 - DNA, 921 bp, Artificial Sequence
  Description of Artificial Sequence: Synthetic coding sequence
atgagcaacgtgaacctgagcgtgagcgacttctggcgggtgatgatgcgggtgtgctggctcgtcaggcaagattcacgacaccagcgaatacggctgccccacctcgaagctgtggttattgggcggggccccgaaaccaaaattaccgataagaagtgcagcaggcagcaagtgcagctcaaggcagagtgtaacaagggctatgttaaggttaaacaagtcggcgtcaatcctaccagtattgactccgtagtgatcggaaaagaccaagaagtcaagcttcagcctggccaagtgttgcacatggttaatgagctgtacccctatattgtggagttcgaggaggaggccaaaaacccgggccttgaaacccacaggaagcgtaagagaagcggaaattcagacagcattgaacgggatgccgcccaggaagctgaagccggcaccggtctggagcccgggtctaattccggccagtgttcggtacctcttaagaagggtaaggatgccccgatcaagaaggagagtctagggcactggtctcaggggctgaagatttctatgcaagaccctaagatgcaagtgtacaaggatgagcaggttgtggtgattaaagataagtatccaaaggcccggtatcattggctggtgcttccgtggacatctatctcatcccttaaggccgtcgctagagagcacctcgagctgctgaaacacatgcacactgtgggggagaaggtgattgtggactttgcaggatcttctaagttacggtttcgcctgggttaccatgccattccctcaatgtcacacgtccacttacatgtgatctcccaagattttgactccccatgcctgaagaataaaaaacattggaattcctttaatactgaatactttctggagagccaggagtag

SEQ ID NO: 179330 - DNA, 855 bp, Artificial Sequence
  Description of Artificial Sequence: Synthetic coding sequence
atgagcaacgtgaacctgagcgtgagcgacttctggcgggtgatgatgcgcgtttgctggctggtcagacaggatagccggcaccagcggattaggcttccccatctggaagccgtggtgatcggtcgcggtcctgaaacaaaaatcacagacaagaaatgtagtagacagcaggtccagctgaaggccgaatgtaacaagggctatgtcaaggtgaagcaagtcggtgtgaatcctaccagcatcgattctgtggtgatcggaaaggatcaggaagtcaagctgcagccgggccaagtcctgcatatggaatccttgggtcactggtcccagggtctgaagattagtatgcaagatccaaagatgcaggtctacaaggatgagcaggtggttgtgattaaagacaagtatccgaaggcccggtaccattggctagtgctgccatggacctccatatcctctctgaaggcagttgctagggagcatctcgagctgctgaagcacatgcacacagtgggggagaaggtgatcgtcgacttcgcaggctcatcgaaacttaggtttaggttggggtatcatgccatccctagcatgtcccatgtacatctccacgtcatatcccaggacttcgactccccatgcctgaagaacaagaagcattggaactcatttaatacagaatacttcctggagtctcaggccgtgatcgagatggttcaagaggcgggccgcgtcacagtgcgggacggcatgcccgaattgcttaaactccctctccggtgccacgagtgtcaacagcttttacccagcatcccacagctgaaggaacatctgcggaaacactggacacagtag

SEQ ID NO: 179331 - DNA, 579 bp, Artificial Sequence
  Description of Artificial Sequence: Synthetic coding sequence
atgatgcgggtgtgctggctggtgcggcaggacagccggcaccagaggatcagactgccccacctcgaagctgtagttatcggccgcgggcctgaaacaaagataacggacaagaaatgtagcagacagcaagtccagctaaaggctgagtgcaacaaaggctatgtgaaagtcaaacaggtcggggttaatccaaccagtattgacagcgtggtgattggcaaagaccaggaggttaaattgcagcctggacaggtcctgcacatggtgaatgagctctatccatatattgtggagtttgaggaagaggctaaaaatcccggcctcgaaacgcacagaaaaaggaaacgttctgggaactcagactcaatcgagagagacgccgcgcaggaagcggaagcagggaccgggctggagcctgggagtaactccggccagtgctcagttcctctgaagaagggaaaagacgcccccatcaagaaggagagcctcgggcattggtcccaaggtctgaagatttccatgcaggatccgaaaatgcagccatgtacctcatcttgtgaccaacctggcttctag

SEQ ID NO: 179332 - DNA, 1029 bp, Artificial Sequence
  Description of Artificial Sequence: Synthetic coding sequence
atgatgcgggtgtgctggctggtgcggcaggacagccggcaccagcgcatccggcttcctcatcttgaagccgtcgtcattgggcgcggccccgaaacgaaaatcaccgataaaaaatgttcccgacagcaggtgcaactgaaggccgaatgcaacaagggctacgttaaagtgaaacaggtgggcgttaacccgaccagcatcgactccgtggtaataggcaaggaccaggaagttaaactgcagcccgggcaggtgctgcatatggttaacgagctgtatccatacattgtggagtttgaggaagaggccaagaatcctggactggaaacccatagaaaacgcaagcgctccggaaatagcgactccattgaacgagacgctgctcaggaggccgaagctggcaccgggctggagccaggatctaatagcggacagtgttcagtgcccctgaagaaggggaaggatgcacctatcaagaaggagtctcttgggcactggtctcaaggtttgaagatttccatgcaggaccccaaaatgcaagtctataaagatgaacaggtcgtggtaataaaagacaagtaccccaaggcccggtatcattggttagtccttccatggacctcgatctcatccctaaaagctgtcgctcgagagcatcttgaactactcaagcatatgcatacagtcggagaaaaggttatcgtagacttcgccggttccagcaagttaaggttccggctgggttaccacgccatcccctctatgtcccatgtacacctgcacgtgatttcccaagacttcgattccccatgcctcaagaacaagaaacattggaactcttttaatacggaatattttctggagagccaagccgttatcgagatggtgcaggaggctggcagagtgactgtgagagacggaatgccagagctgttgaaattgccactccgatgccacgaatgccaacagctgctgccgagcattcctcaactgaaagagcacctgaggaagcattggacgcaatag

SEQ ID NO: 179333 - DNA, 909 bp, Artificial Sequence
  Description of Artificial Sequence: Synthetic coding sequence
atgagcaacgtgaacctgagcgtgagcgacttctggcgggtgatgatgcgcgtctgttggcttgtgagacaggactctaggcaccagagaataagactcccgcatctggaggccgtcgtaattggacgcggtcctgagacaaagatcaccgataagaaatgtagtcgtcagcaggagttcgaagaggaggcaaaaaaccctgggctcgaaacacatcgcaagcgtaaacggtctggaaactctgattctattgaacgagacgcagcgcaggaagccgaagccggcaccgggttagagcccggatcaaattccgggcagtgctcagtgccgctgaaaaaaggcaaggacgcacctattaaaaaagagagcctgggacactggtctcagggactcaaaatctctatgcaggaccccaagatgcaggtgtacaaagacgagcaggtcgtcgtgatcaaggataaatacccgaaagcccgctaccattggctggttctgccctggaccagtattagcagtttgaaggcagtcgcgcgcgaacacttggaactgctgaaacatatgcatactgttggagagaaagttatcgtggacttcgccggcagctcgaagttaagatttcgtctgggttaccacgcgatcccatctatgagccacgttcatttgcacgtcatctcacaagacttcgatagcccctgcctcaagaacaagaagcactggaattcatttaacacggaatacttcctcgaatctcaagccgtgattgaaatggtacaagaagccggtagggtgaccgtgagggatggcatgcctgagctactgaagttacctttacgctgccacgagtgccaacaactgttgccgagtattcctcagctgaaggagcatctgcggaagcactggactcagtag

SEQ ID NO: 179334 - DNA, 1029 bp, Artificial Sequence
  Description of Artificial Sequence: Synthetic coding sequence
atgatgcgggtgtgctggctggtgcggcaggacagccggcaccagcggattagactgccacatctggaggccgtcgtgattgggcgaggccctgaaaccaagattactgacaagaaatgctctaggcaacaggtccagctgaaggcggagtgcaacaaggggtacgtcaaagtcaagcaggtgggggtgaaccccacctctatagactccgtggtgatagggaaagaccaggaagtcaaactccagcccggccaggtcctacacatggtcaatgagctgtatccttacatagtagagttcgaggaagaagccaaaaatccaggactggaaacccaccgcaaacgcaagcgttcaggaaactcagatagtattgagagggatgcagcccaggaggctgaagcaggcaccgggctggagcctggctcaaactccggacagtgttcagtgcctctgaagaagggtaaggacgctcccatcaagaaagaatctctgggacactggagccagggcttaaaaatttccatgcaggaccctaagatgcaggtgtataaggatgagcaagtggtggtcattaaggataaatatcccaaggcgcgataccactggctggtgttgccttggacgagcatatcctcactaaaagctgttgcacgtgagcacctggagttacttaagcacatgcatacagtgggagagaaagtgattgtcgattttgccgggagcagtaagctccggtttcgactaggataccacgctatcccatccatgagccacgtccacctgcatgttatcagccaggatttcgactccccatgcctgaaaaataagaaacactggaattcctttaacactgagtatttcctggagtcccaggcggtgatcgaaatggtgcaggaagctgggagggttacagtaagagacgggatgcccgaacttctcaagctgcctcttcgatgccatgagtgccagcagttgctcccttctatcccccagctgaaagagcacctccggaagcattggacccaatag

SEQ ID NO: 179335 - DNA, 687 bp, Artificial Sequence
  Description of Artificial Sequence: Synthetic coding sequence
atgtacatcatcgcccagtgcgtgggcgccatcgtggccaccgccattctgagtggaatcacgagtagcctcaccggcaactcgctcggaaggaacgacctggccgacggcgtcaattccggtcagggcctcggaattgaaataatcggcacccttcaattggtactgtgcgtacttgcaacaaccgatagaaggcgcagagacttaggagggagtgcccctttagcgatagggttaagtgtcgcgctggggcaccttctggccattgactacactggctgcgggattaacccggcgagatccttcgggtctgccgtgatcacccataatttctccaatcactggatcttttgggtgggtcccttcataggtggagctcttgcagttttgatttatgatttcatccttgccccgaggtcctccgatctgaccgaccgggttaaggtctggactagtgggcaggttgaggagtacgatttggacgcagacgatataaacagtagaagtttccttggcactaaaatctaccaatttacccacagtttggaggtcgtggaagaggtcaaagagcgtgatcctcccgcgtcacgtccgtcggagcatgacggccgatgcgcacgcaagtctcctctagccccgaagctgttaaccgactcccccgcacaggtacctggaattctgccttag

SEQ ID NO: 179336 - DNA, 810 bp, Artificial Sequence
  Description of Artificial Sequence: Synthetic coding sequence
atggccagcgagttcaagaagaagctgttctggcgggccgtggtggccgaatttctggccacaaccctctttgtgtttatctctatcgggagcgcccttggatttaaatatcccgtgggaaacaaccaaaccgcagttcaggataatgtgaaggttagtcttgcattcggcctgtccatcgccactctggcccagtcagtcggccacatttctggtgcgcacttaaatcccgccgtgaccctggggttgctgttatcctgtcagatctcaatctttcgggccttgatgtatattatagcccagtgcgtaggtgcaatagtcgccaccgcaatcttgagcgggatcacaagttctctgaccggaaacagtttgggacggaacgacctggctgacggtgttaatagcggccagggactgggcatagagattattggcaccctgcagctggtcctgtgcgtgttagccaccacggatcgacgacggagagatctcggagggtcagcccctctggccattggcctgtccgtggcactgggccacctcctcgctattgactatacaggctgtggaattaaccctgcacggtcctttgggtccgctgtcatcactcacaacttttctaatcattggattttttgggtggggccctttatcgggggagctttggcagtgcttatttacgatttcattctggcaccgcgttcttccgacttaactgatcgcgtgaaagtttggacctcaggacaggtggaagagtatgatctagacgccgacgatatcaactcgcgggtggaaatgaaaccaaagtag

SEQ ID NO: 179337 - DNA, 657 bp, Artificial Sequence
  Description of Artificial Sequence: Synthetic coding sequence
atgttctggaccttcggctacgaggccgtgagccccgccggcccctcgcatctgttcgcatccttacttctaggggtcctgctgacgattacgttcatgccaggggctcgcccccttcctctagtgctggttccccagaacacactcgcttggatgcagttagatgcaaaggcacctgcccatccacgccccctgcagttattgggtagggtgggtccagggagtcgccaactggccgatggcgtgaactctggacaaggactgggaatcgaaatcataggtaccctgcaacttgtcctctgcgtacttgcgacaacagaccggcggaggagggatctgggtggcagcgcccctctagccattggactaagtgtggcactggggcatctgcttgcgattgactataccggctgtggtatcaatccagctagaagctttgggagcgctgtgattacccacaactttagtaaccattggatcttctgggttgggccttttatagggggggctctggcagtcctcatctatgacttcatcctcgcacccagatcctctgacctcactgacagagtgaaggtctggacttctggtcaagtggaggaatacgacctcgacgctgatgacataaactcacgggtggaaatgaagccaaaatag

SEQ ID NO: 179338 - DNA, 465 bp, Artificial Sequence
  Description of Artificial Sequence: Synthetic coding sequence
atgcagagcggcatgggctggaacgtgctggacttctggctggccgacggggtgaattcgggtcaaggccttggcattgaaatcatcgggactttacagctcgtgctttgcgtattggctaccactgaccgccgtaggagggacctggggggctcagctcctttagctattgggctatctgtggctcttggccatctcctggccatcgattatacagggtgtgggatcaatcccgctcggagtttcggaagcgctgtcatcacccacaatttttctaaccactggatcttctgggtggggccatttattggtggtgccctggctgtcttaatatatgatttcatcttagcgccacgcagtagcgacctcacggacagagtgaaggtatggacatcaggccaagtggaggagtatgacttggatgccgatgacataaacagccgcgtagaaatgaaacctaaatag

SEQ ID NO: 179339 - DNA, 765 bp, Artificial Sequence
  Description of Artificial Sequence: Synthetic coding sequence
atggccagcgagttcaagaagaagctgttctggcgggccgtggtggcggagttccttgccactacacttttcgttttcatctctattgggtccgcgcttggctttaaatacccagttggcaataaccagacggccgttcaagacaacgtgaaagtgagcctggcattcgggctgtccatagccaccctagcccagtctgtcggccatatttccggagcccatttaaatcccgcagttacccttggtctactcttgagctgtcagataagcatagttgcaaccgccatcctcagtggtattacaagttccctgacgggcaacagcctcggccggaacgatttggccgatggcgtgaacagtggccagggattaggaattgagattatcggcaccctccagttggttttgtgcgtactggccacaactgacagacgaaggcgtgatcttgggggcagtgcaccgctcgctatagggctgagtgttgcgctcgggcacctgttggccattgattacactggttgtggaatcaatcccgccaggagcttcggttctgcagtcattacccataacttttcaaatcactggattttttgggtgggcccatttattggcggagcattggcagtgctgatatacgacttcatactggctccccgcagcagcgatctgacagatagggtaaaagtatggacctccggacaggtagaggagtacgaccttgatgccgacgatatcaacagccgcgttgaaatgaaaccgaagtag

SEQ ID NO: 179340 - DNA, 990 bp, Artificial Sequence
  Description of Artificial Sequence: Synthetic coding sequence
atgtgccaggtgggctgcttcctgaagaccccccggttccccatctgggtggtttgttctgaaagccacttctctattcttttttcactccagccagggctcctgagggactggcggaccgagcggctgtttgatctgtactattatgatggattggcgaaccagcaggagcagatcaggctcaccatcgataccacccaaaccatttcagaggataccgataatgatttggtaccccctttggagctgtgcatcagaactaatatagggagcgcgctcggcttcaagtatcctgtgggtaacaaccagacagctgtgcaggataacgtgaaggtgtctctggcattcggcctgagcatcgccactcttgcccagtcagttggacatataagtggagctcacttgaatcccgccgtcacactcgggcttctgctcagttgccaaatcagcattttcagggccctcatgtatatcatcgcacaatgtgttggcgctattgtagctactgctattctgtctggtatcacctcatccctgacaggcaattccctgggcaggaacgacctggcagatggggtcaattccgggcaaggccttggcatagagatcatcgggactctgcagttggttctgtgtgtgctggctaccactgatcgacgcagaagggaccttggtggatctgctcccctggccatcggcctgagcgtggctctcgggcacctgctggccatcgactataccggatgcggaatcaatccagcccgcagctttggaagtgccgtaatcacacataacttctctaaccattggattttttgggtcggaccttttattggaggagccctcgcagtgctaatttacgactttatcctggctcctaggtcatcagacctgactgatcgagttaaagtgtggaccagtggacaggtcgaggagtatgacctggacgctgatgacatcaattctcgcgttgagatgaagcctaagtag

SEQ ID NO: 179341 - DNA, 561 bp, Artificial Sequence
  Description of Artificial Sequence: Synthetic coding sequence
atgcccggcgcccggcccctgcccctggtgctggtgccccagaacactctggcttggatgcagctggatgcaaaggcacctgctcatccccgacccctacagctgctggggcgcgttggacccgggagcaggcagctggccgatggcgtgaactctggacagggcctggggatcgaaatcatcggtaccctccagctagtcctgtgtgtgcttgccacgaccgaccgcaggcgtcgagacctcggcggctccgcaccgctggctattggcctttccgtcgccctgggacacttattggctattgattatactgggtgtggcataaaccccgcaagatcattcggctcagctgtgatcacacacaacttctctaaccattggatcttttgggtcggaccctttataggtggggccctggccgtgcttatttacgatttcatcctcgcaccacggagctctgatctcacagaccgtgtgaaagtttggacttctggccaggttgaggaatacgacctggatgcagacgacattaattcacgggttgaaatgaaacccaagtag

SEQ ID NO: 179342 - DNA, 816 bp, Artificial Sequence
  Description of Artificial Sequence: Synthetic coding sequence
atgagccccctgctgggcctgcggagcgagctgcaggacacctgcacaagcctcggtttgatgctttcagttgtgcttcttatgggtttggccagggtcgtcgcgcgtcagcagctccatagacccgtggcccacgcatttgttctggagtttctggccacattccagctgtgctgttgcactcatgagctccagttgctctctgagcagcacccagcccaccccacctggacactcactttggtttattttttttctcttgtgcacggcctcacactcgtcgggacgagctctaacccatgtggagtcatgatgcagatgatgctgggcggcatgtccccagagaccggcgcggttagattgctcgctcaattggtttcagccctgtgcagtcgttattgcacgtccgcactctggtccctgggactcactcagtaccatgtgtctgaacgctcttttgcctgtaaaaacccgattagagttgatcttctgaaagcagtcatcaccgaggccgtttgtagtttcctttttcatagtgccctcctgcactttcaggaggtgcgcaccaaactgcggatacacctgctggctgcgcttatcactttcctggtgtatgctggaggcagcctgactggcgccgttttcaatcctgctctggcactttccctccatttcatgtgttttgacgaggcattcccgcagtttttcattgtttactggctcgcccctagtttgggcattttactcatgatcctgatgtttagttttttcttaccatggctgcacaacaatcacactatcaacaagaaggaatag

SEQ ID NO: 179343 - DNA, 888 bp, Artificial Sequence
  Description of Artificial Sequence: Synthetic coding sequence
atggccggcctgaacgtgagcctgagcttcttcttcgccaccttcgcactgtgtgaggctgcacgacgagcttcgaaggccttgctgccggtgggcgcatacgaggtctttgctagggaagcgatgcggaccctcgtcgagttagggccttgggctggtgactttgggccagacctcttgctcacactgctctttttattgttcctcgcacacggtgtcacgctcgacggcgcttctgcaaaccccacagttagtctgcaggaattcttaatggcagagcagtcactgccagggacattgttgaagcttgccgcccagggcctcggtatgcaggccgcttgcaccctgatgcgattgtgctgggcttgggagctgtcagacctccacctgttacaatcccttatggcccagtcctgtagttccgccctacgtacctctgtgcctcatggcgcgttagtggaggcggcctgcgcattctgttttcatctcaccctactgcacctgagacactccccaccggcatattctgggccagcagtcgctctgctggttacggttactgcgtacacagcagggccttttacatctgccttcttcaacccggcactggccgcttcagtgacatttgcatgctccggccacactctccttgagtacgtgcaggtctactggttgggtccacttacagggatggtgctggcagtgttattacatcagggcagactgccccacctgtttcagaggaatctgttttacgggcagaagaataagtacagggccccaaggggcaaacctgctccggcttccggcgatacacagacaccagcaaaaggttcctctgtgagggagccaggcaggtctggcgtcgagggaccccattcctcatag

SEQ ID NO: 179344 - DNA, 798 bp, Artificial Sequence
  Description of Artificial Sequence: Synthetic coding sequence
aaccagcccgcccccgccctgagcccccaggtgagctgccggcactcttctagcggcggtccagggcgatggcaggagttcctgatggcagaacaatctcttccgggtaccttgctgaaacttgcagctcaggggctgggcatgcaggcagcatgcaccctcatgcgcctttgctgggcatgggaactttccgacctgcacctacttcaatcccttatggcacagagctgtagctctgcacttagaacaagcgttccacacggtgcactcgtagaagccgcttgcgccttctgctttcatcttacactgctgcatctccggcactccccacccgcctacagcggaccagcagtggcacttctggttacagttactgcgtacacagccggtcccttcacatctgcgttcttcaaccccgctttggcagcctctgtgaccttcgcttgcagcgggcacactctgctggagtacgtccaggtctactggctgggacctttgactgaggagcagcatggggaagttatggagccacccctaggacctcggtcgggggactctgggccatggctccagcgcccccgctggagccctcatctgctgttacacttgctgtcagacactagactccatcttacggaagtaccggaaggccagttgggctcatacggtatccttgaagcattcttcagcttttgttggctgtacacaggtgaggtttccggtgccatgcctcagcccccccttgggggtaaggatcggagttggggcagcctacgacatcttgcattgcggtggtag

SEQ ID NO: 179345 - DNA, 924 bp, Artificial Sequence
  Description of Artificial Sequence: Synthetic coding sequence
atggccggcctgaacgtgagcctgagcttcttcttcgccaccttcgctctctgtgaggcagcacggagggcaagcaaggcattgctccctgtgggagcatatgaggtgttcgctagagaagctgtcggcgcagtgcagctcggcccctgttgtctcgagatgcgcaccctggtcgagttaggcccctgggctggggacttcgggcctgacctgctcctaacacttctattcctgctgttcctggcgcacggcgtgacgctggatggcgccagcgcgaacccaactgtgagcctacaggagtttctcatggccgagcagtcattacccggcacactgttgaaactggctgctcaaggactgggtatgcaggctgcctgcacgcttatgagattgtgctgggcctgggagctgagcgaccttcatttactgcagtccctcatggcccagtcatgttcaagtgctctgcgcacaagtgtgccccacggtgccctggtggaagccgcttgcgccttctgcttccatctgaccctcctgcacttgcgtcacagtccccctgcatactctggcccagccgttgcactcttggttacggtaaccgcttataccgcaggccccttcacaagcgcttttttcaaccccgccctggcggccagcgtgacctttgcgtgttcaggtcatactttactggaatacgtgcaggtatattggcttggtccgctaactggcatggtacttgcggtactcctgcaccaggggaggctcccgcacctgttccagaggaatcttttttatgggcagaagaacaaatatcgggctcccagagggaaacccgccccagcaagcggcgacacccaaactccagccaagggtagctccgtgcgcgagccagggcgtagcggcgtggagggtccgcacagctcttag

SEQ ID NO: 179346 - DNA, 816 bp, Artificial Sequence
  Description of Artificial Sequence: Synthetic coding sequence
atgtgggagctgcggagcatcgccttcagccgggccgtgttcgccgaattcctagccaccttgctattcgtcttttttggactcggttccgcacttaattggccccaagcactgccttcagtgcttcagattgcgatggcctttgggcttggaataggaacgttggttcaggctctggggcatatatcaggagctcacatcaaccctgccgtcaccgttgcctgccttgtgggctgccacgtgagtgttctaagggcagctttttacgtggctgcccagctgttgggggccgtggccggtgctgctcttctgcacgagattacccccgccgatatccgcggcgatctcgccgtgaacgctctctccaactccacaacggctgggcaagccgtgaccgttgagttgttcctaaccctgcagttggtgctgtgcatctttgcatcaaccgacgagcgaaggggagagaaccccgggacccccgctttaagcataggttttagtgtggccctcggccaccttctgggaatccactataccggttgcagcatgaatcctgccagatcactggccccagcagtggtgactggtaagttcgatgatcactgggtgttttggatcggccctttggtgggagcaattctggggtcactactgtataattatgtgctgtttcctcccgcaaagtctctatctgaaagattagcagttcttaaagggctggagcctgatactgactgggaagagagagaagtacgccggagacagtcagttgaattacacagcccccagtctctgccccgaggtactaaagcatag

SEQ ID NO: 179347 - DNA, 879 bp, Artificial Sequence
  Description of Artificial Sequence: Synthetic coding sequence
atgggccggcagaaggagctggtgagccggtgcggcgagatgctgcatattcggtataggctcttaagacaggcactggcggagtgccttggtactttaatcttggtgatgtttggctgtggctccgtggcacaagtggtactgtctcgcgggacccatggcggatttttgacaatcaatctggccttcggttttgcggtaactctcgggatcctcatcgcagggcaggtctccggagcgcaccttaaccccgcggttacgttcgcaatgtgtttccttgccagggagccttggatcaaactgcccatctataccctcgcccaaaccttaggcgcttttctcggcgcaggaatcgtgttcggtttatattacgatgcgatctggcacttcgccgataaccaattgtttgtctcaggtcccaatggaaccgcaggaatcttcgccacataccccagtggacacctggacatgattaacggattcttcgatcagttcatcggtactgcttctctcattgtgtgtgttctggctatcgtcgacccctataataacccggtcccaaggggtctggaggcttttaccgttgggttagtcgtccttgttatcgggaccagtatgggctttaactctggctacgctgtcaacccggcacgtgattttggcccccggttgtttacagcactggcgggttggggatctgctgttttcaccacaggacagcattggtggtgggtcccgattgtgtcaccactgctcggatcgatagcgggtgtgtttgtctaccagctaatgattggatgccatctggagcagcctccaccttctaacgaggaagagaacgtgaagctggcgcacgtaaagcataaggagcaaatttag

SEQ ID NO: 179348 - DNA, 840 bp, Artificial Sequence
  Description of Artificial Sequence: Synthetic coding sequence
atgggccggcagaaggagctggtgagccggtgcggcgagatgctgcacattcgctaccggctgctccgccaggctttggccgaatgccttggcacattgattcttgtaatgttcggctgtgggagcgtcgcccaggtggtgctgagcagaggaactcacggagggtttcttacaataaacctggcatttggcttcgccgttactttaggtatcctcatagcaggtcaggtttcaggggctcacttaaatcctgccgtgacctttgcgatgtgcttcttggccagggagccttggatcaagttacccatttatacccttgcgcagaccttgggggctttccttggcgccggaattgtatttggcctgtactacgatgccatctggcatttcgccgacaatcaacttttcgtgtctggtccaaatggtaccgccggcatcttcgctacttacccaagtgggcacttagacatgatcaacggtttctttgaccaggaccgacccgccctcgtcgtaggagcccatagagtgcctaccccaggcctgcattgcggctgtctcagagtgcctgcagacgatcgcctgccccctggggccgcccctacactacaaagaggtcgcgaatgtgaggcaggaccctgcgaggctcagggcgctgacttgagcggccaggggtcacccctgaggtgtccgggtctcgaacacccattaacggtccagggaccccttccacgctccccgctccatgatcccccattccaggcaaaggaacttcctatctaccctcaccccacaactgcccccagtggctttcctctcgatctggctcagattgctccgtag

SEQ ID NO: 179349 - DNA, 972 bp, Artificial Sequence
  Description of Artificial Sequence: Synthetic coding sequence
atgagcgaccggcccaccgcccggcggtggggcaagtgcggccccctgtgtactcgggagaacatcatggtggcctttaaaggagtgtggacacaggccttctggaaagccgtgacagcagagttccttgcaatgcttatctttgttctgctttcactggggtccacgatcaattggggaggtaccgagaagcccctgcctgtggatatggtattgattagtctgtgtttcggcctttcaatcgctacaatggttcagtgtttcggtcacatcagcggcggccacataaatcccgccgtgacagtagcaatggtctgtacacgaaagatctccattgccaagtctgttttctatattgctgcccagtgtctcggggcaattattggcgccggcattctctacctcgtcaccccgccttctgtggtgggtggcttaggagtgacgatggtgcatggaaatctaaccgcgggccatggacttttggtcgagctcatcatcaccttccagctcgtatttactatattcgctagttgcgatagcaagaggaccgatgttactggttcgattgcactggcaatcggattttcagtggccataggccacctgtttgccattaattatacgggggctagcatgaaccccgcgcggagcttcggccccgccgtcataatggggaattgggaaaaccattggatttattgggttgggcctattattggggccgtgttggccgggggtctgtatgaatacgtgttctgtcctgacgtcgagttcaagaggcgttttaaagaggcgttctctaaagccgcccagcagaccaagggctcctatatggaggtggaagacaatcgttctcaagtcgagactgacgacctcattcttaagcccggcgtggttcatgtgatcgacgtggaccggggcgaagaaaagaaggggaaggatcagagcggagaagttctgagctcggtatag

SEQ ID NO: 179350 - DNA, 660 bp, Artificial Sequence
  Description of Artificial Sequence: Synthetic coding sequence
tgcaccctggccggcgagggcatgagcgaccggcccaccgcccggcgatgggggaagtgcggccctctgtgcactagagagaacattatggtcgcctttaaaggcgtgtggacacaggcattctggaaagcagtgacagccgagtttcttgccatgctgattttcgtgctcttaagtctggggtctacaatcaattggggcggcacggaaaaaccccttcctgttgatatggttctgattagcctttgcttcggactgtccattgcaaccatggtgcagtgctttggccatatctctggcggccatataaaccctgctgtcacggttgcaatggtttgcactcgcaagatttcaattgctaagtcagtgttctatatagcagcccagtgtgtgggtcccataattggagctgtcttagcaggcggactgtatgaatacgttttctgtcccgacgtcgagtttaaacggcggttcaaggaggccttctctaaagccgcccagcagacgaaggggtcctacatggaggttgaggataataggagccaggtggagaccgacgaccttattctcaagcccggcgtcgtgcacgtcatagatgtggatcgaggtgaggagaagaaagggaaggatcagagcggggaggtactttccagcgtgtag

SEQ ID NO: 179351 - DNA, 912 bp, Artificial Sequence
  Description of Artificial Sequence: Synthetic coding sequence
atgagcgaccggcccaccgcccggcggtggggcaagtgcggccccctgtgtactcgggaaaacattatggtggcattcaaaggtgtatggacccaggccttctggaaagccgtgaccgcggaatttctggccatgctgattttcgttctgttgtccctaggatccacaataaattggggcggaactgaaaagccacttcccgtggatatggttttgatctcactgtgtttcggacttagtatagccactatggtgtgtacccgcaagattagcatcgctaaaagtgttttctacatcgccgctcagtgtttaggcgccattataggcgcaggtatcctttatttggtgaccccaccctcagtggtgggaggactcggcgtgactatggttcacggaaatttgaccgcaggacacggtctgctggtggagctgatcatcacttttcaattggtgttcacaatttttgcaagttgtgactctaagcggaccgatgtcactggatccattgctctggccatcgggtttagcgtggcaatcggccacctctttgccattaattacaccggggcaagtatgaaccccgcaaggagcttcggccccgccgttatcatggggaactgggagaatcactggatttattgggtgggcccgatcatcggcgccgtgctcgccggtgggttgtacgagtatgtcttctgtcctgatgtggagttcaagcgccgattcaaggaggctttcagtaaagcagcccagcaaaccaaaggatcctacatggaagtcgaggacaaccggtctcaagtggagacagacgacctcatactgaaaccaggcgtggtccatgtgattgacgtcgaccggggggaggaaaaaaagggtaaagaccagagtggggaggtgctcagcagtgtttag

SEQ ID NO: 179352 - DNA, 849 bp, Artificial Sequence
  Description of Artificial Sequence: Synthetic coding sequence
atggacgccgtggagcccggcggccggggctgggccagcatgctggcctgccggttatggaaagcgatctcaagagccttgtttgcagagttcctggctacagggctgtacgtgttcttcggtgttggctctgttatgaggtggccaaccgctctccccagcgtcctgcaaatcgctataacttttaatctggtgacggctatggctgtgcaagtgacttggaaggcatccggcgcccacgctaacccagcagtgactttagcatttctagttgggtcccatatcagcctgccccgcgccgtcgcttatgtggccgcgcaacttgtaggcgccacagtgggcgccgctttgttgtacggtgttatgcctggtgacatacgcgagaccttggggatcaatgttgtccgtaacagtgttagtaccggacaggctgtcgctgtggagctcctgctgaccctccagttggtgttgtgcgtcttcgctagcacggactccagacagaccagcggctccccagccacaatgattggcatttctgtggccctgggtcacctaattggcatccactttactgggtgctctatgaatcctgcccggtcttttggacctgccatcatcatcggcaagttcacagtccattgggtcttctgggtggggccactgatgggggctcttctcgcctcgctgatctacaattttgtactgttccctgatacgaaaactttggcccagaggctggctatccttaccggaaccgtggaggtcggcacaggcgcaggggctggcgcagaacctctgaagaaagagagccagccaggatccggggcggtcgagatggagagcgtctag

SEQ ID NO: 179353 - DNA, 1029 bp, Artificial Sequence
  Description of Artificial Sequence: Synthetic coding sequence
atggtgcaggccagcggccaccggcggagcacccggggcagcaagatggtgtcctggagtgtcatcgccaagatacaggagattctgcagcgcaaaatggtgcgtgagtttctggccgagttcatgtctacatacgtgatgatggtgttcggactcggctctgttgcccacatggtcttaaacaaaaaatacgggagttatcttggcgtgaaccttggttttggatttggggtgaccatgggagtgcacgtggccggacgcatctctggggctcatatgaatgcggcagtgacctttgctaactgtgcgttgggtcgcgtcccatggcgaaagttccctgtttacgtcctggggcagttcctcggatccttcctcgcggccgccaccatctattctttattttacaccgctatcctgcacttttcaggcgggcagctgatggtgactggacccgtcgctaccgcaggcatttttgcgacctacttgccggaccacatgactttatggcgaggctttctgaatgaggcctggttgacgggtatgttacaattatgcctgttcgcaattactgatcaggaaaacaacccagctcttcccggcacagaagctctggttatcggcatcctcgtggtgataatcggtgttagtctgggtatgaacaccgggtatgccataaaccctagtagagacttgcctccacggatcttcactttcatcgctggatggggaaaacaggtgttttcaaacggtgaaaattggtggtgggtgcccgtagttgccccccttttgggtgcctatctgggcggcattatatatttggtgttcattgggagtacaatacctcgggagcctctaaagctggaggacagtgttgcctatgaagatcacgggatcaccgtgctacctaagatggggtcccatgagcctaccatcagtccactcacacctgtgtcagtcagccctgctaatcggagtagtgtccaccctgcgccacctctgcatgagtcaatggcacttgagcatttctag

SEQ ID NO: 179354 - DNA, 651 bp, Artificial Sequence
  Description of Artificial Sequence: Synthetic coding sequence
atggtgctgaacaagaagtacggcagctacctgggcgtgaacctggggtttggcttcggggttactatgggagtgcacgtcgcaggacgaataagtggcgcccacatgaacgctgcagtgacctttgccaattgtgctctaggtcgggtgccttggcggaagttcccggtctacgtcctgggacaatttcttggcagtttcctcgcagcagccactatttattcactgttttatactgctattcttcatttctctggcggccagttgatggttacaggccccgtggctacggctggcattttcgcaacctatttgcccgatcacatgacgctgtggcgcgggttcctgaacgaagcttggctgacaggcatgcttcagctgtgtctctttgcgattaccgaccaggaaaataatccagccctaccaggaactgaggctctcgtcatcgggatcctggtggttatcattggtgtgagtctggggatgaatacaggctatgcaattaatccgtcccgtgatcttcctccacgtatctttaccttcatcgctgggtggggcaaacaggtgttccgatggcatcatctgcctggtctgcattggctgcaccaccccacaggagcacccgaaattggtggcttctgtggcgtttag

SEQ ID NO: 179355 - DNA, 582 bp, Artificial Sequence
  Description of Artificial Sequence: Synthetic coding sequence
atgggctgggccaccttcaccgaccagggcgaggagggcctggagccaagtgggccttggaagacctcacacacccgcgcacatatgaatgccgcagttacctttgcgaattgtgccctgggcagggtgccctggcgcaaattcccagtgtacgtccttggacagttcctgggtagttttctggccgctgccactatctattccctcttttatacagccattttacatttttccggtggccaactcatggttactggtccagtagcaactgcggggatttttgctacctatctgccagatcatatgactctgtggcgtggtttcctgaacgaggcgtggctcacaggcatgttgcagctgtgtttgttcgccataacagatcaggaaaacaacccggccctcccaggaacagaggctctggtgattggtattcttgtagtaataatcggggtctcgttggggatgaataccggatatgctattaatcctagcagagatctacctccacgtatctttacgtttatcgccgggtgggggaagcaggtatttcgctactgcccatgtccagggccattcttgtag

SEQ ID NO: 179356 - DNA, 771 bp, Artificial Sequence
  Description of Artificial Sequence: Synthetic coding sequence
atgggcagcggccactgcctgcggagcacccggggcagcaagatggtgtcatggagcgtgatcgccaagattcaagaaatactgcagaggaagatggtgagggagtttctcgctgaattcatgagcacctatgtgatgatggtgtttggattagggtcagtcgctcatatggttctgaataaaaagtacggctcgtatcttggggtgaacctggggttcggctttggagtgacaatgggcgttcatgtcgcgggaagaattagcggcgctcacatgaatgccgctgtgacgttcgccaactgcgccctcggacgggtcccatggaggaagttcccagtgtatgttctaggtcagttcctcggctcttttcttgcggctgccaccatctatagtctattttacaccgcgatcctgcatttctccggcggtcagctgatggtgactggccccgtcgccacagctggcattttcgctacctatcttcctgaccatatgactctctggcgtggattccttaacgaggcctggctgaccggaatgctccagctgtgcctttttgccattacagaccaggagaataatccagcgctgccgggaacagaagccttggtgatcgggattttggtggttattattggagtctctttgggcatgaataccggatatgcaattaatcctagccgcgatttgccacctcgcatattcacatttattgcaggctggggcaaacaggtgttcaggtactgcccttgcccaggtccattcctctag

SEQ ID NO: 179357 - DNA, 1026 bp, Artificial Sequence
  Description of Artificial Sequence: Synthetic coding sequence
atgggcagcggccactgcctgcggagcacccggggcagcaagatggtgtcttggagcgtaatcgccaaaattcaggaaattctgcagcggaagatggtgagggaattcttagctgaattcatgagtacttacgtgatgatggtatttggccttggatcagtggcacacatggtactgaataagaagtatggaagctacctcggagttaacctaggttttgggttcggggtgacaatgggcgtgcacgtcgccggacgaatttctggagcccatatgaatgctgccgttacttttgctaactgtgcgttaggaagggtgccatggcgaaaattcccagtctatgtactgggacagtttctgggctctttcttggctgccgctacgatatacagcctgttctacactgcaatccttcattttagtggaggacagctgatggttactgggcccgtggccaccgcggggatattcgctacgtatctacctgaccacatgactctgtggaggggcttcctcaatgaagcctggctgacaggcatgttacagctgtgtcttttcgccatcaccgatcaggagaataatccggctttaccaggaaccgaggccctcgttatcgggattctggtagtcatcattggggtgagcctgggtatgaataccggttacgctataaatcccagccgggatctaccgccgcgaattttcacatttatcgccggttggggcaaacaagtcttctctaacggggagaactggtggtgggtccccgttgttgccccactgctgggcgcctacttaggcggtattatatacctggtcttcatcggatccaccatacctagagaacctttgaagctcgaggattcagtggcctacgaagaccatggcatcaccgtcctcccgaaaatgggatctcatgaaccaacgatcagtccactaactcccgtcagtgtttcaccagctaacaggagctccgtccatcccgcaccccccctgcacgaaagcatggccctggagcacttctag

SEQ ID NO: 179358 - DNA, 513 bp, Artificial Sequence
  Description of Artificial Sequence: Synthetic coding sequence
atgaacgccgccgtgaccttcgccaactgcgccctgggccgggtgccatggaggaagttccccgtgtacgtgttggggcaatttcttggatctttcctggccgcagccaccatctactccctgttttatacagctatactccatttttctggcggccagctcatggttactggacccgtggctaccgccggcatcttcgcaacttatctccctgatcacatgactctctggcggggctttctcaatgaggcgtggttgactggtatgctgcagctatgtctttttgccataactgaccaggagaataatccagctctgccaggaaccgaagctctggtgattggcattctggtggtcataatcggagtatcgctcggcatgaatactggctacgccattaacccaagccgcgatctgcccccgcggattttcacatttattgctggttggggcaaacaggtttttagtaacggggagaactggtggtgggttcccgtggtagcaccactttag

SEQ ID NO: 179359 - DNA, 426 bp, Artificial Sequence
  Description of Artificial Sequence: Synthetic coding sequence
ctgttctacaccgccatcctgcacttcagcggcggccagctgatggtaacaggaccagtcgcgacagcagggattttcgccacatacctgcctgaccacatgacactctggagagggtttcttaacgaagcctggctgaccggaatgctgcagctgtgtctctttgcaattacagaccaagaaaacaacccagcattgcctgggacagaggccttagtgattggtatactggtggtaatcataggtgtgtccctgggcatgaacaccgggtacgccatcaacccttccagggacctgccccccagaatcttcaccttcatcgccggctggggtaagcaggtttttcggtggcatcacctgcccggtctgcattggctgcatcatcctaccggagccccagaaatcggggggttctgcggagtatag

SEQ ID NO: 179360 - DNA, 498 bp, Artificial Sequence
  Description of Artificial Sequence: Synthetic coding sequence
atgaacgccgccgtgaccttcgccaactgcgccctgggccgggtgccttggagaaaattcccagtctacgtattaggccagttcctggggtctttcctggctgcggcgactatttacagtctgttctatacagctatcctacattttagtggcggccagctgatggtgaccgggcccgttgccacagccggcatattcgcaacataccttcccgaccatatgactctttggagggggttcctgaacgaggcctggttaaccggcatgctccagctgtgtctgtttgccattactgatcaggagaacaaccccgctctcccgggcacagaggcgcttgttataggcattctggtagtgatcataggagtgtcattaggcatgaacacgggctacgcaattaacccgtccagagacctgcccccccgcatcttcacgtttattgcaggttggggaaaacaggtgttccgatattgtccctgtcctgggccttttctatag

SEQ ID NO: 179361 - DNA, 774 bp, Artificial Sequence
  Description of Artificial Sequence: Synthetic coding sequence
atggtgcaggccagcggccaccggcggagcacccggggcagcaagatggtgtcctggagtgtgatcgctaagatccaggaaatactgcagcgtaagatggtgcgcgaattccttgctgaattcatgtccacatatgtgatgatggtgttcggtcttgggagcgttgcccatatggtgctcaataagaagtacgggtcatatctcggggtgaacctgggttttggatttggcgtgacgatgggtgtccacgtcgcaggccggatctctggcgcgcacatgaacgccgcagtgactttcgctaattgcgccctcgggcgagtgccctggcgcaaatttccagtttacgttttaggacaattcctgggttcctttttggctgccgcaacgatctactcacttttctacactgccatactccatttctcaggaggacagctaatggtgaccggtccggtggctacggccggaattttcgccacttacctgcctgatcatatgacactgtggagaggttttctcaatgaggcatggctaaccggaatgttgcagctttgcttgtttgcaattacagatcaagagaacaatcccgctctacctggcaccgaggcgctggtgataggtattttggttgtcatcattggagtgagcttaggaatgaacaccggctacgccataaaccctagccgggacctgccacctcggatctttacttttatcgccgggtgggggaagcaggtattccgctactgcccatgtcctgggccatttctttag

SEQ ID NO: 179362 - DNA, 426 bp, Artificial Sequence
  Description of Artificial Sequence: Synthetic coding sequence
atgaacgccgccgtgaccttcgccaactgcgccctgggccgggtgccctggagaaagttccccgtctacgttctggggcagtttttgggtagtttcctggctgcggccacaatttattccctgttttacagcgtggctgaccgtgacgcccctgcagtctcattgcgtcaccatggtccaggcgagcagccgagcactgcaaggaatagaggcgccggggaccgacacccgcgcgggcatcaccgtggggtcccgtggcacgagcacagaatatgccaccagcccgtgccaggtcccgcccctcctcacctgcatctccattgctggctgggccagacaggcctccaggtgcttccactgccacggcctattcctctttccttcagtgttggcccactctgtgtagagggctggggagttatgtag

SEQ ID NO: 179363 - DNA, 1602 bp, Artificial Sequence
  Description of Artificial Sequence: Synthetic coding sequence
atgggcagccggtgcctgaacccccccccccccgcccacagcgacactactgggaaggacagttttggtaacatacgaggagcggagactggccagggagcctctgcatgctcagtcacatcagcccgtgtcacctgcggcgccggatccgaaccgcattcacatcggaaccctggaatatctgcccaggtgggactggctccttcatatggcgcggcccgagggcgtcggaggcctttggccctccagcaaagcccacaggagcggcggcatgttggctggaactccacccggggcttgttgcccgcatctctgccagggaccgcctcctcacagagcgctagtgcaaccgcttccgcggctctgcctctaaaggttacgggccctctagcccgaaacccgacaccaccctggacagcagccgccgcattagcaacacgcggtcaaagacccgagaaaggtctcttccctggcccggcgccattctcccttggcaaacgtaaaagagggagggggcggacatgggagcgaagacgccgagtcagcattgagaccagtacgtgcttcagacccggttgcgagaggcttggagccgctgccggggcaaatttgtcccaactggcaagttcacagagacctttgagggaaagatgggtgttatacacaatcatcatggccgcagcaggagcccctgatgggatggaagagccgggcatggataccgaagcggaaaccgttgctaccgaggccccagcgaggcctgttaattgcctagaggctgaggctgccgcgggggccgcagccgaggattcgggagctgccagggggtccttgcaaccggcaccagcccagcccccaggggaccccgccgctcaggctagtgtgagtaacggagaagatgctggcggcggcgctggaagggaactggttgatctgaagatcatctggaacaagaccaagcacgatgtcaagtttcccttagattccactggctccgaactgaagcagaagatccactcgataaccggcctgccaccagcaatgcaaaaagttatgtacaaaggattggttccggaggacaagacgctccgggagattaaggtgaccagcggtgctaaaattatggtcgtgggcagcaccatcaatgatgtgcttgccgtgaataccccaaaggatgctgcccaacaagacgcgaaagccgaggagaacaagaaggagccgctctgtagacagaaacagcaccgcaaggtactggataaaggcaagcctgaggatgtgatgccctcagttaagggcgcacaagagagattgcccactgtcccattgtctggaatgtataataagtccggggggaaggttaggctgacctttaagctcgaacaggaccaactgtggattggaacaaaagagcggacagagaagttacctatgggctcgatcaagaacgttgtgagcgagccaatagaaggccacgaggattatcatatgatggcatttcagctggggccaaccgaagcgagttattactgggtgtactgggtgccaacccagtatgtggatgcaatcaaagacaccgtgctgggcaaatggcagtatttctag

SEQ ID NO: 179364 - DNA, 9198 bp, Artificial Sequence
  Description of Artificial Sequence: Synthetic coding sequence
atggaggagaagcagcagatcatcctggccaaccaggacggcggcaccgtcgctggagcagctccaacattttttgtcatcctgaagcaacccggaaatggcaagactgatcaagggatcttagtcaccaatcaggatgcctgcgctctggcctcctccgtaagtagtcctgtgaagtccaagggcaagatctgtctgccagctgattgtacagtgggaggaattaccgtaactttagacaacaactcaatgtggaacgagttttaccaccggtcaactgagatgatcctcacaaagcagggccgtaggatgtttccatactgcaggtactggatcactgggctcgacagcaatctgaagtatatccttgtgatggatatctctcctgtcgataaccatagatataaatggaacgggcggtggtgggagccgagcggaaaagccgagccacacgtgctgggaagagtgtttattcacccggagtcgccgagcactggccattattggatgcaccagccagtcagcttctacaagcttaagctcacaaataatactctggatcaagaagggcatattattctgcactctatgcacagatacctgcccagattgcatttggttcctgccgagaaagccgtggaagtaatccaacttaatgggcccggcgtgcatacttttacattcccacaaaccgagttctttgcggtcacagcatatcagaacatacaaatcactcaactgaagattgattataaccccttcgctaaaggatttagagatgatggtctaaataataagccccaacgggatggcaagcaaaagaatagctctgatcaggagggtaacaacatatcatcctcctcaggccatcgagtaagactcaccgaggggcaggggagtgagattcagcccggagatctcgatcccctgtcacgagggcatgagacttctggtaagggtctcgaaaagacctcactgaatatcaagagagacttcttgggatttatggataccgacagcgccctgtcagaggttccacagctgaagcaggagatttcagagtgtctgatcgcttcgagcttcgaagacgactcccgggtggcttcccccttggatcagaatggctcctttaatgtggtgattaaagaagagccactggacgattatgactacgagttgggcgaatgcccagaaggcgtgacagtgaaacaggaggagactgacgaagagactgacgtctactctaacagcgacgacgacccaatcctagagaagcagctgaagcgccacaataaagtcgacaacccagaagccgatcatctgtcaagtaaatggctgccctcttcccctagcggagtcgccaaagcgaaaatgttcaagttagatacagggaaaatgcccgtggtgtatctcgagccctgtgccgtgacgaggagcaccgtgaaaatttctgaactccccgacaacatgctgtcaacgtcacgaaaagataaatctagcatgttagctgagctcgagtatctgcccacatacatcgaaaactcaaacgagaccgcattctgcctgggcaaagaaagcgagaatggccttcggaagcacagtcccgatctccgcgttgtgcaaaagtatcctctgctgaaggagccccagtggaagtatccagacatttcggacagcatctcaaccgagagaatactcgatgactctaaagattctgtcggggacagcctgagcgggaaggaggacttgggacgtaagaggactaccatgctcaaaatagccacagctgccaaagtggtcaacgccaaccagaatgcctctcccaatgtgccaggcaagagggggaggcctcggaaactgaagctatgtaaggcaggccgtcctcccaagaatactggaaaaagcctaatcagtacaaaaaatacccctgtatcgccaggaagcaccttccctgacgtgaaaccagaccttgaggacgtagacggcgtgctgtttgtctcattcgaaagtaaagaggctctggacattcatgcagtggatggcacaaccgaagaatcaagttccctccaggccagtactactaacgactctggatatcgcgcacggatcagccagttagagaaagagcttatcgaagacttgaaaaccttacggcacaaacaggtcattcatcctggcctgcaagaggttggcctgaagttgaattcggttgatcccactatgagtatagacctaaaatatctgggcgtgcagttgcccctggctccagcgacgtcattccccttctggaacctgacaggtaccaacccagctagccccgatgctggttttccttttgtttcccgtaccggcaaaactaacgattttactaagattaaaggttggcgtggcaaattccatagtgccagtgcctcccggaacgagggtggaaactccgagagcagtctcaagaaccggtctgcattctgctccgataaacttgatgagtacttggaaaatgagggaaaactaatggagacatccatgggcttttctagcaatgcccccacttcacccgtggtgtaccagctgcctacgaagtccacgtcgtatgtcaggaccctggacagtgtattaaagaagcagagtaccatatccccctcaacatcctactctctaaaaccacacagtgtccctccagtctcacggaaggccaaatctcaaaatcgccaggccacgttctctggtaggaccaaatcctcttacaagagcatacttccctatcctgtgtcacctaaacagaagtattctcacgttatcctcggggacaaagttactaaaaatagcagcggaatcattagcgagaaccaggccaacaacttcgtggtgccaaccctagatgagaacatctttcccaaacagatcagtctccggcaggcccagcagcagcagcagcagcagcaggggagtagaccacccggcctttccaagtcccaggtcaaactcatggacctcgaagattgtgccttatgggaaggtaagccgcggacgtatatcacagaggagcgggcagatgtttcattgaccacgttgttgactgcccaggccagtctcaagaccaagccaatccatacaatcatcagaaaaagggcccccccttgcaataatgacttctgccgtctgggttgcgtttgcagctcactagccttagagaagagacagcctgcgcactgcaggcgaccagactgcatgttcggttgcacatgtctcaaacgcaaagtggtcttggtgaaaggtggatcaaagaccaaacattttcagcggaaagccgcgcaccgagatccagtcttttacgacaccctcggcgaggaagctagggaggaagaggagggaataagggaagaagaagagcagttgaaggagaagaagaaacgcaagaagctggagtacactatctgtgagaccgagcctgaacagccagtgaggcactacccactatgggttaaggtggaaggtgaggtggatcctgagcccgtctatataccaaccccctctgtcatcgagccaatgaaacctctgctgttacctcagcccgaggtattgtcgccgactgtgaaagggaaactgctgacaggtataaagtctccacggtcctacacccccaagcccaaccccgtcattcgggaggaggataaggatcctgtgtatctctattttgaatcaatgatgacatgtgcacgcgtgcgggtgtacgaacgcaaaaaggaagaccagcggcagccctcttcatccagttccccatctccgagttttcagcagcagacttcttgccactctagccctgaaaaccataataacgcaaaggagccagactcggagcaacagcccctgaagcaactcacttgcgacctggaagatgactccgacaagctgcaggagaagtcatggaaatctagttgtaacgagggagaatcctcctccacgtcttacatgcaccaacggtcccccggcggccccaccaagctgatcgaaattatttcagactgcaactgggaggaggatagaaacaagatcctgagcattctctcgcagcacattaattctaatatgccgcagagtctgaaggtcggaagttttatcattgaactggcatcccaacggaaaagtcgcggggagaaaaatccacccgtgtactccagccgggtgaaaattagcatgcccagctgccaggatcaggacgacatggctgaaaaaagtgggtcagagaccccagacgggccattgtcaccgggtaaaatggaggacatcagcccagtgcaaacagatgctttagatagcgtccgtgagcgcctgcacggtggaaaaggtttgcccttctatgccggtctatctcccgcagggaaactggtggcgtataagcggaaaccatcctcctccaccagcggtttaatacaagtggcctctaacgccaaggtggccgcatctaggaaaccgcggacgttacttcccagcacatctaatagcaaaatggcctcttcgagcgggaccgcgaccaaccgccctggcaagaatctgaaggcatttgtgccggccaagagacctatagctgcccggccttccccgggaggggtgtttacgcaattcgttatgtctaaagtgggggcccttcagcagaaaatacccggcgtctcaacaccacaaacgctagccggcacacagaagtttagtatccggccctcccccgttatggttgtaactcccgtggtgtcctccgaaccagttcaggtctgttctcccgtgacagcggccgtaactaccaccaccccacaggttttcctggaaaacacgaccgccgtcacccctatgactgccatcagcgacgtggagacaaaggaaacaacctactcctccggcgccaccacaacaggcgtggtagaagtgagcgagactaatacatcaaccagtgtcacatccacgcagagcaccgcaactgtgaacctgaccaaaacaaccggtatcaccactcccgtggcctctgttgcattcccgaagagccttgtcgcaagccctagcacaataactttacccgtggcgtcaacagcctctacaagtctggtggttgtgactgccgcagcctctagttcaatggtcacgacccccaccagttctctggggagcgtccctataattcttagcgggatcaacggatccccgcctgtgtcacaaagaccggagaatgcagcgcaaataccagtagcaaccccacaggtgtctcctaacacagtgaagagagccggccctcgcctcctacttatccctgtgcaacaaggatcaccgacactgcgcccagtgagcaacacccagttacagggtcaccggatggtgctgcaacccgtaagatccccctcggggatgaatttgttccgccaccccaacggacaaattgttcagctgctgcctctgcaccagttaaggggctcaaacacccagcccaatctgcagcccgtgatgttccgaaatcctggaagtgttatgggaataagattacccgctccgagtaaaccatcggagacacctccatctagtacctcttcctctgcttttagcgtgatgaatcccgttattcaggctgttggctcgtcttctgctgtcaatgtgatcacccaggcgccaagccttcttagtagtggagcatcttttgtttcccaggccgggaccctaaccctaagaatctccccgccggagcctcaaagttttgcgagcaaaacagggagcgagaccaaaattacatatagcagcgggggtcagcctgtggggacagcttccctgatccccctgcagagcggctcttttgctttgctccagctccctgggcagaagccagttccctccagtatccttcaacacgtggcatctctgcagatgaagagggaatcacagaaccccgaccagaaggatgaaaccaacagtattaagcgggaacaggaaaccaaaaaagtcctgcagagtgagggggaggccgttgaccctgaggcaaatgtgatcaagcaaaatagtggggccgcgacaagcgaagagactctgaacgactcactggaagataggggggaccacctggacgaggaatgccttcccgaagagggctgcgcaaccgtaaagccgagcgagcacagctgcatcaccgggtcacacaccgaccaagattacaaggacgtgaacgaagaatatggggccaggaatagaaagtcaagtaaggagaaggtggccgtgctggaggtccgaacaatctccgaaaaggccagcaacaagaccgtgcagaacctcagcaaagtgcaacaccagaaacttggtgatgtgaaagttgagcagcagaaaggcttcgataatccagaggaaaactctagcgagttccccgtgaccttcaaagaggagagtaaattcgagctttctggatccaaagtaatggaacagcaatccaatctccagcctgaagccaaggaaaaagaatgcggggacagtttggagaaagatcgcgaacggtggaggaagcatcttaaaggaccgctgacccggaaatgcgtgggagcctctcaagagtgcaagaaggaggcagatgagcagctgattaaagaaacaaagacctgccaggagaactcggacgtctttcagcaggagcaaggcatctccgacctactcggcaagagcggaatcacagaagatgctcgagtcttaaaaacagagtgtgactcatggagtaggatctcaaatccatcggctttttctattgttcctcgcagggcagccaagagcagcagaggaaacggccatttccaggggcacttactcttaccaggagaacagatccagcctaagcaggagaaaaaaggaggtaggagctcagccgactttacggtgctggacctagaggaagacgacgaggatgataatgaaaagactgacgatagtatagatgaaatagtcgacgtcgtgtccgactaccagtccgaagaggtggacgacgttgagaagaataactgcgtggaatacatcgaagacgacgaagagcacgtggatattgaaaccgtggaagaactgtcagaagagatcaacgtggcacacctgaaaacgactgctgcccatactcaatcattcaaacaaccgagctgcacgcacatttctgctgacgagaaagctgcggaaagatccaggaaagcccccccaatccctttgaaactgaagcctgattactggagtgataaactgcagaaagaggctgaagccttcgcctactaccgtagaactcacactgcgaatgagcgcagacgtcggggggaaatgagagacctgtttgagaaactgaaaataacacttggtctgctccactccagcaaggtctccaaatcactcatactgactcgggcattctctgaaatacaagggctgactgatcaggcggataagctcatcggccagaaaaacctgttgacccggaaacggaatatcttgattcgaaaggtgtcgagcctgagcggcaagacagaggaagtggtgctcaagaagttagaatacatctacgctaagcagcaagccctggaggcgcagaagaggaaaaagaaaatggggagtgatgaatttgatattagcccacggatctcaaagcagcaagaaggatctagcgcgtcttctgtggatctgggccaaatgttcattaacaaccggagaggaaaacccctgatcctgagtcggaaaaaagatcaggcaacagaaaacacttcccctctgaatactccgcatacatctgctaacctggttatgacacctcaggggcagctgcttaccctcaagggccccctctttagcgggccggtggtcgctgtgtcacccgatctcttagagtccgacttaaagccccaggtcgccggctcagctgtggcactcccagaaaacgatgatctattcatgatgccccgtatcgtcaatgtcacctcgctggcgaccgagggcggcctcgttgatatggggggttctaagtatccccatgaagtgcccgacagcaagccatccgatcacctcaaggacacagtgcgtaacgaagacaattcactggaagataaaggccgaatttccagccgcggcaatagggacggacgagtaaccctcggtcccacgcaggtgtttctcgctaataaagattcaggatatcctcagattgttgacgtgtcaaacatgcaaaaagctcaagagtttctgcccaagaaaatttctggggacatgaggggcatccagtataagtggaaggagtcggaaagcagaggcgaacgggtaaaaagtaaggacagctctttccataagctgaaaatgaaggatctgaaggacagctctatcgagatggaactccgcaaagttactagcgccatagaagaggcagctctggactcctccgaactgctgaccaacatggaagatgaagatgataccgacgaaaccctcacctcgcttctgaacgagatagcattcttgaatcaacaactgaatgatgacagtgtgggtcttgcggaacttccatcatctatggacactgagtttccaggagacgccagacgcgcgtttatctccaaagtaccgcctggaagcagggctacattccaggtagagcatcttgggaccgggttgaaggagttgccagacgttcagggcgagtccgattcaatctcccccctgctactgcatcttgaggacgacgatttttctgaaaatgaaaaacagctggcggagccggcttctgagccagatgttcttaagattgtcatagactccgaaattaaggactccctgttgagtaataagaaggcaatcgatggcggaaagaacacctcagggcttcccgcggaaccagaatcagtgtctagcccacccaccctgcatatgaaaactgggctcgaaaattccaactcaaccgatacgctttggaggcccatgccgaaactggcacctctgggactaaaagttgctaatcctagttcagacgcagacgggcaatcactgaaggtgatgccatgtctggctccaatcgccgccaaagtgggcagcgtgggtcataaaatgaacttaacagggaatgaccaagaaggaagggagagcaaagtcatgccaactcttgcaccagttgttgcaaagttagggaactcaggcgcttcccctagttcggccggtaaatag

SEQ ID NO: 179365 - DNA, 888 bp, Artificial Sequence
  Description of Artificial Sequence: Synthetic coding sequence
atgcagcccgagggcgccgagaagggcaagagcttcaagcagcggttggtgttgaagagctccttggccaaagagactctgtccgagttcctcgggacatttatccttatcgtgcttgggtgcggatgcgtggcacaggcaatccttagccggggtcgcttcggcggtgttatcaccatcaacgtgggcttttctatggctgtagcaatggccatctatgtcgctggaggcgtgtctggaggccacattaaccctgccgtgtcactcgctatgtgtctgtttgggaggatgaagtggtttaaattgcctttctacgtgggcgcccagttcctcggcgcattcgtgggcgcagcaacagtttttggtatatactatgatggcttaatgagctttgcagggggtaaattgctaattgtgggagagaacgcaaccgctcacatcttcgctacctacccggctccatatctcagtttggcaaacgcattcgcggatcaggtggtcgcaacaatgatcctccttattatcgtgtttgccatttttgatagcagaaatctcggggcacctcgagggctggagccgatagcaattgggctgctcattatagtaatcgcctctagtctgggcctaaactcaggatgtgcaatgaatccagcgcgtgatcttagccctcggctcttcactgccctggcaggctggggatttgaagtgttccgggccggtaacaatttctggtggatcccagtcgtggggccactggtgggtgccgtcattggcggactgatctacgtgctggtcattgagatccaccaccccgagccggattctgtttttaagacagaacaaagtgaagataagcctgaaaagtatgagctctccgtcattatgtag

SEQ ID NO: 179366 - DNA, 1992 bp, Artificial Sequence
  Description of Artificial Sequence: Synthetic coding sequence
atgggccggtaccggatccgggtggccaccggcgcctggctgttctccggaagctataaccgagtgcagctatggcttgtcggaacaaggggagaggccgagctcgagctccagttgaggcctgcccgcggcgaagaggaagagttcgatcatgacgttgccgaggacctgggtttacttcagttcgttcgcttgcggaaacaccactggctcgtggatgatgcttggttctgcgataggattaccgtccagggccccggagcctgtgcggaggtcgcctttccatgctatagatgggtccagggggaggacatattgtctctgccggagggaactgcccggctgcccggggataacgcactagatatgttccagaagcatagagaaaaggagttgaaagatcgccagcagatctattgttgggctacctggaaggaggggcttcccctcaccattgccgctgaccgcaaagatgatctgcctcctaacatgcgattccatgaagaaaaacggcttgacttcgagtggactcttaaagccggtgcattggaaatggcactgaagagggtgtacacactgctctccagttggaactgtctggaggacttcgatcaaatcttttggggtcagaaatccgcgctggcagaaaaggtgagacagtgctggcaagacgatgaactgttcagttatcagttcttaaacggcgctaacccgatgttgctgaggagatccactagcctgccatcacgcctggttctgccctccggaatggaagaactccaggcccaactcgaaaaggagctacagaacgggtcccttttcgaagccgacttcattcttttggacgggattcccgccaacgtcattaggggagagaaacaatacttggccgcccctctggtgatgttaaagatggagccgaatggcaagcttcagcccatggtgatccagatccagcccccaaacccgtcttctcccactccaactttgtttctcccctctgacccccccctggcttggctcctcgccaagtcatgggtgcggaatagcgattttcagttacatgaaattcagtatcacctcctgaacacccacttagtggcagaagtgattgccgtggctaccatgcggtgtttacctggcctgcaccctatctttaaattcttaatccctcatatccgatacaccatggagattaatactcgtgccaggacccagctgatttccgacggaggaatctttgacaaggcagttagcaccggtggtggaggccatgtgcaactcctgcgccgagctgctgcccaattaacctattgttccttgtgccccccggacgacctggccgacaggggactcctcggtttgccaggtgccctgtatgcccatgatgccttgcgactgtgggagatcattgcacgatatgtggaaggaatcgtgcatttgttctaccagagagacgatatagtgaaaggggatcccgaactccaggcttggtgcagagagattactgaagtgggcctgtgccaggcacaagataggggctttcccgtaagcttccagagtcagagccagttgtgtcatttcctcaccatgtgcgtgtttacttgtacggcacagcatgctgctattaatcaggggcaactagattggtacgcatgggtacccaacgcgccatgtacaatgcgaatgccgcctcccaccactaaggaggatgtcaccatggcgactgtgatgggctcattgccagacgtgcgccaggcttgtttacaaatggcgatttcctggcacctgtcccgtaggcagccagacatggtccctctggggcatcataaggaaaaatatttcagcggaccgaaacccaaggccgttctaaaccagttccgcactgaccttgaaaagctcgagaaggagatcaccgcccgcaatgagcagcttgattggccatatgaatacttaaaaccgagttgcatcgaaaatagtgtgactatctag

SEQ ID NO: 179367 - DNA, 2106 bp, Artificial Sequence
  Description of Artificial Sequence: Synthetic coding sequence
atggccacctacaaggtgcgggtggccaccggcaccgacctgctgtccggcacaagggatagcattagcctgacaatcgtcggcacacagggtgaaagccacaaacagctcttgaaccactttgggagagattttgccactggcgctgtgggccagtacaccgttcagtgccctcaggacctcggggagctcataattattaggctgcacaaagaacggtatgccttcttcccaaaggacccttggtattgcaactacgtgcagatctgcgcgcccaacggtcgcatctatcactttccagcctaccagtggatggatgggtatgagaccctcgcccttagggaggctacaggcaagacaacagccgatgattccttgcccgtgcttctcgagcatcgtaaggaagaaattcgcgctaaacaagatttctaccattggagggtcttcctgcctgggctgccctcgtacgttcatattcccagttaccggccgcccgtgcgtaggcatcgcaaccccaaccgtccagagtggaatggctacatcccgggttttccaattcttattaacttcaaggcaaccaagttcctcaacctgaatttgcggtactctttcctcaagacagcatcctttttcgtgcgactgggccctatggctctagcatttaaagtaaggggtcttcttgattgtaagcatagctggaagcgtctaaaagacatcagaaaaatctttcctggcaagaaatctgtggtctcggagtacgtggcagagcattgggcagaagacaccttcttcgggtaccagtacttgaatggggtcaatcctggtctgatacgccgatgtacacggattcctgataaattcccggtgacagatgacatggtggccccattcctgggcgagggcacttgtctgcaagcagaacttgagaaaggaaacatttatctagccgactaccgcataatggaggggattccaaccgtcgaactttccggacgcaaacagcaccattgcgctcccctgtgcctgctccacttcggtccagaagggaagatgatgcctatcgccattcaactgagccaaactcctggaccggactgtcccatcttcttacctagtgatagtgagtgggactggttgctcgcaaagacgtgggtaaggtatgccgaattttatagtcatgaagcaatcgcgcacctgcttgaaacacatctgattgctgaagccttttgtctcgcgctcctccgaaacctacctatgtgccaccctctgtataagctgttgatccctcatactcgctacacagtccaaatcaatagcatcggacgcgccgtcttactgaatgaggggggtctgagcgccaagggcatgtctctgggggtagagggatttgcaggggtgatggtgcgggccttgagcgaattaacctacgattccctgtacttacccaacgactttgtggagcggggtgtgcaggatctgccaggctactactacagagacgatagtctggcggtctggaacgccctggaaaaatatgtgactgagattattacctactactatccctctgatgcagccgtggagggtgatcctgagctccagagctgggtgcaagaaattttcaaggaatgtctcctcgggagggagagcagcggattccccagatgcttgagaactgtcccagaacttattcgctacgtaactatcgttatatatacctgctctgccaaacacgccgctgtgaacactgggcagatggaattcactgcctggatgcccaactttccagcttcaatgcggaatcccccgattcaaacgaaagggctaacaactctggagacctttatggacacacttccggacgttaagaccacctgtatcactcttcttgttctatggacgttgtcaagggaaccagacgacagaaggcccctggggcacttccccgacatacatttcgtggaggaggcaccacgacgttccatcgaagccttccgacagcgtctaaaccagattagccacgacattaggcagcggaataagtgcttgcctatcccttattattacttggaccctgtgctgattgagaacagcatctccatttag

SEQ ID NO: 179368 - DNA, 1989 bp, Artificial Sequence
  Description of Artificial Sequence: Synthetic coding sequence
atgggcctgtaccggatccgggtgagcaccggcgccagcctgtacgcaggcagcaataaccaggtgcagctgtggcttgtgggacagcacggggaggctgcactcggtaaacggttgtggcctgctagaggaaaggaaacagagctgaaggtcgaggttcctgaatatctagggcccctcctgttcgtcaagttgcgcaaaaggcatctgttgaaggatgatgcatggttttgcaattggatctcagtgcagggacctggggctggagacgaagtacgcttcccatgctataggtgggtggagggcaacggggttctctccctcccagagggcacaggtcggaccgttggggaagaccctcagggcctgtttcaaaagcatcgagaagaagagctggaggagaggcgcaagctttaccggtggggcaactggaaagacggcctgatcttgaacatggctggagctaaactgtatgatctacctgtagacgaacggttcctggaagacaaaagggtggacttcgaagtctccctggccaagggtctggctgatctcgcaattaaggattccctgaacgtactgacctgctggaaagacctggatgatttcaacagaatcttttggtgcgggcagtcaaaactcgccgaaagagtgagagattcctggaaggaggacgcactttttgggtaccaatttcttaacggtgctaaccccgtggtcttacggaggtctgcccacctcccagcacgtctggtatttcctcccggcatggaagaattacaagcccagctggagaaagagctcgagggtgggacactttttgaggccgatttttctctgctggatggtataaaggcgaacgtcattctttgcagccagcaacacctggctgcacctctcgtcatgctgaagcttcagccagatggtaagttgctcccaatggtgatccaacttcagctgcccagaaccggttcacctcccccccctctgtttctgcccactgatcctcccatggcatggcttctcgcgaagtgttgggtccgcagctctgatttccagctgcatgagcttcagtcacatctcctgcgtggccatctgatggccgaggtaattgtggtcgctacaatgagatgtcttcccagcatacatcctatctttaaattgatcatcccacacctccgctataccttggaaataaacgtgcgggcgaggacaggcctggtatccgacatgggaatattcgaccagatcatgtccaccggtggcggcgggcacgtccagctgcttaaacaagccggggcctttctcacatactcaagcttctgccctccagatgatctggctgacagagggcttctcggcgtgaaatcatctttctacgctcaggacgccctgagactgtgggagattatataccgttacgtggaagggatcgtctcgctgcactacaagaccgatgttgcagtgaaggatgacccagagcttcaaacctggtgtagagagattactgagatcggacttcagggagctcaggatagaggctttccagtgtctctgcaagcacgagaccaggtgtgtcacttcgtcaccatgtgcatctttacatgcaccggtcaacacgcgtctgtccatttggggcaactggattggtattcatgggtaccaaatgccccatgtacaatgcggctaccacctcccaccacgaaagatgccaccttggaaactgtgatggctactctcccgaattttcaccaggcttctttgcagatgagtatcacatggcagttaggtaggaggcagcccgttatggtggcagttggccaacacgaagaggagtacttcagtggacctgagcccaaagcggtgcttaaaaaatttagagaggaactcgccgcccttgataaggagattgagattagaaacgcgaagctggatatgccctacgaatatctacgaccaagtgttgtggagaactcagtggcaatctag

SEQ ID NO: 179369 - DNA, 2055 bp, Artificial Sequence
  Description of Artificial Sequence: Synthetic coding sequence
atgctgaagcggaacgagagccagtggctggcccagcggcggcggagtgagacttccctgagcaagatgggactctatcgcataagagtctctactggggcctctctatatgcgggctccaataaccaggtgcagttgtggctggtcggccagcatggagaagcggcactgggtaaaaggctttggccagcccggggaaaggaaacagaactcaaggttgaagtgccagaatacttaggcccattattgtttgtgaagcttcggaaaaggcatctcctcaaagatgacgcatggttttgcaactggatcagtgtgcaaggcccgggtgcgggggacgaggtccgcttcccttgttatcggtgggtggaggggaacggagtcctgtcccttccagagggtactggccgaactgtcggggaagacccacagggcctttttcagaaacatcgggaagaggagctcgaagagcgaaggaaactgtaccgctggggcaattggaaagatggtctcattctaaatatggctggcgccaaactgtacgatctcccagtggacgaacggtttttggaagacaaacgggtagactttgaggtcagtctggcgaaaggattggccgaccttgcgatcaaagactcactcaatgtgctgacatgctggaaggatctggacgacttcaacaggattttctggtgtgggcagtccaagctggcagaaagggtacgtgatagctggaaggaagacgcgctgtttggttaccagtttcttaacggcgctaaccccgttgttctgagacggagcgcacacctcccagctcgtctcgtgttccctccagggatggaggagctgcaagcgcagctagaaaaagagcttgagggcggtacattgtttgaagcagatttcagcttactcgacggcatcaaagccaacgtgatcctgtgtagccagcagcatctcgctgcccctctcgtcatgctgaagcttcagcccgacggcaaactgctcccaatggtaattcagctgcagctcccccgcaccggtagtcccccaccgccgcttttcctgcctacagacccacccatggcgtggctgctggccaaatgctgggtgcgctcttccgattttcagctgcacgagctccagtcacatctgttaaggggccacctgatggccgaggtgattgtagttgccactatgaggtgtcttccatcgatccatcctattttcaaattaattattccccatctccgctatacattggagattaacgttcgagctaggaccggcctggtgtccgacatgggcatttttgatcagatcatgagtacaggtggcggaggacacgtgcagctgctgaagcaagctggggctttcctgacctatagttctttttgcccacccgatgacttggccgaccgcgggttgctgggggtcaaatcttccttttatgcacaggatgcactgagactgtgggagattatttaccgatacgtggaggggatagtgtctctgcactacaaaaccgatgtggccgtcaaagacgaccccgagctccagacttggtgccgagagatcaccgaaatcgggctgcagggcgcacaggatcgtgggttcccagtgtcgctgcaggcccgagatcaagtttgtcactttgttaccatgtgcatttttacctgcaccggacagcatgcttctgtgcatttgggacaattagactggtacagctgggtaccaaatgccccttgcacaatgagactcccaccccctacgacgaaagacgcaaccctggaaactgtgatggccacattacccaatttccaccaggcatctctgcagatgagcatcacatggcagcttgggcggaggcagccggtgatggtcgcggtaggccagcacgaggaggagtacttttctggccccgaacccaaagccgttttaaagaaatttcgagaggagctggcagccttagacaaagaaattgagattagaaacgcaaagctcgacatgccttacgagtaccttagaccttccgtggttgagaactccgtagcaatatag

SEQ ID NO: 179370 - DNA, 1989 bp, Artificial Sequence
  Description of Artificial Sequence: Synthetic coding sequence
atgggcctgtaccggatccgggtgagcaccggcgccagcctgtacgctggttctaacaatcaggtacagctgtggctggtgggacaacacggtgaggctgccctgggaaaaagattatggccagcaaggggaaaggagacggagttgaaggtggaggttccagaataccttgggccactgctgtttgttaagctgagaaaaaggcacttacttaaggacgacgcctggttttgtaactggatcagcgtccaggggccaggcgctggggatgaggttagattcccatgttacaggtgggtagagggcaatggcgttctttccctacccgagggcactgggagaaccgtcggcgaggatccccagggactttttcagaaacatagggaagaagaacttgaagagcggaggaaactctaccggtgggggaactggaaggacggactaattcttaatatggccggggccaaactgtacgatctccccgtcgatgagcgctttctggaggacaaaagggtcgacttcgaagtaagtttagcaaagggactcgcagacctggctatcaaagactcgctaaatgtcctcacctgctggaaggatctcgatgactttaaccggatcttttggtgtggccagtccaaactcgccgaaagagtgcgggatagctggaaggaggacgccctttttggataccagttcctgaatggcgccaaccccgtcgtgctaaggagatccgcacacctccctgcgcgactggtttttccaccgggtatggaggaactgcaagcccaattggagaaggaactcgaaggcggtactctcttcgaggccgattttagcctactagatggcattaaggccaatgtgatattatgctcccaacagcacctggcagccccgctggtgatgttgaaactccagcccgacggaaaactcctcccaatggttatccagctgcagcttccgaggactggttccccgccccctcctctgtttcttcctaccgacccacccatggcttggctgctggctaagtgctgggttcggagctccgactttcaactgcacgaactgcagagtcatcttttgaggggacaccttatggccgaggtgattgtagttgctaccatgcggtgccttccttcaatacatcccattttcaagctgattatacctcacctgcgctatacgcttgaaattaatgtccgtgcaaggacaggcttagtgtccgatatgggaatattcgatcagatcatgagcacaggaggtggtgggcacgttcagttactgaaacaagccggcgccttcctcacatacagcagcttttgccctcctgatgacttggcggacagagggctgctgggagtgaagagttctttctacgctcaagacgccttacgcttgtgggagatcatctacaggtatgtagaaggaatcgtgtcactccactataagacggatgttgcagtaaaggatgacccggaactgcagacatggtgccgcgagattaccgagattggactccagggggctcaggacaggggtttccctgtgagcctgcaggcccgcgatcaggtatgtcactttgtcaccatgtgcatttttacatgcaccggtcaacacgcttccgtgcacctaggtcaactcgattggtattcttgggtccccaacgccccttgtactatgcgccttcccccacctactaccaaagacgctaccttggagacagtcatggccacactgcctaatttccaccaagcgtccctgcagatgtccattacttggcagctcggacggcggcaacccgtgatggtcgccgtcggtcaacacgaggaggagtatttttccggtcctgagccaaaagccgtcctgaagaagttcagagaggaattggcagccttggacaaggaaatcgaaatcagaaatgccaaactcgacatgccctacgagtaccttcggccctctgtcgtggaaaacagcgtggccatttag

SEQ ID NO: 179371 - DNA, 486 bp, Artificial Sequence
  Description of Artificial Sequence: Synthetic coding sequence
atggaccaggagaccgtgggcaacgtggtgctgctggccatcgtgaccttgatctctgtggttcagaatgggttttttgcgcacaaagtagagcacgagtctcggacccagaacggtcgctcattccaacggaccggtactctggcctttgaaagggtttacacagccaatcaaaattgtgtggatgcctaccccaccttccttgccgtgctgtggtcagccggattgttgtgtagccaagtcccagccgcctttgcaggattgatgtaccttttcgtcaggcaaaagtatttcgtcggatacctcggggaacgcacccaaagcacacctggttacattttcggaaagaggatcattctttttctgttcctcatgagtgttgccggcatatttaattattatctgatcttcttctttggttctgactttgagaattacataaaaacgatatcaacgaccatttcaccgttactgctcatcccctag

SEQ ID NO: 179372 - DNA, 2532 bp, Artificial Sequence
  Description of Artificial Sequence: Synthetic coding sequence
atgccccggggcgccttccggccctgcctgcccgccctgtacttcgccttcctcacctgtccaaccccagagcagcggatgtctgggacccaggctccagatatccacctaggggagccagcccggggtactggctgcgttcggggaaagcaaactagtattagggttcaggattgcgggcggagagaagaagctagagcggcttcaagggagcttaggagagagaaagctcaagagcatccaagggagtcttgggctcacccacagccttatccggcccctcagccgctggctctgcggcctgaaacgcagccctgtccggcttgtaggagcagccctccagggcgcctgctactgcggcccgccttgcccggccatccatttctattgcctatcatggccgtgtatcggttgtgtgtaacaaccggcccatatctgagagccggaacactggacaacatctcagttaccctggtcggcacttgtggagagtcaccgaaacagcgtctagatcgtatgggtcgcgatttcgcccctggttctgtccagaaatacaaggtacgatgtaccgcagaactgggggagctactgcttcttcgagtgcataaggaacgctatgccttttttcggaaggattcttggtactgtagccgcatctgcgtgacagagcctgatgggtccgtcagccactttccctgctaccaatggattgagggatactgtacagtcgaactgcgaccaggtaccgcaaggaccatttgtcaggattccctccccctgctgcttgatcatcgcacaagggagctgcgcgcccgtcaggagtgctatcggtggaaaatctacgctccagggtttccctgtatggtagatgtcaacagttttcaggagatggaatcagacaaaaaattcgctctgaccaaaacgaccacctgtgtggaccaaggtgacagctccggtaataggtacctccccgggttccctatgaagattgacattccaagcttgatgtacatggagccaaacgtaaggtactccgccaccaagacaatctcgcttctgtttaacgctattcctgccagtttgggtatgaagcttcgagggctgctggatcgcaagggcagttggaagaagttggacgacatgcaaaatattttttggtgccataagactttcaccacaaaatacgttaccgaacattggtgtgaagatcacttttttggatatcagtacctgaatggagtgaatcctgttatgctgcattgtatctctagcctaccgagtaagctgcccgtcactaacgatatggtggctccactgttaggacaagacacctgcttgcagactgagttggagcggggaaacatttttctggccgactattggattctagccgaagctcccacccactgtttaaatgggcggcagcagtacgtggccgctccgttatgcctcctgtggctgtcccctcaaggtgccctggtgcctctggccattcaattgagtcagacacctggcccggattcccccatattcctgccaaccgactctgagtgggactggctgcttgccaagacctgggtccgcaacagcgagtttctggtgcatgaaaataacacacactttttgtgcacccatctcttgtgtgaggccttcgctatggccaccttaaggcaactcccgctgtgtcatcctatttataagctgcttctcccacataccaggtacacactacaagtgaacactattgcaagagccacccttctgaatcccgaaggtttggtcgaccaggtgacatcgatcgggagacagggtctcatttacctcatgtctactggtctcgctcactttacctacacaaacttttgcctgcccgattccctgagagcccgcggggtgttggcaatacccaattatcattaccgcgatgatggattgaagatctgggccgcaatcgagtcttttgtctcagaaatagtaggatattactatccaagtgatgcttccgtccaacaggactccgagctgcaggcatggaccggagaaatattcgctcaggcattcctgggcagagagtctagcgggtttcctagccggctctgtacgccaggcgaaatggtcaagttcttaaccgccataatttttaattgctccgcccagcacgccgcagtgaactcaggacagcatgattttggggcgtggatgccgaacgcccctagcagcatgcgccaaccacctccccagaccaagggaactaccacactgaagacatatcttgatactctgccagaggtgaatatatcttgcaataacctgttgctgttttggttggtttcgcaggagcccaaggatcaaaggccactcggtacataccccgatgagcactttacggaggaagcccctagacgatcaatagcagcgtttcagtctcgcttggcacagatatcccgagatattcaggaacgtaaccaagggcttgctcttccctacacctaccttgaccctcccttgattgagaactctgtgagcatttag

SEQ ID NO: 179373 - DNA, 2604 bp, Artificial Sequence
  Description of Artificial Sequence: Synthetic coding sequence
atgggccggaaccggagctggggcaccctgggcagcggccggaccagcaccccggggcaccagagtggcccactgactcggagacgtgcagtttcgcaactttaccgacgatacctcctcttcagcatatcagcttccgacccaagtctgcgctccggtacccaggcccctgacatacacttgggggaacccgcccgtggcaccggatgcgtaaggggcaagcagactagcattcgcgtacaggactgcggtaggagggaggaggcacgggccgcctcccgtgagctgcgacgggaaaaagcacaggaacacccacgcgaaagctgggcgcatcctcagccctacccagctccacagccactcgccctgagacccgaaactcagccttgcccagcttgtaggagcagtccccccgggagactcctcttacgaccagccctacccggccaccctttcttgttgcctataatggccgtgtaccggctgtgtgtcaccactgggccatacttgcgagccgggacactggataatatttcagttacactggtcgggacttgcggcgaatcacctaagcaacggctcgatcgcatggggcgggactttgcacccggcagtgtgcagaaatacaaagttaggtgcacagcggagttgggcgagctgcttctgctgagagtgcataaagagagatacgctttttttagaaaagactcctggtactgttctaggatctgcgtcactgaacccgatgggtcagtgtcgcactttccatgctaccagtggattgaggggtattgcacggtagagttgcgccctggcaccgcccgcactatatgccaggacagccttccgttgttgttggaccatagaacaagggagttacgcgcacggcaggaatgttataggtggaagatttacgcccccgggtttccttgcatggtcgatgtgaatagtttccaggagatggagtctgataaaaagttcgccctgaccaagactacaacatgtgtagatcagggcgactcatccggcaacaggtacttgccgggattccccatgaaaatagatataccttccctgatgtacatggaaccaaatgtaaggtactcagctactaagacaatctccctgctttttaacgcaatcccagcctccctgggtatgaaattgaggggcctccttgatcgaaaagggagctggaaaaaattggacgatatgcagaacattttttggtgtcacaagaccttcacgactaagtacgttacagaacactggtgcgaagatcatttttttggataccagtatctgaacggcgtgaaccccgttatgttgcattgcatcagtagcctcccctctaaattaccagtgacgaacgatatggtagcgccactccttggccaggatacatgtctccaaacagaactggaaaggggaaacatcttcttagccgactactggatcttggccgaggcacctacgcattgtctgaatggacgccagcagtatgttgcggcccctctgtgtctcttgtggctgagcccacaaggagctctggtaccactggctatccagctgtcccagactccgggccctgattctccaatttttctacctactgacagcgaatgggactggttgcttgcaaagacgtgggtaagaaactccgagttcttggtccacgaaaacaatacccatttcctgtgtacgcacctgctgtgcgaagctttcgccatggccacattgcgacaactgccactgtgtcaccccatttacaagcttctcctgccccacacccgttacaccctgcaggtcaacacaatcgcccgagcaacccttctgaaccccgagggcctcgtagaccaggttactagcattgggaggcaaggactgatctatttgatgagcacgggattagcccatttcacctacaccaatttttgtctccccgactctcttagagcccgaggggtgctggccatacccaattaccactaccgggacgacggactgaaaatttgggccgctattgagtcctttgtgtccgaaatcgtgggatactattatcccagtgacgcttccgttcaacaagattccgagctgcaagcttggacaggagagatctttgctcaggctttccttggtagggagagctccggcttcccctcacgcctgtgtactcctggtgaaatggtgaagtttctcactgccatcatttttaattgttcggcccagcacgccgccgttaacagtggacagcacgatttcggggcctggatgccaaatgctccatcaagcatgagacaaccccccccccagacaaaaggaaccacaaccctcaaaacgtatctcgacacgcttcccgaggttaatatctcctgcaacaatttgctgttgttctggctcgtgtcccaagaacccaaagaccaacgacccttagggacttatcctgatgagcatttcaccgaggaggccccccgccggagcatcgcggcttttcagtcgcggttagctcagattagtcgcgatattcaagaacgcaatcagggcttagccctgccttatacgtacctcgatccccccctcattgaaaattctgtcagtatctag

SEQ ID NO: 179374 - DNA, 2136 bp, Artificial Sequence
  Description of Artificial Sequence: Synthetic coding sequence
atggccgtgtaccggctgtgcgtgaccaccggcccctacctgcgggcaggcacgcttgacaacattagcgtgaccctggtgggcacatgcggagagagccccaagcagaggctcgaccgaatgggacgagatttcgcccccggcagcgtacagaaatataaagtcaggtgtactgctgagctgggagagctgttactgctgagagtgcataaggagagatacgcatttttcagaaaggattcatggtactgctcacgcatttgtgtcacagaaccggacggcagtgtgtctcattttccttgctatcagtggattgaaggttactgtaccgtggaacttagacccgggacagcccgcaccatttgtcaggactccctcccactgctcttggatcatcggacacgggagctgcgggctcgccaggagtgctatcggtggaagatttatgctcctggcttcccctgcatggtggatgtaaattcattccaggaaatggagtctgacaagaagttcgctctgaccaaaaccaccacctgcgtggatcagggggacagctctggaaacagatacttgcctggttttccaatgaaaattgacattccgagcttgatgtacatggaaccaaatgttcgttactccgcaacaaagacaatctccctcctgtttaacgccatccctgcaagtctgggcatgaagctcagaggccttcttgatagaaaaggaagttggaagaagctcgacgatatgcagaacattttttggtgccataagacatttaccactaaatatgtgacggagcattggtgtgaggatcactttttcgggtatcagtatctgaatggcgtgaaccccgttatgctgcactgtatcagctccctgccctcgaagctgcccgtgacaaatgacatggtggcccccctcctcgggcaggatacatgtcttcagactgagttagagcgcggcaacatctttctggccgattattggatcctggctgaagccccgactcattgcctaaacgggagacagcaatacgtcgccgccccattatgcctactgtggctttcaccacagggtgcccttgtgcctcttgctattcaactgagtcagacccctggacctgattctccgatatttcttcccacagattcagaatgggactggctcctcgcaaagacttgggtaagaaatagcgagtttctggtccatgagaataatacccatttcttgtgcactcatctgctttgtgaggcgttcgctatggctactctgcggcaacttcccttgtgtcatcccatttacaaactgctgcttccccatacccggtacacgctccaggtcaatacaattgcgagagcaacattactgaatcccgaaggcctggtggaccaagtcaccagtatcggcagacagggattaatttatctcatgagtacaggcctggcacattttacctatacaaatttctgcctcccagacagtttacgcgctcggggtgtgcttgctatcccgaactaccactatcgcgacgacggcttgaagatttgggctgccattgaatctttcgttagcgagatagtcgggtattactacccctctgatgcttccgtgcagcaagatagtgaactgcaggcttggactggcgagatcttcgctcaagcatttctgggccgggagagctcaggattcccctctcgcttatgcacgcccggcgagatggtgaaatttttaacagctatcatctttaactgttccgcgcagcatgccgccgtgaattccggtcaacatgattttggagcttggatgcccaacgcccccagcagcatgcggcagcctcccccccagactaaaggcacaactaccttgaagacctatctggataccctgccagaagtgaacatatcatgtaataaccttctccttttctggctggtctcccaagaacccaaagatcagcgccccctcggaacctacccagacgaacactttacggaggaggcgccccgtaggagcatcgctgctttccagtccagattagcgcagatttcccgtgacattcaggagcgtaatcaaggcctcgcactgccctacacgtatttagacccccctttaatcgaaaacagtgtaagcatttag

SEQ ID NO: 179375 - DNA, 759 bp, Artificial Sequence
  Description of Artificial Sequence: Synthetic coding sequence
atggagccccagagcatgaagggccagaagcggcccttcggcggcccttggcgccttaaggttcttggcggcccaccttggcttagaagaaccctgcccaagctcgggcgaccgaaggaagcacccgttgcccggatgagcacccagagtacgcaccccttgaaacccgaggctccaagactacctcctggcattccggaatctccatcttgccagagaagacacacactgccagcgagtgagttccgttgcctgactcccgaagatgccgtatctgcgttcgagattgagcgcgaggcttttattagtgtgctgggagtgtgccccttataccttgacgagattcgacacttcctgacgttgtgccctgagctctctctagggtggttcgaagagggatgcctggtagctttcatcataggcagcctctgggacaaggaacgcctcatgcaggaaagcctcacactgcaccggtcaggcgggcatatcgcgcatctgcatgtgctggcggttcatagagcgttccgccaacagggacgggggcccatccttctctggcggtatctgcatcatctgggcagccagccagctgtgagacgcgcggcccttatgtgtgaagacgcccttgtgcccttctatgagagatttagtttccacgccgtggggccatgcgctatcactgtgggatccctgacctttatggagctgcattgttccctgagagggcacccatttcttaggaggaatagcggatgctag

SEQ ID NO: 179376 - DNA, 624 bp, Artificial Sequence
  Description of Artificial Sequence: Synthetic coding sequence
atgagcacccagagcacccaccccctgaagcccgaggccccccggctaccccccggtatcccagaatctccatcatgtcagcgcaggcacactctaccagcatctgagtttaggtgcctcaccccagaagatgctgtgtcagccttcgagattgaaagagaagctttcatatcggtactgggagtgtgtcccctatatcttgacgaaatccgccattttctcacattgtgcccagaactgagtctgggctggtttgaggagggatgcctggttgcgttcattatcggaagtttgtgggacaaagaacggctgatgcaagagagcctgactttacaccgatccggcggccatatcgcccatctgcacgtattagccgtgcatcgcgcctttcgacagcaaggtcgcggacctatcctcctgtggcggtacctgcaccaccttggctctcaaccagctgtccggcgcgccgccttgatgtgtgaggacgcccttgtgccattttacgagcggttcagtttccacgccgtgggtccttgtgcaatcaccgttggctccctgacatttatggagctacactgctccctgcgggggcacccatttctgagaagaaattctggatgttag

SEQ ID NO: 179377 - DNA, 1536 bp, Artificial Sequence
  Description of Artificial Sequence: Synthetic coding sequence
atggtgctgctggccgccgccgtgtgcaccaaggccggcaaggccatcgtgagccgacagtttgtcgagatgacgcgcacgcgaatagaaggcctcttggccgcgtttccaaaacttatgaataccggaaagcaacacactttcgtcgagaccgagagcgtcaggtacgtgtaccaaccaatggagaaattatacatggttctgatcactaccaaaaacagcaacattctggaggatctcgaaaccttgcgactatttagtcgggtgatcccagagtactgcagggctctggaggagaatgaaattagtgagcactgctttgacctaattttcgctttcgacgaaattgtggccctggggtatagagagaatgtcaatctagcccaaatccggacattcaccgaaatggatagccacgaggaaaaagtgtttagagccgtccgcgagacccaggagcgagaagccaaagcagagatgcggagaaaagccaaggagttgcagcaagcacgaagagacgccgaacgacagggcaaaaaagcacccgggtttggtggatttggctcatctgccgtgtccggggggtcaacggcggcgatgattacagagaccatcatcgagacagataaacccaaggtggcccccgccccagcaagacctagtgggccttctaaagccctgaaactgggcgccaagggtaaggaggtcgacaactttgtggacaagctaaagagcgaaggggaaaccattatgagctcgagcatgggcaagaggacttcagaggccaccaagatgcacgcccctcccatcaacatggagagcgtacatatgaagatcgaagagaaaatcactctgacttgcggccgtgatggtgggctccaaaacatggagctccatggcatgatcatgctgaggatttctgacgacaagtatggacggattagattacatgtcgagaacgaggacaaaaaaggcgtgcagctgcagacacaccctaatgtcgacaagaaattattcacagccgagtctctcatcgggctgaagaaccccgaaaagtccttcccagttaacagtgacgtgggcgtgcttaagtggcggttacagactacagaagagtcattcattcctctcactatcaattgctggccctctgaaagtggtaatggctgtgatgttaacattgagtacgagctgcaggaagacaatctcgagttgaacgatgtggtgattactatacccttgcctagtggagtaggtgccccggtgattggggagattgatggcgaataccgacacgatagtcgaagaaacactcttgagtggtgcttgccagtcatcgacgccaagaataaatctggcagcctcgagttttcgatagccgggcagcctaacgatttttttcctgtccaggtaagctttgtgagcaagaagaactattgcaacatccaggtcactaaggtcacccaagtcgatggaaacagtccagtcaggttcagcaccgaaactaccttcctggtggataagtacgagatcctgtag

SEQ ID NO: 179378 - DNA, 1659 bp, Artificial Sequence
  Description of Artificial Sequence: Synthetic coding sequence
atggccgagtgcaacctggtggccatcctgatcagcagcatcgacaaccctctcgataaaaacctggacaacgggggaaatagttgcctggactttcggccgctcaacagcttcagccagccacaggtgctgctcgctgcagccgtgtgtacaaaggctggcaaggcaatcgtgtccagacagttcgttgaaatgaccagaactagaatcgagggactccttgcagcctttcctaaactcatgaacactggcaaacagcacaccttcgtggaaaccgaatctgtgcgatatgtctaccaacctatggaaaaactgtatatggtgttgataaccactaagaattccaacattctcgaagaccttgagacactccgactcttctcccgcgtgataccagaatattgccgagccctcgaggagaacgaaataagcgaacattgcttcgacttgattttcgctttcgatgaaatagttgcgctgggatatagagagaatgtgaatttagcccagatccgaacatttaccgaaatggactctcacgaggagaaggtgttcagggcagtacgcgagacccaagaaagggaggcgaaggccgagatgcgtcgtaaggccaaagaactccagcaggctagacgcgacgctgagcggcagggaaagaaggcccctggatttggaggtttcggaagtagcgctgtttctggtggctctaccgcggcaatgattacagagacgatcatcgaaaccgataagccaaaggtagctccagctcccgccaggccctcaggccctagcaaagcactcaaacttggggccaaaggaaaagaagtcgacaattttgtggacaaactgaagagcgaaggagagacaataatgtcctccagcatggggaagcgcacaagtgaggctaccaagatgcatgcccctcctatcaatatggagagcgttcatatgaagatagaagaaaagatcacccttacttgcggcagagatggaggactgcaaaacatggagctgcacggaatgatcatgcttagaatctctgatgataagtacggccgaattcgactccatgtggagaatgaagacaagaagggggtccagctccagacgcatcctaacgtggacaagaaactgtttactgccgaaagccttatcggcctaaaaaacccggagaagtccttcccagttaattccgacgtgggcgtgctgaagtggcgactgcaaacaacagaagagtctttcatccccttgactataaattgttggccttcagaaagcggcaacggttgcgatgtgaacatcgagtacgaactgcaggaggacaaccttgaactaaatgatgtggtcatcacaattccgctgccctcgggcgtgggggcccccgtgattggggagattgatggcgagtatcggcacgacagccgccgtaacacactggaatggtgccttcccgtgatcgacgccaagaataaatctggttccctcgaattctccatagcaggacagcctaacgacttcttccccgtgcaggttagctttgtttcgaaaaagaactactgtaatatccaggtgacgaaagtcactcaggtggacggcaactctccggttagattctctactgaaacaaccttccttgttgacaaatatgagattctttag

SEQ ID NO: 179379 - DNA, 1272 bp, Artificial Sequence
  Description of Artificial Sequence: Synthetic coding sequence
atgatccccgagtactgccgggccctggaggagaacgagatcagcgagcactgttttgacttgatcttcgcgttcgatgagatcgtcgccctgggatatagagagaacgtgaacctagctcaaataagaactttcaccgagatggatagtcacgaagaaaaagtgttccgggcagtcagagagactcaggaacgtgaggcaaaggcggaaatgcgcagaaaagcgaaagagctgcagcaggctcgacgcgatgcagaacgccaaggaaagaaggcaccagggttcggcgggtttgggtccagcgcagtctcaggcggtagcactgctgcaatgattaccgaaactataatagaaacagacaaaccaaaagtggcacctgcccccgcacggcctagcggcccatctaaggccttaaagttaggcgcaaaggggaaggaagtcgacaacttcgtggacaagctgaagtctgagggagaaacaatcatgagttctagcatgggaaaacgcacctctgaggcgaccaagatgcatgccccccccattaatatggagagtgtccacatgaaaatagaggaaaaaatcacactcacctgcggcagagacggtggacttcagaacatggagctgcacggtatgattatgcttcgcatcagcgacgataagtatggccgcatccggctgcatgtcgagaacgaggacaagaaaggggtacaattgcagacccatccaaatgtagacaagaagctgttcaccgctgaaagcctcataggcttgaagaatcccgagaagtcattcccagtgaactccgacgtgggcgtcttgaaatggcgactgcagacaacagaggaaagcttcatccctctcactattaattgctggcccagcgaatccgggaatggatgtgatgtgaacatagaatacgaattgcaggaggataatctggaattaaatgacgttgtgatcacaattccactgccctcaggagtaggcgcccctgtcatcggggaaatcgatggcgagtaccgacatgactcccgaaggaatactctggagtggtgtttgcctgtgatcgacgccaaaaacaaaagcggttcactagaattttccatcgcggggcagccaaatgacttcttcccagtacaagtcagttttgtatctaagaaaaactactgcaatatccaggtaaccaaggtcacgcaggtcgatggcaattctcctgtgcgcttctcaactgagaccacctttctcgtggataaatacgaaatcctgtag

SEQ ID NO: 179380 - DNA, 570 bp, Artificial Sequence
  Description of Artificial Sequence: Synthetic coding sequence
atggtgctgctggccgccgccgtgtgcaccaaggccggcaaggccattgtgtcaagacaatttgttgagatgacgagaacccggatcgaaggccttctggccgccttcccaaagctgatgaacaccgggaagcagcatacattcgttgagaccgagagcgtaaggtacgtctatcagcctatggaaaagctgtatatggtgctgataacgactaagaacagcaacatccttgaggatctggagacccttagattgttttcaagggtgatcccagaatactgtcgggccttggaagagaacgaaatcagcgagcactgctttgatttgattttcgccttcgacgaaatcgtagcccttggttacagagagaatgtaaatctagcccaaatccgtaccttcaccgagatggatagtcatgaggagaaagttttccgcgcggtgcgagaaacccaggaaagagaggcaaaggccgagatgcggcggaaagcgaaggaacttcaacaggctcagtccgtgggaatcaccggaatgtcacaccacgcccagctgctgttgtactttaatccttag

SEQ ID NO: 179381 - DNA, 2223 bp, Artificial Sequence
  Description of Artificial Sequence: Synthetic coding sequence
atgaccgtgaagctggacttcgaggagtgcctgaaggacagcccccggtttcgggccagtatcgaactcgtggaggcagaggtcagtgagttagagacgcgactggagaagcttctcaagcttggcacagggttgcttgagagcggccgccattacctcgctgcctccagggccttcgttgtgggaatctgcgatttagctagactgggtccacccgaacccatgatggcagaatgcctggagaagtttaccgtgtccttaaatcataaactggattcccatgctgagttgcttgatgccacacagcacacactgcaacagcaaatccagacgctggtaaaagagggtctgcgcggtttccgagaggccagaagagacttctggagaggagcagaaagtcttgaggccgcgttaacccataacgccgaagtgccaaggcggcgagcgcaggaagcggaggaggctggcgcagccctcagaactgcacgtgctggatataggggcagagcattggactatgccctgcagataaatgtcatcgaggataaacgaaagtttgatatcatggaatttgtgcttaggcttgtggaggcccaggcaacccactttcagcagggacacgaggagcttagtcgactctcacagtatcgtaaggagttaggagcccagctgcaccagctggtgctgaactccgctcgtgagaagcgtgatatggaacagcgacatgtgttgctcaaacaaaaggagttgggaggcgaagagcccgagcccagtcttcgggaaggacctggcggtttggtgatggaagggcacttgttcaagagagcaagcaatgcctttaagacatggagccgtcgatggttcacaatccagtccaatcagctggtgtatcaaaaaaagtataaagatcccgttaccgtggtggtggacgacctgagactttgcacagtaaaattgtgcccagatagcgagaggcgattttgctttgaagttgtctcaacgtccaagtcttgtttgctccaggctgacagcgaacgactgctacagctgtgggtgagtgccgtacagtcatcaatcgcgtcagcttttagccaagccagactagacgatagtcccagaggccccgggcaaggctccggccaccttgcgatagggtccgctgctaccttgggctctgggggaatggcaagaggtcgcgaaccagggggtgtcggacacgtggtcgcccaggtccagtccgttgatggtaacgcacagtgctgtgattgcagggagcctgctccggagtgggcttccatcaatctgggcgttacactgtgcatccagtgttcgggaatccataggtcactcggggtgcactttagtaaagtaaggagtctgaccctggattcctgggaacctgaactggtgaaactgatgtgcgagctagggaatgtgatcatcaatcagatctacgaggcgcgggtggaggccatggctgtcaagaaaccaggaccttcctgtagccgccaggagaaggaagcctggattcacgctaaatacgtggagaagaaatttctcacaaagctgcctgaaatacgcgggcggagaggcgggcgggggcggccccgtgggcagcccccagtgcctccgaagccaagcatccgtccccgaccagggtcacttcggtcaaagcccgagccccctagtgaagatctgggttcactgcacccaggcgccctgctatttagagctagcggccacccccccagtctgccgacgatggcggacgctcttgctcacggggccgacgtgaattgggtgaacggaggtcaggataatgctacccctttaatacaggccactgccgcaaattcactgctggcttgtgagttcctgttacagaatggcgccaacgttaatcaggctgatagcgcaggccgtgggccactccaccatgctacaatccttggacacactggcctggcttgtctgttcttaaaaaggggggccgacctcggcgctcgggattccgaggggcgcgatcccctaacaatcgctatggaaacagccaacgcagatatagtgacattactgagactcgccaagatgcgggaggccgaagctgcgcagggacaagccggagacgaaacatacctagacatttttagagactttagtttaatggcttccgacgatcctgaaaaactcagccgtcggtcccatgatctccacacgctgtag

SEQ ID NO: 179382 - DNA, 2337 bp, Artificial Sequence
  Description of Artificial Sequence: Synthetic coding sequence
atgaagatgaccgtggacttcgaggagtgcctgaaggacagcccccgatttagagccgccctagaggaggtcgaaggcgacgtggctgaactggaactgaagctggacaaactcgtgaagctctgcatcgccatgattgatacgggcaaggccttttgcgtggccaataagcagtttatgaacggaatccgcgatctggctcagtacagtagtaacgacgctgtggtggagacctcgcttaccaaattctcagactccttgcaagaaatgattaactttcatactatcctcttcgatcagacacagaggagtatcaaagcccagctgcagaacttcgtgaaggaagatctgcgtaaattcaaagatgccaagaagcagtttgaaaaggttagcgaagaaaaagaaaacgcactcgtgaaaaatgcccaggttcaacggaacaaacagcatgaagtcgaggaggccaccaatatcctcaccgctactcgaaagtgcttcaggcacatagccctggattatgtgttgcaaatcaatgtacttcagtctaagagaaggtccgaaatcctgaagtcaatgctgtcctttatgtatgcccatctcgccttcttccaccaagggtacgacctcttctctgaattgggaccttatatgaaggatctgggtgcccaactggataggctggtggtagatgcagctaaagaaaagcgagagatggagcaaaagcacagcacaatccaacagaaagacttcagttccgacgactcgaagctggagtacaatgtggacgcggccaacggtattgttatggagggctacttatttaaacgggcctctaatgcttttaagacttggaacaggcggtggttttcgatccagaataatcagctcgtgtatcaaaagaagtttaaagataacccaactgtggtggtagaagatcttaggctgtgtacagtaaagcactgcgaggacatcgagagaagattctgtttcgaggtagtgtctccaaccaagagttgcatgctccaggcagatagcgagaaactgagacaggcgtggatcaaggcggtacagacgtcgatcgcaaccgcttatcgcgaaaagggtgacgaatccgagaagctggataaaaagtcttctcccagtactggtagcctggattctggcaacgagtctaaggagaaacttctgaaaggcgagtcagctcttcaacgagtgcaatgcattcctggcaatgcctcatgttgtgattgtggattggccgacccacgttgggcgtctatcaacctggggatcaccctgtgtatcgaatgtagcgggatacatagaagcctaggtgttcacttctcgaaagtccgctcactcaccctggacacatgggagccagaactgttaaagttgatgtgtgaactgggcaacgatgtaatcaatagggtctatgaagctaatgtggagaaaatgggcatcaagaagccgcagccaggccaacggcaggaaaaagaagcctacatccgtgccaagtacgttgagagaaaattcgtcgacaagtactccatatccctgtcacctcctgagcaacaaaagaaatttgtctccaaaagtagcgaagagaagcgcctgagtatatccaagttcggccccggggatcaagtcagggcttccgcgcagagctctgtgcggtcgaatgatagcggcatacagcagtccagcgatgatggcagagagtcactgccatccacagtgagtgcaaatagcctctacgagccagagggagagcggcaagactctagcatgttcctggactccaaacacctgaacccaggtttgcaactttatcgtgcctcatacgaaaagaatctgcctaagatggccgaagcccttgcgcacggggcggatgtcaattgggctaactcagaggaaaacaaggccaccccgttgatccaggcagtgctcgggggcagtctggtgacatgtgagtttttgctacagaatggcgccaacgttaatcagagggacgttcaaggccggggtccccttcaccacgccactgtccttggtcacactgggcaagtgtgcctgtttcttaaaagaggggccaatcagcacgcaactgacgaggaaggcaaggatcccctgtcaattgccgtcgaggctgctaacgctgacattgttacattattgcggctggccagaatgaacgaggaaatgagagagtctgagggcctgtatggccagcccggggatgagacttaccaagatatttttcgcgatttctcacagatggccagtaataaccccgagaagctaaacagatttcagcaggacagtcagaagttttag

SEQ ID NO: 179383 - DNA, 3618 bp, Artificial Sequence
  Description of Artificial Sequence: Synthetic coding sequence
atgaccaagaaggaggagcccccccccagccgggtgccccgggccgtgcgcgtcgcctcattgctgtccgagggcgaggaactctcaggtgacgaccagggcgatgaggaagaagacgatcacgcctacgaaggcgtacctaacggtggctggcatacctcctctctgagcctcagtctgccttctactatcgccgccccccatcctatggacggacctcccgggggatccaccccagttactcctgtgatcaaagctggttggctcgacaagaatcctccacaaggcagttacatctaccagaaacgttgggtgaggctcgatactgatcacctgaggtatttcgatagtaacaaggacgcatattctaagcgttttatctccgtggcatgtatatctcacgtagctgccatcggagatcagaaatttgaagtcatcactaacaataggacatttgcctttagggcagagagcgatgtggagcgaaaagagtggatgcaggctctgcagcaggctatggctgagcagagggctcgtgcgcggttgtcaagtgcttatctgctcggcgtgcccggcagcgaacaaccagatcgtgctggctctcttgaactgcggggctttaaaaacaaattatatgtggccgtcgtgggcgataaggttcagctctacaagaaccttgaggagtaccacttaggcattggtatcaccttcattgacatgtcagtgggaaacgtgaaagaggtggatcggcggtctttcgacttaacaaccccttatcggatcttcagtttcagcgccgactctgaacttgaaaaagaacaatggcttgaagccatgcagggagcgatcgccgaggcactgagcacaagcgaggttgccgagaggatttgggctgcagctcccaaccggttttgtgccgactgcggagccccccaaccagactgggccagcatcaacctctgtgtggttatctgtaagcgctgcgcgggtgaacaccgcggcttaggtgctggcgtgtctaaggtccgatctctcaagatggatcggaaagtatggaccgaaacactgattgaactttttctgcagctaggaaatggcgccggtaaccgattttgggccgccaatgtgcctcctagtgaagccctccagccatcatcatccccatccactagacgctgccatctggaggctaaatatcgcgaggggaagtatcgaaggtaccatccattgttcgggaatcaagaggagctggacaaggcactctgtgcagccgttaccaccacagatctcgcagaaacccaagctcttctcggctgcggtgccggcatcaactgtttttccggcgacccagaggcacccacacccttggctctggcagagcaggctggccagactctccaaatggaatttctccggaacaatagaaccacagaagtgcctcgtctcgacagtatgaaaccgcttgaaaagcactatagcgtggtcctgccaactgtctcccactcggggtttctgtataagacagcgtctgccggtaagctgttgcaggatcggcgcgccagggaggaattctctagacgctggtgcgttctgggggacggagttttgtcatacttcgagaatgaacgcgctgtcacccccaacggcgaaattcgagcttcagagatcgtctgtcttgcggtgcccccacccgacacccatgggtttgaacacacctttgaagtgtacacggagggcgaacgcctctatctttttgggctcgagtccgccgagcaggcccatgaatgggttaaatgtatcgccaaagcgtttgtacctccactggccgaagatctgctggcccgagacttcgagaggctggggcggctgccatacaaagctggcctttccttgcaacgggctcaagaaggttggttctccctgtctggatccgagctcagggccgtttttcctgaaggcccctgcgaagagccccttcagttaagaaaactccaagagctgtccatccagggggactctgaaaaccaggtgcttgtactggtagaacggcggaggactttgtacatccagggcgagcggaggctggatttcatgggctggctaggcgccatccagaaagctgcggcttccatgggggatacgctctcagaacagcagctgggagatagcgacatcccagtcatcgtctaccgctgtgtggattatataactcagtgtggactcactagtgagggaatttacaggaaatgtggccagacttcaaaaactcagcgccttcttgaatctctgaggcaagacgctcgctctgtacacctgaaggagggtgagcaacatgtggacgatgtcagcagcgcgctaaaacgcttcctgcgggacctgccggatggcctgttcacacgtgctcagcgcctgacctggctcgaagctagtgagatcgaggacgaagaggagaaggtttctaggtatcgcgagcttttggtaaggctgccgccagtgaaccgtgcaacagtgaaggcactcatcagtcacctctattgcgtgcagtgtttttctgacacgaatcagatgaatgtgcacaacctggccatcgtgttcgggccaacgctgttccagacggatgggcaggactacaaggccggaagggtagttgaagacctaattaatcactacgtggtagtcttctccgttgacgaagaggagctacgcaagcagagagaggagatcactgcaattgtcaagatgcgtgtggctgggactgcatcaggcacccagcatgctggggacttcatatgtactgtgtaccttgaagagaagaaagccgagacagagcagcacatcaaggttcccgctagcatgacagcagaagagctcaccttagaaatcctcgatagacgcaatgtggggattcgcgagaaagattattggacctgctttgaagtcaacgaacgagaagaggccgaacgtcctctccacttcgccgaaaaggtcttgccgatcctccacggcctgggaactgatagccatctggtagtgaaaaagcaccaggcaatggaggctatgctgctgtacttggcctcacgcgtaggggataccaagcacggaatgatgaaattccgcgaggacaggagcttgctcggcctgggcctcccttcagggggcttccacgatcgctactttatactaaattcttcctgtttgcgcctttataaggaggtgcgcagtcaaaggccttggagcggcgcccctgagaccagccacagacccgaaaaagaatggccaatcaaaagcctcaaggtgtatctgggcgttaagaagaagctgcggccaccaacctgttgggggtttaccgttgtccatgagacagagaaacacgaaaaacagcaatggtatctgtgctgtgatacccagatggaactgagagagtggtttgcaacattcttgtttgttcagcatgatggtcttgtctggccaagcgagcctagtcgcgtgagtagagccgtgcccgaggtgcgcctgggctctgtaagccttatccccctgagaggatccgagaatgagatgcgccgcagcgtggcagccttcaccgcggaccccctaagtttgctgagaaatgtatag

SEQ ID NO: 179384 - DNA, 1884 bp, Artificial Sequence
  Description of Artificial Sequence: Synthetic coding sequence
aagtgctgggccgtgtgggtgggcgccgtgtggaccgagggcgcctggcagcctcgcgttggcgtgatctgtgggctgaagggcagaatgacattgtctggttctcgcggacaggaggaaccgccccctagtcgggtgccccgtgctgtgagagtcgcatccttgctgtccgaaggtgaggaactgtccggagatgaccaaggagatgaggaagaggatgatcatgcctacgagggcgttcctaacggcggatggcatacctctagcctgagtctttcattgccgtccaccatcgccgcccctcaccccatggatggccccccaggaggctccaccccggttaccccagtaatcaaagcaggatggcttgacaaaaacccaccccagggcagttacatataccaaaagcgctgggtgcggctcgatacggatcacctacgctattttgattcgaacaaagatgcttattctaaacgctttatttcggtcgcttgcatcagtcacgtggccgccatcggcgaccagaagttcgaagtgattaccaacaaccgtaccttcgcatttcgcgcggaatcagacgtggaacgtaaggagtggatgcaggcactgcagcaagccatggccgaacagagggctagggcccggctgtcttctgcctatctgctgggtgtccccggttccgagcagcctgaccgtgctggcagcttagaattgcggggcttcaagaacaaactgtatgtagccgtggtgggcgacaaagtgcaactgtataagaacctggaggagtaccaccttggaattggaataacttttatcgacatgtccgtgggtaacgtcaaagaagtggacaggagaagcttcgacctgacaaccccttatcggatatttagcttcagcgccgatagtgaactggaaaaggaacaatggttagaggccatgcagggagccatagctgaagcattgtcaacatctgaggtcgctgagcgtatatgggcggcagcaccaaataggttctgtgccgattgcggggcccctcagcctgactgggccagcattaacctctgcgtagtaatatgcaaaagatgtgccggagagcacagaggactgggtgctggcgtttccaaggtgcgtagtctgaaaatggataggaaagtgtggaccgagacactcatagaacttttcctgcagttgggcaatggggccggaaaccggttttgggcagccaacgtccctccttcagaggccctgcagccttcctccagcccaagcacacgccgctgccatctcgaggctaagtatagagagggtaaataccgacgctaccacccactgttcggtaatcaggaggagctcgataaagcgctttgcgctgctgtgaccaccaccgacctggcagaaactcaggcactcctcggatgtggagccggcattaactgcttctccggggatcccgaagcccctactcccctggccctggctgaacaagccggccagactcttcaaatggagttcctcaggaacaaccgaaccactgaagtccctaggcttgattccatgaaaccattggagaagcattacagcgtggtgttaccaaccgtgagccattctggatttctgtacaaaacagccagcgccggaaaactcctgcaagacagaagggcacgggaggaattcagccggcggtggtgcgtgctgggagatggtgtgctgagttacttcgagaatgaacgcgccgtaacacccaatggtgagattagggcaagcgaaatcgtgtgtctcgccgtaccaccacctgacacccacgggttcgagcatacgttcgaagtttacactgaaggggaacgcctgtatctctgggctggcgagtgcggcgcaggtagctag

SEQ ID NO: 179385 - DNA, 4320 bp, Artificial Sequence
  Description of Artificial Sequence: Synthetic coding sequence
atggccgaggccggcgacgccgccctgagcgtggccgagtggctgcgagcccttcacctagaacagtacaccggattgtttgagcagcacggactggtctgggccactgagtgccaaggtctgagcgacacacgcctgatggatatgggaatgctcctcccagggcatagaagacgtatcttggcgggactgctgagggcccacacctctcccgccccagcccccaggcctacccccaggcccgttcctatgaagcgacatatttttcggtcccctcctgtgcctgcgaccccccccgagccattgcccactaccactgaggacgagggcttgcccgccgctcctcccattccaccaaggagaagttgtctgccgcccacctgctttaccacaccgtctaccgccgctcccgaccctgtgctgccccccctaccagccaagaggcatctcgccgagctgtcagtcccacctgtgccacctaggactggtcccccccggctgctggtttccctgcccaccaaagaagaggagagcctgctccccagcttgtcttccccacctcagcctcagtcagaggagccactgagcactttgccacagggcccaccacagccccccagccctcccccctgcccacccgaaataccacctaaacccgtgcggctatttcccgagtttgacgatagtgactacgatgaagtgcccgaagaggggccaggggcgccggcccgggtaatgaccaagaaggaagagccgcctccctcccgtgtccctcgggctgtgcgggtggcatctctgttatccgagggggaggaactgagtggcgatgatcagggagatgaggaggaggacgaccatgcgtacgaaggagttcctaatggcggatggcacacaagctctctttcgttgtctttgccatccacgatagccgcccctcaccctatggatggtccacctgggggctcaacacccgtcacgccagtaattaaagcggggtggttagacaaaaacccccctcaggggtcttatatttatcagaaacggtgggttcgattagatactgatcacttgcgttatttcgactcaaacaaggatgcgtattcaaagcgattcatttcagtcgcctgcataagccacgtggctgcaatcggggaccagaaattcgaagtaatcaccaataaccgaactttcgcctttagggctgaatcggacgtggaacgtaaagaatggatgcaagccctgcaacaggctatggccgagcagcgagctcgggctaggctcagctccgcttatctgctcggagtccccgggagtgaacagccagacagagccggcagtctggagctgcggggtttcaaaaacaagctttacgtggcagtggtaggggacaaagtgcagctgtataagaacctcgaggagtaccatctgggcataggcattacctttattgacatgtctgtgggtaatgtcaaagaagttgaccggcgcagtttcgacttaaccaccccatacaggatattttccttctcagccgacagcgagctggaaaaagagcagtggctcgaggctatgcaaggcgcaatcgctgaagccttgagcacaagcgaagtcgctgaaagaatatgggctgcagctcctaataggttctgcgccgattgtggtgctcctcagccggattgggcgagtattaatctttgtgtagtgatttgcaagcgctgtgcaggtgaacatcggggactgggagcgggagtgtcaaaagtccgaagcctgaagatggatagaaaggtgtggacagagacacttatcgaattatttctgcagctcggaaatggagccggtaatcgcttctgggctgccaacgtaccaccctcggaagccctgcagccgtcaagcagtccctctaccagacgctgccacttggaagccaagtatagagaagggaaatacagacgctaccaccccttattcgggaatcaggaggagctcgataaggccctgtgcgccgcagtcaccactacagatttggccgaaacccaggcactactcggttgcggagccggtatcaactgtttctccggggaccctgaggcacccactccactagccctggcagagcaggccggacaaacactgcagatggagtttctgagaaacaatcgcactaccgaggtccccagactggactccatgaagcctttggagaaacattactcagtcgtgttgcctaccgtgtcacactctggtttcctctacaaaactgcctcagccgggaagctgcttcaggaccgccgcgcaagggaggaattcagccgtcgctggtgcgtgctgggcgacggtgtgcttagttattttgaaaatgagcgtgcggtaactcccaatggtgagatccgggcatcagaaattgtatgtcttgccgtccctccccctgacacacacggattcgagcacacgttcgaggtctatactgagggggagcgattgtacctgtttggcctggagagcgcagaacaggcccatgaatgggttaaatgcatagccaaggctttcgtgcctccccttgctgaggacctcttagcgcgagacttcgaaaggctggggaggctcccatacaaggcgggtctctctctgcagcgggctcaggaaggatggttctccctttctggaagtgaactcagggccgtcttccccgagggcccatgtgaggagccattgcagctcagaaagctgcaagagctgtccatacagggtgactcagaaaaccaggtgttggtgctcgtggagcggaggaggactctgtacatacagggggagagaaggctggattttatggggtggctaggcgcgatacaaaaagcggcagcctctatgggagacacacttagtgaacaacagctcggagatagcgacatacctgtcattgtgtaccggtgcgtcgactacatcacccagtgcggtcttacttcggaggggatctataggaagtgcggacagaccagtaagacacagagactcctcgagagtctccgacaggacgcacgcagcgtgcatctcaaggaaggcgaacaacacgtagacgacgtttcctccgccctgaagagattccttcgcgatctacccgacggtctgtttactagagcgcaacggttgacctggctagaggcctcagagatagaagatgaagaggagaaagtcagcaggtacagagaactgctggtacgcttgccccccgtgaatagggccacagtaaaggccttaataagccatctgtattgcgtgcagtgtttttcagacactaaccagatgaatgtgcacaacctagccatcgtcttcgggccaacccttttccagacagacggccaggactataaggctggccgtgtcgtggaggaccttatcaaccactatgtggtggtgtttagtgtggatgaagaggagttgcgaaaacagagagaagagatcaccgccattgtaaagatgagggtcgccggcacagccagtgggacccaacatgccggcgattttatttgcacagtttatcttgaggagaaaaaggcagagacagaacagcatatcaaagtcccggctagcatgacagcagaggagttgactctggagatactggatcgccggaacgtgggcattagagagaaagactactggacttgcttcgaggtcaatgagcgggaggaggctgagcgcccactgcatttcgctgagaaggtgcttcccatcctgcatgggctagggaccgactcccacctggttgtgaagaaacaccaggctatggaggcaatgcttctgtacttagcctcaagagtcggggacaccaagcacggtatgatgaaattccgtgaagatcggtctctgcttggccttggactcccctccgggggcttccacgatcggtatttcatcttaaacagctcatgtctcaggttgtataaggaggttaggtcccatcgcccagaaaaggaatggcccatcaagtctcttaaggtctacctcggagtgaagaaaaaactgcgcccccctacatgctggggatttaccgtggttcacgagaccgaaaagcacgaaaagcagcagtggtatctctgttgtgacactcagatggagctgcgggaatggttcgccacctttttgttcgttcagcatgatggactcgtttggccctctgagccctccagagtgagccgcgcagtgccagaagtccggttgggatcagtgagcctgatcccacttcgcggcagcgagaacgagatgcgacgaagcgtagctgccttcaccgccgatcccttaagtttactgcgcaatgtgtag

SEQ ID NO: 179386 - DNA, 3633 bp, Artificial Sequence
  Description of Artificial Sequence: Synthetic coding sequence
atgaccctgagcggcagccggggccaggaggagcccccccccagccgagttccccgtgcggtccgcgtggcctctctgttgtcagagggtgaggagctctcaggtgacgaccagggggacgaagaggaagacgaccacgcctatgagggcgtgcctaatggaggctggcatacttcaagtctgagcctcagtctcccttctacaatagctgcaccacatcctatggatggccctcctggggggtctacaccagtgacacctgtgataaaggccggctggttagataagaacccaccacagggttcatatatatatcaaaaacggtgggtgaggctcgatacagatcatctccgctactttgacagtaacaaagacgcatattcaaagcgctttatcagtgtggcctgtatatcccatgttgcagccatcggcgatcagaaatttgaagtgataacaaataaccggacctttgctttccgagctgagtccgatgtggagaggaaagaatggatgcaggcactacagcaagctatggctgagcaaagagcccgcgcccgcctgtccagcgcatacctcctgggagtgcctggcagtgagcagcccgacagggccggctctctggagctcagaggctttaaaaacaaattgtatgtggctgtggtcggcgataaggtgcagctctacaaaaatctcgaggagtaccatctcgggattgggattacattcatcgatatgtctgtgggaaatgttaaggaagtagatcgccggagttttgacctcaccacaccctatagaatattttccttcagcgctgatagcgaactggagaaagagcagtggctcgaagctatgcagggcgcaatcgcagaggcactgtcaacatcagaagtcgccgagcgcatttgggcagctgcccctaacagattttgcgcagactgcggtgccccccagcctgactgggccagcattaacctttgcgtggtgatttgcaagcggtgtgcaggggagcatcggggacttggcgccggtgtatccaaggtgcgaagcctgaaaatggacagaaaggtctggaccgaaactctcatcgaactctttctgcagctgggaaacggagctggcaacagattctgggccgccaatgtcccgccatctgaggccctgcagccatcttcctctccatcgacccgtcgttgccacctcgaggcgaagtaccgcgaaggcaagtacaggagatatcatcccctgtttgggaatcaggaggaacttgataaggcactatgtgccgctgtgactactaccgatctggctgaaacccaggccctcttaggctgcggcgctggcataaattgctttagcggcgaccccgaagctcccaccccactcgcgctggctgagcaggcaggacagaccctgcagatggaatttctcagaaacaatcgcactaccgaggtgccgcggctagatagcatgaagcccctggaaaaacactattccgtggtccttcctaccgtgagtcacagcggttttttgtataagaccgcatcagccggaaaattgctgcaggaccgaagagcacgtgaagaattctcaaggcgctggtgtgtgctcggtgacggggtgttaagttatttcgagaacgagcgagctgttaccccaaatggtgagatcagagcatcggagatcgtttgcttggccgttccccctcccgacacacatggtttcgaacacactttcgaagtttacaccgaaggcgagcggctctatctgttcggtcttgagagtgcggaacaggcgcacgagtgggtcaagtgcatcgcaaaagcattcgtgccgcccctggcagaggatctcttggcgagagattttgagagattgggtcgtttgccctataaggccggactgtccctccagagggcgcaggaaggttggtttagtctgagcggctccgagctccgcgcagttttccctgaagggccttgtgaggagcctcttcaattgcgaaaactgcaggagctgagcatccagggagactccgagaaccaggtgcttgtactggttgaacggcgcagaaccctctatattcaaggcgaacgcaggcttgacttcatggggtggttgggggcgatacagaaggccgccgccagtatgggcgatactctatcggagcaacagcttggtgacagcgatatcccggtcatcgtgtataggtgcgtggattatatcactcagtgcgggctcacatccgaagggatctaccggaagtgtgggcagacttccaagactcagaggctgctggaatctctccgccaggatgctcgtagcgtgcacctgaaggagggcgagcagcacgttgacgatgtttcttctgcgttgaagagattcctgagggacctcccggacggtttgttcacccgagcgcagcggctgacatggttagaagcttcagagatcgaggacgaagaagagaaagtctctcggtacagggagttattggtccgattaccgcccgttaatagagctactgtgaaggcgctgatctcccacttgtattgcgttcaatgcttcagtgatacaaaccagatgaacgtgcacaatctggccattgtattcgggcctaccctcttccagacagatggccaggactataaagctggtcgggttgtggaggatctgatcaatcactacgtcgtggtgttcagcgtggatgaagaggagctgcgtaagcagcgagaggaaattaccgcaatcgtgaaaatgcgagtggcagggacagcctctgggacacagcacgctggggattttatctgcaccgtgtatctggaggaaaagaaggcagagacagaacagcacatcaaggtacccgctagcatgaccgctgaggagcttacattggagatcctcgaccgcaggaatgtgggcatacgggagaaggattactggacctgtttcgaggtcaatgaacgggaagaggcggagcggcctctgcactttgcagagaaggtcctgcccatactccacgggctgggcaccgattcccatctggtggtcaaaaaacaccaggccatggaagccatgctattgtatctcgcatcaagagtcggggataccaaacatggcatgatgaaattccgggaggacagaagcttgctcggcttgggactcccatccgggggatttcatgacaggtacttcattctgaattcatcttgcctcaggctctacaaggaggtaaggagccagagaccctggtccggcgcccccgaaactagccaccggccagagaaggagtggcccatcaaatccctgaaagtatacctgggagtgaagaagaagttaaggcccccaacatgctggggattcactgtggtccatgagaccgagaagcatgaaaagcagcaatggtacttatgctgtgacacacagatggaactgagagagtggtttgctacctttctgttcgtgcagcacgatgggctggtgtggccctcggagccgagcagagtctctcgggcagtgcccgaggtgcgcctggggtcagtgagcctaataccactccgggggtccgagaacgaaatgcgtcggagcgtcgctgcttttaccgccgacccgctgtctttactgcggaatgtatag

SEQ ID NO: 179387 - DNA, 4353 bp, Artificial Sequence
  Description of Artificial Sequence: Synthetic coding sequence
atggccgaggccggcgacgccgccctgagcgtggccgagtggctgcgagcactacatctggagcagtatacagggctgtttgagcaacatggtctagtgtgggccacagaatgccaggggttaagtgatactcgtttgatggacatggggatgctgttgccagggcacaggaggagaattctggcaggactcctccgagctcatacaagtcccgcccctgcccccaggcctacgccccggcctgttcccatgaagcggcatatctttaggtcgcctcctgtacccgcaaccccccctgagccactgcccaccactacggaggacgagggtctgccagcggctcctcccattccaccaagacgttcttgtctcccccccacatgtttcacaactcctagcacagccgccccagatcctgtgttacccccgctgccggctaagcggcacctcgcagaactgtcagtccctccggtgcctcctcgaacaggtccaccccgcctgttggtgtcccttccaactaaggaggaggaatctcttctgccaagcctttctagcccgccccagcctcagtctgaagaaccactaagcaccctgccccagggccccccacagccgccttccccacccccttgccctcctgagatccctcccaaaccagtcaggctttttcctgagtttgatgatagtgactacgacgaagtcccagaagaaggccccggcgcgcccgcacgcgttatgaccaaaaaggaggagcctccccctagccgggtgcccagagctgtccgggtggccagtttgctgagcgagggagaagagctgtccggagacgatcagggcgacgaagaggaggatgaccacgcctatgagggggtccctaatggagggtggcacacctcgtcactcagcctatcattaccatccaccatcgccgccccccaccctatggacggcccgcctggaggctccaccccggttactcctgttattaaggcgggctggcttgataaaaatcctccccaggggtcatacatttaccagaagaggtgggtccggctggataccgatcaccttaggtattttgacagtaacaaggacgcttatagcaaacgctttattagtgtggcgtgcatcagtcacgtggctgctatcggagaccagaaattcgaagttataaccaacaatcggaccttcgcttttagggcggagagcgacgttgagcgaaaagagtggatgcaggccttgcagcaagctatggcagaacaacgagcccgtgcccgccttagcagcgcctatttgctgggggtgccgggctccgaacaaccggatcgggccgggtccctcgagctgagaggttttaagaacaagctgtacgtggcagtcgtcggagacaaggtgcagttgtacaagaatcttgaggagtaccacctgggcatagggatcacattcatagacatgtctgtcggcaacgtcaaggaggttgatcggagatcatttgacctgaccacaccatataggatattctcattcagcgccgactctgaattagaaaaggagcagtggctggaagcaatgcaaggcgctatcgctgaggccctgtctacctcagaggtggcagagaggatatgggccgcagcccctaacaggttttgcgccgattgcggcgccccgcagccggactgggccagtataaatctttgcgtcgtgatctgcaaacgctgtgccggcgagcaccggggccttggggctggagtgagtaaagttcggtctctaaagatggaccggaaagtgtggacagaaacccttatcgaactatttcttcagcttggcaatggggccgggaataggttttgggccgccaacgtgcctcctagcgaggccttgcagcctagtagcagtccatcaaccagacgatgtcatctggaggctaagtacagagaagggaagtacagaaggtatcatccacttttcggaaatcaagaggaacttgacaaggcgctttgtgctgccgtgactaccacagacctcgctgagacgcaggccctgcttggctgcggagccggaattaactgttttagcggtgaccctgaggccccaacaccactagctctcgccgagcaggctgggcaaacccttcagatggaattcctgaggaataatcgtaccacagaagtgccgcggctcgattcaatgaaaccacttgaaaagcactacagcgtggtactgccaaccgtatcccatagcggattcttgtacaagactgcttcagcggggaaactgcttcaggaccgacgggcccgcgaagaattttcaaggcgttggtgcgtgctcggcgatggcgtgttatcttactttgagaatgaacgtgcggtgacacctaacggcgagatcagagcttccgagatagtgtgccttgccgtcccccctccagatactcatggatttgaacatacgtttgaggtctacaccgaaggcgaacggctctacctgtttggacttgagagcgctgagcaggcccacgagtgggtaaagtgtatagctaaagcgtttgtgcccccactggctgaagatttgcttgcgcgggatttcgaacgcctggggcgcctcccttataaggccgggctgagcctccagcgggctcaggaaggatggttctctttgagtggaagtgagctgagggcggtcttcccagagggcccgtgcgaagagcctctccagttacgtaagctccaggaactgtccattcagggagacagtgagaaccaggtgcttgtccttgttgagcgccgacggacattatacatacaaggcgaacggagactggatttcatgggttggctcggcgctatacagaaggcagcggcctccatgggagatacactgtcggaacaacagctgggggatagcgacattcccgtgatagtctacagatgtgtagactacattacacagtgcggcctgaccagtgaagggatatatcggaagtgcggacagacttccaaaactcagcgcttgctggaatctctgcggcaggatgccagatctgtgcacctgaaagagggcgaacaacacgtggatgatgtgagctctgccctaaagagatttttaagggacctgccagatggcctgttcaccagagcccagcgcctgacctggctggaggccagtgaaatcgaagatgaggaagaaaaggtgtccagatatagggagttactcgttaggttaccacctgtgaaccgagccactgttaaagccctcatcagccacctgtactgcgtccaatgctttagtgacacaaaccagatgaatgttcacaacttggccatagtgttcggccccactctcttccaaaccgatggccaagattataaggctggacgagtggtggaagacctgatcaaccactatgtagtcgtgttctcagtggacgaagaggagctccgcaagcaacgagaggaaattacagcgatcgtgaagatgagggttgccgggacagcctccggaacccagcatgcaggagacttcatttgtaccgtgtacctggaggagaagaaagctgaaacggaacagcacatcaaggtgcctgccagcatgacggctgaagaactgacacttgaaatcctggatcggcggaatgtcggtattagggaaaaggattactggacctgttttgaggtgaacgaaagagaggaggctgagaggccacttcattttgccgagaaagtgctgcccatcctccacggcttgggcactgactctcaccttgtcgtgaaaaagcatcaagctatggaagccatgctgctctacctagcatcaagagtgggagacactaaacacggaatgatgaaattccgcgaggaccgctctctgctaggcctgggactaccgtctgggggatttcatgataggtactttatacttaacagctcctgcctgagactctataaggaggtgcgcagtcaacggccctggagcggcgctccagagaccagtcacagaccagaaaaagagtggccaataaaatcgctgaaggtatacttgggcgtgaaaaaaaaattgcggccccccacctgttggggattcactgtggtgcatgagactgaaaagcacgaaaagcagcaatggtacctgtgctgcgatacgcaaatggagctgagagagtggtttgccaccttcctcttcgtgcagcacgacgggctagtgtggcccagcgaaccctcccgtgtcagcagggccgtgcccgaggtacgattagggtctgttagtttaatcccccttagaggaagtgagaatgagatgagacggagcgtcgccgcctttacggctgacccactctccctgttgagaaacgtgtag

SEQ ID NO: 179388 - DNA, 3402 bp, Artificial Sequence
  Description of Artificial Sequence: Synthetic coding sequence
atgaccaagaaggaggagcccccccccagccgggtgccccgggccgtccgtgtcgcttctttgctctccgagggggaagaactgtcaggggacgaccagggggacgaggaggaggatgatcatgcctatgaaggggttccaaacggaggttggcatacttcctccctgagcctgagtctgccatccaccattgctgcacctcatcctatggacggaccgcccggcggttcgactccagtcacaccggtgataaaggccgggtggctcgacaaaaatcctcctcaggggtcttacatttatcaaaagcggtgggtcaggttagatactgaccatctgaggtacttcgactccaacaaggatgcttatagtaaaagattcatctcagtagcttgcatttcacacgtcgccgcgataggggatcagaaatttgaggttataactaataatcggaccttcgccttccgtgccgaaagcgacgtagaacgaaaggaatggatgcaggccctccagcaggccatggccgagcagcgggctagagctcgtctgagtagcgcatatctgctgggcgtccccggatctgagcagccagacagggctggatccctagaactgagagggttcaagaacaagctctatgtcgcagtcgtgggcgataaggtgcaactttacaaaaatttggaagaataccacttggggatcgggataacgttcatcgacatgtctgtgggcaacgtaaaggaggtagatagacgctcctttgaccttactaccccttacagaatttttagctttagcgctgattccgagctggagaaggaacagtggctcgaggcgatgcagggtgcaatcgccgaagccctatcaacttccgaagtggccgaaaggatatgggccgccgcccctaatcgcttctgtgcggattgcggagctccgcagcccgactgggcgagcattaacctttgtgtggtgatttgcaaacgttgcgcgggagagcacagaggtctcggggccggcgtcagcaaggtgcgatcactcaaaatggatagaaaggtgtggactgagaccttgatagaagctctctgcgctgctgtcacaacaaccgacctggctgagacacaagcattgttaggctgtggcgccggcattaactgtttttctggagatccagaagcacctacaccgctcgccctcgccgagcaggccggccagactcttcaaatggagttcctgcggaataacagaactacagaggtcccacggctggacagcatgaaaccattggagaaacactactctgtggtgctgcccactgtgagccatagcggcttcctttataagactgccagtgcaggcaaactcctccaagaccggcgggcgcgcgaagagttctctaggagatggtgtgtgctcggagacggagtgctgtcctactttgagaatgagagagccgtgactcctaacggcgagatccgggcctctgagatagtctgcctggccgtcccgccaccagacacccatggttttgagcatacctttgaggtgtatacagaaggagaacggctgtacctgttcggcctggagtccgccgaacaggcccacgagtgggtcaaatgtatagcaaaggctttcgtcccaccactggccgaagatctgttggcccgcgattttgagcggttaggccggttgccatataaggccgggctgtcactgcagagggctcaggagggatggttctccctgtcggggtcggaacttcgagcggtttttcccgaggggccctgtgaagaacctctgcaacttaggaaactgcaagagctctccattcagggcgacagcgagaatcaggtgctggttcttgtggagagaaggcggacactctacatacaaggcgagcggaggctcgactttatggggtggttgggcgcgatccagaaagccgcagccagcatgggcgacaccctttctgaacagcagctaggcgatagtgacatccccgtgatcgtctaccgctgcgttgattatatcacacagtgcggcctgacttccgagggcatctataggaagtgtggccagacatctaagacacagaggctgctggaatccctaagacaggatgctagatctgtgcacctgaaggagggagaacagcatgtcgatgatgtcagtagcgccctcaagagattccttcgcgaccttccagatggtttatttactcgcgcacagcgactaacctggctcgaagcctctgagattgaagacgaggaggagaaggtttcaaggtaccgtgagctgctggtacggctacctcctgtgaaccgcgcgactgttaaggccttaattagccatctctattgtgttcaatgtttttctgatactaatcagatgaacgtgcataatcttgccatcgtattcggccctactctattccagactgacggccaggattataaagccggaagagtcgtggaggacctcataaaccactacgtggtcgtgttttcagttgatgaagaggagctgaggaagcagcgggaggaaatcaccgcgattgtgaagatgcgagttgcagggactgcctccggcacccagcacgccggagactttatatgcaccgtgtacttggaagagaaaaaggcggagaccgagcaacatatcaaagtaccagcctctatgactgctgaggaactgaccctggaaattttagataggagaaacgtcgggatccgcgagaaagactattggacatgtttcgaagttaacgagcgtgaagaggccgaaagacctttacattttgccgaaaaggtgctgccaattttgcacgggctcggcaccgactctcacttggtggtcaagaaacatcaggcaatggaagccatgctgctctatcttgctagtcgggttggcgacacaaagcacggcatgatgaagtttcgggaagaccgttcgttgctgggtctgggactccccagtggaggattccacgatcgatatttcatcctgaactccagctgtcttaggctttacaaggaggtcaggtctcacagacctgaaaaggaatggccaatcaaatctctcaaagtctacctgggtgtgaagaagaagctgaggccccccacctgttggggatttacagtcgtacacgagaccgaaaagcacgagaaacaacagtggtacctgtgctgcgatactcagatggaactaagggaatggtttgccacttttctgtttgtgcagcatgacgggctagtgtggccatcagaaccttcacgggtgagcagagcagtacctgaggtgaggctgggcagtgtgagcctcatccccctgagaggaagcgaaaacgagatgaggaggagtgttgccgccttcaccgctgaccctctaagtctgcttaggaacgtctag

SEQ ID NO: 179389 - DNA, 4320 bp, Artificial Sequence
  Description of Artificial Sequence: Synthetic coding sequence
atggccgaggccggcgacgccgccctgagcgtggccgagtggctgcgggccctgcacctagaacagtacacaggactgtttgaacaacacggtctggtctgggctaccgagtgccagggactgagcgatacacgcctgatggacatgggtatgctgttacccggccacaggagacgcatactggctggcctcctccgagcccatacctccccagctcctgctccacggccgactcctaggcctgtgcctatgaagcgacacatattccgctctccccctgtcccagccacaccgccggagcccctgccaactactacagaagatgaggggctccctgctgcccctccaatcccaccccgtcgttcctgtctaccacccacgtgcttcaccaccccaagcacagcggccccagatccggtgttacccccactgcctgctaagcgccatctggccgagctatctgtgccaccggttcctccacgtactggcccacctcgcctcctggtctccttacccactaaagaggaagaatctctcttaccatctctgagctcacctccccagcctcaatctgaagaaccactgtctactctgccccaggggcctccccaacctccaagtccccccccatgccctccggagatacccccaaagcccgtcaggcttttcccagagtttgatgattctgactatgacgaagtccctgaggagggccctggcgcacctgcgcgcgtgatgactaagaaggaggagcctccaccgagtagggtaccccgcgccgtgcgggtggcctctctcctcagcgagggagaggaacttagcggggacgatcagggagacgaagaggaggatgaccacgcttatgagggagttccgaacgggggatggcataccagttcccttagcttatcactgcctagcacaatcgccgccccacaccctatggatggaccacccggcgggtctacacctgtgacccctgtgattaaggcaggatggctggataagaaccccccacagggtagctatatctatcagaaacgttgggtcagactcgacactgaccatctgcgctatttcgactccaacaaagacgcatactccaagcgatttattagcgtcgcctgtatttcgcacgttgccgcaattggcgaccaaaaatttgaagttataaccaataaccgcacatttgcattcagagcagaatcagacgttgaacgaaaagagtggatgcaagccctccaacaggcaatggccgagcagcgtgccagggccagactctctagcgcttatctcctcggggtcccagggtccgaacaaccagaccgtgcgggatcactggagctgcgaggcttcaaaaataaactctacgtcgccgtcgtcggtgataaagtacaactctataaaaacctggaggaatatcacctgggaattggtatcaccttcatcgacatgtccgtggggaatgtgaaggaagtcgatcggcggtcttttgatctgacaaccccttacagaatctttagcttctcagccgattctgaattagagaaggaacagtggcttgaggcaatgcaaggtgccatcgctgaggccctcagcacctcggaggtggccgagcggatctgggccgctgcaccgaacaggttctgtgctgattgcggggccccacaacccgattgggcatctattaacctgtgtgtagttatctgtaagaggtgcgctggcgagcatagagggttgggagccggggtcagcaaagtccggtcactcaaaatggaccgaaaggtgtggactgaaaccctcatcgagctgtttctacaactcggcaacggagcaggcaatagattttgggctgcgaacgtgcccccgtccgaggcgctgcagccttcctcatctccaagtactcgccgatgtcatttagaagcaaaataccgggagggtaagtatagaagataccacccactatttggaaatcaagaggaactcgataaagccctttgtgccgccgtcacgaccactgaccttgctgaaacacaagctttgttgggttgtggagccgggatcaactgcttctccggcgacccagaggcccccacgcccctcgcgctggccgagcaagccgggcaaaccttgcaaatggagtttctaaggaataaccggacaaccgaggtacctagactggacagcatgaaacctttagagaagcattattcagtggtcctacccaccgtctcacatagcggatttctttataagacagctagcgcaggtaagctcctgcaagataggcgcgctagagaagaatttagtcgaagatggtgcgtgttaggggatggcgttctatcctacttcgaaaacgaaagggcagtgacgcctaacggcgagatcagagcctcagaaatcgtgtgcctggccgtgccacctccggatacgcacggatttgagcatacctttgaggtgtatactgaaggcgaacgactatacttattcggtctggaatccgccgagcaggcccatgagtgggttaagtgcattgcaaaagcgttcgtcccaccccttgctgaggatctcctggcacgcgattttgaacgactgggccgtttgccttataaggcaggcctgtcactccagcgcgcacaggaaggatggttttctctctctgggtccgagctccgtgcagtgtttccggaggggccttgcgaggaaccactgcagctgcgcaaactccaggagctgtcaattcaaggcgacagtgaaaaccaagttttggttctggtggaaaggcgccgcacactttacatccagggagagcgccgccttgactttatgggatggctgggagctatacagaaggcagcagcttcgatgggggacaccctttccgagcagcagttaggcgactccgatatcccggtaatcgtgtacagatgtgtggactacattacccagtgcggcctcactagcgaagggatctatcgtaagtgcggtcaaacatcaaagactcagaggctgctcgaatccctgaggcaggacgcacggtctgtgcacctcaaagagggtgaacaacacgtcgatgacgttagctccgcactcaaacgattcctccgggacttgcctgacggtctttttacgcgtgcccagagactgacttggctggaggcctcagaaattgaggacgaagaggaaaaggtgagtcgttacagagagctgctcgtgcgcctgcctccggtaaatagagccaccgttaaagcccttatttcacatttgtactgtgtgcaatgtttctccgataccaatcagatgaacgttcacaatctagctatcgttttcggacctacactctttcaaaccgacgggcaggattacaaggcaggacgtgtggtcgaggacctcatcaaccactatgtggtcgtgttctccgtggacgaagaggagttaagaaagcaaagagaagagatcaccgcgatagttaagatgagggtcgctgggacggctagcgggacccagcacgccggcgatttcatttgcactgtctatctcgaagaaaagaaagctgagacggagcaacacattaaggtgcccgcgtccatgacagcagaagagctgactctggagatcctcgaccgccgtaacgtgggcattcgggaaaaggattattggacctgctttgaggtgaatgagcgggaggaggccgagcggcccctgcactttgcagagaaggttctgcctatcctccacggacttgggactgactcacacctggtcgtcaaaaaacatcaggccatggaggctatgcttctctatttggcatcacgtgtaggcgacactaagcatggaatgatgaagttcagggaggatagatccttactcgggctcggcctgccaagcggtggcttccacgacaggtactttatccttaactcctcatgcctcaggttatataaggaagtaaggagtcatcggccggagaaagaatggccgatcaaatcactgaaagtttatcttggcgtcaagaaaaagctgagacctcctacatgttggggattcaccgtggtgcatgaaacggagaagcacgagaaacagcagtggtacctgtgttgtgacacacaaatggagcttcgggaatggtttgcaaccttcctgtttgtccaacacgatggccttgtctggccctccgagccgtccagagtgtcgcgggccgtgcctgaggtgcgcctaggttcggtgagcctgatcccactgcgtggaagtgaaaatgagatgcgaaggtcagtcgctgcttttaccgccgatcctctcagcttgcttagaaacgtgtag

SEQ ID NO: 179390 - DNA, 5115 bp, Artificial Sequence
  Description of Artificial Sequence: Synthetic coding sequence
atgagcagcgtgagcgaggtgaacgtggacatcaaggacttcctgatgtccatcaatctcgagcaatacctgctgcactttcacgagagcggattcacaaccgtgaaggactgcgccgccattaacgatagtctgctgcagaaaatcgggatctctcctaccggccaccgccgaagaatcctgaagcagctgcagataattctaagtaagatgcaagacatcccaatctatgctaatgtgcacaagactaaaaagaatgacgacccctcgaaagattaccacgtgcctagcagtgaccagaatatttgcattgagctctccaactcaggatccgtgcaaaccagcagtcctcctcagttagagacagtccgaaaaaacctggaggactccgatgcaagtgtcgagcgtagccagtatcctcagagtgatgataagctgtcaccccctaagcgggatttcccaacagctgaagagcctcacttaaatcttggctccctgaacgactctctcttcggcagcgacaacatcaagattgaatcactgatcacaaagaaaaccgtggatcacaccgtagaagagcaacagaccgagaaggtaaagctaatcaccgagaatttgtccaaactcccaaatgccgattccgagtgcctgtccttcgtgggatgcagcacaagcggcacgaattcagggaacggtacaaacggattactggagggtagcccaccctccccattcttcaagttccaaggggagatgattgtgaacgacttatacgtgccgtcctctcccatcctggcgcccgttcggtcccgaagtaaactcgttagcaggcctagccggtcatttctgctccggcataggccggtacctgagatccctgggagtacaaaaggcgtcagtggatcctactttagggagcgacggaacgtggccacgagcactgaaaagtctgttgcttggcagaatagcaatgaggaaaactcctctagcatttttccctacggagaaacgtttctcttccagcgtctagaaaactccaagaagcgtagcattaagaatgagttcctgacacagggagaggcactgaagggtgaagcggcaaccgcaacaaatagcttcattattaaatcaagcatctacgataataggaaggagaaaatcagtgaggataaagtggaagatatctggatcccacgagaggacaaaaataacttccttatcgatacagcttctgaatccgagtatagcaccgttgaggaatgttttcagagcctgaggagaaagaactccaaggccagcaaaagtcggacacagaaggctcttatcctcgatagcgtaaatcggcatagttaccctctcagttcaacatccgggaacgctgactcttctgccgtgtcttcccaagcaatttcaccctatgcatgtttctatggcgcatctgccaagaaagtgaagtctggatggcttgataaactctcaccccagggaaaaaggatgtttcagaagcgatgggttaagttcgacggactcagtatctcttattataacaacgaaaaagaaatgtacagcaaggggatcatccctctgagcgcaatcagcaccgtgcgagtgcagggagataacaagttcgaagtagttaccacacagcgtacgtttgtgttcagagtcgagaaggaggaggagcgaaacgactggatttcaattctgctgaacgctctaaagagccagtcattaaccagtcagtctcaggccgtggttacccccgaaaaatgtggctacctcgagttgagaggttataaggccaaaattttcactgtcttatccggtaactctgtgtggctatgcaaaaatgaacaggatttcaaatccggcctgggaattactatcattcccatgaatgttgccaatgtgaaacaagtcgaccgaacagtcaagcagtcctttgaaataataacgccctacaggtctttctcttttaccgctgagaccgaaaaggagaaacaagactggatagaagcagtgcagcagagcatcgcagagacacttagtgattatgaagtggccgaaaaaatatggtttaacgagagcaacaggagttgcgcggactgtaaggcccctgatccagattgggcaagcatcaatctctgcgttgtgatctgcaagaagtgtgccggacaacaccgcagcctaggtcccaaggactccaaggtccgctctcttaaaatggacgcatcaatctggagtaacgagctaatcgagctcttcatagtgatcggaaacaagcgggcgaatgacttctgggccggaaacctgcagaaggatgaagagctgcacatggacagcccggtggaaaagcggaagaactttattacccagaaatacaaagaggggaagttcagaaaaacccttctggcatccttaacgaaagaggagttgaacaaagccctttgcgccgccgtggttaaaccagacgtgcttgagacgatggccctgctgttctccggagcggacgtgatgtgtgcgaccggggatcccgtccacagcactccatacttgttagcaaaaaaggcaggccagtccttacaaatggagtttttatatcataacaagtttagtgacttccctcagcacgatatacatagcgaaggggtgctgtctcaagaatcctcccagtctacttttctctgtgacttcctgtaccaggccccaagtgctgcatcaaagctttcttcagagaagaagctgctggaggagacgaataagaaatggtgcgtactggaaggaggctttctgtcatattacgaaaacgataaatcaacaacaccaaatggaaccataaatatcaacgaagtgatctgtctcgctatacacaaagaggacttctacctgaacaccggtcccattttcatctttgagatctatctgccaagcgaacgggtatttctgtttggggcagaaactagccaggcacagagaaagtggacggaggcaatagccaagcacttcgtgcctctgtttgctgaaaacctcactgaagcagattacgatcttatcggtcaactcttttacaaggattgccatgcattggatcaatggcgaaagggatggtttgctatggacaaatcctcgctgcacttttgtcttcagatgcaagaagtgcagggcgacaggatgcatctgagacgtcttcaggaactgactatcagcacaatggtgcagaatggagagaaactggacgttctattactggtcgaaaaaggtcggaccctctacattcacggccatactaaactggacttcacagtatggcataccgctattgaaaaagctgccggaactgacggaaacgctctgcaggatcagcaattgtctaagaacgacgtaccaataatcgtcaattcctgtattgccttcgttacccagtacggcctcggctgtaaatatatatatcagaaaaacggagatccactgcatattagcgagctgctggagagttttaaaaaggacgcccggtcattcaagctccgagcaggaaagcaccagctggaagacgtgaccgctgtgctcaaatcattcttatctgacatagacgacgccttgctcacaaaagaactgtacccctattggatcagtgccctggacacgcaggacgacaaggagcgcattaagaagtatggggccttcatccgttcgcttccgggcgttaaccgtgcaacgcttgcagctattatcgaacatctgtatcgagtgcagaaatgttcagaaataaaccatatgaatgctcacaacctggcacttgtattctcttcttgtttatttcagactaaaggacagacatctgaagaggttaatgtgatagaagatctgattaacaattatgtagagatctttgaggtgaaagaagaccaggtgaaacaaatggatatagagaattctttcatcaccaaatggaaggatacacaggtgtcccaagcaggtgacctgttgattgaggtgtacgtggagcgcaaggagcccgactgctctatcattatccggatttcccccgtgatggaagcagaggagctgactaacgacattcttgctatcaaaaacataatcccaacaaaaggggacatctgggccacattcgaggttatcgagaatgaggaactcgagaggcccctgcactacaaagaaaacgtgcttgagcaagtgctgcgctggagtagcttagcggagccagggtctgcctatttggttgtgaagcgttttctgacggccgataccatcaagcattgctctgaccgctctacgctgggtagcattaaggagggcattttaaagatcaaagaagagccatccaaaatcctcagtggcaataaatttcaggacaggtacttcgttctgcgcgacggatttctgttcctgtataaggatgtaaagtcatctaagcacgataagatgttctccttgtctagtatgaaattctatcgcggagtgaagaaaaaaatgaaaccccctacaagttgggggctgaccgcctactccgaaaagcaccattggcacttgtgctgtgattccagccgtacacaaacagagtggatgacatctatattcattgcgcagcacgagtatgatatctggcctcccgcaggcaaggaacggaagcgctccatcaccaagaacccaaaaattgggggcctgcctttaattcctatccagcacgagggcaacgctactctcgctagaaaaaatatcgagtcagcccgcgccgaactggaacggctgaggctgagcgagaaatgcgacaaagaatctgtggacagttctctgaaagagagagcttcaatggtggcccattgccttgaacataaggatgacaagctgaggaatcgaccgcggaagcaccgctcattcaactgtctggaagacactgagcctgaagcacctctgggtcagccaaagggccacaagggtttgaaaaccctgcgtaagaccgaggacagaaactccaaagccacactggactcagaccataaactgccttcccgcgttattgaggagttgaatgtggtgctccaacggagcaggacactccccaaggagctgcaggatgaacagatcctcaagtag

SEQ ID NO: 179391 - DNA, 144 bp, Artificial Sequence
  Description of Artificial Sequence: Synthetic coding sequence
atgagcagcgtgagcgaggtgaacgtggacatcaaggacttcctgatgagcatcaacctagagcagtacttactgcatttccatgaatcagggtttactacggtcaaggattgcgcggccatcaatgattctttattgcagtag

SEQ ID NO: 179392 - DNA, 3399 bp, Artificial Sequence
  Description of Artificial Sequence: Synthetic coding sequence
atgcggagcagcgccagccggctgagcagcttcagcagccgggactccctgtggaatcgcatgccggaccaaatcagcgtaagtgaattcattgccgagaccactgaagactacaacagcccaacaacctcttccttcactacccgattgcataattgccgcaacacagtcactctactagaagaagcactggatcaggacagaacagcgctccagaaagttaagaagagtgtgaaagcaatttacaattcaggacaggaccacgttcagaatgaagagaactatgcacaggtgctcgataagtttggaagtaattttctgtctcgggacaaccccgacctaggaaccgccttcgtgaaattctctacactgacaaaagaattgtcgactctgctgaaaaacctgctccagggcctgtctcacaatgtgatcttcactctggattccctcttaaagggagatcttaagggggtaaagggcgacctcaaaaaacccttcgataaagcatggaaagactacgaaacaaagtttaccaagatcgaaaaagagaaaagggaacatgccaagcaacatgggatgatccggaccgagataactggggctgaaatagcggaagagatggagaaagaacgcagactgttccagctgcagatgtgcgaatacctgattaaggtgaacgagataaaaacaaagaaaggcgtagacctgctgcaaaacctcatcaagtattatcatgcccagtgcaacttctttcaggacgggttgaagacagctgataagctgaagcaatatatcgaaaaactggctgcagatctgtacaacatcaagcagacacaggatgaagagaaaaagcagctgaccgctctgcgtgacctcatcaagagttctctgcaactggatcagaaggaggcacggcaggatagtcaatcgcgccagggaggctacagcatgcaccagcttcaggggaacaaagagtacggaagtgaaaagaagggctacctcctcaaaaagtcggatggtatacgcaaggtgtggcagcggcgaaaatgttctgtgaagaacggaattcttactataagccacgcgaccagtaatagacagcctgcgaaactcaacctgttaacatgtcaggtgaagcccaacgccgaggataaaaagagtttcgacctcatctcccataatcgaacttaccactttcaggctgaggacgagcaggattatgttgcctggatttctgtccttactaactctaaggaagaagctctaaccatggcgttccgtggcgagcagagtgccggcgagaatagtcttgaggacctaacgaaggcaatcatcgaggatgttcagcgattgcccggcaatgacatttgctgtgactgcggaagttccgaacctacttggctctccaccaatctgggaattctgacatgcattgagtgttctggtattcaccgcgaaatgggggtgcacatcagccgtattcaaagtttggaacttgataaattaggaactagtgaacttctgcttgccaagaatgtaggaaacaactccttcaacgatattatggaagcaaatttgcctagccctagcccaaaacccacaccgagctcagacatgactgtgagaaaagagtatataaccgccaaatatgttgaccatagattttcccgcaagacttgctccacttccagtgcaaagttgaatgagctgctggaagcgatcaagtccagagatcttctggcgcttatccaggtctatgcggaaggggtcgaactcatggaaccactattggaacctggccaggaactgggcgaaaccgccctacacctcgcagtccgcaccgcagatcagacctccctccacttggtggactttcttgtgcaaaattgtggtaatttggacaagcagactgccctcgggaacaccgtgctgcactactgctctatgtattcaaagccagagtgtctgaagcttttgctgaggtcgaaacccacagttgacattgtgaaccaggccggcgagactgctctggatattgctaaaagattgaaggcgacccaatgcgaagacctgctgagccaggccaagtccggaaaatttaatccccacgttcacgtggaatatgagtggaatctcaggcaggaggagattgatgaatctgatgacgatctagatgataaaccatctcctattaaaaaagagcgcagcccccgtccgcagtccttttgccacagctccagtatctctccccaggacaagctcgcgctacccggcttcagtacccctcgagataagcagagactgagctatggagcgttcaccaatcagatattcgtttcaacttctacggacagtccgacaagtcccacaactgaggcacccccattacctccacgaaatgccggtaagggacctaccgggccacccagcacacttccgcttagtacacagactagtagcgggtcaagtaccttgtctaagaaacgtcctcctccaccccctcccggtcataaaaggacgctgtccgaccctccgtcccccctgccccatggtccacctaataagggagccgttccttggggcaatgacggtgggccttcaagcagcagcaaaactacaaataagtttgaaggactctcccagcagagcagtacgtccagtgcaaagacggctctgggtccccgggttctccctaagttgcctcaaaaagtggcgctgcgtaagaccgatcacctttccttggacaaagccacaatccctcctgagatttttcagaaaagctcccagttggccgagctgccacaaaaacctcccccaggggatctgccgccgaaacccacagaactggcgcctaagccgcagataggggacctgcccccgaagccgggtgaactgccaccaaaaccccaactcggagacctgccacccaagccacagttgagtgatctgcccccaaagccccagatgaaggatttgccaccaaagccccagctcggggacttactggccaagagccagactggcgatgtgagcccaaaggcccagcagccttcagaggtcacgctcaagagccacccactggacctgtcccccaatgtgcagtcccgcgatgccatccaaaaacaagcatctgaggatagcaacgacctgacgccgacattacctgagaccccggttcctctccctagaaaaattaacacgggaaaaaataaggtgcgtcgtgtgaaaaccatttacgactgtcaggctgataacgacgacgaactgacatttattgagggcgaagtaattattgtcaccggagaggaggaccaagagtggtggattggacacatagaaggacaacccgaaagaaaaggggtgtttcccgtgtccttcgtgcacatcttatcagattag

SEQ ID NO: 179393 - DNA, 3390 bp, Artificial Sequence
  Description of Artificial Sequence: Synthetic coding sequence
atgcggagcagcgccagccggctgagcagcttcagcagccgggactcactctggaacaggatgcctgaccagatttctgtgagcgagtttatcgcggagacaacagaggattacaactcaccaactaccagcagttttacaacccgcttacacaattgccgcaacaccgtaacattgcttgaagaagccttggatcaagaccgtaccgcgctgcagaaggtcaagaagtccgtaaaggccatttacaactcgggccaggatcacgtacagaatgaagagaactacgcccaggtgctggacaagttcggctcgaattttctgtcaagagacaatcctgatcttggaaccgctttcgtcaagttctccactctcactaaggaactctctacattgctgaaaaatctgctgcaaggcctgagccacaatgtgatttttacactggatagtctgttgaaaggggatttgaagggcgtgaaaggtgatctaaagaagccttttgacaaggcatggaaggactatgagacgaagtttactaaaatagagaaagaaaaacgagagcacgctaagcagcacgggatgattcggaccgaaattacaggcgcagagattgctgaagaaatggagaaggaacggcgacttttccagctgcagatgtgcgagtacctgatcaaggtgaacgagatcaaaaccaagaagggcgtcgacctgcttcagaacttaatcaaatactaccacgcacagtgtaacttcttccaggacggcctgaaaaccgcagacaagctgaagcaatatatcgaaaaactcgccgccgatctttataatataaagcagacacaggacgaggaaaagaaacagctcactgccctgcgagatctgattaagtcttccttgcaactagaccagaaggaagactctcaatccagacagggtggatattccatgcaccaactccagggcaataaggagtacgggtctgagaagaaggggtacctactcaaaaagagtgatggcatccgcaaggtttggcagcgacgcaagtgcagcgtgaaaaacgggatccttacaatctctcatgccacatcaaatcgccagccagcaaaactgaacctattaacttgtcaggtcaaacccaatgctgaagacaagaaatcatttgacctgattagccacaatcgaacctaccacttccaagcagaagacgagcaagactatgttgcttggatttcagtactgaccaattctaaagaagaggctctgacaatggctttcagaggcgagcagtcagccggtgagaatagtctagaggatctcacgaaagcaataatcgaggacgtgcagcgactgccgggcaacgatatttgttgcgattgtgggtcaagtgaacccacatggctctccactaaccttgggatcctcacgtgcatagagtgcagcggtatacatagggaaatgggggtccacattagtagaattcagtctttggagcttgacaagctcggaactagcgaactgctcctggctaagaatgtaggcaataattcgtttaatgacatcatggaagcaaaccttccctctcctagccctaagccaacaccttcctctgatatgacagtccgtaaagagtacatcactgcaaagtacgtggaccatcgattctctagaaagacctgctccacatcctcagcaaagttgaacgagctcttagaagcgatcaagtccagagatttgctcgcgctgatacaagtctacgcagaaggcgtcgaattaatggagccacttctggagcccggccaggaactgggagaaaccgcactgcatctagccgtcagaacggccgaccagacatccctgcatctcgtcgacttccttgtgcagaactgtgggaatctggacaagcagaccgccttgggcaatacagtattacactactgttccatgtattcgaaaccagaatgtctgaagttgctgttaagatcaaagcccaccgtggatattgttaaccaagcaggggagactgcattggatatcgccaagcgccttaaggctactcagtgcgaagatcttctgtcacaggccaagtcgggcaaattcaatccgcacgtacatgttgaatatgaatggaatctgcgccaggaggagattgacgaaagcgatgatgacctagatgataagccgagcccaatcaagaaggagcggtcccccaggcctcagtcgttctgtcacagctcctctatatctcctcaagacaagttggcgttaccaggtttctccaccccgagagacaaacagcgtctcagctatggcgcattcacaaaccagatattcgtgtccacgtctacagactctcccacgagccccacaacagaggcccctcctttaccaccgaggaacgccgggaagggcccaaccgggcctccatcgaccctgcccctcagcacacaaacatcgagcggcagctctaccttaagtaagaagcgaccaccgccaccccccccggggcataaaagaactctgtctgatcccccaagcccacttccacacgggccaccaaacaagggggccgtcccgtggggaaatgacggagggccttcgagtagttctaaaaccactaataagtttgaaggccttagtcagcaatcctccaccagtagcgctaaaacagccttgggcccgagagttttgcctaaattaccacaaaaggtggccttgaggaagaccgaccacctgagcctcgataaagcaaccattccgcctgaaatcttccaaaagtcttcgcagctggccgaactgcctcagaaaccaccccccggcgacctgcctccaaagccaacagaacttgcacctaaacctcagattggagacctgccacctaagcccggggaactgccacctaagccgcagctaggagacctccctcccaagccacaactcagtgacctgcctccgaagccccagatgaaggaccttccacccaagccacaacttggcgatctgcttgcgaaaagccagacaggagatgtgtcacctaaggcccagcagccaagcgaagtgacactcaagtcccaccctctggatctgagcccaaacgtgcaatctagagatgccatccagaagcaagcatctgaggactccaacgatttgacccccacactgcccgaaacgcccgtgccacttccccgaaaaattaacacagggaagaacaaggtgcgccgcgtgaaaacaatttatgattgtcaggccgacaatgatgatgagctgacctttatcgaaggggaggtgatcattgtgacgggagaggaagatcaagagtggtggatagggcatatcgagggtcagccggagcgcaagggagtcttccctgtgagcttcgtgcatatcttaagtgactag

SEQ ID NO: 179394 - DNA, 3390 bp, Artificial Sequence
  Description of Artificial Sequence: Synthetic coding sequence
atgcggagcagcgccagccggctgagcagcttcagcagccgggacagcttgtggaatagaatgcctgatcagatctctgtgtctgaattcattgcagagacgaccgaagattacaactcccctacaacttcttcctttaccactcggttacataactgcaggaatacagtcacactgttggaggaagccctagaccaggatcgtacagcgctgcagaaagtgaagaaatctgtcaaagccatttacaactcaggccaggatcatgttcagaatgaggagaattacgctcaggtgctggacaagttcggatcaaattttctcagtcgggataatccggatctggggaccgcctttgtaaaattctcgacactgaccaaagagctgagcactctcttgaagaacctgttacagggtttgagccataacgtcatctttacgctagatagcctgcttaaaggcgatctgaagggcgtgaaaggggatctgaaaaaaccctttgataaagcttggaaggattatgagacaaagtttaccaagatcgaaaaagagaagcgcgaacacgctaaacagcatggaatgattaggaccgagattaccggagcagaaatcgccgaggagatggagaaggaaagaaggctgttccagctgcagatgtgtgagtacctgatcaaagtcaatgagatcaaaaccaagaagggggtggatctgctgcagaacctgataaaatactaccatgcacagtgtaatttctttcaggacgggctgaagaccgccgataagctgaaacagtatatcgagaagctggccgccgatctatacaacatcaagcagacacaggatgaggaaaaaaagcagctgacagctctgagagacctgataaagtcatcgttacagttggaccagaaagaagatagtcaatcaagacagggcggatattcgatgcaccagcttcagggcaataaggaatatggctctgagaagaaaggctatctgctcaaaaagagcgatggtattagaaaggtgtggcaaagaaggaaatgttctgtcaagaatggcatactgacaatatcccatgccactagtaacagacaaccggccaagttaaaccttctgacttgccaagttaagcctaacgccgaagacaagaaaagtttcgacctcataagccacaatcggacttaccatttccaggccgaggacgaacaggattacgtggcctggattagtgtcctcaccaattccaaggaagaagcgctaacgatggcgtttagaggggagcagtcggcaggcgaaaacagtctggaagatctcactaaagctattattgaagacgtacagcgcctgcctgggaacgacatctgctgtgactgtggtagctctgaacccacgtggctcagcaccaacctgggaatcctcacatgtattgagtgcagcggtatccaccgagagatgggcgttcacatttctaggatccaatcactcgaactagataagctggggacctcagagttactgttagccaagaacgtcggcaacaacagcttcaacgacattatggaagctaacctgccctctccctcacctaagcccacgccgagttcagatatgaccgtgcgtaaggagtatatcactgccaaatacgtcgaccatcggttttcaaggaaaacttgttccacatccagtgccaaactaaacgagctgctggaggccatcaagtcccgggaccttttagcactgatccaggtgtacgcagagggtgtggaactgatggaacctctgctggagcccggacaagaactgggagagaccgcactccacttagccgtaagaacagcagaccaaacttctcttcacctggtggatttccttgttcaaaactgcggtaatctcgataagcagactgcccttggtaacacagttctgcactactgttccatgtattccaaacctgaatgtctgaaactcctgctgaggtccaaacctactgtcgacatcgtcaatcaggccggcgagacagctctggacattgccaaacgcctcaaagccacgcagtgtgaggacctgctgtctcaggccaagtctgggaagttcaatccccacgtgcacgtggagtacgagtggaaccttcggcaggaagagatcgacgaaagtgacgatgatttggacgacaagcccagcccgatcaagaaagaaaggtcaccacgccctcagtccttttgccattcatcctccatcagccctcaggacaagttggccctccctggattctccactcccagagataaacagcgtctctcctatggagcttttactaaccaaatattcgtctctacgtctacagactcaccaacgtccccaacaaccgaggctcccccccttccgccgaggaacgccggcaagggtcccactggccctccctccactctcccccttagtactcagacatcaagcggtagtagtacactttctaaaaagcgtccccctcctcctccaccaggccacaagagaacactgtctgatcccccaagcccactgccccatggcccacctaacaagggagctgttccctggggaaatgatggaggccccagctcttccagcaagacaacaaataagttcgaggggctgtcccagcagtcttcaacctccagtgccaagactgccttgggacctagggtgttaccaaagctgccccagaaggtggctttgcgcaaaactgatcacctgagcctggataaggcaaccattccgcctgaaatttttcagaaatccagtcagctggccgaactgccccagaaacccccccctggcgatttgccgcccaagccaactgagttggctccaaagcctcagataggagacctgcctcctaagcctggcgaactgccccctaagcctcagctgggagacctacccccaaaaccccagttgtctgacctgccgcccaagccccaaatgaaggacttgccccccaagccgcagctgggagacctgcttgcaaaatctcagaccggcgatgttagcccaaaggcacaacagccgtcggaggtgacattaaaaagtcaccccctggacctgtcccccaacgtgcagtccagggatgcaattcagaaacaggccagcgaggattcaaacgacctgacacctacccttcccgagacacccgttcccctgccaagaaagatcaacactggcaaaaataaggttagaagagtcaagaccatatatgattgccaagctgataacgatgacgaattaacctttatagagggggaggtgatcatcgttacaggagaggaggatcaagagtggtggatagggcatatagagggacaacccgagcgaaagggggtattccccgttagcttcgtgcacatactgtcagactag

SEQ ID NO: 179395 - DNA, 1065 bp, Artificial Sequence
  Description of Artificial Sequence: Synthetic coding sequence
atgagcctgcggggcagcctgagccggctgctgcagacccgggtgcattccattttaaagaaaagcgtgcacagtgtagctgtgatcggggctcccttcagtcagggccagaagcggaaaggggttgagcatggacccgcagcaattcgtgaggctggccttatgaagaggctcagctcccttgggtgccatctgaaggactttggcgatcttagcttcactcctgtgcctaaggacgatttatataacaacctgattgtgaaccccagaagtgttgggctggctaaccaagagctggccgaagtcgtgagccgggcagtgtcagatggttattcatgtgtcacactaggcggtgaccactccctggccattggcaccatcagcggccatgctcgccactgtcctgatctgtgtgtcgtgtgggttgatgctcacgccgatatcaatacccctcttaccaccagttctggcaatcttcacggacaacccgtgtcattcttgctacgcgagctgcaggacaaggtgccacagctccccggcttttcttggataaagccatgcatatcaagtgcctccatcgtatatatcggcctgagggacgtcgaccctccagaacatttcattctgaagaattacgatatccaatatttttcaatgcgggatatcgaccggcttggaatccagaaagttatggaaagaaccttcgacttgctaatcgggaaacggcagcgccctatccacctttcatttgacattgatgcattcgacccaactttggctcctgccactggcacgccggtagtgggcggactgacctatagggagggtatgtacatcgcggaagaaatacacaacacgggccttctgagtgcgctggacctggtggaggttaacccacagctcgctacctccgaagaggaagccaaaacaaccgccaacttggcggtagacgtcatagctagtagctttgggcagaccagggagggtggccatattgtgtacgaccaattgcctactccatcttcacctgacgagagcgagaatcaagcccgagtgcggatctag

SEQ ID NO: 179396 - DNA, 207 bp, Artificial Sequence
  Description of Artificial Sequence: Synthetic coding sequence
atgaagctgaacgagaagttcagcgagggctggcggaagcccaacgcatcctggaagtcttcgtgttctaagaactccagcgacagggacaaactgtctctgccacacaaaaaacttgagagagggtcctggcgggtttggcagccccgatcaacgctgtgccgcacccttgataaaaccgaggaggagcgcgctaagcgtgagtag

SEQ ID NO: 179397 - DNA, 429 bp, Artificial Sequence
  Description of Artificial Sequence: Synthetic coding sequence
atgaagctgaacgagaagttcagcgagggctggcggaagcccaacgcatcatggaagtcgagctgtagtaagaattccagcgacagagataagttatcgctcccacacaagaagttggaacgtggaagctggcgcgtctggcaaccccggtccacactgtgtcgcacactggacaagacagaggaagagcgggccaaaagagaggagctagagcggattcttgaggaaaacaatcggaagatcgccgaagcgcaggccaaacttgccgaagaacagctgaggatcgtggaggaacaaagaaaaattcatgaggagaggatgaaactcgaacaggaacgtcaaagacaacagaaggaagagcagaagatcatccttgggaagggcaagtctagacctaaactgagcttctcactgaaaacacaggattag

SEQ ID NO: 179398 - DNA, 822 bp, Artificial Sequence
  Description of Artificial Sequence: Synthetic coding sequence
atgggccggagccggagccggagcagcagccggagcaagcacaccaaatcctcaaagcacaacaaaaagagatcccgatcccgcagccggagtagagacaaggagagagttaggaaacgcagcaagagtcgcgagagcaagcgaaaccggagaagggagagccgatccaggtctagatcaactaatactgctgtgagcaggagagagcgcgatagagagagagcatccagcccacccgatcgcatcgatatcttcgggcgcaccgtctcaaagcgctccagtctcgatgagaagcagaagcgggaggaagaggaaaaaaaggctgagtttgagagacagaggaaaatccgtcagcaagaaatcgaggagaagctgattgaagaggaaactgcccgcagggtagaggaacttgtggctaagagggtagaagaagaattagagaaaaggaaagacgaaatcgaacgtgaagtcctccggcgagttgaagaagccaagcgaattatggaaaagcagctactagaagagctggagaggcaaaggcaggccgagctcgctgcacagaaggctcgtgaagaggaggagagagctaagcgagaggagctcgagagaatcctagaagaaaacaataggaagattgccgaggcccaagcaaagcttgcagaagagcagcttcgcatcgtggaggaacaacgaaagattcatgaggaacgcatgaaactggaacaggaacgccaacgtcaacagaaagaggaacagaagataatactgggcaaaggaaaaagtcggcctaagctgagttttagtctgaagacgcaggactag

SEQ ID NO: 179399 - DNA, 672 bp, Artificial Sequence
  Description of Artificial Sequence: Synthetic coding sequence
atgggccggagccggagccggagcagcagccggagcaagcacaccaagtcgtcaaagcacaataaaaagcgagcaagtagcccccctgacagaatcgacatctttgggagaaccgtaagtaagagaagcagtctcgatgagaagcagaagagagaggaggaagagaaaaaagcggaatttgagcgacaaagaaagatcagacagcaggaaattgaggagaagctgattgaagaggagaccgctcgacgggtcgaggaactggtcgccaagcgagtcgaggaagaactggagaaacgaaaagacgaaatagagagagaagtcctgcggagggtggaggaggctaagagaattatggaaaagcaactgctcgaagaactggagagacagagacaggccgagctggctgcccagaaggctagggaggtcaccctcggccggcttgaaagtcgggactctccttggcagaatttccaatgttgggtgcttccccctgctcagttccggaagcggtggaacacggattacctgattcctttctcctcgaaacttaatatcgccgcaaaagtcaatttcctcgcttattcagaagtgctcaccgacaatctgaaggtgggtagcttttacaagacatacagccgaatcctgtttgatctcatggagctggcaatttag

SEQ ID NO: 179400 - DNA, 495 bp, Artificial Sequence
  Description of Artificial Sequence: Synthetic coding sequence
atgcccgacaccatgctgcccgcctgcttcctgggcctgctggccttctcttccgcatgctacttccagaattgccccagaggcggcaagcgcgcaatgtcagatctggagctgcgacaatgtctcccatgtggccccggcggcaaggggaggtgttttggacctagtatatgctgcgcggacgagctgggatgctttgtcggaacggcagaagcgctgaggtgccaagaagagaactacctgccaagtccctgccagtctggtcaaaaggcctgcggatctggcggtagatgcgctgccttcggtgtctgctgcaacgacgagagctgcgtgacagaacccgagtgtagagagggcttccaccgcagagcccgcgctagcgacagaagcaatgctacccagctcgatggtcccgctggagcactgctactgcgtctggtgcagctggccggagcccctgagcccttcgagccggcacagcccgatgcatactag

SEQ ID NO: 179401 - DNA, 1257 bp, Artificial Sequence
  Description of Artificial Sequence: Synthetic coding sequence
atgcggctgagcgccggccccgacgccggccccagcggcaacagcagcccttggtggcctttggcaaccggggcagggaatacatcgagagaagctgaagccctcggagaaggcaacggaccccctcgcgacgtccgtaatgaagagcttgctaaactggaaattgcagtgctcgcagtgaccttcgccgtcgcagttttgggcaatagcagtgtactgctggcgcttcacagaacaccccggaagacttcaagaatgcatctgtttattagacacctgtcccttgccgatcttgctgtcgcattcttccaagtgctgccccaaatgtgttgggatatcacataccgcttcaggggccctgattggctgtgtagagtggtcaaacacctccaagttttcgggatgtttgctagtgcttacatgctggtggtgatgaccgctgacaggtacatagccgtatgccacccattaaaaacacttcaacagccggcgaggagaagcagactgatgattgccgccgcctgggttctgtcctttgtgctgagcacacctcagtacttcgtgttctccatgattgaggtaaataatgtgacaaaggccagggattgttgggcaacttttatccagccatggggcagtcgggcctatgtgacctggatgactggcggtattttcgtggccccggtggtgattcttggaacctgttacggcttcatttgttacaacatatggtgtaacgtaagagggaaaactgccagccgacagtcgaaaggagcagaacaggccggagttgcctttcagaagggatttctcctggctccatgcgtcagttcagttaagagcatcagccgggctaaaatacggactgtaaaaatgacatttgttatagtaaccgcttacattgtgtgttgggcacccttctttatcattcagatgtggagcgtctgggatcccatgagcgtgtggaccgaatcagaaaacccaaccattacgattaccgccctactgggttcactgaacagctgctgtaacccttggatttatatgttttttagcggccacctcttgcaggactgtgtacaatctttcccctgctgtcagaatatgaaagagaagttcaataaagaggatacagattccatgtcaagacgccaaactttctacagcaataatcgcagtcccactaattcaactgggatgtggaaggattcacccaaaagcagcaagtctattaaattcatacctgtgtcaacttag

SEQ ID NO: 179402 - DNA, 1275 bp, Artificial Sequence
  Description of Artificial Sequence: Synthetic coding sequence
atggacagcggccccctgtgggacgccaaccccaccccccggggcacactgagtgccccaaatgccaccaccccgtggttgggccgcgatgaggagctggcgaaagttgaaatcggcgtcctggcaaccgtgctggtactcgcaactggaggcaacctggccgtcctgttaacactcggccagctggggaggaagcggtccagaatgcacttgttcgttttacacctggctcttaccgaccttgcggtggcactgtttcaggtgttgcctcagctcctctgggacataacctaccggttccaaggacctgacctgctgtgcagggccgtgaaatacctgcaggtgcttagtatgttcgccagcacatacatgctcttggccatgactcttgatcgatatctggccgtatgtcacccccttcgtagcctgcagcagcccggacaaagtacatatctgctgatcgccgctccttggctcctggctgcgatctttagcctgccacaagttttcattttcagcttgagggaggtgatacagggatctggcgtgctggattgctgggccgacttcggcttcccctggggtcctagggcgtaccttacatggacaacacttgcgatttttgttctccccgtgacaatgttaaccgcctgttattctctcatttgtcatgaaatctgcaagaatctcaaagtcaaaactcaggcatggagggtgggtggaggcgggtggcggacatgggatagacctagtccgtctacgctggccgccacgacaagaggattgcctagccgcgttagctcgatcaacacaatctcacgagcaaaaatccggaccgtcaagatgactttcgtaatcgttttagcttacatagcatgctgggctccctttttttccgttcagatgtggtcagtttgggataaaaatgcccccgacgaggacagtaccaatgtggcgtttacaatatcgatgctgctggggaacctgaactcttgctgtaacccatggatctacatgggctttaactcacatctgcttccacggcctctgaggcatctggcatgttgcggcggtccacagccacgaatgaggcgccggctatccgacgggtctctgagttcccgccacactacgcttcttacccgtagttcatgcccagctacactgagtctatcactcagcttgactctgtctggaagacctagacccgaggaatctcctagggatctcgagttggccgacggcgaaggaaccgcagagaccatcatcttctag

SEQ ID NO: 179403 - DNA, 1116 bp, Artificial Sequence
  Description of Artificial Sequence: Synthetic coding sequence
atgctgatggccagcaccaccagcgccgtgcccggccaccccagcctgcctagtttacctagcaatagttcacaggagcgccctctcgacacccgcgatccactgctcgcacgagcagagcttgccctcctgtcaatcgtgtttgtggccgtcgctctttctaacggtctggtgctggcggccctggcccgcagaggacgccgcggccactgggcaccaattcacgtattcattggccacctctgcctcgctgatctggccgtcgcattatttcaagttctgccccagttagcatggaaggccacggatcgcttccgcgggcctgacgccctgtgccgcgccgtgaaatatttgcagatggtgggtatgtacgctagttcctacatgatcttggctatgacactagaccgccaccgagctatttgcagacctatgcttgcctacaggcatgggtccggcgcccactggaaccgccccgtgctggtcgcctgggcattcagtctcctgttgagcctgcctcagctgttcatctttgcccaaagaaatgtcgagggaggttctggtgttactgactgttgggcctgttttgcggaaccctgggggcggcgtacttacgtgacatggatagccctcatggtctttgtggctcctacgcttggcatcgctgcatgccaggtgttgatttttagagaaatccacgcttctctggtccccggcccaagcgagcgacctgggggtcgtcgcaggggcagaagaaccggcagccctggtgaaggggcacacgtctcggcggcagtcgcgaagactgtccggatgacactggtgatcgtggtcgtgtatgtgctgtgctgggctccattttttttggttcagctttgggcggcatgggatcctgaggcccccctagagggggcaccttttgtgctcctgatgctgctagcgagcctgaacagttgcaccaacccttggatttacgcttccttttcatcaagcgtgtcatctgagctgagaagtctattgtgttgtgcccgtgggcggaccccacccagcctggggccccaggacgagagctgtacaacggccagtagctccttggccaaggatacaagctcatag

SEQ ID NO: 179404 - DNA, 1116 bp, Artificial Sequence
  Description of Artificial Sequence: Synthetic coding sequence
atgctgatggccagcaccaccagcgccgtgcccggccaccccagcttgccatccctgccttctaactcatcgcaagaacgccctctggacacaagagatcctctgcttgctcgcgcagaactggcattgctttccattgtgttcgtggctgtggcactatcaaacggccttgtgctagctgccttggcccgccggggaaggcggggccactgggcacctattcacgtgtttatcggccatctttgcctcgcggacttagccgtagctctctttcaggttcttcctcagctcgcctggaaggcaactgatcgatttagagggcccgacgccctctgtagagcggtgaaatacctgcagatggtgggaatgtacgcatcctcctatatgatcctggctatgaccctcgataggcacagggccatttgtagaccaatgttggcatatcggcatggaagcggcgcgcattggaaccggcccgtcttggttgcttgggccttttccctgctgctcagcttaccccaactctttatcttcgcgcagcgcaatgtggaaggcggcagcggtgtcactgactgctgggcatgcttcgcagagccttggggaaggcgaacttacgtgacctggattgcgttgatggtattcgtggctccaactttaggcatagccgcatgccaggtcctgatttttcgggaaatacacgcatctttagtgcccgggccatcagagaggccaggcggtagacgtcgcgggcgccggaccggttcacctggcgagggcgctcatgtcagcgcagcagttgccaagaccgttagaatgactctagttatcgttgtcgtgtacgtgctatgttgggctcccttctttctggtacagctgtgggccgcctgggaccccgaggcccctctcgagggagccccctttgtcctcctgatgctcctggcatctctgaactcatgcacgaacccttggatctatgctagctttagtagctctgtgtctagcgaactcagaagtcttctatgttgtgcgcgcgggagaactcccccgtcgctcggtccacaggacgaatcgtgcactacggcttccagctctctggcaaaggacactagctcttag

SEQ ID NO: 179405 - DNA, 930 bp, Artificial Sequence
  Description of Artificial Sequence: Synthetic coding sequence
atgctgatggccagcaccaccagcgccgtgcccggccaccccagcctgccaagtttaccctcaaatagttcccaagaaagacctttggataccagggaccccctccttgcacgcgctgaactcgccctcctgagtatcgtctttgtggcagttgccttaagcaatggtctggtgctagccgctcttgcacgtcgggggcggcggggtcattgggctcccattcatgtttttattgggcacctgtgtcttgcagatctggccgttgctctgttccaggtccttccgcaactcgcttggaaggctaccgatcgctttaggggccccgacgctctttgcagagccgtgaaatacttacagatggtggggatgtatgcctcaagctacatgatactcgcaatgacactggatcggcaccgcgcgatctgccggcccatgctggcgtacaggcacgggagcggcgctcattggaacagacccgtgctggtcgcatgggctttcagcctgctgctcagtctgcctcagctgttcatcttcgcccagcggaacgtggaaggcggttctggggtaaccgattgttgggcctgcttcgcggagccttggggtcggcggacctatgttacgtggattgctctcatggtgttcgtggcaccaaccctgggtatcgccgcgtgtcaggttctgatttttcgcgagattcacgcctctcttgtgcctggcccgtcagagagaccagggggccgccgtcgtggccgcagaaccggtagcccaggagaaggagctcatgtgagtgcagcagtcgccaagacagtaagaatgaccctcgtgattgtagtggtgtacgtgctatgctgggcgccattttttctcgttcaattgtgggccgcctgggaccccgaagcacctctcgagggaggatgtagccgaggctag

SEQ ID NO: 179406 - DNA, 1005 bp, Artificial Sequence
  Description of Artificial Sequence: Synthetic coding sequence
atgggccggcggagcagcgacaccgaggaggagagccggagcaagcgtaagaagaagcataggagaagaagctcatcctcatcctctagcgacagcaggacgtactcccgcaagaagggaggaaggaagagccggtccaagagtcgatcatggtctcgcgacctccagccaagatcgcattcttatgataggcgccgtagacatcgctcttcctcatcttcatcctatggcagcagacgcaagcgtagccgtagcaggagtaggggtagggggaaaagctatcgggtgcagaggtcaaggagcaagagccgaactcggcgttctcgctcccgacccaggctgagaagccacagccggagctcggaacgctctagtcaccggcgcacacgctcccgttctcgcgatcgcgaacggcgcaagggcagagataaggaaaagcgcgaaaaggaaaaggataaagggaaggacaaagagctacataatatcaagaggggggagtcaggcaatattaaggcaggattagagcacctgccacctgccgagcaagcgaaggcccgcctgcagctggtgctcgaggctgccgctaaggccgatgaggcgctgaaggccaaagagcgaaacgaagaggaggcaaagcgaaggaaagaggaggaccaggcgacacttgtggagcaagtcaaaagagtgaaggagatcgaggccattgagagcgatagctttgtgcagcagactttccggtcctccaaggaggttaaaaagtccgttgagccgagcgaagtgaagcaagctacatcgaccagtggaccagctagcgcggtggctgaccccccatcaacagaaaaggaaatcgaccccacaagcatccccacggccatcaagtaccaggatgataattcgctcgcgcaccctaacctattcattgagaaggccgatgcggaggaaaagtggtttaagaggttgatcgcactccggcaggaacggctcatgggttccccagtggcctag

SEQ ID NO: 179407 - DNA, 831 bp, Artificial Sequence
  Description of Artificial Sequence: Synthetic coding sequence
atgggccggcggagcagcgacaccgaggaggagagccggagcaagagaaagaagaagcacaggcggagaagctcatcctcttcttctagcgattcccggacatactcaagaaagaagggtgggcgaaaatctcgttccaagagccggtcatggtcaagggatctgcagcccagaagtcacagttatgataggcgtcgccgacatagatcatcttcaagtagttcatacgggagtagaaggaagagaagtcggagccgcagtcgcggtcgcggaaagtcttaccgcgttcagcgctcaaggtctaaatctagaacccgtagagaaagcggcaatatcaaggcaggcctcgagcatttgccacccgccgaacaggccaaagctaggctgcagctcgtgctggaagccgctgctaaggccgacgaggcattgaaagccaaagagcgcaacgaggaggaagccaagcggcggaaggaagaagatcaagccaccttggtggaacaggtgaagagggtaaaggaaatcgaagctatcgaaagcgatagctttgtgcagcagacattcaggtcttctaaagaagtcaagaagagcgtggagccaagcgaagttaagcaggcaacttcgacctcaggaccagcgtccgcggtggcagatccgccgagtaccgagaaggagattgatcccactagcattccaacagccatcaagtaccaggatgacaattctttggctcatcccaacctgttcatcgaaaaggccgacgccgaggaaaagtggttcaagaggcttatcgcgctgcggcaggagcgcctgatgggttcacctgtggcttag

SEQ ID NO: 179408 - DNA, 831 bp, Artificial Sequence
  Description of Artificial Sequence: Synthetic coding sequence
atgggccggcggagcagcgacaccgaggaggagagccggagcaagcggaaaaaaaagcatcggagacggagctcatctagttctagcagcgacagtcgcacttatagccgaaagaagggaggccgtaagagccgtagcaagtcgagatcctggagccgggacctgcagccacggtctcattcatacgatagaaggaggcgccaccggtcttcgtcttcctcctcctacggcagccgccggaaacgctctagatctcgcagcaggggcagaggaaagtcataccgcgtccagcgttcacggtccaagtcacgaacacgccgagaatctggaaatatcaaggcaggcctcgagcatctgccccccgcggagcaggctaaagcccggctacagctggttctagaagccgccgcgaaagctgatgaagccttgaaagctaaagagcggaacgaggaggaggccaagcgaagaaaggaggaagatcaggctacccttgttgaacaagtcaagagagtcaaagaaattgaggccatcgaaagtgactcctttgttcagcagacatttagaagcagtaaagaggtaaagaaatctgtcgaaccctcggaagttaagcaggcaaccagcacaagtggacctgcatcggcagttgccgatccccccagcacggagaaagagatcgaccctacatccattcccaccgctattaagtaccaggacgacaattcactggcacatcccaatctcttcatcgaaaaagccgatgctgaggagaagtggtttaagcgcctcatcgccttgagacaggagcgccttatgggtagcccggtggcatag

SEQ ID NO: 179409 - DNA, 612 bp, Artificial Sequence
  Description of Artificial Sequence: Synthetic coding sequence
atgggccggcggagcagcgacaccgaggaggagagccggagcaagcggaagaagaagcacaggcggcgtagtagctcctcaagcagctccgatagtaggacctattcacggaaaaagggcggcaggaagtcccggagcaaatccaggtcatggtctcgtgaccttcaaccaagaagtcacagttatgacaggcggcgccgtcacaggtcttccagtagctcctcctacggtagcaggcggaagcgcagccggtcccggagcagaggacgagggaagagctacagggtccagagatctcggagcaagtcccggaccaggcggtccaggagccgccctcgcctccggtcccactcgagatcctctgagcgttcctcacaccgcagaactcgtagtagatcacgtgaccgcgagaggaggaagggccgtgacaaagaaaagcgcgagaaagaaaaagacaaggggaaggataaagaactgcacaatattaaacgtggtgagtccggcaacataaaagctggattggaacatttgccacctgcagagcaggctaaagcccgcctccagctggtgctggaggcggccgcgaaggcagatgaggcactgaaggcctag

SEQ ID NO: 179410 - DNA, 585 bp, Artificial Sequence
  Description of Artificial Sequence: Synthetic coding sequence
atgggccggcggagcagcgacaccgaggaggagagccggagcaagcgaaaaaaaaagcaccgaaggagatctagctcatctagctccagcgattcgcgtacttattcgcggaagaagggaggaagaaaaagcagatcaaaaagccggagctggtcccgggacctgcagcctcgatcacattcttatgaccgcaggaggaggcaccgctccagcagctcttcgtcttatggctcaagaagaaagaggtctcggtcaaggagcagaggtcggggtaagtcttatcgcgtgcagcggagccggtccaagtcccggacacgccggagtcgcagcaggccacgcttacgttctcacagccggagtagtgaacgatcctctcaccggcgcacaaggtcgcgctcacgagatcgggaacggaggaaaggtagagataaagagaaaagggaaaaagaaaaagacaagggcaaagacaaggaattacacaatataaaaaggggtgagagcggtaatattaaagccggtctcgagcacctacctccagccgagcaagcaaaagcccggttacagctggtgttggaggccgcatag

SEQ ID NO: 179411 - DNA, 1005 bp, Artificial Sequence
  Description of Artificial Sequence: Synthetic coding sequence
atgggccggcggagcagcgacaccgaggaggagagccggagcaagagaaaaaaaaagcatagacggcggtcttcttccagttcatcctccgacagcagaacttattcacgcaaaaagggtggtagaaaaagccggagtaaaagtagatcttggagccgagatttacagcctagaagtcattcttacgacaggcggcgccgtcatcgctcctcctccagtagcagctatggtagtaggaggaagaggagtagaagccgctcccgaggtcgcgggaagtcctaccgggtgcagagatcccgcagcaagagccgtactcgaagaagccggtcaagacctagacttaggagccatagcagatccagcgagcgaagctcccaccgacggacacggtcccgatcccgggacagagaaaggcggaaaggccgggacaaagaaaaacgcgagaaggaaaaagataagggcaaggacaaggagctccacaatatcaagcggggcgaaagcggcaacatcaaagcggggttagagcacttgcctccagcagaacaggccaaggctaggctgcagctggtgttggaagcagcagcaaaagccgacgaggccctgaaggcgaaggagcggaacgaagaggaagccaaaagaaggaaggaggaagaccaagccacacttgttgaacaggttaagcgcgtcaaggagattgaggcgatcgagtccgattcttttgtccagcagacattccgctcttctaaagaggtgaagaaatctgtcgagccctctgaggtaaagcaggcaacctctacaagtggtcctgcaagcgccgtcgctgatcccccatccaccgagaaggagattgatcccacgagtattccaactgcaattaaataccaggacgataacagccttgcccatcctaatttattcatcgaaaaggccgacgctgaagaaaagtggtttaaaaggctgatagctcttaggcaagagaggttgatgggtagtccggtggcctag

SEQ ID NO: 179412 - DNA, 498 bp, Artificial Sequence
  Description of Artificial Sequence: Synthetic coding sequence
atgggccggcggagcagcgacaccgaggaggagagccggagcaagcgaaaaaagaagcatagaaggcgcagcagcagctcttccagctctgactcgagaacctacagtagaaagaaaggagggaggaagtcacgcagcaaatctcggtcctggtcccgcgatctgcaaccacgctcacattcttacgaccggcggagaagacacaggtcatcctcatcaagtagctatggatcccgtagaaagaggtcacggtcaaggagtagaggtcgcggtaaatcctatcgtgtgcagcggagtcggagtaagtcgcgcactaggcgttccaggtcacgtccacgattgcgcagtcattcaaggagttctgagaggagctctcatcgacgaacccggtcaagaagccgcgatcgagagaggcggaagggacgggataaggaaaaacgcgagaaggagaaggacaagggaaaagataaagagctccacaacataaagaggggctag

SEQ ID NO: 179413 - DNA, 948 bp, Artificial Sequence
  Description of Artificial Sequence: Synthetic coding sequence
atgcggaaccggatggcccccgagaacccccagcccgaccccttcattaatagaaactactctaatatgaaagttattccccctcaggatcccgcttcacccagctttaccctgttgtctaagctggagtgcagtggaaccgttagtgcttattgctcattaaacttgcccggctcgactgatccccccacctccgcatcgagagtagccgccaccaccgcaattagaaggaggcataaggagcggacatcattcactcatcagcagtatgaagagctggaagccctcttcagccagactatgttccccgatcgaaacctgcaggagaagctcgccctgaggttggacctgcctgaaagcactgtgaaggtgtggttcagaaaccgacgttttaagctgaaaaagcagcaacagcagcaaagcgccaagcagagaaaccagatcctgccttccaagaaaaacgttcccacaagccctcgaacatccccgtccccctacgccttcagtccggtaattagcgatttttacagctctcttccttctcagccgctggacccctccaattgggcctggaacagtacattcaccgagtctagtactagtgatttccagatgcaagacacacaatgggaacggctggtggctagcgttcccgcactgtattccgatgcctacgatatcttccaaatcatagaactgtataatctgcctgatgagaacgaaattagttcaagtagtttccattgtctttatcagtatttatctccaacaaagtatcaagtggggggccaggggtctagtctcagcatttttgccggtccagcggttggactctctccagcgcagacatggcctaatatgacgtctcaagccttcgaagcatattccttaactgattccctggaattccaaaaaacatctaatatggtggacttgggctttttatag

SEQ ID NO: 179414 - DNA, 4701 bp, Artificial Sequence
  Description of Artificial Sequence: Synthetic coding sequence
atgaccgccgacaaggacaaggacaaggacaaggagaaggaccgggacagagacagggatagggagcgcgagaaaagagacaaagcgcgcgagtcagaaaactcccggccaaggcgctcctgtacactcgaaggaggcgccaagaattatgccgaaagcgaccattcagaagatgaagataacgacaataactccgcgacagctgaagaaagcacaaagaaaaataagaaaaagcccccgaagaagaaaagtcggtacgaacgcactgacaccggagaaattacttcttacattacagaggacgatgtcgtgtataggccaggagattgcgtctacatcgaatcacgacgccccaacactccatatttcatctgttctatccaggatttcaagttggttcacaactcccaggcctgctgtaggagccccacacctgcgttgtgtgatccaccagcgtgcagcctacccgtggcctctcagccgccccagcatctctccgaggccggaaggggcccagttggctccaagcgggaccacctgctcatgaatgtcaaatggtattacaggcagagcgaagtcccagattccgtctaccagcacctcgtgcaggacagacacaacgagaatgactctggtcgggagttagtgatcaccgaccccgtaattaagaaccgcgagctgtttatatctgactatgttgacacatatcatgccgcggccttgagaggtaaatgcaatatatcacactttagcgatatctttgccgcccgggagtttaaagcccgagttgatagcttcttctatatcctaggttacaatccggagacccgccggctaaattctacccaaggtgagattagggtgggccccagccaccaggccaaattgcccgaccttcagccttttccgagtcccgatggtgatacggtgacgcagcatgaagaactcgtgtggatgccgggggtcaatgactgcgacctgctcatgtatctcagggctgcaagatctatggcagccttcgccggcatgtgcgatggggggtccaccgaggacggatgtgttgctgccagcagggatgatactaccctcaatgctttaaacacgttgcatgagagcggatatgatgctgggaaagctctgcagcgactggtcaagaaacccgtgcccaaattgatagaaaagtgctggacggaggatgaagtgaagcgatttgttaaaggcttaagacaatatggtaagaacttttttcgtatcaggaaagagctacttcccaacaaggaaacaggagagctgattacgttttattactattggaaaaaaacccccgaggccgccagctctcgggcccacaggcggcaccggcgtcaggcggtgttccgtcgaatcaaaactaggacagctagtacccctgtcaataccccaagtcgcccccctagttctgaattcctcgacctcagtagtgccagcgaagatgattttgattctgaggattcagaacaggagctgaaagggtacgcatgcaggcactgttttacaacgacctccaaagattggcatcacggaggacgggagaacatcctcctgtgtactgactgcaggatccactttaaaaagtacggagaacttccacctattgaaaaacctgtggatcctccccccttcatgttcaagcctgtgaaggaggaagacgatggcctatctggtaaacacagcatgagaacacgcaggtccaggggatctatgtccacgttaaggagtggaagaaagaagcagccagcgtctcccgacggaagaacatcgccgatcaacgaggacatcagatcttccggacgcaattccccttcagcagcgtcaacatccagcaacgatagcaaggccgaaactgtgaagaaaagcgctaagaaggtgaaggaggaggcttccagcccactgaaaagcaataaaaggcaacgagagaaagttgcatctgacacggaggaggctgatagaacttcttccaaaaagactaaaacacaggagatcagtaggccaaactctcctagcgagggcgagggggaaagcagcgattcgcgtagcgtcaatgacgaggggagcagcgacccgaaggatattgaccaagacaaccggtctacctccccaagcattcctagcccccaggataatgagtctgactctgattcttctgcacaacagcagatgctccaagcccagcctcccgccctccaggcccccactggtgtcaccccggcaccatccagcgctccacccgggacacctcaactccctacccctgggccaaccccgtccgctacagccgtgcccccccaggggtcgcctactgccagtcaagcccccaatcagccccaggcaccaacagcaccagttcctcacacccacatccagcaggcaccagcgctccatccgcagcggccgccaagtccacatccgcctcctcatcctagccctcatcctccactgcagcccctgaccggctcagctggacagccttccgcaccctcccatgctcagcctccattgcacggccagggaccgcctggaccccatagtttgcaggccggcccgttgctgcagcacccgggacctcctcagcccttcgggttgcccccacaggcctctcaaggacaggcccctctcggcacctctcctgctgcggcctatccacacacatccctgcagctgccagcaagccagtccgcacttcagtcccagcagccccctcgcgagcagcctctccctcctgcccctctggcaatgccacacattaaaccgcctcctactacgcctatcccccagctgcctgccccacaggcgcacaaacatcccccccatctgtccgggccatctccctttagcatgaatgctaatcttcctccaccaccagctctcaaacccttatcatcactgagtactcatcaccccccttccgcgcaccccccccccttgcagctcatgccccagagtcagcccttgcccagctcacctgctcagccacctggattgacccaatcccaaaatctgcctcctccaccggctagtcacccgcctacaggcctgcaccaagtggccccccagcctccattcgctcagcacccatttgtgcccggtgggcccccgcctattacacctcccacctgccctagtacttcgactccgcctgccgggcccggcacttccgcacagccaccgtgttctggggcagccgcctctggagggtccatcgccggaggcagtagctgtcccctcccaaccgtgcagattaaagaagaagctttagacgacgcggaggagcccgaatcgccacccccgcccccccgttccccttctccagagcctactgtcgtggacacaccctctcatgcctctcagtctgctcgattttataagcatctggatcgtggatacaacagctgtgccagaacggacttatacttcatgccacttgctgggtctaagctggccaaaaagcgagaagaggcaatagaaaaagctaaacgggaagctgagcaaaaagctagagaggaaagggagagagaaaaggagaaggaaaaggagcgcgaaagggagagagaaagggagagagaagctgagagggctgccaaggcatcatccagcgcccacgaaggtaggctatctgatccccaactgtccggacctgggcatatgagaccatcattcgagccccccccgaccactatcgctgcggttccaccatatatcggtcccgatacaccggcgctgcggaccctgtccgaatatgcacggcctcacgtgatgtcccctaccaaccggaatcatccattctatatgcccctcaaccccacagacccgttgcttgcttaccatatgcctggcctgtataatgtcgacccaactattcgcgagagggaattgcgggagagggaaattcgcgaacgagagatcagggaacgggagctacgggagagaatgaagcctgggtttgaggtcaagccgcctgaactcgatccactgcaccctgcagccaatcccatggagcacttcgctaggcattctgccctaactatccctccaacggctggaccccaccctttcgcaagtttccatcctggattgaacccactcgaacgggaaaggctcgctctcgctggaccacagctgaggcccgaaatgagctacccagataggctggcagccgagcgtatccacgctgaacgcatggcaagtctgactagcgaccccttggcccgcctgcaaatgttcaacgtgaccccgcatcaccaccaacatagccacattcacagccacctccacttgcaccagcaggatcccttacatcagggcagtgctgggccggtccatcccctcgtggacccactgaccgcgggtccccacttggctcggtttccctaccctcccggcaccctgccaaatcccctgctcgggcagcctccacatgaacacgagatgctgaggcatcccgtatttggtactccataccccagagatctacctggcgcgataccccctcctatgtcggccgcacaccaactgcaggcaatgcacgctcagtcagcagagctgcagcggctcgcaatggagcagcagtggctgcatggccacccacacatgcatggaggccatctgccatcacaggaagactactactcaagactgaaaaaggaaggagataaacagctctag

SEQ ID NO: 179415 - DNA, 3897 bp, Artificial Sequence
  Description of Artificial Sequence: Synthetic coding sequence
atggacgaccccttcagcccctgccggcggctgaacagcacccagggggagatccgggtcggcccttctcaccaggccaagctccctgacctgcagcccttcccctctccagatggggatactgtcacacagcatgaggagcttgtctggatgccgggcgtcaacgattgcgacctgttaatgtatttgcgcgctgcacggtccatggcagccttcgctggaatgtgtgacgggggcagcacagaagatggatgcgtggccgcaagcagagatgatacgactcttaacgccctgaatacgctccatgagtccgggtacgacgcaggcaaggcactacagaggcttgttaagaaacccgtgcctaaattgatagaaaaatgttggacagaagatgaggtgaagagattcgttaaagggttgcggcagtacggaaaaaacttcttccggattagaaaggagttacttcccaataaagagacaggcgagctaattacattttactattactggaaaaagactccggaggccgcctcatctagagcacatcggcggcacagaagacaagccgttttccgccgcataaaaactaggactgcatccacacccgtaaatacaccgtcaaggccgccgagtagcgaatttcttgacctgtccagtgcctcggaggacgactttgacagtgaggactccgaacaggagttgaagggatatgcctgtcgccactgctttacaaccacaagtaaagattggcatcacggcggcagggagaatattcttttgtgtactgactgccggatccactttaagaaatacggagaacttcccccaattgagaaacctgtcgacccgcccccgttcatgttcaaacccgttaaagaagaagacgacgggttaagcggcaagcattcaatgagaacccggaggagccgaggaagcatgtcaacactgcgcagcggcagaaagaagcagcccgctagccctgatgggaggacctcacccattaatgaagacatcagaagctcaggccgcaactctccaagtgctgctagtacctcatccaacgatagcaaggccgaaaccgttaagaagagtgctaaaaaggtgaaggaggaggcatccagtccactcaaaagcaacaaacggcaaagagagaaagtggcctccgataccgaagaggccgaccgcacgtctagcaaaaagacgaaaacgcaggagattagcaggcccaactctccatccgaaggggaaggagagagtagcgatagtaggtctgtgaacgatgaagggtcatcagatcctaaagatattgatcaggataaccgttccacctctccatctataccctctccacaggacaatgagtccgattctgactcgtctgcccaacagcagatgctgcaggctcagcctcccgcgctacaggcaccgaccggggtgacaccggccccctcttccgccccacctggtacaccccagctgccgactcctgggccaacccccagtgcaacagccgtcccaccccagggcagtcccaccgcttctcaggctcccaatcaacctcaagcacctacagcacccgtgccacatacgcatatccagcaagcccctgccctgcacccacagaggcctcccagcccgcacccccctccacacccttctccccacccccccctgcagccactaacaggttcagcaggccagccatccgcgccttcacatgcccagcctcctctccacgggcagggccctccggggcctcattccttacaagcaggtcctcttctgcagcaccctggaccaccacagcctttcggcctgcctccccaggcaagccaaggtcaggcaccactggggaccagccccgctgccgcttacccccatacctccctacaattgccggcttctcagtcagctttacagagccagcaacctccccgcgagcagcctttgccacctgcgccactcgcgatgccccacatcaagcctccacctacaactccaataccgcaactcccagcccctcaggcccataagcaccccccgcacctgtccggcccatcaccattctcgatgaacgctaacctgcccccccctccggccctaaagcccctctcctccctaagtacacatcatcccccctccgcccaccctccgccattgcaactgatgccccagtctcagcctttgccctcttcgcccgctcagccccctggcctaacccaaagccagaatctccctccgccacccgcctcccaccctccaactggcttgcatcaagtcgcaccgcagccacctttcgctcagcatccatttgtgcccggaggaccgcctcctataacacccccaacatgccccagcacgagcaccccccccgctggtcctgggacctcagcgcagccaccatgtagcggtgcagctgcctctggcggtagcattgctggcggcagttcatgtcccctgccaacggtccagataaaggaggaagcgctggacgacgctgaggaacctgaaagtcctccccccccacctcgatcaccgtctcctgagccaactgtggtggacacgccctcacatgcctcccaatccgcccgattttataaacacctggaccgtggatataatagttgtgcaagaacggatctttattttatgccactggctggcagtaaacttgccaaaaaacgtgaagaggccatagagaaagcaaaacgtgaagccgaacagaaggctcgggaagaaagagagcgagagaaagagaaggagaaggagagggagagagaacgagagagggagagggaagctgagcgggcagccaaagcctccagttcagcccacgaaggtaggctcagtgatcctcagctgagcgggccaggccacatgagaccttcctttgagccaccccccacaacgattgccgccgtgccaccatatatcggtcctgacacgcctgcgctgcgcacgctgtctgagtacgctcggccccatgtgatgagccctacaaaccggaatcacccattctatatgcctcttaacccaacggatccgctcctggcttaccatatgccaggtttatacaatgtggacccaactattagagagagagagctccgcgagcgcgagattcgagaacgtgagatacgagagagggagcttcgcgagcgcatgaaaccaggattcgaggtgaaaccccctgagttggaccctctccacccagccgctaaccccatggagcattttgctcgacactcggcacttacaattcccccgactgctgggcctcatccattcgccagtttccatccaggattgaacccccttgagcgcgagagactcgccctcgctggtccacagctgcgccctgaaatgagctatccagatagactagcagccgaacgcatccatgccgaacgcatggcctcgcttacatccgatcccctggctagactgcagatgtttaatgttaccccacatcatcaccagcactcacatatacacagccatctgcacctgcatcagcaagaccctcttcaccagggaagtgctgggccagttcacccgcttgtggatccccttaccgcgggccctcacctagctaggtttccatacccacccggaacactcccgaacccactgcttggacagcccccacatgaacacgaaatgctgcgacatccagtgtttggtactccatacccccgcgatctgccgggggctatccctcctccaatgtcggcagcacaccagttacaagctatgcatgctcaaagtgcagaactgcagcgtcttgccatggagcaacagtggctgcacggtcatccacacatgcacggaggtcaccttcccagccaggaagactattacagcagattgaagaaagaaggtgacaagcaattgtag

SEQ ID NO: 179416 - DNA, 4701 bp, Artificial Sequence
  Description of Artificial Sequence: Synthetic coding sequence
atgaccgccgacaaggacaaggacaaggacaaggagaaggaccgggatagggatagagatcgggaacgggagaagagggacaaggcaagagagtcagagaattctaggccgaggcggagctgtacactcgaggggggggccaaaaattacgctgaaagcgaccactcggaggatgaagacaatgataataattcagctacagcggaggaatcaacaaaaaagaacaagaaaaagcctcccaaaaaaaagagccgctatgagaggacagacacaggagagattaccagctacataacggaggatgatgtggtgtacagaccaggcgattgtgtgtatatcgaatctcggcgccccaataccccctactttatatgttccatacaggattttaagcttgtgcataactcacaggcatgctgtcgcagtcctacgcctgcactgtgtgatcccccagcttgcagcctacctgttgcgtctcagccaccgcagcatttgtctgaagccggccgggggccagttggaagtaagagagatcatctcttaatgaacgtgaaatggtattaccgacaatcagaggttccggactccgtgtatcaacacctcgtgcaagaccggcataacgagaacgactccggacgagaacttgttattactgatccagtcattaaaaaccgggagctgtttatttctgattacgttgatacataccatgctgctgcactccggggaaagtgtaatatttctcactttagcgatattttcgcagccagagagtttaaagctcgggtggactcctttttctatatcctagggtataacccggaaacacgtcggttgaattctacacagggcgagatccgagtgggccctagtcaccaggccaagctgcccgatctgcagcctttcccatcccctgacggcgacactgttacccagcatgaagagctggtctggatgcctggggtgaacgattgcgacctgctgatgtacctgagagcggccagatccatggcagcgtttgccggaatgtgcgacggcggatccactgaagatggatgcgtcgccgcctccagggatgatacaaccctgaatgcgctgaacacgctgcacgaatccggctatgacgccggcaaagctcttcagcgactcgttaagaaacccgttcctaagctgatagagaaatgctggacagaagacgaagtgaaaagatttgttaaagggctgcgccagtatggtaagaacttttttagaattagaaaggaactgctgcccaacaaagaaactggcgaactgataacattttattactactggaagaaaactcccgaagctgctagttcgagggcccacaggcggcacagacggcaggctgtgttcaggagaatcaaaacccggactgcaagtacccccgtgaatacaccaagccggcctccctcatccgagttcttagacctaagctccgcgtctgaagacgactttgactccgaggactccgaacaagagctcaagggttacgcttgtcggcactgcttcacaacaacgtctaaagattggcatcacggagggagagaaaacattttgctgtgcacggactgcagaatccacttcaagaagtatggagaacttccccctatcgagaaacctgtggacccaccacctttcatgttcaagcccgtgaaagaggaggacgatgggttgtccgggaagcacagcatgagaacgcgtcgcagccgcggctcgatgtctactttgcggtccggaagaaagaagcagcccgctagccccgatggccggacttcaccaatcaatgaggatatcaggtcaagcggcagaaattctcctagcgctgcatcaacaagctccaacgattcaaaagctgagactgtaaagaagtctgctaaaaaggtcaaagaggaggccagttcacctcttaagagcaataagcggcagcgggagaaagtcgctagcgacaccgaggaggccgaccggacaagctctaagaaaactaagacgcaggagatttctagacccaactctcctagcgagggagaaggagaaagcagcgattcccgatccgtgaacgacgaaggttccagcgacccaaaagacattgaccaggacaaccgctccacctcgccctctatcccttcaccgcaagacaatgagtctgactctgattcatccgcccagcaacaaatgctccaggctcaacctcctgccctgcaagccccaacgggcgtgacacctgctccctcttcagctccacccggtaccccccaactgccgacaccggggccaacaccgtcagccaccgccgtccctccccaggggtcacctacagcatcacaggcaccgaaccaaccccaggcccctaccgctcccgttccacatactcacattcagcaggcacccgcccttcatcctcaacgcccaccgagtccgcatccccctccacacccctcacctcaccctccactgcagcctctcaccggatctgccggccagccttctgctccgtcgcatgctcagcctcctctgcacgggcaaggtcctcctgggccccacagcttacaggctggccccctcctgcaacaccctggcccccctcagccgttcggtctccctccacaggcttcccaagggcaggcgcctcttggtaccagccccgccgcagcctatcctcatacctcccttcagctgcctgcctctcagtcagcccttcagagtcaacagccccctcgggagcagccattgccccccgcgccattggccatgcctcatataaaaccaccacccactacccccatcccccaactgccagccccacaggctcacaaacaccccccacatctgagcggccctagcccttttagtatgaacgccaacctaccgcctcctcctgctctaaagcccctgagctccctttcaacccatcatcccccatcagctcaccctccgcctctgcaactgatgccccagagtcagcctcttccatcaagtcctgcccagccaccaggactgactcaatctcagaatcttccacctcctccagcatcccatcctcccactggcctgcaccaggtggcaccgcagcctcctttcgcacagcacccattcgtgccagggggtccccctcctattacaccccctacatgcccatccacttcgaccccccctgcaggacccggtacaagtgcccagccaccatgctcaggtgcagccgcctcaggcgggagcattgccggcggcagttcctgtcctcttccaacagtgcagatcaaagaagaagcactcgacgatgctgaggaacccgagtctccccctcctccccctcgctctcccagcccagagccaacagttgtcgatacgccgtcccatgctagccagtccgctaggttttacaagcaccttgatcgcgggtacaattcttgcgcacgcaccgatctctactttatgcccttggccgggagcaagctggctaagaaacgcgaggaagcgattgaaaaagcaaaaagagaggctgaacaaaaggcccgtgaggaacgcgaaagggagaaggagaaggagaaagagcgggaaagagagagagaaagggagcgggaagccgagcgcgccgctaaggcctcttcatctgcccatgagggccggctgtctgatccccagttaagcggcccgggccacatgcgcccctcttttgagccaccacctacaacaattgctgctgtgcctccctacatagggccagacacgcccgccctccggactctttctgagtacgctaggccccacgtaatgtctcctactaatcgcaaccaccctttttatatgcctctcaacccaactgatccgctccttgcgtaccacatgcccgggttatacaacgtggaccccaccatccgagaaagagagctgcgtgagcgggaaatccgggaacgcgagattagagaacgggaactgcgggagcgcatgaagcctggatttgaagtgaaaccgccagagctcgaccctctgcaccctgccgcgaaccccatggaacacttcgctagacattcagcactgactattccaccaaccgccgggccacatccctttgcctcctttcacccaggcttgaatccacttgaaagggagcgcctggctctggccggcccccagcttaggcctgagatgtcttaccccgaccgcttggcagctgagcgcattcatgcggaacggatggccagcctgacgagtgatcccctggctagactgcaaatgttcaatgtcacacctcaccaccaccagcacagtcatatccatagtcaccttcatcttcaccagcaagacccactgcaccaaggctctgcaggtccagtccaccctcttgtggatcccttgaccgctggccctcaccttgcaaggtttccataccctcccggcactctgccgaaccctctgctgggacaacctccgcatgagcacgagatgctgcgccatcccgtgttcgggaccccttaccctcgggacctgccaggggccatccctcccccaatgtctgccgctcaccagctgcaggcgatgcacgcacagtccgctgagctacagcggctggcaatggagcagcaatggctacatgggcatcctcatatgcatggcggacacctcccttcacaggaggattattactctaggttgaaaaaagagggcgacaaacagctctag

SEQ ID NO: 179417 - DNA, 3039 bp, Artificial Sequence
  Description of Artificial Sequence: Synthetic coding sequence
atgttcaagcccgtgaaggaggaggacgacggcctgagcggcaagcactccatgcggacacggcgttcccggggatccatgagcactttaagaagcggacggaaaaagcagcccgcaagtccagacggcagaacgtctcccatcaacgaagacatacgatcttccggccggaactcaccctctgcagccagcacttccagcaacgattccaaggccgagaccgttaaaaaatctgccaagaaggtaaaggaggaggccagcagtccccttaagagcaataaacggcagagagagaaagtggcatctgacaccgaagaggccgatcggacctcctccaaaaagaccaaaacccaggagattagcaggcctaattctccctccgagggagaaggcgagtcttctgactcacgctccgtgaatgacgagggatcgtcggaccccaaggacatagatcaggataacaggagtaccagtcctagtatcccctcaccacaggataatgaatccgattcagattcatccgctcagcagcagatgcttcaggcccaacctccagcactgcaagctcctaccggggtgacacctgctccctcaagcgcccccccggggactccgcagttacccacaccaggccctacaccctccgcaaccgctgtaccacctcaaggttcacccactgccagtcaggctcctaaccaacctcaagcaccgacggcaccggtgccacacacccacatccagcaagcccccgcccttcatccccaacggcccccctcccctcatcctccccctcatccgtccccccatccccccctgcaacctctgactgggagcgcagggcagcctagcgctccgtcacatgcccagccacctctgcatggacagggtcccccaggtccccacagcctgcaggccggtcctctgctgcagcatcccggacccccccagccctttggactgccacctcaggcgagccaaggacaggcccccctcggtacttctcctgccgcagcctaccctcatacctcccttcagctgccagcttctcagagtgccttgcagtcgcagcagccgccacgcgaacagccgctcccccctgccccactcgccatgccccacatcaaaccaccgccaaccactccaatcccccagcttccagccccacaggcacataagcatcccccccatctgagcgggcctagtcccttttcaatgaacgctaacctgcctcccccgcccgcattgaaaccactctcatccctctccactcaccaccccccatcagcgcatccacccccgctgcaactgatgccccagtctcaacccctgccaagtagccctgcacagccacctgggctcacacaaagccaaaaccttccgcctcctccagcgagccacccccctaccggtctccaccaggtggctccacagcctcccttcgctcaacatcccttcgttcctgggggtcctcctccaatcactccacccacctgtccctctacctcaacacctcctgcagggcctggaacttcagcccaacctccctgctcaggagccgccgcttcaggcggctctattgccgggggatccagttgcccattgccaactgtgcaaattaaggaagaggcccttgacgatgcagaggaaccggaaagcccacccccgccacccagatctccaagcccagaacccaccgtggtggatacacccagccatgccagccaaagcgcccggttttacaagcatctggatcgtggctataatagttgcgcccggaccgatctttacttcatgccgctggctggcagtaaactggctaagaagcgggaggaggcgattgagaaagccaaacgagaggccgagcagaaggcaagagaagaacgggagcgcgaaaaggagaaggaaaaggaaagggagcgggagcgggagagagaacgcgaggcagagcgggcagcgaaagcctcatctagcgcccacgagggtcgtctgtctgacccacagctcagtggccctggacacatgaggccttccttcgaacctccaccaacaactatagcggcagtgccaccttacattggccctgatacccccgccctccggacactctccgagtatgcccggccccacgttatgtcaccaaccaaccgcaatcacccattttatatgcctttaaaccctaccgacccccttctggcctaccatatgcctggcttgtacaatgtagaccccaccatcagagaacgcgaactgcgggagcgggagatcagggaaagagaaatcagagaacgggagctgcgagagagaatgaagccgggatttgaagttaagcccccagagttggacccattgcatcccgccgccaacccaatggaacatttcgccagacattctgcactgactatcccacccaccgcgggtccgcaccctttcgcatctttccatcccggcctgaaccccctggagagagagcggctcgctcttgccggacctcagcttcgacccgagatgtcctaccctgaccgccttgccgccgaaaggattcatgccgagcgtatggcttccctcacctcagatccactggcaaggctccagatgtttaacgtgacccctcatcatcaccaacatagccacatccatagccacctgcaccttcaccagcaggatcctttgcaccagggctccgcaggccccgtgcaccccctggtcgatccactgaccgccggaccccacctggcgcggtttccgtatccccctggaacattgccgaatccattgctgggacaacccccacacgagcacgaaatgttgagacaccctgtgtttgggacgccttatccccgtgatctgcctggtgccattcctccgccgatgagtgctgcccaccagttgcaggctatgcatgcccagagcgccgagctgcagagactcgctatggaacagcagtggttacacggccatcctcacatgcacggaggacacctgccttcccaggaggattattatagtcgtctcaagaaggagggcgacaagcaactgtag

SEQ ID NO: 179418 - DNA, 1953 bp, Artificial Sequence
  Description of Artificial Sequence: Synthetic coding sequence
atggccagcggcgagcacagccccggcagcggcgccgcccggcggcccctgcactccgcccaagcagtggatgtggcttccgcctcaaactttcgggccttcgagttgctccacctgcatttagatctcagagcagagtttgggccacccgggccaggcgccggctctcgaggcctgagtggaaccgcggtgctcgatctcaggtgcttagagcctgagggcgccgctgaacttcggctagatagccacccctgcttggaggtaaccgccgccgcactacggagagaacggcctggcagcgaagagccaccagccgagcccgtctcattttatacccaacctttcagccactatggccaggcactttgtgtgtcattcccacagccatgcagggccgctgagaggctgcaggtcctcctgacatatcgtgtgggtgagggacccggcgtctgctggttggctccagagcagacagccggaaagaagaagccatttgtctacacccagggtcaagccgttctcaaccgggccttcttcccttgcttcgacacccctgctgtcaagtacaagtattcagctctgatagaagtacctgatggcttcacagccgtgatgtccgcatctacatgggaaaagcgagggcccaataagttttttttccagatgtgtcaacccatcccttcttacctcatcgcacttgcaatcggcgatttggtgtcggccgaagttggccccaggtccagagtgtgggccgagccctgccttattgatgccgctaaagaggagtataacggagtcatagaagagttcctggccactggcgaaaagctcttcggaccttatgtgtggggccgatatgacttactatttatgcctccttcttttccctttggaggcatggaaaatccttgcttgaccttcgttaccccctgcctcttggctggtgaccgctccctcgccgacgtcattattcacgagattagtcactcgtggttcggcaatcttgtcactaacgctaattggggagagttttggctgaatgaaggcttcacaatgtacgctcagaggaggatatcgaccatcctgtttggggctgcctacacgtgcctcgaggcagccactggccgcgcactgctgcgacaacatatggacatcaccggggaagagaatccactcaataagctgcgcgtgaagattgagccgggcgttgatcctgatgacacttacaacgagactccctacgaaaaaggattctgttttgtcagttacttagcgcatctggtgggcgaccaggaccagtttgatagcttcctaaaagcttacgtacatgaatttaaatttaggagtatcctggccgatgactttttggatttctacctagaatacttccctgaactcaaaaaaaagcgggtggatatcatacccgggttcgagtttgacaggtggctgaacaccccaggatggccgccatacctgcctgacctgtcccccggcgattctctgatgaagcccgccgaggagctggcccagctgtgggctgctgaagagctggatatgaaagctattgaggcagtcgcgatcagcccttggaaaacataccagctggtttattttctcgacaaaattcttcagaaaagtcccttaccgcccggaaatgtgaagaaattgggtgacacgtatccatctataagcaatgcgcgtaatgcagaactgagactgcggtggggtcagatcgtgctgaaaaacgaccatcaggaggacttttggaaggtgaaagaatttttgcacaaccaggggaaacaaaaatacactctgcccctctatcacgcaatgatgggtggttctgaagtggctcaaacattggcgaaagagacttttgccagcacagccagtcagctgcactcaaatgtggtgaattacgtccagcagattgtcgctcccaagggctcatag

SEQ ID NO: 179419 - DNA, 1836 bp, Artificial Sequence
  Description of Artificial Sequence: Synthetic coding sequence
atggccagcggcgagcacagccccggcagcggcgccgcccggcggccgctgcatagtgcacaggcagttgacgtggcatccgcttccaacttccgcgctttcgaactcttgcatctgcatctggacttacgcgcggagttcggacctcctggacccggcgctggcagccgcggtcttagcggcaccgcagtcctcgaccttcgctgcctggaacctgagggagcagccgagctgcgcttggacagtcatccctgccttgaagtgaccgccgctgcgctacgccgggagcggcctggatcagaagagccacccgcagagcccgtatcattttatactcagccctttagtcactacggccaggccctgtgcgtctcttttccccagccttgccgcgccgcagagagactgcaggtactcttgacttatagagtgggagaaggcccaggagtgtgctggctggctccagaacaaacagccggcaaaaagaagccgttcgtctacactcagggccaggccgtgctgaatcgcgccttcttcccatgtttcgatacccctgctgtgaaatacaaatatagcgcactcattgaggttcccgatggcttcactgccgtcatgagtgccagtacctgggaaaagcgagggccaaataagttcttttttcagatgtgtcagccgatcccgagttatctcatcgcgctggccattggggacctggtttctgccgaagttgggcctcgatatgatttgctttttatgcccccctcttttccatttgggggtatggagaatccctgtctcacattcgtgactccttgtctactggcaggagataggtctttggccgacgtgatcattcacgagattagccatagctggtttggcaacctggtaaccaacgccaactggggggaattctggctgaacgaaggctttaccatgtacgctcagcgtcgaatctctaccatacttttcggtgccgcatacacctgcttagaggctgccactggacgagccctgctgcgccaacacatggatatcactggcgaagagaacccgctcaacaaacttcgggtcaaaatcgagccaggcgttgaccctgacgacacctacaacgaaaccccgtatgagaaagggttttgttttgtgtcttacctggcacacctggtgggagatcaggatcagtttgatagtttccttaaggcatacgttcacgagtttaagttccggtcaatcctcgcggatgacttcttagatttctacctggaatatttccccgagctaaagaagaagcgggtggatataatccccgggttcgagtttgatagatggttaaatacccccggctggccaccctacttgcccgacctgagtccaggcgactctctgatgaagccggcagaggagctggcccagctctgggccgccgaggaactcgatatgaaagccatcgaagcagtggctattagcccctggaaaacctatcagctcgtgtattttctggacaaaatacttcagaagtctccactgcctcctggcaacgtcaagaagttgggcgacacatatccttctatttctaatgcccgcaacgctgagctgcggctgagatggggacagattgtactaaagaatgatcaccaggaggacttttggaaagtcaaagaatttcttcacaaccaaggaaagcagaaatacacacttcccctataccacgccatgatggggggcagcgaagtggcccaaaccctggccaaggagacgttcgcttccaccgcctcccaactccattctaacgttgtcaattacgtccaacagatcgttgctcccaaaggtagctag

SEQ ID NO: 179420 - DNA, 1035 bp, Artificial Sequence
  Description of Artificial Sequence: Synthetic coding sequence
atgacctgctgcagctgcaccagcctgagcgccctgctggacttctgggctgaagtgtgttggctggctccagagcagactgctgggaaaaaaaagccatttgtgtatactcagggacaggcagtcctcaaccgagcattctttccatgcttcgacacgccagcagtgaaatacaagtacagcgcgctaatagaagtcccagatggctttaccgccgtgatgagtgcgtccacctgggagaaacggggacctaacaaatttttctttcagatgtgtcagcctattccatcgtatctgatagcgttggcaatcggagacctcgtaagtgccgaggttgggcctcgatcacgagtctgggcagagccatgtctgatagatgctgccaaagaagagtacaatggtgtgattgaagagttcttagccacaggtgagaagctgtttggtccatatgtgtggggcagatacgatcttttgtttatgcctcccagtttcccatttggtggcatggaaaacccgtgcctgacctttgtgacaccctgcctgttagcaggcgatagatcactggctgacgtgatcattcacgagatttcccacagttggttcgggaatttggttactaatgctaactggggcgagttctggcttaatgaaggcttcacaatgtatgcccagcggcgcatttctacaattctcttcggtgccgcatatacttgtcttgaagccgctacagggcgcgcactgctcagacagcacatggacattacgggggaagaaaaccccctgaataaactacgcgtgaagatcgagcctggagtggatcccgacgatacttacaacgaaacaccatatgaaaaggggttttgttttgtatcatatctcgcccacctggtaggagatcaggatcagttcgatagctttctcaaagcttatgttcacgagtttaagttccggtccatcttagcagacgactttttggatttttaccttgaatacttccccgaactgaaaaagaagagagtggatattataccatag

SEQ ID NO: 179421 - DNA, 507 bp, Artificial Sequence
  Description of Artificial Sequence: Synthetic coding sequence
ctgatcgacgccgccaaggaggagtacaacggcgtgatcgaggagttcttggctactggcgagaaactgttcggaccatatgtctggggtaggtacgacttactctttatgcccccctcctttcctttcggagggatggaaaacccctgcctaaccttcgtgaccccttgcctcctcgcaggcgaccgcagtctggctgatgtaattatccacgagatcagccatagctggttcggcaacctggtgactaatgctaattggggagaattttggctgaacgagggcttcactatgtacgcccagcggcgaatcagcaccatactgtttggagttgacccagacgatacctacaatgagactccttatgaaaagggcttctgttttgtctcttatcttgctcatttggtgggcgaccaggaccagtttgactccttcctgaaagcctacgtacacgaattcaaatttcgctccattttggcggatgacttccttgacttttatctgtag

SEQ ID NO: 179422 - DNA, 1485 bp, Artificial Sequence
  Description of Artificial Sequence: Synthetic coding sequence
atgagcgccacccggagcgcctacatggaggaggagggcgtgttccacttccatatggagcacccagtgccagcatatctggtcgctctggttgctggggacctcaaacccgcagacatcggccctagatcgagggtgtgggctgagccatgcttgctcccaaccgcaacatccaaactttcaggtgccgtggagcagtggttaagtgccgcagagcggctctatgggccctacatgtggggcagatacgacatcgtttttttgccgccgtccttccccatcgtggccatggagaacccttgtctgacttttatcatctcaagcattctggagtccgatgagttccttgtcatagatgttatccatgaggtggcacacagttggttcggaaacgctgtgactaatgcaacctgggaggagatgtggctgagcgaaggtctcgcaacctacgcacagcggcgtattacgacggagacatacggcgctgcattcacttgcttggagacagccttccgcctggatgctttgcatcggcagatgaaactactgggcgaggactcccctgtcagcaagttgcaagttaaactggagccaggagtcaatccgagccacttaatgaatctatttacatacgagaaaggctattgcttcgtgtactacctttctcaactttgcggagaccctcagcggttcgacgacttcctccgagcttatgtggagaaatataagtttacttcagtagtcgctcaggacctgctggacagctttttatccttctttccagaattaaaagaacagagtgtggactgccgtgctggactggagttcgagaggtggctaaatgctaccggccccccgctggcggagcctgacttaagtcagggcagcagtctgaccaggcctgtggaggccctgttccaattgtggacagccgaaccgcttgaccaggctgctgcctccgccagtgccattgatatctccaaatggcgaacattccaaacagctctctttttggaccggctgcttgacggtagcccactcccccaggaggtggtgatgagtctgagtaagtgttattccagcctgctcgatagcatgaatgctgagatccggattcgctggcttcaaattgttgtgaggaacgattattaccccgacttgcatcgcgtgcggcgctttctggagagccagatgagcagaatgtacactattccgctctatgaagacctgtgcacaggtgccttgaaatcctttgcattggaggtcttttaccagacccagggccgtttacaccccaacttgcgtcgcgctattcagcaaatactttcgcagggccttgggagttcaactgaaccggcgagcgagccaagcacggagctcgggaaggctgaggcagacaccgactctgatgcacaggccttgctgcttggcgacgaagcaccaagctctgctatttcattaagggacgttaatgtctccgcatag

SEQ ID NO: 179423 - DNA, 1236 bp, Artificial Sequence
  Description of Artificial Sequence: Synthetic coding sequence
atggaggtgaacccccccaagcaggagcacctgctggccctgaaggtgatgcgcctcacgaagccaaccctcttcaccaatatacctgtcacatgcgaagagaaggaccttcctggcgatctcttcaatcagttgatgagagacgatccgtcaactgtgaatggtgctgaggttctcatgctgggggagatgctgaccctcccgcagaatttcggcaatatcttcctgggtgaaacctttagctcgtacataagtgtccacaacgatagcaaccaggtggtcaaagatattctcgtgaaggccgaccttcaaaccagctcccaaaggcttaacctgagcgccagcaatgctgccgttgcggagctgaagcccgattgctgtatagatgacgtcatacatcacgaggtcaaagagattggtacacatatccttgtgtgcgccgtgagctacacaactcaggctggcgagaagatgtacttcagaaagttcttcaaatttcaggtactgaaaccccttgatgttaagactaaattttacaacgctgagacggacgaagtgttcttagaggcccagatacagaatatgaccacctctccaatgtttatggagaaagtctccctggagccctccatcatgtataatgtgaccgaattgaactcagtgtctcaggcaggagagtgtgtatccaccttcggatcccgcgcctacttgcagcccatggatacgcggcagtatctgtattgtcttaagccgaagaacgaattcgcagaaaaggctgggatcatcaaaggcgttaccgtcattggaaagcttgacatagtgtggaagaccaacctaggggagcgggggaggctgcaaacctctcagctccaacggatggcacccggatatggcgacgtgaggctaagcttggaagccattcctgatacggtcaatttagaggaaccatttcacatcacctgcaagatcacaaactgctccgagcgcacaatggacctcgtattagagatgtgtaacacaaattcgatacactggtgcgggatttccggtcgccagcttggtaagctccatccatctagttcattatgtctcgcgctgaccctgctttcgtccgtgcagggtctgcaaagcatttcaggactccgcttaaccgacactttcctcaagcgtacttatgagtacgacgatattgctcaagtgtgcgtggtgtcctctgctatcaaggtagaaagctag

SEQ ID NO: 179424 - DNA, 1365 bp, Artificial Sequence
  Description of Artificial Sequence: Synthetic coding sequence
atgcacgtgggccacctgcggagcaccatcatcggcgagagcatctctcgcctgttcgagtttgcaggctatgatgtgttgcggcttaaccatgtcggcgactggggaacccagtttggcatgctaatcgcccatctgcaggacaagttccctgattacttaacagtctcccctccaattggggacctgcaggtattctacaaggagtctaagaaacggttcgacacagaggaggagtttaaaaagagggcttaccagtgtgttgtgcttctgcaaggaaagaatcctgatattactaaggcatggaaactgatctgcgacgtttcacgtcaggaattgaataagatttacgatgccctcgatgtgagcctgattgagagaggggaatccttttaccaggatcgaatgaatgacatcgtgaaagagttcgaggacaggggctttgtccaggtggacgatgggaggaaaattgtctttgtacctggctgctctattcccctcaccatcgtaaagtccgacggagggtacacatatgacacatctgatctcgccgctatcaagcagcggctatttgaggagaaagctgacatgataatctatgtggttgacaacggccagtcagtacactttcagacaatctttgcagccgcccagatgattgggtggtatgacccaaaagtcacacgcgtatttcacgctggcttcggggtagtccttggtgaagataaaaagaaattcaagactaggagcggggagacagtgcgtctaatggatttgttgggtgagggccttaagcggagcatggacaagctaaaggagaaggagcgcgataaggtcctgaccgctgaagaactcaacgcggctcagacaagtgtcgcttatgggtgcatcaagtacgctgatttgtcacacaataggttgaatgattacattttctccttcgacaagatgctcgatgataggggtaataccgctgcctatctcctttatgcctttacccgaattcggagtatcgcacgactagccaatatagatgaggaaatgctgcaaaaagcagcaagggaaacaaaaatactgctagatcacgagaaagaatggaaactaggacggtgcatcctgaggtttccagaaatactgcagaaaatcctggatgacctgttcctgcacaccctctgtgattatatttatgaactggcaaccgccttcaccgagttctacgattcatgctactgtgtagagaaagatcgacaaaccgggaagattctgaaggtgaatatgtggagaatgttgttatgtgaggcagtcgccgccgtcatggcaaaggggttcgacatcctgggtattaagcctgtccagagaatgtag

SEQ ID NO: 179425 - DNA, 618 bp, Artificial Sequence
  Description of Artificial Sequence: Synthetic coding sequence
ttccagagcgtggagagcagcacccggaagctggaccacatcaacatatgctcaagcaatttcccgaaaaggtctttcgccttggttactcaggccggtgtgcaatggcacaatctcgactccttgcagtccccacctcctggatttaagagatttccttgtttgtctctgcctagttcttgggactgccgtgaagtggccgacttccagttgtcagtcgatagcctgctggagaaggacaatgaccacagcaggccagatattcaggtgcaggccaagaggttggcagagaagctgcgatgcgatacggttgtatctgagatttcgaccggtcagagaacagtgaattttaagataaatcgcgaattgcttaccaaaacagtgttgcagcaagtcatagaggatggatcaaagtacggtctcaaatctgaactctttagcggattgccgcagaaaaagatcgtggtggaattttcgtcacctaacgtggctaaaaagttccatgtcggccatcttcgttctacaatcatcgggaatttcattgccaatctgaaggaggccctcggacaccaggtaatccgcatcaactatttaggggattggggtatgcagttttag

SEQ ID NO: 179426 - DNA, 1737 bp, Artificial Sequence
  Description of Artificial Sequence: Synthetic coding sequence
atggcctgcggcttccggcgggccatcgcctgccagctgagccgggttttaaatctacctccagagaacctcattacaagcattagcgccgtacccattagtcagaaagaggaagtggcggattttcagttatcagtggatagcttgctcgagaaggataacgaccatagcagacctgatatacaagttcaggccaagaggctggcggagaagcttcggtgcgacacggtggtatccgagatcagtacaggacaacgcactgtcaactttaaaattaaccgagaactgctgactaagacagtgctgcaacaagtaatcgaggatgggagcaagtatggcctaaagagtgaacttttcagcggcctgccgcagaagaaaattgttgtggagttcagcagtccgaacgtcgccaagaaattccacgtcggacatctgaggtccaccatcataggaaatttcatcgctaacctgaaagaggccttgggtcatcaagtgatacggattaactatctcggcgactggggcatgcaatttggccttttgggaactggcttccaactttttggatacgaggagaaactccagtccaaccccctccagcatctctttgaagtgtacgtgcaggtgaataaggaggccgcggatgacaaatccgtcgctaaagccgcccaggaatttttccagaggctggagctcggcgacgtacaggccttgagcctttggcagaaatttagggatcttagcattgaggagtacatcagggtctataaaagactcggagtgtactttgacgagtattcaggggagagcttttatagagagaaatcccaagaagtcctgaagctactggagagtaagggcctgctactaaaaaccatcaagggaacggccgtggtagacctgtcaggcaatggggacccatcaagcatatgtaccgtcatgaggagtgatggaacttctttgtacgcgaccagagatctagcggccgcaattgatcggatggataagtataacttcgacactatgatctacgtcactgataaggggcaaaaaaagcatttccagcaggttttccagatgctgaagataatgggctatgactgggcggagcgatgtcagcatgtgcccttcggagtcgtccaggggatgaagactaggcggggtgatgttacctttttagaagatgtgttgaacgaaatccaacttcggatgctacagaacatggcttccattaaaacaaccaaagaactgaaaaatccacaagaaacagcagaacgggtcggcttggctgcgttgatcatccaggattttaaggggctgctgttgagtgactacaaattctcatgggatcgcgtcttccagtcccgaggcgatacaggcgttttcctacagtatacacatgcccgcttgcatagtctggaggagaccttcgggtgtggatacttgaatgatttcaacaccgcgtgcctccaggaaccacagtctgtatctatcctgcaacacctcctgagatttgacgaggtcctctacaagtcatcccaggactttcagcccaggcatatcgtgtcctacttgttaaccctgagccacctcgcagcagttgcacacaaaaccctgcagatcaaagactccccccctgaggtggccggcgcaaggcttcatctgtttaaggccgtgagaagcgttctcgcgaatggaatgaagctactgggcattacgccagtgtgtcggatgtag

SEQ ID NO: 179427 - DNA, 621 bp, Artificial Sequence
  Description of Artificial Sequence: Synthetic coding sequence
tgattccagagcgtggagagcagcacccggaagctggaccacatcaatatctgcagctccaatttccctaagcgatccttcgcactggtaacacaagccggcgtccagtggcataacctggatagcctgcaatctccccccccaggtttcaaacggttcccgtgcctgtcactcccttcctcctgggattgccgtgaggtcgccgacttccagctgagtgtagatagcctgctcgagaaagacaacgatcattcccgaccagatatccaggtgcaagccaaacgcctggccgagaaactgagatgcgacacagtagtttctgaaataagcacggggcagcgaacagtgaactttaagattaacagggagctcttgaccaaaactgtgttacagcaggtgatcgaggatggatctaagtatggccttaaaagtgagctgttttctggacttcctcagaaaaaaatcgtcgtggaattcagcagtcccaacgtggcgaagaagttccacgtcggccacttgaggtccacaattattggaaacttcatcgccaacttaaaggaagcactcggtcaccaagtgattaggatcaactaccttggagactgggggatgcaattttag

SEQ ID NO: 179428 - DNA, 1482 bp, Artificial Sequence
  Description of Artificial Sequence: Synthetic coding sequence
atgagcgtggacatgaacagccagggcagcgacagcaacgaggaggactatgatccaaattgtgaagaagaggaggaggaagaagaggacgatccaggcgatatcgaggattactatgttggtgtggcaagtgacgtagaacagcagggagccgacgctttcgatcccgaggagtaccagttcacatgcctaacctacaaagagtccgagggggcgctgaatgagcatatgacctctctcgccagcgtgttgaaggtctcgcattccgtggccaagctgattctcgtgaattttcactggcaggtcagcgaaatcctcgatcggtacaaatcaaactccgcacagcttctggtggaggccagagtgcagcctaatccctccaaacatgtgcctacaagccaccctccccaccactgcgccgtgtgtatgcagtttgtgaggaaggagaatcttctgtcgttagcatgccagcaccaattttgccggtcatgttgggagcaacactgctccgtccttgtgaaggacggcgttggtgttggcgtttcatgcatggctcaagactgtccactgcggactccagaggacttcgtgtttcctctgctgccaaacgaggagttgagagagaagtataggcggtacctttttagagattatgtcgagtctcattaccagctacaactgtgtcctggtgccgattgcccgatggtgattagggtgcaggaacctcgggcccgtagggtgcagtgcaaccggtgtaacgaggtgttttgttttaagtgcaggcaaatgtatcatgctcctactgattgtgccaccattcggaagtggctcacaaagtgtgccgacgacagcgagactgcaaactacatcagtgcccataccaaggattgtcccaagtgtaatatctgcatcgaaaagaatggagggtgcaaccacatgcagtgctccaagtgtaagcacgatttctgttggatgtgtctcggcgattggaaaactcacggaagcgagtactacgagtgtagcagatataaggagaatccagatattgtgaatcaatctcagcaggcacaggctcgggaagctctgaaaaagtaccttttttacttcgaacgctgggaaaaccacaacaagagcctccagctggaggcccagacctaccagaggatacatgagaaaatccaggaacgcgtcatgaacaatttaggaacgtggattgactggcagtatctgcagaacgccgctaagctgctggcgaaatgtagatacaccctgcaatatacatatccctacgcatactacatggagtccggcccgcgaaaaaaactcttcgaatatcagcaggcacaattagaagccgaaatcgaaaatctttcgtggaaagttgaaagagccgactcctacgatagaggcgatctggagaatcagatgcatatcgccgaacagcgaagacgcactctgctaaaggacttccatgatacctag

SEQ ID NO: 179429 - DNA, 954 bp, Artificial Sequence
  Description of Artificial Sequence: Synthetic coding sequence
ggcatcaccggcgtgagctgcatggcccaggactgccccctgcggacacctgaggactttgtgtttccgctgttgcccaatgaggagttgcgggaaaagtaccgccgatacctgttccgggactacgtggaatctcattaccagctgcagttgtgtccgggggccgattgccccatggttattcgtgtgcaggaacccagggcccggcgggtccagtgtaacagatgcaatgaagtgttttgttttaagtgccggcaaatgtaccacgcccctacggactgcgccactatcaggaagtggctgaccaagtgtgccgacgactccgagaccgccaactatatctctgctcacacaaaggattgtccgaagtgcaacatctgcatcgagaaaaacgggggttgtaatcatatgcagtgctccaagtgcaagcacgatttctgttggatgtgtcttggggactggaaaacccatggttccgaatattacgagtgcagccgctataaagagaatcctgacatcgtgaatcaaagtcagcaagcccaggcccgagaggcccttaagaagtatctgttctacttcgaaaggtgggaaaaccataacaagagcctccagttagaagcccagacctaccagagaatccacgaaaagattcaggagcgagtcatgaataaccttggtacatggatcgactggcaatacctgcaaaatgccgctaaactcctcgccaaatgtagatataccctgcagtacacgtacccctatgcctactacatggagtcgggcccccgcaaaaaactgtttgagtatcagcaggcccagctggaggctgaaatcgagaacctgtcgtggaaggtcgaaagggcagactcatacgacagaggagacttggagaatcaaatgcacatcgctgaacaaagaagaaggactctcctgaaagacttccatgatacctag

SEQ ID NO: 179430 - DNA, 1233 bp, Artificial Sequence
  Description of Artificial Sequence: Synthetic coding sequence
agcgtggacatgaacagccagggcagcgacagcaacgaggaggactacgacccaaactgcgaagaagaggaggaagaggaagaggatgacccgggagacatcgaggactattacgttggagtggcctctgacgtcgagcagcagggggccgacgctttcgatcctgaggagtaccaatttacttgcctcacttacaaggagtcagaaggcgcccttaacgaacatatgacctccctggcatccgttctcaaagtaagccactcagtcgctaagctgatcctcgtgaattttcactggcaggtgtcagaaatcttggatcgatataaatctaattcggcccagctgcttgtggaggcccgcgttcagcccaacccttcaaagcacgtgcctacttcccacccacctcatcactgtgccgtttgtatgcagttcgttcggaaagaaaacttgctatctctcgcgtgccagcaccaattttgcagatcgtgttgggaacagcattgctccgtgctcgtaaaggatggtgtcggcgtcggggtgtcctgtatggctcaggattgtccactcagaactccagaagactttgtattcccgctacttccaaatgaagaactgcgcgagaagtaccgcagatacctgttccgagattacgtcgagagtcattaccagctgcagctgtgtcccggagctgattgccctatggtcatccgtgtgcaggaaccaagagctaggagagttcagtgcaatcgttgtaacgaggtcttttgttttaaatgcagacagatgtatcacgcccccacggactgtgctacaatcaggaaatggcttaccaagtgcgcggatgatagcgaaaccgccaactacattagcgcacataccaaagattgtcctaaatgtaacatatgcattgaaaagaatggggggtgtaaccacatgcagtgttctaaatgcaaacacgatttctgctggatgtgtctgggggactggaaaacacatggatcagagtattacgaatgctcacggtacaaggaaaaccctgatatagtgaatcagtctcaacaagcccaagctagagaagccctgaaaaaatatttattttatttcgaaagactcgaaaacctgagctggaaggtggaaagggccgacagctatgatcgtggggatcttgaaaatcagatgcacattgccgagcagcgccgcagaacactgctgaaggacttccacgacacatag

SEQ ID NO: 179431 - DNA, 1482 bp, Artificial Sequence
  Description of Artificial Sequence: Synthetic coding sequence
atgagcgtggacatgaacagccagggcagcgacagcaacgaggaggattatgaccccaattgcgaggaagaggaggaagaggaagaagatgaccccggagatatcgaggattactacgtgggggtggcgagcgatgtggaacagcagggagcggacgccttcgacccggaggaatatcagttcacatgtctcacctacaaggagtccgaaggagcccttaatgagcacatgacgtccctggcctctgttcttaaggtgagccactctgtggctaaattgattttggtgaattttcactggcaggtgtcagagattttagaccgatacaagtccaacagcgcccaactgcttgtggaggcccgtgtgcagcccaatccctcaaaacatgtgcccacttcacacccaccacaccattgtgctgtgtgcatgcagtttgttaggaaagagaacctgctcagcctcgcctgtcagcaccagttttgtcggtcatgctgggagcagcactgtagcgttttagtgaaagacggggtgggcgtgggcgtcagttgcatggcccaggattgccctctcagaacccccgaagactttgtttttccgcttctgcctaacgaggagctacgagagaagtaccgcaggtacctgtttagggattacgtggaatctcattaccagctacagctgtgccctggggcagactgccccatggtaatccgcgttcaggaaccaagagctcgtcgggttcagtgcaaccgatgtaacgaggtattctgctttaagtgtcgccaaatgtaccacgcccccacggattgtgccacaatccgtaagtggttaacaaaatgcgcagatgatagcgagaccgcaaattatatttctgcccacacaaaagattgccccaagtgcaacatctgcattgagaaaaatggtgggtgcaaccacatgcagtgcagtaaatgcaaacatgacttttgctggatgtgtctgggagattggaagactcacggatccgagtattatgagtgttcaagatataaggagaatccagatatagtaaaccagagccagcaggcccaggctcgcgaggcccttaaaaagtatctgttttacttcgagaggtgggaaaatcacaacaaaagtttgcagctggaggctcaaacctaccagcgtattcacgagaaaatccaggagcgtgtgatgaacaacctggggacttggatcgactggcagtatctccagaacgcagcaaagctgttggccaagtgcaggtataccctacagtacacgtatccttatgcttactatatggagtcagggccccgcaagaagctgttcgagtatcagcaggcacagttagaggctgagatcgagaacctctcctggaaagtggaaagggccgactcttatgatagaggagatctagaaaatcagatgcatatcgccgagcagaggaggagaacacttttgaaggattttcatgacacatag

SEQ ID NO: 179432 - DNA, 1584 bp, Artificial Sequence
  Description of Artificial Sequence: Synthetic coding sequence
ctgcggcgggccgccagcggccccctggcccccagcctgccccccccaagacccccgagaaggcaccagccttctaacgccaaccgccgcagttggggaggtgcagcggcccggggcgccggagcacgccccgcgtccggacaccagccggagcccgagcgagagccgggaccgaggcgtcccaggcccctccctgcttcagctagcgttcgaagagcacccgctaggcgggcgatggattctgacgaggggtataactacgaattcgttaacgaggtcatccaaaacccagccaccatcacccgcatcctgctgtctcactttaattgggataaggagaagctcatggaacgatacttcgatgggaacctcgaaaagttgttcgctgagtgtcatgtgattaacccaagcaagaaaagtaggactcggcagatgaatactcggtcctcagcccaggatatgccatgccagatctgttacctcaactaccctaattcctacttcaccgggctagaatgcggccacaaattttgcatgcagtgctggtctgaataccttacaaccaagattatggaagagggtatggggcagacaatttcatgcccggcacacggctgcgatattctggttgacgataatacagtcatgagattaattacagactctaaggtgaaactaaagtatcagcatcttatcacaaactccttcgttgagtgcaatcgcttactcaagtggtgtccagctccagattgccaccacgtggttaaggttcagtatccagacgctaagcctgtacggtgtaagtgcggacggcaattctgcttcaactgtggcgaaaattggcacgacccagtcaaatgcaagtggttgaagaagtggataaagaagtgcgatgacgactcggaaaccagcaattggatagccgccaacactaaagagtgtcctaagtgtcacgtgactattgagaaagatggaggctgcaaccatatggtgtgcaggaaccagaactgtaaggccgagttttgctgggtgtgcttgggcccctgggagccgcatggatcagcctggtataattgtaatcgttacaacgaggatgatgcgaaggccgcccgtgacgcccaggagcgcagtagagccgcccttcagaggtacttgttctattgcaaccgatatatgaaccatatgcagtctctgcggtttgagcacaaactttacgcccaggtaaagcagaaaatggaggagatgcaacagcataacatgagctggatagaagtgcagttccttaagaaggctgtggatgtgctgtgtcagtgccgcgctacgctaatgtacacctatgtgttcgctttttatctgaagaagaacaaccagagtataatattcgaaaataaccaagccgacttagagaacgcgaccgaggtcctgtccggttacctcgaacgagacattagccaggactccctccaggatattaagcagaaagtacaggacaaatatcgctactgcgaaagtagacggcgggtgctgcttcagcacgtgcacgagggttacgaaaaggacttgtgggagtatatcgaagactag

SEQ ID NO: 179433 - DNA, 1674 bp, Artificial Sequence
  Description of Artificial Sequence: Synthetic coding sequence
atggacagcgacgagggctacaactacgagttcgacgaggacgaggagtgttccgaggaggactctggcgctgaggaagaggaagatgaagatgacgacgagccggacgacgacacactggatctgggagaggtcgaactggtcgagcccggcctgggcgtgggtggcgaaagagacggacttctgtgtggcgagactggcgggggtggaggctccgcattgggacctggcggagggggcggcgggggcggcggcggaggagggggaggacccggccacgagcaagaggaggactataggtacgaagtgctgaccgccgagcagattttacagcacatggtagaatgcattagggaggtaaacgaagtgatccagaacccggctacaatcactagaattctgcttagccactttaattgggataaggaaaagttaatggaaaggtacttcgatgggaatttggagaaactatttgccgaatgtcacgttataaatccttccaaaaagagcagaacaaggcagatgaacacgcggtcttctgcccaggatatgccatgccagatttgctacctgaactaccccaacagttacttcaccggactggaatgtggacacaaattttgcatgcagtgctggtccgagtacctcacaactaagatcatggaagaaggtatggggcagactatctcgtgcccagcccacggctgcgacatccttgtggacgataataccgtcatgcggctaattacggatagcaaggtgaaacttaaataccagcaccttatcactaattcatttgtggagtgcaaccgactgttaaaatggtgcccagcaccggactgtcaccacgtagttaaagttcagtatcccgacgccaaacctgttcgctgcaaatgtggccggcaattttgtttcaactgcggcgagaattggcatgacccagtcaagtgcaaatggctcaagaaatggattaagaagtgcgacgatgactctgaaacatctaattggatcgccgcaaatacaaaggaatgccctaagtgtcacgtaacaattgagaaagacggcggttgtaaccacatggtgtgccgtaatcagaactgtaaagccgagttttgctgggtgtgtctaggaccttgggaaccccacggatccgcatggtacaactgtaaccgttataatgaggacgacgctaaagccgcacgagacgcacaggagcgtagcagagccgctctccagaggtacttattttactgtaaccggtacatgaaccatatgcagagcttacggttcgagcacaagctttatgcccaggtaaagcagaagatggaggagatgcagcagcacaacatgtcatggatcgaggtgcagttcctgaagaaggccgttgatgtgctctgtcagtgccgcgcgacgctgatgtacacttacgtgtttgctttttatcttaaaaagaacaatcagtcaatcattttcgaaaataaccaggccgatctcgagaatgctacagaggttctgtccgggtacctggaaagggatatttctcaggatagcctgcaggacatcaagcagaaagttcaggacaagtacagatactgcgagtcgcgccgccgagtcctgctgcagcatgttcacgagggctatgagaaagatctatgggagtatattgaggactag

SEQ ID NO: 179434 - DNA, 1689 bp, Artificial Sequence
  Description of Artificial Sequence: Synthetic coding sequence
atgagcaaccagtaccaggaggagggctgcagcgagcggcccgagtgcaagagtaaaagcccaaccttgctgagctcatactgcatagactccatactgggaagaaggtccccgtgcaaaatgcgactgctcggagcggcccagtccctgccagcgccgctgacttctcgtgctgatccagaaaaggctgtccagggttccccgaagtccagttccgccccctttgaagcagagctccacttgcctcctaagctgcgacggctttatggccctggagggggcagacttttacagggtgctgcagctgctgcagccgctgccgctgccgctgcagctgccgccgcaaccgccactgcaggtcccagaggcgaagctccccctccccctcccccaaccgctcgccccggcgagcgaccggacggagccggggccgccgcggctgctgctgccgctgcagccgccgcctgggatacgctgaaaatctcccaggctccccaagtctccatctcacggtccaagtcatatcgcgagaacggggccccattcgtgcctccacccccagcgctggatgagcttggcggccccggtggggtgacacatccagaagaaaggctgggtgtggccggtggaccgggctcagcccctgccgcaggcggcggtacaggaaccgaagatgacgaagaggagctgcttgaggatgaagaagacgaggatgaagaggaggaactgctggaggacgatgaagaggagctgcttgaggatgacgctcgagccttattgaaagagccccggcgctgccctgttgctgccaccggtgccgtcgcagcagccgcagcggcagccgtggccacggaggggggtgaattgtcccccaaggaggagttgcttttacatccagaagacgcggagggaaaggatggcgaggattccgtctgcctcagcgcgggctctgatagtgaagaaggtctgctaaaacgcaagcaaagacgctacagaacaacattcacatcataccaattggaagagttggaaagggcgttccaaaagacacattatcccgatgtcttcactcgcgaagaattggccatgcgtctggatttgactgaggccagagtgcaagtgtggtttcagaaccgacgtgcaaaatggaggaagagagaaaaggctggcgcccagactcaccccccaggcctgcccttccccggtcctctctccgcaacacaccctctttccccatacttggatgcctcccccttcccgccccaccatcccgcattagattctgcgtggactgctgctgccgccgctgccgctgctgcattcccttcccttcccccacccccaggcagcgcaagccttcctccttcgggggccccactgggactgagtacgttcctgggcgccgcagtgttccgtcaccccgcatttatatcgccagcattcgggcggctgttttcaactatggccccactaacctcagcttcaactgcagcagcgctcttaaggcaaccgacaccagccgtcgagggggctgtggcgtccggtgcactggcagatccagcgacagcggcagcagacagacgcgcctcctccatcgctgctctccggctgaaggccaaagaacacgcagctcagctgactcaactcaacattctgccagggaccagtactggcaaggaggtgtgttag

SEQ ID NO: 179435 - DNA, 1032 bp, Artificial Sequence
  Description of Artificial Sequence: Synthetic coding sequence
atgggcggcccccggggcgccggctgggtggccgccggcctgctgttaggggccggagcgtgctactgcatatatagactgacgcgaggacggaggcgtggtgacagggaattaggaattagaagcagcaaatctgctggagccctggaggagggcacaagcgagggtcagctgtgcgggagatccgcacgacctcagaccgggggaacctgggagagccagtggtcgaagacatcccagccggaggacctaacggatggcagctacgacgacgtgttaaacgcagagcagctgcagaagctcctttacctacttgaatccacggaagacccggtgatcattgaacgcgccctgataacccttggtaacaatgctgcttttagtgtcaatcaggcaatcatcagggagttgggtggaataccaatcgttgcaaataagattaaccatagcaaccaaagtatcaaggagaaagctctgaacgccctcaacaatcttagcgtgaatgttgaaaaccaaataaaaattaagatttacataagccaggtttgtgaagacgtgtttagcggtccgctgaactccgcggtgcaactcgcaggcttgaccctgcttaccaacatgactgttaccaatgatcaccaacacatgctgcactcctacatcaccgatttgtttcaggtacttctgactgggaacggtaatacgaaggtgcaagttctgaagctgctgttgaacctcagtgaaaatcccgccatgacagaaggcctgctgcgggcccaggtggattccagctttctgagtttatatgacagccatgttgctaaggaaatcctgctgcgagtgctgaccctatttcaaaatattaagaattgcctgaaaattgaaggacacttggctgtgcagccgacattcactgaaggatcattgttcttcctgctgcacggtgaagaatgcgcccagaagataagggccctggtggatcaccacgacgcagaggtcaaggagaaagtggttaccataataccgaagatctag

SEQ ID NO: 179436 - DNA, 855 bp, Artificial Sequence
  Description of Artificial Sequence: Synthetic coding sequence
atgggcggcccccggggcgccggctgggtggccgccggcctgctgttgggcgccggcgcctgttactgtatttaccgtctaactcgcgggcgccgccggggggacagggaactcggcatccgctcttctaagtctgccgaggacctcacagatggttcatacgatgacgtgttaaacgctgagcaactccagaagctgctctatctgctggaatcaacagaggatccagtgatcatcgagcgagcacttattaccctggggaataatgctgccttttcagttaaccaggcgatcatccgagagttaggaggcatacctatcgtggccaataaaattaaccatagtaaccagtccattaaagaaaaggctctaaacgcattgaataatctgtctgtcaacgtggaaaaccagataaagattaagatctatatatcccaggtgtgcgaggatgtcttttcaggtcctctcaatagcgcggtacagctggcagggctgactctactcacgaacatgactgtcactaatgaccatcagcacatgcttcattcttacatcaccgacctgttccaggtgcttctgacgggcaacggaaacaccaaagtggactcttccttcttgtccctgtatgatagtcatgtagccaaagagatcttgcttagagtactaacattatttcagaatataaaaaactgccttaagatagaggggcatctggcggtgcagcctacgtttacagaaggcagccttttctttttgctgcatggtgaagagtgtgcccagaaaatccgcgcgctggtcgaccatcatgatgccgaagtcaaggagaaggttgtgaccattattcctaagatttag

SEQ ID NO: 179437 - DNA, 855 bp, Artificial Sequence
  Description of Artificial Sequence: Synthetic coding sequence
atgggcggcccccggggcgccggctgggtggccgccggcctgctgcttggcgctggcgcttgttattgcatctaccgtcttacaaggggcagaaggcggggcgaccgggagctgggcattcggtcctcgaagagcgctggtgctctggaagaaggtacatcagagggtcagctttgcgggcgctcagctaggcctcagactggcggaacatgggagtcacagtggagcaaaaccagtcagccagaggacctgaccgacggttcttatgatgatgttctgaatgcagaacagctgcaaaagttgctttacctgctggagtccaccgaagatccagttatcatcgaacgtgctttaataacactcggtaacaatgcagctttttccgtgaatcaggctattattcgcgagcttggaggcattcccattgttgccaacaagatcaaccattccaatcagtcgattaaagaaaaggcactcaacgctcttaacaatctatctgtcaacgtggaaaatcagattaagattaaggtgcaggtgttaaaactcctattgaacctgtctgagaacccagcgatgactgagggtctcctgagggcacaggttgattcctccttcctcagtctgtacgattctcacgtagctaaggagattctccttagggtgctgaccttgttccaaaacattaagaattgcctcaagattgaagggcacttggccgttcagccaacattcacagagggcagcctgttctttctcttacacggagaagaatgtgcccagaagatccgagctctggtggaccaccatgacgctgaagtaaaagagaaggtggtgaccatcattccaaagatttag

SEQ ID NO: 179438 - DNA, 927 bp, Artificial Sequence
  Description of Artificial Sequence: Synthetic coding sequence
atgggcggcccccggggcgccggctgggtggccgccggcctgctgcttggcgccggagcctgctattgtatctatagattgactagggggcggagaagaggcgatagagagctggggatcagaagttccaaatccgcagaggacttaactgacggctcctacgatgacgtgctgaacgctgaacagctccaaaagcttctgtatctgttggagtcgacagaggaccctgtgatcatcgaaagggctttgatcactctgggcaacaatgccgccttcagtgttaatcaggccattattagagagctcggaggcatccccattgtggctaacaagatcaatcactccaaccagtctatcaaggaaaaagccctcaatgcactgaataacctgtctgtcaatgtagagaatcagattaaaatcaaaatttatatctcccaagtgtgcgaggacgtattctctggcccactgaattccgccgtacagttagctgggttaacgctgctcactaatatgacagtcacaaacgatcatcaacatatgctgcactcctacataacggacctatttcaggtgctgctcaccggaaatggcaacactaaggtccaagtcttgaagctactgctgaatttgtcggaaaatcctgcaatgaccgaaggcctgttacgggctcaagttgactctagctttcttagcctgtacgactcccacgttgctaaggagatacttctacgggtcctgaccctgtttcagaatataaaaaattgtttgaaaatcgagggccacttggcggtgcaacccaccttcacagagggcagtctgttcttccttctgcacggcgaggaatgtgctcaaaaaatcagagctttagtggaccaccacgacgcagaggtcaaggaaaaagtcgtcactatcatccccaaaatctag

SEQ ID NO: 179439 - DNA, 750 bp, Artificial Sequence
  Description of Artificial Sequence: Synthetic coding sequence
atgggcggcccccggggcgccggctgggtggccgccggcctgctgctgggcgctggcgcatgttattgcatttacagactaaccagaggtaggaggcgcggggaccgtgagttaggcattcgctcttctaaatccgctgaggacttaactgatggttcttacgacgacgtgctgaacgcagagcaattacagaagcttctctatctcctggagagtaccgaggatccagtcatcattgagagagccctgatcacccttggcaacaacgctgcctttagcgtgaaccaggctattatcagagagcttgggggcataccaatcgtcgctaacaaaatcaaccacagcaaccagtccatcaaggaaaaggccctgaacgcgctgaataacctgagtgttaacgtagagaaccagatcaagatcaaggtccaagtgcttaagctgctacttaacctgtccgaaaatcctgcaatgactgagggcctgctaagggcccaagtcgactcctcattcctgagtctctatgatagccacgtagcgaaggagattctgctgcgggtgctgacacttttccagaatatcaaaaactgtctcaagatcgagggacatttggccgtgcagccaacattcacagaaggatcgctgttcttcctgttgcatggcgaagagtgtgctcagaagatacgggctttagtggaccatcacgatgccgaggtgaaggagaaagtggttactataattccgaaaatctag

SEQ ID NO: 179440 - DNA, 678 bp, Artificial Sequence
  Description of Artificial Sequence: Synthetic coding sequence
atgggcggcccccggggcgccggctgggtggccgccggcctgctgctgggcgcaggcgcctgctactgtatctatagactgacccgtggccgcaggcgtggcgatcgcgagctgggtatacgcagtagtaaaagcgccgaagatctcactgacgggtcttacgatgacgttctgaatgcagagcaactccagaaactcctttacttgctggaaagcacggaggacccagtgatcattgaaagggctcttatcactctaggcaacaacgccgcattctccgtaaaccaagcaattataagggagctgggaggtataccaattgtggccaataaaattaaccacagtaatcagtcgattaaagaaaaggcactgaatgccctgaataatctttctgtgaatgttgaaaaccagatcaagataaaggtggactctagcttcctttccttgtacgactctcatgtggctaaagagatactgttgcgcgtcctcacactgttccagaatatcaagaactgtttaaagatcgaaggacacctagctgttcagcccacgtttaccgagggaagtctgttcttcctgctccatggtgaagaatgtgcccaaaagattcgcgccctggttgaccatcacgatgcggaggtgaaggaaaaagtcgttacaatcatccctaagatctag

SEQ ID NO: 179441 - DNA, 1362 bp, Artificial Sequence
  Description of Artificial Sequence: Synthetic coding sequence
atgggccggacccgggaggccggctgcgtggccgccggcgtggtgatcggtgctggggcctgttactgcgtgtatcgcctagcctggggaagagatgagaacgagaaaatatgggacgaggacgaggagagtaccgatacttcggagattggtgtggagacagtcaagggcgccaagacgaatgctggggcgggcagtggggcgaagttgcaaggcgattcagaagtaaagccagaagtgtctctgggtcttgaagactgccctggagttaaggagaaggctcacagcggttctcattcaggaggcggactggaagctaaagccaaagctctgttcaataccctgaaggagcaggcatccgctaaggcaggcaagggcgcccgggtcgggaccatcagcgggaacagaactctcgccccatcattaccctgtccgggcggacggggcggcggatgccaccctacacgctccgggtcaagggcaggcggccgagcctctggcaaaagcaaaggtaaagctcgatcaaagtccacaagggcacctgcaaccacatggccagtgcgtcgaggcaagttcaattttccctataagatcgatgatatcctgtctgcccctgatctgcaaaaggtgctgaatatactagaaaggacgaatgacccgtttatacaggaggttgccttagtgaccctcggaaataacgctgcatactcttttaaccaaaacgccatacgtgagctgggcggtgtgccgataatagctaagcttattaagaccaaagatcctatcattcgcgaaaagacctataatgctctgaataatctctcagtgaatgctgagaaccaaggcaaaatcaagacctacatatcccaggtgtgtgacgacaccatggtttgcaggctcgacagtgcagttcagatggctggacttaggctcttgactaatatgaccgtgacgaaccactatcagcatctactgagttactcctttcccgacttcttcgccctgctgttcttgggcaaccatttcacaaagattcagattatgaagctgatcattaattttactgaaaaccccgccatgaccagagaactggtctcatgcaaagtaccaagtgaattaatctcactgttcaacaaagaatgggatcgtgaaatcctgctaaacatactaaccctgttcgagaacattaatgataatatcaagaacgagggactcgcctcaagccggaaagaattctctcggagctcactgttctttctgtttaaagagtccggagtttgtgtgaagaagattaaagctctggcaaaccacaatgacttggtcgtgaaggtgaaggttttaaaggtgctcaccaagctatag

SEQ ID NO: 179442 - DNA, 477 bp, Artificial Sequence
  Description of Artificial Sequence: Synthetic coding sequence
atggtgtgccggctggacagcgccgtgcagatggccggcctgcggttgctaaccaacatgactgtgaccaaccactatcagcaccttttatcctatagcttcccggactttttcgcgctacttttcctgggcaatcattttacaaagatacagatcatgaagttgattataaattttaccgagaaccccgcaatgactcgcgagctcgtctcctgcaaggttcctagtgaactgatctctctcttcaacaaggagtgggatcgcgagatactgctcaatatcctcacgctattcgagaacatcaatgataatatcaagaatgagggattagcctctagcagaaaggaatttagtcgctcttctctcttctttttgtttaaagaaagcggggtgtgcgttaaaaaaattaaagccttggcaaatcataatgacttggtggtgaaagtgaaggtattaaaggttctgaccaagctttag

SEQ ID NO: 179443 - DNA, 1899 bp, Artificial Sequence
  Description of Artificial Sequence: Synthetic coding sequence
atgagccgggtgcgggacgccggctgcgtggccgccggcatcgtgattggcgcaggggcttggtattgcgtttataagtacacaagggggcgcgatcagaccaaaaagcgaatggccaagcccaagaaccgcgccgtggccggcactggtgcccgggcacgagccggcctcagggctgggttcacaatcgacttggggagcggattttctcctccgaccccagtgcgggcggaggctgaggacagagcacaggacgaggcaagtgccctggacaccgtgggggcagaggccgttgctcccgccgcatcgagcgcagaggctcagtccggggctggctcacaagcacaagaggcagatggagctggagttggccctaaggccgaatccgttgttggggccgcaatggcttccgctattgcgcctcctcccggcgtgaccgaggctctcggtgcagctgaggcccccgccatggccggggcacccaaggtggcggaagcaccaagagaagcggaaacctcccgagccgctgtaccgcccgggacggtcgtgcccaccgaggccgctgcaccaaccgaggtgaccgagggcccgggagtggctgccccgaccaaggttgctgaggcacctggcgtagctagccccacggaagccgctgaagccccggtgcctgcaacccccacaggagccgcggccccgaccggggctgccgaaagcccaggcacatctggtagccctagaacagcagttgtccctggcacctctgcggccaagaaagccacccctggcgcccacactggcgccatccctaaagccaccagtgctaccggggccgtccccaaaggagggggtaagggggtgacccgttcgcgcaacggcggcaaaggcaaaggcaaaaaatcaaaggtggaggtcgacgagctgggaatgggatttaggcctggtgatggagccgctgctgccgctgccgcatcggctaacgggggtcaggcttttctggctgaggtccctgatagcgaggaaggtgaatcgggatggacggacactgaaagcgatagcgactctgagcccgagacccaacggagagggcgaggacgtaggccagtcgcaatgcagaagaggccctttccctacgaaatcgatgaaattctgggagtgagggatctccgaaaagtgttggctcttctgcagaagagcgatgatccttttatacagcaggtcgccttgcttacacttagtaacaacgctaactattcttgtaaccaggaaactatccggaagctgggcggcctgccaatcatcgccaatatgatcaataaaactgatccccacataaaggagaaggcgcttatggctatgaataacttgtccgaaaactatgagaaccaagggaggctgcaggtctatatgaacaaagttatggacgatatcatggcttctaacctgaactctgccgtccaggttgtggggctgaagtttctgacaaacatgaccataacgaatgactaccagcatcttcttgtgaactcaattgccaacttttttcgcctcctgagtcaggggggcggcaaaataaaagtcgagatccttaagatactcagcaacttcgcggaaaatccggacatgttaaaaaagctcctctcaacccaagtgcctgctagtttctcctctttgtataattcctacgtggagagcgaaatcctaatcaacgccctgactctgttcgaaatcatctacgataatttacgggccgaagtattcaactatcgagaatttaacaagggatcgctgttctatctgtgtaccacttcaggcgtttgcgtcaaaaagatcagggccctggccaaccaccacgatctacttgtaaaggtgaaggtgatcaagctggtcaacaagttttag

SEQ ID NO: 179444 - DNA, 1899 bp, Artificial Sequence
  Description of Artificial Sequence: Synthetic coding sequence
atgagccgggtgcgggacgccggctgcgtggccgccggcatcgtgataggtgccggcgcgtggtactgcgtttacaagtatactaggggtcgcgaccagaccaagaaacgcatggccaagccgaaaaaccgagccgtggctggtactggggctcgtgctcgggcaggactgagagcagggttcacgatcgatttaggatccggcttttcacctcctacgcccgttagagccgaggcagaagacagggcgcaggacgaggcgagcgctctggatacagtgggcgctgaggcagtcgcacccgccgcatctagcgcagaggctcagtcgggcgccggctcacaagcccaagaagcggatggagccggcgtaggtcccaaggcagaatctgtcgtgggcgcggcgatggctagcgcgattgctccgcctcccggcgtgaccgaggctctgggcgcagccgaagctcccgccatggccggcgcccccaaagtcgcggaagctccaagagaggccgagacctcgcgtgctgcagtgcctcctggcacagttgtacctacagaggctgcagctcccacagaagtgacagaagggccaggagtcgccgcgccaactaaggtggccgaggcgcccggggtcgcctcccccactgaagccgctgaagcacccgttccagcaaccccaacgggcgctgccgctcccacaggagccgctgagagtcctggtacatccggctctccaaggactgcagtggtcccaggcacttctgccgccaaaaaagcaacgccgggagctcacacaggggcaatacccaaggcaactagtgcgacaggtgcagtacctaaaggagggggcaagggggtgacaagaagtaggaatggcgggaagggaaaaggtaagaagagcaaagtcgaggttgacgaacttggaatggggttccgccctggagatggcgctgccgccgctgctgctgcttcagccaatggtggacaggcctttttggccgaagtgcccgactcagaggaaggagaatccggctggaccgacacagagagcgattccgatagcgaacccgaaacgcaacggcgcggaagaggtcggaggcccgtggccatgcagaaaagaccattcccatacgagattgacgaaatcttaggcgtgagagatcttcgcaaggtgcttgctttgctgcaaaaaagcgatgaccccttcattcaacaggtggccctgctgacactgtccaataatgcaaactactcatgcaatcaggagaccatccgcaaactaggcggattgccaatcattgctaacatgatcaacaagacggatccccatatcaaggagaaagccctcatggccatgaataatttgagcgagaattacgagaatcagggacgccttcaggtgtatatgaacaaggttatggatgatatcatggctagcaacctgaattcggctgttcaggtggtggggctgaagtttctgacaaatatgacaataacaaatgattaccagcacctgctggtgaacagtattgctaacttcttcaggctactctcgcagggcggtggcaaaatcaaggtcgaaatcctgaaaattctgagtaatttcgctgagaatcccgacatgctgaaaaaactgctctccactcaggtaccagcgagcttttcttcgctttataactcttacgttgaatctgagatcctgataaacgccctaaccctgttcgaaatcatctatgacaatctcagagccgaagtgtttaactaccgagaattcaataagggcagcttattctacctgtgtacaacatcaggggtctgcgtgaagaaaattcgtgcccttgccaaccatcacgacctcctcgtaaaggtgaaagtgatcaagttggttaataaattttag

SEQ ID NO: 179445 - DNA, 1899 bp, Artificial Sequence
  Description of Artificial Sequence: Synthetic coding sequence
atgagccgggtgcgggacgccggctgcgtggccgccggcatcgtgataggagccggggcctggtattgcgtatataagtatacaaggggtagggatcagaccaagaagaggatggctaagcctaaaaaccgggctgtcgccggcacgggagctcgcgctagggccggactgcgggctggatttacaatcgatctgggaagtggatttagtccccctacaccagtgcgggctgaggccgaggaccgggcccaggatgaggcaagcgcactagacaccgtaggggcagaggccgtcgcgcccgcagcctcctccgctgaagctcagagtggcgccggatcccaggcgcaagaggccgacggggcaggagtaggaccaaaggccgagagcgtggtgggcgctgcgatggcgagtgccatagctcctcccccgggcgtcacagaagctctgggagcagccgaagctcctgcaatggctggcgcaccaaaagtggccgaggcacctagggaagccgaaacttcccgtgcagcggtgcccccaggaacagtcgtgcctactgaggccgcagcacccactgaggtgactgaaggacccggagtggcagccccaacaaaggtcgccgaggcccctggggtggcatccccaacagaagccgccgaagccccggttcccgctactccaacaggagccgccgcaccaaccggggccgccgagagcccaggtacatcaggcagtcctagaactgccgtcgttccgggaacttctgccgccaagaaagcaacccctggcgcacatacgggcgcgattccaaaagccacctcagcgaccggggccgtgcccaaagggggaggcaagggagtcacccgcagtcgtaatgggggaaagggcaaaggcaagaaatccaaagtagaggtggatgaattgggcatggggtttcgacccggagacggtgccgccgctgcagcagccgcctccgcaaacggcgggcaggcttttctcgccgaagtgcccgactcagaagagggagaatctggctggaccgacaccgaaagcgattcggacagcgagccagagacacagcgacgtggtcgcggtcgtcggcctgtggcaatgcagaagagacctttcccatatgagatcgatgaaattctcggcgtcagagacctgcggaaagttctagccctccttcagaagtcagacgacccattcatccaacaggtggctctgctgacactgtccaataatgcaaactattcttgtaatcaggagaccatcagaaaactaggcggcctacctatcattgctaacatgattaataaaacagaccctcatataaaggagaaggctctgatggcgatgaacaacctgagcgaaaattacgagaaccagggacggttacaagtgtacatgaacaaggttatggatgatatcatggcttctaacctgaattccgccgtgcaagtagtgggcctgaaattcctgaccaacatgaccattacaaacgactaccagcaccttctcgttaactccattgcaaacttttttcgactgctgagtcaagggggtggcaagatcaaggtagaaattctgaaaattctgagcaacttcgctgaaaatccagacatgctgaagaaactgctgtccactcaggttccggcgtctttctcatcactttataatagctatgtagaatccgagatcttaattaatgcattaactcttttcgagatcatctatgataacttacgcgctgaagtgttcaattaccgagagttcaataagggaagccttttttacctgtgcactacatctggcgtgtgcgtcaaaaaaatacgggccctcgccaatcatcacgatttactagttaaggtgaaagtgattaagctggtcaataagttctag

SEQ ID NO: 179446 - DNA, 504 bp, Artificial Sequence
  Description of Artificial Sequence: Synthetic coding sequence
atgagccgggtgcgggacgccggctgcgtggccgccggcatcgtgatcggtgccggggcctggtattgcgtgtacaaatacactcgcggcagggatcagactaagaaaagaatggccaagccaaagaacagagcggtcgccgggactggcgctcgagcgagggcaggactgcgtgccggcttcacaatcgatctgggaagtggcttttcaccacctacccctgttcgagccgaggctgaggaccgcgcgcaagacgaggcttccgcacttgacaccgtaggagctgaggccgtggcaccagccgcgagctccgctgaggctcagtcaggcgcaggttctcaagcccaagaagccgacggggctggagtggggccaaaggccgaatccgtggtcggcgccgctatggcctctgccatcgcccccccccctggcgtgactgaggcccttggcgcagcagaggcacccgcaatggcaggcgcaccgaaagtcgcagaggcaccctag

SEQ ID NO: 179447 - DNA, 189 bp, Artificial Sequence
  Description of Artificial Sequence: Synthetic coding sequence
atgagccgggtgcgggacgccggctgcgtggccgccggcatcgtgatcggtgcaggagcatggtactgtgtctacaaatacacaagagggcgcgatcagaccaaaaaacgtatggcgaagccgaagaatagagccgtcgccggaaccggagccagagcacgcgccggactgagggcagggttcacttag

SEQ ID NO: 179448 - DNA, 498 bp, Artificial Sequence
  Description of Artificial Sequence: Synthetic coding sequence
atgagccgggtgcgggacgccggctgcgtggccgccggcatcgtgattggggctggggcctggtactgtgtgtataagtacacccggggacgcgatcagacaaagaaaagaatggcgaaaccgaaaaatagggctgtggccggcaccggcgcgagagctcgcgccgggctgcgcgccgggttcactattgatttaggttccggcttctctcctccaacgcccgtacgcgcggaggcagaggatcgcgcccaggatgaggcctccgcgttagataccgtgggggcggaagccgtcgctccagctgcctctagcgctgaggcccagtccggtgccggcagccaggcacaggaggctgatggcgctggtgttggccctaaagcagaaagcgtcgtgggcgcggccatggctagcgctatagcaccacccccaggagtgacagaagccttgggggcggctgaggctcccgcgatggccggcgccccgaaagtggcagaatag

SEQ ID NO: 179449 - DNA, 318 bp, Artificial Sequence
  Description of Artificial Sequence: Synthetic coding sequence
atgagccgggtgcgggacgccggctgcgtggccgccggcatcgtgatcggagcaggtgcttggtactgcgtctacaagtacactcgggggagagatcagaccaaaaagcgaatggccaagcctaagaacagggccgtggccggcaccggcgcaagagccagagccggcctgagggcgggttttacgatcgatttgggatcagggttctccccgccaacacccgtaagagccgaggctgaagacagggcccaggacgaggcatccgcccttgacactgtcggggccgaagctgttgcccctgccgcatcttccgcatag

SEQ ID NO: 179450 - DNA, 282 bp, Artificial Sequence
  Description of Artificial Sequence: Synthetic coding sequence
atgagccgggtgcgggacgccggctgcgtggccgccggcatcgtgattggcgctggtgcttggtactgcgtgtataaatacactagagggcgagaccagactaagaagcgcatggccaaacccaaaaaccgcgccgtcgctggcaccggagcccgggcacgagcaggactgcgcgcaggcttcaccatcgacctaggttccggtttctcccctcccactcccgtgagggccgaggccgaagacagagcccaggacgaggcctcagcactagatactgtctag

SEQ ID NO: 179451 - DNA, 1140 bp, Artificial Sequence
  Description of Artificial Sequence: Synthetic coding sequence
atgggctacgcccggaaggtgggctgggtgaccgccggcctggtgattggggcaggagcgtgttactgtatttataggctgacccgtggccggaaacaaaacaaggaaaagatggccgaaggggggtctggcgacgtggatgatgcaggcgattgcagtggagcgcggtacaatgactggtcagatgatgacgatgatagtaacgaatcaaaatctattgtgtggtaccccccttgggccagaatcggaaccgaggcaggcaccagggcccgggctcgggcccgtgcccgcgccaccagagcacggcgcgctgttcagaagcgagccagccctaacagcgatgataccgtcctgtccccccaggagctccagaaggtcctgtgtcttgtggagatgtcggagaaaccctacatcctggaggctgcgctgattgccctggggaacaacgccgcctacgcattcaatcgcgacatcatccgtgatctgggggggcttcccatcgtggctaaaatcttaaatactcgagaccccatcgtaaaagagaaggctttgatcgtgttgaacaacctgagcgtgaatgcagagaaccaaaggcgtctgaaggtttacatgaatcaggtctgcgacgacacgataacttctcgactgaactcgtctgttcagctggccggactccggttgctgaccaacatgaccgtgacgaacgagtaccaacatatgctggccaatagcattagcgacttttttcgactgttctctgcagggaatgaggagacgaagctccaggtattaaaactgctgctcaacctggctgagaatcccgcaatgactcgtgagctgctgcgagctcaggttccttcttccctcggcagcctgtttaataagaaagagaacaaggaagttatcctaaagctactcgtgatattcgagaacatcaacgacaacttcaagtgggaagaaaatgagcctacccagaaccagtttggggaaggcagcttgttcttctttctcaaagagttccaagtatgtgccgataaagtgctgggtattgaatctcaccacgactttctggtgaaggtcaaggtgggaaagttcatggctaaactggcagagcacatgtttccaaagtcccaagagtag

SEQ ID NO: 179452 - DNA, 1140 bp, Artificial Sequence
  Description of Artificial Sequence: Synthetic coding sequence
atgggctacgcccggaaggtgggctgggtgaccgccggcctggtgatcggggctggcgcgtgttactgtatttatagactgacgcgggggcggaaacagaataaagaaaaaatggctgagggcggctcgggagacgtggacgacgccggggactgctccggggcgcgctataatgattggagcgatgacgacgacgatagtaacgaatccaaaagcattgtatggtatcccccctgggccaggattggtacagaagcaggcacccgcgctcgagctcgcgcgcgcgcccgggccactcgtgccagacgagccgtgcagaaacgcgcgtctcccaacagtgatgatacagttttgagtccgcaagagttacaaaaagttttgtgtctggtggagatgagtgagaagccatatatacttgaggctgccttgattgccttgggcaacaacgccgcctacgctttcaaccgggatatcataagggatctcggtggcctccccatcgttgcaaagatattaaatactcgcgaccccatcgtgaaagaaaaggcactcattgtccttaataacctttctgtcaatgccgagaaccagaggcgactcaaggtgtacatgaaccaggtctgcgacgacaccattacctccagactgaactcatcagtgcagctggccggacttcgtcttcttaccaatatgactgtgaccaatgagtaccagcacatgcttgcgaactctatttctgatttcttccgattgtttagcgccggtaacgaggagacaaaactacaggtcttgaagttgctgttaaatctggccgagaacccagccatgacaagggaacttctgcgagcccaggtcccctcgtcactcggatccctctttaacaagaaagaaaacaaggaagtcatcctgaagttgttagtgatattcgaaaacataaatgacaactttaaatgggaagaaaacgaacctacccagaatcagtttggcgaaggcagcctgttcttttttttaaaggagtttcaggtttgcgcagataaggttttgggcattgagtcgcaccacgactttttagttaaagtgaaggtgggcaaatttatggccaagctggccgaacacatgttcccgaagtcccaggagtag

SEQ ID NO: 179453 - DNA, 2889 bp, Artificial Sequence
  Description of Artificial Sequence: Synthetic coding sequence
atggaggactgcaacgtgcacagcgccgccagcatcctggccagcgtcaaagaacaggaggcccgttttgagagactgacacgtgcattagaacaggagcggcgtcatgtggcacttcagttggaaagagctcagcagcctggtatggtctcaggcggcatgggctcaggacagcccctacctatggcttggcagcagcttgtgctgcaagaacagtccccggggagccaggcctctctggctaccatgccagaggccccagacgtattggaagaaaccgtcaccgtcgaagaggatcccggcacacctaccagccacgtgagcattgtgacgtctgaagacggcacaacaagaaggacggagacaaaggttactaaaaccgtaaagaccgtgactaccagaacagtaaggcaggtccccgtgggtcctgatgggctgcccctcctggacggcggcccgccattggggcctttcgctgatggagcactggacagacattttctgctccgaggcggcggacctgttgccaccctgtcacgggcgtacctgtcctcagggggcggatttcccgaaggccccgaacctagagattccccttcctatgggtctctgagcagagggctgggaatgaggccaccacgcgccgggcccctcggcccagggcccggagatggttgcttcacccttccaggacacagggaagcgttccccgtgggcccagaaccaggccccccaggtggaaggtcgctgccagagaggttccaggcggagccatacggattggaggatgacacccgatctctagccgccgatgatgaagggggccccgagttggagccggactatggtacagcgacccgccgacgacctgagtgcggaagagggcttcacactcgtgcgtacgaggatactgctgacgatggtggtgaactcgcagatgagcgaccagccttccccatggtcaccgcccccctcgcccagcctgagaggggcagcatgggatcccttgaccgcctcgtcaggcgctccccttctgtggatagtgctcggaaggaaccaaggtggcgcgacccagaactgccggaggtgctcgctatgctacggcaccctgtagatccagtgaaagccaacgccgctgcttacctccaacacctttgctttgagaatgaaggcgtgaaacggcgggttcgccaattgcgggggctgcctctgctcgtcgcccttttggatcatcctcgggcggaagttcggcgccgggcttgtggcgccctccgcaacttaagctatgggagggacactgacaataaagccgctattcgggactgtggaggagttccggcattagtcagactgctgagggcggcccgggataacgaggtgcgggaattagtgacaggaaccctttggaacctttccagttacgaacctttgaagatggtaattatcgatcacggcctgcagacactgactcatgaagtgatcgtgcctcacagcggctgggaaagagaacctaacgaggattctaaaccgcgcgacgcagagtggactacagttttcaagaatacatctggctgtttgagaaacgtcagttcagacggagctgaggcccgtaggcgtcttcgagaatgcgagggactggtggatgccttgcttcatgcgttgcagtctgcagtcggaaggaaggacaccgataataaatcggttgagaattgtgtatgcataatgcgcaacctgtcctaccacgttcacaaagaggtccccggggcagaccgctaccaggaagcagaacctggcccattgggatcggccgtgggctcccagcggcgccgaagagatgatgcttcatgctttggaggaaaaaaagctaaagaagagtggtttcatcagggcaaaaaggacggcgagatggatcggaacttcgacacccttgatctccctaagcggaccgaggctgcaaagggatttgaactgctttaccagccagaggtggtcagactttacctatctctgctgactgagtcacgcaacttcaacactctggaggccgctgctggcgcactgcaaaatctctcggccggcaattggatgtgggcaacctacattcgcgctacagtgcgtaaggaaagaggcctcccagttctggttgagctgctgcagagcgagaccgacaaagtggttcgggctgtggcgatcgccctcaggaatctttccttggaccgccgaaacaaggatctcataggtagctacgctatggcggaactagtgcggaatgtacgcaacgcacaagctccccctcggccgggggcctgcctagaagaagacaccgtggttgccgtgctgaataccatccacgaaattgtctctgacagtctcgataatgccaggagtctgctccaagcccgcggcgttccagcactggtggccctcgtcgccagtagtcagtccgtgcgggaggcaaaggccgcatcccacgtactgcagaccgtgtggagctataaggaattaagggggacactgcaaaaggatgggtggaccaaggcccgctttcagtctgccgcagctactgccaagggtcccaagggagcactgtcccctggcgggttcgacgattccactcttccgctcgtggacaaatctctcgaaggcgagaagaccggatcacgcgatgtgatccctatggacgccttggggcccgacgggtactctaccgttgataggcgggaaaggcgtcctcgcggagcctcatccgcgggcgaggcaagcgagaaagaacccttaaagcttgatccatcacgtaaagcccctccaccaggacccagcaggcccgcagtgcgtctcgttgacgctgtcggggatgctaagccccaaccagtagacagctgggtgtag

SEQ ID NO: 179454 - DNA, 2700 bp, Artificial Sequence
  Description of Artificial Sequence: Synthetic coding sequence
atgcccgccgagctgcggcaggagcagagccccggcagccaggcctcacttgccacgatgcctgaagctccagatgtgctcgaggagactgttacagttgaggaggatccgggcacgcccacatcacacgtgagtattgtgacttcagaggatgggactacaagacgtacagagacgaaagttaccaagactgtgaagaccgtgacaacaagaaccgtgcgccaagtgcctgtcgggcccgatggacttcctttgctcgatgggggccctccactgggtcccttcgcagacggtgcattggacagacatttcttgcttcgggggggcggccctgtggcaactctctcacgcgcctaccttagtagtggagggggcttcccggaaggcccggaacctagagactctccaagttacgggagtctttctcggggattgggcatgcgaccccctcgagctggaccgttaggcccaggccccggggacggatgtttcactctcccaggccatcgcgaggcctttcccgttggacccgagcctggcccccctggcggtcgttcactgccagaacggtttcaagcggagccatatggcttggaagacgacacgcgctccctggctgccgacgatgaaggaggtccggagctggaacccgactacgggaccgctacccggcggaggcctgagtgcgggagaggtctgcacactagagcttacgaagataccgccgatgatgggggagagctggcagatgagagacccgcttttcccatggttacagcaccgctggcacagccagaaagggggagcatgggcagcctcgacaggctggtgcggcggagcccttctgtggattcggctcgcaaggaaccacggtggagggatcctgaacttcctgaagtgctcgccatgctgagacatccagtcgatccggtaaaggctaatgcagccgcgtacttgcagcatctgtgcttcgaaaatgagggagtgaaacgaagggtacgtcaactccggggactacctcttcttgtggcgctgctcgatcacccaagggcagaggtacgccgacgcgcctgcggtgcattgcggaacctgtcttacggcagggacactgacaataaggcagccatccgggactgcggtggagtacccgcactcgtgcgactccttcgggccgcccgggacaacgaggtgagagaactagtcactggcactctgtggaaccttagtagctatgaaccactgaagatggttatcatcgatcatggcctgcagaccctcactcacgaagtgatcgtgccacattcggggtgggagcgggaacccaatgaagatagtaagccgagggacgcagagtggacgaccgtctttaagaacacatccggttgtttaaggaacgtttccagcgatggagccgaagccaggagacgactgagagaatgtgagggattggttgacgccctactccacgcactccagtctgccgtcggcaggaaagacactgacaacaaatctgtcgaaaactgcgtatgcatcatgcgcaatctctcctatcatgtacacaaggaagtgcctggagccgataggtaccaggaggccgaaccgggcccccttggctctgccgttggcagccagcgacgacgcagggacgatgcgtcctgttttgggggcaagaaggccaaggaggaatggtttcatcaggggaagaaggacggggaaatggaccgaaatttcgatactctggatctgccaaaacggaccgaggcagccaaaggcttcgaactattgtaccagcctgaggtggttaggttgtacctgtcactgttgacggaaagccggaacttcaacaccttggaggccgctgccggtgccctccagaatctgtccgccggaaactggatgtgggctacgtacatacgggcgacggtgcgcaaggaaaggggcctacctgttctggtggagctcctgcagagcgagacggacaaagtcgtgagggccgtcgccattgcgctcaggaatctgtctttagaccgacgtaataaggacttgataggcagttacgcaatggctgagctagttcggaacgtcagaaatgctcaggcaccccccagacccggcgcctgcctggaggaggacaccgtcgtagctgtgctgaacacaattcacgagatcgtctctgactccttggacaacgcacgctcactcctccaggcacgcggtgtgcccgcactggttgctctggtggcaagcagtcagagcgtccgggaggccaaggctgcgtcccacgtgttgcagacagtttggtcgtacaaagagctccgtggcacattgcagaaggatggctggaccaaggctaggtttcagagcgcagccgccactgctaaaggcccgaaaggagcccttagccccggcggttttgacgacagtaccctgccccttgtagacaaatctcttgagggtgagaagacaggctcccgtgacgtcataccaatggacgcgcttggtccagatggctactcaacggtggataggagggagcgcaggcctcgcggggctagttctgctggagaagccagcgaaaaagaacccttgaaactggacccttccagaaaggctccacctcccggccccagcaggcccgcagtgagactagtggatgccgtgggagatgccaagccacagcccgtggattcttgggtctag

SEQ ID NO: 179455 - DNA, 2700 bp, Artificial Sequence
  Description of Artificial Sequence: Synthetic coding sequence
atgcccgccgagctgcggcaggagcagagccccggcagccaggcctcgctcgcaactatgccagaggccccagacgtgcttgaagagactgttacagtagaagaggatcccggtacacccaccagtcatgtctccattgttaccagtgaggacggcacaacacgcaggacagaaacaaaagtaacaaagactgtcaaaaccgtaacaactcgcaccgtgagacaggttcctgttggacctgacggcttgcctctcttagatggcggaccaccgctaggccccttcgccgacggcgcactcgacaggcactttttactgagagggggcgggcctgttgccactctcagcagggcctacttgagctcaggaggcggtttccctgagggccctgaaccccgcgactcaccgagctatggctcgctgtcccggggccttggaatgagaccacccagagctgggcccttaggccccgggcctggcgatggctgtttcaccttacctggccaccgcgaggccttccctgtgggacccgaacccggtccccctggcgggcgctctctgccagagaggttccaagccgaaccctatgggttagaggacgatacgcggagcctggctgccgatgatgagggcgggccagagttggaaccagactacggcacggccacgcggcgccggccagaatgtggcaggggactgcatacccgcgcgtacgaggacaccgcagatgatggcggcgagctggcggatgagcgcccggccttcccgatggtgaccgccccacttgcccagcctgagagaggttcaatgggctcattagatcggctggtgaggaggagtccaagcgtggattcggctaggaaggagccccgttggcgtgatcccgaattaccagaggtgttagctatgctgagacatcccgtcgatcctgttaaagcaaacgctgccgcctatcttcagcacctgtgctttgagaacgagggcgtcaaacgcagggtgcggcagttaaggggtctgccactgctggtggccctcctggaccatccacgagccgaagtgcggagacgggcctgcggcgctctccgcaacctgtcctacggtcgcgataccgataacaaggctgcaattagggactgtgggggcgttccagcacttgtccgccttctgcgggccgcaagagataacgaggtgcgtgaactcgtgaccgggactctgtggaatctgtcgtcatatgagcccctgaaaatggtcatcattgatcacggactccaaacactgacccacgaggtgattgttccgcactcaggctgggagagagagcccaatgaggactccaagcctcgcgacgcagaatggacaacggtgttcaagaatactagtggatgtctccgtaatgtgtctagcgacggtgctgaggcacggcgcaggctgcgtgagtgtgaaggcctggtggacgccctgctacacgcattgcagagcgcggtgggtcggaaggacactgataataagagcgtcgaaaattgtgtgtgcatcatgagaaatctgtcctaccacgtacataaagaagtgccaggtgcggatagataccaggaagctgaaccgggacccttaggaagtgctgtgggttctcaacgacgcagaagggatgacgcatcttgtttcggcggtaaaaaagctaaagaagagtggtttcatcaagggaaaaaagacggggagatggacaggaacttcgacaccttggacttgcctaagcggactgaggctgcaaaaggttttgaactgctttatcagccggaggtggtgaggctgtacttgagcctgctgaccgagagtcgcaacttcaacacattagaagccgcagctggagctctccagaacctgtctgccggaaactggatgtgggcaacttatattcgggccacggtccgcaaagaacgtggtctccctgtactggtggaattgctgcagtccgaaaccgataaggtggttcgggccgtggccattgcactgaggaatctctctctggaccggcgcaacaaagacttgatcggatcgtatgctatggctgagctcgtcaggaatgtgagaaatgcccaagctcccccacgccccggagcatgtttggaggaagacacagtcgtggcggtactcaacaccattcatgaaattgttagcgactcactggacaacgctagaagtttgctgcaggcacggggagttcccgcactggttgcactcgtggcctcctcccagtccgtccgtgaggccaaggcggcgagtcacgtgctacaaaccgtgtggagttacaaagaactgcgcggtacgttgcagaaggatggctggacgaaggctaggtttcaatctgctgcagccacagcaaaaggccccaagggggcgctctcccctggaggttttgatgactccacactgcctctggtggacaagtccctagagggcgagaaaactggtagccgcgatgtgatccccatggatgccctaggaccagatggctattccactgttgacaggcgcgaaagaagaccaaggggcgccagttccgctggcgaggccagcgagaaggagccactgaagttggatccttcacggaaggcaccacccccaggtccatcacgcccagccgtgaggttggtggacgccgtcggggacgcaaagcctcagcccgtcgattcctgggtgtag

SEQ ID NO: 179456 - DNA, 2871 bp, Artificial Sequence
  Description of Artificial Sequence: Synthetic coding sequence
atggaggactgcaacgtgcacagcgccgccagcatcctggccagcgtgaaggaacaggaggctcggtttgaaagactaacacgtgctcttgaacaggagaggagacacgtggcattgcagctggagcgtgcccaacagccgggcatggtctccggagggatgggctcaggtcagccactaccaatggcttggcagcagctcgtactgcaagagcagtcacctggatcacaggcatcccttgcaaccatgcctgaagctcctgacgtacttgaggagactgtaactgtcgaagaggatcctgggactcctacctcacatgtgagtattgttacttccgaggatgggactacacggaggaccgagacgaaagttacaaaaaccgtgaagacagtaaccactcggaccgtcagacaagtgcctgtggggcccgacggtcttccgctgcttgatggcgggccaccacttggaccgttcgccgacggcgcactggaccgtcatttcctgctgcgaggtggaggccctgtggctacgctgtctcgagcttacctttcttccggagggggctttcccgagggtcccgagcctcgggactctccctcctatggctcattgtcgagagggctcggtatgcgtcctccacgcgcgggcccactgggtcccggacctggggatggatgttttacgctccctggacatagagaggccttccccgtcggccccgagcccggccctcccggcgggcggagcctgcccgaacggttccaggcggaaccgtatggcctggaagatgacactcggagcctagccgctgacgatgagggcgggcctgagctggaacccgattatgggacggccactcgaagaaggccagaatgtggtagggggctgcacacacgtgcctacgaggacacagctgacgacggcggagaactcgctgatgaaagacctgcattccccatggtgacagcccccttagctcagcccgagcgcggatccatgggtagcctggaccgcctcgtccggcgatcaccaagcgtagactctgccaggaaggaacctcggtggagggaccctgagctgccagaagtgcttgcgatgttgcggcaccctgttgatcccgtgaaagcaaacgcagccgcttatctacagcacctgtgcttcgaaaacgagggggtcaagaggcgggtgcgccagctgcgaggcttacctctgctagtggcccttctggaccatccccgtgctgaagtccgcaggcgtgcctgtggggctctgcggaatctgtcctacggcagggatacagataataaagcagctatcagagattgcggcggcgtgcctgccctggtccggctgctccgcgccgcccgcgataacgaagtcagggaactggtgacaggcacactttggaacctcagctcctacgaacctttgaaaatggtcatcattgatcatggtctccagacattaacgcacgaagtgattgtccctcattctggctgggaacgggagccaaatgaggactctaaaccaagagatgccgaatggactactgttttcaaaaatacctcaggttgcctccgcaacgtttcatccgacggggctgaagccaggaggcgtctgcgtgagtgtgagggcctcgtggatgctttgctgcacgcactgcagagcgccgtggggaggaaagatacagacaacaaatcagtcgaaaactgtgtgtgtattatgcgcaacctcagctaccacgtgcataaagaagtgccaggagctgacagataccaggaagccgagcccggccccctaggctctgctgtagggtctcagaggaggcgcagagatgatgcaagttgtttcggcggaaaaaaagcaaagggcaaaaaagatggggaaatggaccggaacttcgataccttggatctacccaagaggaccgaggctgcaaagggttttgaattgctctaccagcccgaggtagtgagactttatctttccttgctgaccgaaagtaggaacttcaacactctggaagccgctgctggggccctccagaatctgagtgccggcaattggatgtgggcaacatatatcagggcaaccgtgcgtaaggaacgaggattgccagtgctggtggagctactgcagtctgagaccgacaaggtcgtgcgagcagtagctatagcgttgaggaatctatcccttgatcgccggaacaaagatctaataggctcatacgcaatggccgagttggtgaggaacgtccggaatgcgcaggccccccctcgtccgggtgcatgtctggaggaggataccgtagtggccgttctgaataccatccacgagattgtatctgattccctggataatgccaggtcactcctgcaagccaggggagtgccagccctggtggccctggttgcgtcatcccaaagcgtccgtgaggcaaaagccgctagtcacgttctgcaaactgtttggtcttacaaggaactccgcggcacactccagaaagatggctggaccaaagccagattccagtcagccgcggccaccgccaaaggccccaagggggctctctccccaggtggcttcgatgactccaccctccccctggtggataaatccctggaaggtgaaaagaccggctcgagagacgtgattccaatggacgccctgggtcccgacggttattctacagtcgacaggagagagagacgacctcgaggagcttcaagtgccggtgaggcaagcgaaaaggaacccctcaagctggacccaagtagaaaggctccgccaccgggcccaagccggccagctgtgcgcctcgtcgatgcggtgggggacgctaagcctcagccagtcgactcctgggtgtag

SEQ ID NO: 179457 - DNA, 2682 bp, Artificial Sequence
  Description of Artificial Sequence: Synthetic coding sequence
atgcccgccgagctgcggcaggagcagagccccggcagccaggcctccctggcaaccatgcccgaagcgcccgacgtcctggaggaaactgtgactgtagaagaggaccctggcaccccaacttcacacgtgtcaatcgtgacgagcgaggatggaacaacacggaggacggagactaaggtcacgaagaccgtgaaaactgtaactactcgcaccgtgaggcaagtaccagttggcccagacggcctccctttacttgatggcggacctccattaggccctttcgctgatggtgcactggacaggcatttcttgctgcggggcggaggccccgtagcgacactgagccgggcctacctctcgtccggcgggggttttcctgagggtccagaacccagggatagtccgagctacggatcactatctagagggttgggcatgagacctcccagggctggccccttaggccccggtccaggggacggctgcttcactctccccggtcaccgtgaagcttttcccgtcggccccgagcctggaccacccggcggacgaagtctccccgagcgatttcaagcagagccgtacggactggaagatgatacacgctcactggctgccgatgacgaaggcgggcctgagctggagccagactatggtaccgccacccggcgacggccagaatgcggacgaggcctccacactcgggcctacgaggacactgccgacgatggcggcgaacttgcggatgagcggcctgccttcccaatggtaactgcgccactcgcacagcctgagcgagggtctatgggaagtctcgaccggctggtaagaaggagcccttcggtcgacagcgctcgtaaagagcctcgatggcgggatcctgaattgccagaggtgctggctatgttacgtcatcccgtcgaccccgtgaaggccaatgccgccgcatatttgcagcacctgtgcttcgaaaacgagggggttaaaagacgcgtacggcagcttcgaggcctccctttgctagtcgccctcctagatcacccaagagccgaggtgcgacgcagagcctgcggggctctccgcaatttgagctacggaagagacaccgataacaaggcggccatccgggattgtggtggggtgcccgccttagtccgcctgctgagggctgcccgggataacgaggtgagagaactggtaacaggtaccctttggaacctgtcgtcatatgagcccctgaaaatggtgattatcgatcacggcctccagaccctgacacatgaggtgattgtgccccactcagggtgggaaagagagccaaacgaagactctaagccaagagatgcagaatggaccaccgtatttaagaatacgtctggctgtttgagaaacgttagtagcgacggggcagaggccaggcgccggctgcgcgagtgcgagggcttagtggatgcattgctccacgcattgcagtctgctgtgggccgtaaggatactgataacaagagtgttgagaactgcgtctgtatcatgaggaacttgtcgtaccacgtgcataaagaggtacctggcgcagaccgctatcaggaagcagagcccggccctcttggttccgcggttggctcccagaggcggaggcgggatgatgcaagttgtttcgggggaaaaaaggcaaaaggtaaaaaggatggtgagatggatagaaacttcgatactctggacctccctaagagaaccgaggctgctaaaggcttcgaactcctgtatcagcctgaagtagtgagactttacctcagccttctcaccgagagccggaattttaacacgctcgaagctgcagccggagccctgcagaacctgtctgcaggcaactggatgtgggctacctacatcagggccacggttcgaaaggaaaggggcctgccagtgttggtggagctgctgcagagcgagacagacaaagtggtccgtgccgtggctatcgccctcagaaacctgagcctggatcgccgcaacaaagatctcatcgggtcttacgcaatggccgaactcgtcaggaacgtgcgtaatgcgcaagcacccccacgccctggtgcttgtctggaggaagacaccgtcgtagcagtcctgaataccatccatgagatcgttagtgacagcctggataacgctagatctctgctgcaggcgcggggcgtacctgcgttagtggcactggtagcgagcagtcaaagtgtgcgcgaagcaaaggctgcatcccatgtgctgcagaccgtttggagctacaaggagctgcgtggcacattgcagaaggatgggtggactaaggcacgattccagtcggcagcagcgaccgcaaaggggcctaagggcgcactgagtcccggaggattcgacgattctaccctgcccctcgtcgataagtctctggagggcgagaaaactggaagccgagatgtgatccccatggatgccctgggccctgacggatactctactgtcgataggcgcgaaaggagaccacgcggggcaagctccgcgggcgaggcaagtgaaaaggaaccactgaagctggaccccagcaggaaggcccccccgcctggccccagcagaccagcagttcgattggtcgatgccgtcggcgatgccaagccacaacctgtggacagttgggtgtag

SEQ ID NO: 179458 - DNA, 1131 bp, Artificial Sequence
  Description of Artificial Sequence: Synthetic coding sequence
atggagagctacgacatcatcgccaaccagcccgtggtgatcgacaatggttctggggtgatcaaagctgggtttgctggtgatcaaatccctaaatattgctttcctaactatgtgggccggcctaagcacatgcgggtgatggccggcgccctggaaggcgacttatttattggtcctaaggctgaagaacatcgcggcctgttgacaattcgatacccaatggagcacggggtggtgcgggattggaatgacatggaaagaatttggcaatacgtatactctaaggaccagctacagaccttcagcgaggagcacccagtgctcctgaccgaagccccactcaatccatccaagaacagggagaaagccgcggaggtgttcttcgaaaccttcaacgtgccggcacttttcatcagcatgcaagccgtgctgtccctgtacgcaactggcagaaccactggcgtggtgctggatagtggggacggagttacacatgccgtgcctatctatgaaggattcgccatgccacactcaatcatgcgcgtggatatcgccggaagggacgtgagtaggtatctgagactcttactccgcaaggaaggcgtggatttccatacatccgccgaatttgaagttgtgagaaccattaaggagagggcttgttacctgagcattaatccacaaaaagacgaagccctggaaacggagaaggtccagtacacacttccggacggaagtactctcgatgtgggccctgcccggttcagggcacccgaactgctttttcagccagacttagtgggtgacgaaagtgaaggattgcacgaggttgtggcctttgctattcataagtctgacatggacctgagacggacactctttgccaacattgtgctgagtggtggatccaccttattcaaaggattcggagataggctgctgtccgaggtcaagaagctggctcctaaggacattaaaattaagataagcgccccgcaggaaaggctgtactccacgtggataggggggtccatccttgccagtctcgacacctttaaaaaaatgtgggtaagtaagaaagagtatgaggaggatggcagcagggcaattcaccgtaagacattttag

SEQ ID NO: 179459 - DNA, 1167 bp, Artificial Sequence
  Description of Artificial Sequence: Synthetic coding sequence
atgagcaaggtgttcaagaagaccagcagcaacggcaagctgagcatctacctgggcaagcgagactttgtggatcacgtggataccgtggagccaatcgacggcgtcgttctcgttgatcccgagtacctcaagtgtcgcaaactatttgtgatgttaacctgtgcatttcgttacggtcgggacgacctcgaagtgatcggcttgacatttcggaaagacctgtacgttcagaccctgcaggtggttcctgcagagtcctccagtcctcaagggccgctcaccgtgctgcaggaaaggctcctccataaactgggcgacaatgcttatccctttaccctgcagatggtgaccaatctgccatgttccgtgactttgcagcctggaccagaggatgcgggaaagccctgcggaatcgactttgaggtgaaatccttctgcgcagagaatcctgaagagaccgtgagcaaacgcgactacgtgcggctggtcgtgcgtaaggtccagttcgcgccacccgaagccggcccaggcccaagcgcccagaccatccgacgctttttgctgtccgcccagcctctgcaattgcaggcatggatggatcgcgaggtacactatcacggcgagcctatctccgtgaatgtctcaatcaacaactgcactaacaaggtaatcaagaaaattaagataagcgtggatcagatcacagatgtggtcctgtacagtctggataagtatacgaagacagtttttatacaggagttcaccgagacagtagccgcgaattcttctttcagtcagtcctttgcagtgactcccatcctggccgcctcttgccagaaacgcggactcgccctcgatgggaaattgaaacacgaggataccaatctcgcttcgtccacaattattaggcctggcatggacaaggaactgctaggcattctagtgtcctataaagtcagggttaatttgatggtctcctgtggcggcatcctgggggatcttactgcatctgacgtgggagtggaactcccactggtactgattcatccaaagccctcccatgaggcagcttctagcgaggacatcgtgatcgaggaattcacacgaaaaggcgaggaggagtcacagaaggctgtagaggccgaaggagacgaggggtcttag

SEQ ID NO: 179460 - DNA, 1167 bp, Artificial Sequence
  Description of Artificial Sequence: Synthetic coding sequence
atgagcaaggtgttcaagaagaccagcagcaacggcaagctgagcatatacctcggcaagcgcgactttgtggatcatgtggacacggtcgagcctatagacggggtagtactggtcgaccctgaatatctgaagtgtcgaaagctcttcgttatgttgacgtgcgcgtttcggtacggcagggatgatctcgaggtgattggactgacctttagaaaggacctatatgttcagactctccaggtggtaccggcagagtcgagttcaccccagggccctttaaccgttctgcaggaaaggctactacataagcttggcgataatgcctacccttttacactgcagatggtgaccaaccttccttgtagcgtgaccctgcagcctggcccagaggacgcaggcaaaccttgtggaattgatttcgaggttaaatccttctgtgcagaaaatcccgaagaaaccgtgtctaaacgggattacgtgcgattggtggtccggaaagtccagtttgcccctcccgaggccggtcctggtccatccgcacagactatcaggcgatttttattgagtgcccagcctcttcagttgcaagcatggatggaccgcgaagtgcattaccatggcgaaccaattagcgtgaacgtcagcatcaataactgtactaataaagtaatcaagaagatcaagatctctgtcgatcaaatcaccgatgtggtgctctattctctggataaatacaccaaaacagttttcattcaggaattcactgagactgtggctgcaaattctagtttttcacagagtttcgcagtgactccaattttggccgcctcctgtcagaagcgcgggttggccctggacggtaagcttaaacacgaagacaccaaccttgcatcatcaactataatccggcccggtatggataaagaactactgggtatcctagtaagctataaggtcagggtgaatcttatggtgtcgtgtggtggtatactgggagacctgactgcctccgatgttggcgtcgaacttcctttggtgcttatacatccaaagccgtcccacgcatccgccagcagcgaggatatcgttatcgaagaattcacccgaaaaggagaggaagagtcacaaaaggctgtcgaagcggaaggtgacgaggggtcttag

SEQ ID NO: 179461 - DNA, 1080 bp, Artificial Sequence
  Description of Artificial Sequence: Synthetic coding sequence
atgagcaaggtgttcaagaagaccagcagcaacggcaagctgagcatctacctcgggaaacgggattttgtggatcatgtggacacagtggagccaatcgacggagtggtgctggttgatcccgaatatctcaaatgtcggaaactgttcgtaatgcttacgtgcgcgttccggtacggtagagatgacctggaagtgataggcctgacgtttagaaaagatctgtatgtccagaccctgcaagtggtgccggcagagagctctagtccacagggcccactgacagtgttacaagaacgcctgctgcataaactgggggacaatgcatacccattcaccctccaaatggttaccaaccttccatgcagcgtgacccttcagcctggacccgaggatgcagggaaaccatgtggtattgattttgaagtgaagagcttttgtgccgaaaatcccgaggagacagtctccaagagggattacgtgcggcttgtcgtaagaaaagtgcaattcgcccccccggaagctgggcccggccctagcgcgcagaccataagaagatttttgctctctgcgcaacccctgcaactccaggcatggatggatagagaagtccactatcatggagaacctatatcagttaatgtgtcaatcaataattgcacaaataaagtcataaagaagataaaaatctccgtagaccaaatcacagatgtggtcctctatagccttgataagtacaccaagactgtctttatccaggaatttacggagaccgttgccgcaaactccagcttttctcagtcattcgctgtgacccccatcctggctgcatcttgtcaaaaacggggactcgccttggatggtaagctgaagcatgaggatactaacctggctagttccaccatcatcaggcccggcatggataaagagcttttaggaatcttggtgagctataaagtacgtgtgaatttgatggtgagctgcgggggcatcctgggcgacctgaccgcgtctgatgttggtgtggagttgcccctggtgctgattcacccgaagccatcccacgaggctgctcggtag

SEQ ID NO: 179462 - DNA, 993 bp, Artificial Sequence
  Description of Artificial Sequence: Synthetic coding sequence
atgggcgagaagcccggcacccgggtgttcaagaagagcagccccaattgcaagctgactgtgtatctggggaaaagagacttcgtcgatcacctggataaggttgatcctgtcgacggtgtcgtcctggtggacccggactacctgaaagacaggaaggtttttgttacgctcacttgcgcgttccggtacggaagggaggacttagatgtgctcggattaagcttccggaaggacttattcattgctacttatcaagcattcccccctgtgcctaacccaccccgtccgccgacacggctgcaggataggctcctgaggaagctggggcagcatgctcaccccttttttttcactataccccaaaatttgccgtgctctgttaccctgcagcctggaccagaggacacaggcaaggcatgtggcgtagatttcgaaatccgagctttttgcgccaaatctttggaagaaaaaagccacaaacgaaacagcgtcagactcgtgattaggaaagtgcaatttgctcctgagaagccaggccctcagccaagcgctgaaaccacaagacatttcctaatgagcgatcgatcgttacacctagaggcgtccctcgataaagagctctactaccacggcgaacctcttaacgtgaacgttcatgtcacaaacaactctacgaaaaccgttaagaaaattaaggtcagcgtccgacagtacgctgatatttgcctgttctcaactgctcagtataaatgcccagttgcccagctggagcaggacgatcagcgggaggggggctgccagcagggtggtgctggcaacccaggggtgctgcagggccaaggcgaggctgggggagtatcacgtcgtggatgcctgtgcggggccgccttctgctcatatgcaccccaggcccctaggcctcatccgccccctcaaacacccgtatctcggtccggggacaggtgtccttgtggacaccaaccacactag

SEQ ID NO: 179463 - DNA, 1245 bp, Artificial Sequence
  Description of Artificial Sequence: Synthetic coding sequence
atggtgctgggcaaggtgaagagcctgaccatcagcttcgactgcctgaacgattcaaatgtgcccgtatactcttccggagatacagtgagcggccgggttaacctggaagtgactggtgagatccgagtcaaaagccttaaaattcatgcaagggggcatgctaaagtcaggtggaccgagagtaggaacgcgggtagtaatactgcttatactcagaattacaccgaagaagttgagtactttaaccacaaagatattctgataggccatgagagggacgacgacaactctgaagagggattccacaccatccacagtggtcgccacgagtatgcattttcgtttgagctaccacagacccctttagctaccagcttcgaaggcagacatgggtccgtgcggtactgggtaaaggccgagctgcataggccatggctcctacctgttaagctcaaaaaagaattcacggtattcgagcatatcgatatcaataccccctctctactgtcccctcaggccggcaccaaagaaaagacactgtgctgctggttttgtactagtgggccaatcagtctcagcgcaaaaattgaacgaaaggggtacacacccggtgagagcatacagattttcgctgagatagagaactgctcctctagaatggtcgtccccaaggcagccatctaccagacccaggctttttatgccaagggcaagatgaaggaagtcaaacaactcgttgccaatctccgcggagagtctctcagctcaggcaaaacagagacatggaacggcaagctgctgaagattcctccagtcagccctagcatcttggactgttctattattagggtggagtacagcctaatggtttacgtcgacatccccggcgccatggatctcttcttgaatctgcctctggtcattgggaccatccctctacacccattcggctcaaggactagctcagtatcatcccagtgttctatgaatatgaattggctcagcctgtcacttccggaacgaccagaagcgccaccatcctacgctgaagtcgttaccgaggaacaacgcagaaacaatttagctcctgtgtcagcttgcgacgacttcgagcgagctcttcagggcccacttttcgcctatatacaggaatttcggttcttgcccccccctctctatagtgagatcgaccctaatcccgaccagtctgcggacgaccgcccaagttgtccgagtagatag

SEQ ID NO: 179464 - DNA, 1233 bp, Artificial Sequence
  Description of Artificial Sequence: Synthetic coding sequence
atgggcgacaagggcacccgggtgttcaagaaggccagccccaacgggaaattaacggtttacctcggaaaacgagacttcgtggaccacattgacctggtcgacccggttgacggagtggtgctagtcgaccccgagtacctaaaggagcgtagggtgtacgttacgttaacatgtgccttccgctacggccgggaggatctggacgtgctcggcctaactttccgaaaagacctctttgttgcaaacgtacaatcatttcctcccgcaccagaggacaagaagccgctgacacgcctgcaggagaggctgatcaagaagcttggagaacacgcttatcctttcacattcgagatcccacccaacttgccctgctcagtgaccctccagccaggccctgaagatacaggaaaggcatgtggcgtcgattatgaagtcaaagccttctgtgccgaaaatctggaagaaaagatccacaaacgcaattccgtccggctggtgattcgaaaggtgcagtacgcacccgagcggccaggccctcagccaactgccgagacaacccggcagtttctgatgtccgacaaaccactccacttagaggctagcctggacaaggagatttattatcatggagagcccattagcgtcaatgttcatgtcaccaacaacactaataagactgtgaagaagataaaaatctcggtacgccaatatgcggacatttgcctgttcaatacagcacagtacaaatgccctgtggcaatggaagaagctgacgataccgtagccccatccagtactttctgtaaggtgtatacactgaccccattcctcgccaacaatcgcgaaaaaagaggcctggctcttgatggcaaactgaaacacgaggacacaaatctggcttcctctacactcctccgcgagggcgctaatcgggagatactgggtatcatagtctcctacaaagtgaaagtcaaactggtagtgtcgcgtgggggggacgttgccgtagagcttcctttcactctgatgcatcctaaacccaaggaagagcctcctcatagagaagtgcccgagaacgagacccccgtggacaccaacctgattgagttagatactaatgatgacgacattgtttttgaggatttcgcccgtcagaggctgaaaggtatgaaagacgacaaagaagaagaagaggatggtaccggctctcctcaattgaataaccgctag

SEQ ID NO: 179465 - DNA, 1257 bp, Artificial Sequence
  Description of Artificial Sequence: Synthetic coding sequence
atgggcgacaagggcacccgggtgttcaagaaggccagccccaacggaaaactgacagtttacctcggaaagagggacttcgtggatcacatcgatcttgttgatccggtagatggtgttgttctagtggatccagaatatctgaaagagaggagagtttatgtgaccttgacgtgtgctttccgatatgggcgcgaagacctggatgtgcttgggcttacctttaggaaggatcttttcgttgctaacgtgcagagtttccctccagctcccgaggacaaaaaacccctgactcgactccaggagcgactaataaaaaaattaggtgagcatgcctacccttttacctttgagatcccccccaatctgccatgctcggttactttgcaacctggcccagaggataccggaaaagcctgtggtgtagattacgaagtgaaagctttctgcgccgagaacttggaagaaaagatccacaagcggaactccgtccgtctggttatcaggaaggttcagtacgctccagagcgcccagggccccaaccaacagcggaaaccaccagacagtttctgatgtcggataagcccctgcatctggaagcatccctggataaggaaatttattaccacggtgagccaatttcagttaacgtgcacgttacaaataataccaataaaacagtcaagaagattaagatctctgtgcggcagtacgcagatatttgtttgttcaatacagctcagtataaatgcccagttgcaatggaggaggcagacgataccgtagccccgtcatcgactttctgcaaagtgtacacattaacccctttcctggccaataatagagagaagagaggcctcgccctcgacggcaaactgaagcacgaagataccaacttagccagctccacactgttgcgggagggagcaaacagggaaatactgggaataatcgtctcatacaaagtgaaagtcaagctcgtagtgtcccggggcggactgctgcgaggtctgtgtttctctgacgtggcagtggagctccctttcactctgatgcaccccaagcccaaggaggaacctcctcatagggaggtgccagagaacgagacccctgtcgatactaacttgatcgagctggacactaacgacgacgatatcgtgttcgaggatttcgctcggcagcgtctgaagggcatgaaggatgataaagaggaagaggaggatggtaccggcagcccacaactcaacaacagatag

SEQ ID NO: 179466 - DNA, 1257 bp, Artificial Sequence
  Description of Artificial Sequence: Synthetic coding sequence
atgggcgacaagggcacccgggtgttcaagaaggccagccccaacggtaaactgactgtgtacttgggaaaacgggatttcgtggaccatatagacttggtcgacccagttgatggagtggtgctggtagatcccgagtatctgaaggagcgaagggtgtacgttactcttacatgcgcgttcaggtacgggcgcgaagacttagatgtgctgggtctcactttcagaaaagacctgtttgtggccaatgtgcaatcttttccaccagccccagaggataaaaagccgctcacgagattacaggaaagactaattaagaagctgggggaacacgcttatccctttaccttcgagatacctcccaatctgccctgcagcgtaacactgcagcctggaccggaggataccggaaaggcctgtggggtggattacgaggtgaaggcgttctgtgccgagaacctggaggagaaaatccataaacgaaattcagtgagactcgtgatcagaaaggtgcagtatgcgccggagcggcccggaccacagcctacagctgaaactacgcggcaatttttgatgagcgataaacccctgcatctcgaggcttctctggacaaggaaatctattatcacggcgagcctatcagcgtaaatgtgcacgtgaccaataataccaataaaacggttaaaaagataaagatatctgtacgacagtacgccgatatctgcctgttcaacactgctcagtacaaatgcccggtggctatggaggaggccgatgataccgttgccccttcttccaccttttgtaaagtatataccctgacccctttcctggcgaataacagggagaaaagaggcctggctttggacggtaaattgaaacacgaggatactaacctggcaagcagtactctgttgcgagaaggagcgaacagggaaatcctgggcatcatcgtgtcatacaaagttaaggtcaagctggtggtgtcacgcggggggctgctgggggatctggctagcagtgatgttgcagtggaactcccattcacgctgatgcacccaaagcccaaggaggagcccccccacagagaagtgcccgagaacgaaactcccgtggacaccaacctgattgaactcgataccaatgatgacgatattgtgttcgaagacttcgcgaggcaaaggctgaaggggatgaaagatgacaaggaagaagaagaggatggcacgggtagtcctcaactgaataacagatag

SEQ ID NO: 179467 - DNA, 1230 bp, Artificial Sequence
  Description of Artificial Sequence: Synthetic coding sequence
atgggcgagaagcccggcacccgggtgttcaagaagagcagccccaactgcaagctgacagtgtacctggggaaacgggattttgtagaccatctcgacaaagtggatccagttgatggcgtagtgcttgtggatcccgattacctgaaggacagaaaagtattcgtgacgctgacatgtgctttcagatatggtcgggaagatctggacgtgctcggtctttcctttcgaaaggacctttttattgccacataccaggcctttccccccgtgcccaaccctccccgcccgcctactcggctgcaggataggctgctgcgcaagctggggcagcacgcccaccctttcttcttcacaatcccccaaaacctgccatgctctgtgacccttcagccaggccccgaggataccggtaaggcatgcggcgtcgatttcgagatccgcgctttctgcgcgaagtccctagaggagaagagccacaaacggaattcggtcaggttggtcatcaggaaggtgcaattcgcacctgagaagcccgggccacagcccagcgcagaaactacaagacatttcctaatgtcggacagatccctgcatcttgaggcctctcttgataaggaactctactaccacggcgaaccgctgaatgtcaacgtgcatgttaccaacaatagtacgaagactgtaaagaaaataaaagtctccgtgcgtcaatacgcggatatttgcctcttcagtacagcccaatataagtgccctgtcgcccagctggagcaggacgatcaggtttcgccatccagcacgttttgcaaagtttatacaattacaccactgcttagcgataaccgtgaaaagcggggtctggcccttgacggtaaactgaagcacgaggatacaaatctggcgtctagcactatagtgaaggaaggcgcaaataaggaggtacttggcattctggtatcctacagagtcaaggtgaagctggtcgtctctcgaggcggggacgtgtcagttgagctgccattcgtcttaatgcacccaaaaccccacgatcacatacccctcccaagacctcagagcgccgcccctgaaactgatgttccggtggacaccaaccttatcgagtttgacacaaactatgccaccgatgatgatattgtgtttgaggacttcgccaggctgcgtctgaagggcatgaaggacgacgattatgacgatcagctatgctag

SEQ ID NO: 179468 - DNA, 1185 bp, Artificial Sequence
  Description of Artificial Sequence: Synthetic coding sequence
atgggcgagaagcccggcacccgggtgttcaagaagagcagccccaactgtaagctcacagtatatctcggcaagcgagacttcgtagatcatttagataaagttgatcctgttgtcttcgtcacactgacttgcgcgttcagatacggacgggaagacttggatgtgctgggactcagctttcgaaaggacctctttatagcaacttaccaggcctttccgcccgtgccgaatcctcccagaccccctacacgactgcaggacaggttgctgaggaagctcggccaacacgcacacccgttttttttcaccattccccagaacttgccttgtagcgttaccctccagccagggcccgaggacaccggaaaggcgtgcggcgttgactttgagatccgcgcgttctgtgccaagagcctagaggagaagtcacataaacgcaactccgtgcgactggtgatcagaaaagtgcagtttgctcctgagaagccagggccccagccttctgccgaaaccactcgtcacttcttaatgtcagaccgttccctccacctagaggccagcctggacaaagagttgtactaccacggagagcctttgaatgtcaacgtgcatgtgactaacaacagtactaagactgtgaagaaaataaaagttagtgtgcggcagtacgctgacatttgtcttttctcaactgcccagtacaaatgtccagtcgcccaactcgagcaggacgatcaggtgtctccatcctcaactttttgcaaagtctacactataacccctttgcttagcgacaatcgagagaagaggggcctggccttggacggtaagctcaagcacgaggacaccaatcttgcctcgagcacaattgttaaagagggagccaataaagaggtcctcggtatcctggtgagctatagagtcaaagtgaaactggtcgtgtctcgcggcggcgacgtgtccgtggaactgcccttcgtactcatgcaccccaagcctcatgatcacatacctttgcctcgaccccagtcggcggcacccgagacagacgtgcctgttgacactaacctcattgagtttgacactaactatgccacagacgacgatatagtttttgaggattttgcgagactgaggctgaaagggatgaaagatgacgattacgacgatcagctgtgttag

SEQ ID NO: 179469 - DNA, 1266 bp, Artificial Sequence
  Description of Artificial Sequence: Synthetic coding sequence
atgggcgagaagcccggcacccgggtgttcaagaagagcagccccaactgtaagctgaccgtgtacctcggaaagagggacttcgttgaccacctcgataaggttgatcctgtggatggggtggttctggtagatccagattatctgaaggaccgtaaggtctttgtgacattgacctgcgcttttcgttatggccgagaagatctggacgtattaggtctatctttccgaaaggatctgttcatcgccacctaccaggccttccctccagtccctaatccgccaagacccccgacccgcctgcaggatcgcttacttagaaagctggggcagcacgctcacccgttctttttcacaatcccacagaacctcccatgctctgtgacgctccaacctggcccggaagacactgggaaggcatgtggggtggattttgagatccgcgctttttgtgcgaagagcctggaagaaaaaagtcataagagaaattccgtgagactggtgatacgcaaggtccagtttgccccagaaaagccgggaccacagccttcagctgaaactactcgccatttcctaatgagtgatcggagtttacatctcgaagcctcactagataaggaactgtactatcacggcgagcctcttaatgtgaatgtgcatgtgaccaataattctacaaagaccgtcaagaaaattaaggtgtccgtgagacagtacgctgacatctgcttgttttccaccgcccagtacaaatgcccagttgcccagctagaacaggacgatcaggtgtctccaagctcaacattttgtaaggtttatactataactcctcttctgtccgacaaccgagaaaagcgggggcttgccttagacggaaagttgaaacacgaggatactaatttggccagcagcacaatcgtcaaggaaggcgcaaataaggaggtcctcggcatcctagtgagctatagggtaaaggttaagctggtcgtgtccagagggggcgacgtctcagtggaactgcccttcgtgcttatgcacccgaagcctcacgaccatattccattgccgcggcctcagagcgctcctacacccactcctcctcttccagtgccccccgctgcccctgagacagacgtgcctgtggacacaaatctcattgaattcgatactaactatgccaccgatgatgacattgtcttcgaggattttgcacggctgaggctcaagggcatgaaggacgacgactatgatgaccagttatgctag

SEQ ID NO: 179470 - DNA, 1233 bp, Artificial Sequence
  Description of Artificial Sequence: Synthetic coding sequence
gccgccaaccgggccggcggcggccgggcccaccacggcggcgagacccgtgaccagctcacagtatatcttggcaagagggattttgtcgatcacctggacaaagtggaccctgtggacggagtggttctggtggatccagattatctcaaggaccgaaaggtgttcgtaactctgacttgcgcatttcgatacggacgcgaagatctcgacgtgctgggcctgtcctttagaaaggacttgttcattgctacatatcaggctttcccaccagtgcccaatcctccgcgaccaccgacaagattacaagacagactcttacgaaagctcggccaacacgcacatccattcttctttactatcccacaaaacctaccgtgctccgtcacactccagcccggacctgaggacacgggaaaggcgtgtggtgtcgatttcgagattcgagctttttgcgccaagtcgttagaggagaaatcccacaagcgcaacagcgtgaggcttgtcatccggaaagtgcagtttgcccccgaaaaacccggccctcagcctagcgctgagactactaggcactttctgatgtctgatagaagtctgcacctggaagcatccttggataaggaactgtattaccacggcgaacccttgaacgtaaatgtacacgtgacaaataacagtaccaagaccgttaaaaagattaaggtgtcggttaggcagtatgctgatatatgtctgttctctacggcccagtacaagtgtcctgtggcacagctggaacaagacgaccaggtctcgccatccagcactttctgcaaagtgtacacaataactcctctgctgagtgacaatcgagagaaacgaggcctggcgctggacggtaagctgaagcacgaagacaccaatctcgccagcagcaccatcgtgaaagaaggggcgaacaaagaggttctgggcatcctggtctcttatagagtgaaggtcaaactggtggtgtcacgcggcggggacgtgtcagtagagctgccctttgtgctgatgcacccaaagccccacgatcacatacctctcccccgaccacagtcagcagcacctgagactgacgtgcctgtcgacacaaacttgattgaattcgacacaaattacgcaaccgacgacgatatcgtgtttgaggacttcgccagactacgacttaagggcatgaaagatgacgactatgatgaccagttatgctag

SEQ ID NO: 179471 - DNA, 1047 bp, Artificial Sequence
  Description of Artificial Sequence: Synthetic coding sequence
atggccgccggcgtggccggctggggcgtggaggccgaggagttcgaggacgccccagatgtggaacccctggaaccaaccctttccaatattatcgagcaacggtccttaaagtggatcttcgtgggaggcaaagggggagtgggcaagacaacctgcagctgtagcctggctgtgcagctgagtaaagggagggagtctgtcctgatcatttctacggatcctgcccataacatctcagacgccttcgaccagaagttcagtaaggtccccacgaaggttaaaggatatgacaacttgttcgcaatggaaattgacccctccttgggggttgccgagttgcctgatgaatttttcgaagaagacaacatgctgtcaatgggaaaaaagatgatgcaagaggccatgagcgctttccctggcatagatgaagctatgtcttacgcagaggtgatgagacttgtgaaggggatgaactttagtgtggtcgtgttcgacactgcacccactgggcataccctccgtcttctcaactttccaaccatagtcgaaagaggcttggggcgcctcatgcagataaagaaccagataagtcctttcatctctcagatgtgtaacatgttggggctgggcgatatgaacgcagatcagctggcttcgaagctggaggaaaccctccccgtgatcagatctgtttctgagcagttcaaagatccagaacagacaactttcatatgcgtatgtatcgccgaattcctttctctatatgagacagagagactgattcaggaactggcaaaatgtaaaatcgatactcacaacattattgtgaatcagttggtgttccccgatcctgagaagccctgcaagatgtgcgaggccagacacaagatccaggccaagtatctggatcagatggaggatctgtacgaggattttcacatcgttaagctgcctttgctgccacacgaggtgagaggagctgacaaagtcaataccttctctgccctcttactggagccctataagccaccctcagctcagtag

SEQ ID NO: 179472 - DNA, 1047 bp, Artificial Sequence
  Description of Artificial Sequence: Synthetic coding sequence
atggccgccggcgtggccggctggggcgtggaggccgaggagttcgaggatgcaccagacgtggagccgctggagcccaccttgagtaatatcatagaacagaggagcctgaaatggatttttgtggggggaaaagggggtgttggaaagacgacttgctcctgttctctggccgtgcagctatcgaaaggtcgcgaaagcgtcttgatcatctctactgatccagcccataacatctccgatgccttcgaccagaagttttcgaaggtgccgacaaaggtcaaaggctatgacaacctcttcgctatggagattgacccaagcctgggggtagccgagctgccagatgagtttttcgaggaagacaacatgttgagtatgggcaagaaaatgatgcaggaggccatgtcagcatttccaggaattgacgaggcaatgagttacgccgaagttatgcgactggttaaggggatgaacttctctgttgttgtttttgacaccgcacccactggccacaccctacgcctgctgaactttccaacaatcgtggagcgcggcctcggtcgcctgatgcagatcaagaaccagatctctccatttatatctcaaatgtgtaacatgctgggattgggcgatatgaacgcggatcagcttgcgtctaaactagaggagactctccccgtaatccgcagtgtgagcgagcagtttaaagaccccgaacagaccacatttatctgtgtatgtatagccgagttcctgtctctgtatgagaccgaaagattgatccaggaactggctaagtgcaagattgatactcacaacatcattgttaatcaactggtgtttcctgatcctgaaaagccctgcaaaatgtgtgaggcccgccacaagatacaggccaagtacctagatcagatggaggatttgtacgaggactttcacattgtgaaactgcctctgcttcctcatgaagtgcgcggagcagacaaggtcaatacttttagtgctcttctgttggaaccatataagccacctagtgcgcagtag

SEQ ID NO: 179473 - DNA, 1128 bp, Artificial Sequence
  Description of Artificial Sequence: Synthetic coding sequence
atggccgccctgcgggacgccgagatccagaaggacgtgcagacctattatgggcaggtgctcaagagaagcgccgacctgcagaccaacggatgtgtaactacagcccgtccagttccgaaacacattcgtgaggccctccagaacgtgcacgaggaagtcgccctccgctactatggctgcggccttgtgattccagaacatctggaaaactgctggatactggacctgggctcgggcagtggaagggattgttacgtgctgtcccagctagtgggcgagaaaggtcacgtgaccggaattgatatgacgaaagggcaggtggaggtcgcagaaaaatacctggattatcatatggaaaaatatggctttcaggcgagcaatgtgacctttatccatgggtatattgagaaacttggagaggccggtatcaaaaacgaatctcatgacatcgttgtgtctaattgcgtgataaacctggttcccgacaagcaacaggtcctgcaagaagcctatagagtcttgaagcacgggggggaactctatttcagcgatgtgtatacgagcctggaactccccgaggagattagaacccataaagtgttatggggggagtgcctgggcggggcactgtactggaaagaattggcagtacttgcacagaaaattggattttgtccgccgcgcctggtcacggcgaatctgattactatacagaataaagagctggagcgagtcatcggcgactgtcggttcgtcagtgccacttttagactgttcaagcactcaaaaactggtccgaccaaaaggtgtcaagtgatctacaatggcggcattaccgggcatgaaaaagagctgatgttcgatgctaactttactttcaaggaaggggagatcgtggaagtcgatgaggagaccgctgcgatcctcaagaattcgaggttcgcccaggatttccttattaggccaatcggcgaaaagctgccaacgtccggtggatgcagcgccctcgagctgaaggacatcatcacggacccatttaagctggccgaggagagtgacagcatgaagtccagatgtgtccccgatgccgccggcgggtgttgcggtaccaagaaaagctgctag

SEQ ID NO: 179474 - DNA, 816 bp, Artificial Sequence
  Description of Artificial Sequence: Synthetic coding sequence
atgggcaacggcggccggagcggcctgcagcagggcaagggcaacgtggatggcgtggccgctaccccaacagcagcgtctgcctcttgccaataccgatgtattgagtgtaatcaagaagcaaaggagctgtatagggattacaatcacggtgtgctcaaaatcaccatctgtaagagctgccagaagcctgtggacaaatacatcgagtacgaccctgtgatcattctcattaacgccatactgtgcaaagcccaggcgtaccgccacattctgttcaatacccagataaacatccacggtaagctgtgtatcttctgcctcctctgtgaggcctacctgcggtggtggcagctgcaggacagcaatcagaacactgcaccagacgacctcattcggtacgcaaaggaatgggatttctacaggatgttcgctattgccgccctagagcagacagcatatttcatcggaatctttaccttcctttgggtggaaagacccatgaccgccaagaagaaacctaatttcattcttctattgaaggccctgttacttagctcttacggcaaactgctgctgatccctgccgtcatctgggagcatgactatacaagcgtctgtttgaagctgataaaggtctttgtcctgacctccaactttcaggccatccgcgttaccctgaacattaacagaaaactctcatttctggcagtgctgagcggactgctgttggagtccattatggtatatttttttcagtcaatggagtgggatgtgggctcggattatgcaatctttaaatctcaggatttctag

SEQ ID NO: 179475 - DNA, 807 bp, Artificial Sequence
  Description of Artificial Sequence: Synthetic coding sequence
tgaggccggagcggcctgcagcagggcaagggcaacgtggacggcgtagccgccaccccaacagcagcttctgctagctgtcagtacaggtgcatcgagtgtaaccaggaggcaaaagagctgtatagggattacaatcacggagtgttgaaaataacaatatgcaagagttgccaaaagcctgttgacaaatacattgagtatgacccagtgattatcctgattaatgcaatcctctgtaaagcccaggcgtaccgccacatcttgtttaatacacagattaacattcatggaaaactgtgcatcttctgccttctatgtgaggcctatctgcgctggtggcagctgcaggattcaaaccagaatacagctcccgacgatctgatacgatatgccaaagagtgggatttttatcgcatgttcgccatcgctgccctcgagcaaacggcgtattttataggcatcttcacattcctgtgggtggaacgccccatgactgcaaagaaaaagccgaacttcatactgctccttaaggccctgctgttgagctcctatggcaagctcctgctgatccctgcggttatctgggagcatgactacactagcgtgtgcctcaagcttataaaagtcttcgttcttacttctaacttccaggccattcgggtcaccctgaacataaacagaaagctgagcttcctggctgtgttgtctggtctcctgctggagtctataatggtttactttttccagtctatggaatgggatgtggggagcgattatgcaatatttaagtcccaggatttctag

SEQ ID NO: 179476 - DNA, 2547 bp, Artificial Sequence
  Description of Artificial Sequence: Synthetic coding sequence
atgaacagcagcagcgccaacatcacctacgccagccggaagcggaggaagccagtacagaaaaccgtcaagccaatcccggcggaagggatcaaaagcaatcctagcaagagacatagggatcggctcaatacagaactcgaccggctggcatctctgctgccgttcccgcaggacgtgatcaacaaactggacaagctgagtgtgcttcggctgagcgtctcgtacctgcgtgcaaaaagttttttcgatgtcgcacttaagtcgagccccacagagcggaacggggggcaggataattgtcgtgccgctaacttcagagagggcctgaacttacaggaaggagagttcctgctgcaggcattaaacggatttgttctcgtggttacaacagatgccctggtgttttacgctagctcaacaattcaagattatctgggctttcagcaaagtgatgttattcatcagagcgtttacgaactaattcacacagaagatcgagccgagttccaaagacagctgcactgggctcttaatccctcacagtgcacagaatcagggcagggaatagaagaggccaccggactaccccagaccgttgtgtgctacaacccagaccagatccctcctgaaaattcgcctctcatggaaagatgcttcatctgtagattgagatgcctcctggataattcctcagggtttctggcaatgaacttccagggcaaacttaagtatctacatggccaaaagaagaaaggaaaagatggcagtatcctcccaccacagctcgcgctgtttgctatcgcaacgcctttgcagcctccttccatcctggaaatccgcacaaaaaatttcatcttccggactaaacacaaactggactttactccaataggatgtgacgccaaaggccggatcgtactggggtatacagaggctgagctatgcactcgcggatcaggctaccaattcattcacgctgcggacatgctttattgtgcagagtctcatataaggatgataaaaactggcgaaagtgggatgatagtcttccgtttgctcactaagaacaatagatggacttgggtccagagcaatgcacgcctgctgtataagaatggtcgacccgactatatcatcgtcactcagagacccctaaccgacgaggagggcacagagcatcttaggaaacgtaacacaaagcttcccttcatgttcactacaggcgaggcagtattgtatgaggccaccaacccattcccagctattatggatccccttcctctgcggactaaaaacggcacaagcggaaaggactctgctactactagtactctgagcaaagacagcctcaacccaagttccctgctcgctgcaatgatgcagcaggacgagtccatttatctgtatcctgcctcatctactagcagcacggcacccttcgagaacaatttcttcaatgagtccatgaatgagtgtcgcaactggcaggacaataccgcaccaatgggcaacgatacaatactaaaacacgaacagattgaccaaccacaagacgtcaactcgtttgcgggaggacatccaggcttgttccaagacagtaagaacagtgatctgtatagcattatgaagaacttgggaattgattttgaagatatccggcatatgcagaacgaaaagtttttcagaaatgacttcagtggcgaagtggactttagagatattgacctgacagatgagatcttgacctatgttcaggacagcctgagtaaatccccattcatcccatcggattatcagcaacagcagtcgctggcccttaactccagctgcatggtgcaggagcatctccatctggagcagcagcagcagcaccaccagaagcaggttgtcgtggaaccgcagcagcaattgtgtcagaagatgaagcacatgcaggtgaacggcatgtttgaaaattggaattcaaaccaatttgtgccatttaactgtcctcagcaagatccccagcagtataatgtgttcacagaccttcacggtatttctcaagaatttccctacaagagtgaaatggattcgatgccctatactcagaactttatctcatgtaatcagcccgtgctgccccaacactcaaaatgtacagaactcgattatcctatgggctcctttgagccaagtccctatcccaccacatcatccctcgaagacttcgttacttgtcttcagctgccagagaaccagaagcatggactgaaccctcaaagcgccattatcaccccccagacttgttacgccggagcagtcagcatgtaccaatgccagccagagccccagcacacacacgtgggccaaatgcaatacaatcccgttttgccaggtcagcaagctttcctgaacaagtttcagaacggcgtgctgaacgagacatatcctgcagagcttaacaacataaacaacactcagaccaccacgcaccttcaacctctacatcatcccagtgaagccaggcccttcccggacttaacgtcttcaggctttctgtag

SEQ ID NO: 179477 - DNA, 2547 bp, Artificial Sequence
  Description of Artificial Sequence: Synthetic coding sequence
atgaacagcagcagcgccaacatcacctacgccagccggaagcggaggaaaccagtgcaaaaaaccgtgaagcctatacctgcggaagggattaagtccaacccctctaaacgacacagagataggctgaacacagaactagatcggttggcaagtctgttgcccttccctcaggatgtcatcaataaactcgataagctgagcgttctacgcctgtctgtgtcttacctaagagctaagagttttttcgacgtggccctgaaaagcagtcctacagaaagaaacggcggtcaagataattgccgcgccgctaatttccgcgaagggctaaacctgcaggagggcgagtttttattacaggcactgaacggcttcgtgctggtggtgacgactgatgcactggttttttacgctagtagcaccatccaggattatttaggatttcagcagtctgacgtgattcaccaatctgtctatgaactcattcataccgaggatagggcagaatttcaacgccagctgcactgggccctcaatccatcgcagtgcacagagagcggtcagggcattgaagaagcgacgggacttcctcagaccgtggtatgctacaatcctgaccagataccccctgagaacagcccattgatggaaaggtgtttcatctgtagactgaggtgtctactggacaactcctctggtttcttagctatgaacttccaaggtaagctgaaatatcttcacggtcagaagaagaaaggcaaagatgggagcatactccctccccagctagcactctttgccattgccaccccactgcaaccaccctccatcctggagatccgcaccaagaatttcatcttccggactaaacacaaactggatttcacccctataggctgcgacgcaaaaggtcgaatcgtcttgggatatactgaggctgagttgtgtactcgcggatccggctaccagtttattcatgccgcggacatgctgtattgtgctgaaagtcatatcaggatgataaaaactggggaatctggcatgatagtgttcaggctgctaacaaaaaacaataggtggacatgggttcagagtaatgcacgactgctgtataaaaatgggagacccgactatatcatcgtcactcagaggcctctgacagacgaggaaggcacagaacatctgcgtaagaggaacactaaactcccattcatgttcaccacgggagaggccgtgttatacgaggccacaaatccctttcctgcaatcatggaccctttgcctctgcggaccaaaaacgggacttcaggaaaggattctgccactacaagcacactgtctaaggattcactgaatcctagtagcctgcttgccgccatgatgcaacaggatgaatccatatatctttacccagcgtcatcaacttctagtacagcacctttcgaaaataatttcttcaatgagtccatgaatgaatgccggaactggcaggacaacaccgcgcccatgggcaacgacacaatcctgaaacacgaacagattgaccagcctcaggacgtgaactcgttcgctggggggcatcccggactgttccaggactctaagaatagcgatttgtattcaattatgaaaaaccttggcatcgacttcgaggatatcaggcacatgcagaatgagaaatttttccgcaacgacttctccggcgaggtggattttcgggacatcgatctgactgacgagatattgacttacgtccaagatagcctgtctaagtcccccttcataccgagcgattaccagcagcagcaaagcctggccctgaattctagctgcatggtgcaggaacacctgcaccttgagcaacagcagcagcaccatcagaagcaggttgtcgtagaaccgcagcagcagctgtgtcagaaaatgaagcatatgcaggtgaatggtatgtttgaaaattggaactccaaccaatttgtgcctttcaattgtccccagcaagatcctcagcagtacaacgtttttactgacctccatggcataagccaagaatttccatataagagcgagatggatagtatgccttatacacagaattttatttcctgcaaccagcctgtgctgccccagcactccaaatgcactgagttggactaccctatgggatctttcgaaccttctccgtaccccacgaccagcagccttgaagattttgttacttgcctccagttgccggaaaaccagaaacatggcctgaaccctcaatccgcaattataaccccccaaacatgctatgcaggagccgttagcatgtaccaatgccaaccagaacctcagcatacccacgtggggcaaatgcagtataatccagtcttgccaggacagcaagcgttcctaaataaatttcaaaatggagtgctaaacgagacctaccctgccgaactgaacaacatcaacaatacccagactactacacacctgcaacccctacaccatcccagtgaggcccgccccttcccggatctaacaagttccgggttcctctag

SEQ ID NO: 179478 - DNA, 993 bp, Artificial Sequence
  Description of Artificial Sequence: Synthetic coding sequence
atggccgacatcatcgcccggctgcgggaggacggcatccagaagagagtgatccaggaaggaagaggagagctccctgattttcaggatggtacaaaagctaccttccactaccgcactctgcattccgatgacgagggcacagtactggacgactcacgggctcgcggaaagcccatggaactgatcatcggaaagaagtttaagctgcctgtttgggagaccatcgtctgcaccatgagagagggcgaaatagcccagttcttatgtgatatcaagcacgtggtgctgtacccgttggtggccaaatcccttaggaacattgctgtgggtaaggacccactggagggtcagaggcattgctgtggggtagcacagatgcgggagcattcgagcttgggacacgccgacctagacgcactgcagcagaatccgcaacccctgatctttcatatggaaatgctcaaggtggaatcaccaggcacttatcagcaggatccctgggccatgacagacgaagagaaagctaaagcagtgcctctgattcaccaagaaggaaaccggctgtaccgggagggtcatgttaaggaagccgctgccaaatattatgatgctatagcttgcctcaagaatctgcaaatgaaggaacagcctggctccccagagtggattcagctggaccagcaaataactccactactgctcaactactgccaatgtaaacttgtcgttgaggaatattacgaagtgctggatcactgctcatctattttaaacaagtacgacgacaacgtcaaggcctactttaaaagaggaaaggctcatgctgccgtctggaacgcccaggaagcccaggctgattttgccaaggtccttgagctggacccagctcttgccccggtcgtaagccgggagctgcaggcactggaagcccggatccgtcagaaggatgaagaagataaagcaaggtttagggggatcttcagtcattag

SEQ ID NO: 179479 - DNA, 966 bp, Artificial Sequence
  Description of Artificial Sequence: Synthetic coding sequence
atggacgccgccctgctgctgaacgtggagggcgtgaagaagaccatcctccatggtggaaccggtgagttacctaatttcatcaccgggtctcgggtgatcttccactttagaaccatgaaatgtgatgaagaacgaacggtgatagatgattcacggcaagtagggcagccgatgcacattatcatcggtaatatgttcaaactggaagtgtgggagatactgctgacaagcatgcgagttcatgaggtcgctgagttctggtgtgataccattgtggacgccccctcagattaccaacgtgagacctggaacctgagtaaccatgaaaagatgaaggccgttcctgtgctccatggggaaggcaatcgtctctttaaactgggtaggtatgaggaggcctctagcaaatatcaagaagccatcatctgcctgcgaaacctgcagaccaaggagaagccttgggaagtccagtggttgaaattagaaaagatgattaatacacttatcctaaactattgccaatgtctgctgaaaaaagaggaatactacgaagtgcttgagcacacaagtgatatcttgagacatcatcccggaatcgtgaaggcctattacgttcgcgcccgggcgcatgccgaggtctggaatgaagccgaggccaaggctgacttgcaaaaagtcctggaacttgaaccaagcatgcaaaaagctgtccgcagagaattgcgcctactggagaatcgcatggcagagaagcaggaggaggagcggctccgctgtaggaacatgctgtcgcagggcgccactcagccccctgcggaacctcccaccgaaccaccggcccagtccagtacggagcccccagccgaaccacccactgccccgtccgcagagttaagcgctgggcctcctgccgagccagctaccgaaccccctccttcccctggccactccttacagcactag

SEQ ID NO: 179480 - DNA, 975 bp, Artificial Sequence
  Description of Artificial Sequence: Synthetic coding sequence
atggacgccgccctgctgctgaacgtggagggcgtgaagaagaccatcctccatggcggaaccggtgagctacctaattttataacggggtcaaggcacactggcgtctatcctattcttagtagatctctgaggcagatggcccaaggcaaagatcccacagagtggcacgtccatacgtgcggactggcaaatatgttcgcctaccatactctgggctatgaggacctggacgaactccagaaagaaccacagcccttagtattcgtcatcgagttattgcaggtggacgcccccagtgattatcaacgggagacttggaatctgtctaatcacgagaagatgaaggcagttccagtgttgcatggtgaaggtaacaggctgttcaagctaggccgatatgaggaagccagctcaaaataccaggaggcaattatctgcctgcgcaatttacaaacaaaagaaaaaccctgggaagttcagtggctaaaactggaaaagatgataaatacccttatactaaactactgccagtgcctactgaaaaaggaagagtattacgaggtactcgaacacacatccgacatactgagacaccacccgggcatagtgaaagcttattatgtgcgcgccagggcccacgcagaagtgtggaatgaggcagaagctaaggccgacttgcagaaggtcctagagcttgaaccttccatgcaaaaggctgtgagacgtgagctgcgcctcctggaaaatagaatggccgagaagcaagaggaagagcggctgcgctgtcggaacatgcttagccagggcgccactcagcccccagctgaaccacccaccgagccaccagcccaatctagcacggagccaccggctgaacccccaactgccccaagcgccgaacttagcgcaggtccgcccgcagagcccgcaaccgagccacccccatcccctggtcacagcttgcagcattag

SEQ ID NO: 179481 - DNA, 1155 bp, Artificial Sequence
  Description of Artificial Sequence: Synthetic coding sequence
atggacgccgccctgctgctgaacgtggagggcgtgaagaagaccatcctccacggaggtaccggcgaattaccaaatttcatcacaggatccagggtgatctttcactttaggactatgaagtgcgatgaggagcgcaccgtcattgacgacagtcggcaggttggtcaacctatgcacatcattattggaaacatgtttaaactggaagtctgggagatattattgacttccatgagagtgcacgaagtagctgagttctggtgcgacaccatacacactggggtgtatccaattctgtcaagatccctacgacaaatggctcaaggcaaagaccccacagaatggcatgtacacacatgcgggttagccaacatgtttgcgtaccataccctgggctatgaagacttagacgagctgcagaaagaaccacagcccctggtgtttgtgatagagctgctccaagtggacgccccctcggattaccagagggaaacttggaacctcagcaatcatgaaaaaatgaaagctgtgcctgtcctgcatggcgaaggtaaccgcctgtttaaactaggcaggtacgaagaggcatcatctaaataccaagaggctatcatttgcctcaggaacttgcaaacgaaggaaaagccctgggaagtgcagtggcttaaactggagaagatgatcaatactttgatcctgaattattgccagtgtctactgaagaaagaagaatactatgaggtcctggagcacaccagtgacatcctacgtcatcacccggggatagtgaaggcatactatgttcgagccagagcgcacgccgaggtttggaacgaggcggaggccaaagccgacctccagaaagtgctcgaattggagcccagcatgcaaaaagccgtgcggagagaactcaggctgcttgaaaaccggatggccgaaaagcaagaagaggaaaggctcagatgtcgcaacatgctctcccagggcgccacccagcctcctgctgagcccccaaccgaaccacccgcacagagcagcacagaaccccctgcagagcctcctactgctccttcagccgagctgagcgctggtccacccgccgagcctgcgaccgagccccctcctagtcctgggcatagcttgcaacactag

SEQ ID NO: 179482 - DNA, 981 bp, Artificial Sequence
  Description of Artificial Sequence: Synthetic coding sequence
atggacgccgccctgctgctgaacgtggagggcgtgaagaagaccatactgcacggtggcaccggagagcttcccaatttcattacaggctcacgggttattttccattttaggaccatgaagtgcgacgaagagcggacagttattgatgattcccggcaagtgggacagcccatgcatatcatcatcgggaacatgtttaaattagaggtttgggagatcctgctgacaagcatgcgtgtccatgaggtggcagaattctggtgtgacactattcacaccggcgtctacccgatcctgagtaggtccctgcgtcaaatggcacaagggaaagaccctactgaatggcatgtccatacttgcggattagctaacatgtttgcttaccataccttgggatacgaggatctggatgaacttcagaaagagcctcagccgctcgtgttcgtcatagagctactccaggtggatgcgcctagtgactaccaacgggagacctggaatttgagcaaccatgaaaaaatgaaggcagtgcccgtgctccatggcgaaggaaacaggctgtttaagctgggaaggtatgaagaggctagcagcaagtaccaggaggcaattatctgcttgaggaacctccaaacgaaggagaagccatgggaggtgcagtggctaaaattggaaaaaatgattaacaccttgatcctcaactactgtcaatgtctcctaaaaaaggaagaatattatgaagtgctggagcacacctccgacattctgagacaccatccgggcatcgtcaaggcctattacgtgcgggccagggcacacgccgaggtgtggaatgaggccgaggccaaggcagacctgcaaaaagtgctcgagctcgaaccgagcatgcagaaggctgtcaggcgtgagctgaggctccttgaaaatgcctggaggagatcacgtcgtagatccggctgtgcggccggtacctgctag

SEQ ID NO: 179483 - DNA, 975 bp, Artificial Sequence
  Description of Artificial Sequence: Synthetic coding sequence
atggacgccgccctgctgctgaacgtggagggcgtgaagaagaccatcctacatggcggcacgggggaactgccaaatttcattacaggctctagacacacaggagtctacccgatcctttcccggtctttgcggcagatggcccagggcaaggacccaacagagtggcacgtgcacacgtgcggactggctaacatgtttgcttaccataccctcggttacgaagacttagatgagcttcagaaggaaccgcagccacttgtatttgtcattgagctccttcaagttgacgccccttccgattaccaaagggagacctggaacctgtcgaatcatgaaaagatgaaggccgtaccagtcctgcacggcgagggaaaccggctgttcaagctgggcagatacgaggaagcatcatcaaagtaccaagaggcgatcatctgcctgagaaatttgcagacaaaggaaaaaccttgggaagtgcaatggctaaagttggaaaagatgattaatacattgatattaaactactgccagtgcctgcttaaaaaggaggagtactacgaagtgctcgaacacacttcagatattttacggcatcacccgggcatcgtgaaagcgtactacgtccgagccagagcgcacgctgaggtctggaacgaggcggaggccaaagctgacttacagaaggtgctggaactggagccctccatgcaaaaggccgtacggcgggaactacggcttcttgaaaatcgaatggcagaaaagcaggaagaagagcgtctacgctgtagaaacatgttatcccagggagcaacgcaacctcctgcagaaccacctacagagccccccgcccagtcatcaactgaacctcccgccgaaccaccaactgctccatcagcggagctcagcgcagggccacccgcagaaccggcgaccgagcctccaccgagtccagggcatagccttcaacactag

SEQ ID NO: 179484 - DNA, 1251 bp, Artificial Sequence
  Description of Artificial Sequence: Synthetic coding sequence
atggccgccaccaccgccaaccccgagatgaccagcgacgtgcccagcctcggtcccgccatcgcttctggcaatagcgggccaggcatccagggggggggagccatcgttcaacgcgccatcaagagaaggccggggttggatttcgacgacgacggggaggggaactcgaagtttctgcggtgcgacgacgaccaaatgtccaatgacaaagaacggtttgccaggagcgacgacgagcaatcgagcgctgacaaagaacgcctggcccgcgagaaccattctgagatagagcggcgacgtcgaaacaaaatgactgcctacatcaccgaactgtcggacatggtccctacctgttctgcgctcgccaggaagcccgacaaactgacgattcttcgcatggcagtgtcgcacatgaagagcctcaggggaacaggaaatactagtaccgatggaagttataagccgtccttcctcaccgatcaggagttgaagcatctgatccttgaggctgcagatggatttctgttcatagtgtcttgcgagacaggtcgggtcgtgtatgtgtccgatagtgtgacgcctgtgctcaaccagccccaatccgagtggtttggtagcactctatacgaccaagtccaccctgacgatgtggataaacttagggagcagctctcaacatccgaaaacgccctcacaggacggattctggaccttaagaccgggaccgtgaagaaggagggccagcaatcatctatgcggatgtgtatgggatccagaaggagcttcatctgccgtatgcggtgcggatcaagctctgtcgatcctgtgtccgttaaccgactgtctttcgtgagaaataggtgcagaaatggtttggggtccgtgaaggacggcgaacctcatttcgtggtcgtgcactgtacagggtatatcaaagcctggccaccggcaggcgtctcactcccagatgatgacccagaagccgggcaaggcagcaagttctgtcttgttgccatcggccggctccaggtaacgtcaagccctaactgcacagacatgtccaatgtgtgccagcctaccgagttcatatccaggcataatattgaggggatcttcactttcgtcgatcaccggtgtgtcgcaactgtaggttatcagcctcaggagctactcggcaaaaacatcgttgagttctgtcaccccgaagaccagcagctgctccgggatagctttcagcaggagctttag

SEQ ID NO: 179485 - DNA, 2223 bp, Artificial Sequence
  Description of Artificial Sequence: Synthetic coding sequence
atgtaccaccactgggtgcagcccctgcccctggagaccctggacctcgaattcaaagtggaagagcctctctcacgcggtctgctgtctggtgatcaggcggggttgaagtacctccttctggccttcctgcggctggattttgacgatgacggcgaaggaaacagtaaatttctgcggtgcgacgatgaccagatgtcaaatgacaaggagaggtttgcacgtgaaaaccatagcgaaatcgaaaggagacgccggaacaaaatgactgcctatatcacagagctgtccgacatggtacccacctgctctgccctggccaggaagccggataaactgaccatactgcgtatggccgtctcacatatgaagagtctgcggggcacaggaaataccagcaccgacggtagttataaaccctctttcctgaccgatcaggagctaaagcaccttatcttagaggcagctgacggatttcttttcattgtgtcatgcgagacaggtagagttgtatacgtctcagacagcgtgactccggtgctgaaccaaccacaaagcgaatggtttggatctaccttgtacgatcaggtgcaccccgacgacgtggacaaactgcgcgaacagctgagcacgtccgagaacgccttaacaggaagaatactcgatctcaaaacaggtaccgtgaaaaaagagggccaacagtcgagcatgaggatgtgcatgggttcccggcggtcgttcatctgtcgaatgaggtgtgggagttcatccgttgacccagtgagtgttaacaggctgagcttcgtgaggaataggtgtcgcaacggattggggagtgtgaaggatggggagcctcacttcgttgtggtccattgcacaggctatatcaaggcctggcctccagcaggtgtgagtcttcctgatgacgacccagaggcaggacagggctctaagttctgcttggtcgccattgggaggttgcaggtgacaagctctccaaattgcacagacatgagcaacgtttgtcagccaactgagtttatctcacgccacaatattgaaggaatctttacctttgtagaccatcgctgcgttgcaacagtgggctaccagccgcaagagctcctgggtaaaaacattgtcgaattctgtcatccagaggatcagcagctactcagggactctttccagcaggtcgtgaagttaaagggacaagtgttaagtgttatgttcaggttccgcagtaagaaccaagagtggctatggatgcgcacttctagcttcactttccagaacccttactctgacgagatcgaatatataatctgtaccaatacaaacgttaaaccgttgacttataggcaacagcagcagcagacagaactggacatggtgccgggccgggatggactcgcttcatacaaccatagccaggtggtccaaccagtaaccactacgggtcctgagcacagcaaaccactcgagaagagcgacgggttgttcgcccaggatcgcgacccccggttctccgaaatttaccacaacattaatgctgaccagtccaagggaataagctctagcaccgtgccggccactcaacagctctttagtcagggtaacacattccctcccactcccagacccgccgaaaattttaggaattcaggacttgcacctcccgtaaccattgtccaaccctcagcctctgctggccagatgcttgcccagatttcacggcacagcaacccgactcagggggcaactcctacatggacgccaacaacaaggagcggcttcagcgctcaagtcgctacccaggccaccgctaagacccggacttcccagtttggcgtgggcagctttcagaccccctcttccttcagttcaatgtccctacctggcgcaccaaccgccagtcccggtgctgcggcttatccctccttaaccaatagggggtcaaacttcgcccctgaaacaggacaaaccgccggccaatttcagactcgtaccgccgagggagtcggggtttggccgcagtggcaggggcagcaacctcaccacaggtcttccagttccgaacagcatgtacagcaacctcccgcacaacagccgggacagcctgaagtttttcaggaaatgctttccatgctaggcgaccaatccaattcgtataataatgaggaatttccagatctgaccatgttccccccattctctgaatag

SEQ ID NO: 179486 - DNA, 1251 bp, Artificial Sequence
  Description of Artificial Sequence: Synthetic coding sequence
atggccgccaccaccgccaaccccgagatgaccagcgacgtgccctctttgggtcccgctatcgcaagcggcaacagcgggcccggaattcaaggaggcggagcaatcgttcagcgcgccatcaagagacgccctggcctcgactttgacgacgatggtgagggcaatagtaagtttctcaggtgcgacgatgaccagatgtccaacgataaggagcgtttcgcacgttccgacgatgagcagtctagtgccgacaaagagagactggctcgagaaaaccatagtgagatcgaacggcggcgcagaaacaagatgaccgcctacatcacggagctgagtgatatggttcctacatgcagcgccctcgccagaaaacccgacaagctcaccatcctcagaatggctgtttcacacatgaaatcccttcgtgggacaggtaatactagcacagatgggagctataagccttcattcctgacagatcaggaactgaaacacctgatcctcgaggctgcagacgggtttctcttcatcgtgagctgcgagacaggtagggttgtgtatgtgagcgacagcgtgacgccggtcctgaatcagccgcagtctgagtggttcggatctaccctttacgaccaggtacaccctgacgatgttgacaagctgcgtgagcagctgagcaccagtgagaatgctttgaccggtcgtatcttggacttgaaaacggggacagttaagaaggagggccaacagtcctcaatgcggatgtgtatggggagtcgccgttccttcatatgtcggatgagatgcggcagcagctctgtggatcctgtttccgtcaatcgattatcctttgtgcgtaacaggtgccggaatggactcggatctgttaaggatggcgaaccacattttgtggtggtgcactgcacgggctatattaaggcctggccaccagctggtgtatctcttcccgatgacgatcccgaagccggtcagggctccaagttttgcctagtggcaatcggcaggttgcaagtcacatcttcccctaattgtactgacatgtcaaatgtgtgccagccaaccgaatttatttctaggcataatattgaggggattttcaccttcgtggaccatagatgcgttgctaccgtcggttatcagccacaggagcttctcggcaaaaacatcgtagagttttgccatcccgaggatcaacaattactgagggatagctttcagcaggagctgtag

SEQ ID NO: 179487 - DNA, 2325 bp, Artificial Sequence
  Description of Artificial Sequence: Synthetic coding sequence
atggccgccaccaccgccaaccccgagatgaccagcgacgtgcccagcctgggtcccgccattgcatcgggaaacagcggacctgggatccaagggggaggcgcaattgtgcagcgggccataaaacggagacccggcttggacttcgacgacgatggggaaggcaactctaagtttctgcggtgcgacgacgatcagatgtctaacgataaggaacgttttgcccgcgaaaatcatagcgagatcgagcgcagacggcgaaataaaatgacagcttacatcaccgaactgagtgatatggttcctacatgctcagcgctcgctagaaagcccgataagctaaccattctccgcatggccgtatcccacatgaaatccttgagaggcacaggaaacacttcaaccgacggctcatataagccatccttcctgacagaccaggagctaaagcaccttatcttggaagcggcagacggctttctattcatcgtcagctgcgaaactgggcgagtggtttatgtgagcgatagcgtaaccccggttctcaatcaacctcagtcggaatggttcggcagtaccctgtatgaccaggtccacccggatgatgtggacaagcttcgcgaacaactgtcgaccagcgagaatgcgttgaccggtagaatacttgacttaaagacgggtacagtaaagaaagaggggcagcaaagcagcatgcgcatgtgtatgggctccagaagatcttttatctgccggatgaggtgtgggtcttccagcgtggatccagtgagtgtaaatcggctcagctttgttcggaatagatgtcgcaatgggctcggatctgtaaaggatggggagccacatttcgtcgtggtgcactgtactggctacatcaaagcatggccccccgcaggagtgtccctgccagacgatgatcccgaggctggtcaaggaagcaaattttgcttggtcgccataggtagactgcaggtcacgtcttcaccaaactgtactgacatgagtaacgtctgtcagccaacggaatttatctctcgtcataatatcgaaggcattttcacctttgttgaccatcgatgtgttgctactgttggctaccaacctcaggagctattgggaaagaatatagtggagttctgccatcctgaagatcagcagttgctcagagactctttccagcaagttgtgaaactcaaaggccaagttctttccgtcatgttccgcttcagatctaaaaaccaagagtggctgtggatgcgaacttctagttttacttttcagaatccctacagcgacgaaattgaatacattatctgcaccaacaccaacgttaagaatagttcacaggaacccaggcctacattatcaaatacaatccagagaccacaactgggcccgaccgctaatttacccctggagatgggcagcggccagctcgcccctcggcagcagcagcaacagaccgagctggacatggtgcccggccgagatggtctcgcctcctacaatcattcacaggtcgtccagcccgttacaacaacaggccccgaacactctaaaccactggagaagtctgatggtcttttcgctcaggaccgcgatcctcggttcagtgagatttatcacaatattaacgcggatcaatccaagggcatctcatccagcactgtgcccgcaacccaacagctattcagccagggaaataccttccctccaaccccccgaccagccgagaacttccgtaacagtggtctggctccccccgtgactatcgtccagccgtctgccagcgcgggccaaatgctggctcagatctcaagacactctaacccaacgcagggagcaaccccaacttggacacctactactagatctgggttttcagcccaacaggtggcgacccaggctaccgctaagacaaggaccagtcagttcggtgttggatctttccaaacccctagcagtttttccagcatgtcactgccaggagccccaactgcatcccctggagccgcggcatacccgtccctgaccaataggggtagtaatttcgcccctgagacaggccaaaccgcaggacagtttcaaacccgcactgccgaaggggtgggggtgtggccccagtggcagggtcagcaaccgcaccaccggtcttcctcatccgaacagcacgtgcagcagccacccgcccagcagccgggccagccagaggttttccaggaaatgctctccatgctcggagatcagtctaactcctataataacgaagagtttccagatttaactatgtttccacctttttctgagtag

SEQ ID NO: 179488 - DNA, 2328 bp, Artificial Sequence
  Description of Artificial Sequence: Synthetic coding sequence
atgaccagcgacgtgcccagcctgggccccgccatcgccagcggcaatagcggtccagggatacagggaggaggtgctatcgtccagcgagccataaaaagacggccggggctggattttgatgacgacggagaaggaaatagcaagtttctgcgatgtgatgacgaccagatgtcaaatgacaaagaaaggtttgcccgatcggatgatgaacagtcctcggccgataaggagcgactggctcgtgagaaccattcggagatagaaaggaggcgcaggaacaaaatgactgcgtacatcaccgaattgtccgatatggttccaacttgctccgcattggccagaaaaccagataaactcactattctgcgcatggcagtgagtcatatgaaaagcttgcgggggacaggtaacacttccaccgatgggagttacaagccttccttcctgacggaccaggagctgaagcatctgattttagaggctgccgacggatttctctttatcgtgtcttgcgaaactggtagagtcgtgtatgtgagcgactcggtcactcccgtgctgaatcagccgcagtccgagtggttcggctccacactgtatgaccaggtgcacccggacgatgtggataaactgcgggagcagctttccacgagcgaaaatgcactgaccggccgcatcctcgaccttaagactggaacagtgaaaaaggaaggccagcagagctcgatgagaatgtgcatggggagcagacgtagttttatctgccgaatgcgctgcggctcatcctccgttgacccagtgagtgtcaaccggctctctttcgttaggaaccgctgccggaatggacttggctctgttaaggacggcgaaccccactttgtagtggtgcactgtacaggatatatcaaggcctggcctcccgccgatgatgatccagaagctgggcaggggtcaaaattttgcttagttgccatcggaaggctgcaggtgaccagttctcccaattgcactgatatgtcaaatgtgtgccagccaaccgagttcatttcacggcacaatatcgaggggatcttcacgttcgtggatcatcgctgtgtggcgacagtaggataccagccccaggagttacttggcaaaaacattgtagaattctgtcaccccgaggaccaacagctcctccgggactccttccagcaggtagtaaaactgaaaggacaggttctgagcgttatgttcaggttccgtagtaagaaccaggagtggctatggatgagaacctcctccttcactttccagaatccgtattcagatgaaatcgaatacattatctgtactaacacaaacgtgaagaattccagccaggaacccagacctactttaagcaatactatccagcggcctcaactcgggcccaccgctaacctgcccctggagatgggatccggccagctggcacctcggcagcaacaacagcaaactgaactggatatggtccctgggcgtgacggtctcgcttcctacaatcattctcaagtggtgcagccggtcactactactggccctgagcactctaaacccctcgaaaagtctgacggtcttttcgcccaggatagagatccacgcttctctgaaatataccataatatcaacgccgatcagtctaagggcatttcatcttcaacagttcccgctacacaacagttgttttctcaggggaacacctttccccccactccccgacccgccgagaactttagaaactctgggcttgcccctcccgtaacaattgtccagccgtccgcgtccgccggacagatgctggctcagatctcacgccatagtaatccaacccagggtgcaacacctacctggactcccaccactcggagcggattctcagcgcaacaagtggcgacacaggcaactgcaaaaaccagaacttcccaattcggggttggttcattccagaccccctccagcttctcatcaatgtcactgcctggggccccaaccgcctcacctggcgccgcagcctatccaagcctcaccaacaggggaagtaacttcgctcccgaaaccggccagacagccgggcagttccaaacacggacggcagagggggtgggcgtgtggccgcagtggcaaggccagcagccacatcataggtcatccagttccgaacagcatgtacaacaacctcctgctcagcagcccggccagcccgaggtattccaggagatgctaagcatgctcggtgaccagtctaattcttacaacaacgaggagttccctgacctaacaatgttccctcccttcagtgaatag

SEQ ID NO: 179489 - DNA, 1428 bp, Artificial Sequence
  Description of Artificial Sequence: Synthetic coding sequence
atgagcgccaccgccgccgcccggaagcggggcaagcccgccagcggcgcaggggctggcgctggagccggcaagcggaggcgtaaggctgatagtgcgggagaccgcggcaaatctaaaggcggaggcaagatgaacgaggaaatttctagcgacagcgaatctgagtccctggctcccaggaagcccgaggaagaggaagaagaggagcttgaagaaaccgcacaggagaagaaactgcgcctggcaaaactgtacttagaacagctccgccaacaagaggaggagaaagccgaagctcgggcattcgaggaagatcaagttgcgggacgtttgaaagaggacgttctggagcagagagggcgtctgcagaaattagtggccaaggagattcaagccccggcaagcgccgacatacgcgtcctgaggggacaccagctgtcaatcacttgcctggttgtgacgcccgacgactccgcaattttttcggctgctaaggattgttcaatcattaagtggtccgtcgagagcggaagaaaattgcacgtgatccccagggctaagaaaggtgctgaaggtaaaccccctgggcactcaagtcatgtcctatgtatggccatcagctccgacgggaaatacctagctagcggggatcgatccaagttaatacttatatgggaagcccagtcatgccagcacctgtacacgtttaccggccaccgggacgctgtcagcgggctagcctttaggagaggtacacatcagctttacagcactagtcacgacaggtctgtgaaggtttggaatgttgcggaaaatagctatgtggagacattattcggccaccaggacgccgtcgccgccctcgacgccctgagccgagaatgttgtgtgacagccggcggcagggacggcaccgtgcgcgtttggaaaatccctgaagagtcccagctggtcttctatggccaccagggaagcattgattgcatccacctgatcaacgaagagcatatggtgagtggcgccgatgacggaagtgtcgcattgtgggggctgtccaaaaaacgacccctcgctctgcagcgagaggcgcacgggttacgcggggagcctggcctggaacagcctttttggatttccagtgtggctgccctcctgaacactgatctcgtggctactggctcacatagtagttgtgttcggctgtggcagtgcggcgaaggtttccgtcaattagatctgctgtgtgatattccccttgtggggttcatcaatagtctcaaattcagctcttctggagactttctggtcgctggcgtaggacaagagcatagacttggccgctggtggaggatcaaggaggccaggaattctgtctgtataatacccctccgacgggtccctgtgccgccagccgccggcagttag

SEQ ID NO: 179490 - DNA, 2154 bp, Artificial Sequence
  Description of Artificial Sequence: Synthetic coding sequence
atggccacccccgccgccgtgaacccccccgagatggccagcgacattccaggcagtgtgacccttccagttgcacctatggctgcgaccggacaggttagaatggccggcgccatgcccgcgcgaggaggcaagcggcgtagcgggatggacttcgatgacgaggatggggaggggccttcaaagttttcgagggagaaccattccgagattgaacgccggagacggaacaaaatgacccagtatatcactgagctttctgatatggtgccgacatgctccgcactggccagaaagcctgacaaactaacgatcctaaggatggcagtgagtcacatgaaatccatgcgtggcactggtaacaaatctaccgatggtgcttataagcccagctttcttacggagcaggagcttaagcaccttatactggaggctgccgacggattcctttttgtagttgctgccgagaccggtcgggtgatttacgtctccgactccgtgacacccgtcttgaaccagccacagagcgagtggttcggcagcaccctgtatgagcaggtacacccagacgatgtcgaaaagctgagggagcaactgtgcaccagtgagaactcaatgacgggtcgtatactggacctgaaaacgggtacggtcaaaaaggaaggacagcagtcatccatgagaatgtgtatgggttcccggaggtcatttatatgtaggatgagatgcggtaatgctccattggaccatctacccctcaaccgaatcactacaatgcgtaagcgtttccggaacggtctcggccctgtcaaggagggcgaggcgcagtatgcagttgtccactgcaccggttatattaaagcctggcccccggccgggatgacaattccggaagaagatgcagatgtcggccagggcagcaaatattgtctagtagcaatcggacggctacaagtgaccagttccccagtctgcatggacatgaacggaatgtcggtccccactgagttcctgagcaggcacaattcagacgggataattaccttcgtggacccccgatgtatttctgtaattggataccagccccaggatcttctgggaaaagacattctggaattctgtcaccctgaggaccaatcccacctgcgagagagctttcagcaggtggtgaaacttaagggccaagttttatctgtcatgtaccgattcaggacaaagaatagggaatggatgttgattaggactagctctttcacgtttcagaacccttactccgacgaaattgaatatataatttgcaccaacacaaatgtgaagcagctgcaacagcaacaggctgaattagaggtgcatcaacgagatgggctgagctcctatgatctgagccaagtccctgttcccaaccttcccgccggtgtccatgaggctggaaagtctgtggaaaaagctgacgcgatcttcagccaagaacgagatcccagattcgcagagatgtttgctggcattagtgctagcgagaagaaaatgatgtcatcagctagcgccgccggcacccagcagatatacagccagggctcacccttcccttctggccactctgggaaggcattcagtagctccgttgtccatgtcccaggtgtaaacgacatacagtcttcaagcagtacagggcagaatatgtctcagatctccagacagctgaatcagtcccaagtcgcctggactggctctcgaccacccttcccaggccagcaaattccgtcccagtcttcaaaaactcagtcgtccccattcggaattggcacatctcacacttaccctgccgatccatcttcttactcccctctatcttcccctgccacttcatctccctctggtaatgcctactcctccctcgccaatagaacacccggattcgccgaaagcggtcagagttcgggccaattccaaggcaggccctctgaagtgtggagccagtggcaaagccagcatcacggacagcagtccggcgagcaacacagccaccagcagccgggacagacagaagtctttcaagatatgctgcctatgccgggagaccccacacaggggacaggtaactataacatagaagactttgcagatctgggaatgttcccaccattcagcgagtag

SEQ ID NO: 179491 - DNA, 2118 bp, Artificial Sequence
  Description of Artificial Sequence: Synthetic coding sequence
atggccagcgacatccccggcagcgtgaccctgcccgtggcccccatggctgctacgggacaggtgcggatggccggggcaatgccagcaaggggtggcaagaggaggtcaggcatggacttcgacgatgaagacggggaagggccaagtaaattttctcgcgagaatcactctgagatcgaaagacggcgccggaataaaatgacgcagtacatcactgaactgagcgatatggtgccaacatgcagtgcgctggctagaaagccagataagctgaccattttgaggatggcggtttcacacatgaaatctatgaggggcacaggcaataaaagcacagacggagcatataagccttcgttcctcactgagcaggaattaaagcaccttatcctggaagctgcggatggctttctgttcgtggttgctgctgagaccggcagggtgatctatgtgagcgactcagttacccctgtcctcaatcaaccacagagtgagtggttcggatcaacactgtacgagcaggtccatccagacgacgtggagaagctccgtgaacagctttgcacctctgagaattcaatgactggaaggattcttgacctcaaaacaggcactgttaaaaaggaaggacaacagagtagtatgcggatgtgtatggggtccagacgatccttcatttgccgcatgcgctgtggaaatgcaccattggaccatctgccactgaatagaatcacgactatgagaaaacgcttccgaaatgggctcggcccagtaaaggaaggggaggctcaatacgctgtggttcactgcacagggtatattaaagcgtggccacctgctgggatgacgatccctgaggaggatgccgatgtcggtcaaggctccaagtattgtctcgtagcgatcggacggctgcaggtgaccagcagtcctgtttgcatggacatgaacggcatgtccgtgccaacagaattcctgtctcggcacaactccgacggaatcataacttttgtcgatccaagatgcatcagtgtgatcggataccagccacaggacctactcggcaaggacatcctggaattctgccatcctgaagaccagtctcatctaagggagtccttccagcaggtggtgaagctgaagggccaggtcctgtctgtgatgtataggttccggactaagaaccgtgagtggatgctgattagaacctcctctttcacgtttcagaacccgtatagcgacgagattgagtacatcatttgcaccaataccaatgtcaaacagctgcaacagcagcaggccgagctcgaagtccaccaacgcgacggtctctcctcttacgatctctcccaggtccccgtaccaaatttgcccgccggcgtccatgaagccggaaagagcgtcgagaaggccgatgctatcttctctcaggaaagggatccccgtttcgccgagatgttcgccggcatcagtgcatctgaaaaaaaaatgatgtcctcagcttccgctgctggtacccaacaaatctatagccagggatccccatttccttccggccatagcggcaaggccttcagttcttccgtcgtccatgtcccaggtgtcaacgatatccagtctagcagcagtaccggccagaacatgagtcagatttctcggcagctgaaccaaagtcaggtggcctggacagggtctcggccaccttttcctggtcagcagatcccaagtcagtcgagcaagacccaaagtagtcctttcggtatcgggacaagccacacgtatccagcagacccaagctcctattcacctctgagctctcctgctacgtcttcaccctcaggcaatgcatacagttctcttgcgaacaggacccccggcttcgccgagtccggccaatcatccgggcagttccagggacgacccagcgaggtctggagccagtggcagtcccaacaccacggccagcaatccggagagcagcattcacaccagcagcctggccagactgaagtctttcaggacatgctgcctatgccaggggaccccaggaatgagtggtggtctccgcactcaaggcagcatttccgccagcctatctcttacgcccgcatgtag

SEQ ID NO: 179492 - DNA, 2121 bp, Artificial Sequence
  Description of Artificial Sequence: Synthetic coding sequence
atggccagcgacatccccggcagcgtgaccctgcccgtggcccccatggcggctacagggcaggtgaggatggccggcgccatgccagcaaggggggggaagaggagaagcggcatggacttcgatgacgaagacggcgaaggcccatccaagttcagtcgggaaaatcactctgagatagagcgtcgaagacgcaacaagatgacccagtatataaccgagctgagtgacatggtgcccacatgctctgccttagcccggaagccagataagctaacaatcctgcggatggccgtatcacatatgaagtccatgagagggaccggtaacaaaagcaccgacggcgcatacaagccatcatttttgacggagcaagagctgaaacacttgatcttagaggcggccgacgggttcctgtttgtggtggccgcggaaactggaagggtcatttatgtgtctgactcagtcacacctgtgctaaatcagcctcagagcgagtggtttgggtctacgctttacgagcaagttcaccccgacgacgtagagaagctaagggagcaactttgtacttctgaaaatagcatgaccggtcgcattctagacctcaaaactggcacagtgaaaaaggaaggccaacagtcatctatgagaatgtgcatgggaagtcgacggagcttcatctgcagaatgcggtgcggcaatgcccccttagaccaccttccgcttaaccggattactactatgagaaagcgtttccggaacggcctgggacccgtgaaggaaggcgaggctcagtacgcggttgttcactgtaccgggtatatcaaggcgtggccaccggcaggcatgactattcctgaagaggacgccgacgtcgggcaagggagcaaatattgcctggttgctatcggccgcctgcaggtgactagctccccagtatgtatggatatgaacggaatgtctgtccccaccgaatttctgagccggcataattcggacggaattatcacgttcgtggatcctagatgtatcagcgtgattgggtaccagccacaagacctgctcggcaaggacattctggagttttgccatcccgaagaccagagccacttaagggagtctttccagcaagtggtgaaacttaaaggacaggttctgagtgtgatgtataggtttcgaacaaagaacagggagtggatgttgattcgcacgtctagcttcactttccaaaacccgtactccgacgaaattgaatacatcatatgcaccaatactaacgttaagcagctgcaacagcagcaagcagagctggaagtccatcaaagggacggccttagttcctacgacctgtcgcaggtacctgttcctaatctgcccgccggcgttcatgaggccggtaagtcggtagagaaggccgacgcaatattctcacaagaaagagatccacggttcgccgagatgtttgccggcatcagtgccagcgaaaagaagatgatgagcagtgctagtgccgctggtacgcaacagatttatagtcaaggctctccgttcccatccggtcacagtggcaaagcattctcaagctccgtcgtgcacgtgcccggcgttaatgatatccagtctagctcctcaacaggacagaacatgagccagatctcccgccaactaaatcaatctcaggtggcttggaccggctcacggcccccttttcccggccaacaaatcccttcccagtcaagcaagacccagtctagtccattcgggatcggaacatcacacacctatccagccgacccatcgtcctacagccccctgtcgtcacctgccacgagctcgcctagcggaaatgcttacagttccttagccaacagaacacctggtttcgccgagtcaggccagtcttctggacagttccaggggaggcccagcgaagtctggagccagtggcagtctcagcatcatggacagcagagcggtgaacaacactcacatcagcagcctgggcagaccgaggtgttccaagatatgctccccatgcctggagacccaacacaagggacagggaattacaacatcgaagactttgctgacttggggatgtttcccccattttcagagtag

SEQ ID NO: 179493 - DNA, 2121 bp, Artificial Sequence
  Description of Artificial Sequence: Synthetic coding sequence
atggccagcgacatccccggcagcgtgaccctgcccgtggcccccatggctgctacaggacaggtccgcatggcgggcgcaatgcccgcgcgggggggaaagcgtcgctcaggcatggactttgatgatgaggacggggagggacccagcaaattctcacgggagaatcactccgagattgagagacggcgcaggaacaaaatgacacagtacatcacagaactgtctgacatggttcccacatgcagtgccctcgcccgaaagcccgacaagctgacgatcctgcgcatggcggtgtctcacatgaagtcaatgaggggcactgggaacaagagcacggatggcgcctataagccaagcttcctcacagaacaggagctgaagcatttgatcttggaggctgccgacggctttttatttgttgtagcagccgagaccggcagggtaatttatgtatctgattcagtcacacccgtgctcaatcaaccgcagagcgagtggttcggttcaaccctttatgagcaagttcacccggatgacgtggaaaagttgagggagcagctttgcacgtctgagaattcaatgacagggcggatcctagatctgaagaccggtacggtgaaaaaggaaggccagcagtcatctatgaggatgtgcatgggaagcagacgcagcttcatttgccgcatgcggtgtggcaacgcgccattggatcatctgccactgaatcggattactaccatgcgcaagcgcttcagaaatgggcttgggccagtaaaagaaggggaggcacaatacgccgtggttcactgcaccggatacattaaagcttggccacccgccggtatgacaattcctgaggaggatgcagacgtaggccagggctccaaatattgtctcgtggctataggcagactgcaagtaactagcagcccagtctgcatggacatgaatggaatgtctgtccccacagagttcctgagccggcataacagcgacgggattattactttcgtcgacccacgttgcatctctgttattggctaccagccacaggatctgttaggaaaagatatcctggaattctgccaccctgaggatcagtcacaccttcgtgagtcattccagcaagtggttaagctgaagggtcaagttctgtcagttatgtatagattcaggacgaaaaatcgcgagtggatgttaatccggacttccagttttacctttcagaacccttattccgacgagatcgagtatataatctgtacgaataccaatgtgaaacagctgcagcagcagcaggccgagcttgaggtacaccagcgcgatggactgtcttcctatgatcttagtcaggtccccgtacctaatctgcccgccggagtccacgaggctggcaaaagcgtcgagaaagctgacgccatattctcccaggaaagagatcctcggttcgccgaaatgtttgctgggatcagcgcgtctgaaaaaaagatgatgagcagcgcatcggcggcaggcacacagcaaatttacagccagggatccccgtttccctcaggccattcgggaaaggccttcagcagctcagtagtccatgtgcctggcgttaatgatattcagtcatcgtcctcgactggccagaatatgagtcagatctcccgccaactgaaccagtcccaggtcgcctggaccgggtctcgtcctcccttccctggccagcagattccctcccaatctagcaaaacacagtcttctccatttggcattggaaccagccacacctaccccgccgacccgagtagctattcccctctgtcctcacccgcgacgtcgtcccccagtggtaatgcctattcgagtctggcaaaccggacacccgggttcgcagagtcgggacagtcatccggtcagtttcaggggagacctagtgaggtgtggagccagtggcagtcacagcaccatgggcaacagtcaggtgagcaacactcgcatcagcagcctggccagactgaagtgttccaggacatgctgcctatgcccggagacccgacccaggggacgggcaactataacattgaggactttgccgatttggggatgttcccccctttttccgagtag

SEQ ID NO: 179494 - DNA, 1701 bp, Artificial Sequence
  Description of Artificial Sequence: Synthetic coding sequence
atggccacccccgccgccgtgaacccccccgagatggccagcgacatcccgggctccgttacccttccagttgctcctatggctgccaccgggcaagtgaggatggccggtgccatgccagccagaggagggaagcgtcgctccggaatggatttcgacgacgaggacggagaggggccatctaagttttcccgggaaaatcattctgaaatagagcgccgccgccgaaacaaaatgactcagtacattactgaactgagtgacatggtccccacctgctctgcccttgcaagaaagcccgataagctcaccatcttgagaatggcagtgagtcatatgaagagcatgcgcggcaccggaaataagagtacagacggagcttataagccttcttttttgaccgaacaagagctgaagcacttgatactcgaggccgccgacggcttcctgtttgtggtggccgccgagactggcagggtaatttacgtgtccgattcagtcactcccgtgcttaaccagcctcaatctgaatggttcgggtccacactgtatgagcaagtacaccccgatgacgtcgaaaaactccgggaacaactgtgcacaagtgagaactctatgacaggcaggatcctcgacttaaagacaggcacagtcaaaaaggagggccagcagagcagtatgagaatgtgtatgggctcccgaaggtccttcatctgccgcatgcgctgcggcaatgccccgttagatcatttacctttgaatcggatcaccaccatgaggaagagatttcgaaacgggcttggacctgtgaaggagggagaagcgcagtacgccgtagtgcactgtaccggctatatcaaagcttggccaccagcgggcatgacaatccccgaagaggacgccgatgtcgggcagggaagcaagtactgcttggtcgctataggacgcctacaggtgacaagcagccctgtctgtatggatatgaacgggatgtcagtgccgacagaattcctcagccggcataacagcgacgggatcattacatttgtggatccacggtgcattagcgttattgggtaccaaccacaggacttgttaggcaaggatatcctggaattttgccatcccgaagaccaatctcatctgcgcgagtccttccagcaagtcgtcaagttgaagggacaggtcctgagtgtcatgtaccgcttccgcacgaagaatagagagtggatgttgatccgcacctctagcttcactttccagaacccttattcagacgagatcgaatacatcatttgcactaatacaaacgtaaaacaactgcaacagcagcaggcggagctcgaagtgcatcagcgcgacgggctttccagctatgacctatcacaggtgccagtgccgaatctcccggccggagtgcacgaggctgggaagtctgtggagaaggccgatgccatatttagtcaagaaagagatcctcgcttcgctgaaatgtttgctggcatctccgcctccgagaagaagatgatgtccagcgcaagcgcagccgggacccagcagatctactcccaaggcagcccgttcccctcaggacactcagggaaggcgtttagctccagtgtggtacacgtccctggcgtcaatgacatccagagcagcagtagtacaggacaaaacatgagtcagatctctggcagttag

SEQ ID NO: 179495 - DNA, 2160 bp, Artificial Sequence
  Description of Artificial Sequence: Synthetic coding sequence
atgccccggaccatgatcccccccggcgagtgcacctacgccggccgcaagcggcggcgccccctgcagaagcagagacccgccgtcggtgctgagaaatcaaacccttctaagaggcatagagatagactgaacgcagagctggatcacctggcgtcacttcttccattccctccggatataatttcgaaactagacaagctgagcgtcctaagactgtcagtgagctatctgcgcgtgaaaagtttcttccaggttgtgcaggaacagagctctcgacagccggctgcaggggccccatcccctggagactcctgccctctggctggttccgctgtactcgagggccgccttctgttagagtctctgaatggctttgctcttgtggtatctgccgaaggcacaatcttttatgcttctgctactattgtggactatcttgggtttcatcagacagatgtgatgcatcagaacatttatgattatattcatgtagacgacaggcaagatttctgtcggcagttgcactgggcgatggacccgcctcaggtcgtgtttggacagccgcctcctcttgagacgggagacgatgcaatcctggggcgtctccttcgtgcgcaggaatggggcacgggtactccgaccgagtacagtgcattccttacacgttgctttatctgccgcgtgcgttgtctccttgactccaccagtggcttcctggctagaggatctcaggcatggcaattgcgcttatgttgtcctgagccgctcatgacaatgcagttccaaggaaagctcaaatttttgtttggacagaaaaagaaagctccttctggagctatgctccccccccggttgagcctgttttgcatagccgccccagttctcctgcctagtgccgccgagatgaaaatgaggtctgctctgttgcgagcgaagccaagagccgataccgccgctaccgccgatgctaaggtaaaagcaacaacttctctgtgtgagagcgaactccacggaaaacctaactattccgccgggagaagctcaagggagtccggtgttcttgtgctgcgtgaacagactgacgccggaaggtgggcgcaggttcctgccagagcaccatgtctttgtctccgtggcggaccagacctcgtcctggaccctaagggaggttccggagacagagaggaagagcagcacagaatgctgtccagagcgtctggggtgacagggcggagggaaactcccggacccaccaaacctttgccttggacggctggcaagcacagtgaagacggggcccggcctcggctgcagccctccaagaacgatcccccatccctgcggcctatgccccgagggagctgtttaccttgtccttgcgtgcagggaacctttaggaatagcccaatctcccaccccccatctccttcaccctccgcgtatagctcacggacctcccgtcccatgcgcgacgtcggagaggatcaggtccaccccccactctgtcatttcccccagagatctttacagcatcaactaccacaaccaggggcacagcgcttcgctacccgcggctatccaatggaagacatgaagctgcagggggttcctatgccgcccggtgacctatgtggcccgacgctgctgctggatgtatctattaagatggagaaggactccggctgtgagggtgcagctgacggatgcgtgcctagtcaagtatggcttggcgcgagcgatcggtcacatccggccacctttcctacgaggatgcacctgaagacggaacctgatagccgacagcaggtctacattagtcatctcggtcacggggtacgcggggcccaaccacacggcagagctaccgccggcaggtcccgggaattgactcccttccatccagcacattgtgcctgcctggaaccaactgacggtctccctcagagtgaacctccacatcaactttgcgctcgagggaggggagagcagagctgcacatgccgcgccgctgaggccgcaccagtggtgaaaagagaacccctggattcaccccagtgggccacccatagtcagggcatggtccccggcatgttacccaagtccgccctggcaaccctggtccccccgcaggcatcagggtgtacttttcttccttag

SEQ ID NO: 179496 - DNA, 2106 bp, Artificial Sequence
  Description of Artificial Sequence: Synthetic coding sequence
atgccccggaccatgatcccccccggcgagtgcacctacgccggcaggaaacggaggcgccccctgcaaaaacagcgacctgctgtgggagcagagaaaagcaaccccagtaaaagacacagggataggttaaacgcggaactcgatcatctcgctagcttactcccttttcctcccgatatcatttctaaactggataagctgtcggttctgagactgagcgtctcttacctcagagtgaagagcttctttcaggttgttcaggagcagtcctctcgacagcccgccgccggtgcccctagcccgggcgatagctgtccgctagcgggtagcgcggtgcttgaaggaaggctcctgctggaaagtctgaacggattcgcgttagtggtttccgccgagggcacgatcttctacgcctctgccaccatcgtggattacctgggttttcatcagacggatgttatgcaccagaatatttacgattacattcacgtggatgaccggcaggatttctgccgccagctgcactgggccatggacccccctcaggtggtctttgggcagcccccccccctggagaccggagacgatgccatccttggtcgactccttcgagcacaggaatggggcactgggacacctactgagtatagtgcatttctgacacggtgctttatctgtcgcgtgaggtgcctcttagactctaccagtgggttcctaaccatgcaatttcaagggaagctgaagttcttgtttggacagaaaaaaaaggcccccagcggggccatgcttccgccaagactcagcctgttttgtattgccgctccggtactgctccctagcgcagctgagatgaagatgagaagcgcgctgttgagagcaaagcctagggctgatacggcagcgactgcagatgccaaggtgaaggctacaaccagtctctgcgagtccgaactgcatggaaaaccgaattacagcgccggacgctccagtcgtgagagcggagtgctggtgctgagagaacagaccgacgcagggagatgggcacaagttccagcccgggcaccatgcctgtgcctgaggggcggccccgacctggtgctcgatcccaagggcggtagtggagatagggaggaagaacaacatagaatgctctctcgggccagcggcgtgactgggagacgggagacaccagggcctacaaaacctttgccctggacagcaggtaaacatagcgaagatggtgctagaccaaggttacagcccagtaagaacgaccccccttctctgcgtccgatgcctcgggggtcatgcctgccctgcccttgcgttcagggtacctttaggaacagccctatttcccatccaccctccccatcgccatcagcatactcttctcgcacatcaagacctatgagggacgtaggtgaggaccaggtgcacccacctttgtgccacttcccacaacggagtcttcagcatcaacttcctcagcccggggcccaacgcttcgctaccaggggttaccccatggaggatatgaagctgcagggagtccctatgccacccggcgacctgtgcggcccaacgttgctcctggacgtgagcattaaaatggaaaaggactcaggctgcgagggggccgccgatggttgcgtgccctctcaggtgtggttgggcgcttccgacaggagtcaccctgcaacctttccgacccgtatgcacctaaagactgagcctgactcgaggcagcaggtttacatttcgcacctgggacacggggtgaggggcgcccagccacacgggagggcaactgccggccggagtagagagctcactccattccaccctgctcactgtgcgtgtcttgaaccgacagacggtctgccccaatcggagccaccccaccagttgtgtgcacgcggacgaggagaacaatcatgcacatgccgcgccgctgaggcagcccccgttgtgaagagggaacctcttgactctcctcagtgggctacgcacagccagggaatggtgcctggtatgttgccaaaatcagctctcgcaaccctagtgccaccacaagcttccggttgtaccttcctaccatag

SEQ ID NO: 179497 - DNA, 2205 bp, Artificial Sequence
  Description of Artificial Sequence: Synthetic coding sequence
atgagcggcttcgacgaccccggcatcttctacagcgacagcttcggcggagatgcgcaagcagacgagggtcaggcccggaagagtcagctccaacggaggttcaaggagttcctccgtcagtacagagtcggaacggatcgtaccgggtttacctttaagtacagagatgaactcaaacgccactacaacttgggagaatactggattgaggtagaaatggaggacctagccagctttgacgaagatctcgctgactatctgtacaagcagcctgccgagcatctccagttgctggaggaagcagctaaagaagttgccgacgaggtgacacgccctcggccatccggcgaagaagtgttgcaagacatacaggtaatgttgaaatctgatgcttccccaagctccatcagatcccttaagtctgatatgatgtctcacctcgtgaaaatacctggcattattattgccgcgtcagccgttcgcgctaaagcaacaagaattagcatccagtgcagatcctgtcggaatacactgaccaacatcgccatgcgtccaggactggaaggctacgctctgcctcgcaaatgtaacacggaccaggcaggaaggccaaagtgtccactcgatccgtattttatcatgcccgacaagtgcaagtgtgtggactttcagactctgaagttgcaagagctgcctgacgcagtcccacacggggagatgccaaggcatatgcagctttactgtgacaggtacctgtgcgataaagtggtgcccggcaaccgtgtgacgatcatgggaatctactctataaagaaatttgggctgaccacatcaaggggaagagacagggtgggggtgggtattagatcctcatatatccgagttttgggaatccaagtagacaccgatggttccgggcgcagcttcgccggggccgtgagcccacaggaggaggaagaattccgtcggcttgccgccctgcctaacgtctatgaggtaattagtaagtctatcgcccccagcatcttcggaggaacagacatgaaaaaagctattgcctgtctgcttttcggagggtctcgaaagcgactccccgatggcctcacacgccgcggtgatattaatctgcttatgctgggcgatcccggtaccgcaaagtctcaactgctgaaatttgtagagaagtgcagcccgatcggcgtgtatacatccggcaaaggtagctctgcagcaggtttgactgccagtgttatgcgtgacccaagtagccggaactttatcatggagggcggagcgatggtcctggctgatggcggagtggtttgtatagatgaattcgataaaatgcgcgaagacgacagagtagccatacacgaggctatggagcagcagaccattagcattgctaaggccgggattacaacgacattaaatagtcggtgctctgtgctggctgccgctaacagcgtgtttggaagatgggatgaaacaaaaggagaggacaacattgacttcatgcctaccatccttagccgtttcgacatgatatttatcgttaaggatgagcacaatgaggagcgggatgtgatgttggccaagcatgtgattactctccatgtctccgcactgacccaaacacaggcggtggaaggcgagattgacctagccaaactgaagaagtttatagcgtactgccgcgtgaagtgtggtccgcgcttaagcgccgaggcggcggagaagctgaaaaataggtacatcattatgaggtccggcgcccgacagcacgagagagattccgatagacgctccagcattcctataaccgtgcgccagctagaggcgattgtgcgcattgcagaggctctctcgaagatgaagcttcagcccttcgccaccgaggccgacgtggaggaggctttgcggttatttcaggtctctacattggacgccgccttaagcgggaccctctcaggggtggaagggttcacctcacaggaggatcaggagatgttgtcccgaattgagaagcaactgaagagacgattcgcaatcggctctcaggtttcagagcacagtataatcaaagactttacaaagcagaagtaccccgaacatgctatccataaggtccttcagctaatgctgcgacgaggagagatccagcatcggatgcagcgaaaggtgctgtatcgactgaaatag

SEQ ID NO: 179498 - DNA, 1530 bp, Artificial Sequence
  Description of Artificial Sequence: Synthetic coding sequence
atgagcatgggcgccccccggagcctgctgctggccctggccgccggactcgcagttgcacgccctcctaacattgtcttgatcttcgcggatgatctgggctacggtgatctgggctgttatggacacccaagtagtaccacacccaacttggaccagctcgccgcaggcggcctgcgatttaccgatttctatgttcccgtgtcactgtgcaccccctcacgagcagctctgttgacaggcaggctgcctgtcagaatgggaatgtatccaggcgtgttagtcccatcttctcgggggggactgcctcttgaggaagtgaccgtggcagaggttctcgccgcccgcgggtacctgactggcatggcgggtaaatggcacctgggcgtgggcccggaaggcgcttttctaccaccccaccagggattccaccgatttctcggaattccctattctcacgatcaggggccatgccagaatctgacctgttttccgccagccaccccatgcgatggagggtgtgaccaggggctcgttcccattccactgcttgcgaatctgtcagtggaggcgcaaccaccctggctccccggactggaggcgcgttacatggcttttgcacatgacctgatggcagatgcccaacgacaagaccggccattcttcctgtactatgccagtcatcacacacactatccacaattctcgggccagagtttcgcagagagatcgggacgtgggccttttggtgacagcctgatggaattagacgctgccgtgggaaccctgatgacagccatcggcgatcttggtctgctggaagagacgctagtgatcttcactgccgacaacggcccagagacaatgcgcatgagtaggggcggatgcagtggactgctgagatgcggcaaaggcaccacttacgaggggggtgtgcgagagcccgccctcgccttctggccggggcacatagcccccggagtcacccacgagttggcttcaagcctggacctgcttccaaccctggctgccttggctggggctccgttgcctaacgttacgctcgacgggtttgatctctctcctttgctgctggggacaggcaagtctcctaggcaaagtctgttcttttacccgtcataccctgacgaggtgcggggagtgtttgccgtgcgaaccggcaaatacaaggcccattttttcacgcagggatcagctcacagtgatacaacggccgatcccgcctgtcacgccagttcatcactgacagctcacgagccgccactgctgtacgacctttccaaagaccccggcgagaactacaacctgctgggaggagtggcaggagccacacccgaagtgctgcaggccctgaaacagctgcagctgctgaaggcacagcttgatgctgcagtgaccttcggcccatcccaggttgcgagaggggaggatcccgcgctccaaatttgctgccaccccggctgcacaccgcgccctgcttgctgccactgccccgatcctcatgcatag

SEQ ID NO: 179499 - DNA, 1530 bp, Artificial Sequence
  Description of Artificial Sequence: Synthetic coding sequence
atgagcatgggcgccccccggagcctgctgctggccctggccgccggcctggccgtggcacggccgcccaatatcgtacttatatttgctgacgacttgggatatggagacctgggctgctacggtcatcccagtagtaccacccctaacttggaccagctggccgctgggggactgagattcactgacttctacgtcccagtcagtctgtgcacgcctagcagggccgccctcctcacgggtcggctgccggtgaggatgggaatgtaccctggggtgctggtgcccagttccagggggggcctcccgttagaagaagtgacggtggctgaggtactcgcagctagaggctatctcaccggcatggctggcaagtggcacctcggcgtgggacctgaaggtgcctttctgccccctcatcaggggtttcataggtttctcgggatcccatactcccacgaccagggcccatgccagaatctaacctgtttccctccggcaaccccctgcgatggcgggtgcgatcaggggctggttcctatacccttgctggcaaacctgagcgtcgaggcccaacctccttggttgcccggtcttgaggcccgttatatggctttcgcacatgatctgatggctgacgctcagcgacaagatcgcccgttctttttatactacgccagtcatcacacccactacccacagttcagcggacagagtttcgccgaaaggtcaggccgcggacccttcggagactccttgatggagctggatgcggcagttggcacgctcatgacagccatcggtgatctcggtcttctggaggagactctcgtcatcttcacggccgataacggcccagaaacgatgcgtatgtccagggggggatgcagcgggctgctgcgctgcggcaaggggaccacctatgaaggcggagttcgtgagccagctcttgctttttggcccggacatatcgcgcccggcgtgacccacgaactggctagctcactggacctcctgccgacactggctgcattagcaggggctcccctcccaaatgtcacccttgatggctttgacctgagccctttgctgctggggaccgggaaatcaccccgccaaagcctgttcttttacccgtcgtatcccgatgaagtgcgcggagtcttcgccgtgaggaccgggaaatacaaggctcatttttttacacagggatctgcacatagcgacacaaccgccgatcccgcttgccatgccagttcatccctcactgctcacgagccccccctcctgtacgatttgagtaaggatcctggggagaattataacctgctaggaggggttgcaggggccacaccagaggttttgcaggcattgaagcagctgcaactgctcaaggcccaactggacgctgccgttacatttggacctagccaagtcgctagaggtgaagacccagctctgcagatttgctgccatccaggatgcaccccaagacccgcctgctgccattgtccagacccacatgcatag

SEQ ID NO: 179500 - DNA, 1530 bp, Artificial Sequence
  Description of Artificial Sequence: Synthetic coding sequence
atgagcatgggcgccccccggagcctgctgctggccctggccgccggcctggcagtcgctagaccccctaatatcgtgctaattttcgccgacgatttgggctatggagaccttggttgctacggccaccccagctctacgacgcccaatctggatcagctggccgccggtggcctgagatttactgacttctatgttcctgtgtccctatgcacacccagcagggccgccctgctaactggccgtctgcctgttcgcatgggcatgtacccaggcgtactggtaccgtcgtccagaggaggacttccgctggaggaagtgacagttgcggaggtgctggcagcgcgcggctatctgacaggaatggccggaaaatggcatcttggcgtggggcctgagggcgctttcctgccaccgcaccagggcttccacagattcctaggcatcccttatagccacgaccaggggccttgccagaacctgacctgcttcccacctgctacaccatgcgacggtggttgtgaccaagggttagtcccaatccccttgctggccaacctttcggtggaagcccagccgccatggctccctggactggaggcgcgatacatggcgttcgcccacgacctaatggcagatgcgcagagacaagatcggccttttttcttatattatgctagccatcatacccactacccccagttcagcgggcagtcattcgccgagcgaagtggacgaggcccatttggagatagcctgatggaactggatgcagctgttgggaccctaatgactgccatcggcgacctgggccttcttgaagagacgctggtcattttcacagctgacaatgggccagagacgatgagaatgtctagaggcgggtgtagcggactcctgcgctgtggaaagggaaccacctatgaagggggcgtgcgcgaaccagctcttgcgttctggcccggccatattgcgcctggtgtcactcacgagctggcaagcagcctagacctgttgcctaccctggcagccctggccggagcccccctgcctaacgtcacactggatgggttcgatctgtcacctttgctgctcggcaccggcaaatcgccaagacaatccttattcttctacccttcttacccggatgaagtgcgtggggtgtttgctgtgagaaccgggaagtataaggcacattttttcacacaaggtagtgctcacagcgacacgactgctgatcccgcctgccacgcctctagcagcttgaccgcccatgagcctcccctgctatacgatctcagcaaagatccgggcgagaattataacctcttggggggcgtggcaggcgctactccagaagtgttacaggcattgaagcaactgcagctcctgaaagcccagttggatgcagcggtcaccttcggtccatcccaggtcgcgcggggcgaggaccctgctcttcaaatctgctgccaccccggatgtaccccaaggccagcctgctgtcactgcccagaccctcatgcttag

SEQ ID NO: 179501 - DNA, 1272 bp, Artificial Sequence
  Description of Artificial Sequence: Synthetic coding sequence
atgggcatgtaccccggcgtgctggtgcccagcagccggggcggcttgcccttagaagaggtgactgtagctgaagtgctggccgcgaggggctacctaacagggatggcaggcaagtggcatctgggagtcggacctgaaggtgcatttctgccccctcatcagggttttcatcgcttcctgggtataccctactcccatgatcagggcccctgccaaaatcttacttgttttcccccagcaactccatgcgatgggggctgcgatcagggactcgtgccaatccctctcctggctaacttgtcggtcgaggctcaaccaccttggctacccggccttgaggcaagatacatggccttcgcccatgacctgatggcggatgctcagagacaagacagacccttttttctgtactacgcatctcatcacacgcattatccccagttctctggacagtcatttgcagagcggtcagggcgtgggcccttcggggattctttgatggagctggacgcagccgtcggtacattaatgaccgccattggcgacttgggccttctggaagaaacactcgtaatatttacagcggacaacggacctgagacaatgagaatgtccaggggagggtgtagcggcttactgagatgcggcaagggaaccacctacgaaggaggtgtccgcgaaccagctctggccttctggcccgggcatatcgccccgggagtgacacatgaacttgcctctagtcttgatttgttgcctacgctggccgcgcttgctggggctcccctgccgaatgtgaccctcgacggcttcgacctcagtccgcttctgctgggaacaggaaagagtcctagacagagcttgtttttctacccttcttatcccgacgaggtgaggggcgtgtttgctgtccggactgggaagtacaaggcacatttttttacacagggtagcgcgcatagcgacacaaccgcagaccctgcctgtcacgctagcagctcactgaccgcccacgagccaccgctgctgtacgacttatcaaaggaccccggcgaaaattataaccttcttggaggagtggccggcgcaactcctgaagtgctccaagcacttaagcagctgcagcttctgaaagcgcagctggatgcagccgtaacgtttggacccagtcaggtggcccgcggtgaggatccagccctgcagatctgctgtcatcctggctgtacaccccggcccgcatgttgccactgtccagaccctcacgcctag

SEQ ID NO: 179502 - DNA, 1524 bp, Artificial Sequence
  Description of Artificial Sequence: Synthetic coding sequence
atgggcgccccccggagcctgctgctggccctggccgccggcctggccgtcgctagaccaccaaacattgtgctgattttcgcggacgacctggggtatggcgacctgggatgttacggccatccttcctcaacaactcctaatctcgatcagcttgcagcaggcggtctgaggttcactgacttttacgttccggtgtcactctgcacaccatctcgggctgcgttgctgacgggccggctcccggtcagaatgggcatgtatccaggtgtactggtgccctcaagccgcggagggctcccactggaggaggtcacagtcgctgaagttctggcggcacgaggttacctaaccggcatggccggcaaatggcatctcggagtgggtcccgaaggagcctttctacctccccatcaaggtttccaccgattcctgggtatcccttatagccacgaccaggggccatgccagaatctcacctgttttccaccggccacgccatgcgatggtggatgtgaccagggtctcgttcccattcccctcctggctaacctaagtgtggaagcacagcccccctggctgccaggtttagaggccagatacatggcctttgctcacgacctaatggccgatgctcagcgacaggaccggcctttttttctgtattacgcttcccatcacacccattatccccaattctcaggccagtcctttgctgagcggtctggcagaggacccttcggagactccctgatggagctcgacgccgccgtaggcactctgatgacagctatcggggaccttggactgctcgaggagacattggttatctttaccgctgataatgggcccgagaccatgcgaatgtcgaggggaggctgcagcggcctgctacgctgcggtaaaggcactacgtacgaggggggggtacgcgagccggccctggcgttttggccaggccatatcgctcctggtgtgacccacgagttagcttccagcttggatctccttcccactctcgcagccctggctggggctcccctgcctaacgttactttggatgggttcgacctgtctccccttctattaggaactggcaagtccccacggcagtcccttttcttttatcctagttaccctgacgaggttcgaggggtttttgcagtccgcacgggcaaatataaggcccacttctttacacagggaagcgcccatagcgatacaactgccgaccccgcctgtcatgcgagctcctctctcacggcccacgaacctccattgctctatgatctgtccaaggacccaggggagaactataatctcttgggcggcgtcgccggcgcaacacctgaggtcctacaagccttgaagcagcttcagcttctcaaggctcagctggacgcagcagtgacttttgggcccagccaggttgcaagaggcgaggacccagctctccagatctgttgccatccgggttgtaccccaagaccagcctgctgtcattgtccagacccgcacgcatag

SEQ ID NO: 179503 - DNA, 1524 bp, Artificial Sequence
  Description of Artificial Sequence: Synthetic coding sequence
atgggcgccccccggagcctgctgctggccctggccgccggcctggctgtagcacgacccccgaatatcgtgctgatattcgcagacgatttaggctatggtgatctggggtgctatggccacccaagctcaaccacccccaacctggatcaacttgccgcaggaggcctgaggtttacagatttctacgtgcctgtgagtctgtgtacccctagccgcgccgccttactgactggaaggctaccagtcagaatggggatgtatccaggggtgctggtgccctcttctcggggaggcctgcccctcgaggaggtaacagtggcagaagttctggccgcacgcggatacctcaccggcatggcagggaaatggcatctgggggtaggcccggagggcgccttcctgccaccacaccagggcttccaccgatttctgggcattccttacagtcacgatcaaggcccctgccagaatctcacgtgtttccccccagccaccccctgcgatggggggtgcgaccagggcctggtgccaatcccacttcttgctaatcttagtgtcgaagctcagcccccatggctgcccggtcttgaggcccgctacatggcctttgcacatgatttaatggccgacgctcagcgtcaggacaggccctttttcctgtattacgcctctcaccacacccattaccctcaattcagtggtcaatcgttcgcagagagatccggtcgaggtcccttcggagactcgctgatggagctggacgcagcggtgggtacactcatgacagccatcggggacttgggtctgctagaggagacactggtcatatttactgctgataatgggccagaaacaatgcgtatgtccagaggaggctgctcaggcctcctgaggtgcgggaaagggaccacgtatgaaggcggggtacgggaaccagcactggctttttggccagggcacatagctccaggggtgacccacgagttagcctcctccctggacctgctgcctaccctagctgcacttgctggggcccctttgcctaatgttactttagacggcttcgatttgagtccactactgctggggacgggaaagtctccccgccaaagccttttcttttatccctcttaccctgacgaggtcagaggcgttttcgccgtgaggaccgggaagtacaaggcgcacttcttcacccagggttccgcccactctgataccaccgccgaccctgcttgtcatgcttccagttctctgaccgcacacgagcctcctctgctgtacgacctttcgaaggaccctggggaaaattacaatctgctggggggcgttgcgggtgccacccccgaggtgctacaagcgctcaagcagctgcaactgctgaaagcccaacttgatgctgcagtcaccttcggcccctcccaggtcgctcgaggtgaagatcctgctctgcagatatgctgccacccaggatgcacacctcgtccagcctgctgccattgtcccgaccctcatgcatag

SEQ ID NO: 179504 - DNA, 1782 bp, Artificial Sequence
  Description of Artificial Sequence: Synthetic coding sequence
atgcggagcgccgcccggcggggccgggccgcccccgccgcccgggattccctccctgtcctgctgttcttgtgtctcttgctgaagacatgcgagcctaagactgccaacgctttcaaacctaatatcctcctgatcatggctgatgacctgggcacgggagatctgggctgctacggaaacaacaccttgagaacgcccaatattgaccagctagccgaagaaggagtccgcttgactcagcacctcgcggctgcccctttatgtaccccaagcagagcagcattcctcaccggcaggcatagctttcggtccggaatggatgcatccaacggataccgggccctacagtggaacgctggatctggaggattacccgaaaatgaaaccacattcgcccgcattctgcaacagcatggatatgcgacgggacttattggcaagtggcaccaaggagtgaactgtgcctctcggggagatcattgtcaccacccacttaaccacggctttgattacttttatggcatgccctttaccctcacaaatgactgcgacccaggtagaccacctgaagtggatgctgcactgcgggcacagctgtggggctatacacagtttctcgccctaggtatcctgaccctcgctgcaggtcagacatgtgggttcttcagtgtctccgccagagctgtcacagggatggccggggtaggctgcctctttttcattagctggtattctagctttggctttgtccgacgctggaactgcatcttaatgaggaaccacgatgtcaccgaacagcctatggtcttggagaagacagcttcgcttatgttgaaagaagccgtgtcctatatagaacggcacaagcatggacctttcctgctttttctttctttgcttcatgtacatatacccctggtgaccaccagcgcttttctgggcaagagccagcacggcctgtatggggataacgttgaagaaatggactggctcatcgggaaagtcctgaatgcgatcgaagacaatggactcaagaatagcacctttacatacttcacttctgaccacggtggccaccttgaggccagggacggccatagccagcttggtggctggaatgggatttacaaaggtgggaagggtatgggtggatgggaaggtggcatccgagtgccaggcatttttcattggcccggcgtcctgcctgccggccgtgtcattggcgagcccacttcccttatggatgtgttcccaaccgtggtacagttagtgggcggcgaggttccgcaggacagggtcatcgacggccactcattggttcctcttctccagggtgcggaagccaggtcagcccacgagtttttatttcattactgcggacagcacctgcatgcggcgaggtggcaccagaaagacagtggctcagtgtggaaagtccattataccacgccacagttccatccagaaggcgcgggagcttgctatggccgcggggtttgcccatgctcaggggagggagtgacccaccacaggccaccgttattgtttgacctgagccgcgacccaagtgaagctcgtccactcacacctgactcggagccactctatcatgcagtgatcgctcgcgtgggcgcggcagttagcgaacataggcagacactgtctcctgtgccgcagcagttttccatgtcgaatatcttatggaaaccatggctgcagccatgttgcgggcacttcccattctgctcctgccacgaggacggggatgggaccccatag

SEQ ID NO: 179505 - DNA, 1770 bp, Artificial Sequence
  Description of Artificial Sequence: Synthetic coding sequence
atgctgcacctgcaccacagctgcctgtgcttccggagctggctgcctgccatgttggccgttttgctgtctcttgcgccttcggctagttctgacatttcagccagcaggcccaacatcctgcttctgatggcggacgatctgggtatcggagacataggttgttatggtaacaacacaatgcgaacccccaacatagacaggctggcagaggatggagtgaagttaacacagcacatttctgctgctagtctttgtacaccttccagagcagcctttttgacgggtagatatccagtccgatctggcatggtgtcctctattggataccgcgttttgcaatggacaggggcatcaggtgggctcccaaccaacgagaccacgttcgctaagatcctgaaggagaagggctatgcgacggggttgattggcaaatggcacttgggtctgaactgtgagtcagcgtccgatcattgccatcacccactgcatcatgggttcgatcacttctatggtatgcctttttctttgatgggcgattgtgcccgatgggagctgagcgagaaaagagtgaatttagagcagaagctgaacttcctctttcaagttttggccttagtcgctctcactctggtcgcaggcaaattgacacatctcattccagtttcctggatgccggtcatctggagtgccctttcagcagtactcctcttagcaagcagctatttcgtcggcgccctgattgtccatgccgattgcttccttatgcgaaaccacaccattacagagcagcctatgtgtttccagcgcaccactcccctaattctacaagaagtggctagtttcttaaaaaggaataagcatggccctttcctgctctttgtgagcttccttcatgtgcacatccctttgattaccatggagaactttctcgggaaatcgctccacggactgtacggagataacgtggaagagatggactggatggtcgggcgaatcttagacactttagacgtggagggcctctcgaatagcaccctgatctatttcacctcagaccatggcggctcactggagaatcagttgggtaacacgcaatatggggggtggaacggtatttataaaggaggcaaggggatggggggatgggagggcgggatcagagtgcctggaatttttcgttggccaggagtgctgcctgctgggagagtaatcggggagcctacaagccttatggatgtgtttccaactgtggtgcggctggcaggtggagaagtgcctcaagatcgggtcatcgatgggcaggacctgcttcctcttctcctcggtacagcccagcacagcgaccacgaatttctgatgcactattgtgagcgcttcctgcatgccgccaggtggcatcaacgagatagaggcacgatgtggaaggttcattttgtcactcctgttttccagcccgagggagccggagcctgttacggccgcaaggtgtgtccttgttttggagaaaaggttgtgcaccacgacccccctttactatttgatttatctagggatccatctgaaacccatattttgacacccgcgtcagagcctgtgttctaccaggtgatggagagggtacagcaggctgtttgggaacatcagcggacgctctctcccgttcctctacaactcgatcggttaggcaatatttggaggccatggctccagccatgctgcgggccttttcccttatgttggtgcctgcgtgaagatgacccgcagtag

SEQ ID NO: 179506 - DNA, 537 bp, Artificial Sequence
  Description of Artificial Sequence: Synthetic coding sequence
atgctgcacctgcaccacagctgcctgtgcttccggagctggctgccggccatgctagccgtgttgctgagtctcgccccatccgcctcctccgacatctccgccagccgacctaacattctattgctcatggccgatgacttggggattggcgatattgggtgttacggaaataataccatgcgaacccctaatatcgaccgtctcgcagaggacggggtgaagctcactcagcacatctcagccgcctccctttgcactccttccagagcagccttccttactggaagatatcccgtcaggtcgggaatggtgagtagtattggctatcgggtgcttcagtggaccggcgcaagcgggggactgcccactaacgaaacaacgttcgcaaagatcctgaaggaaaaggggtatgccactgggctgatcggaaagtggcaccttggactcaattgtgagtccgcttctgaccactgtcatcacccactgcaccatggattcgatcatttctacgggatgccattctccttgatgtag

SEQ ID NO: 179507 - DNA, 1635 bp, Artificial Sequence
  Description of Artificial Sequence: Synthetic coding sequence
atgagcggcagccgggagcgggacaacatgctgcacctgcaccactcctggacacccaacatagatcgacttgccgaagatggcgtgaagctcactcagcacatctcagccgcatccctctgtacaccgtcaagggctgctttcctgaccggacgttaccccgtaagatctggaatggtgagttcaataggataccgtgtgctgcagtggaccggcgcaagcggcgggctccctactaatgagaccacattcgccaagatcctcaaggaaaaagggtacgccaccggcctcattgggaaatggcaccttggtctgaactgcgaatctgcgtcggatcattgccaccatcctctccatcatggctttgaccatttttacggcatgccctttagtctgatgggcgattgcgccagatgggaactctctgagaagagggtgaacctggagcagaaactgaacttcttattccaggtcctagccctcgttgccctaacactcgtcgcgggaaagcttactcacttgataccggtctcctggatgccagtgatctggtcggccctctctgcagtcttgttactggcaagttcctactttgtgggtgcccttatcgtccacgcagactgcttcctcatgcgaaatcacactatcacagaacaacccatgtgttttcagaggaccaccccactcatactccaggaagtggcttcgttcctgaagcgcaacaaacacggcccctttttgctctttgtatcatttcttcatgtccacataccacttatcaccatggaaaatttcctggggaagtcactgcatggcctctacggcgacaacgtcgaagaaatggactggatggtgggtcgtattctcgacactctcgatgtggaggggttgagcaattctactctgatatactttacttcagaccacggcggctcgctcgaaaatcagcttggcaatactcagtacggcggctggaacggaatttacaaaggggggaaaggaatgggtggatgggagggaggcatccgtgtccctggcatatttaggtggccgggcgttcttcctgccgggcgagttataggggagcccacatctctaatggacgtgttccctactgtggtgaggttggccggcggagaggtgcctcaggatcgcgtgatcgatggacaggatctgctgcccctcttactgggtacagctcaacactctgatcacgagtttcttatgcactactgcgaacgattcttacacgccgcccggtggcatcagcgcgacagagggacgatgtggaaagtgcatttcgtgacaccggtgttccagcccgaaggagcaggggcttgctacggaaggaaggtatgtccttgtttcggcgagaaagtggtgcaccacgatcccccattactgttcgatctttcccgcgacccctccgaaacccacattttgacacctgcgagcgagcccgtgttttaccaggttatggagagggttcaacaggccgtgtgggagcaccagcgaacattgtctccagtgcctctgcaactggaccggttaggcaacatctggcggccctggttgcaaccctgctgtggccctttccctttgtgctggtgcctaagagaggatgacccacagtag

SEQ ID NO: 179508 - DNA, 1845 bp, Artificial Sequence
  Description of Artificial Sequence: Synthetic coding sequence
atgcggcccgtgatcaaccggtgcgcccccggcagcctggacctgatgttaccccaggccgcatctgagggcattgtttttcattcactgcagatcagcttgtgtttcaggagctggctgcctgccatgctcgctgtgctactgtctctcgccccctctgcttcaagtgatatttctgcctcccggccaaacatcctgctgctgatggcagatgacctagggattggagatataggttgctacggaaataatacaatgcgcactccgaatatagaccgactcgcagaggatggcgtgaagttgacccagcatattagcgctgcgagcctctgtacaccaagcagagcagcctttttgacaggccggtaccccgtgcgctccggtatggtgtcctccattggctaccgagtcctgcaatggactggtgcgtcaggaggactccccaccaacgagacaactttcgccaagatcttgaaagagaaaggttacgccaccgggctcattgggaagtggcacctcggattaaattgtgagagtgctagcgaccactgtcatcaccccctgcaccacggcttcgatcatttttacggtatgcctttttctctcatgggcgactgtgcacgctgggaactttcagagaagcgggtaaatctcgagcagaagttaaatttccttttccaggttctcgccctggtcgctctcaccctggtggccggtaaacttactcatctcatccctgtgagttggatgccagtgatttggagcgcactgagcgctgtgttactcttagcctcttcctacttcgtaggcgctttgatagtccacgccgactgtttcctgatgcgaaatcatactatcacggaacagccgatgtgctttcaacgcaccacccctctgatacttcaggaagtggcatcctttctgaaaagaaacaagcatggacccttccttttattcgtgtccttccttcacgtccacattcccctgattacaatggagaatttcctcggcaagagtcttcatggcctatatggggataatgtagaggaaatggattggatggtaggccgcattctggataccttggacgtggaaggactttccaactcaacactgatttacttcacgtccgaccacgggggtagcctggagaaccagctcggtaacactcaatatggtggatggaacggcatttacaaaggaggaaagggaatgggcggttgggagggcggcattcgggtccctggcatctttcgttggccaggtgttctgcccgccggccgggtcattggtgaaccgacctccttaatggacgtattccccactgtggttcggctggccggcggtgaagtgccgcaggatagagttatcgacgggcaagatcttctgccactcctgctagggactgctcagcacagtgatcatgaatttctgatgcattattgcgagcgcttcttacatgctgctaggtggcaccagagagacagaggaacaatgtggaaagtgcactttgttactcctgtcttccaaccagagggagccggcgcctgttacggccgcaaggtgtgtccctgttttggcgagaaagtggtgcaccacgatccacccctgttgtttgacctcagccgggatccgtcggagacccacatcctgacccctgcctccgagccagttttttatcaagtcatggagcgggtgcaacaagccgtgtgggaacaccagagaacactgagtccagtcccattgcagctggaccggctgggaaacatctggcgcccatggttgcagccttgctgtggtcccttccctttgtgttggtgcctccgagaagacgacccccagtag

SEQ ID NO: 179509 - DNA, 1773 bp, Artificial Sequence
  Description of Artificial Sequence: Synthetic coding sequence
atgcggccccggcggcccctggtgttcatgagcctggtgtgcgccctactcaacacctgccaggcccatcgcgttcatgatgacaagcccaatatcgtgctgatcatggtagacgacctgggcatcggggatctgggctgttatggtaatgacacaatgaggaccccccatatcgaccgcctcgctagggagggtgtccggcttacccagcacatcagcgctgcttcgctgtgttctccatcccgctccgccttcctaaccggacgctatcctataagatctgggatggtgtcatcggggaaccggcgtgtgatacagaaccttgcggtgcccgctgggctgccgctgaatgaaaccaccctggctgcattactgaagaagcaggggtattccaccggcctgattggcaaatggcatcagggactgaattgcgacagccgtagcgatcaatgccaccatccttataactatggatttgactactattacggaatgccctttacgctggtagactcatgctggcctgaccccagcagaaacactgagctagctttcgagtcccagctttggttgtgcgtccagttagtggccatcgctattctgacactcacattcggcaagctgtccggttgggtgagcgtgccatggcttctgattttttcgatgatcctctttattttcctccttggctatgcctggtttagttcccacacatcaccgctgtactgggactgtctcctcatgaggggccatgaaattaccgaacagccaatgaaggcggagcgcgctgggagtataatggtgaaagaagctatcagttttttggaacgacactctaaggagactttcctactttttttctcttttctgcacgtgcatacacccctgccaacaacagacgactttactggaacaagtaaacacggcctctacggggacaacgtggaggagatggatagcatggttggtaagattttagacgctatcgacgacttcggcctgcggaataatacgttggtatattttaccagtgaccacggaggacacttagaggcacggcgaggccatgcccagcttggtggttggaatggcatttacaagggcgggaaaggaatgggcgggtgggaggggggcatcagagtccccgggattgtgagatggccaggcaaggtgcctgcaggtaggttgattaaggagccaaccagcctgatggatatcttgcctacggtcgccagcgttagtggcgggagtctgcctcaggaccgggtaatagatggccgcgacctgatgccattgctgcaaggcaatgtccgccactctgagcatgaattcttgtttcactactgcgggtcttacctgcacgccgtccgctggatcccaaaggatgacagtggttccgtttggaaagctcattacgttacccccgtgttccagcctccggcctctggaggatgctacgtgaccagcttgtgcagatgtttcggcgaacaggtgacctaccataatcctccattactgttcgatctctcacgcgacccctccgagtcaactccactgaccccagctaccgaaccactccatgatttcgtaatcaaaaaggttgccaatgctcttaaagagcaccaagaaaccatcgtgccagtgacctatcagttgtccgaactaaaccagggtcgaacgtggctgaagccatgctgcggggtctttcccttctgtctgtgcgacaaagaggaagaggtgtcacagccgcgtggccctaacgaaaaacgctag

SEQ ID NO: 179510 - DNA, 1773 bp, Artificial Sequence
  Description of Artificial Sequence: Synthetic coding sequence
atgcggccccggcggcccctggtgttcatgagcctggtgtgcgcccttttaaacacctgtcaagcccaccgcgtgcacgacgataagcctaatatcgtgctgatcatggtggacgatttggggatcggggatctgggctgctacggcaatgacaccatgcggactccacatatcgatagactagcgagagagggcgtgcgtttaacacagcacatctcagctgcatctctgtgcagcccttcacgcagcgctttcctgaccggcagatacccaattaggtcaggcatggtgtcatctggaaatcgcagagtgattcagaacttggccgtgcccgcaggactccctctgaatgaaacaacgctggccgccctcctgaagaaacaggggtattctactggacttattggtaaatggcaccaagggctgaattgcgatagccggtctgaccagtgccaccacccctacaattatggctttgactactactacgggatgcctttcaccctggtcgatagttgctggcctgatcccagccgcaacacagaacttgcatttgagagtcaactgtggctctgcgtccagctggtggcgatcgccatactgaccctcaccttcggaaagctgagcgggtgggtgagtgtcccatggctgttgatcttctcaatgatcctatttatttttttactcgggtacgcatggttttcatctcacacctctcctctctattgggactgccttttgatgaggggccacgagatcactgaacaacctatgaaggctgagagggccggaagcataatggtaaaggaagcgatttcattcttagagaggcattccaaagagacctttcttctgtttttctctttcctccacgtccacacaccgctgccgacaaccgatgatttcacgggcacgtcaaagcatggactctacggggataacgtggaggagatggattccatggtgggcaagattcttgatgcaattgatgactttggcttacgcaacaataccctagtgtactttactagcgaccacggcggccacctggaggcaagaaggggccacgcccagctaggagggtggaacggcatctataaaggtggcaagggtatgggggggtgggaaggcgggatccgggtgcccggcattgtgcgttggcctggtaaagtgccagctggacggctgattaaggaacctacctctctgatggatattcttccaacagttgccagcgtgtcaggggggagtctgccccaagatagagtcatagacggtcgggacttaatgcctctcctgcaaggtaacgtgcgtcactcagagcatgagtttctcttccactactgcggctcctacctgcacgcagtgcggtggatccccaaggacgactctggctctgtctggaaggcccactacgtgactcctgtcttccagcctccggcttcaggaggatgctacgtgacctcactgtgtcgttgttttggcgaacaagtgacatatcataaccctccgctgctgttcgacctttcaagagacccctccgaatcaacgcctttaacgccagccacggaaccactgcacgacttcgtgataaaaaaagttgccaatgctctcaaagagcatcaggaaaccattgttccagtcacatatcagctgagtgaactgaatcagggaaggacctggctgaaaccgtgctgtggagtgtttccgttttgcttgtgtgataaggaggaggaggtcagccagccccggggacccaatgagaagaggtag

SEQ ID NO: 179511 - DNA, 1773 bp, Artificial Sequence
  Description of Artificial Sequence: Synthetic coding sequence
atgcggccccggcggcccctggtgttcatgagcctggtgtgcgccttgcttaatacctgtcaggctcaccgggtgcatgatgataaacctaatattgtgctgatcatggtagatgacctgggcataggcgatctgggctgttacgggaatgacactatgaggacccctcatatcgatcgcctggcccgcgagggtgtgaggctaacccagcatatctccgccgcctcattgtgttcacctagtcgcagcgctttcttgaccggaagatacccaatcagatctggcatggtttcaagcggaaacaggcgcgttattcaaaaccttgccgttccagcaggcctgccactcaacgagaccaccctcgccgccctattaaagaaacagggctattcaactgggctgattggtaaatggcatcagggcttgaactgcgattcccgcagcgaccagtgccaccatccatacaactacggtttcgattactattatggcatgccattcaccctggtggattcatgctggcctgatccttccaggaataccgaactggccttcgagagccagttgtggctctgcgtgcaacttgttgctatcgctatcctaacactgacctttgggaaactgagcggatgggtatctgtgccctggctactgatcttctcaatgatcctcttcatctttctgctgggatacgcttggttttcttctcacacaagtcccctttattgggattgcctgcttatgcgaggtcacgaaatcaccgagcagccgatgaaagcagagcgcgcgggcagtatcatggtcaaagaagccattagttttctagaaagacattcgaaagagacgttcctgctcttcttttccttcctccacgtccacacgcccctgccgacaaccgatgactttacaggcaccagtaagcatgggctttacggagataacgttgaggagatggacagcatggtcggaaagatcttggatgcaattgacgacttcggattgcgaaacaatactctggtatacttcacctccgatcacggcggtcacctggaggctagaaggggtcacgcccaactcggcggatggaatggtatctacaagggcggcaaagggatgggaggttgggagggggggatccgcgttcctgggatcgtgagatggcctgggaaggtgccagccggcagactcattaaggaacctacaagtctgatggacatcctgcccaccgtcgccagtgttagtgggggttccctgccacaggatcgtgtcatcgacgggcgtgatctcatgccgctcctacaggggaatgtacggcatagtgagcatgagtttcttttccattattgcgggtcctacttgcatgccgtgaggtggattcccaaagacgattctggctcagtctggaaggctcactacgtgactcccgtttttcagccgcctgcctcaggtggctgttatgtgaccagtctgtgccggtgcttcggtgagcaggttacataccataacccaccactcctgttcgacctttctagggacccaagtgagagtacacccctgaccccagctacagagcccttgcacgacttcgtgatcaagaaggttgccaacgccctgaaggagcaccaggaaactatcgtccctgtcacataccagttgtctgagttgaatcagggccggacatggctcaaaccatgttgcggagtgttcccattttgtttgtgtgataaggaggaggaggtgtcccaacctcgaggacccaacgagaagagatag

SEQ ID NO: 179512 - DNA, 1689 bp, Artificial Sequence
  Description of Artificial Sequence: Synthetic coding sequence
atgacccggaacgcccggcccaacatcgtgctgctgatggccgacgaccttggcgtcggggacctgtgttgctatgggaacaatagcgtgtccacccccaacatagaccgtctcgcgtctgagggggttcggttaacccaacatcttgctgctgcttctatgtgcacacccagccgggctgccttccttacaggcaggtatcctattagatcaggcatggtgagcgcgtataatttgaatcgggcatttacatggcttggcggcagtgggggactgccgaccaacgagacaaccttcgcaaaacttctgcagcatcgggggtatagaaccggactgatcggcaagtggcacctgggcctatcatgtgcctctcgaaacgatcattgctaccatccactgaatcatggcttccactatttctatggagtgccgttcggccttctgagcgattgtcaagccagcaagactccagaactgcatagatggctgcggattaagctgtggattagcacagtggctttggccctggtgcccttcctgctgcttatcccgaagttcgctcgctggtttagcgttccctggaaagtgatcttcgtattcgctctactggcatttctcttttttacatcttggtacagcagctacggcttcactcggagatggaactgtattctcatgcggaaccacgagattatccagcagccaatgaaagaggaaaaagtggccagtctgatgctcaaggaagctctggccttcatcgaacgatataaacgggagcccttccttttattttttagcttcttgcatgtccatacgccgctgatttcaaagaagaagttcgttggccgttcaaaatatgggcgctatggggacaacgtggaagagatggactggatggtggggaagatcctggatgctctggatcaggagcgacttgctaaccatactttggtttacttcacatccgacaacggtgggcacctagaaccactcgacggggcagttcaactgggaggttggaacggaatttacaagggtggaaagggtatgggcgggtgggaagggggtattagagttccgggaattttcagatggcccagtgtgcttgaggccggccgggtaattaacgaaccgacatcattgatggatatatacccaacccttagctacatcggtggcgggatactatcacaggatcgcgtgattgatgggcagaacctgatgcccctgctcgaaggcagagcaagccacagtgatcacgaatttttattccactattgcggggtttacctgcataccgttaggtggcatcaaaaagattgtgccactgtgtggaaagcgcactatgtaactcctaaattttatcctgagggaactggagcttgttatgggtcaggcatctgtagctgttctggcgacgtcacttaccatgaccctcctctgctgttcgacatttctcgcgacccctcagaggcactccccctaaatcctgataatgaacccttgttcgacagtgtcataaagaagatggaggccgctattagagagcaccgacgcacactgacgcccgtcccacagcaattttccgtattcaatactatctggaagccttggttgcaaccctgctgtgggactttccctttctgcgggtgcgacaaggaggatgacatcctgccaatggccccctag

SEQ ID NO: 179513 - DNA, 1710 bp, Artificial Sequence
  Description of Artificial Sequence: Synthetic coding sequence
atgcacaccctgaccggcttcagcctggtgagcctgctgagcttcgggtacctgtcttgggactgggcaaagccatcattcgttgctgatggacctggcgaagcgggcgagcagccaagtgccgcccccccccaaccccctcatatcatctttatattaacggacgaccaaggttaccatgatgtcggataccacggctctgatattgagaccccgaccttagatagattagctgctaagggcgtaaagttggagaattactacattcaaccaatttgcactccttccagatctcaactgcttacagggagatatcagatccatacaggccttcagcattccatcataagacctcaacaacccaattgtctgcccctggaccaagtcacccttccccaaaaactacaggaggccggttacagtacacacatggttgggaagtggcatctgggattttaccgcaaagaatgtctgcccactcggaggggattcgacaccttcctgggaagcctgacaggtaatgtggattactacacctacgacaattgtgatggcccaggtgtttgcggctttgatcttcatgagggcgaaaacgtagcttggggcctgagtggacaatacagtactatgttatacgcacagcgagccagtcatattttagcttctcattcccctcagcgtccactgttcctctacgtagcctttcaggctgtccacacgcccctgcagtcccctcgggaatacctgtaccgctacaggacaatgggtaacgtggcccgccggaagtacgcagccatggtgacctgtatggatgaagcagtccggaacatcacatgggcactcaagaggtatgggttttataataactctgttatcatcttctctagtgataacggcggtcagactttttctggaggatccaactggccactccgtggacggaagggaacatattgggagggaggcgtaagagggctcggtttcgttcatagccctctactaaaacggaagcagcgaacttcacgtgccctcatgcatatcaccgactggtatcccacccttgtggggcttgcagggggtaccacaagtgccgccgacgggctggatgggtatgacgtctggccggccatctccgagggaagagctagtcctagaacggagattttgcataatatagaccccctgtataaccatgcacagcacggctccctggagggaggcttcggcatctggaacactgccgtgcaagcagccatcagggtgggcgaatggaagctcttgaccggcgatccagggtacggcgattggattcccccccagacccttgcaaccttcccaggaagttggtggaacttggagaggatggcctctgtgcggcaggctgtttggctattcaacattagcgcagatccttacgaacgggaggacctggccggacagcgtcctgacgtagtccggacattgctggccaggttagctgagtataaccgcacagccatcccagtgcgctaccctgctgagaacccgagagcccaccctgatttcaacgggggggcgtggggtccctgggcctccgacgaggaggaagaggaagaagagggtcgcgcgcgttcattttcacgaggaagacgcaagaagaagtgcaagatttgtaaactcaggtcctttttccggaagcttaacacgcgcctcatgtcacagagaatatag

SEQ ID NO: 179514 - DNA, 261 bp, Artificial Sequence
  Description of Artificial Sequence: Synthetic coding sequence
atggtgggcaagtggcacctgggcttctaccggaaggagtgcctgcccacacgcagaggcttcgacacctttcttggatcccttacaggaaacgtggattactatacctatgataattgcgacgggcccggggtgtgcgggtttgacctacacgaaggagaaaatgtggcatgggggctgtctgggcaatactccaccatgctctatgctcaaagggcttcgcatattctggcttctcattccccacagcggccactatag

SEQ ID NO: 179515 - DNA, 1281 bp, Artificial Sequence
  Description of Artificial Sequence: Synthetic coding sequence
atggtgggcaagtggcacctgggcttctaccggaaggagtgcctgccgacacgaagaggattcgacacctttctggggtctctaactggcaacgtggactactatacctatgataactgcgatggacctggtgtgtgtgggttcgatttacacgaaggtgagaatgtagcctggggcctcagcggccagtacagcacaatgttgtacgctcagcgagccagccacatcctggcttcccatagcccacagcggcccctctttctgtatgtcgccttccaagcagtgcatactccactgcaatccccgcgcgaatatttatatcgctacaggactatggggaacgtggcaagaagaaagtacgcggccatggtgacatgcatggacgaggccgtgagaaacattacttgggctctcaaaagatacgggttctacaacaattcagttatcattttcagttctgacaatggagggcaaaccttttctggagggagcaattggccgctgcgtgggcgaaaagggacctactgggaggggggcgtgcgcggcttggggttcgttcattcccccttactgaagcggaagcagagaacaagccgggcactgatgcacattaccgattggtatcctactctggtaggattggccggcggcactactagtgccgcagacgggctcgatggctatgacgtatggcccgccatttccgagggccgggcctctcctcggaccgaaatccttcacaatattgaccccctctataaccacgcacagcacggatccctggaaggtggctttggcatatggaatactgcggttcaggccgcaatccgtgtgggtgaatggaagctgctgacaggcgaccccgggtatggggactggattccaccacagacactggccaccttccctggatcttggtggaacctggaacgaatggcctcggtgcggcaggctgtgtggctcttcaacatatcggccgacccttatgagcgcgaggatctggccgggcagcgtcccgatgtggtgcgaaccttgttggcccgactcgcggaatataatcggaccgctatcccggtccgataccccgcagaaaacccgagggctcaccccgatttcaacgggggcgcctggggtccctgggccagtgacgaggaagaggaagaggaagaaggacgggcccgatcattctctagggggagacgtaaaaagaagtgcaaaatttgtaaactccgtagcttcttccgcaagctgaacacccgcctaatgagtcagagaatctag

SEQ ID NO: 179516 - DNA, 1800 bp, Artificial Sequence
  Description of Artificial Sequence: Synthetic coding sequence
atggccccccggggctgcgccggccacccccccccccccagcccccaggcctgcgtctgcccagggaagatgttggcaatgggagccctcgccggtttttggatcctctgcctgctgacttacgggtatcttagctggggccaggccttggaagaagaagaagaaggtgcacttttggctcaggccggtgaaaagctggagccgagcacgactagcacgtcacagccgcacctgatttttattttagccgacgatcaggggttccgggacgtgggataccatggctcagagattaagacccctacactcgacaagctggccgcagaaggggtcaaactggagaactattatgtccagccgatctgtactccctcccggtcccaatttattaccggcaagtatcagatccacacggggttgcagcatagcatcatccggcccacccagcctaactgtctgccactcgacaatgccaccctgccgcagaaactgaaagaggtcggctatagcacacatatggtgggaaaatggcatctcggtttctataggaaggaatgtatgcccactagaaggggctttgacacattttttggctctctactggggagcggtgactactacacacactataagtgcgattccccaggcatgtgcggctatgatctgtatgagaatgacaatgccgcatgggattatgacaacgggatttacagcacacaaatgtatacgcagcgagtccaacagatcctggcctctcataatccaactaagccaatcttcctgtacatcgcctatcaggccgtgcatagccccctgcaggctccagggagatacttcgagcactatcgctccataattaatatcaatcgtagaaggtatgctgctatgctctcttgcctggacgaggccatcaacaacgttacgttagctctgaaaacttacggcttctacaacaatagcatcattatatactcctctgataatggtggtcagcctacggcaggcggatccaactggcccctccggggctcaaagggcacttactgggagggaggtattcgcgctgtgggcttcgtgcattcccccctgctgaagaacaagggaactgtgtgcaaagagctggtacatatcacagattggtaccccacgttaatttccctcgcggagggacaaatcgacgaggacattcagctggacggctacgacatctgggagacaatctccgagggcctgaggagcccccgcgtggacatcctccacaacattgacccgatctataccaaggcaaaaaatggcagctgggctgcgggctatgggatttggaataccgctatccagagcgcgataagggttcaacattggaagttgctgaccgggaaccctggctattccgactgggtcccccctcagtccttctccaaccttggccctaatcgctggcataatgaaagaattacactgtccactggaaagagcgtgtggctgttcaatatcacagccgatccctatgagcgggtcgatctctctaaccggtatccaggtatcgttaagaaacttctcagacgattgtcccagttcaacaaaaccgccgttcccgttcgctacccccccaaggatccacgctctaaccctagactgaatggcggtgtctgggggccatggtacaaggaggagaccaagaagaaaaagccctctaaaaatcaggcagagaagaagcaaaaaaagtccaaaaaaaaaaagaaaaagcagcagaaggcagtttccggctctacctgtcactctggagtgacctgtggctag

SEQ ID NO: 179517 - DNA, 1791 bp, Artificial Sequence
  Description of Artificial Sequence: Synthetic coding sequence
atggccccccggggctgcgccggccacccccccccccccagcccccaggcttgtgtgtgccctggcaaaatgcttgccatgggcgctctcgccggtttctggatcctctgcctactgacgtacggctatttatcatggggtcaagctttggaggaggaagaggaaggggctctactggcccaggccggggagaagttggaacctagcactaccagtacttcgcaacctcatctgatctttatactggccgacgaccagggtttccgagacgtgggatatcacggctccgagataaagaccccaaccttggacaagctcgcagcagaaggtgtaaagctcgagaattactatgtccaacctatttgtaccccttcccgcagtcaatttataacgggaaagtaccagattcacactggtctgcaacactccattataagacccacacagcccaattgtctaccactcgacaatgccacgctgcctcagaaactgaaagaggtgggatactcaacccatatggtagggaaatggcatctgggattctacaggaaagagtgcatgcctacgagacgcggattcgataccttttttggatccctcctcgggagcggggactattacacacactataaatgtgattcccccggaatgtgtgggtacgatttatatgagaatgataacgcagcgtgggactacgataacggaatctactctactcaaatgtatacacagcgggtgcaacaaatcttggcctcacacaaccccaccaagccaatctttctgtacatcgcttaccaggcagtgcactcaccactgcaagcacctggacgatattttgaacactaccgcagcataataaacatcaacagacggagatacgctgccatgttgagctgtctggatgaagctattaacaacgtgaccctagccttgaagacgtatggcttctataacaattcaatcattatctattcatcagacaatggtgggcagcccaccgccggcggcagtaactggcccctgcgggggagtaaaggcacttattgggaaggcgggattagagccgtggggttcgtgcattctcccctactgaagaacaaagggacggtctgcaaggagcttgtacacatcacagactggtaccctacccttatctcgctggcagagggccagattgacgaagacatacagctggatggatatgatatctgggagactatttctgagggcctgaggagccccagggtagatatcctgcacaatatagatcccatttacacaaaagcaaagaatgggtcttgggctgccgggtacgggatctggaacaccgctatccagtctgctataagagtgcaacattggaagctgctaaccggaaatcccggttatagtgattgggtcccgccacaatcttttagcaacctcggaccaaatcggtggcacaacgagagaataactttgtctaccggcaagtcagtgtggctgtttaacataaccgccgatccttacgaaagggttgatctaagtaatcgttaccccggcatagtcaagaagctgctgagaagactgtctcagttcaacaagacagcagttccggtgagatatccccccaaggacccccgatcaaaccctcgtctcaacggcggcgtttggggcccctggtacaaagaagaaacaaaaaagaagaagccatctaagaatcaagcagaaaaaaagcaaaagaaatccaagaagaagaaaaaaaagcagcagaaggccgtgtctggtaagcccgccaacttagcccggtag

SEQ ID NO: 179518 - DNA, 507 bp, Artificial Sequence
  Description of Artificial Sequence: Synthetic coding sequence
atggcccccggccagcaggccatgggcagcggcaccctgcagagctctcagccctctgagtgctcaacgggtttgttaacgggtaacccaggatactccgactgggtgcccccacaatctttcagcaatttgggcccaaaccgatggcataatgaacgtatcacgctgtcaactggaaaatctgtatggctctttaatataaccgctgatccttacgagcgcgtggatctatcaaaccggtatccaggaattgttaagaagctgctgcgacgtctcagtcagtttaacaaaacagctgttcctgtgcgctacccacccaaggatccccgcagcaatccacggctgaacggtggggtgtggggaccctggtacaaagaggagaccaagaagaagaaaccatccaaaaaccaagctgagaaaaaacaaaaaaagtccaaaaagaagaaaaaaaagcagcaaaaagcggtgtctggcagcacatgtcactctggagtgacttgcggttag

SEQ ID NO: 179519 - DNA, 1611 bp, Artificial Sequence
  Description of Artificial Sequence: Synthetic coding sequence
atgctgctgctgtgggtgagcgtggtggccgccctggccctggccgtgctcgcacctggagccggtgaacaacgtagaagagcagctaaggcgcctaacgtagtgttggtcgtgtccgacagttttgatggcaggctgaccttccacccaggcagccaggtggtgaagctgccatttataaactttatgaagacccgtggaacttcatttctcaacgcctacactaactcaccgatctgttgcccgagccgagctgcaatgtggtcgggtctgtttactcatttaacagagagctggaataacttcaaggggcttgaccccaattacactacatggatggacgttatggaacgccatggttaccgcacccagaaatttgggaaactagactacacttcgggccaccattcaattagcaatcgagttgaggcctggacccgcgatgtggcgtttctgctgaggcaggagggtcggcccatggtgaacctgatacggaatcggacaaaagtccgggtgatggaacgagattggcaaaacacagacaaagctgtgaattggctccgcaaggaggcaatcaattataccgagccattcgtgatttatctgggactcaatctacctcacccgtatccttcaccttcttcaggcgaaaactttggctcctccactttccacacatccctgtactggttagaaaaggtgagccacgacgcgattaagatccctaagtggtctcccctgagtgaaatgcaccctgtcgattattatagctcctacaccaaaaattgtaccggcagatttacgaaaaaagagatcaaaaacattcgggccttttattatgcaatgtgcgccgagaccgacgccatgcttggagagattatactcgccctgcaccagttggatctcctgcagaagaccattgtgatctacagttctgaccacggcgaactggccatggagcataggcagttttataaaatgtcgatgtacgaggcttctgctcatgtcccactcctgatgatgggacctggcataaaggctggactccaggtgagcaacgtcgtgtccctggtggatatctatcctaccatgctggatatagcaggaattccactcccgcagaatctgtctgggtactctctcctgcccctctcttctgaaactttcaaaaacgaacacaaggtgaagaacctgcatcccccgtggatattgtctgagtttcatggttgtaacgtgaacgcctccacctacatgctgcgcactaaccactggaagtacatcgcatattccgacggtgcctcaatcttgccacagctgtttgacctgagcagtgacccagatgagctcacaaatgtggccgtgaagtttccagaaatcacatacagcctggaccagaaactccactccataattaattatcccaaagtgtccgcctctgtccaccagtacaataaggaacaatttatcaaatggaagcagtccatcggccaaaactacagcaacgtgattgcaaatttacggtggcatcaggattggcagaaggagccaagaaagtacgaaaatgcgatagatcagtggctcaaaactcacatgaatcccagggccgtttag

SEQ ID NO: 179520 - DNA, 561 bp, Artificial Sequence
  Description of Artificial Sequence: Synthetic coding sequence
atgctgctgctgtgggtgagcgtggtggccgccctggccctggccgttctggctcccggggccggggaacagagacgacgggccgccaaagcgccaaatgtagtccttgtggtctcggattccttcgacggcaggcttaccttccaccccggctcccaagtggtgaaactccccttcatcaacttcatgaaaactcgagggacatcattcttgaacgcatatactaatagcccgatctgctgtcccagccgcgcagcaatgtggagcggactttttacacatctcacagaaagctggaacaactttaaaggattggatcccaattacacaacttggatggacgtcatggagcgacatggttataggacccagaaatttgggaagctggactataccagcggacaccactctatttccaatagagtggaggcttggacccgagatgtcgccttcttgctgcgacaggaggggcgaccgatggtgaatctcatccgtaaccggacaaaggtgagggtgatggagcgtgattggcaaaatacggacaaggctgttacaggctag

SEQ ID NO: 179521 - DNA, 1275 bp, Artificial Sequence
  Description of Artificial Sequence: Synthetic coding sequence
atgtggggctgctgcgtgtgcggcgccctgttcgagggccagcggctgagactgttgcgggcccccggagatggactatccagccccttcaccgtggtctctaggaaatggcacctaggacatcacggtagctatcaccctaatttcagagggtttgattattatttcggcataccttactcccatgacatggggtgcaccgataccccagggtacaaccatcccccatgtcctgcatgtcctcagggggatggaccctccagaaatctgcaaagagactgttatacagacgttgctctccccctgtacgagaacctcaatattgtagagcagccagtcaatttgagcagcttagctcagaagtacgcggagaaggctacacagtttattcaaagggcaagtactagcggtcggcctttcctcctatacgtagccctcgcccacatgcacgtgcccttaccagtcacccagctccccgcggctccgaggggccgaagcctatacggggctgggctgtgggagatggacagcctggtcggacagataaaagataaagtggaccacacagtgaaggagaacactttcctttggttcaccggagataatggcccatgggcgcagaaatgcgaattggctggatcagttggccctttcaccggcttttggcagactagacagggcggctccccggccaagcaaacgacttgggaaggcggacaccgtgtacctgctctggcgtactggcccgggagggtaccagttaacgtgacatctactgccctactgtccgtcctagacatcttccctacagtagtggcgctggcgcaggcaagtctgcctcagggcagaagatttgatggcgtggacgttagtgaagtcttattcgggcgaagccagcccggtcaccgtgtgctgtttcatcccaatagtggcgccgctggggagttcggagccttacaaacggtgagactagagcgctataaagcattttatatcacgggaggtgcaagggcctgcgatggttccacaggtccagagcttcagcacaagtttccactgatatttaatctggaagacgacaccgccgaggcagtgccccttgagaggggaggcgcagaataccaggctgttctgccggaggttcgtaaggtacttgccgatgttttgcaggacattgccaacgataacatttcctcggcggactacacgcaggatcctagtgttaccccctgctgtaacccctaccaaatagcttgtagatgtcaggccgcgtag

SEQ ID NO: 179522 - DNA, 1578 bp, Artificial Sequence
  Description of Artificial Sequence: Synthetic coding sequence
atgggctggctgttcctgaaggtgctgctggccggcgtgagcttcagcggctttctttaccccttagtggacttctgcatttccggaaaaacgaggggccaaaaaccaaattttgtgataatactcgcagacgacatgggatggggcgatctgggagcaaactgggccgagacaaaggacaccgccaaccttgacaagatggcctccgaggggatgaggttcgtagatttccatgccgctgcaagtacctgttccccatccagggcaagcctgctcacgggcagattaggcctccgcaatggagtgacccgcaactttgccgtcacctcagtggggggattgcccttgaatgagaccacccttgcagaggtgttacagcaggctggttacgtgacaggcataatagggaaatggcatctgggacaccacggatcttatcatcccaatttcagagggttcgattactacttcggtattccttactcccatgacatgggctgtacggacactccaggatataaccacccgccttgcccagcttgtccacaaggcgatggccccagtagaaatcttcagagagactgctacaccgatgtagccctccctctatacgagaacctcaacatcgtggaacagcccgtgaacttgtcaagcctagctcagaaatacgccgagaaagctacacaattcattcaaagggcaagcacatcaggtcgtccctttctgctgtatgtcgccttggcccacatgcacgttcctctgcctgtcactcagctgcccgccgcccctcggggccgctccctctacggggcaggtttgtgggaaatggactccttggtgggccaaattaaagataaagtggaccatacagtcaaagagaataccttcctgtggttcacaggcgacaacggaccatgggcacaaaagtgcgagttggctggctctgtgggtcccttcacgggattttggcagacaagacagggcgggtccccagccaagcaaaccacctgggaagggggccaccgcgtgccggcgctcgcctactggcccggaagggtgccggtgaacgtcaccagtacagcactactgagtgtgctggacattttcccgacggtggttgccctggcacaggcctccctgccacaaggccgaaggttcgacggcgtggacgtaagtgaggttctgttcggcaggtcacagcctggtcatagggtcctcttccatccaaactccggggctgctggagaattcggggccctgcagaccgtgcgcctggagcggtacaaagcgttttatatcactgggggcgcacgtgcctgcgacgggtccacagggcctgagcttcagcacaagtttcctttgatttttaatttagaagatgatactgccgaggccgtccccctggagagaggaggcgccgaataccaggcagtactgcccgaggtgcgaaaagtgcttgctgatgtgctgcaggatatagcgaatgataacatctcttcagccgattacacccaagacccatctgtgaccccatgctgcaatccctaccagatagcgtgccgctgccaggcagcatag

SEQ ID NO: 179523 - DNA, 747 bp, Artificial Sequence
  Description of Artificial Sequence: Synthetic coding sequence
atgaccaagaccagcacctgcatctaccacttcctggtgctgagctggtatacttttctgaactattatatatctcaggaggggaaagacgaagtgaaacccaagatcctcgctaatggagcccgctggaaatatatgacgctcctcaatcttttgaaaaaccggacagccggatttgatatctaccagcccgggtctttcagacagctgctgcagacgattttttatggggtcacatgtcttgacgacgtgttaaaacgaactaaagggggaaaagatataaagtttctgactgcgtttagggacctgctctttactacactggcattccccgtgtcgactttcgtgtttttggcattctggatcctgttcctgtacaatagagacctcatctaccccaaggtactggacactgtgattccagtttggctcaaccacgccatgcataccttcatctttccaatcactctggctgaagtggttctccgccctcattcatatccaagcaaaaagacagggttaacattgctcgccgccgcctccatagcctacatatctcgcatcttatggctctacttcgagactggtacatgggtctacccagtcttcgccaaactttccctgctcggtctcgctgctttctttagtctatcatatgtgttcattgcctcaatctacctgctcggggaaaaacttaaccattggaagtggggcgacatgcggcaacctcgcaaaaagcgcaaatag

SEQ ID NO: 179524 - DNA, 609 bp, Artificial Sequence
  Description of Artificial Sequence: Synthetic coding sequence
atggccaaggtgagcgtgctgaacgtggccgtgctggagaacccctccccatttcacagtccatttagattcgagatttccttcgaatgcagtgaggctctggccgatgacctggagtggaagataatctatgtgggatccgccgagagtgaagagttcgatcagatcctcgactcagttctggtgggcccggtacctgccgggcgtcacatgtttgtttttcaagcagatgcaccgaacccttctctgattccagagacggacgcagtgggtgtcacagtggtgctcattacttgtacctaccacggtcaggaatttattcgtgtgggttactacgtcaacaatgagtacctgaatcccgaactgcgagaaaacccacccatgaagccagactttagccagctccagaggaacatcctggcctcaaatccgcgcgtgacccgattccatatcaattgggacaataacatggaccgcctcgaagccatagagacgcaagatccctcactcgggtgtggactccctctcaactgcacccctataaagggcctagggctgcccgggtgtatcccgggactcctgccagagaattccatggactgtatctag

SEQ ID NO: 179525 - DNA, 1506 bp, Artificial Sequence
  Description of Artificial Sequence: Synthetic coding sequence
atggacacccaggccggcagcgtggacgaggagaacggccggcagctcggggaagtggagttgcagtgcggcatctgcactaaatggtttacggctgatactttcggaatagatacctccagctgtttgcccttcatgactaattactcctttcactgcaatgtgtgccatcactctgggaatacgtacttcctcaggaaacaggccaatctgaaggagatgtgcctgagcgctctggcgaatctgacttggcagtctcggacgcaggacgaacacccgaagaccatgttttccaaggataaggacattattcccttcattgacaaatattgggaatgtatgaccactcgccagcggcctggcaagatgacatggcccaacaacatcgtgaaaaccatgagcaaagaaagggacgtgttcctggtgaaagaacaccctgaccctggctctaaggaccccgaagaggattatcccaaattcggacttctggaccaggatctctcgaatattgggcccgcctacgataaccagaagcagagcagcgcagtgagcacttccggcaacctgaatggcggcatcgccgcgggcagctccggaaaaggacggggcgccaagaggaagcaacaggacggcggcacgactgggacaaccaaaaaggcccgctcggaccccttgttctctgcgcagcgcctcccccctcacggctacccgttagaacaccccttcaacaaagatggatatcgttacatactggcagagccagacccccacgcccctgatccggagaagctggaactggactgctgggctggaaagcctatccccggcgatttgtaccgtgcgtgcctttacgaacgggtgctgctggcactgcacgatcgtgctccccagctaaagatttccgacgatcgcctcaccgtggtcggggaaaagggttattctatggtcagggccagccatggtgttaggaagggcgcatggtacttcgagatcacagtcgatgaaatgccccccgacaccgcagcgcgtctaggctggagccaaccattaggaaacttgcaagcgccacttggctatgataagtttagctacagttggcgcagcaagaaagggacaaaattccaccagtccatcggcaaacattattcgtcaggttacggccagggggatgttctggggttctacattaacctacctgaggacacagaaacagccaagtcactgcccgacacctacaaggataaggccctgattaagtttaagtcatacctatactttgaagagaaggattttgtcgataaggctgaaaagagcctgaagcaaaccccgcactctgaggtctctattaacttcggcccctgtttcaaatacccaccgaaggatctcacttaccgtcccatgtccgacatgggctggggcgcagtggtggagcacacccttgccgacgtactctaccatgtggaaaccgaggtcgatggaagaaggtcccctccctgggagccatag

SEQ ID NO: 179526 - DNA, 1887 bp, Artificial Sequence
  Description of Artificial Sequence: Synthetic coding sequence
atggccgccgccggcgccggccccggccaggaggccggcgccggcccaggccccggcgccgtagccaacgccacaggcgcagaagagggagagatgaaacctgttgccgccggagccgccgctcccccaggggaagggatctccgcggcgcctacagtggaaccctctagcggcgaagctgagggtggagaagccaacttggtggatgtaagcggggggttggagaccgaatcctccaacggcaaagacacactggaaggcgcaggggatacatccgaagttatggatacgcaggctggctcagtggacgaggaaaatggaagacagttgggggaggttgaactacagtgtggaatttgcaccaagtggttcaccgctgacacattcggcattgacacaagttcgtgcttgccatttatgactaattatagttttcattgcaacgtgtgccaccatagcggaaatacctactttctccgtaagcaggcgaatttgaaggagatgtgtctcagcgctttagctaatctcacttggcagtcccggactcaggatgagcacccaaaaactatgttctccaaggataaggacatcattcctttcattgataaatactgggagtgcatgaccacccgccagaggccggggaagatgacttggcccaacaacatcgtcaagactatgtctaaggagcgtgacgtgttcctggtcaaggaacatcccgaccccggctccaaagacccagaagaggattatcccaaattcggtctgcttgatcaggacttaagtaacattggccctgcctatgataatcagaagcagagcagcgccgtgtccacgtccgggaatttgaatggcggcattgcagcaggctctagtggtaaaggccggggcgccaagagaaagcaacaggacggaggcacgactggaacaactaaaaaggcccgttccgacccattgttctcggctcagaggctaccaccccatggctacccgctcgagcacccatttaacaaggacggctaccgatatatcctggcggaacctgatccgcatgcacccgacccggagaaactggagctggattgctgggcaggaaaacctatccccggagacctatatcgagcttgtctgtacgaacgggtcctgctcgccctgcacgatcgagccccgcagttaaagatcagcgatgatagacttactgtcgtgggcgaaaaggggtattccatggttcgcgcatcccatggggtgcgtaagggagcatggtatttcgagatcaccgttgacgaaatgcctcctgataccgcagctcggctgggatggtcacagcctcttggaaacctgcaggcccccttgggatacgacaaattttcatattcatggaggtcaaagaaagggactaagttccatcagagcattggaaaacattactctagcgggtacggtcaaggcgacgtactgggcttctatatcaatctgccagaggataccgaaaccgctaaatcgctgcccgacacttataaggacaaggccttgattaagttcaagagttacttatactttgaggaaaaagacttcgtggataaagcagagaaatccctgaagcagactccgcattctgagatcatattctacaaaaatggcgtgaaccagggcgtcgcttataaagacatctttgagggagtgtattttccagcaatttccctgtataagagctgcaccgttagcataaatttcggcccctgtttcaagtatccaccaaaggatctgacctacaggccaatgtcagatatggggtggggcgcagtggtcgagcacactctggccgatgtgctgtaccacgtagagactgaggtagacgggcgtaggagtcccccttgggagccatag

SEQ ID NO: 179527 - DNA, 1605 bp, Artificial Sequence
  Description of Artificial Sequence: Synthetic coding sequence
atggacacccaggccggcagcgtggacgaggagaacggccggcagctaggagaggtcgagctccagtgtggaatctgtaccaaatggttcaccgccgatacctttgggatagataccagttcctgtcttccatttatgactaattactcctttcattgtaatgtctgccatcattctggcaacacctactttcttcggaagcaggcaaacctaaaggagatgtgcctctccgcattggcgaacctgacatggcagtcacgaactcaagatgaacatcctaaaactatgttctccaaggacaaagatatcatcccatttatcgacaagtactgggagtgtatgacaactcgccaaagacctggtaagatgacttggccaaacaacatcgtgaaaaccatgtcgaaggagcgggacgttttcttggtcaaggagcatccagatcctgggtccaaggatcccgaagaggactatcctaagttcggcctgcttgatcaggacctgtccaacatcggccccgcctacgataaccagaagcagtcaagtgctgtcagtaccagcggtaacctgaacggaggcatcgctgcaggcagctccggtaaaggacgcggggccaaacgaaaacaacaggatggcggcaccacaggaaccaccaagaaagcccgatcggaccccttgtttagcgcacaaagactcccccctcacggttatcccttggagcacccatttaataaggatggctatcggtatatcctggccgagcccgatccgcacgctccagatcctgagaagttggagttggattgttgggctggcaagcccatccccggcgatctctaccgggcatgcctgtacgagagagtgcttctggctctgcatgatcgcgccccgcagttgaaaatatcggatgaccgactgactgttgtaggggaaaaggggtattctatggttcgagcctctcatggagtccgaaagggggcttggtactttgaaatcactgtggacgagatgcctccagatacagccgccaggctgggctggtcgcagccattgggcaatttgcaagcccctcttgggtatgacaaattttcatactcttggcgctctaaaaaaggcaccaaatttcaccagtccatcggaaaacactattcttcaggatacggccagggggatgttctcgggttctacatcaacctgcctgaagatactgagacagccaagtctctgccagatacttataaggacaaggcgttgatcaaatttaagagttacctgtactttgaagagaaggactttgtggataaagcggagaaatctctcaaacagacaccacacagtgaaatcatcttctataaaaatggcgtgaaccagggtgtggcctacaaggacatctttgagggagtgtactttcccgctatctctctgtacaagtcatgcaccgtctcaattaattttgggccatgtttcaaatatccacctaaggatcttacatatagacccatgtccgatatgggatggggggctgtggtggagcatacactcgccgatgtcttgtatcacgttgaaacggaggttgacggtcgccgctccccaccttgggagccatag

SEQ ID NO: 179528 - DNA, 1506 bp, Artificial Sequence
  Description of Artificial Sequence: Synthetic coding sequence
atggacacccaggccggcagcgtggacgaggagaacggccggcagttgggcgaggtggagctccagtgcggcatatgcaccaaatggtttactgctgacacattcgggattgacactagttcttgcctgccgttcatgacaaattattcatttcattgcaacgtgtgccaccactcaggtaatacctattttcttcggaagcaggccaatctcaaggagatgtgtctcagtgccctggccaaccttacatggcagtcacgcacccaagatgagcaccccaagaccatgttttctaaggacaaggacatcatccccttcattgacaaatactgggagtgcatgaccacgcgccagaggccgggtaaaatgacttggccgaacaacattgtaaaaaccatgtcaaaggaaagagatgtcttcctcgtgaaggaacatcctgatccaggatcaaaggatcccgaggaggactaccccaagtttggtctgctcgatcaggatctaagcaatattggtcccgcttatgacaatcaaaagcagtcttctgctgtaagcacctccggcaacctcaacggaggcatcgccgcaggttcctctggcaagggtcggggcgctaagcggaagcagcaggatggaggaacaacgggaaccacaaagaaggctaggagcgaccccctgttttccgcccaaagactcccccctcacggttatcctctggagcatccttttaataaggacggctatcgttacattctcgcagagccggaccctcacgcacccgatccagagaagctcgaactggattgctgggctggcaagccaatacctggcgacctctatcgggcttgtctttacgagagggtgctgctggccctgcacgaccgcgcgcctcaattaaagatttcagatgatcggttgaccgtcgttggcgaaaaaggttatagtatggtcagagcgtctcatggagttaggaagggtgcttggtatttcgaaatcactgtggacgagatgcctccggataccgcagcgaggttgggctggagtcagcccctaggcaaccttcaagcacccctggggtatgataagttctcttactcctggagaagcaagaaggggacaaaatttcatcagtctataggtaagcactattcttctggctacggccagggtgatgtgttaggcttttacattaatctgccggaggacacagaaaccgccaagtcactgcctgatacctataaggataaagctttgattaaatttaaaagctatctgtactttgaagaaaaagactttgtggacaaggccgagaagtctctcaaacagacgccgcacagcgaggtttcaataaatttcggcccctgtttcaagtacccccctaaggaccttacttaccggcctatgtcagacatgggctggggggcagtggtcgaacacacgctggccgatgttctgtaccacgtggagactgaagtcgatggccgaaggtccccgccatgggagccatag

SEQ ID NO: 179529 - DNA, 1470 bp, Artificial Sequence
  Description of Artificial Sequence: Synthetic coding sequence
atgaccaactacagcttccactgcaacgtgtgccaccacagcggcaacacgtatttcttgcgcaagcaggcgaacctgaaagaaatgtgcttatccgctttagcaaacctgacatggcaaagcagaacacaagacgaacaccctaaaacgatgttttccaaagacaaagatataatcccattcattgacaaatattgggagtgcatgaccactcgtcaacgacccggtaagatgacctggccaaacaacatagtcaagaccatgtccaaagagagggacgtcttcctagttaaagagcaccctgacccagggagtaaggatcccgaggaggactaccctaagtttggtctgttggaccaagatctgagtaatattggcccagcatacgacaaccaaaagcagtcttcagcggtttcaacctctggtaacctgaacgggggcatcgcagccgggagtagcggaaaagggcgcggggctaagcgtaaacagcaggacgggggtacaactggcacaacaaaaaaggcaagatccgaccccctgtttagcgcacagaggttgcctcctcatgggtaccccctggagcacccctttaacaaagacggctatagatatattctggcagaaccagatccccatgcgcccgacccagagaagctggaactagattgctgggcgggtaaacccatccccggggatttgtaccgggcctgcctatacgaacgtgtgctcctggcccttcacgacagagcgccccagctgaaaatctcggatgaccgcttaaccgtggtcggcgagaaggggtacagcatggttcgcgcctcacatggagtgcgcaaaggtgcgtggtactttgaaatcaccgtcgatgaaatgcctcccgacacggccgcacggctgggctggtcccagcctctcggtaacttacaagctcctctcggttacgacaagttttcttactcctggcgcagcaagaaaggcaccaaatttcaccaatccattggaaagcattactcatcaggctacggacagggcgatgtcttgggcttctatataaacttaccagaggacaccgagactgctaagagccttcccgatacctacaaggacaaagccctgatcaagttcaagtcgtatctgtatttcgaagaaaaggactttgtggataaagccgaaaaatctctgaaacagacaccccatagtgagatcatcttttacaagaacggtgttaaccaaggtgtggcatataaagatatctttgagggagtctactttccagctattagtctgtacaagagttgtactgttagtattaatttcggcccatgcttcaagtatcctccaaaggatctgacataccggccgatgtccgatatgggatggggcgcggtggtagagcacaccctggccgatgtactttatcacgtggagactgaggtggacggacgtaggagccccccatgggagccttag

SEQ ID NO: 179530 - DNA, 876 bp, Artificial Sequence
  Description of Artificial Sequence: Synthetic coding sequence
atgaccaaggagtaccaggacctgcagcacctggacaacgaggagtccgatcaccatcagttgagaaaaggacccccaccaccccagccactcctgcagagactgtgctccgggcccagactgctgctgctctccctaggcctgagcctgctcctgctcgtggtggtctgcgtgataggatcccaaaacagccagttacaggaggaacttaggggcttgcgggaaacttttagcaactttactgcaagcactgaggcccaggtgaagggattatctacccagggggggaatgttggccgaaagatgaagagtttggagtcgcagttagagaagcagcagaaagacctcagtgaggatcactccagtctgctcttacatgtcaaacaatttgtcagcgacctgaggtctctgagctgccagatggctgcacttcaaggcaatggctctgaaaggacatgctgccctgtgaactgggtggagcatgaacggtcatgctattggttctcacgtagtggaaaagcttgggcagatgctgataactactgtcgcctggaggatgctcacctggtcgtggttaccagctgggaagagcagaagtttgtgcagcaccacatcgggcccgtgaacacctggatggggctgcacgatcagaatggaccttggaaatgggttgatgggacagactacgagactgggtttaaaaattggagacccgaacagccagacgactggtacggacacggattgggcgggggcgaggattgtgcccatttcactgatgacgggcgttggaacgacgatgtgtgtcagcgcccatatagatgggtgtgtgagaccgagcttgataaagcttcccaggagcctcccctgttatag

SEQ ID NO: 179531 - DNA, 759 bp, Artificial Sequence
  Description of Artificial Sequence: Synthetic coding sequence
atgaccaaggagtaccaggacctgcagcacctggacaacgaggagtcggaccatcatcaactgagaaaagacagccagctccaggaggaattgcgggggttacgagagacatttagtaactttaccgcctctacggaggcccaggtaaagggactgagtactcagggggggaacgttgggcggaagatgaaaagtctggagtctcagctggaaaaacagcagaaagatctgtccgaagaccactcctctctgctgttgcacgtgaaacagtttgtgagcgatttgcgatccttgtcctgccagatggccgcccttcagggcaatggatccgaaagaacatgctgtcccgtcaattgggtggagcacgaaagaagctgttattggtttagtagatcaggcaaggcctgggccgacgccgataactactgccgactggaggacgcccaccttgtggtggtgacctcatgggaggaacagaagttcgtccagcaccacattggcccagttaatacgtggatggggctgcacgatcagaacggcccttggaagtgggtcgacggcacggactacgaaacaggattcaaaaattggcggcctgagcaacccgatgattggtatgggcacgggttgggagggggggaagattgcgcccacttcacagacgatgggcgatggaatgacgatgtgtgtcaaaggccatacaggtgggtgtgcgagaccgagttggataaagcgagtcaggagccgcccctgctgtag

SEQ ID NO: 179532 - DNA, 759 bp, Artificial Sequence
  Description of Artificial Sequence: Synthetic coding sequence
atgaccaaggagtaccaggacctgcagcacctggacaacgaggagtccgatcatcaccagctgcggaaggatagtcagctccaagaagagctgagaggcctcagagagactttttccaactttaccgcctctacagaggcacaggtgaagggactctccacccagggcggtaacgtgggacgcaagatgaagtccttggaatctcagctggaaaagcagcagaaggatctatccgaggatcacagttcactgctgttacacgttaagcagttcgtaagcgacctgcggtccctctcatgccagatggcggcgctacagggcaacggcagcgagcgaacctgctgtcccgttaattgggtcgagcatgaacgaagctgttattggttcagccggtctggcaaggcttgggccgacgcagataactactgcagacttgaagacgcccacctggttgtcgttacatcctgggaagagcagaagtttgtgcagcatcacattggacctgttaacacttggatgggtctccacgaccagaatgggccctggaagtgggtcgacggcaccgactacgaaacggggttcaagaattggagacccgaacagcctgacgactggtacgggcacgggctaggaggaggcgaggactgtgctcacttcacggatgacggcagatggaacgacgatgtgtgccaaaggccctatagatgggtatgcgagacagaactcgacaaggcatcccaggaaccccccctcctgtag

SEQ ID NO: 179533 - DNA, 5679 bp, Artificial Sequence
  Description of Artificial Sequence: Synthetic coding sequence
atggccaaccggcgggtgggccggggctgctgggaggtgagccccaccgagcggaggcctcccgccggcttgcgcggccccgccgccgaggaagaagctagtagcccacctgtcctgagtctgtctcacttttgtcgcagccctttcctgtgctttggcgatgtgctgctcggggccagccgtacccttagcttagcactagataatccgaatgaggaggtggccgaggtgaagatctcacactttccggccgcggacctggggtttagcgtatcccagcggtgctttgttttacagcccaaagaaaaaatagtgatttccgtcaattggaccccccttaaagagggcagggtgcgggaaatcatgacatttcttgtgaatgacgtgctcaaacatcaggctatcttgcttggaaacgctgaggagcaaaaaaaaaagaaacgctccttatgggacacaatcaagaaaaagaaaatctccgcttcaacctcgcacaacaggcgcgtgagtaacatccaaaacgttaacaagaccttcagtgtgagtcagaaggtggacagggtgcgatcaccacttcaggcttgcgaaaacttagcgatgaatgaaggcggcccaccgactgaaaacaactcattaattctagaagagaacaagatcccaatttcccccatctcccccgctttcaatgagtgtcacggggctacttgtctgcccctgtcagtgcgacggtcaaccacatatagctctctccacgcctctgagaatcgtgaattactcaacgtgcattccgcaaacgtgagcaaagtatctttcaatgaaaaagccgtgaccgagacaagtttcaacagcgttaatgtaaatggtcagagaggggagaactcgaagctgagcctgactccaaactgctcttctaccctcaatattacccagtcacagatccactttctctctccggacagttttgttaataattcgcatggcgccaataacgagctggaactggttacctgcctcagttccgacatgtttatgaaggacaatagccagcctgtgcacctcgagtcgaccattgcccatgagatataccaaaaaatattgtcccccgacagctttatcaaagataattatggcttgaatcaggatctggagagtgagtccgtcaatcccatcctttccccaaatcagttcctgaaagacaacatggcctatatgtgcacttcgcaacaaacttgtaaagtgccgctgtccaacgagaattctcaggtccctcagtccccagaggactggaggaaaagcgaggtcagccccagaattccggagtgccagggcagcaagtctcccaaggccatctttgaggagctggtagaaatgaaatctaattattactctttcatcaagcagaataaccccaaattttctgcagtccaggacatctcctcccattctcacaacaagcagccaaagagaagacccattctttcggccaccgtcactaaacggaaggcgacctgcacccgcgagaatcagaccgaaatcaataaacctaaggctaaacgctgccttaattctgccgttggtgagcatgagaaggttatcaataaccagaaggaaaaggaagactttcatagttatcttccaatcatcgaccctatcctctcaaaaagtaaatcttacaagaacgaggtgacaccctccagcaccaccgccagcgttgcaaggaaacgaaagtctgatggaagtatggaagacgcaaatgtgagggtggcaattactgagcatacggaggtccgagaaattaaaagaatccacttttcccctagcgagcccaagacgagtgcagtgaagaagaccaaaaatgtgacaaccccaatttctaagagaatttccaacagggaaaaactgaacctcaaaaaaaaaaccgacttgtcaatcttccggacacctattagcaaaactaacaagcggaccaagcccatcatcgccgttgcgcagagttcactgacgttcatcaaaccattgaaaaccgacattcctaggcaccccatgccttttgctgcgaagaacatgttttacgacgagcgatggaaggagaaacaggagcagggctttacatggtggctgaatttcatcctgacccctgacgactttacagtgaaaaccaacatttcagaggtcaatgcagcgacccttctgctgggaatcgagaaccagcacaagatttccgtgcctagagcccccactaaagaagagatgtccttgagagcatacaccgctcgctgcagactgaatcgcttacggagagcggcgtgccgcttgttcacgtcagagaagatggttaaagccattaaaaaactggagattgaaattgaggcaagacggctgatcgtgcgcaaggacagacacttatggaaggacgtgggagagcgtcagaaggtactcaactggctgttgagttacaaccccctgtggttaaggatagggctcgagacaacatacggagagttgataagtttagaggacaatagtgacgtcaccggactcgcaatgttcatactcaatcgactgctttggaacccggatattgccgccgaatacagacacccaactgtgccccatctctaccgggacggccacgaggaggcactgagtaaatttacgctcaagaagttactactcctggtttgctttctcgactacgccaagatatctcgtctgattgaccacgatccatgcctcttttgtaaggacgctgaattcaaggctagcaaagagatcctgttagctttttcccgtgacttcctgtccggcgagggcgatctaagcagacatcttggcctgctaggacttcccgtgaatcacgtccagaccccgttcgacgagttcgattttgcagtcacaaatctggcggttgacctgcaatgcggcgtgcggctggtgcgtaccatggaactacttacacaaaactgggatttaagtaaaaagctaagaatccctgctataagccggctccaaaaaatgcacaatgtcgacattgtactgcaggttctcaagagtcgcggaatagagcttagcgacgagcatggaaataccatcctgtcgaaggacattgttgaccgacaccgcgagaagaccctgcgtctactttggaagatcgcatttgccttccaagtggacatttctctgaacctcgaccagttaaaggaggaaattgcgttcctgaagcatacaaaaagtataaagaaaaccatttctctcctttcatgtcacagcgatgacctaattaacaaaaagaagggaaagagagattcaggcagctttgagcagtactcagaaaacattaaattacttatggattgggtcaacgcagtttgtgccttctacaataagaaagtggaaaacttcaccgtgtctttttccgacggtagagtgctttgctatctgatccaccactaccatccttgttatgtcccatttgatgctatatgccagcgcactacccagacagtagaatgtacccagactggctcggttgtgctgaattcgtcatccgaatcagatgattcatccctggatatgtccctgaaagcttttgaccacgagaacacctctgagctgtacaaagagcttcttgagaatgaaaaaaaaaattttcacctggtgagatctgccgtgagagacctaggcggaatacctgccatgatcaatcactctgacatgagtaacacaattcccgatgagaaggtggttatcacctacttgagtttcctgtgtgcccgactgctggacctccgcaaagagatccgcgccgcgcgcttgattcagacaacctggcgcaaatacaaacttaagaccgacttaaagcggcatcaggagcgggagaaggccgcaaggattatccagctcgctgtcataaacttcctggcaaagcagcggttgcgcaagcgtgtgaatgctgcgctggttatccaaaagtattggagacgggtgctggcgcagcgcaagctgctgatgctgaagaaagaaaaattggagaaggttcagaataaggccgcctccctgattcaagcaatgtggcggagataccgcgcaaagaaatacctatgtaaggtgaaggccgcttgtaaaatacaggcctggtacagatgctggcgcgcacacaaggagtatctggctattctgaaggccgtgaaaattattcagggctgtttctatactaagctggagcgtacaagattcttaaatgtacgcgcaagcgctattattatccaaaggaaatggagggcaatactgcccgctaagatagcgcacgagcacttcctcatgatcaagaggcatagagccgcctgccttattcaggcccattaccgggggtacaaaggccggcaggtgttcctgcggcagaaatccgccgcccttatcatccagaaatatattagagcacgcgaagcaggtaaacacgagcgaatcaagtacatagagttcaaaaaatccacagtgatcctccaggccctggtgaggggctggctcgtgagaaaaagattcctggagcagagagccaagatccgtctgctccatttcacggcggccgcttattaccacctgaacgccgtgcgcattcagcgtgcatataagctttatctcgccgtgaaaaatgcgaacaaacaagtgaacagcgtcatttgcatccagcggtggttcagagctcggctccaggagaagagattcatacagaagtatcactccatcaagaaaatcgagcacgagggccaggagtgtctgtcccagaggaatcgggccgcaagtgttatccagaaggctgtgagacattttctgcttcggaaaaagcaggaaaagttcacatcagggattatcaaaatccaggccttgtggagggggtattcttggcggaaaaagaatgactgtaccaagataaaagcgatccgtcttagcctccaggtggtcaaccgagaaatccgggaagagaacaagctgtataaacgcaccgcgctcgccttgcattacctgcttacctataaacacttgtccgccatcctggaggctctgaaacacttggaagtggtgacccgactgtctcccctgtgttgtgagaacatggctcagtctggtgctatttctaaaatctttgtgctgatccgcagctgtaaccgatccatcccttgcatggaagtgatcaggtatgccgtgcaggtcctcctgaacgtgtctaagtacgagaaaaccacatcagcggtttacgatgtggaaaactgtattgacatactcctggaactgctacagatatatagagagaagcccggcaacaaagttgcagataaaggaggcagtatctttactaaaacctgttgcttgttagccatcttgttgaagaccactaatcgagcaagcgacgtgagatcccgcagcaaggtcgtggatcggatctattctttgtataagttgacagcacacaaacataaaatgaacacagagcgaatcctgtataagcagaagaaaaattctagcattagtattcccttcatccccgaaacgcctgtccgaacaagaatcgtgtccagattgaaacccgattgggtgctgcgacgtgacaatatggaggaaatcactaatccactacaggccattcaaatggtaatggatacactggggataccttattag

SEQ ID NO: 179534 - DNA, 4170 bp, Artificial Sequence
  Description of Artificial Sequence: Synthetic coding sequence
atggccaaccggcgggtgggccggggctgctgggaggtgagccccaccgagcggcggccacccgccggacttcgagggccagcagctgaggaagaagccagttcccctcctgtgttgagtctgtctcatttttgtcgatctccgtttttatgcttcggggacgtactgttgggagccagccgtaccctctcgttggctcttgataatcctaacgaagaagtcgctgaggtgaagatctctcattttcccgcagcagacctcggcttcagcgtttctcagaggtgcttcgtcttgcagcctaaggaaaagattgtaattagtgtcaattggaccccactgaaagaaggacgtgtgagagagatcatgacttttctagtgaacgacgtgctgaaacatcaggccattctgctcggaaatgccgaggaacagaaaaaaaagaagcgatccctctgggacaccattaaaaagaagaagatttccgctagcacatctcataatcgccgggtcagcaacatccaaaatgtgaacaagacattttcagtctcgcagaaagttgatagaaggtatcggcagcagacatacttcaacaaactgaaaaaaatcactaaaactgtgcaacagagatactgggcaatgaaggaacgaaacattcagtttcagcgctacaacaagctacgccactcagtcatctatatccaggccatcttcaggggaaagaaggcccggagacacctgaagatgatgcacattgctgctaccttgatccaacgtagatttcggaccctgatgatgagacggcgttttctgagccttaagaagaccgccatcttgattcagcggaagtacagagctcacttatgcacaaagcatcatcttcagttcctgcaggtgcagaacgcagttatcaaaattcagtcatcttacaggcggtggatgattagaaagagaatgcgcgagatgcatagagctgcaactttcatccagagcacctttagaatgcatcgtcttcacatgaggtatcaggccctgaagcaggcgtctgtggttatccagcagcagtaccaggcaaaccgggccgcaaagctgcagcgtcagcactatctgcgccagaggcatagtgctgtgattctgcaggcagcgtttagaggaatgaagacccggaggcatctgaaatcaatgcactccagcgctactttaattcaatctagattccgctcacttctcgtacgcaggcgtttcatatctctgaagaaggcaaccatcttcgttcagagaaagtatcgcgccactatctgcgcaaaacacaagctgtaccagtttctacacctgcgcaaagccgcaatcaccatacagtctagctacagaagacttatggtgaaaaaaaagctgcaggaaatgcaacgagcagctgtacttatccaggcaacatttaggatgtacagaacatacatcactttccagacttggaagcatgcttccatcctgatccagcagcattacagaacctaccgagctgcaaagctccaacgggaaaattatatccggcagtggcactccgcagtcgtcattcaggcagcttataagggtatgaaggccagacagcttctgcgcgaaaaacacaaagcaagtattgttattcagagcacctaccgtatgtacagacagtattgcttctaccaaaagctgcagtgggcgactaagatcattcaggagaagtatagagctaataaaaaaaaacaaaaggtcttccaacataacgaactgaagaaagaaacctgcgtgcaggctggttttcaggacatgaacatcaaaaaacaaattcaggagcagcaccaggccgctatcatcatacagaaacactgtaaggcgtttaaaatacgtaaacattatctacatctcagggccactgtagtgtccatccagcgtagataccgtaagctgactgcagtgcgcactcaggccgtgatatgtatccagtcatactaccggggctttaaagtgaggaaggatatccagaatatgcacagggcggccaccctcatacagtccttttaccgtatgcatcgggctaaagtggactatgagacaaagaaaaccgcaatagttgttatccagaattattacaggctctatgtgagagtgaaaaccgagcgaaagaattttctggctgttcagaaatccgtgaggactattcaggcggcttttcgaggaatgaaggtgcgacagaagctcaaaaacgttagtgaggaaaaaatggccgcaattgtgaatcagtctgcactgtgctgctaccgaagtaagacacagtacgaagctgtgcagagcgagggggtcatgatacaagagtggtacaaggcttcggggcttgcatgctcccaggaggccgagtatcacagtcagtcaagggccgctgtaactatacaaaaagccttctgcagaatggttacacgcaagctagagacccaaaaatgcgccgcccttcgtattcagttttttctccaaatggccgtgtatagaaggcgattcgtgcagcagaagagagccgctattaccttacagcactattttagaacatggcagactaggaaacagttcctgttatacaggaaggcggctgtagtgctccagaaccattatagggcctttctcagcgccaagcaccaacgccaggtctatctgcagattagatctagtgtcataatcattcaagctcgatcgaagggcttcatccagaaacggaagtttcaggagatcaaaaatagcacaattaagatccaggctatgtggcgaaggtacagagccaaaaaatacctctgtaaggtgaaagccgcctgcaagattcaggcgtggtatagatgttggcgagcacataaagagtatttagccatccttaaagccgtcaaaataattcagggttgcttctataccaaactagaacggacgagatttctcaacgtccgagcaagcgcaatcattatccagaggaaatggagggctatcctacctgctaagattgcccatgagcatttcttaatgattaagcgccaccgggccgcatgtctcatccaggcccactacagaggctataaagggcgtcaagttttcctgcgccagaagagcgccgctctgattatccagaaatatatcagagcccgcgaagccggcaagcatgaacggataaagtacatcgaatttaagaaatccacagtaattctgcaggcgctcgtccggggatggcttgtccgcaagcgcttccttgaacagagagcaaaaatcaggctcctccactttaccgccgctgcctactatcatcttaacgctgttcggatccaacgggcttataagttgtacctcgccgttaaaaatgctaacaaacaggtcaatagcgtcatctgtattcagcgctggtttagagccagactgcaagaaaagcgctttatccagaagtatcattccattaagaagatcgagcacgaaggccaggagtgtctttctcagcgaaaccgggccgcaagcgtgattcagaaagccgtgaggcatttccttctccggaaaaagcaggagaaatttacctctggaataattaagatacaggctctgtggagggggtattcctggcgtaagaagaacgactgtaccaaaattaaagccattcgcctgagtttgcaggtcgtgaacagggaaattagggaagaaaacaaactatacaaacgtactgccctggcactgcattacttgttgacctacaaacatctttcagccatactggaagcactgaagcatctcgaagtcgtgacccgcctctcacccctttgctgcgagaacatggcgcaaagcggagctatctccaagatattcgtgctcataaggtcgtgtaatcgctccatcccttgcatggaggttatcaggtatgcagtccaggtcctgttgaacgtaagcaaatacgaaaaaactacatccgcagtctacgatgtagaaaactgtattgatatactgctcgagctgctccaaatttaccgggaaaagcccgggaacaaagtggcagataagggagggtctatcttcacaaaaacttgctgcctgctcgcaatcctgctgaaaactaccaacagagcctcagttagcataagccagttgcctttcttcaagattatctttttgtggtcctag

SEQ ID NO: 179535 - DNA, 3429 bp, Artificial Sequence
  Description of Artificial Sequence: Synthetic coding sequence
atgagcctgcgggcctacaccgcccggtgccggctgaaccggctgcggagggccgcctgtagacttttcaccagtgaaaagatggtgaaggctatcaaaaaactcgagatcgagatcgaagcacgcaggttaattgtccgcaaagataggcacctatggaaggacgtgggcgagagacaaaaagtcctcaattggctgctgagctacaaccctctgtggttaaggatagggctagagacaacgtacggtgagctaatcagtctcgaggacaattctgatgttactggccttgcaatgtttatcctcaatagactcctgtggaatcccgatattgctgctgagtaccgccatcccactgtcccgcatctgtaccgggacgggcacgaggaagcgctcagtaagtttacactgaagaaactcttactgttggtatgttttctggattacgcaaaaatctcaagacttattgatcacgacccctgtctcttttgtaaagacgctgagttcaaagcctcgaaggagatccttctggcttttagtcgcgactttctttcaggggaaggtgacttgagtaggcaccttggcctgctggggctgccagtaaaccatgtgcagacaccttttgacgagttcgattttgctgtaaccaacctggccgtggatttacagtgcggtgttagactggttaggaccatggaactgctgacccagaactgggacctgagcaaaaaacttagaatacccgccattagcaggctacagaagatgcataacgtcgacatcgtgctccaggtgttgaaaagccggggtatcgaactctccgatgagcacgggaacaccattctgtccaaagatattgtggacagacacagagagaaaactctgcgcctcctctggaagatagccttcgcctttcaggtggatatttctttaaacctggaccagctcaaagaagagattgcctttctgaaacacaccaaatcgataaaaaaaaccatctctttgctgagttgtcattcagatgatctcattaacaaaaaaaaaggtaagagagatagtggctctttcgagcagtactctgagaacatcaagctcctgatggactgggtgaacgcagtatgcgccttttataacaagaaagtggagaacttcactgtgtcttttagcgatgggcgggtgctgtgttatctgatccaccactaccacccttgctatgtcccctttgacgctatttgtcaaaggacaacccagacagtcgaatgtacccaaaccgggtcagttgtcctcaatagtagttctgagtccgatgacagctcacttgatatgtctctcaaggcgttcgatcacgagaatacgtctgaactgtacaaggagcttctcgaaaatgagaaaaaaaattttcatctcgtgcgatcagcggtaagagatcttggcggcatccctgcaatgattaatcactctgacatgagcaatactatccctgacgagaaggtggtgatcacctacctgtcgtttctttgtgcccgcctgttggatctgaggaaagagattagggccgcaagactcatacaaaccacctggaggaagtacaagctcaaaacagaccttaagaggcaccaggagagagaaaaagccgcccgcatcatccagctagctgtgatcaactttctagccaagcagaggctaaggaagcgggttaacgctgccctagtgatccagaaatactggcgacgtgtgctcgcgcagcgcaagcttctgatgcttaaaaaagagaagctagagaaagtccagaataaggctgccagtctgatccaggctatgtggcgtaggtacagggccaagaaatacctgtgcaaggtgaaggctgcatgcaaaattcaggcttggtaccggtgctggcgggcccataaggagtacctggctatcctcaaagctgttaaaatcatacaggggtgtttctacaccaagcttgagcgaactcgcttcttaaatgtgcgagccagtgccattattatacagcggaaatggcgggctattttgccagcgaaaatcgcacatgagcatttcctgatgatcaaaagacacagggcagcgtgcttgatccaggcccactacagagggtacaaaggtcgccaggtcttcttgagacaaaaatctgccgccctcattatccagaaatacatacgggcccgtgaggcaggtaagcacgagcgcataaagtacattgagttcaaaaaaagtaccgtgatcctccaggctttagttcggggctggttggtgaggaaaagattcctagagcaaagagccaagatccggctgctgcattttaccgcagccgcttactaccatctgaacgcagttcggatccagagagcctacaaactgtatctggccgtaaagaacgcgaataaacaggtgaatagcgttatttgcattcagagatggttccgtgcacgattacaggagaaaaggtttatacagaaataccacagtatcaaaaagatagaacacgaggggcaagagtgtctgtctcaaagaaaccgcgctgcaagtgtaatacagaaagcggtccggcacttcttactgcggaaaaaacaggagaagtttacaagcgggatcatcaagatccaggcattatggcgcggctacagctggcggaaaaaaaatgactgtacaaagattaaagcaatcagactgagtcttcaggtagtgaacagggaaattcgggaggagaataagctgtacaagcggaccgcactggcgctgcactatctcctgacttataagcacctgagcgccattcttgaggcactcaagcatctcgaggtggttacacgccttagcccactctgctgcgagaatatggcccaatctggagctatctcgaagattttcgtcctgatcaggtcttgcaaccgaagtattccttgtatggaagtgattcgatatgccgtgcaggtactcctgaatgtgagtaagtatgaaaaaacaacatccgctgtgtacgacgtggagaattgcattgacatcctgctagagttattgcaaatctacagggagaagccagggaataaagtggccgacaagggcggttccatcttcactaaaacctgttgtttgcttgcgatcctgctgaagacaacaaatcgggcgtccgatgtgaggagtcgtagcaaagtagtggatcggatttattctctttacaagctgacagcacacaaacacaagatgaacacagagagaattctgtacaaacaaaagaagaactcaagtatctctataccatttatcccagaaacccccgtcaggactcgaattgttagccgcctcaagcctgactgggtcctaagaagagataatatggaggagataaccaatccgctgcaggcaatccagatggtaatggataccttagggatcccctactag

SEQ ID NO: 179536 - DNA, 10434 bp, Artificial Sequence
  Description of Artificial Sequence: Synthetic coding sequence
atggccaaccggcgggtgggccggggctgctgggaggtgagccccaccgagaggagaccccctgccggactccgggggcccgctgccgaggaggaggcttcttctcccccagtattgtctctaagtcacttttgtcgctctccgttcctatgcttcggggacgtcctcctgggcgccagcagaactctctccctggccctggacaatcccaatgaagaggttgctgaggtgaagataagtcactttcctgctgccgacctaggcttttccgtgagccaaaggtgcttcgtgcttcagcctaaggagaagatcgtgatcagcgtaaattggacccctctcaaagaaggaagggtacgggaaattatgacctttctggtaaatgacgtactaaaacaccaggccatactccttggcaatgcagaggaacagaaaaagaaaaaacgaagcttatgggatactatcaaaaaaaaaaagatttcggccagtactagccataataggcgcgtgtccaatatccagaacgttaacaagacattttcagtcagtcaaaaagtagatcgggtaaggtcacctctgcaggcttgtgagaacctggccatgaacgaggggggaccacctactgaaaataactcactcattttggaagagaataaaataccaatctcaccaataagtcctgcgtttaatgagtgtcatggagcaacttgcttgcctctttccgttcggcgaagcacaacttactcctctcttcacgcctcagagaatagagagctgctgaacgtacatagtgccaacgtttctaaagtgagcttcaatgaaaaagcggtgactgagacctccttcaacagcgtcaatgtgaacggtcaacgcggcgagaattcaaaactgtccctcacacccaattgctcatccaccctgaacatcacgcaaagccagatccactttctgagtcctgattcattcgtgaataactcacacggcgccaataatgaactcgaactggtgacgtgcctgtcttccgatatgttcatgaaagataacagccagccggttcacctcgaaagcacgatcgctcacgaaatctaccaaaaaattctgagtcctgactcatttattaaggataactacggcctgaatcaagacttggagagcgaaagtgtgaatcccatattgtctcctaatcagttcctcaaggataacatggcatacatgtgtaccagccaacaaacttgcaaggtcccactttccaatgagaatagccaggtcccacaatctcctgaggattggcgaaaatccgaggtatctccccgcatccctgaatgtcaaggctctaaaagtcctaaggctatctttgaggagttggtcgagatgaagtcaaattattactcatttataaaacaaaataatccaaagttcagtgcagtacaagatatttcatctcattcccataacaagcagccaaagcggaggcccatcctcagcgccaccgttactaagagaaaggccacgtgtaccagggagaatcagaccgaaattaataagcccaaggcaaaacggtgtcttaactcagcggttggcgagcacgagaaggtaataaacaaccagaaggaaaaggaggacttccattcatacctgccgatcattgatcctatactgtcaaaaagtaagtcatataagaatgaggtcactccatcctcaacaactgcctccgtcgcccggaaaagaaaaagcgacggatccatggaagacgcgaacgtcagagtggccattacggagcatactgaggtaagggagattaaacgtatccacttcagtccttccgagccgaaaacatcagcagtgaaaaaaactaagaacgtgactaccccaatttccaagcggattagcaatcgagaaaagcttaatctgaaaaaaaagaccgacctgtccatctttcgcactccgattagcaagactaacaagcgcacaaaacctataattgcagtggctcagtcaagtcttacctttatcaagccattaaagaccgatattccaaggcacccgatgcccttcgccgctaagaacatgttctatgatgaaagatggaaggaaaagcaagagcagggcttcacttggtggcttaacttcatcctgacacctgatgattttaccgtcaaaacaaacatcagtgaggttaacgccgctacactattgctgggcatagaaaatcaacataaaattagcgtgccacgggcccccaccaaagaggaaatgagccttcgggcctacacagctaggtgcagactgaacaggctccgtagagcagcatgccgcctttttaccagtgagaagatggttaaagccattaagaaattggagatcgagatcgaggctcggcgactgatcgtccggaaagacagacatctgtggaaggatgtgggggagagacaaaaggtgctgaattggctgctgtcttacaatcctttatggttgcgcattggactcgagaccacatacggcgagttgataagccttgaggataattccgacgtgacagggctcgccatgttcatccttaataggctgctgtggaaccccgatattgctgccgagtaccgtcatcccacggtgccgcacctctaccgcgatggtcacgaagaggccctgtctaagttcacccttaagaagttactactgctggtgtgcttcctagattacgccaagattagcagactgatcgatcatgatccctgtttgttttgcaaggacgcagaattcaaggcaagtaaggagattctgcttgccttttctcgcgactttctgtccggtgaaggcgacctctcacggcatcttgggctgttaggactgcctgttaatcacgtgcagacacccttcgacgagttcgacttcgctgtcaccaatctggcggtcgaccttcagtgcggagtgaggctagttcgcacaatggagctgctcactcagaactgggatttgtccaagaaactgagaattcccgccatttcacgtctacaaaaaatgcacaatgtggatatcgtactgcaggtgctaaagagcaggggcattgaactgagtgatgagcacggtaataccatcttgtcaaaggacatcgtagaccggcaccgggagaaaaccctccgcctcctgtggaagatcgccttcgcttttcaagtagatatatccctgaatctggaccagctaaaagaggagatcgccttcctgaaacacactaagagtatcaaaaaaacaataagtctcttgtcttgccattcagacgatctcattaataaaaaaaagggcaaacgagacagcggtagctttgagcagtattccgaaaatatcaaactgctgatggactgggtaaatgctgtgtgtgccttttacaacaagaaggtggagaacttcacagtgtcattctctgatggcagggtactgtgctatctgattcatcattatcatccatgctacgtgccttttgatgccatctgtcagcgaacgacacagaccgtggagtgtacacagaccggctccgtagtcttgaactcctccagtgagtccgatgacagcagcctggatatgagcctgaaagcctttgaccacgaaaacacgtcagaactgtacaaggagctactagagaatgagaagaaaaatttccatctggtgcgctcagctgttcgcgacctgggcggaattccggccatgattaaccattctgatatgtccaacactatacccgatgagaaagtggtcatcacttacctctccttcctctgtgcccgcctgctggacttgcgtaaagagattcgtgcggccaggctaatccagacgacatggagaaagtataagctgaaaactgaccttaaacggcatcaggagcgagagaaagctgcaaggatcatccaacttgccgttatcaattttctggcgaagcagaggctgcgtaaacgggtgaacgcggcactggttattcagaaatactggcgtcgggtcctagctcagcgtaaactattgatgctaaagaaagagaaactcgagaaagtgcagaataaggctgcttccctgattcaaggctactggcgccgctacagtaccagacagagatttctcaagctcaagtactacagcatcatcctgcagtctcggattaggatgatcattgcggtgacatcctacaagcgctatctgtgggctaccgtaacgatccaaagacattggagagcctatttaagacggaagcaggaccagcaacggtacgagatgctcaagtcttcgactcttataatacaatctatgttcaggaaatggaagcagagaaagatgcaaagccaggtaaaggccacagtcatcctacagcgagcctttagggaatggcacttgcggaagcaagcgaaggaagagaacagtgcaatcatcatccagagctggtatagaatgcacaaagaattaagaaaatacatatatattcgctcttgcgtggtgatcatccaaaagagattccgatgctttcaggcacagaaactgtataaacgcaggaaggagtccattttaactatccagaaatattacaaggcgtacctgaagggcaagatcgagaggaccaactaccttcagaaaagggcagcagctatccagttacaggctgcattccgtcggttaaaggcccacaatttgtgccgtcagattcgtgccgcatgcgtcatccagtcgtattggagaatgagacaggacagggtgcggttcctcaacctcaaaaagactatcatcaaatttcaggcacacgttaggaagcaccagcagcggcagaaatataagaaaatgaagaaggctgctgtgattattcaaacccatttccgtgcctacatttttgcaatgaaagtcttggccagttaccagaagactcgctccgctgtgattgtgttgcaaagtgcatatcgaggaatgcaggctcgtaaaatgtacatccatattcttaccagcgttattaagatccaaagctattacagagcttatgtgagcaagaaagaattcctgagcctcaaaaacgcgactatcaaacttcagtccacagtcaagatgaaacagacaaggaaacagtacctgcacttgcgtgcagctgcacttttcatccaacagtgctaccgctccaagaagatcgcagcccagaaaagggaggagtacatgcagatgcgcgaaagctgcatcaagctccaggcctttgtgcgaggatacttagtgcggaaacagatgaggttacagcgcaaagctgttatatccctacagtcctacttcaggatgaggaaagcacggcagtactacctcaaaatgtacaaggccatcatagttatccagaattactatcatgcctacaaagcacaagttaatcagagaaaaaactttctgcaagtgaagaaggccgcaacatgtttacaagcagcgtacaggggttacaaggttcggcaacttataaagcagcagagcatcgccgcgctcaaaattcagtccgcattccggggctacaataaacgggtgaagtaccagtctgtcctccaaagcattatcaagatccaaaggtggtacagagcctacaagacgttgcatgatacccgcactcattttttgaaaaccaaggcagcggtgatctcccttcagtccgcatatcgtggctggaaagttaggaaacaaattcgaagagagcaccaggcggcattaaagatccagagtgcctttcgcatggccaaagctcagaaacagtttcgtttgttcaagaccgcagcattagtgattcagcagaattttcgtgcctggacagccgggcgtaaacagtgtatggagtatatagaattgaggcacgctgtattagtactccaaagcatgtggaagggaaaaactctccgtcgtcagctccagagacagcataaatgtgccatcataatccagagctactaccggatgcacgtccagcagaaaaaatggaaaatcatgaaaaaggctgccctgttaatccagaagtactatagagcatattctattggaagggagcaaaaccacttgtatttaaagaccaaggccgccgtcgttacacttcagtccgcctacagaggtatgaaggtgcggaaacgaattaaagattgtaacaaagctgctgttaccatccagtctaagtatcgggcctataagactaaaaagaagtatgccacatacagagcttctgctattattatccagaggtggtacagagggattaaaatcaccaaccaccagcacaaagagtacttgaatttgaagaagacagccattaagatacagtctgtttaccggggcattagagttcggagacacatccaacacatgcatagagccgccacctttatcaaagcaatgtttaaaatgcatcagtcccgtatatcctaccacactatgcgcaaagcagcaatcgttatacaagtgaggtgtagggcctactaccaaggaaagatgcagcgggagaagtatctgaccatcctcaaggctgtgaaggtactacaagcatcctttcggggtgtgcgcgtcagacgtactctgagaaaaatgcagacagctgctaccctaatccaaagcaactatcggaggtatagacagcagacctattttaacaaactgaagaagataactaaaactgtgcagcaaaggtactgggctatgaaggaacgaaacattcaattccagcggtataacaagcttcgacactctgttatttatatccaggctattttccggggtaagaaggctagacgccaccttaaaatgatgcacatcgctgcgactcttattcagcgccgattcagaacattgatgatgaggcggaggttcttgagtctgaagaaaaccgctattctgattcagaggaagtaccgcgctcacctctgcaccaaacaccacttacagtttctccaggtgcagaacgccgtcatcaaaatccagagcagctacagaagatggatgattcggaagcggatgagagagatgcacagggcggccacctttattcagtcgacattccgcatgcaccgactgcacatgcggtatcaagccctcaagcaggctagcgtggtaatacagcaacagtaccaagccaatagagctgcaaaactgcagcgacaacattatctgaggcaacggcactctgcagtgattctgcaggctgcttttcgcggcatgaagactcggcgacacctgaaaagtatgcattcatctgctacccttatacagagccgttttcggtctttgctggtgcgcaggaggtttatctccctcaagaaagccacaatcttcgttcagcgtaaataccgcgcaactatttgtgccaagcacaagttgtaccaattcctgcacctgagaaaggcggccattacaatacagagcagctataggcgcctaatggtgaaaaagaaattgcaggagatgcagcgggctgctgtcctgattcaggctaccttccgtatgtaccgaacctacatcacatttcaaacttggaaacatgcgtccattctgattcagcagcactaccgcacctatcgcgctgctaagctgcagcgggagaattacattagacagtggcattctgctgtcgttatccaggccgcttataaaggtatgaaggcccgacagctgctccgtgaaaagcataaagcctccattgtgatacaaagcacttacagaatgtaccgccagtactgtttctaccagaagctgcagtgggcaaccaagatcatccaggagaagtatagagctaacaaaaaaaagcagaaagtgttccaacacaatgagctcaaaaaggagacatgcgttcaggcgggtttccaggacatgaatatcaagaagcaaatccaggagcagcaccaggctgcaattatcatacagaaacattgcaaggcttttaagataaggaaacattatttacacttacgcgctacggtcgtgtcgattcagagaagataccggaagctgaccgctgtgaggacacaggcagtcatctgtattcagtcctactacagagggttcaaggtgcgcaaagatattcagaatatgcatagggcggcaacactcatccaaagtttctatagaatgcaccgcgctaaggtggattatgagaccaaaaaaaccgccatagtggtgatacaaaactactaccgcctgtacgtgcgagttaaaaccgaaagaaagaacttccttgccgtccagaagtccgtgagaacaatccaggctgctttccgcgggatgaaagtgcgacagaagttaaaaaatgtgtctgaggagaagatggcagctatcgttaatcagtccgctctgtgctgctatcgctctaagactcaatatgaagcagttcaaagcgaaggagtcatgatccaagaatggtacaaggcatcggggctggcttgtagccaggaggcggagtaccactctcaaagtcgtgctgcagtcactatccagaaggccttctgcagaatggtgacaaggaagttagaaacacagaagtgcgccgccctcaggattcaattttttctgcagatggcagtgtaccgtcggaggttcgtccagcaaaagagagctgcaattacccttcagcactactttaggacttggcagacaagaaagcagttcctgttatacagaaaagccgccgtggtactgcaaaaccattatagggccttcctctctgcaaaacatcaacgccaagtgtacttgcagatacggagtagtgtgatcattatacaagcccggagcaaaggttttatacaaaagcggaagtttcaggagattaaaaattcaacaattaaaatccaggctatgtggcggagatacagagcaaagaaatatctgtgcaaggtgaaggcggcctgtaagatccaggcatggtataggtgttggagagcccataaggagtacctggctatcctgaaggctgtcaaaattatacaaggctgtttctacaccaaactggagcgaactagatttctgaatgtccgagcctccgctatcatcatccaacgcaagtggcgggccattcttcctgctaagatagcccacgagcatttcctgatgattaagcgccacagggccgcctgcctcatacaagcccactaccgcgggtacaagggacggcaggtcttcctacggcagaaatcagcagctctgattatccagaaatacattcgtgccagagaagcagggaaacacgaaaggatcaaatatatcgagtttaagaagtcaaccgtgattctccaagcactggttcgcgggtggctggtgaggaagcgcttcctcgaacagagggccaaaattaggttactgcacttcaccgccgccgcctattaccaccttaacgccgtccggattcagcgtgcttacaagttgtaccttgccgttaagaacgccaataagcaggtgaacagtgtgatctgtattcagaggtggttcagggctcgtcttcaggagaagcgattcatccagaaatatcacagtatcaagaaaatcgagcatgaaggccaggagtgcctgtctcaaaggaacagagcggcctccgttattcagaaagcggtgcgtcattttctgctgcgaaagaagcaggaaaaattcacatctggcatcattaagattcaggctctgtggaggggctattcctggcgcaaaaagaatgattgtactaaaatcaaggccatcagattgagcctgcaggtggtcaacagagagatacgcgaggaaaataagctctataaacgaaccgccctggcgctccattacctcctcacttacaagcacctgagtgccatcctcgaggccttaaagcatctcgaagttgttacccgtctgtcgccactttgttgcgagaacatggctcagagtggagccatttcaaaaatctttgtccttatcaggtcctgtaaccgttccatcccatgcatggaggtgattagatacgccgtgcaggtacttctcaacgtgagtaagtatgaaaagactaccagtgctgtgtatgacgtcgagaactgtatcgacattttgctagagctgctccagatttaccgggagaaacctggaaataaagtggccgataaaggtggctcaatcttcaccaagacctgctgtctgttggctattttactgaagactacaaaccgagcctccgatgtgagatcgagaagcaaggttgttgaccgaatctacagcctgtacaagctgacagctcataagcataagatgaataccgagcgcatcctctataagcagaaaaagaattcatcaatctcaatcccattcatcccagagaccccagtgagaaccaggattgtctcaagactgaaacccgattgggtcctcagaagagataacatggaggaaatcaccaaccccttgcaggccattcagatggtgatggacaccctaggcattccatattag

SEQ ID NO: 179537 - DNA, 1686 bp, Artificial Sequence
  Description of Artificial Sequence: Synthetic coding sequence
atgtgcggcatctgggccctgttcggcagcgacgactgcctgagcgtccaatgtttatccgccatgaagatcgcccatagggggcccgacgctttcagattcgagaacgtgaatggatacaccaactgttgctttgggttccacaggcttgcagtcgttgatcccttgtttggaatgcagcccatcagagtgaagaaatatccttatctatggctatgctataacggggagatttacaatcacaagaagatgcagcagcattttgagtttgagtatcagacgaaagttgatggggagatcattctgcatctgtacgacaaagggggcattgagcagacgatctgcatgctagatggagtcttcgccttcgtgctgctggacactgctaataaaaaggtgtttcttggccgagacacctacggcgttaggcctctattcaaggccatgactgaggatggtttcctcgcggtatgtagcgaggccaagggattggtgacactcaaacatagtgcaacaccttttctgaaagtagagccttttctgcccgggcactatgaggttctggatctgaaaccaaacggcaaagtggcatcagtcgaaatggtcaagtaccaccattgccgggacgtccctctgcacgcactttatgataatgttgaaaaactcttcccaggcttcgagatcgaaacggtaaagaacaacctgaggatattatttaacaatgctgtcaagaagagattgatgacagatagaagaattggatgcctgttgtctggtggactggacagctctctcgttgccgcgacactgttaaagcagttgaaggaggcccaggtccagtatcccctgcaaaccttcgccattggtatggaagattcccccgacttgttggccgctcggaaagttgccgatcacattgggagtgagcattacgaagttctgttcaactccgaggagggcattcaggccctcgatgaggtgatcttctcactggagacctatgacatcacaaccgtgcgagcttccgtcgggatgtaccttattagcaaatacataaggaaaaacacagacagtgtcgtaattttttccggggaaggctcagacgagcttacccagggatatatttattttcacaaagctccatcacccgagaaagctgaggaggagtcagagagacttctgcgcgagctgtacttgttcgacgtgctcagggccgatcgtacaaccgctgcccatgggctcgagctccgggtgccatttttggatcaccggttctcatcttattatctgtccctgccacctgaaatgcggattcccaagaacggcattgagaagcacctattacgcgagacatttgaagattccaatctgattcctaaagagatcctctggagacccaaagaggcattttctgatggtatcacaagtgtcaagaatagctggttcaagatcctgcaagaatacgtggaacaccaagttgacgacgctatgatggctaatgctgcccaaaagttcccctttaacactcctaaaacaaaagaggggtactactatagacaggtgtttgaacgacattatccagggcgcgctgattggcttagccactattggatgccaaaatggatcaatgctaccgatccttcagctcgcacccttacacactataaatcagctgtgaaagcctag

SEQ ID NO: 179538 - DNA, 1686 bp, Artificial Sequence
  Description of Artificial Sequence: Synthetic coding sequence
atgtgcggcatctgggccctgttcggcagcgacgactgcctgagcgtgcaatgtttgtccgctatgaagattgcacatcgggggcctgatgccttcagatttgaaaatgtgaacgggtataccaattgctgtttcggattccatagactggccgtggtagacccacttttcggaatgcagcctatccgtgtcaagaaatacccatatctgtggttgtgctacaatggagagatctacaaccacaagaaaatgcagcaacactttgaattcgagtaccaaacgaaggtcgatggcgagatcatactgcatctttacgacaagggaggtattgaacagaccatatgcatgctggatggcgtgttcgctttcgtgctcctcgatactgctaacaaaaaggtgttccttggacgggacacctatggcgtgagacctctgttcaaggctatgacagaagacggctttctggccgtctgctcggaagcaaaagggctggtgaccctcaagcacagtgccaccccatttctgaaagtggagccttttttacccggacactacgaagtgctggacttgaagcccaatggaaaagtggcctcagtcgaaatggtaaaataccatcactgccgtgacgtgccactccatgccttatatgataacgtggagaagttgttccctggattcgagatagaaaccgttaagaacaaccttaggattctgttcaacaacgctgtgaaaaaaagactaatgaccgaccgtcgaatcggatgtttgttaagcggcgggctggacagttccttagtcgcggctactctcctgaaacagttgaaagaagcgcaggtacaataccccctgcagaccttcgctattggcatggaagactcccccgatttgcttgctgctaggaaggtggcagaccacattggctccgaacactacgaggtactctttaactccgaagaaggaatacaggcacttgatgaggtaatcttttccctggaaacctacgacatcacgaccgttcgagcttccgtcgggatgtatctgattagcaagtacataagaaaaaatacagattcagtggtcattttttctggggagggtagtgacgaactcactcagggatatatttacttccataaggcaccttctcctgaaaaagccgaagaagagagcgaacgcctcttgagggagctttacttgttcgacgtgctccgggctgatcgcaccacagctgctcatggactggaacttcgggttccattcctcgaccatcggttctctagttactacctgagcttgcctcctgagatgcgcatccctaagaacggtatcgaaaaacacctgcttagagagaccttcgaagactctaatttaattccaaaggagatcttatggagacctaaagaggccttctctgatgggattacatctgttaaaaattcatggtttaagattcttcaggagtacgtcgagcaccaggtcgacgacgctatgatggcaaacgccgctcagaaattcccgttcaacacaccgaagactaaagagggatactattatcgtcaagtatttgaacggcattaccctggacgggctgattggcttagccactattggatgcccaaatggattaatgctaccgatccaagcgcccgaacgctgactcactacaagtccgccgtcaaggcctag

SEQ ID NO: 179539 - DNA, 1686 bp, Artificial Sequence
  Description of Artificial Sequence: Synthetic coding sequence
atgtgcggcatctgggccctgttcggcagcgacgactgcctgagcgtgcagtgtctgtctgcaatgaaaattgcccatcggggccccgatgccttccgcttcgagaacgtaaatggatacactaactgctgtttcggcttccacagattggccgtggtggatcctctttttggaatgcagcccattagagttaaaaaatacccctatctctggctgtgctacaatggcgagatctataatcacaagaaaatgcagcagcactttgagttcgagtatcagactaaggtcgacggtgaaattatcctgcatttatatgacaagggtgggatagagcagaccatttgtatgctggacggtgtgtttgccttcgtgttgttggacactgcgaataaaaaagtgttcttgggacgagacacgtacggcgtcagaccattgtttaaggctatgacagaagacggctttctggctgtctgctctgaagctaaagggctggttaccctcaagcattcagcgaccccgtttctaaaagttgaaccttttttgccaggccactatgaagttctagatttgaaaccaaacggaaaagtcgccagtgtggaaatggtgaagtaccatcattgtcgcgacgttcccctacatgccctatatgacaacgtcgagaaactctttcccgggttcgaaattgaaacggtgaaaaacaaccttcggatcttgttcaacaacgccgtaaagaaaagactgatgacagaccggcgaattgggtgtctgttaagcggaggactggactcttccctggtcgccgctaccctcctgaaacagcttaaggaagcccaggttcagtaccccctccaaacctttgccatcggcatggaggattctcctgacctgttagctgctagaaaggtggcggatcacatcggtagtgaacattatgaggtgctgttcaactcggaggagggcattcaggctttagatgaggtcattttctcacttgagacttacgacatcacaactgtccgagcctccgtgggcatgtatttgatctcaaagtacatcagaaaaaacaccgatagtgtggtcatcttcagcggcgaagggtctgatgagttgacccaggggtacatctatttccacaaggcccctagtccagagaaagcagaagaagaatctgagcgcctgttacgcgaattgtatctatttgatgttctgcgggccgacaggaccacagctgctcacggcctagaacttcgggtgccgtttctcgatcaccggtttagcagctactacctgagcctgcctcctgaaatgagaatccccaagaatggcattgaaaagcacctactgagagagaccttcgaggattccaacttgatccccaaagagatcttatggaggcctaaagaagccttttctgacggtattacatccgtcaaaaattcctggttcaagattctacaggaatacgtcgagcatcaagttgacgacgccatgatggccaacgcagcccagaagttccccttcaacacaccaaagaccaaagaggggtactactatcggcaggttttcgaaaggcactatccggggagagcagactggctgtcacactactggatgcccaagtggattaacgccacagatcccagcgctcgcactctcacccattataaatctgcagtaaaggcttag

SEQ ID NO: 179540 - DNA, 87 bp, Artificial Sequence
  Description of Artificial Sequence: Synthetic coding sequence
atgtgcggcatctgggccctgttcggcagcgacgactgcctgagcgtgcagtgtttaagtgctatgaagatcgcccacaggggatag

SEQ ID NO: 179541 - DNA, 489 bp, Artificial Sequence
  Description of Artificial Sequence: Synthetic coding sequence
atgtgcggcatctgggccctgttcggcagcgacgactgcctgagcgtccagtgcttgtcagcaatgaagatagcacaccggggccccgatgcttttcgcttcgaaaacgttaacggatataccaattgctgcttcggctttcataggctcgctgtcgtcgatcccctcttcgggatgcagcccatccgagttaagaaatacccctacttgtggctatgttataatggagaaatctataatcacaaaaagatgcaacagcatttcgaattcgagtaccaaaccaaggtcgacggggaaataatcctccatttatatgataagggcgggatcgaacagaccatttgtatgctggacggcgtttttgccttcgttctgctcgacaccgctaataagaaagtttttttgggcagagacacttatggggtgcgtcccctcttcaaggcgatgactgaggatggatttttggcagtgtgttctgaggctaagtag

SEQ ID NO: 179542 - DNA, 648 bp, Artificial Sequence
  Description of Artificial Sequence: Synthetic coding sequence
atgtgcggcatctgggccctgttcggcagcgacgactgcctgagcgtgcagtgcctctcggccatgaagatagctcaccgaggtccggatgcatttagatttgaaaacgtgaatgggtacactaattgctgttttggttttcatcggctggccgtcgtggatccactgtttggtatgcagccgatccgggtgaagaagtatccctacctttggctttgctacaacggagaaatttataaccacaaaaagatgcagcagcactttgaattcgagtaccagacaaaagtagacggtgagatcatcctacacctttatgacaaaggaggcatcgaacaaaccatctgcatgctggatggcgttttcgccttcgtgttgctagataccgcgaataagaaagtgtttctgggccgggatacatatggggtgagaccactgtttaaagcaatgacggaagacggcttcttagctgtctgcagtgaagccaagggcctcgtaacactgaagcattccgctactcccttcttaaaggtggagcctttcttacccggacactatgaggtactcgatcttaagcctaatgggaaggtcgccagcgttgaaatggtgaagtaccaccactgcagggatgtgccactgcatgccctgtag

SEQ ID NO: 179543 - DNA, 360 bp, Artificial Sequence
  Description of Artificial Sequence: Synthetic coding sequence
atgtgcggcatctgggccctgttcggcagcgacgactgcctgagcgtccagtgcctgagtgccatgaaaattgcccatcgagggccggatgccttccggtttgagaacgtgaacgggtacaccaactgctgctttggctttcatagactggccgtggtcgatcctctgtttggaatgcagcccatacgagtgaagaaatatccatacctctggctgtgctataacggtgaaatctataaccataaaaagatgcagcagcactttgaattcgagtatcaaaccaaagtggatggagaaatcatcctccacctttacgataagggtggcatcgagcagacaatctgcatgctggatggctag

SEQ ID NO: 179544 - DNA, 102 bp, Artificial Sequence
  Description of Artificial Sequence: Synthetic coding sequence
atgtgcggcatctgggccctgttcggcagcgacgactgcctgagcgtgcagtgtctgagcgcgatgaagattgctcacagggggcccgacgcttttagatag

SEQ ID NO: 179545 - DNA, 192 bp, Artificial Sequence
  Description of Artificial Sequence: Synthetic coding sequence
atgaagatcgcccaccggggccccgacgccttccggttcgagaacgtgaacggctacactaactgctgtttcggcttccaccgactggccgtggttgaccctctctttggaatgcagcccataagggtcaagaaatacccctatctctggctttgttacaatggtgagatctataatcacaaaaaggtgtag

SEQ ID NO: 179546 - DNA, 1437 bp, Artificial Sequence
  Description of Artificial Sequence: Synthetic coding sequence
atgcagcagcacttcgagttcgagtaccagaccaaggtggacggcgagatcatacttcacttgtacgacaaaggtgggattgaacaaaccatttgtatgctcgatggggtgttcgctttcgtcttactagatacagccaacaaaaaggtctttctggggcgagatacttacggtgtgaggcccctattcaaggccatgaccgaagacggctttttggccgtgtgcagcgaggcaaaaggtttggtcacccttaaacactcggcgacaccattcttgaaggttgagccctttctccctgggcattacgaggtgctggatcttaagcccaatggaaaagtggcctctgtggagatggtgaagtaccatcattgcagagacgtgcctttgcacgccctatatgacaacgtcgagaaactgtttcccgggttcgagatcgaaacggtaaaaaacaatttgagaattttattcaataatgctgtcaaaaaacgactgatgactgatagacgaatcggctgcctcctgtcagggggcctcgacagcagcttagtagccgcaaccctcctcaaacagttgaaagaggcccaggtacagtacccacttcaaaccttcgctataggaatggaagatagcccggacctgctcgccgctaggaaggtggccgaccatattggaagtgagcattacgaggtgctgtttaactctgaggaaggcattcaggctcttgatgaggtgatcttctctttggagacttacgatattactacggtcagagcctcagtaggaatgtatctgatcagtaagtatatcagaaagaatacagacagcgttgtgattttcagcggagaaggatctgatgaactcacccagggctatatctattttcataaggcccccagcccggaaaaagcggaggaagaatccgagcggctgcttcgcgagctctacctcttcgacgtgttaagagccgatcggaccacagccgcacacggtctagaattaagggtgccgtttctggatcataggttctcatcctattatctcagccttcctcccgaaatgcgtatcccaaagaacggtattgaaaaacacctgctaagagagaccttcgaggacagtaatctgattccaaaggagatattgtggagacctaaggaagcattctcggatggcatcacgagcgtgaaaaattcctggtttaaaatattgcaagagtatgtggagcaccaggtcgatgacgccatgatggcaaatgccgcacagaaatttccctttaacaccccaaaaactaaggaggggtattattatcgtcaagttttcgaaagacactaccccggcagggccgactggctgtctcattactggatgcctaagtggataaacgcaaccgacccctcagctcggactctcacccattataagtccgctgtcaaggcctag

SEQ ID NO: 179547 - DNA, 1623 bp, Artificial Sequence
  Description of Artificial Sequence: Synthetic coding sequence
atgaagatcgcccaccggggccccgacgccttccggttcgagaacgtcaacggctacaccaactgctgctttgggtttcacagactggccgttgttgatcctttgtttggcatgcagcctataagagtgaagaagtacccttatctttggctgtgctataatggtgagatttataaccacaagaagatgcaacagcactttgagtttgagtaccagaccaaagtggatggtgagattatcctgcatttgtacgacaaaggaggcatagagcaaaccatctgtatgctggacggtgtctttgccttcgttctcctggacaccgccaacaaaaaggtttttttaggccgcgatacttatggggtcagacctctcttcaaggccatgaccgaggacggcttcctggccgtttgttcagaagccaaggggctggtcaccctgaagcacagcgccaccccctttctcaaggtcgagcctttcctccccggccattacgaagtgttggacctgaagccgaatggaaaagtcgctagcgtagaaatggtgaaatatcatcactgccgtgatgtgccactccatgccctgtatgacaatgtggagaaactgttcccaggcttcgagattgagactgtgaagaataatcttcgaattctattcaataacgccgtgaagaagcgtctcatgacagaccgcaggattggctgcttgttgagtggcggccttgactcaagtctggtggccgctacactcctgaagcaacttaaggaagcacaggtccagtacccactccagacttttgccattggaatggaggacagtcccgatcttcttgccgcacgcaaggtggccgaccatattggctcagaacattacgaagttctgttcaatagcgaagagggcatccaagccctcgacgaagttatattttccctcgagacatatgatatcaccaccgttagggcaagcgtgggtatgtatttgataagtaagtacatcagaaagaatacggactccgtagtgatattttccggtgagggctctgatgagttaactcagggatatatctatttccacaaagctcccagccctgagaaagcggaagaagagtctgagcggttgttgcgggagctgtacctttttgacgtgctgagggctgacagaactaccgccgcccatggtttggaattgcgtgtgccctttttagatcaccggttttcttcttactatctaagcctgcccccagagatgaggatcccaaagaacggtatagaaaaacacctgctgcgggagactttcgaggacagtaatctaatacctaaggagatcctctggaggccgaaggaggcattctccgacggcatcaccagtgttaaaaattcgtggtttaagatattacaagaatacgttgaacaccaggtggatgacgcgatgatggcaaacgcagcgcaaaagtttcccttcaacactccaaaaaccaaggagggctactattataggcaagttttcgaacggcactatcccggccgcgcagactggctgtcccattattggatgcccaagtggataaacgctacagatccatcagcccgaacactaacccattacaaatcagctgtaaaagcatag

SEQ ID NO: 179548 - DNA, 1437 bp, Artificial Sequence
  Description of Artificial Sequence: Synthetic coding sequence
atgcagcagcacttcgagttcgagtaccagaccaaggtggacggcgaaattatcttacatctgtacgataaaggcggaattgaacagaccatatgcatgctggacggcgtgtttgcattcgtgctgctagacaccgccaacaagaaggtattcttgggtcgggacacctatggtgtcaggccactctttaaagccatgactgaggatggtttcctggcagtgtgttcagaggccaaaggcctagttactctcaaacactctgcaacacccttcctcaaagttgagcccttcctgccaggccattacgaggtgctggatttaaagccaaatggcaaggtagccagtgttgagatggtgaagtaccatcactgtcgagacgtgcctctccacgcactctacgacaacgtggaaaaactgttcccgggtttcgaaattgagacagtgaagaacaatctgcgaatccttttcaacaacgccgttaagaaaagacttatgaccgaccgacgcattggttgcttactgtccggtgggctcgactcatccctggtagcagccaccctgttaaagcagctcaaggaggcccaggtccagtacccgctccagacctttgcgatcgggatggaagattcacctgatctgctggctgctcggaaggtggccgatcacatcgggagtgagcattacgaggtgttgtttaactcagaggaggggatccaagcactggatgaggtgattttttccctggagacgtacgatataactaccgtccgtgcctccgttggtatgtaccttatcagtaaatatattcggaagaacaccgatagcgtcgtgattttttctggtgaggggtcagacgaattaacccagggctatatttactttcacaaagccccttcgcctgaaaaggccgaggaggagagtgaaagactgctccgggaactctaccttttcgacgtattgcgggcagatagaactactgccgcacacggtcttgagctgagagtccccttcctggaccatcgcttttcctcttattatttgtctctgccccctgagatgcgaattcctaagaatggcatcgagaagcacctgcttagagaaacctttgaggactccaatttaatcccgaaggagatcctttggaggcccaaggaggctttttctgacggaattaccagcgtgaaaaactcatggtttaagatcctgcaagagtacgtcgagcatcaggtggacgatgcaatgatggctaatgcagcccagaagtttccattcaatacaccaaagacgaaggaaggatattactacagacaggtgtttgaaagacactaccccgggagggccgattggctcagtcactattggatgccaaaatggatcaatgccacggatccatccgcccggacactgacccattacaagtccgccgtgaaggcctag

SEQ ID NO: 179549 - DNA, 1395 bp, Artificial Sequence
  Description of Artificial Sequence: Synthetic coding sequence
atggccgccagctgcctggtgctgctggccctgtgcctgctgctgcctctgctgttactgggaggctggaaacgatggcggcggggtcgagctgcaaggcacgtcgtcgctgtggtcctcggcgacgtggggcgctcccccagaatgcagtatcacgcactcagcttggccatgcacgggttctcagttacccttctcggtttttgtaactctaagccacatgatgaattgctgcagaacaatcggattcagattgtgggacttacagaacttcagtcgctcgcagttggacctcgagtcttccaatacggagtcaaggtggtgctacaggcaatgtacctcttatggaagctgatgtggagggaaccaggcgcttatatctttctgcagaatccacccggtttgccgagcattgcagtttgctggttcgttggatgtctttgcggcagcaagctggtaatcgactggcataattatggatactctatcatgggacttgtgcacgggcctaaccatcctcttgtcctgttggctaaatggtacgaaaagtttttcggccgtttgagtcatctgaacctgtgcgtcactaatgccatgcgggaggacctggctgacaattggcatatccgggccgtaaccgtgtatgataaaccagcaagtttctttaaagaaaccccccttgatcttcagcacagattgttcatgaagctgggctccatgcattcaccatttagggcacggtctgagcctgaggacccagtgacagaacggtctgcctttactgagcgggacgccggatccggtctggtcacccggttgagggaacgtcctgcccttctggtgtcatcaaccagctggactgaggatgaggacttcagtattctgctcgcagcattggaaaaattcgagcaactcactctggacgggcataacctgccctcactggtgtgcgtaattactgggaagggcccccttcgagaatactacagccgcctgatccaccagaaacattttcaacatatccaggtgtgtaccccttggcttgaggctgaagactaccctttgttgctcgggagcgccgacctgggcgtctgtctacacacgtcatccagtggacttgacctgcctatgaaggttgtagatatgtttgggtgctgcctgccagtgtgcgctgttaatttcaagtgcctacacgaactggtcaaacacgaggaaaatggactggtattcgaagactctgaggagctagctgctcagctgcaaatgctattcagcaattttcctgatcccgccggtaagttaaaccagtttagaaagaatctgcgggagtcacaacagctgaggtgggatgagtcatgggtccagactgttctacccctggttatggatacatag

SEQ ID NO: 179550 - DNA, 1062 bp, Artificial Sequence
  Description of Artificial Sequence: Synthetic coding sequence
atgtacctgctgtggaagctgatgtggcgggagcccggcgcctacatctttctccaaaatccgccggggctgccaagcatcgcagtttgttggtttgtgggatgtctgtgcggctccaagctggtgatagactggcataattacggatattccatcatgggcctcgtgcacggtcccaatcatcccctcgtgctgctggccaaatggtacgaaaagttttttgggcggctgagccatctcaacctgtgtgtgacgaacgcaatgagggaggatctggcggacaattggcacattagggctgttacagtgtacgacaaacctgccagctttttcaaggagacccccctcgacctacagcaccgattatttatgaaactcggatcaatgcatagtcctttccgggcgaggtctgaaccagaagacccggtgactgagaggagtgcatttaccgaacgtgatgccgggagtggtctggtgacacggctcagggagcgccctgcgctattagtgtccagcaccagctggacggaagatgaggatttttcaatccttctggccgccttggaaaaatttgaacagctgactctggacgggcataacctgcccagcctggtttgtgtaatcacgggcaagggccctctgagagaatactatagcagactgattcaccagaagcatttccaacatatccaggtctgtaccccatggctcgaggctgaagattaccctttgctgcttggatctgccgacctcggtgtgtgcctgcatacttcttccagcgggctggacctgcccatgaaagtagtggatatgttcgggtgctgcctgccagtgtgtgccgtgaacttcaagtgcttgcacgaacttgtgaagcacgaggaaaatggcctggtttttgaggacagcgaggaactcgctgcacagctgcagatgctgtttagcaacttccccgaccctgccggcaaactgaatcaattccgtaaaaatcttagggagtctcaacagctccggtgggatgaatcctgggtccagaccgtacttcccctggtaatggacacatag

SEQ ID NO: 179551 - DNA, 1422 bp, Artificial Sequence
  Description of Artificial Sequence: Synthetic coding sequence
atggcccagctggagggctactacttcagcgccgccctgagctgcacctttctggtttcatgtctcctatttagcgctttttccagggctctgagagaaccttacatggatgagattttccacctcccgcaggctcagagatattgtgaaggacactttagcttgtcacagtgggacccgatgatcactacactgcctggtctttatctcgttagcataggagtgatcaagccagcgatctggattttcggctggtccgagcatgtcgtgtgcagcatcggcatgctgcgcttcgtcaacctgcttttctccgtgggaaatttctatcttctctatctgctgttctgtaaggtacagcctcgcaataaggccgctagttccatccagcgcgtgctttccacccttacactcgccgtattcccaaccttgtacttcttcaactttttatattacactgaagcgggttctatgttttttactctgtttgcttatctaatgtgcctctacggaaaccacaagacgagtgcctttttgggtttttgtgggtttatgttccggcagaccaacattatatgggcagtattctgcgccggtaacgttattgcccagaagctgacagaagcttggaagacagagttgcagaagaaggaagatagactaccccccatcaaaggacctttcgccgagtttcgaaaaattttacagttcctgctagcttacagcatgagttttaaaaacctgtctatgctgcttctcttaacatggccgtatatactcttaggtttcttattttgtgctttcgtggtagtcaacggcggcatcgtgataggcgaccggagctcacatgaggcttgtttgcattttccccagctattctatttcttcagtttcacgttgtttttcagctttccccacctgctgtctccctccaaaattaagactttccttagtcttgtgtggaagagacgaatcctattcttcgtcgtgacgctggtttctgtattccttgtgtggaaatttacctacgcacataagtatctgcttgccgacaatcgacactacaccttctatgtgtggaaacgcgtgttccagcgctacgaaacagtgaagtacctgctcgtccccgcgtacatcttcgccggttggagcatcgccgactccctgaagagcaagtccatcttttggaacttgatgtttttcatctgtctgttcaccgtgatcgtgccacagaagctcctcgagttcaggtatttcatattgccctacgtgatatatcgtctgaatattcctctgcctcctacttctcggctaatatgcgaactgagctgttacgccgtagttaactttatcacattttttatatttctcaataagacattccaatggccaaacagtcaggacatacagagattcatgtggtag

SEQ ID NO: 179552 - DNA, 1479 bp, Artificial Sequence
  Description of Artificial Sequence: Synthetic coding sequence
atggccgccggcgagcggagctggtgcctgtgcaagctgctgcggttcttctactctctttttttcccagggttgattgtttgcggcactctttgcgtctgtctggtcattgtgttatggggaatccgactgctgcttcaacggaaaaagaaactggtttcaactagcaagaacggaaagaaccagatggtgatcgctttcttccacccatattgcaatgctggaggaggcggcgagcgcgtgctctggtgcgcacttagagcactacagaagaaataccccgaggctgtttatgttgtgtataccggggacgtgaatgtcaatggacagcaaatcctggagggcgcatttcggcggtttaacataagactgattcatcccgttcaattcgtgtttctacgtaagcgctatttggttgaagactccctctatccccacttcacactactgggccagtctcttggatccatattcctgggctgggaggccttaatgcagtgcgtacctgacgtgtacatcgactctatgggctatgctttcaccttgcccctcttcaaatatatcggtggatgccaggtgggaagctatgtacattaccctactatcagcactgacatgctttcagtcgttaaaaaccagaatatcgggtttaacaatgctgctttcatcaccagaaatcccttcctgagcaaggtcaagctgatctactattacttatttgcctttatatacggtctggtgggtagctgctccgacgttgtgatggttaacagctcctggacactgaatcacatactgtccctgtggaaggttggaaactgcacaaacatcgtgtatccgccttgcgacgtgcagacgtttctggatattccgctgcatgaaaagaaaatgacccctggacacctattagtgtccgtgggtcaatttcgccctgagaagaatcatcccctacagatacgagcttttgccaaacttctcaataagaaaatggtcgaatctcctcctagtttaaaactggtgctaattgggggatgcaggaataaggacgacgagctaagagtaaaccagctgcgacggttgagcgaagacttaggggtccaggagtatgttgagttcaagatcaatatccctttcgatgagctgaaaaattacctgagcgaggctacaatcggtctgcatacaatgtggaacgaacactttggaattggggtggttgagtgtatggccgccggaacaataatcttggcccacaattcaggggggcccaagttggatatagtagtgccccacgaaggggacataactggcttcctggcagaatctgaggaggactacgctgagacgatcgctcatatactgtctatgagtgcagaaaagcgcctgcagattcgtaagagcgcaagagcttccgtcagccggtttagtgatcaggagtttgaggttacctttctttcctctgtagagaagctgtttaaatag

SEQ ID NO: 179553 - DNA, 111 bp, Artificial Sequence
  Description of Artificial Sequence: Synthetic coding sequence
atggccgccggcgagcggagctggtgcctgtgcaagctgctgcggtcctgcggagtgtatggttcatggcataattatccatgtacccagtttggcggcccaaaagcctag

SEQ ID NO: 179554 - DNA, 1467 bp, Artificial Sequence
  Description of Artificial Sequence: Synthetic coding sequence
atggccggcaagggcagcagcggccggcggcccctgctgctgggcttattggtagctgtggccactgtacacctggtgatctgcccgtacacgaaggttgaagagtcctttaacctacaagctacccacgatctcctgtatcactggcaagatcttgagcagtacgaccacctcgagtttccaggcgttgttccaagaacctttctcggacccgtggttattgctgtttttagctctccggccgtgtacgttcttagcttactagaaatgagtaaattttactcacagctgattgtgcgaggtgtgctcggacttggcgtgatctttggactctggaccctccaaaaagaagtcaggcgacatttcggtgccatggtggcaacaatgttctgctgggtgacagccatgcagttccacttgatgttttactgtactcgcacactgcccaatgtgttggctctccccgtcgtgctgttggctctcgcggcttggctgagacatgagtgggcgaggttcatctggctgagcgcatttgcaataattgtgttcagagtggagctctgtctgttcctcggtctattgcttctcctggctctaggcaatcggaaggtttcagttgtacgagcccttaggcatgcagtgcccgcggggatcctgtgcttggggctgactgtggccgtcgacagctacttctggcgtcaactgacgtggccggagggaaaggttctctggtataacaccgtgctgaacaagagctccaactgggggacaagtccgttattgtggtatttttattcagctctgccacggggcctgggttgttccctgctgttcattccactcggcttggttgacaggcggactcatgcacccacggtgctggcactgggcttcatggcgctctactccttacttccccacaaggagctgagatttatcatttacgccttcccaatgctcaacattaccgccgcccgcgggtgctcatatttgctgaacaactacaagaagtcatggctttacaaggctggatccctgctggttataggccatctggtcgtcaacgcagcttattctgccaccgccctgtatgtgagccactttaattatcccggcggggtcgcaatgcagaggctacatcagctggttcctcctcaaacagatgtgcttctccacatcgacgttgctgcagcccagactggtgtgtctaggtttttacaagttaactctgcctggcggtatgacaagagagaggacgtgcagcccggcacaggcatgctggcctacacccacattttgatggaagcagcaccaggcctgctcgccctgtacagagacacacatcgcgtattagcaagtgtggttgggactactggcgtatccctgaacctgacccagctgccccccttcaatgtgcacctacaaaccaagcttgtgctgttggagaggctgcctaggccaagctag

SEQ ID NO: 179555 - DNA, 987 bp, Artificial Sequence
  Description of Artificial Sequence: Synthetic coding sequence
atgccccccacccagccccggccctgcatgtgccccatcagcaccacgcaggtggcctcccagtgtcgtggctgcacatcgtggtgccccccgcgccagacatcgttttgcacgctgacttggcaacctccgaggcaagtttgcctgggattctcaaagtctaccgccccaggaggcactacgagaggtagaatgtgctccaggggacaagcctgctggcacactcacacctccagctggcggcgtccctgggcgcccgggcccctgcaggggcataccccaggtcctggacaaagacgaggcgaccatcgctgcgagtccgagcctgacccaacggcacccctgcagagaccacctgcagacaaagctggtgcctccggagaggcgccaccagctgtgttgcgcggaacacggcagccttctgcagcaacaggactgcccggggcagttatcactacctcattctggcacaattcgtctacaattatgactatacagcggtctaaaagtaaggactgggcccctgcctctgatcggcatcagaccaggagccgggctagtagcacagccagtgctggagccctctcaactaaagagaggggggctcaggttctgctcgcgccccgggagccgcttccaagggtgatggtggctagctctggactacctgcaggcgactgtaggcccgaccaggtgccatttatgaccaaccaggagcagagggcccaccccgggacctgcttgccaggggggcatgtatgtcctgcccatcctggaggcgcggtgttctggcagcatcctacgttagcggcccggggccccctgggggcacccaaaacagcaccaccactacggggagaccatggtggcccaggtcgcacccctcctccatggtgtcaccactgcaatttctgcatccacaggcaccctatctctatcacagacaaaattctcggtgataaacacatccagaaagggatgcgctag

SEQ ID NO: 179556 - DNA, 2865 bp, Artificial Sequence
  Description of Artificial Sequence: Synthetic coding sequence
atgaacaaccaccagctggagctggccaagcagctgcacaaggaggggcacctcttttactgcacttgccgcgtcctgacctgccccggccaggctaagagcatcgcctctgctccgggtaagtgccaagatagcgccgctcttacttctacggccttcagcggactcgacttcggcttactgtccggttacctgcacaagcaggccctggttacagcaacccaccctacatgtaccctgctgtttccaagctgccacgccttctttcctctgcctctgactcccacgctctacaaaatgcacaagggatggaaaaactattgcagccagaagtctttaaacgaggcatccatggatgagtacctgggatcactcggactgttcagaaagttgaccgcgaaggacgccagctgcctgttcagagctattagtgagcagctcttttgcagccaggtgcaccaccttgaaatccgcaaagcttgtgtatcctatatgcgggaaaatcaacagacatttgaatcctatgtcgaaggttcgttcgaaaagtatctcgaacgcctgggcgatcctaaagaatcggcagggcagctggagattcgggccctttctctgatctataatcgcgactttattctctacaggtttcccggaaagccacccacatatgttaccgataatgggtatgaagataagatcctgctgtgctacagcagctctgggcactacgactccgtgtattccaagcagtttcagtcgagcgccgccgtttgtcaggctgtgctctatgagatactgtacaaggatgtctttgtagtggatgaggaggagctcaaaacagccattaaactgtttcggtccggcagcaagaagaaccgcaataatgccgtgaccggtagcgaagatgcacatactgattacaagtcctcgaaccagaatcgaatggaggaatggggggcatgctacaatgccgagaacattcccgagggctacaacaaaggcacagaagagaccaaatccccagagaatccgtctaaaatgcccttcccttacaaggtgctgaaggcgttggacccggagatttaccgcaacgtggaatttgatgtctggctcgattctaggaaggagctgcagaagagcgactacatggaatacgctggccgccaatattatttgggcgacaaatgtcaagtctgtttggaatcggagggacgatactacaatgcccatattcaggaggtcggcaacgaaaacaactcagtcacagtatttatagaagagctggccgagaagcatgtagtccctctggcaaacctcaaacctgtcactcaagtgatgtccgtacccgcttggaacgctatgccatctcggaaagggcgcggataccaaaagatgccaggtggctacgttccagagatcgtgatatctgaaatggacattaagcagcagaaaaaaatgttcaaaaagattaggggaaaagaggtctacatgacaatggcttatggcaagggggacccactcctcccgccgaggctccagcactctatgcactatggccacgatccccccatgcactatagccagaccgctggtaatgtgatgtcaaatgagcattttcacccacagcatccgagtcctcgacaggggagaggctatggaatgccacgtaactcatcacggtttataaacaggcataacatgcctgggcccaaagtcgatttctaccctggtcccgggaaacggtgttgccagagttacgataacttcagctatcgtagcagatctttccgccgatctcaccgtcagatgagttgtgtcaacaaagaatcccagtacggttttacaccaggcaacggtcagatgcctcgagggctggaagagacaatcaccttttacgaagtggaggaaggggacgagactgcctacccaaccctccctaatcacggtggaccttcgacaatggttccggcgaccagcggatattgtgtcgggagacggggccattcttcaggcaagcaaaccctcaacctggaggagggtaacggccagtcagaaaatggccggtaccacgaggagtatctgtatcgagctgagcctgactacgagacatccggggtctactcaacaacagcctccaccgctaatctgtctctgcaggaccgcaagagctgttcaatgtcccctcaggataccgtgacttcttataattatcctcagaaaatgatgggcaatatcgccgctgtcgcagcgagctgcgcaaacaacgtacccgctccagtgctgagtaacggagcggcagcgaaccaggcaatctcaactacaagcgtttccagtcagaacgccatccagcctctattcgtcagccccccaacccacggtcggcctgatacaaaggttctccagtactactttaatctgggacttcagtgctattatcattcttactggcatagtatggtgtatgttccacaaatgcaacaacaattgcacgtcgaaaactaccctgtgtacaccgagccccccttggtggatcaaacagtgccacagtgttactccgaggtgaggagggaagacggcatacaggccgaggcatcggctaatgatacctttcctaatgcagattcttcgtcagtaccccatggcgccgtctactatcctgtgatgtcagacccttatgggcaaccaccgttacccgggtttgattcttgccttcccgttgtgcccgactacagttgcgtcccaccttggcacccagtgggcaccgcttatggcggctcctctcagattcatggtgctatcaatccaggccctattgggtgtatcgcaccctccccacctgctagtcattacgttccgcagggcatgtag

SEQ ID NO: 179557 - DNA, 498 bp, Artificial Sequence
  Description of Artificial Sequence: Synthetic coding sequence
atgaagtgcgtgttcgtgaccgtgggcaccaccagcttcgacgacttgattgcttgcgtttcggcccccgacagcctccaaaagattgagagcctgggctataatcgacttattctccagattggtcgggggactgtagtgcctgagcctttttccacggaatcgtttaccctggatgtgtaccgctataaggacagcttgaaggaagatatccaaaaagccgaccttgtgatctctcacgccggggcaggctcatgcctggaaaccctcgagaagggtaagcctctcgtggtcgtcatcaacgagaagctgatgaataaccaccagctagagctggccaagcagctccacaaagaaggacacttgttttattgcacctgtagcaccctcccgggcctgcttcagtctatggatctctccacccttaaatgctatcctccaggtcaacccgagaagtttagcgcttttctggataaagttgtaggcttgcagaagtag

SEQ ID NO: 179558 - DNA, 3414 bp, Artificial Sequence
  Description of Artificial Sequence: Synthetic coding sequence
atgaagtgcgtgttcgtgaccgtgggcaccaccagcttcgacgacctgatcgcatgtgtgagcgcccctgactctctgcagaagatagaatccctcggttacaatcggcttattctacagatcggacgtggtaccgttgtacctgagccatttagtactgagtcctttacactggatgtgtacaggtataaggattccctgaaggaggacattcaaaaggctgacctggtgatctcgcacgctggggcgggctcatgcctggagaccctcgaaaaaggaaaaccacttgttgttgtcattaacgaaaaacttatgaataatcaccaattggaactggctaaacagttgcacaaggaaggccatctgttttactgcacatgtagggttcttacctgcccagggcaagctaaaagcatcgcctccgctcctggcaagtgccaagattccgccgctctgacatcaactgcgttctctggcctagattttgggcttctcagcggctacctacataagcaggccctcgtcaccgccacacatccaacttgtactttgctcttcccctcttgccacgccttttttccactgcctttgactccaaccctttacaaaatgcataagggatggaaaaactactgctcccagaagtctttgaacgaagccagcatggatgaatatctgggaagcctcggactattccggaagctgaccgcgaaggacgctagttgtctgtttcgggcgatttcggagcagctcttctgtagtcaggtgcaccatcttgagatccgcaaggcctgtgtgtcatacatgagggaaaatcagcagacattcgagagctacgtggagggctccttcgagaaatatctggagcggctgggggatccaaaggaatccgccggtcagctcgagattcgcgcgctcagtcttatctataatagggattttattctttatcgtttccccggaaaaccacccacctatgtgacggataacggctatgaagacaagattctcctgtgctatagctcatctggccattacgacagcgtgtacagcaagcaatttcagtcttcggctgctgtctgtcaagccgtgctctatgagattttgtataaagatgtctttgtggtggatgaagaggaactcaagacggctatcaagttgttccggagcgggagtaagaagaaccggaacaacgccgtgacaggctcggaggacgctcacactgattacaagtcctctaaccagaaccgcatggaagaatggggagcctgctacaacgcagagaacataccagagggctacaacaaaggcactgaggaaacaaagtcccccgagaatccatccaagatgccgtttccatacaaagtcctgaaagcactggatcctgagatctacaggaacgtggagttcgatgtgtggctcgactctcggaaagagctgcagaagagtgattatatggaatacgctggcaggcagtattatttgggagacaagtgccaagtatgcctcgaatctgaaggacgctactataacgcccatatccaggaagtgggtaatgaaaataattcagtgactgtgttcattgaggagcttgccgagaaacatgttgtccccctggccaacctgaagcctgtgacccaggtgatgtctgtcccggcatggaacgcaatgccaagccgaaaaggcaggggatatcagaaaatgccaggcggttatgttccagagattgtgatcagcgaaatggacataaaacagcagaagaagatgtttaaaaaaattagaggcaaggaagtgtacatgacaatggcttacggaaagggggaccctctcttgcctcccaggctgcagcactcgatgcactacgggcacgacccccccatgcactacagtcagaccgcaggcaacgtgatgtctaacgaacacttccatccccagcatccgtcaccaaggcaggggcgcggctatgggatgccacgtaactccagccgattcatcaatcgccataatatgcctggccccaaggtggatttttatcctggacccggaaagcgctgttgtcagtcatacgacaacttctcctacagaagccggtcttttagaagaagccaccgacagatgtcttgtgtaaacaaagagagccaatacgggtttaccccgggcaatgggcagatgccacgcggactagaagaaactattaccttctacgaagtggaggaaggcgacgaaacggcctatcctactctgcctaaccatggagggccttcaaccatggtgcctgcaaccagcggatattgtgtcggcagacgggggcactcctctggcaaacaaacactaaacttggaggagggaaacggacagtcggagaatggccgataccatgaagagtacctctaccgcgctgagccagactacgaaacgtcgggcgtatattctactactgcttccaccgccaacttgtccctgcaggatcgtaaatcctgtagcatgagcccacaggacaccgtgactagttacaattatccccaaaagatgatggggaacatagctgccgtggccgcgagttgcgccaataacgtcccggcccccgtcttgtccaacggggccgcggctaaccaggctatttccaccacttcagtatcttcccaaaatgccatacaacccttgttcgtctctccgcctacccatggaaggccagttatcgcatcaccttcgtatccctgccacagcgccataccgcatgctggggcctccctccctcctccacctcctcctcccccacctcccccccccccgccgcccccccccccccctccaccaccccccccccctcctccagcattggacgttggtgaaacttctaacctccagccccctcctccactgcctccacccccatattcctgtgaccctagtggctctgatttgccgcaggatacaaaagtgctccagtactatttcaacctcggccttcagtgttattatcactcctactggcatagcatggtctacgttccccagatgcagcaacagctgcatgtggagaactaccccgtgtatacagagcccccgctggtggaccagaccgtgccacaatgctacagtgaggtcagacgggaagacggaatacaggcagaggcctcagcgaacgatacatttccgaatgctgactcgtcaagcgtgccccatggagccgtgtactatccagtcatgtctgatccatacggtcagccaccactacctggctttgactcatgcctgcctgtagtgccagattattcctgtgtgccaccctggcaccccgtggggactgcctacgggggaagcagccagatccacggcgccatcaaccctggcccgataggctgtatcgccccaagtccacctgcaagccactacgttccacagggcatgtag

SEQ ID NO: 179559 - DNA, 651 bp, Artificial Sequence
  Description of Artificial Sequence: Synthetic coding sequence
atggtgtgcgtgctggtgctggccgccgccgccggcgccgtggccgtgtttctgattctgagaatttgggtggttctgcgttcaatggacgtgacgcctagggaaagcctgtcaattctagtggtggccgggtccggagggcataccacagagatccttcggctactcgggtcactcagtaacgcgtattccccgagacactatgtaatcgccgacacagacgagatgagtgcaaataagatcaacagcttcgaactggaccgagctgatagggatccatcaaatatgtacacaaagtattatatccatcgcataccaagatccagagaggtgcagcagagctggccaagtacagtgttcacgacattgcactcaatgtggctctcttttcctctgattcatcgggtgaaaccggatctcgtactgtgtaatggccctggcacatgtgtgccaatttgcgtgtcagctctcttactgggaatactgggaataaagaaggtgattatcgtttatgtggaatcaatttgccgagtggaaactctgtccatgtcgggcaagattctgttccacctatctgattatttcatagtccaatggcccgccctgaaagaaaagtatccgaaatctgtgtacctcggccggattgtatag

SEQ ID NO: 179560 - DNA, 972 bp, Artificial Sequence
  Description of Artificial Sequence: Synthetic coding sequence
atgcccctgctgaagctggtgcacggcagccccctggtgttcggcgagaaattcaagctgtttaccctggtctctgcgtgtatccctgtctttagacttgcacggaggagaaaaaaaatcctgttctactgtcattttcccgatctgctattaaccaaacgggattcatttcttaaacggctgtatcgggcccctatcgattggattgaggaatacactaccggcatggctgactgcatcctcgtaaatagccagtttacggcagcagtgttcaaagaaactttcaagtccctgagtcacatcgacccggatgtgctgtaccctagcttgaatgtaacttccttcgactccgtggtccctgagaagctagacgatctggtaccgaagggcaaaaagttcctgctcctctcgatcaatcggtatgagcgcaagaagaacttaactctggccctcgaagcacttgtgcagctgagagggcgccttaccagtcaggattgggaaagagtgcacttgattgtggctggcggctacgacgaaagagtgctcgagaacgttgaacactatcaagagctgaagaagatggtgcaacagtccgacctcgggcagtatgtgaccttcctgcggtcatttagtgataaacaaaagatcagtctgctgcacagttgtacctgcgtcttgtacaccccctctaatgagcactttggtatcgtcccgttagaggccatgtatatgcagtgtccagtaatcgcagttaacagcggtgggcctctggagagcatcgatcactccgtgaccggatttttatgcgagcctgaccctgtgcacttcagcgaggctattgagaaattcatccgagagccaagtttgaaggctacgatgggactagctggtcgcgccagagtaaaggagaagttttctccagaggccttcactgaacaattatatcgctatgtcacaaaactactcgtctag

SEQ ID NO: 179561 - DNA, 1251 bp, Artificial Sequence
  Description of Artificial Sequence: Synthetic coding sequence
atggccgaggagcagggccgggagcgggacagcgtgcccaagccctcagttctcttcctccaccccgacctaggggtgggtggcgcggagcgattggtgctggacgcagccctcgccttacaggcaagaggatgctccgttaagatctggaccgcccactacgaccccggccactgctttgccgaatcaagagagttgcctgtgagatgtgctggcgactggctgccacgcggacttggctggggtggccggggggctgccgtttgcgcttacgtgaggatggtttttttggcgctgtacgtcctgttcctggccgatgaagagttcgatgtcgtggtttgcgatcaggtgtcggcttgcatccccgtgtttaggcttgcccgccgacggaaaaagattcttttttactgtcacttccccgatcttctgctcacaaagcgggactcctttttgaagcggctttatagggcacccatagattggattgaagaatataccaccgggatggccgactgtatcttagtaaactctcagtttactgctgctgtattcaaagaaacatttaagagtttaagtcacatcgatcccgacgtgctgtacccaagtctcaacgtgacatcctttgatagcgtcgtcccggagaagctcgacgatctggttcctaaaggaaagaagtttctgttgctctctatcaataggtacgagaggaagaagaatcttaccctggctctggaggcgctggtccagctccgtggccgccttacgagccaggactgggagcgcgtgcatctgattgtggctggcggatatgacgagcgagttctcgagaacgtagagcactatcaggagctgaaaaagatggtacagcagagtgacttggggcagtacgtaactttcctgcggtccttctctgacaaacaaaagattagtctgttacactcttgcacctgtgttctatacacaccctcaaatgaacattttggcatagtcccactcgaggccatgtatatgcagtgccccgtgatagcagtgaattctggtggcccgcttgagagcatcgatcattcagtgacaggctttctttgtgaacctgacccagttcacttctcagaggccattgagaaatttatcagagagccttccctgaaggcaaccatgggcttggctgggagggcccgggtgaaggaaaaattctctccagaggcattcactgagcagctctataggtatgttactaagctgttggtttag

SEQ ID NO: 179562 - DNA, 1317 bp, Artificial Sequence
  Description of Artificial Sequence: Synthetic coding sequence
atggccgccggcctgcggaagcggggccggagcggcagcgccgcccaagcagagggattgtgtaagcagtggctgcagcgcgcttggcaagagcggcgcttattgcttagagagcccagatataccttgctcgtggcagcttgtctgtgtctggcggaggtcggcattacgttctgggtcattcatagagtagcatacaccgagatcgactggaaagcttacatggccgaagtggaaggagtaattaacggcacttatgactacactcaacttcagggcgatactggccctttggtttatcctgccggatttgtatacatatttatggggctgtactacgccacgtcgaggggcactgatatcaggatggctcagaacattttcgccgtcctttacctcgccaccctcctgctcgtgttccttatataccaccagacctgcaaagtccccccgtttgtgttttttttcatgtgttgcgccagctatcgggtgcacagtatcttcgtgctgaggcttttcaatgatcccgtggctatggttttgctcttcttatcaattaacctgttgctggcccagagatggggttggggatgttgttttttctctctcgccgtgtcggtaaagatgaatgtcttgttgttcgcccccggcctcctgttcctgttgctgacccagttcgggttccggggggctctccccaagctaggcatctgcgctggtcttcaagtggtcctcgggcttccattcctcctagagaatccatccgggtacttgtcgcggtccttcgatcttgggagacaattcctctttcactggactgttaactggaggttcctgccggaggccctcttcctgcacagggcattccacctggcgctgttgacagcacacctgaccctgcttctcctgtttgccctttgtcgatggcatagaacaggagagtccattctgtccctcttgcgggatccatccaagaggaaggtccccccccagcctctgactcccaatcagattgtatccactctcttcacgagtaatttcatcggtatctgcttttcacgttcactgcattatcagttttacgtgtggtatttccataccttaccctacctgctgtgggccatgccagcccggtggctgacacacctgttgaggctgctggttctgggccttatcgagctgtcatggaacacatacccttccacatcttgctctagcgcggcacttcacatctgtcatgccgtcattctcctccagctttggctgggtccacagccattccctaaatctacccagcactcaaagaaggcgcactag

SEQ ID NO: 179563 - DNA, 1149 bp, Artificial Sequence
  Description of Artificial Sequence: Synthetic coding sequence
atggccgccgcccggctggcccgggccgcccccgccgccgccggcgctgccctgcatgccgcagggggccgactccctcttcctggagggggcggtcatcaccttttgggacactctcagggaggtatgtatcctgcaggattcgtgtatatattcatgggcctgtattacgctacttctcgcggcactgacattagaatggcccagaacatctttgctgtcctgtacctggcgacactgctactcgtttttctcatctaccaccaaacctgtaaagtgcctcccttcgtgtttttctttatgtgctgtgcatcttatagagtccattcgattttcgtgttaagactttttaatgaccccgtggccatggtactattgttcctgtctatcaaccttcttttagctcagcgctggggctggggatgctgcttcttctcactcgccgtcagtgtcaagatgaacgtgctgctgttcgcgcccggtctcttattcctgctgctgacacaatttggcttccgaggagctctgccgaaactcggaatttgcgctggtctccaagttgttttagggttgcccttcctattggaaaacccgtccggatacctcagtcgctcgtttgacttggggagacagttcctgtttcactggactgtcaactggcgattcttgccggaggctctgttcctgcatcgagccttccatctggctctgctcacagcccacctgactcttttgcttctattcgccctgtgcagatggcacagaactggcgagagcatcttaagcctcctacgcgatccttcaaaacgaaaagtcccaccccaaccgctcactcccaatcagatcgtatctacactgttcacttcaaacttcatcgggatttgtttttctcggtctcttcattaccagttctatgtttggtattttcacaccctgccctatctgttgtgggctatgcctgcccggtggctaacacacctactacgcttactggtgctgggcctcatcgagttgagttggaatacataccctagcacctcttgcagctccgccgctctgcatatctgtcacgcggttattctcttgcagctgtggctggggccccagccattccctaagtccacccagcatagcaaaaaggcccattag

SEQ ID NO: 179564 - DNA, 1530 bp, Artificial Sequence
  Description of Artificial Sequence: Synthetic coding sequence
atggagaagtggtacctgatgaccgtggtggtgctgatcggcctgacagtgcgatggacagtgtcactgaactcatattccggcgcaggaaagcctcctatgtttggagactacgaagctcagcggcattggcaggagatcacctttaatctgcccgttaagcaatggtacttcaatagtagcgacaataaccttcagtattgggggctggattatcctcccctaactgcataccactccctcctctgcgcatacgtggcgaagtttatcaatccagattggattgccctacatacctcaaggggctatgaatctcaagctcataagctgttcatgcgcaccacagtcctgatcgcagacctgctcatctatattcccgctgtcgtgctctattgctgctgcctcaaggagatcagtaccaagaagaagatagccaatgctctgtgtattctactgtatcctgggctgatcctgatagattatggccacttccagaatatatataactccgtgagcctgggcttcgctctttggggggtgctgggcatctcatgtgactgtgaccttctcgggtcacttgcattttgtctggcaatcaattataaacagatggaattgtatcacgctctccccttcttttgcttcctccttggaaagtgttttaagaagggcctcaaaggaaaaggattcgtgttacttgtcaagctggcctgcattgtagtcgcgtccttcgtgctgtgctggctgcccttcttcacagagcgcgagcaaaccttacaagttcttcgcagacttttccctgtggaccgaggcctgtttgaagataaagtggctaatatctggtgttcattcaacgtgttcctcaagatcaaagatattcttcctagacacatccaactgatcatgtctttctgttctacttttctgtcactcctgcctgcctgcattaagctcatccttcagccctcttccaaggggttcaagttcacactggttagttgcgcgctgagcttctttctgttttcatttcaggtgcacgaaaagtcaattcttctggtatcactcccagtgtgtttagttttgagtgagatccccttcatgtcaacctggttcctgcttgtgtctacatttagcatgcttcccctattacttaaagacgaactgctaatgccctccgtagtcacgactatggcattttttatcgcatgcgtgacctcgttttcaattttcgaaaagacgtcggaggaggagcttcagctgaaatcctttagtatcagcgttcggaaatatctaccttgcttcactttcctgtctcggataatacaatacctgtttctcattagtgtcattaccatggtgttgctcactctcatgaccgtaaccctggatcctccgcagaagcttcccgacctcttttctgtgctggtttgtttcgtcagttgcctcaactttctgttctttctggtgtattttaatatcattataatgtgggactcaaaaagtggacgtaaccaaaaaaagatcagctag

SEQ ID NO: 179565 - DNA, 1524 bp, Artificial Sequence
  Description of Artificial Sequence: Synthetic coding sequence
atggagaagtggtacctgatgaccgtggtggtgctgatcggcctgacggtgagatggactgttagtctgaatagctacagcggtgccggcaagccacccatgttcggagactacgaggcccaacggcactggcaggaaataacttttaatctgccagtgaaacaatggtactttaatagttcagacaataacttgcagtactggggtcttgactacccccctctgacggcttaccactctttattgtgcgcttacgtcgccaagttcattaaccctgactggatcgctcttcacacaagtcggggatacgagagccaagctcataagttatttatgaggacgactgtgctcattgcagatctcctgatttatattcccgcagtcgtactgtactgctgctgtttgaaagagatatcgacaaaaaagaaaatcgcaaacgctctgtgtatcctgctgtacccggggctcatactgatcgactacgggcatttccagtataactctgtgagtctggggttcgcgttgtggggagtgttgggaatctcatgcgattgcgatctccttggctccctcgccttctgtctagctattaattataagcagatggagctgtaccatgctttgccattcttctgttttctgctcggaaagtgcttcaagaaaggtctgaaaggaaagggatttgtactcctcgtgaagttagcttgtatcgtggtagcatcctttgtgctttgttggctacctttttttactgaacgcgagcaaactctccaagtattgaggcggctctttcccgtcgacagaggtctcttcgaagataaggttgcaaacatctggtgctccttcaatgtgtttctgaagattaaagatattctgccccgacacattcagttgattatgtctttttgtagcaccttcttgagtttactgcctgcttgcataaagttgatcctgcagccctcctcaaagggattcaaatttacccttgtctcttgtgccctgagtttctttctcttttcttttcaggtgcacgagaaatcaatcctgcttgtttctttgccagtgtgcctggtcttgagtgaaattccgtttatgtccacttggtttctgctggtgagtactttttcgatgctgccccttctgttaaaagatgaattgctcatgccttcagtcgtaactacaatggctttcttcattgcctgcgtaacttcttttagcatctttgagaagacttccgaagaggagctacaactgaagagcttttctatttccgtgagaaagtatctgccctgctttactttcctgtctaggatcatccagtacctcttcctgatctctgttatcacaatggtgctgctgactttaatgacagtgactctggatcctccccagaaattgccagacctcttctcggtgctggtctgctttgtgagttgcttgaactttctgttttttcttgtgtacttcaatattataattatgtgggactctaagagcgggagaaaccagaaaaagatatcgtag

SEQ ID NO: 179566 - DNA, 765 bp, Artificial Sequence
  Description of Artificial Sequence: Synthetic coding sequence
atggagctgtaccacgccctgcccttcttctgcttcctgctgggcaaatgcttcaaaaagggcttaaagggcaaggggttcgtgctcctcgtaaaactcgcttgtattgtcgttgccagctttgttctgtgttggctgccgttttttacggagagggaacaaacgcttcaggtcctgcggcgcttattcccagtcgatcggggattattcgaggataaggtcgctaatatttggtgttctttcaacgtgtttcttaaaatcaaagatatcttgcctcgtcatattcagctgattatgcggcctgtttgtcttgtactgagtgaaatccctttcatgtcaacttggtttcttctggtgtcgacattttctatgcttccattgctgctcaaggatgaactcctgatgccttcagtggtgaccacaatggctttctttatagcatgcgtgacctcattctctatattcgaaaaaacaagtgaagaagaactgcagctgaaatccttcagtatatctgtcaggaagtacctcccttgtttcactttcctgagtcgaattatccaatacctctttcttatttctgtgatcacgatggtcctcctgaccctgatgacagtaaccttggatccgccacagaaactgcctgatctgtttagcgttcttgtgtgctttgtctcctgtctgaatttcctgttcttcctggtgtattttaatatcattatcatgtgggacagtaaatctggtaggaatcagaaaaaaatcagctag

SEQ ID NO: 179567 - DNA, 1581 bp, Artificial Sequence
  Description of Artificial Sequence: Synthetic coding sequence
atggccgccctgaccatcgccaccggcaccggcaactggttcagcgccctggccctcggcgtcaccttgctcaagtgtctgctaatccccacctaccattctaccgacttcgaagtgcatcgcaattggctggccatcactcatagcctgcctatcagccagtggtattatgaagccacttccgaatggaccctggactaccccccattctttgcatggttcgaatacatcctctcccacgtggcaaagtactttgatcaggaaatgctcaatgtgcacaatctgaattattcatctagtcgcacccttctattccaacgcttttctgtgatattcatggatgtgctgtttgtgtatgctgtcagagaatgttgtaagtgtatcgatgggaagaaggtgggcaaggaactcacggagaaacctaaatttatattgagcgtgctcctgctttggaacttcggcttgttaatcgtggaccacatacacttccagtacaacgggtttctgtttgggcttatgttattgagcatcgctagattatttcagaaaaggcacatggaaggagcatttctgttcgcagtgctcttgcacttcaaacacatttacctatatgttgcccccgcatacggcgtgtatctgcttcgctcctactgcttcacggctaacaagccagacgggagcatcaggtggaaatccttctcctttgtgcgagtaatctccttaggactcgtagtgttcctggtctctgcactgtccctcgggccattccttgcactgaaccaactgcctcaggttttctcacgcctattcccgtttaagaggggactatgccacgcgtattgggcccccaacttctgggctctgtataacgcactcgataaggtgctcagcgtcattgggctcaagctcaagttcctggatcccaataacattcccaaagcatccatgacttccgggctggtccagcagtttcagcatacagtgctgccctccgtcaccccactggctacccttatttgtaccttgatcgcgatcctgccctccatcttttgcttatggttcaaacctcagggcccccggggcttcctcaggtgtctgacgctctgcgctttatccagtttcatgttcggctggcatgtgcacgagaaagcgattctgctggccatcttgccaatgagcctgctgagtgttggcaaagcgggcgatgccagcatctttcttatactgaccactaccggccactatagtctgtttcctttgttatttacagccccagagctgccgatcaagattttactcatgttgctgtttacaatttacagcatcagctccttgaagacgttatttcgaaaagagaaacctctgttcaattggatggagaccttttacctcctcggactaggacctctcgaggtttgttgcgagttcgtgtttcctttcacttcttggaaggtcaaatacccgtttatcccactgctgcttacctctgtatattgcgccgtcgggatcacctatgcctggttcaaactgtatgtaagtgtacttatcgactccgctatcggtaaaacaaaaaaacaatag

SEQ ID NO: 179568 - DNA, 1404 bp, Artificial Sequence
  Description of Artificial Sequence: Synthetic coding sequence
atggccgccctgaccatcgccaccggcaccggcaactggttcagcgcactcgcgctcggggtcacactgttgaaatgtctccttatccccacttaccattctaccgacttcgaggtccaccgcaactggctggccattactcatagtctgcccatctctcagtggtattacgaagccacctcggagtggaccctggattacccaccattttttgcctggtttgaatacattttgagccacgtagccaaatattttgaccaggagatgttgaacgttcacaatctaaattattctagcagtcggaccctgctttttcaaagattttccgtaatcttcatggatgtgttgttcgtgtacgcggtacgggagtgttgtaagtgcatcgacgggaaaaaggtaggaaaggagctaaccgagaaaccgaagtttatcctgtctgtgctgctgctttggaatttcggtctgctcatcgtggaccacatccactttcagtacaacggatttttgtttggtctgatgcttctctccattgctcgcctatttcagaagcggcatatggaaggagctttcctgtttgctgtgttgctgcacttcaagcacatttatttgtatgtcgcccctgcgtacggcgtgtatctgctgaggtcttattgcttcacagccaacaagccagacgggagcattcggtggaagtcattttctttcgtgagggtaatctccctgggtcttgtggttttcctggtgtcagccctgagtctgggacccttcctggccttgaaccagttgccccaggtgtttagtaggttgtttccctttaaacggggtctgtgccacgcctattgggccccaaacttctgggccctgtataacgccctggacaaggtcctcagcgtgatagggctcaaattgaagttcctggatcccaacaatatccccaaagctagtatgacgtctggattggtccaacagtttcagcataccgtccttccttctgtgaccccactggctacgctgatctgcaccttaatcgccattctgccatcaattttttgcctatggttcaaacctcaggggccacgtggctttttgcggtgtttaactctgtgcgcgctgtcatcttttatgttcggttggcatgtgcatgagaaggcgatcctgctggctattctgccaatgtccctgctctccgtgggcaaagcgggagatgcgtcaatcttcctcatccttaccactacaggacactattccctgtttcctttgctcttcactgccccagagctcccaattaagatcctgctcatgctcctcttcacaatatattcaatttcttcgctgaagaccctctttcgacgctcatttacactggtagctcaggctggggttcagtggcatgacctgagttag

SEQ ID NO: 179569 - DNA, 1323 bp, Artificial Sequence
  Description of Artificial Sequence: Synthetic coding sequence
atgatgctggccttcctggtgctgagcaccggcatgttctgcagcagttccgcttttctgccttcaagtttttgtatgtacacgactctgattgctatgacagggtggtacatggataaaacctcaatcgccgtcctgggagtcgctgctggcgcaatattgggatggccatttagtgcagccctgggcttgccaattgccttcgacttactcgtgatgaagcaccggtggaaatcctttttccactggtccttaatggccttgattctgtttctcgttccggttgtggtcattgatagttactactatggaaagttggtgatagcgccactaaacattgtcctctacaatgtgtttacccctcacggaccagatctctacggcaccgagccttggtatttctacctgattaacggtttcctcaacttcaacgtggcattcgccctggccctattggtgctacctctgacctctttaatggagtacttactgcagagattccatgtgcagaacttgggccatccctattggctgactctcgcccccatgtatatatggttcataatcttttttatacagccccacaaagaagagagattcctgttcccggtctatcctttaatctgcctctgcggagcagtagccttatcggctcttcagaagtgctatcattttgtctttcagaggtatcgcctagagcactacactgtgacaagcaattggctcgcactgggaactgtcttcttattcggccttctcagttttagccggtccgttgccctgttccgaggctaccatggccctcttgacttgtaccccgagttctaccgtatcgcgacagatcccaccatccacacagtgcccgaaggaagacccgttaatgtttgcgtggggaaggagtggtatcgatttcccagtagctttctgctgccggataactggcaactgcagtttatccctagtgaattccgaggacagctgccaaaacccttcgccgaaggaccccttgcgactagaattgtacctaccgacatgaatgatcagaacctggaagagcccagtcgatacatcgatatttctaagtgccactatttggtggacctggacactatgagggagaccccacgagaaccgaaatactcaagcaacaaagaggaatggattagcttagcttacaggccttttctcgatgccagtcgctcaagcaagctgttaagagctttctatgtgccttttctgagtgatcagtatactgtctacgtgaattatacgatcctcaagcctagaaaggctaagcagatccgcaagaaaagcggcggctag

SEQ ID NO: 179570 - DNA, 2535 bp, Artificial Sequence
  Description of Artificial Sequence: Synthetic coding sequence
atggccccccggcggctgctgctggtgggcgagggcaacttcagcttcgcagccgcgctatctgaaacactagaccagagcactcagctaaccgcaacctgccttcaacgtcccgcggagcttgcccgcgaccctcttgcctgggaaaacctgcagtgtctgcgggaaagaggcattgatgttcggttcggcgtggattgtactcagttggccgatgtcttcgagctccatgaaagagagttcgatcaaatttacttcatctttccccattgtgggcggaaggccggtgtggccaagaatcgcgaactgttggccaaattttttcagagctgcgcagatgttcttgccgaggaaggagaagtgcatgtcgctctgtgtcgcgggcagggcggaactcccgccgacaaaccacagcgcgagtggcataactcttggcaagtggttgccatggccgcactcggggggttgatcctgtctgacgtgtatccgttctcatgtaaggccgtggccggatataaatgcacaggctatcgttcccaggataagtctttccacgtggaaggtgccctgaatcacatattcacgagatcgctgccattcgaggggtctcagcctcgaattttccgaatcaaactggggaatcagtggttcagctttcccgagccagaggccctggtggggaagctgaatagactggcaatggccagccgaggtgccaggcagaggctgaagggctcgggcgcgtcctccggagacactgctccagcagcagataagctgagggaattattgggctccagagaggccggtggtgccgagcatagaacagaactgtctggaaacaaggctggtcaggtgtgggctcctgagggcagcaccgcattcaaatgtcttcttagcgcccgactctgcgccgccctgctttctaatatttctgactgcgacgaaacttttaattactgggaaccaacccactatctcatatacggtgaggggtttcaaacttgggagtattctcctgcctacgcgattagaagctatgcatacttgctcctgcacgcttggccagcagcattccatgcaaggatcttgcaaaccaataagatacttgtgttttactttttgaggtgtttgcttgctttcgtcagctgcatctgcgaactgtatttctacaaagctgtgtgtaaaaagttcggcctgcacgtttctagaatgatgcttgcattcctagtgctctcaaccggcatgttttgttcttcatcagcattcctgccctcttctttttgcatgtatacaaccctgattgccatgactggctggtacatggataagaccagtatcgcagtactcggagtagcagcaggggcaatcctgggttggcctttctcagccgccttaggcctaccaatcgctttcgacctcctagtaatgaagcacaggtggaagtcgttcttccattggtctctcatggccttgattttgtttctggtccccgttgtggtgatcgatagttattattatggcaagctggttatcgccccactcaacattgtactctataacgtttttacaccccatgggcccgacctgtacgggacggagccctggtatttctatcttattaacgggtttctgaatttcaatgtggcgtttgctttggccctccttgttctgccgctgacatctcttatggagtatctcctgcagagattccatgtgcagaatcttggtcatccctactggctcacgctggcccccatgtacatctggtttattatcttcttcatccaacctcacaaagaggagcgattcttatttcccgtctaccctctgatctgcctgtgcggcgccgttgccctctccgctctgcaaaaatgctaccacttcgtgttccagcgctataggctggagcactacaccgtgacatcaaactggctagcccttggcaccgtctttttatttgggcttttatccttctctcggtctgtggcgctttttaggggttatcatgggcccctggacttatacccagagttctaccggattgcaactgatcccaccatccatacggttcctgaaggccgcccagtaaacgtgtgcgtaggtaaggagtggtaccgtttccccagctcttttcttcttccagataattggcagctgcagttcattccgtccgagtttagggggcagctgcctaaaccgttcgccgagggcccactggctaccaggatcgtgcccactgatatgaatgatcaaaacctggaggagccatctcggtatatcgacatttccaagtgccattatctggttgatctggatactatgcgcgagacaccgagagagcctaagtattctagcaataaggaagaatggatcagtctggcgtatcggccattcctcgacgctagccgatcttccaagctacttcgagccttttacgttcctttcctgtcagatcaatacaccgtgtatgttaactacactatcctgaagccacgaaaggctaagcagattaggaaaaagtcggggggttag

SEQ ID NO: 179571 - DNA, 1344 bp, Artificial Sequence
  Description of Artificial Sequence: Synthetic coding sequence
atgatgctggccttcctggtgctgagcaccggcatgttctgcagcagtagcgcttttttgccatcttctttttgcatgtatactactcttattgctatgaccggttggtacatggataagacttccatagccgtccttggcgttgccgccggcgctattctgggatggcctttctcagctgccttggggcttccgattgcgttcgacttactcgtaatgaagcatcgatggaagtcattcttccactggtccctgatggcgctcatcttgttcctagtgccggtcgtcgtcattgattcctattactatggaaaactggtaatagctcccctaaatatcgtcttgtataacgtctttacgccccatggcccggacctgtacgggaccgagccatggtatttctatcttatcaatggcttcctaaactttaatgtggcctttgccctggccctgctggtcctgccactgactagcctgatggagtatctgctgcaaaggtttcacgtgcagaacctaggccatccgtactggttgacattggctcctatgtatatttggttcattatcttcttcatccagccccataaggaggagcgcttcctatttcccgtgtacccactcatttgcctgtgtggcgccgtggctctcagcgccctgcagcattccttcctgtacttccagaagtgttaccattttgtctttcagcggtataggctagaacactataccgtgacaagtaattggctggccctcggaaccgtctttctctttggcctgctgagcttcagcaggtctgtcgcactgttccgtggttaccatggaccactggatctgtatcccgagttttaccgcatagcgacggatcccactattcacactgttcccgaggggcggcccgtgaacgtgtgcgtcggcaaggagtggtatcgctttccctccagttttcttctgcccgataattggcagttgcagtttatcccctcagagtttaggggccagctccctaaaccattcgccgaaggccccctggctacacggatcgtccctacagatatgaacgaccaaaacctggaagagccctccagatacatcgatatctctaaatgtcattatctggtggatctcgacaccatgcgggaaaccccgcgagaaccaaagtattcgagtaacaaggaagaatggatctcgctggcgtaccgtccattcttggacgccagtcgatcttcaaagctgcttcgagctttttatgttccattccttagcgatcagtacaccgtttacgtgaactatacgattcttaagcctcgcaaagctaaacagattcggaagaagagcggcggctag

SEQ ID NO: 179572 - DNA, 1647 bp, Artificial Sequence
  Description of Artificial Sequence: Synthetic coding sequence
atggtgctggccgagctgtacgtgagcgaccgggagggcagcgacgccacaggggatgggactaaggagaagccattcaaaacgggcctgaaagctctcatgactgttgggaaagagcccttcccaactatctacgttgattcacagaaggaaaacgagaggtggaacgttatatcaaaaagccaactcaaaaatattaagaagatgtggcatcgcgagcagatgaagtctgagagcagggaaaagaaagaggccgaagacagcctgagacgggaaaaaaacctggaagaggcaaagaagatcacgattaagaatgacccctcactacccgaaccaaagtgcgtcaaaatcggagcacttgaaggctacagagggcagagagtgaaggtattcgggtgggtccacagactccgcagacagggcaagaacctgatgtttcttgttcttcgggacgggacgggttatctgcagtgtgtcctggccgacgagctctgccaatgttacaatggggtcctgctaagcactgagtctagtgtagctgtgtacgggatgctgaacctaacgcccaaggggaagcaggcacctgggggacatgaactgagctgcgacttctgggaattgattggattggcccctgcaggtggtgcggataacctgatcaacgaggaatccgatgtcgatgtgcagctgaacaatcggcacatgatgatccgaggggagaatatgtctaaaatcctcaaggcccgctccatggtgaccaggtgttttcgcgaccatttcttcgatcgtggttattacgaggtcaccccccctaccttggtacagacccaagtcgaaggcggagccactctcttcaagctcgattatttcggcgaagaagccttcttgactcagagctctcaactgtacctggaaacctgtttgcccgcccttggcgatgtcttttgtatcgcccagtcctaccgcgcagagcagagccgtacccgaagacacttggcagagtacacacacgtcgaagcagagtgcccattcttgacctttgacgatctgctcaacagactcgaagatttggtttgcgacgtggtggataggatcctgaaatccccagcaggcagcattgtgcatgaattgaaccccaatttccagccacccaagcggccatttaaacgcatgaattactcagacgcgattgtctggctgaaagaacacgatgtgaaaaaggaggatggaaccttctatgagttcggtgaagacattcctgaggccccggaacgacttatgacagacacgattaacgaacctattctcctttgccgattcccagtggaaatcaaaagcttctacatgcaacgttgccctgaggatagccgtctgacagaatcagttgacgtgctgatgcccaacgtaggggaaatcgttggaggttcaatgaggattttcgatagtgaggagatccttgctggatacaaacgcgaaggtatcgatccaaccccttactactggtacaccgaccaacggaagtacggaacatgccctcatggtggatacggtctggggctggagcgatttctgacttggatcctcaacagataccatatacgcgacgtctgtctgtatcctcggtttgtgcaaaggtgtaccccgtag

SEQ ID NO: 179573 - DNA, 765 bp, Artificial Sequence
  Description of Artificial Sequence: Synthetic coding sequence
atgaccgtgggcaaggagcccttccccaccatctacgtggacagccagaaggaaaatgaacggtggaatgtgatatccaaaagccagctcaaaaacatcaagaagatgtggcatagggagcaaatgaagagtgaatctagagaaaagaaggaggccgaagattccctaaggcgggagaagaacttggaggaagctaaaaaaattactatcaaaaacgaccccagccttccagagccaaaatgcgtgaagataggggctttggagggatatcgcggccagcgcgtgaaggtgtttggctgggtgcatagactccgtcgacagggcaaaaacttaatgtttttagtgttacgcgatgggacaggatacctgcagtgtgtgctcgcagacgaattatgccaatgctacaacggagtcctgctctccactgaatccagcgtggctgtgtatggaatgctaaatctcacccctaagggcaagcaagctccaggtgggcacgagctgtcatgcgacttttgggagctgataggccttgctcctgctggcggagccgataatctgatcaatgaggaatctgatgtcgatgtgcagctgaacaatcggcacatgatgataaggggagagaacatgtcaaaaatactaaaggcaagatccatggtgacacgctgcttccgagatcacttctttgaccggggctattatgaagtttcaatgcactcgtccgctttcgcgaagaacatgttctttgccgtgctcaaactcgagtag

SEQ ID NO: 179574 - DNA, 900 bp, Artificial Sequence
  Description of Artificial Sequence: Synthetic coding sequence
atgtgcgaggactggtgcttccgggaccacttcttcgaccggggctactacgaggtcaccccacccacccttgtgcagacccaagtggaaggcggagctaccctttttaaactggactattttggagaagaagcttttctgacacagtcgtctcagctttatctggaaacatgcctgcccgcactaggcgacgtgttctgcatcgcacagtcatatcgcgccgaacaatcccgcacacgtcggcatctggccgaatacacccatgttgaagctgaatgtcctttcctgacctttgatgatcttctcaacagacttgaagacctggtgtgcgacgtggtcgaccggattctgaagagcccggcaggctccattgtccacgaactgaaccccaatttccagccaccaaagcgacctttcaagaggatgaattactccgatgcaatcgtgtggctgaaggagcatgatgtgaaaaaggaggacggcacgttctacgagtttggagaagacatacccgaagcccctgaaagactgatgacagacaccatcaacgagccaatactactctgccgctttcccgtcgagatcaagtcattttacatgcagcggtgtccggaagactcaagacttaccgaaagcgtcgacgtcctgatgcctaacgttggggagattgttggcgggtctatgcgcatatttgactcagaggagatcctggctggctacaagagagagggtatcgaccctactccctattactggtataccgaccagcggaagtacgggacctgtccacatggaggatacggactgggcctagaaaggtttctaacctggatcctcaataggtaccatatcagagatgtttgcttatatccccggtttgtgcaacgatgcaccccctag

SEQ ID NO: 179575 - DNA, 525 bp, Artificial Sequence
  Description of Artificial Sequence: Synthetic coding sequence
atggtgctggccgagctgtacgtgagcgaccgggagggcagcgacgctaccggagacggaactaaagaaaaaccttttaagaccggcttaaaagctttaatgaccgtggggaaggagccgttcccaacgatctacgtggatagccagaaagagaacgaacgctggaatgttattagcaagtcccagctaaagaatattaagaagatgtggcatcgcgagcagatgaaatccgagtcacgagaaaaaaaggaggctgaggattcactgcgcagagaaaagaacctcgaggaagctaaaaagataaccatcaagaatgatccgagtctccccgagcctaagtgcgtcaagattggggccctggaagggtacaggggccaaagggtcaaagtctttgggtgggtgcaccgcctccggcggcaagtcagcgtcctacaatggtctagcctagtgcacggtgaacaatgctgttccgtttggaacgcgaagagctatcccaaggggcaggctggatcaagatggccctag

SEQ ID NO: 179576 - DNA, 1434 bp, Artificial Sequence
  Description of Artificial Sequence: Synthetic coding sequence
atgctgggcgtgcggtgcctgctgcggagcgtgcggttctgcagctccgcaccattccccaaacataaaccatccgcgaaactgagcgttagagatgcccttggagcgcaaaacgcgtccggagagaggatcaaaatccagggctggattcggtccgtgcggagccagaaggaggtcttgttcctacacgtgaatgacggaagctccttagagtcattacaagttgttgccgactccgggttggacagcagggagttgaattttggctccagtgtggaggtgcaaggtcagcttatcaagtcgcccagcaaacgacagaacgtcgagctcaaagccgaaaaaatcaaggtgattggcaattgtgatgccaaagactttcccattaagtacaaggagcgccacccacttgagtatctaaggcagtacccgcacttccgctgccgaaccaatgtccttggtagcatcctgcgaattaggtccgaagctacagccgcaattcactcttttttcaaggactctgggttcgtgcacatccacactcccattatcacctcaaacgactcagagggcgctggcgaactcttccagctggaaccatcaggtaaactgaaggtccctgaggagaacttcttcaacgttcctgcctttctcactgtcagtgggcaacttcacctcgaggtgatgtctggcgcttttacacaggtgtttacgtttggccccacctttcgggcagagaattctcaatcacggaggcatctcgcagagttttatatgattgaagccgagattagcttcgtcgactctttacaagacctcatgcaggtaattgaagagctgttcaaggctacaaccatgatggtgctatctaaatgtcccgaggatgtcgagctctgccataagtttatcgctcctggccagaaagacaggctcgaacatatgcttaagaataactttttgattattagctacacggaggcagtcgaaatactgaagcaggccagtcaaaattttacttttacacctgaatggggagccgacctgaggacagaacatgagaaatacctcgtgaagcattgcggaaatatccctgtgttcgtgataaattaccctcttaccctgaagccattttacatgcgggacaatgaagatgggccgcagcataccgtggctgcagtggaccttctggtccccggagtgggggaattatttggtgggggcctaagagaggaacgctaccactttctcgaggaaaggctggccaggagcggcctgactgaagtctatcagtggtatctggacctgaggcggtttggaagtgtcccccacggcgggttcggcatggggttcgaacgttacctgcagtgtatcctgggtgtggataatattaaagatgtcattccatttccgaggttcccccactcctgcctgctttag

SEQ ID NO: 179577 - DNA, 942 bp, Artificial Sequence
  Description of Artificial Sequence: Synthetic coding sequence
atggcccagcggaagaacgccaagagcagcggcaacagcagcagctccggctcaggcagcggatcaactagcgccggatcatcaagtccaggggcccgcagggagacaaagcacggagggcataagaatgggcgaaaaggtggtctgtccggaacaagttttttcacatggtttatggtcatcgcactgctcggggtctggacgagcgtcgctgtcgtgtggttcgacctggtagattacgaagaggttctagggaagcttggtatttacgatgccgatggggacggcgacttcgacgtcgacgacgccaaggtgcttctgggcctgaaagaaaggagcacaagcgaacctgccgtcccaccagaggaggctgaaccgcacactgaacccgaagagcaggttcctgttgaagctgagccgcaaaacatcgaagacgaggctaaggaacagattcaatccctgcttcatgaaatggtgcacgctgagcatgtggaaggcgaggatttgcagcaggaagacgggcccacaggggaacctcaacaggaagacgacgaatttttaatggcgacagatgtggatgaccgcttcgaaacccttgaacccgaagtcagccacgaagagacagaacacagctatcacgtcgaagagaccgtcagtcaagactgcaatcaggacatggaagagatgatgtctgagcaggagaaccccgactcgagcgagccagtggtcgaggatgagaggctgcaccatgatactgacgacgttacctatcaggtgtatgaggaacaagctgtttacgagcccttagagaacgaggggatcgaaataacggaggtaaccgccccccctgaggacaatccagtcgaagattcacaggtcatcgtggaggaggtttctatctttcccgtggaggagcaacaggaggtcccacctgacacctag

SEQ ID NO: 179578 - DNA, 612 bp, Artificial Sequence
  Description of Artificial Sequence: Synthetic coding sequence
atggcccagcggaagaacgccaagagcagcggcaacagcagcagcagcggctctgggtctgggtctacaagtgctggctcttcgagtccgggtgctcggagagaaacaaagcatgggggccacaaaaatggccggaaggggggcctgagcggaacctccttttttacatggtttatggtgattgcactgcttggcgtctggacatccgtggcagttgtgtggtttgacctggttgattacgaggaggtattggctaaagctaaggattttaggtacaacctgagcgaagtactccagggtaaactgggtatttatgatgctgacggcgacggggacttcgacgtggatgatgctaaggtgttactgggactgaccaaagacggatctaatgaaaacatcgactcactggaagaggtactgaacatactagccgaagaaagcagcgactggttttatggcttcctgagtttcctttacgacatcatgactccatttgagatgctagaagaggaagaagaggaatctgagacagcggatggagtggatggcacatcccagaatgagggcgtgcaaggtaaaacttgcgtgatactggatctccacaaccagtag

SEQ ID NO: 179579 - DNA, 2277 bp, Artificial Sequence
  Description of Artificial Sequence: Synthetic coding sequence
atggcccagcggaagaacgccaagagcagcggcaacagcagcagctccggaagtggatctgggtcaacctctgcagggtcttcctctcccggagctcgcagggagactaaacacggcgggcacaaaaacgggaggaaaggaggtctgtccggtacaagctttttcacctggtttatggtgattgccctcttgggagtctggaccagcgtggcggtcgtctggttcgacctagtcgactacgaagaggtcctaggtaagttgggtatatatgacgccgacggcgatggcgactttgatgttgatgacgctaaggtcctgctgggactgaaggaacgaagtaccagcgagcccgcagtgccacccgaagaggccgagccgcacacagaacctgaggagcaggtgcctgtcgaagccgagccacagaatatcgaggatgaggcaaaagagcaaatccagtcactgctgcacgaaatggtgcacgccgagcacgtggaaggcgaggacttgcagcaggaggacggacccacaggtgagccccagcaggaggacgacgaatttttgatggctaccgatgttgacgatcgcttcgagactctggaaccagaagtctctcacgaggagactgagcactcataccatgtggaagagactgtgagtcaggattgtaaccaggatatggaagagatgatgagtgaacaggagaacccagatagtagtgaacctgtagtggaggatgaacgactccaccatgacacagacgacgtaacttaccaggtgtatgaggaacaggctgtttatgagcccttggagaacgagggtatcgagataactgaggtgacagctcctcctgaggacaatccagtggaggactcacaggttatcgttgaggaagtgagcatcttccccgtcgaggaacagcaggaagttcctccggagactaaccggaagacagacgacccagagcagaaggctaaagttaaaaagaagaaaccgaagctgctgaataagtttgataagactattaaagccgagttggatgccgcagagaagctgcgaaagcgaggcaaaatcgaggaggcagtgaacgcatttaaggaactcgttcggaagtatccacagagtccacgtgcccggtacggaaaggcgcagtgcgaagatgatctggccgaaaagcggagaagcaatgaggtcctgagaggggccatcgaaacttaccaggaagtggcctctctccccgatgtgccagcggaccttctgaagctgtcgctgaagaggaggagcgacagacaacagttcctgggacatatgcgcggaagtcttttgacactacaacggctggtccagttgttcccgaacgacacctcattgaagaacgacctgggggttggatatttacttattggagataacgataatgctaaaaaagtatatgaagaggtcttatccgtgacccccaacgacgggtttgcaaaggtacattacgggtttatccttaaggcccaaaataaaatagctgagagcattccctacctgaaggaggggatcgagtctggcgatcccggaacagatgacgggagattctattttcacctgggggacgccatgcagcgtgtgggtaataaagaagcttataagtggtacgagctgggacataagaggggtcactttgcctccgtttggcagcggagtttgtacaacgtgaacggtctgaaagcccagccatggtggaccccaaaagagacagggtacacagagttggtgaaatccctcgagagaaactggaaactgattcgcgacgagggactggcagtcatggataaagcgaagggtctctttctgcctgaagatgagaatctgagggagaagggggactggtcccaatttaccctatggcagcaggggcggcggaatgagaacgcctgtaagggcgcgcctaagacatgcacactgctggaaaagttcccagagaccaccggctgcagacgtggccagatcaaatattcaataatgcatcccggaacgcacgtatggccccacactgggcccaccaattgtagactgagaatgcacctcggtttagtgatccctaaagagggctgcaagattagatgtgccaatgagacaaagacttgggaagagggtaaagtgctgatctttgacgactcatttgagcacgaggtgtggcaagatgctagcagcttccgcctgatctttattgttgacgtatggcacccagaattgacgccacagcagaggagatccctgcccgcaatctag

SEQ ID NO: 179580 - DNA, 678 bp, Artificial Sequence
  Description of Artificial Sequence: Synthetic coding sequence
atggccgaggacaaggagaccaagcacggcggccacaagaacggccgtaagggcggcctgtcaggcactagcttctttacatggtttatggtcatcgcgctactgggcgtgtggacctctgtggccgtggtttggttcgatctggttgattatgaagaggtgctggctaaagccaaggacttcagatacaacctgtccgaggtgcttcagggcaaattaggaatttatgacgctgatggtgacggcgatttcgatgtagacgatgctaaggtgctccttgaggggccgtccggcgtggcaaaaagaaagactaaagccaaggtgaaggagctgacaaaggaagagctgaagaaagagaaagagaagcctgagagccgcaaggagtcaaagaacgaggaacgcaagaaggggaaaaaggaggatgtccggaaggataaaaaaatagcggatgctgatctgagcagaaaagagagtccgaagggcaaaaaggaccgggaaaaggagaaagtcgacctggagaagagtgcgaaaacaaaggagaaccggaagaagtcaacgaacatgaaggatgtatccagcaagatggcttctcgggacaaagatgataggaaggaatctcgtagcagtacccgctacgcccacttaactaaaggtaacacacagaaacggaacggctag

SEQ ID NO: 179581 - DNA, 1290 bp, Artificial Sequence
  Description of Artificial Sequence: Synthetic coding sequence
atggcccagcggaagaacgccaagagcagcggcaacagcagcagctccggctctgggtctgggtcaacatccgccggatccagcagtccaggtgctcggagggaaacgaaacacggaggtcacaaaaatggaaggaagggcgggttaagtggcaccagtttttttacatggttcatggtcattgctcttttaggcgtctggacgagcgtggcggtcgtctggttcgatcttgtcgactatgaggaagtgctggggaaactcggaatctatgacgcagatggggacggagactttgacgtggacgacgctaaagtccttctcggtctgaaggagaggtcaacaagcgagccagctgtgccccctgaggaggccgagccccacaccgaaccggaggagcaggtcccagtagaggcagaaccccagaatatcgaggacgaggcaaaggagcagatccagtccctgctgcacgagatggtgcatgccgagcacgttgagggagaggacctccagcaggaagacggccctacaggtgagccccagcaggaagatgatgaattcctgatggcgaccgatgtggatgatcgtttcgaaactctcgagcccgaagtttcacatgaggagacggagcattcttaccacgtagaagaaactgattccagcgaacccgtcgttgaagacgaaaggctgcaccatgataccgatgatgtcacgtaccaagtgtacgaagagcaagcagtctacgagcctttagaaaatgagggaatcgagataaccgaagtgaccgctccccccgaagacaacccagttgaggacagccaggtcatagttgaagaagtttcaatctttccagtcgaagagcagcaggaagtgccccccgaaacgaatcgaaagactgatgaccccgaacagaaagccaaagtgaagaaaaagaaaccaaaacttctgaataaatttgataagaccattaaggctgagttggacgcagccgagaagctccggaaacggggaaagatcgaggaagctgttaacgcattcaaggaattggtccgcaaatacccacagagtcctagggcccgctacggcaaggcacagtgtgaagatgacttagcagagaaacgacgcagtaatgaagtactgagaggagccatcgagacatatcaggaggtggccagcttgccagacgtgcccgcagacttgttaaaattgtccctgaaaaggcgaagtgatcgtcaacagtttctgggccatatgagagggtctcttctgacactgcagcgtctggttcagtag

SEQ ID NO: 179582 - DNA, 900 bp, Artificial Sequence
  Description of Artificial Sequence: Synthetic coding sequence
atggccgaggacaaggagaccaagcacggcggccacaagaacggcaggaagggaggactctctgggacctccttctttacgtggtttatggtgatcgctctgctcggcgtgtggacctccgttgcagtggtttggtttgatcttgtggattacgaagaggtcctcgccaaagcaaaggatttccgctacaacttgtctgaggtgttgcaaggaaagcttggaatatacgacgccgacggggacggagatttcgatgtggatgatgcgaaagttctgctgggcctgaaagagaggagcacctccgaacctgccgttccccccgaagaagctgagccccacacagaacctgaggaacaggtgcctgtagaggccgaaccacagaacatcgaagatgaagcaaaggagcagatacagagcttattacatgaaatggttcacgccgagcacgtcgagggtgaagatttgcagcaggaagatgggccaactggtgagccacagcaggaagatgatgaattcctaatggctactgatgtggatgaccggttcgagactctggaaccagaggtgagccatgaggagaccgaacacagttatcatgtggaagagaccgtgagccaggactgcaatcaggacatggaggagatgatgtccgagcaagaaaaccctgatagcagcgagcctgtggtagaggacgaacggctgcatcatgacacagacgacgtcacgtatcaggtctatgaggaacaggctgtgtatgaaccattagaaaacgaggggattgagattacggaggtcacagcgcctcccgaggataaccctgtcgaggactcccaggtgatcgttgaagaagtgtccatctttcctgtcgaagagcagcaggaagtgcccccggatacttag

SEQ ID NO: 179583 - DNA, 900 bp, Artificial Sequence
  Description of Artificial Sequence: Synthetic coding sequence
atggccgaggacaaggagaccaagcacggcggccacaagaacggccgtaagggcggcttgtcagggacgtccttcttcacgtggtttatggtcatcgcactgttaggtgtatggacctctgttgccgtggtttggttcgatctggttgactacgaggaggttctcgccaaggcaaaagatttccggtataatcttagcgaggtgctgcagggcaagctcggaatatatgacgccgacggggacggggattttgatgttgatgacgccaaggttttgctgggcctgaaggaacggtcaacatctgagccagcagtgccaccagaggaggccgaacctcacacagaacccgaggaacaggtgccagtagaagccgaaccgcagaatattgaggacgaagcaaaagaacagattcagtccttactgcacgagatggtccatgctgaacacgtggaaggcgaagatctccaacaggaggatggccccacaggtgaaccacaacaggaagacgatgaattccttatggccacagacgtggacgatcggtttgagaccttagagccggaagtgtcccacgaggaaacggagcacagttaccacgtcgaggaaactgttagtcaggattgtaatcaggacatggaggagatgatgagcgaacaagagaatccagacagctcagagcccgtggtggaagatgaaaggctccatcacgacaccgatgatgtgacttatcaggtatacgaagaacaggccgtttatgagcctctggagaacgaaggaattgagattaccgaggtgaccgcgccacccgaggacaaccccgtcgaggatagtcaggtgattgtggaggaggtgtccattttccctgtagaggagcagcaagaggtgcccccagacacgtag

SEQ ID NO: 179584 - DNA, 897 bp, Artificial Sequence
  Description of Artificial Sequence: Synthetic coding sequence
atggccgaggacaaggagaccaagcacggcggccacaagaacggccgaaaaggagggctgtccggaaccagcttcttcacatggttcatggtgatagccctgctgggggtctggacaagtgtggcagtggtctggttcgacctggtggactacgaggaagtgctcgctaaggccaaggacttccggtacaatttatctgaggttctccaagggaagctcggcatctatgatgctgacggtgatggagatttcgatgtcgatgatgcaaaggtgttactcgggttaaaagaacggagcacatccgaacctgccgttcctcctgaggaggccgaaccccatacagagccagaggaacaggttcccgtggaggcggagcctcagaacatcgaggatgaggcaaaggaacaaattcagagtctgctccatgaaatggtgcacgctgaacatgtggaaggagaagatctccagcaagaggacggaccgacaggcgaacctcaacaggaagacgacgagttcctgatggctaccgatgttgacgacagattcgaaaccctcgagcctgaagtgtcacacgaggagaccgagcatagctatcatgtggaggaaaccgtaagccaggattgtaaccaggatatggaagagatgatgtcggagcaggagaatcctgatagctccgaaccagtcgtggaggacgaaaggttgcaccatgatacagatgatgtcacgtaccaagtttatgaggaacaggtatatgagcccctggagaatgaggggatcgagattacggaagtaactgccccaccagaggacaatcctgttgaagattcacaggtgattgtcgaggaagtgtccatatttccggtcgaagagcaacaggaggtgcctccagacacatag

SEQ ID NO: 179585 - DNA, 813 bp, Artificial Sequence
  Description of Artificial Sequence: Synthetic coding sequence
atggcccagcggaagaacgccaagagcagcggcaacagcagcagctcaggatctggttctgggagtacctctgccggctcttcttcgccaggcgcccggcgggagacaaagcacggtggacacaaaaacgggcgcaagggagggctgtctggaaccagtttttttacatggtttatggtcattgccctcctgggggtctggacatctgtggccgtggtatggttcgacttggttgactacgaagaagttctaggcaaactgggaatttacgacgctgacggcgatggagacttcgatgtggatgacgccaaagtgctcctcggtctcaaggaacgcagcaccagcgagccagcagttccccctgaggaggcagaaccccacacggagcctgaagagcaggtgcccgtggaggcagagcctcagaatatagaggatgaagcaaaggagcagatccaaagcctgttgcatgagatggttcacgccgaacacgagaccgagcatagttatcatgtggaggaaacagtctcccaggattgcaatcaggatatggaagagatgatgtcagagcaggagaatcctgatagttctgagcccgtggtggaggatgagcggttgcatcatgacaccgacgacgtcacatatcaggtgtacgaagagcaagccgtgtatgaacctctggagaacgaaggaattgagataactgaggttactgcaccccctgaggataaccctgtggaagacagtcaggtgattgtggaggaagtctctattttcccagttgaagagcagcaggaagtcccaccagacacgtag

SEQ ID NO: 179586 - DNA, 633 bp, Artificial Sequence
  Description of Artificial Sequence: Synthetic coding sequence
atggccgaggacaaggagaccaagcacggcggccacaagaacggcagaaagggcggactcagcggcacctcatttttcacttggtttatggttattgcactacttggtgtttggactagtgtggccgtggtgtggtttgaccttgtcgattatgaggaggtgctcgggaagctgggcatctacgatgcagatggtgatggagatttcgacgtggacgatgctaaagtgctcctcgagggaccgtcaggagtggccaaacggaaaaccaaggccaaagttaaagagctgaccaaggaggaattgaaaaaggagaaggaaaaacccgagagtcgaaaagagagtaagaacgaagaacgtaagaagggaaaaaaggaggacgtgcgaaaggacaaaaaaattgctgacgccgacctctccagaaaggaaagtccaaaagggaaaaaggaccgcgaaaaagaaaaagtcgacctggagaagagtgccaagactaaagagaacaggaagaaaagcacaaatatgaaggatgtgagtagtaagatggccagcagggacaaggacgatcgcaaagaatcgaggagctcaactcggtacgctcatctgacgaagggcaatacacagaagcgtaatgggtag

SEQ ID NO: 179587 - DNA, 771 bp, Artificial Sequence
  Description of Artificial Sequence: Synthetic coding sequence
atggccgaggacaaggagaccaagcacggcggccacaagaacggcaggaaaggcggcctgtccggaactagctttttcacctggttcatggtgattgctttgcttggggtctggacgtctgtggcagtggtctggtttgacctcgttgattacgaagaagtgctggccaaggctaaagattttcgctataacctgagtgaggtgcttcaggggaagctaggtatttacgatgcagacggcgacggcgattttgacgtggacgacgctaaagttcttctggggctgaaggaaagaagtacctcagagcctgccgtgcctccggaagaggccgagccccatacggagcctgaagagcaggtgccagttgaagcagagcctcagaacatcgaagacgaggcaaaagagcaaattcagtccctgctccacgaaatggtgcacgcagagcacgagactgaacactcataccatgtggaggagacagtgtcacaggactgtaatcaggatatggaagagatgatgtcggagcaggaaaatcccgattctagtgagcctgtggttgaagacgaaaggctgcatcacgacaccgacgacgtaacctaccaggtctacgaggagcaggcggtgtacgagcctctcgagaatgagggtattgagataacggaagtcactgcccctcctgaggataaccccgttgaagacagtcaggtcatagtggaagaggtgtcgatcttcccggtggaagagcagcaggaggtccctccagatacctag

SEQ ID NO: 179588 - DNA, 2190 bp, Artificial Sequence
  Description of Artificial Sequence: Synthetic coding sequence
atggccgaggacaaggagaccaagcacggcggccacaagaacggcagaaagggcgggctctctggtacaagcttctttacctggtttatggtcattgctctgctgggtgtttggacctcggtcgccgtggtgtggtttgatttagtcgattacgaggaggttttgggcaaacttggcatctatgacgcagacggtgatggcgatttcgatgtcgatgatgcaaaggttctgcttggcctcaaggaacgaagtacttctgagcccgctgtgccacccgaggaggccgaacctcataccgagccagaggagcaggtgccggtggaagccgagcctcagaatatcgaagacgaggctaaggagcagattcagtctcttctgcatgaaatggtgcacgccgagcatgtcgagggagaagatttgcagcaagaggacggccccacaggagagcctcaacaggaagacgatgagtttcttatggctaccgatgtcgacgataggttcgagaccctggagcctgaagtgtcacacgaggagacagaacacagttatcacgtcgaagaaaccgtgtcacaagactgtaaccaggacatggaggaaatgatgagtgagcaagaaaaccccgatagcagcgagcccgtagtggaagatgagagacttcaccacgacaccgatgacgtgacttaccaagtgtacgaggaacaagccgtgtatgaaccgctggagaacgagggtatcgaaatcacggaggtgaccgccccccccgaggacaaccctgtggaagacagtcaggtaattgtggaggaagtatctattttcccggtggaggaacaacaggaagtgcccccagaaaccaacagaaagaccgatgatcctgaacaaaaggccaaggtcaagaagaaaaagcctaagttgctgaataaatttgataagaccattaaggccgaattagatgcagcggagaagctgcgcaagaggggcaagattgaggaagccgtcaacgccttcaaggaattagtgcgcaagtatcctcagagcccccgggcgcggtatgggaaggcccaatgcgaggacgatctggccgaaaagcggagatcgaacgaggttcttaggggtgccattgaaacctaccaagaggtagcaagcctacctgacgtgcctgcagacctactcaagttatcactgaagaggcggtccgatagacaacagttcctaggacatatgaggggctccctgctgacactccaaagactcgtgcagctgtttccaaacgatacgtcactaaaaaatgacctcggagtggggtatcttttgattggggataatgacaacgcaaaaaaagtgtacgaggaagtgctctccgtcactccgaatgacggcttcgccaaggtgcattatggttttatattaaaggcccaaaataagattgcagaatcaattccatatctgaaggaaggaatagagtcaggtgaccccggcaccgacgatgggaggttttattttcaccttggagatgctatgcaacgggtcggcaataaggaagcttataaatggtacgaattagggcacaaaaggggccattttgcctctgtgtggcaaaggtccttgtataacgtgaacggcttgaaggcccagccatggtggaccccgaaagagacgggctacaccgagttggtcaaaagcctggaaaggaactggaagctcattcgggatgaaggtcttgccgtgatggacaaagcgaagggcctctttttgcccgaagacgaaaatctccgagaaaaaggagattggtcccagtttacattatggcagcagggccgacggaacgagaacgcatgcaaaggtgcccccaagacgtgtaccctgctcgagaagtttcctgaaactaccggctgtagacgaggtcagatcaagtactcaataatgcatcctggcacgcacgtgtggccgcacactggaccaaccaattgtcgcctgagaatgcacctgggcctggtgatcccaaaagaggggtgcaaaatccgatgcgccaacgaaacaaaaacctgggaggaagggaaagtgctgatctttgatgatagttttgaacacgaagtgtggcaagatgcctcaagcttcaggctcatatttattgtggatgtgtggcatccagaactgacaccccaacaacgccgcagtctgccagcaatctag

SEQ ID NO: 179589 - DNA, 1032 bp, Artificial Sequence
  Description of Artificial Sequence: Synthetic coding sequence
atgggcagccccggcgccagcctgggcatcaagaaggccctgcagagcgagcaggccactgctctgcctgcaagcgctcccgccgtaagccagccaacagcgcccgcgccttcttgtctccccaaggcgggacaggttataccgaccctgctcagagaagcccctttttcttcagtgatcgcaccgaccctgctttgtgggttcttgtttctggcatgggtagccgcggaggttccagaggaaagctcccggatggccggctctggcgctagaagtgaggaaggcaggagacaacatgcattcgtgcccgagccctttgatggcgctaacgtcgtgcctaacctgtggcttcactcgtttgaggtcatcaacgacctgaaccattgggaccatatcaccaaactcaggttcttaaaagagtcacttaggggcgaggcactgggagtgtataacagactgagcccccaggaccagggagactacggtactgtgaaggaggcccttctcaaggcttttggagtcccaggcgcagcacccagtcatcttcctaaagaaatcgtgttcgctaactccatgggcaaggggtactacctcaaagggaagatcggtaaggtgccagtgcgtttcttggtcgacagcggtgcccaggtaagcgttgtacatcctaacctctgggaggaagttacggacggggacctcgatactctccaacctttcgaaaatgtggtgaaggtggccaatggggccgagatgaaaattctgggggtgtgggacactgcagttagtctggggaagttaaagctgaaagcccagtttctcgtggccaacgcctccgcagaagaagcaatcattggtaccgacgtgctccaggaccacaacgctattctggacttcgaacatcggacctgcaccctgaaaggaaaaaaatttcgtctgttacctgtcggggggtcgctggaggatgagtttgatctggagctaattgaggaggaccccagctcggaagagggcaggcaggagctgtcacattag

SEQ ID NO: 179590 - DNA, 960 bp, Artificial Sequence
  Description of Artificial Sequence: Synthetic coding sequence
atgtgcagcctgcccgtgccccgggagcccctgcggcgggtggccgtgacagggggtacacacggtaacgagatgtccggagtgtaccttgctaggcactggctgcacgctcctgcagaactgcagcgggctagcttcagcgcagtgccagtcttggccaacccagccgctacttccggatgcagacgctatgttgaccacgatctgaacaggacattcacgagctcctttcttaacagtcggcccacgcccgacgatccctacgaggtcaccagagctagagaattgaaccagctgctgggtcctaaggcttccggtcaggcatttgacttcgtattagacctacacaacaccactgccaatatgggcacatgtttaatagccaagagctctcatgaagtctttgccatgcacttgtgtcgacatctccagctgcagtacccagaactaagctgtcaagtgttcctctaccagagaagtggcgaagagagttataatctagattccgtggcaaaaaatggtctcgggctggaacttggacctcagccgcagggcgtgctcagagcagacatcttctctcgtatgcgtaccctggtggcaactgtgcttgacttcatcgagctgtttaaccaggggaccgccttccccgccttcgagatggaagcttaccgaccagtcggtgtcgtggactttccacgcaccgaagccggacacctggccggtactgttcatccgcaactccaggaccgcgatttccagccactgcagcctggagctccgatcttccaaatgttctcgggtgaggaccttctctacgagggagaatccacagtgtatcctgtttttatcaacgaggccgcttactacgaaaaaggggtggcatttgtccaaacagaaaagtttacctttaccgttccggctatgccagcgctgactccagctcccagccccgcctcctag

SEQ ID NO: 179591 - DNA, 1041 bp, Artificial Sequence
  Description of Artificial Sequence: Synthetic coding sequence
atggcccggaagagcaacctgcccgtgctgctggtgcccttcctgttgtgccaagctctggtaaggtgtagttcccccctgccactggtcgtaaacacatggccttttaaaaacgccaccgaggcagcttggcgcgctctggcatcaggtggatccgccctggatgctgtggaaagcggatgcgccatgtgcgagcgtgagcagtgcgatggcagtgtcgggttcgggggcagccccgatgagctcggggagacaacacttgacgccatgattatggatggaaccactatggacgtaggcgcggttggcgacctgcggcggatcaagaacgccatcggggtcgcccggaaagtgcttgagcatactacacacacactactagtgggggaaagcgcgacaactttcgcacaatccatgggatttatcaacgaggatctgagcacaacggcttcccaggctctgcactctgactggctggcaagaaactgccagcccaattattggaggaatgtgatcccagatcccagcaagtactgcggcccgtacaaaccccccgggatcctcaagcaagacataccgatccataaagagaccgaggacgacagaggacatgataccatcggaatggttgtgatccacaaaaccggtcacatcgcggcaggcacctccactaacggtattaagttcaaaattcatggacgggtgggcgacagtccaatccccggggctggcgcctatgcggatgatactgcaggcgctgcagcagccactggcaacggcgacatcctgatgcgcttcttaccttcataccaggcagtggagtatatgcgcaggggcgaggaccccaccatcgcctgtcagaaagtgatttctcggatccagaagcatttcccggagtttttcggcgcagtcatctgcgccaatgtgactggatcctatggagcagcttgtaacaaattgtcaaccttcacccaattttcattcatggtgtacaatagtgagaagaatcagcctacagaagagaaagtggactgcatttag

SEQ ID NO: 179592 - DNA, 573 bp, Artificial Sequence
  Description of Artificial Sequence: Synthetic coding sequence
atggagagccagcggctggagctgatccggctgatggagacccaggaggaggacgtggtcctgctcaccgccggagagcataacaaggcctgctctcttctgggaaagctccgtttggaatgtgctgacttgcttgagactagaggcgtggtcctgcgggacccaacattgttttcgtttctgtgggttgtggatttccctctgtttctccctaaagaggaaaatcccagggagttggagagtgctcaccatccctttactgcccctcacccctctgacattcacttgttgtacaccgagccgaagaaagaggatgtgaagatgcttagtcatctgctgcaggcgttggattatggagcgcccccacatggggggatcgcgctgggactggacagactcatatgtctcgtcaccggctccccttcaatcagggatgtgatagccttcccaaagagcttccgtggacatgatctcatgagtaatacccccgactcagtgcctccagaggagctcaaaccctaccacattcgggtatctaagccaaccgattctaaagccgagcgggcacattag

SEQ ID NO: 179593 - DNA, 1938 bp, Artificial Sequence
  Description of Artificial Sequence: Synthetic coding sequence
atgtacttccccagctggctgagccagctgtaccggggcctgagcaggcccattaggcggaccacacaacctatttgggggagcctctacaggtctttgctgcagtcttcacaaagaagaatacctgaattcagtagctttgtggtgcgtacaaacacatgcggcgaactgcggtcttcccacctgggccaggaagttacactatgcgggtggattcaataccggcgacaaaacactttcttggttcttcgtgacttcgatgggctagtccaggtgatcatcccacaggacgagtctgcggcttctgtgaaaaaaatactgtgcgaagcccccgtggaatctgtggtacaggtgtcaggcacagtcatatcacggcctgcaggccaggaaaatcctaaaatgcccaccggggaaattgagattaaagtcaagaccgcagagctgcttaatgcatgcaaaaaactgccctttgagattaagaattttgtcaagaagactgaagccctgcggctgcagtatcgctacctcgatttgagaagttttcaaatgcaatacaacttaaggctgaggagccagatggtaatgaagatgagggagtatctttgtaacctgcacggattcgtcgacatcgaaacacccactctgttcaaacgaacacctgggggcgccaaggaattcctggtacctagtcgcgagccgggcaagttttactccctgccacagtccccacagcaattcaaacagctgctgatggtcggtgggcttgaccgatatttccaggtcgcgcgctgctaccgcgatgaggggtcccgaccagatagacagccggaattcacccagattgacatcgagatgtccttcgttgaccagaccgggattcagtccctcatagaaggacttcttcaatatagctggcctaacgacaaagatcccgtagtcgtgccgtttcccaccatgacgtttgccgaggtactcgctacctatggaactgacaagcctgatacacggttcggtatgaagatcatcgacatcagcgatgtcttccggaacacagagattgggtttctccaagacgccttaagcaagccccacggcaccgtgaaggctatttgcatcccagagggggccaagtatctcaagcgaaaggatattgaaagcatccgcaatttcgccgccgaccactttaaccaggaaatcctgcctgttttcttgaacgcgaacagaaactggaacagtcccgtggcaaattttattatggagtctcagaggctagagctgatcaggttgatggagacacaagaggaggacgtggtgctgttgacagccggcgaacataacaaagcctgttctctgttgggcaagttaagactggagtgcgctgatttgctggaaacacgcggggtggtcctgagggatcctactctgttctcgtttttatgggtcgtggacttccctttgtttctgcctaaagaagagaaccctagagaacttgagtcagcacaccatcctttcacagccccccatccctccgacattcacctgttgtacacagagcctaaaaaggcccgttctcagcactatgatctcgtcctaaacggcaatgaaattgggggcggcagcatcagaatccataatgctgagcttcaacgctacatcctggccacgctgttaaaggaggacgtgaagatgctcagtcatctgctgcaagctctcgactacggcgctccacctcacggagggatcgcattgggccttgaccggctgatctgcctcgtaactgggagtccaagtatccgagacgtaattgctttccccaagagctttaggggccacgacttaatgagtaatacacccgactccgtgcctccggaagagctgaagccatatcacatccgagtgtccaagccgacagacagcaaagccgagagagctcactag

SEQ ID NO: 179594 - DNA, 1143 bp, Artificial Sequence
  Description of Artificial Sequence: Synthetic coding sequence
atgaaggagtacgtgctgctgctgttcctggccctgtgcagcgccaagccatttttctcaccctcgcatatcgcgctgaagaacatgatgctgaaggacatggaggacaccgatgacgatgacgacgacgacgacgatgacgacgacgacgacgaggacaactcactcttccccacaagggagcccaggtcccacttcttccccttcgatctgttccccatgtgcccgtttggctgtcaatgttattcccgggtcgttcactgtagtgatctgggactgacctcagtccccactaacatacctttcgatacccgaatgttggatctgcagaacaacaagatcaaagagatcaaggaaaatgactttaaagggctaacaagcctatatggacttattctaaacaacaacaagttgactaaaatacaccctaaggctttcttgaccaccaagaagttgcgccgactgtacttgagtcacaatcagctcagcgaaataccactaaatctgccgaagtccctagccgaattgcgtatacatgagaacaaggtaaagaaaattcagaaggataccttcaaaggcatgaacgcactgcacgtcctagagatgagcgccaacccgctagacaataacgggatcgagcctggagcttttgagggcgtaaccgtattccatatcaggatcgccgaggctaagctcacctctgtgcccaagggtctccctcctacactgctagaactccatctggattacaacaaaatttcaaccgttgagctagaggatttcaaaaggtacaaagaactgcagagactcggcttgggcaataacaagattacagacattgaaaatggaagcctggcaaatattccccgagtcagagagatacacctggagaacaacaagctgaaaaagattccctccggcttgcccgagttgaagtacctgcagattatcttcttgcatagcaatagcattgcaagagttggagtaaacgacttttgccctacagtccccaagatgaaaaaaagcctgtacagcgccatttctcttttcaacaaccctgtaaagtattgggagatgcagccagccacctttaggtgtgtgctgtctcgtatgtctgttcaacttggcaattttgggatgtag

SEQ ID NO: 179595 - DNA, 732 bp, Artificial Sequence
  Description of Artificial Sequence: Synthetic coding sequence
atgaaggagtacgtgctgctgctgttcctggccctgtgcagcgccaagccatttttttcccctagccacattgcactcaaaaatatgatgctaaaagacatggaagataccgacgatgatgacgacgatgatgacgacgacgacgatgatgatgaggataattccctgttccccacccgggagccaagatcacatttcttccccttcgacctgtttccaatgtgtccattcggctgccagtgctattctcgtgtagttcattgttctgacctggggctgacctctgtccctactaatataccctttgacaccaggatgttggaccttcaaaataacaagatcaaggagatcaaggagaatgactttaagggtttgacttccctatacggcctgattctaaacaataataagctgactaagattcatccaaaggcttttctcacgacaaagaaacttagaaggttgtatctttctcacaaccaactcagtgagatccccctgaaccttcctaaaagcctggccgagctgcgaatccatgaaaataaagtcaagaagattcaaaaagatacattcaagggaatgaatgcactccatgtactcgaaatgtcagctaatcccctggacaataacggcatcgaaccaggtgccttcgaaggggtcacggtcttccacatccgtatagccgaggctaaattgacttccgtgccgaaggtgaaccttccgcagttttag

SEQ ID NO: 179596 - DNA, 243 bp, Artificial Sequence
  Description of Artificial Sequence: Synthetic coding sequence
atgatgctgaaggacatggaggacaccgacgacgacgacgacgacgacgacgacgacgacgacgatgacgaggataatagcctatttcccacgcgcgagccccgtagccatttcttccctttcgatttatttcctatgtgcccatttggctgtcagtgttatagcagagtggtgcattgctccgacctggggctgacatcagttcccaccaacatccctctgatcctcgagtgcctcatttag

SEQ ID NO: 179597 - DNA, 732 bp, Artificial Sequence
  Description of Artificial Sequence: Synthetic coding sequence
atgaaggagtacgtgctgctgctgttcctggccctgtgcagcgccaagccatttttcagcccatcccacatcgctctcaagaacatgatgctcaaagatatggaggatactgacgacgatgacgatgatgacgacgatgacgacgacgatgacgaagataattctctctttcctacacgcgaaccaaggtcacacttttttcctttcgatctgttcccgatgtgtcctttcggctgtcagtgttacagccgagtcgtccactgttcagaccttggcctgacatccgtccccaccaacattccattcgacacccgcatgttggatctgcagaacaataagatcaaagagatcaaagaaaatgattttaaaggactgacctcgttgtacgggctgattctgaataataacaagctgaccaaaatccatcccaaagccttccttaccaccaagaagctgagaaggctgtatttaagccataatcagctgtcagagatcccgttgaacttgcctaaaagcttggcagaacttcgtatccacgagaacaaggtaaaaaagattcagaaagatacgttcaaagggatgaatgctttgcacgtcctggagatgagcgcaaacccattagacaacaatgggattgaaccaggggcattcgaaggtgtgacggtatttcacatccggattgctgaggctaagttgactagcgtacccaaggacaacctccctagcttctag

SEQ ID NO: 179598 - DNA, 3885 bp, Artificial Sequence
  Description of Artificial Sequence: Synthetic coding sequence
atggccctggccggcctgtgcgccctgctggcctgctgctggggccccgcagcagtgctcgcaacggctgccggcgacgtcgaccctagtaaggaactggagtgtaagcttaagtccattaccgtctctgccctgccgttcctgcgggagaatgacctatcaatcatgcactctcccagcgccagtgagccgaagctgctgtttagcgtgcgtaacgattttccaggcgagatggttgttgtggacgatctcgagaataccgagctcccttacttcgtgctggaaatcagtggtaacaccgaagatatccccctggtgagatggcgacagcagtggctggaaaacggcacccttctgttccatattcaccaccaagacggcgctccttccttgccaggtcaggatccaacagaggagccccagcacgaatccgcagaagaggaactccggatcctgcacatttcagtgatgggaggaatgatcgccttgctgctctctatcctctgcttagtaatgatcctgtataccagacgtcgctggtgtaaaagacggagagttcctcagccccaaaagagtgcctccgccgaggctgcaaacgaaatccattatatcccctccgtcctgatcggtggccacgggagagaatctctcagaaatgcacgcgtgcagggccataatagtagcggcactctgtcaattcgggagactccaattctggacggttatgagtatgacatcacggatctgcgccatcacctgcagagggagtgtatgaacgggggagaagatttcgccagtcaggtaactcgcaccctggactcattacaggggtgcaacgagaaatccggcatggaccttacaccagggtctgataacgccaaattaagtctcatgaataaatataaagacaatatcatcgcaacttccccagtggactccaaccaccagcaggccacacttctctctcatacgtcttcctcccagcgtaagaggattaacaacaaagccagggccgggagcgccttccttaaccccgagggagattccgggactgaagcagagaatgaccctcagttgactttctacaccgatccatcccgctctaggcgccgcagcagagtcggcagtccacggtctccagtcaacaagactactcttaccctcataagcattacaagctgcgtcattggattagtttgtagctctcacgtcaattgtcccttggttgtgaaaatcactctccacgtgccagagcaccttatcgccgacggctcacgattcattctcctagagggcagccagctggacgcctcagattggctgaatcccgcccaagtggtgctgttctcacagcagaattcaagcgggccttgggctatggatctgtgcgcccgcagactgctcgatccgtgtgagcaccaatgcgatcctgaaaccggagagtgcctctgctacgaaggatatatgaaggaccctgttcacaaacacctctgtataagaaatgaatggggcactaatcagggaccctggccctacacaatctttcagcgcggcttcgacctcgtccttggcgaacagccttctgataaaatattccggttcacttacactttgggtgaaggtatgtggctgccactgagcaagtcttttgtcataccccccgccgagttggcgataaatccatccgccaagtgtaaaacagacatgactgtgatggaagatgccgttgaggtcagggaggaacttatgacttcttctagtttcgatagcctcgaggtattgctggatagcttcggtccagtccgtgactgctccaaggacaatgggggatgttcgaagaattttagatgtatctcggaccggaaactcgactctaccggatgtgtctgccctagcgggctctcacctatgaaggatagcagcggctgttacgataggcacataggcgtcgactgtagcgatgggttcaacggaggatgtgaacaactatgcctacagcaaatggcacccttccccgatgaccccactctctacaacatcctgatgttttgcgggtgtatcgaggattataaactgggcgtcgatgggagaagctgtcagcttataacagaaacttgccctgaagggagcgattgcggggagtcacgggagttgcctatgaatcaaacactattcggcgaaatgtttttcggatataacaatcattctaaggaggtcgccgctgggcaagtgcttaaaggcaccttccgtcagaataatttcgccagagggctggaccagcaactgccagatggcctggtagtggccacagtgccactggagaaccaatgcctggaggaaattagtgagccgacacctgacccggactttctgactggcatggtgaacttcagcgaagtgagtggctacccagtactgcagcactggaaggtccgttcggtgatgtaccacataaagctgaaccaggtggcaatcagccaagctttgagtaacgccttacactctcttgatggggcaacctccagggctgatttcgtggcgctcttggatcagttcgggaatcactatattcaagaagctatctacggctttgaagagtcttgtagcatctggtatccaaacaagcaagttcagaggcgcctgtggttagaatatgaggatatttctaaaggaaatagtccctcagatgagtccgaggagcgggagcgggatccgaaggtgctgaccttcccagaatacattacaagcctcagtgattcagggacaaaacatatggccgctggagtgaggatggaatgccactccaagggtaggtgtccctcgtcttgcccactgtgccatgtgacctctagcccagataccccagctgagcccgtgctccttgaagttacaaaggcagctcccatctatgagttagtgacgaataaccagacacagaggttgttacaggaggccaccatgagctcgctgtggtgctccggaacaggagacgtgatagaagactggtgccgctgcgactccaccgcctttggcgccgacggcctccccacctgcgcacctcttcctcagcctgtgttacggctgtcaacagtgcacgagccctcatctacactggtggtcctggagtgggagcactcagagccccctatcggcgtccagattgtcgattacctgctcagacaggaaaaagtgaccgacaggatggatcattctaaagtcgagacagagaccgtgttatcttttgtagacgatatcatatcaggcgccaagtctccctgcgccatgcctagccaggtcccggataaacagctaaccaccatcagcctgatcataaggtgccttgaacccgatacgatctacatgtttacgctgtggggtgtcgacaatactgggaggaggagtcgcccatctgacgtcatagtaaagaccccatgtcctgtcgttgatgacgtgaaggcccaagaaattgccgataaaatatataatctgtttaatggttatacttcggggaaggagcagcagacagcctacaatacgctgctagatctgggctcccctacactgcaccgagtgctttaccattacaatcagcactatgaaagcttcggagagttcacctggaggtgtgaggacgagctggggcctagaaaggctggcctgatcttgtcacagcttggggacctgtcttcatggtgcaatgggctgctccaagaacccaagatctcactgcggagaagtagccttaagtacctagggtgtcgttacagcgagattaaaccgtatggcctggattgggcagaactcagcagggacctgaggaaaacatgcgaggagcagacactgtccatcccatataacgactacggagacagcaaggagatatag

SEQ ID NO: 179599 - DNA, 3909 bp, Artificial Sequence
  Description of Artificial Sequence: Synthetic coding sequence
atggccctggccggcctgtgcgccctgctggcctgctgctggggcccagccgccgtgctggctacggcggctggcgacgtggatccatccaaggaactagaatgcaagctgaagagcattaccgtaagcgcactcccctttcttcgggagaacgatctgtccatcatgcactcaccgtcagcaagcgagcccaagctgcttttctcggtccgaaacgattttccaggggagatggtggtggtggatgatcttgaaaatacagagctcccctattttgtcctcgagatctcaggaaatactgaagatataccactggtgaggtggaggcaacagtggttagagaacggaacactcttgttccatattcatcatcaggacggtgctcctagcctaccaggccaggaccccactgaggaaccccagcacgagtccgcggaagaagaactccgcattcttcacattagcgtcatgggcggcatgatagcactactgctgtcgatcctctgtctcgtcatgattctgtataccagacggagatggtgcaaaaggaggagggtcccccaaccccagaagtccgcaagtgcggaggctgcaaacgagatccattatattccctccgtcctgattggcggacatggacgtgagagtctcagaaatgcaagggtgcagggccataacagcagtggtaccctttcaatccgggagactccaattctcgacggctacgaatacgatatcactgaccttagacaccatttgcagcgggagtgtatgaatggcggcgaagatttcgcctctcaggtgacaagaacacttgattctctccaggggtgcaatgaaaaaagtggaatggacttgaccccaggaagtgacaatgcaaagctttctctgatgaacaagtataaagacaacatcatcgccacgtcccccgtggattctaatcatcaacaggccacccttctgtcacatactagttccagccaaagaaagagaattaataataaagcaagggccggtagtgcatttctgaaccctgaaggcgacagcggcacagaagccgagaacgacccgcagctaacgttctacaccgaccctagtcgctctaggagaagaagtcgcgtcgggtctcccagaagcccggtgaacaaaacgactttaaccctgatctctatcacctcatgcgtgatcgggctggtgtgtagttctcatgtgaactgcccactggtagtgaagatcaccctgcatgtgcctgaacaccttattgcagacggctccaggtttatcttgcttgagggatcccagctcgacgcctcagactggctcaatccggcccaggtagtcttattctcacaacagaatagcagtggaccatgggctatggatttatgcgcccggcggctgctagacccctgtgagcaccagtgtgatccggaaaccggtcgacgggagcaccgcgccgctggtgaatgtctttgttacgagggttacatgaaggaccccgtgcacaaacatttgtgcataaggaacgagtggggtaccaatcagggcccgtggccatacacgatcttccagcggggctttgacttggtgctgggtgagcagcccagcgacaaaattttcagattcacttacacactgggagaggggatgtggcttccgttgtccaagtccttcgtgattccacctgccgagctggcaataaacccttccgccaaatgtaaaacagatatgactgtgatggaggacgccgtcgaggtacgcgaagagctgatgacctcatcttctttcgattctctcgaagtccttctggactccttcgggccagtccgcgattgtagtaaagacaatgggggctgcagtaagaattttcgctgcattagcgacagaaagttagactcgacaggatgtgtttgcccatcagggctgtctcccatgaaagacagcagcggctgctacgaccggcacatcggagtcgattgctcagacgggtttaacggcggttgcgagcaactttgcttgcagcagatggccccttttcccgacgaccccactctgtacaacattctgatgttctgcgggtgcatcgaagactacaagttgggcgtagacggaaggagttgtcagctcataaccgaaacctgtcccgagggctccgattgtggtgagtccagggaattacctatgaaccagaccctctttggagaaatgttcttcggatacaataaccattccaaagaggtggccgccggtcaagtattaaaggggacattccgccagaacaacttcgcccgcggactcgatcagcagctgccagacgggctggtcgtggctactgtcccactggagaatcagtgcttagaagagatcagtgaaccaactccggaccctgacttcttaaccggaatggtgaatttctccgaggttagcggttacccagttcttcaacactggaaagtcagatctgtgatgtatcacatcaagctcaatcaggtggctataagtcaggccctgagcaatgccctccattccttggacggagccacctcgagggctgattttgtagcattacttgaccagtttgggaatcactacattcaggaagccatctatgggtttgaagagtcctgttcaatttggtaccctaacaaacaggtacagcgtcgactttggctggagtatgaggacatctccaagggtaactccccaagcgatgagagcgaggagagagaacgtgatccgaaagtgcttacgttccctgaatacataacaagtctgagcgactcgggcaccaaacacatggctgctggcgtccgcatggaatgccattccaaaggtaggtgtccttcaagctgcccattgtgccacgtgacctccagcccagatacacccgctgagccagttttattagaagttaccaaggcggccccaatctatgagctggtgacgaacaaccagacccagaggctccttcaggaagccacaatgtcctcactatggtgtagtgggaccggggatgtgatcgaggattggtgcagatgtgatagtaccgcatttggtgcggacggcctgcctacttgtgcgcctttgccgcagccagtgcttaggttgtccacagtgcacgagccaagttctaccctagtcgtgttggagtgggagcattccgagccaccgatcggagtgcaaatcgtcgactacctgttaaggcaggagaaggtcactgaccggatggatcacagtaaagtcgagactgaaaccgtactttcttttgttgacgacattatcagcggggccaaaagcccgtgcgccatgccttcccaagtgcctgataaacaattgactacgatcagtctcataatccgttgcttggagcccgacactatctatatgtttacactgtggggagtggataatacggggcggcggagtcgacctagcgacgtgattgtaaaaaccccgtgcccagttgtagatgacgtgaaagctcaagagatagccgacaagatctacaacttgttcaacgggtacactagcggcaaggaacaacagactgcctataatacgctgctggacttgggctcacccacactccatagggttctgtaccactacaatcagcactacgagagcttcggggagttcacttggcggtgcgaagatgaacttgggccaaggaaagccggcttaatcctgtcacagctgggtgatctgtctagctggtgtaatggcttattgcaggagcccaaaatctcactgaggcgttcatcgctgaaatacttggggtgtcggtactcagagataaaaccctacgggctcgactgggcagagttatcccgggacctccgtaaaacctgtgaagagcagaccctctccatcccatataacgactatggtgactctaaggagatttag

SEQ ID NO: 179600 - DNA, 3651 bp, Artificial Sequence
  Description of Artificial Sequence: Synthetic coding sequence
atggccctggccggcctgtgcgccctgctggcctgctgctggggccctgccgctgtgttggccacagctgccggcgatgttgacccgagcaaagaattggaatgtaagttgaagagcattaccgtatctgctctcccctttctccgtgaaaacgacctatcaattatgcactctccttcagcgtcggaacctaaactgcttttttcggtacggaacgactttcctggcgagatggtcgtcgtggatgatttggaaaataccgaactgccctacttcgttctcgagattagtggtaataccgaagatataccattagtcaggtggaggcagcaatggcttgagaatgggactctgttatttcatatccaccatcaggatggggcgccaagtctacccggacaggaccccacggaggagcctcagcatgaaagcgctgaagaggaattgcggatcctccacatttcggtgatgggcgggatgatcgctctcctgctgagtatcctctgcttggtgatgattttatacactcgacgaaggtggtgcaaaaggcgtagggtaccccaaccccaaaaaagcgcaagcgccgaggccgctaatgagattcattacattccatccgtgttgatcggcgggcacggcagggaatcactgcggaatgcacgcgtccagggtcacaacagttcaggtactctgagcattagggaaacgcctatattagacgggtacgaatacgacattactgatttacgccaccacctgcagagggaatgtatgaacggcggagaggatttcgcctctcaagtcacccgaaccctggactccctccagggttgcaacgaaaagtcaggaatggatctcactcctggttctgacaatgctaagctctccctcatgaacaaatacaaagacaacattattgccacctctcctgttgatagcaaccaccaacaggcaactctactcagccacacctctagttctcagcgcaagcgcatcaacaacaaggccagagccggttccgcattccttaatccagaaggagattctggaacggaggccgagaacgacccccagctcactttctacactgatccaagtaggtctaggcggcgttctcgcgtcgggtctccccgctcacccgtcaataaaaccacactcactttaattagtattacctcttgcgttatcgggctggtgtgtagctcccatgtgaactgtcctcttgtggtcaaaatcaccctgcacgttccggagcacttgatcgccgatgggtccagatttattcttctggaaggtagtcagctggatgcttccgactggcttaatcctgcccaagtcgtgctcttttcccagcagaactcaagtggcccgtgggccatggatctttgtgcccgaaggctgctcgatccatgcgagcaccagtgtgatccagagaccggagagtgtttgtgttacgagggctacatgaaggacccagtgcacaagcatctgtgcatacgtaatgaatggggtactaaccagggcccctggccatataccatttttcagagaggcttcgatctggttctgggagaacaaccctctgataaaatctttaggtttacgtacaccttgggcgaaggcatgtggcttccactgtcgaagtccttcgtaattccaccagctgagcttgcgatcaacccatccgcaaaatgtaagactgatatgacagtgatggaagacgcagtggaggtccgggaggaattaatgactagttctagtttcgattcccttgaggtgctgttggactcgtttgggcctgtgagggactgcagtaaggataatggcggctgttctaaaaactttcggtgtatcagcgatcgcaagcttgattccactgggtgtgtgtgcccttccggcctatcgccaatgaaggatagcagcggctgctatgatcggcatattggagtagattgcagtgatggattcaacggcggctgcgagcagttgtgccttcaacaaatggcccccttccccgacgacccaacattgtacaatatcctgatgttctgtggatgcattgaggactacaagctgggggttgacggacgttcttgccaactgataactgaaacttgccccgaaggatccgactgtggcgaaagtcgcgaactaccaatgaaccaaaccctgtttggcgaaatgttctttgggtataataatcactcgaaggaggtggccgctggtcaggtactgaaaggtacctttcgccagaacaattttgccaggggcctggaccagcagcttccagatgggctcgttgttgccaccgtgccgctggagaaccagtgcctggaggaaatcagtgagcctaccccagaccctgactttctgaccggcatggttaacttctccgaagtgtcaggctaccctgtgcttcaacattggaaggttaggtccgtcatgtatcacatcaagctgaatcaggtggctatctcccaggcactgagcaacgcgctgcattccctcgacggagctacttcacgagcagacttcgtcgccctgctggatcagttcggaaatcactatatccaggaagccatctatgggttcgaggagtcttgtagcatttggtaccccaataaacaagtgcagcgaagactgtggttggagtacgaagacattagcaaaggaaactcaccctccgacgaaagtgaagaaagggagagggacccaaaagtcctgacttttccagaatatattacctctttgtctgatagtggcacaaagcatatggccgcaggggtgcgcatggagtgccattcaaagggaagatgcccaagctcgtgtcccctgtgtcatgtgacctcttcacccgacaccccagcggaaccggttttactggaagtaaccaaagctgccccaatctacgagctggttaccaacaaccagactcagaggctgttacaagaggcaaccatgtctagtctctggtgctccgggactggggatgtgattgaagactggtgtaggtgtgactcaaccgcattcggtgctgacggcctccctacatgtgctcccctcccacaacctgtgctgaggctctccaccgtacacgagccgtcatctaccttagtcgtgttggagtgggagcactccgagccccccattggcgtgcaaatcgtggattatctgctccgtcaggagaaggtgactgatcggatggaccactcaaaggttgagactgagactgtgctgtccttcgtggacgacataatatctggcgcaaaaagcccatgcgctatgccgtctcaggtgcccgataaacagctgacgacaatcagcctgataatccgttgcctggaaccggataccatctacatgttcacactgtggggggtggataatacagggcgccgttccagacctagcgatgtgattgtgaagaccccgtgccctgtggttgacgatgttaaggcgcaagaaatcgcggacaaaatttacaacctgtttaacggctacaccagtgggaaagaacaacagactgcatataatactttgctggacctgggttcccccacactgcatagggttctctatcattataaccagcattacgaatcctttggcgagttcacctggcgctgcgaggacgaactgggtccgcggtag

SEQ ID NO: 179601 - DNA, 3657 bp, Artificial Sequence
  Description of Artificial Sequence: Synthetic coding sequence
atggccctggccggcctgtgcgccctgctggcctgctgctggggcccggcagctgtgctagccacggctgcaggagacgtggacccaagtaaggagctcgagtgcaaattgaaaagcattacggtgtctgccttgccatttctgcgcgaaaacgatctgtctattatgcactctccttccgcttctgagcccaagctcttattcagtgttagaaacgatttccctggagaaatggtggtagttgatgacctcgagaacacagaactaccctattttgttctggaaatcagcggtaacaccgaagacatcccgctggtacggtggagacagcagtggctggagaacggaactctgctgttccatattcaccatcaggatggcgctccctcactgcctgggcaggaccctactgaagagcctcaacacgagagcgccgaggaggagttaagaatcctgcacatcagtgtgatgggggggatgattgctctgctgctcagtatcctgtgtctagttatgatactctacaccaggagaagatggtgtaaaagacggagggtcccacagccccagaagagtgcctcagctgaggccgccaatgaaatccactatatcccctccgtgctcatcggcgggcacggccgtgaaagtctgcgcaacgcacgggtccaagggcataactccagtggtacgctcagtatcagggaaacaccaatcctggacggatacgaatatgacattaccgacctcaggcaccacttacagcgcgagtgtatgaacggaggggaggacttcgcttcacaggtgacgcgcacccttgatagtcttcagggctgcaatgaaaaaagcgggatggatctcacaccaggatcagataacgctaagctgtcactgatgaacaagtacaaggacaacatcatagccacttctccagttgatagtaaccatcagcaggccacactgctttcacatacctcatcatcccaacgaaagcgtatcaacaacaaggctcgcgcgggcagtgcatttctcaaccccgaaggtgactccggtaccgaggccgaaaacgatcctcaactgaccttttacactgacccaagcaggtcccgccgtagatcccgggttggcagccctcggagccctgttaacaagacgactctgaccctcatatccatcacaagctgtgttatcggactcgtgtgttcctcccatgtgaactgccctctcgtcgttaagattacacttcatgtccctgagcacctgatagcagacggatctcgctttatcctattagagggctcacaacttgatgccagcgattggcttaatcccgcgcaggtggtgctgttcagccagcaaaatagcagtgggccttgggccatggacctgtgcgccaggcggctcttggatccttgtgagcaccagtgcgatccagagaccggcgagtgcctgtgttatgagggatacatgaaggacccggtgcataaacacttgtgtattagaaatgagtggggcacaaaccagggcccttggccctatactatctttcagcgcggattcgacctagtgctcggagagcagccttctgacaagatttttaggttcacatacacgttaggcgagggaatgtggcttccactgtccaagagcttcgttattccccctgcagagttggctatcaatccatcggccaaatgcaagaccgacatgacagttatggaagacgccgtcgaggtccgcgaggagctgatgacttcctccagcttcgactctctcgaggtgctgctggactccttcgggcctgtgcgagactgtagcaaggataacggaggatgttctaagaacttcagatgcatctccgaccgcaagctggactccacagggtgtgtctgcccctctgggctttcgcccatgaaagatagcagtggctgttacgatcgccacattggcgttgactgctctgacggctttaatggagggtgcgagcagctgtgtctgcaacagatggctcctttccccgatgatcccaccctttataatatattaatgttttgcgggtgcattgaggactacaagttgggggtggatggtaggagctgtcagctgataactgagacatgtccagaaggtagtgattgcggggagtccagagagttacctatgaaccagactttgttcggggaaatgttcttcggctataacaaccactccaaagaagtcgcagccgggcaagtcctgaagggtactttccgtcagaacaactttgccaggggccttgatcaacaactgcccgacggacttgttgtagccactgtgcccctggagaaccagtgtctagaggagatatctgagcctactcctgaccctgatttcctgacagggatggtgaatttctccgaggtgagtggatacccagtcttacaacactggaaagtgaggtccgttatgtaccatatcaagctaaatcaggtagccattagtcaagcactatcaaacgctctgcacagcctggacggagcaaccagccgagccgacttcgtggcactgctggatcaattcggcaaccattacatccaggaagctatctatggattcgaggaatcctgctccatttggtacccaaataaacaggtgcaacgtagactctggctcgaatacgaggatatttctaaaggcaactccccaagcgatgagagtgaggaacgggagcgggaccctaaagtactgaccttcccggagtacatcacaagcttgtctgactccggaacaaaacacatggccgcgggtgtccggatggagtgccacagcaaagggcgctgccctagtagttgtcctttgtgccatgtcacgagttcgcctgataccccagccgagccagtgctgttggaagtcactaaggccgctcctatctacgagctcgtgaccaacaaccaaactcagcgcctgctgcaagaagccaccatgtcttctctatggtgcagcgggaccggtgatgttatcgaagattggtgcagatgtgattcaactgcctttggcgccgacggcttaccaacatgtgcaccgcttccgcaacccgtattgagactgtccaccgtgcatgaacccagttccaccctggtggtgctcgagtgggaacactccgagcctccgatcggagttcaaatcgtagactaccttctccggcaggagaaggtgaccgaccgaatggaccattctaaagtcgagacggaaactgtcctgtcattcgtagatgacatcatatctggggcgaagagtccttgcgccatgcccagccaggtgcccgataaacagctgactacaattagcctgattatcaggtgtctcgagcccgacactatctacatgtttacactgtggggcgtagataataccgggaggcgctcccgcccatccgatgtgatagttaaaaccccctgccctgtcgtggatgatgtgaaggctcaagagattgctgataaaatctataacttatttaatggatatacatcgggcaaggagcaacagaccgcctataacacgctgctggacctaggttcacctaccctgcaccgggtactgtaccactacaatcagcattatgaatccttcggtgaatttacttggcgctgtgaagacgagttgggccccaggaaccagtag

SEQ ID NO: 179602 - DNA, 1323 bp, Artificial Sequence
  Description of Artificial Sequence: Synthetic coding sequence
atgaacaccctgctgtgcaagggcatgttctgcctgctgagctgggaggcagacagtagggggcggttgggcgagtacacgcttcaacctctttccctccaaactgaagagaccaccgagttgggttccaagaaggagttgaaaagtatgccttttattacctacctgtctggattgctcaccgcccagatgctgtccgacgaccagctgataagcggcgtagagattcggtgtgaggaaaagggccgatgtccgagcacatgccatttgtgccggcggcccggtaaagaacagctatcgcccacacctgtcctgctcgaaattaacagagtggttccgctttataccttgattcaggataatggaactaaggaggcttttaaatccgcacttatgagctcatattggtgttccggaaaaggcgacgtcatcgacgattggtgtaggtgtgatctgagtgcctttgacgctaacggtcttcctaattgtagtcccctcctgcagccagtgctgaggttgtcacccaccgttgagccctcaagcactgttgtatccctggaatgggtggacgtccagccagccataggaaccaaagtgagcgattacatcctgcaacacaagaaggtcgatgaatacaccgataccgacctgtataccggtgagtttctgtccttcgcagatgacttactgtctgggctaggtactagctgcgtagcagccggacggtcccacggagaagtgcctgaagtgtccatctactctgtcatcttcaagtgtctggagcctgacggcctttacaaatttactctctatgcagttgacacccggggacggcacagtgagttaagcaccgtgaccttaagaaccgcctgtccgttggttgatgataacaaagccgaagagatcgcagacaaaatctacaacctatataatggttacacgtccggaaaggagcagcaaatggcatacaacaccctgatggaggttagtgccagtatgctgttccgagtgcagcatcattacaattcacactacgaaaaattcggggactttgtctggcggagcgaagacgagctgggacccaggaaagcccacctcatcctgagaagacttgaacgcgtctcttcacactgttccagcctgttaagaagcgcctacattcaaagtcgtgtcgagacagttccgtatttgttctgtagaagcgaagaggtccgacctgcgggcatggtgtggtattctatccttaaagataccaagatcacatgcgaggaaaagatggttagcatggcacgcaatacctatggagagtcaaagggtagatag

SEQ ID NO: 179603 - DNA, 4020 bp, Artificial Sequence
  Description of Artificial Sequence: Synthetic coding sequence
atggccgccgccggcgcccggctgagccccggccccggcagcggcctgcggggaagaccacgcttgtgtttccaccctggaccaccaccattgcttcctttgcttctgttgtttttactactgctgccgcctcccccgctgctggccggtgctactgcggcggcatcaagggaacctgacagcccttgcagactgaaaaccgtcacggtgtctactctccctgcactgagagagtccgatatcggttggtcgggagcacgtgcaggggcaggcgcgggtacaggagccggggccgcggcagccgctgcatcccccggaagtcctggcagcgctgggacagccgctgagtcgcgattgctgctgttcgtacgcaatgaattacctggtcgaatagccgtacaggatgatctcgacaataccgaactgcctttctttaccttggaaatgagcgggaccgctgcagatatttcactcgttcattggcggcaacaatggctcgaaaatggaacactgtattttcacgttagcatgagcagctcgggccagctagctcaggctactgctcctacattacaggaaccctccgaaatcgtagaagaacagatgcatatcttacacatcagtgttatggggggtctgatcgcactgttacttttgttgcttgtgtttactgtcgctctatacgcccagaggcgctggcaaaaaaggcgccggattcctcagaagtctgcttctaccgaagctacccacgaaattcactatatcccctcagtactgctcggaccccaagctagagaaagctttcggagctccaggcttcaaacccacaattccgtgatcggcgtgccaattcgggagaccccgatcctggacgattatgactgtgaggaagacgaggaacccccacgtcgggcgaaccacgtgtcaagagaggatgaattcggctcccaggttacgcatactctggattccctgggccaccccggggaggagaaagtggatttcgaaaagaaggcagccgcagaggcaactcaagagaccgtggaaagcctgatgcagaaatttaaagaatcctttcgagcgaacacacctatcgaaattggtcagctgcaaccacctctaaggtcaacttccgccggtaagagaaaaaggcgctcgaagagtcggggcggcatttccttcggacgcgctaaaggaacctcaggcagcgaagcggacgacgaaacccagctgactttctatactgagcaatacaggtccaggcgccgctcaaaggggctgctgaagtccccagtcaataaaacagccctgactctgatcgcagtcagtagttgtattttggctatggtgtgcggcagtcagatgagctgtcccctcacagtcaaggttacccttcatgtgccggaacatttcattgccgacggatcatcttttgtggtatccgagggatcctacttggacatatccgattggctcaatccagccaagctgtccctgtactaccagataaacgccacatcaccttgggttcgagatctctgcgggcagagaaccacggacgcttgtgagcagctgtgtgacccagaaaccggggagtgttcatgccatgaggggtacgcgccagacccagtccatagacatctgtgtgtgcgatcagactgggggcaaagcgaagggccttggccttataccacgttggaacgcgggtacgatctcgttacaggagaacaggcaccagaaaagatcctccgctctaccttctccctcggtcagggactgtggctcccagtgagtaagtcattcgtggtgccccccgttgagttgtcaattaaccctctcgcctcctgcaaaactgatgtactcgttactgaagatcccgccgatgttcgggaagaagctatgctatcaacctattttgagacaataaatgaccttctgagtagttttggccccgtgagggactgttctcggaataacggcggctgtactcggaacttcaaatgcgtgtccgaccggcaggtggatagcagtgggtgcgtgtgccccgaggagctaaaaccaatgaaagatggatccggctgttacgatcacagtaaggggatcgactgctctgatggtttcaacggcgggtgtgaacaactgtgcttgcagcagacacttccgctgccttacgacgcaacttcctccaccatattcatgttctgtgggtgcgtagaggagtataagttagcacccgatggtaagagctgtctgatgctcagcgatgtgtgtgaaggccccaagtgcctcaaaccagacagcaagttcaacgataccttattcggcgagatgctgcatggctacaacaatcgtacacagcatgtcaaccagggccaggtgttccagatgactttcagagaaaataattttataaaagattttccacagctggccgacggcctacttgtcatccccctgcctgtcgaagagcaatgcaggggcgtgctctcagagcccctgcccgacctccagctgttaaccggagatatccgctatgatgaagcaatggggtatcccatggtccaacaatggcgagttcggagtaacctgtacagggtaaagctgtctacaatcaccctggctgcagggtttacaaatgtgcttaaaatcctgacgaaagaaagctctcgcgaggaactcctgtcctttatccagcactacgggagccactatatcgctgaggccctgtatgggagcgagttgacatgtattattcatttcccgagtaagaaagtgcaacagcagttgtggctccagtatcagaaggaaaccaccgaattgggcagtaagaaagagctcaaatctatgcctttcatcacatatttaagcgggctcctaactgcccagatgctgagcgatgaccagcttatctccggcgtggaaattagatgcgaggagaaaggaagatgtccctctacctgtcacctctgcagacggccaggaaaggagcagctctcccccaccccggtgctgctggagataaaccgtgtggtgcccttatatacactgattcaggataacggtaccaaagaagcctttaagtctgccctcatgtcttcatattggtgcagtggcaagggtgacgttattgatgactggtgccggtgcgacctgagcgcgtttgatgctaatggactgcctaactgcagtccactcctgcagcccgtgctgcggctgtcccctacagttgagccctcatccacagtagtttcattggagtgggtggacgtacagcctgcaattggtacaaaggtctccgattacatcctgcaacataaaaaggtggacgagtacactgacacagacctgtatacaggggaattcctgtcatttgcggacgacctcttgtcaggactcggtacttcctgtgtggccgcaggcaggagccatggtgaggtgcccgaagtctccatctattccgtgattttcaaatgtctggaacctgatggactttacaaatttactctgtacgccgtggataccagagggcgccactcagaacttagtactgtaacgctccggactgcttgccccttagtcgacgacaacaaggctgaggaaatcgccgacaagatctacaacctgtacaatggatacacgtcagggaaagagcaacagatggcttacaacaccctgatggaggtaagtgcttccatgctcttccgagtccaacaccactacaattcacactacgaaaagttcggtgattttgtctggcgttcagaggacgaactgggacctaggaaagctcacctcattctgcgtcgactggaacgagtgagctctcactgcagtagtctacttaggtccgcttatatacagagccgggttgaaactgtcccatatttgttctgtagatccgaggaagtgaggcccgcggggatggtgtggtactccattctcaaagacactaaaatcacatgtgaggagaagatggtgtccatggcacggaacacatatggagagtcaaaaggaaggtag

SEQ ID NO: 179604 - DNA, 1188 bp, Artificial Sequence
  Description of Artificial Sequence: Synthetic coding sequence
atgcccttcatcacctacctgagcggcctgctgaccgcccagatgctgagcgacgaccagttgatcagcggtgtagagattcggtgtgaggagaaaggccgctgtccatccacctgtcacctgtgccgaaggccggggaaggagcagctgtctccgacccctgtccttctcgagatcaacagagtggtgccactatacacactgatccaggacaatggcaccaaagaagccttcaaatctgccctcatgtcttcttactggtgtagcggcaagggagacgtgatcgacgactggtgccgatgcgacctctcagccttcgacgccaacgggctgccaaattgcagtcccctgttgcagccagtgctgcggttgtctccgacagtggaaccgtccagcactgtggtgagcctcgaatgggtagatgtgcagcctgccatcggtacaaaggtgtcagactatattcttcagcataagaaggtagatgaatacaccgatactgacctctacacaggcgaattcctatcttttgccgatgatctgctgtccggcctcggcacgtcatgcgtggccgctgggaggtctcacggggaagtccccgaggtctctatctactcagtaatctttaaatgcttagagccagacggcctttacaagtttaccctgtacgccgtggatactcgtggcagacattctgagctgtctaccgtaacattacggacagcctgtccactggttgatgataacaaagcggaggaaatcgcagacaaaatttataatttatataacggctacacaagcggaaaggagcaacagatggcctataacaccctcatggaggtcagcgcaagtatgctcttccgtgtgcagcaccactataatagtcattatgagaaattcggtgatttcgtctggcggagcgaggacgaactcgggcctcgaaaagctcaccttatactaaggcgactggagcgtgttagctctcactgcagtagcctcctacggtctgcatatatccagtcaagagttgagacagtgccttatctcttttgcagatcggaggaggtgcgacccgctggtatggtgtggtacagcattctgaaagacacaaagattacatgtgaggaaaagatggtgtcaatggcccggaatacctactatctcacccttagcaaggtttctccgttctag

SEQ ID NO: 179605 - DNA, 585 bp, Artificial Sequence
  Description of Artificial Sequence: Synthetic coding sequence
atgcccttcatcacctacctgagcggcctgctgaccgcccagatgctctcggacgaccagctgatcagtggtgtcgagatccggtgcgaggaaaaaggacgctgcccctcaacctgtcacttgtgcaggcggccaggcaaggagcagctctcccccacccctgtgctacttgagataaatcgcgtggtgccactgtacaccctgatccaagataacggcaccaaagaagcttttaagtccgccctgatgtcatcgtactggtgcagcggaaaaggtgacgtgatagacgactggtgtagatgtgatctctctgcttttgatgccaatggacttccgaactgttccccgctcctgcagccagtgttgcgactttcacctacagttgaacccagttctactgtagtctcccttgaatgggtcgacgtgcagccagcaatcgggacgaaggtaagcgactatattttgcagcacaagaaagtggacgaatacacagacaccgatttgtatacagtatattgttggatcaccttcatcgatctgaggattttaaaccaaccatgcatccctggaatgaagcccacttag

SEQ ID NO: 179606 - DNA, 3867 bp, Artificial Sequence
  Description of Artificial Sequence: Synthetic coding sequence
atggccgccgccggcgcccggctgagccccggccccggcagcggcctcaggggtcgtcccagactttgcttccaccctggccctcctccactgcttcctctgctgctgctatttctcctcttgttgccccccccacccctgctcgcaggcgccaccgccgctgcctcacgtgagcccgactcaccctgccggttaaagacggtcacagtgtcgacactgcctgctctgcgtgagtccgacattggatggagcggcgcacgcgcgggcgccggggcgggcacaggcgccggagccgctgctgctgccgctagtcctggcagcccaggttccgccggaactgctgcagagagccgtctgctcttgttcgtaaggaatgaactgccaggccgcattgctgtgcaggatgatcttgacaatactgaactgccctttttcactttggaaatgtctggcaccgctgccgacattagcttggtccactggagacagcagtggctggagaatggaaccctttattttcacgtttctatgtcgagcagtggccagctggctcaggccaccgcacccactctgcaggagccgagtgagatcgtggaagagcagatgcatatactgcatatcagcgtgatgggagggctgatcgctttgcttttgctgctgctcgtattcacagtagccttatacgcacagcgaaggtggcagaaaagacggcggattccacagaaatcggctagtacggaagccactcacgaaatccactatattccatccgtgcttttgggtcctcaagctagggagagctttaggtctagtcgcttacaaacccacaattccgtgatcggggtgcccattagagagactccaattttggacgactatgattgcgaggaggacgaggagcctcctaggcgggccaaccacgtctccagggaagatgaatttgggagtcaagtaacacatacactggactcactcggacaccccggcgaagagaaagtagacttcgaaaaaaagggcggtatatcattcggacgcgcaaaagggacttcaggcagcgaggcagacgatgaaacccaactgaccttttacacagagcagtatagatctcgcaggaggagtaaaggactcctcaagtccccagtgaacaaaactgctttgacacttatcgctgttagttcatgtatccttgctatggtctgtggctcccagatgagttgcccgctaactgtgaaggtgaccctgcatgttccagagcacttcattgcagatggaagctcttttgtggtatccgaaggaagctacctggatataagtgattggctaaaccctgccaagctgagcctgtactaccagatcaatgccacaagcccttgggtcagggacctctgtggtcagaggactaccgatgcttgcgagcaactctgcgatccagagacaggggagtgttcgtgccatgaaggctacgctccagatccggtgcataggcacctctgcgtgaggagcgactggggacagtcggaaggcccgtggccctacactacgctcgaaagaggatatgacctggttacaggggaacaagccccagagaagattctgagatccacattttccttggggcagggcctctggctcccagtgtctaagtctttcgtcgttccaccggtggaactgtcaattaatccactggccagttgcaaaaccgatgtcctcgtgacagaagatccagctgacgtcagagaggaagcaatgctcagtacatactttgagaccatcaatgatctactgtcctcctttggtcctgtgagggattgcagtcggaacaatggcggctgcaccaggaacttcaagtgcgtttccgatcgacaggttgactcctccgggtgcgtgtgtcctgaagaattaaagcctatgaaagatggtagcggctgctacgatcacagtaaaggcatcgactgttctgacggatttaatgggggctgcgaacagctgtgtctccagcagactttgccccttccctacgatgccacaagctctacaatctttatgttctgcggatgcgtggaagaatacaagttggcccccgatgggaaaagttgcctgatgctgagtgatgtctgcgagggccccaaatgcttgaaacccgacagcaagtttaacgacaccctttttggtgaaatgttgcacggttacaataatagaacccaacacgtaaaccagggccaggtgttccagatgacatttagggagaacaatttcataaaggattttccccagctggccgacggcctcctggtcattcccctgcccgtcgaggaacagtgccgcggggtgctaagcgagcccctgcccgacctgcagctcctcaccggtgacatccggtacgatgaggccatgggctaccccatggtgcagcaatggcgtgttaggtctaatctgtatcgtgtcaaattgtccactataaccctggcggctggattcactaacgtactcaagatcctaactaaagagagttctcgagaggagttactcagttttatccaacactacggctcccactacatagcagaggctctgtatggatccgagctcacgtgcattatccatttccctagcaaaaaagtgcaacagcaactgtggctccagtatcagaaagaaacaaccgaattgggctcaaaaaaagagctcaagagcatgcctttcatcacatatctaagcggcctcctaactgcacagatgttgagtgatgaccagctaatatccggcgtagaaattagatgcgaggagaaaggcagatgtccctcaacgtgccatttatgcaggagacccgggaaagaacagctttcccctacccccgtgctgctagaaatcaatagagtggtgcctctttatacactgatccaagataatggaacaaaggaggcctttaaaagtgcactgatgtcgagctactggtgctccggaaagggcgacgtgatagatgactggtgtcgttgcgacctttccgctttcgatgcaaacgggctccctaactgcagccctttactccaacccgtgttacgcctctcccccactgtggagcctagtagtacggtagtgagtttagagtgggtggacgtgcaacctgccatcggcactaaggtctccgactatatcctgcagcacaagaaagtggacgaatacaccgacacggatttatacaccggcgagtttctgtcttttgccgacgatctgctgtcggggcttgggacgtcgtgtgtcgctgctggacgttctcacggagaggtccccgaggtctccatttatagtgtcatttttaagtgtttggagcccgacggactgtataagttcacactctatgccgttgacacaagagggcgccacagcgaactgtctacggtgactctccgaaccgcttgtccactcgttgacgacaataaggccgaggagattgcggacaaaatttataacctgtacaatggctacactagcggaaaggaacagcaaatggcctacaacaccttgatggaggtgagcgcctctatgttatttcgcgtgcagcatcattataacagccactacgagaagtttggagattttgtttggagatcagaagacgagctcgggccccgaaaggctcatttgatcctgcggcggctggaaagagtttcttcccattgtagtagtttactgaggtcagcgtacattcagtcgcgcgttgagactgtcccatacctgttctgcaggagtgaagaggtgagacccgcaggcatggtgtggtatagtatcctgaaggatactaagatcacatgtgaggagaagatggtctccatggctagaaatacctatggagaatcgaaaggcagatag

SEQ ID NO: 179607 - DNA, 1188 bp, Artificial Sequence
  Description of Artificial Sequence: Synthetic coding sequence
atgcccttcatcacctacctgagcggcctgctgaccgcccagatgctctctgacgatcagttgatctctggcgtggagattcggtgtgaagagaagggcagatgccccagcacgtgccatctgtgccgtcgtccaggaaaggaacagctctcgcctacacctgtgctgctggaaatcaacagagtggtacctctttatactctgatccaggataatgggacaaaggaggcctttaaatccgccctgatgtcttcatactggtgttctgggaagggggacgtgatagacgattggtgccgctgcgatctgagtgctttcgacgcgaacggactccccaactgttcccctttactgcagccagtgctgcgcctgtccccgactgtcgagccctccagcactgtggtgtcattggaatgggtcgacgtccaacccgctatcggtactaaggtgtccgactacatactacaacataagaaagtcgatgaatataccgacacagacctctacacaggggaattcctttccttcgccgatgacctcctgtcggggctggggactagctgtgtggctgcaggcagatctcatggtgaagtcccggaggtgtcaatctattctgtcatatttaaatgcctggaacctgacggactctataagtttacactatacgcggtggatacaagggggagacattccgaactttccactgtcacactgaggactgcttgtccactggtcgatgataataaggctgaagaaattgccgacaagatctataatttatacaacggctatacttctggtaaggagcagcagatggcgtacaatactctaatggaagtgtccgcaagtatgttgttccgcgttcaacaccactataatagccattatgagaagttcggggactttgtgtggcgttccgaggatgagctgggtccaaggaaagctcatttaattctacggcggctggagcgggtttcatctcactgcagctctcttctgagaagtgcgtacatccagagtcgggtggagaccgtaccatacctcttttgccggtccgaggaggtgcggcccgccggaatggtatggtattctatcttgaaggataccaaaattacatgcgaagaaaaaatggtgagtatggctaggaatacgtactacttgaccctctccaaggtctctcctttttag

SEQ ID NO: 179608 - DNA, 4008 bp, Artificial Sequence
  Description of Artificial Sequence: Synthetic coding sequence
atggccgccgccggcgcccggctgagccccggccccggcagcggcctccgaggacggccgcgtctctgctttcaccccggacctcccccactgctgcctctgctccttctattcctgctcctgcttccccctccccctctgctcgctggagcgaccgccgccgccagtcgcgagccagacagcccctgcaggcttaagacggttacagtgagcaccctaccagccctgagggaaagtgatatcggatggtccggggctcgggctggggcaggagcagggaccggagccggggccgccgcggccgccgcgtcacccggctccccagggtctgctggaacagcagcagagtctcgtctgttgctgtttgtgcggaacgaactgcccggtcgaatagccgtacaagatgacctcgataacacggaattgcctttctttacactggaaatgtccggaacagccgcggatatttctctggttcactggagacagcagtggctggagaacggaacactttattttcacgtctcaatgagctcctccggccagctcgctcaagcgaccgctcctaccctgcaggagccgagtgaaatcgttgaggaacagatgcacatcctccacatctcggtgatgggaggcctcattgcgctgctgctgctactcctcgtgttcaccgtcgccttgtacgcgcagcgtcgctggcaaaaacgtaggagaattccacagaagtctgcttccaccgaggctacccatgaaatccactacattccttcggtcctgctgggcccccaggcgcgtgagtcctttagaagttcgcggttacagacccacaactcggttatcggggtgcccattagggaaactcccatcctcgacgattacgactgcgaggaggacgaagagcctccacgtcgagccaatcacgtatcccgagaagatgaatttggcagtcaagtgacgcacaccctggattctcttggacatcccggagaggaaaaggtagattttgagaaaaaggctgctgccgaggctacacaagaaactgtggaatccctgatgcagaaatttaaagaaagcttcagggccaacactcctatagaaattggccagttacagcctccacttagatccacgagtgctggtaaacgtaagcgacggtccaaatcccgcggcgggatttcatttggtagggccaagggtacttcaggtagcgaagccgatgacgagactcagcttacattttacacagaacagtaccgttcgagacgacgcagcaagggactgctcaaaagcccggttaataagactgccttaacactaatagcggttagttcttgtatcttggcgatggtttgtgggagtcaaatgtcatgccctttaacagtaaaggtgactttacacgtgcccgagcatttcatcgccgatggaagtagcttcgttgtatctgaaggttcctacctggatatctctgattggctgaatcccgcaaagctgagtttatactaccaaattaatgctacttcaccttgggtgcgagacctgtgtgggcagcgtacgaccgacgcctgcgagcagttgtgcgacccggaaaccggcgagtgttcttgccatgagggttatgcccccgatcccgtgcatcgccacctgtgcgtgcgttcagactgggggcagagtgagggtccgtggccttacacaacgctggagaggggatacgacctagtcactggggagcaggcccccgagaagatcctttcactcgggcaggggctctggcttccggtgtcgaagtcttttgtggtgcccccggtggaactaagtataaacccgctcgcaagctgtaaaacagacgtgctcgtcactgaagatccggcagacgtcagggaggaggccatgctgtccacatatttcgagaccataaacgatctcctgtccagctttggtccagtgagagactgttctcggaacaatggaggctgtacacggaattttaagtgtgtttcggacagacaggttgacagctcaggttgcgtatgccccgaggaattaaaaccaatgaaagacggcagcgggtgttatgaccacagcaaaggtatcgattgtagtgacggcttcaacggcggatgtgagcagctctgcctacagcagacactcccactcccatatgatgccacttcttcaactattttcatgttttgcggctgcgtagaagagtacaagttagcacctgatggcaagtcatgcctgatgttaagcgacgtctgtgaggggcctaagtgcctgaaacccgactctaaatttaatgacaccctctttggcgagatgttacatgggtataataaccgcacccagcacgtgaaccagggtcaagtgtttcaaatgacctttcgggagaataacttcattaaagacttccctcagctcgcagatggactcctggttattccactgccagtggaggaacagtgtagaggagtgctgagtgagccgctgcccgatctgcagttattaactggcgacataaggtatgacgaagccatggggtaccccatggtacagcagtggagagtgcgcagtaacttgtaccgtgtgaaactctcaaccattactctagccgccggttttacaaatgtgctgaaaatcctaaccaaggaatccagcagggaagaactgctgtcgtttatccaacattatggctcacactatatcgcggaggcgctctacgggagtgagctgacttgtatcattcactttcctagcaagaaggtccagcagcagctgtggctgcaatatcaaaaggagacaactgaactcggttctaaaaaggagttgaagtctatgccattcatcacatatctgagcgggttacttacagcccagatgctgtcggatgatcagcttatctcaggagttgaaatccgctgtgaagaaaagggacgctgtccttctacttgccatctctgcagaaggcctggaaaggagcagctgagccctactccagtgctgctggagataaatagggtggttccgctctacacacttatccaggacaacggcactaaggaagctttcaagagtgcattaatgtcctcttactggtgctctggcaagggcgacgtgatagacgattggtgtcggtgcgacctgagcgcatttgacgccaacggactcccaaactgctctccgctcctgcagcccgtccttcggttaagccctacagtggaaccctcctcaaccgtagtgtcgctagaatgggttgacgtgcaaccagccatcgggactaaggtaagcgactacatcctccagcacaagaaggttgacgagtacacagataccgacctgtatacaggcgaattcctgagcttcgcagacgacctcttgagcggcttgggtacaagttgtgtagcagccggtagatctcacggagaggtaccggaagtgagcatttacagcgttatctttaaatgtctggagcctgacgggctatacaagttcacattgtatgctgtcgacacacggggcaggcactcagaacttagtactgttaccctccggacagcctgccctttagtggacgacaataaagcagaagagattgccgacaaaatctacaacctttataacggttatacctctgggaaggagcagcagatggcgtataacacactgatggaggtgtccgccagcatgctctttagagtgcagcaccattataattctcactacgaaaagttcggtgattttgtgtggcggtctgaggacgagctggggcccagaaaagcgcacctcattctgcgcagactggagagagtatccagccattgctcctccctattaaggtctgcatacatccaaagtagggtggaaaccgtgccctaccttttctgtcggtcagaggaagttcgcccagcaggcatggtttggtacagcatcctgaaggacactaaaataacatgtgaagagaaaatggtttccatggctcggaatacctacggcgaaagtaaggggagatag

SEQ ID NO: 179609 - DNA, 297 bp, Artificial Sequence
  Description of Artificial Sequence: Synthetic coding sequence
tgaatggcctacaacaccctgatggaggtgagcgccagcatgctgttccgggtgcagcaccattataacagccattacgagaagtttggcgacttcgtgtggcgaagcgaggatgagctgggtccctccttactggaaagttttatgtcattgcaagacatcaatctgctcgaacgccgccccggcaggccacagcgccccggaaaccccctctctaacgtgtcctggcggatatctgaaatcgcgccaacctcacacacagacatgagcgctggaataaaggagactgccagctag

SEQ ID NO: 179610 - DNA, 6828 bp, Artificial Sequence
  Description of Artificial Sequence: Synthetic coding sequence
atggccgccgagcggcggtgcggcagcatgcgggacctgcgggcccaggtgacctcaggcttgctgccctttccagaagtgacactacaagccctgggtgaggatgagatcactctagaatcagtcctgagaggaaaattcgctgctggcaaaaacggtttggcctgtctggcctgcggaccccagctggaggtcgtgaattcaatcacaggtgaacgtctgtcagcctacaggttttccggggtcaatgaacagccccctgtggtgcttgctgtcaaggagttttcatggcaaaaacggacaggcctgctgatcggactggaagaaaccgagggctccgtgctgtgcctctacgaccttggtatttccaaagtggttaaggcagtggtcctgcccgggcgggtgactgccattgagcccattattaaccacggcggagctagcgcgtccacccagcatctccacccatctctcaggtggctttttggagtggctgcggtcgtgactgatgtcggccagatactgctcgtcgatttgtgtctggatgatctgtcatgcaatcagaacgaagtggaggcatccgatctggaggtgttgacagggatcccggccgaagtcccgcacatccgtgagtcggtcatgagacagggccggcacctgtgctttcagcttgtgtcccccaccggcactgccgtgtcgacactgagctacatcagtcgcaccaaccaactcgccgtggggttttcagacggatacctggccctctggaacatgaaatctatgaagcgtgagtactatatccaactggagtctggacaggttcctgtatatgctgttacctttcaagagcctgagaacgatcctcgcaattgctgttatctctgggcagttcagtctacccaagattcggaaggtgatgtgctcagtttacatctgcttcagttagcttttggaaatcggaaatgcttggcatctgggcagatcctctacgagggcctcgaatactgtgaggaacgatacaccctcgacctgaccggaggaatgtttccgctccggggccaaacgtccaacaccaagctgttaggctgtcagtccattgagaagtttcgcagccacggggaccgggaggagggtgtaaatgaggctctgagtcctgacacttccgtttccgtctttacatggcaggtcaacatatacggccaaggaaaaccctcggtgtacctgggcttgtttgacatcaacaggtggtaccacgcccaaatgcctgactctctcagatctggggagtatctgcataattgtagctacttcgccctgtggagcctggagtcagtcgtgtcgagaacatcaccgcatggcatcctcgatatcctcgttcacgagagatctttgaatcgaggcgtgccccctagctaccctccccccgaacagttctttaatccgtctacatataattttgacgccacgtgcctcctgaattccggggtggtccacttaacctgtaccggattccaaaaagagacactaacattccttaaaaaatcgggacccagcctcaatgagctaatacccgacggatacaacaggtgtctcgtggctgggctgctgagccctcgcttcgtcgatgtgcagcccagctcgctcagtcaggaagagcagctggaagctattctctccgctgctatacagacgtcttccttgggactgctgacaggctatatcaggagatggattaccgaggagcagcccaatagtgcaactaacctccgcttcgttttagaatggacatggaacaaggtcgtcctgaccaaggaagaattcgaccggctttgcgtccccctgtttgacgggagctgccatttcatggatccgcagacaattcagagtattcagcagtgctatcttttattatctaatcttaatattgtgctgagctgcttcgcctctgaagccagagagatcacagaacgaggactcattgacctgtccaataaattcgtggtgtcacatctcatttgccaatacgcccaagtagtgctgtggtttagccactctggcctgttgccagagggtatcgacgactctgtgcagctctcaagattatgctacaactacccagtcatccagaactattacacctcgagacggcaaaaattcgagagattatccagaggcaaatggaatccagattgtttaatgattgacggcctagtgtcacagctgggcgagaggattgagaaactctggaagagggatgaagggggcaccggaaagtatcctccagcatctttgcatgccgtgttagacatgtatttactggatggcgtgactgaggctgccaaacattcgatcaccatatacttgctactcgacataatgtatagcttcccaaacaaaactgatacaccgatcgagtcttttcctaccgtgttcgcgatcagctgggggcaggtgaagctaattcaggggttttggttgatcgatcacaatgattatgagagcggcctggacttattgttccaccccgcaacggccaagccactgtcctggcaacactccaaaatcatccaggcgttcatgtcacagggtgagcacagacaggccttacggtacattcagactatgaagccaacagtgtcaagcggtaacgatgtgatccttcacctcactgtgctcttgttcaatagatgcatggttgaggcttggaatttccttcgacagcattgtaacaggctcaacatcgaggaattgttaaagcacatgtatgaggtatgccaggaaatgggtctgatggaggacctgctgaaactaccatttacggataccgaacaggagtgtttggtgaaatttcttcagtccagcgctagtgtgcagaatcatgagtttttgctggtccaccacctgcagagagccaattacgttcccgcgctgaaattaaaccagaccctgaaaattaatgttatgaatgatagggaccccaggctgcgagagagatccttggcccgaaactctatactggatcaatatggcaagattcttcccagagtgcaccgaaagctggccatcgaaagagccaaaccatatcatctgtccacatcttccgtgttccggctggtgagtaggcccaagcccctaagcgccgttcccaagcaggtggtcactggcacagtgctaacaaggagtgtgtttatcaataacgtgttaagcaaaatcggagaggtgtgggcaagtaaggagcctatcaattctaccacaccctttaattccagcaaaattgaagagccatctccaatcgtgtatagcctgccagccccggagctgccagaagcgttttttggaacccccattagcaaggccagtcagaagatctcccggctcctagatctggttgtccagcccgtccctcgcccaagtcaatgtagtgaatttatccagcagtcttctatgaagagtcccctctacttggtgagtcgttccctgccctcgtcaagtcagctaaagggatcaccacaagcaatatcgcgggcttccgagctgcatctattggagactccgctggttgtgaaaaaagccaagtcgcttgctatgtcagtgactacaagcggattcagcgaattcaccccccagtctattctgaggtctactctcagatccacacctctcgcgtctcctagcccttcccctggacgcagcccgcagagactgaaggaaactagaatctctttcgtcgaagaggacgtccaccccaagtggattcctggcgccgctgacgatagcaaactggaggtattcactactcccaaaaagtgtgcagtcccagttgagactgaatggctgaagtccaaagaccggaccaccagtttcttcctgaactcccccgaaaaggagcaccaagagatggatgagggctcacagtccctcgagaaactggacgtgtccaagggaaacagcagtgtgagtataacatccgacgaaacaaccctggaataccaggatgcccctagtccagaagatctggaagagacagtatttaccgcttcaaagccgaagtcaagttctactgcactgaccacaaacgttaccgaacaaacggaaaaggacggcgacaaagacgtgtttgcctccgaagtgaccccttctgacctacaaaagcagatggggaatctcgaggatgccgagactaaggacctgctagtggccgccgaagctttcagtgaactcaaccacctatccccggtgcaagggactgaagcgtcactgtgtgccccttctgtatatgaagggaagatctttacacagaaatcaaaggtaccagtgctcgatgaaggcctgacatccgttgagacctatacccccgcaatccgcgccaatgataataagagtatggccgatgtgcttggcgatggagggaactccagtctgacaatttctgaaggccctattgtctctgaaagacgcctgaatcaagaagtcgccttgaatctcaaggaagaccatgaagtcgaggttggagttctgaaggagagcgtggacttgcctgaggagaaattgccaatatctgactctccacctgacactcaggaaattcacgtgatagagcaagagaagcttgaggcccaggacagtggggaggaagcgagaaacttgtcattcaacgagctgtatcccagtggcaccctgaagctgcagtataatttcgatacaattgatcaacagttctgcgacttggctgataataaagacactgccgagtgtgatattgccgaagtggacggagaactctttgtggcccagagtaacttcacattaatcttggaaggagaggaaggcgaggtcgagccaggtgacttcgctagcagtgatgtgctgccgaaggctgcaaataccgcgaccgaggaaaaacttgtctgtagcggagaaaatgacaaccatggccaaatagctaacctgccgagcgcagtgaccagcgatcagaaaagtcagaaggtggacacgctgccttacgtcccggagcccatcaaagtcgctattgccgagaatctgcttgatgtcatcaaggatacccgcagcaaagagattacttccgacactatggagcagtccattcatgaaacaatccccctcgtatcacagaacataatgtgtcctactaagctcgtgaagtccgccttcaaaacagctcaggagacaagtactatgacaatgaacgtgtctcaagtggacgatgttgtgtcctctaaaactcgcaccagaggacagaggatacagaacgttaatgtgaagagcgcccaacaagaagcctcagctgatgtggctacgcccaaaatgccagggcagagcgtccgaaagaaaacccgtaaagccaaagagatttctgaagctagtgaaaatatctacagtgacgtccggggcctctcacagaaccaacagattccgcagaactccgtgaccccaagacgcggccgcaggaagaaagaggtgaaccaggatatcctcgagaataccagctccgtagagcaggagctccaaataaccacaggtagagagagcaaaaggctcaaatcgtcacagcttctagagcctgccgtggaagaaacgactaagaaagaggtcaaggtgtcttctgtgactaagcggacaccccgacgcatcaagaggagcgtggagaaccaggaatcagtggagatcattaatgacctgaaagtgtcaactgtgacctctcccagccggatgattcgaaagttaagatcaactaatctcgacgcaagtgaaaacacgggcaataaacaagatgacaagtcttccgacaaacagctccgaatcaagcacgtgaggcgggtgcggggtagagaagtctctccgtccgatgtgagagaagactcaaatctggaaagctcccagttgacagtacaggctgagttcgatatgagtgcaataccacgcaagagaggtcgtcctcgcaaaatcaacccatctgaggacgtcggtagcaaggctgtgaaggaagagcggtcacctaaaaagaaggaggccccatcaattcgacgcaggagtactcgaaatacccccgccaagagcgagaatgtggacgtgggaaagccggccttaggcaagtcaatcctggtgcccaacgaagagctgagcatggtcatgtccagtaaaaaaaagctaaccaagaagactgagtcccagtcacaaaagaggagcctccactcagtgtctgaggagaggactgacgagatgacccacaaagaaacgaacgagcaggaagaacggttgctggcaacagcttcgttcaccaagagctcccgctcctctcgtactaggagcagtaaggctatcctgttgccagacctctcagagccaaataacgagcccctgttcagcccagccagcgaggtgccgcgtaaagcgaaagcgaaaaaaatcgaagtcccagcccaactgaaggagttagtatcagatttaagttcccagtttgtgatcagcccacccgccctccggtcaagacagaaaaacacatcaaacaaaaacaaattagaagacgaactaaaggacgatgcacaatccgtcgaaactctgggtaagcccaaggccaaacgcattcgaacatccaagacaaaacaggcctcaaaaaacacggagaaggagagtgcatggagtcccccccctatagaaatccgactaatcagtcccctcgcctctccagctgatggcgtgaagtccaagcctaggaaaacaacagaggtgacagggaccgggctaggcaggaacagaaagaagctttcatcctatcccaagcagattttgcgacgaaagatgctctag

SEQ ID NO: 179611 - DNA, 6906 bp, Artificial Sequence
  Description of Artificial Sequence: Synthetic coding sequence
atggacagcctggccggcctgagcccccgggaggccgccggcgtgctctccctctcttgcgtgggagtgtgttctacttgcgcgtgggcatggccccacggctccatgagggatctgagagcacaggtcacttctgggctgctgccgttcccagaggtgaccctacaggccctcggggaggatgaaattactctcgagagcgtgctacgaggaaagttcgctgccggcaaaaacggacttgcttgcttggcctgtggaccccaacttgaggtcgtaaactccatcaccggggagcgcctgagcgcgtatcgtttcagcggcgtgaatgagcagcctcccgtagtgctggcagtgaaagagttctcatggcagaaacgaacagggctgcttatcggcctcgaagagaccgagggtagtgtcctgtgcctgtatgacttggggatcagcaaggtggtgaaggcggtagtgttacccggcagagtcacggccattgagcccatcattaatcacggcggggcgtccgcctccactcagcacctacatccgtctctgagatggttgttcggtgtcgccgccgtagtgacagatgtgggacaaattctcttagtcgacctgtgcctcgacgacctctcgtgcaaccagaacgaggtcgaagcatctgatctggaggtccttaccggtatcccggccgaagttccccatattcgtgagtctgtcatgaggcagggtaggcatttgtgcttccagctggtttcccccacagggactgctgtgagcaccctgagttacatttccaggactaatcaattggcagttggttttagcgacggatatctggccttgtggaacatgaagtccatgaagagggagtactatatccagcttgaatctggccaggtccccgtgtacgccgtgacgttccaggagcctgaaaatgacccccggaactgctgttacctgtgggccgtgcagtccactcaggatagtgaaggggacgtcttgtctctccatctcctacaacttgcctttgggaatcggaaatgtctggcctcaggacaaattctgtacgaaggcctggagtactgcgaggaacgatatactctggacctgaccggggggatgttcccattgcggggacagacctcaaataccaaactgctgggatgccagtctatcgagaagttccgtagccatggggatcgtgaagagggggtgaatgaagcactgagccctgataccagtgtgtctgtctttacatggcaggtaaacatttatggacagggcaagccttctgtttatttaggcctattcgatattaatcggtggtaccacgcccaaatgccggactccttacggagtggagagtacctgcacaactgttcttatttcgccctgtggagcttggagtccgtggtgagcagaaccagcccgcacgggattctggacattctggtgcacgagcgatcactcaatcggggggtgcccccaagttaccccccacccgaacagttctttaacccttctacttacaactttgatgctacttgcttgctgaactctggggtggttcatctcacctgcaccggctttcagaaggaaacactcaccttcttgaagaagtctggaccctccctgaacgaactgatccccgatggctacaaccgctgtctcgtggcggggctgctgtctcccagatttgtggacgtacagccaagttcactgtcacaagaggagcagcttgaggccatcctctctgccgccatacaaaccagctcgctgggactgttgactggttatattcgtagatggatcactgaggagcagccaaattctgctactaatttaagatttgttctcgaatggacgtggaataaggtagtactgaccaaagaggagtttgataggctgtgtgtgcctctgtttgacggttcctgtcactttatggacccccagacgatccaatccattcagcaatgttatttacttctaagcaatctgaatatcgtgctttcctgcttcgccagtgaagcccgggagattacagaaaggggcctgatcgatctctcaaataaatttgttgtctctcacttgatttgtcagtacgcccaagtcgtcttatggttttcacactctggactccttccagaaggcattgacgattccgtccaattgtctagactctgctataattacccagtgattcagaactactatactagtagacggcagaagttcgagcgcttgtccagggggaaatggaaccctgactgcctgatgatcgacgggctggtgagccagctgggggaaagaatcgagaagctgtggaagcgggacgaaggaggtacaggaaagtacccacccgcatctctgcacgctgttttggatatgtacctgctcgacggtgtgaccgaagcagcgaaacattcaattaccatttatttgctgttggatattatgtacagcttcccaaataaaactgacactcctattgagagcttcccgacagtgtttgcaatatcttgggggcaggtgaaactcatccaggggttttggctgatcgaccacaacgattatgaaagtggcctggacctgctgttccaccctgccacagctaaaccgctgtcctggcagcactcaaaaatcatccaggcttttatgtcccaaggcgagcatcggcaagccctgcgctacatacagactatgaagccaactgtgtcttcagggaatgatgttatcctgcatctgaccgtactgctgttcaatagatgtatggtggaagcttggaacttcttgaggcagcattgtaatcggctcaacatagaagaactgctgaagcacatgtacgaggtgtgccaggagatgggattgatggaagatctccttaaattgccctttacggacacggagcaggagtgtctcgtgaaatttctgcagtccagcgcctctgtgcagaatcacgaattcctgttggtccaccacctgcagagggccaactatgtgcccgctctgaagctgaatcagaccctaaagatcaatgtgatgaatgatcgcgacccccggttgagagaacgtagcctggcccgaaactcgatcttagaccagtatggcaaaatcctccctagagtgcatcgtaagcttgcaatagaaagagccaagccgtaccacttgtccacaagctcagtgttcaggctcgtctctcgcccgaagccattaagtgcagtccctaaacaggtggtgaccgggaccgtgctaactaggtcagtgttcatcaataacgttctaagtaagattggcgaagtctgggccagtaaggaacctatcaacagcacaacgccattcaactcatcaaaaatcgaggagccgagtcctatcgtgtacagtttgcctgcccctgagctccctgaagcttttttcgggactcctatctccaaggcatcacagaagatcagcagattgctagacttagtggttcagccggtcccacgacctagtcagtgctctgagtttatccagcagagcagcatgaaatcccctctatacttagtcagcagatccttgccctcctcctcccagctgaagggctctccccaggccatttctagagcgtctgagctgcatcttctggaaacgcccctcgtcgtgaagaaggctaagtcgctggccatgtctgtcacaactagtggattttcagagttcactccgcagtcaattttacgttcaacactgcgaagcacgcccctggcctccccctccccatcgccaggcagaagcccccagcgtcttaaggaaaccagaatcagcttcgtagaagaggatgtgcatccgaaatggatcccaggcgcagccgacgacagcaagctggaagtgttcacaacacccaaaaagtgcgcagtacctgtggagaccgagtggttgaaatccaaagataggacgacaagcttttttctgaacagtccagaaaaggaacatcaggaaatggatgaaggtagccagtctctggagaaacttgacgtttccaagggaaacagctctgtctcaatcacaagcgatgaaacaacactggaataccaggacgctccgagtcctgaggacctcgaggaaacagtcttcactgccagcaagcccaagtccagcagtacagcactcaccaccaacgttacggagcagaccgagaaagacggcgacaaagacgtgttcgcatctgaggtcactccgagcgacctccagaaacagatggggaatctagaggatgcggaaactaaggatctgcttgtggcagccgaggcgttctcggaactgaaccacctctcccctgtgcagggcacagaggcttcgttgtgcgccccatctgtgtatgaaggaaaaattttcactcaaaagtcaaaggtgccagtccttgacgagggcctgacaagcgtcgagacatacacacctgctatccgtgctaacgacaacaagagcatggctgatgtgctcggtgacggcgggaatagctccctgacaatctccgagggtccgatcgtctccgaaaggaggctgaatcaagaggtagccctgaatctcaaggaggatcacgaggttgaggtgggcgttttgaaggaaagtgtggatctgcctgaggagaaattgcccatctctgactctccccctgatacccaggaaatccatgtgatcgagcaggaaaagcttgaggcccaggattccggggaggaggcgagaaacctttcgttcaatgagctctatcccagtggaactctcaagctgcagtacaatttcgacactatcgaccagcaattttgtgacttggcagataacaaagacacagccgagtgcgatatcgccgaggttgatggcgaactcttcgttgcccaatccaatttcactcttatcctggagggcgaagaaggcgaagtcgaacccggcgacttcgcaagcagcgacgtcctgcccaaggctgccaatacagctactgaggaaaagctcgtctgctccggagagaacgataaccatggccagatcgccaacctgcctagcgccgtgacatctgaccagaagagccagaaagtcgacactctcccgtatgtacccgagcctatcaaggttgccatcgccgagaatcttctggacgtgattaaggacacgcgaagcaaagagataacctccgataccatggagcagtcaatccacgagacgattcctctggtcagtcagaatattatgtgtcccactaagctggtgaagagcgcattcaagaccgcccaggagacgagcacaatgacaatgaatgtatctcaagttgacgacgtggtgagctctaagactcgcacccggggccagaggatccagaatgtcaatgtaaaatcagcacaacaggaggcttctgccgatgtcgccactccaaaaatgcccggacagagcgtcaggaaaaagactagaaaggccaaagagatttcagaggcaagtgaaaatatatatagtgatgtgcgtggactgtcacagaatcaacagattccacagaactccgtgacgccaaggagaggcaggcgaaagaaagaagtgaaccaggacattctcgagaatacaagctcagtcgaacaggagctgcagataactaccgggagggagtctaaacggctgaagagttcccagcttctggaaccggcagtggaggagaccacaaaaaaagaggtgaaagttagttccgtgacaaaaagaacccctcgacgcattaagcggagcgtggaaaaccaggaaagcgtggaaatcataaatgatcttaaggtgtcgaccgtcacatccccttcccgcatgatccggaagttaaggagcactaacctcgatgccagcgagaatactgggaataaacaagatgataagtcctccgacaaacaactacgcatcaaacacgtgagaagagtgagggggcgagaggtgtctcccagtgatgtgcgagaggattcaaaccttgaaagcagccagctgaccgttcaagcagaattcgacatgagcgctatacctcgcaagcgcggccgtcctcgcaaaattaatccgtccgaggatgtgggcagtaaggccgttaaagaagagaggagccctaagaagaaggaggctccaagcatccgaaggcgtagcaccaggaatacccccgccaagagcgagaatgtcgacgtgggaaaacctgctctcgggaaatctatcctagttccgaatgaagaactttccatggtcatgtcatcaaagaaaaaactgaccaaaaagactgagagccagtctcaaaagcgcagcctgcatagcgtgtccgaagagaggaccgacgagatgacacacaaggaaacaaatgaacaggaagaacgcctgctggcaaccgcatcctttaccaaatcttcaaggagctctagaactcgaagctctaaggcaatccttctgcccgacctttccgaaccgaataacgaaccccttttttcccctgcaagcgaggttcctcggaaagccaaagccaaaaaaattgaagtgcccgcacagctgaaggagctggtgtcggacctcagcagccaattcgttatatcaccacctgccctgcgcagtagacagaaaaatactagcaataagaacaaactggaggatgagctgaaggatgatgcccagagcgtcgagactctgggaaagccaaaagcaaaacggattaggaccagcaaaaccaagcaggcgtccaagaatacagagaaggagtctgcctggagccccccccccatagagatacgtttaatttctccgctagccagcccagcggatggagtgaagtcgaagcccaggaagaccacggaagtgacagggaccgggctcgggaggaacaggaagaaactgagctcctatccgaagcagatcctaaggagaaagatgctgtag

SEQ ID NO: 179612 - DNA, 6801 bp, Artificial Sequence
  Description of Artificial Sequence: Synthetic coding sequence
atgcgggacctgcgggcccaggtgaccagcggcctgctgcccttccctgaggtaacactgcaggcactaggtgaggacgagattacgctggagtccgtgcttcggggtaaattcgcagctggaaaaaatggcctggcctgcttggcctgcgggccacagctggaggtagtgaacagcatcacaggcgaacgcctctccgcttatcggttctctggtgtcaatgaacagccccctgttgtgttagcggtcaaagaattcagttggcagaaacggacagggttactaattgggctcgaagaaacagaggggtcggtcctctgcctgtacgacctgggaatatcgaaggtcgtgaaggccgtcgtgctgccgggccgcgtgacagctatagaacctattattaaccatggcggggcatcagcttcaacacagcacctgcatccatcgcttcgctggctgtttggcgttgctgcagtggtcactgatgtgggtcagatactgctagtggacctatgcctagatgatctgtcttgcaaccagaacgaggtggaagcttctgatctggaggttctgacaggaatacccgctgaggtaccacatatccgtgagtctgtgatgcgacaagggcgccatctgtgctttcagttggtgtctcccaccggcactgcagttagcactctaagctacatcagtagaacaaatcagttagccgtgggcttctcagacggctatttagcattgtggaatatgaaatccatgaagcgggagtattatattcagctcgagtccggccaggtccctgtgtacgctgtgacctttcaagaaccggaaaacgaccctcgcaactgctgttacctatgggctgtgcaatccactcaggactcagagggggatgtcctgtctctccacctgctccagctggccttcgggaacagaaaatgcctcgcatctggacagatcctgtatgaaggcctggagtactgtgaggagcgctatacactggatctcacagggggaatgttccccctccgaggacagactagcaacacaaaattgctgggctgccagagcattgaaaagttccgaagccacggggacagggaggagggggtcaacgaggccttatctcccgacacctctgtgtccgtgttcacctggcaggtcaacatttatgggcagggtaagccttcagtttatctgggtctgttcgatatcaataggtggtatcatgcccagatgcccgactctctccgcagcggtgagtacctgcataattgctcctatttcgccttgtggtcacttgaatcggtggtgagcagaacgtcacctcatggcatacttgacatcctcgtacacgaaaggtccctcaatagaggagtgccaccaagctaccccccgccagaacagtttttcaaccccagcacctacaatttcgacgccacgtgcctcctcaatagcggggttgtgcatttgacatgtacaggattccagaaggaaacactcacctttctgaagaagtccggccccagtctgaatgagttgatacccgacggatacaacagatgcctggtcgcgggcctcctttcacccaggttcgtggatgtgcagccctcttccctttcacaagaggaacaattggaggccatcctgagcgcagctatacaaacgagttcgctggggctgttgacgggctatattcgtcggtggattactgaagaacaacctaactccgccactaatctgcggttcgtccttgaatggacatggaacaaagtggtattgacaaaggaggagtttgatcgactgtgcgtgcccctcttcgacgggagctgtcacttcatggacccacaaaccatccagagcattcagcagtgttacttacttctaagtaatttaaacatcgtgctatcctgctttgcctctgaggcgcgagaaataaccgagcgcggcctgatcgatcttagcaacaaattcgtcgtgagccaccttatttgtcagtatgcacaggtagtgttgtggttctctcacagcggtctccttcccgaggggattgacgattccgtgcagctgtccagactgtgctataattatcccgtaatccagaactattacacttcacgccggcagaagtttgagcgcctgagtcgcggtaaatggaaccccgactgcctgatgattgacggacttgtgagtcaactcggtgaaaggattgagaagctttggaagagggacgaggggggcacgggcaagtatcctcccgcgagcctacatgccgttctggacatgtatctgttagacggcgttaccgaagccgcgaaacacagtataactatttacctcttactggatattatgtactctttccctaacaagacagacacccctatcgaatctttccctacagtgttcgcgattagctggggtcaagtaaagctgattcagggattttggctcattgatcataatgattacgagagtggcctggatcttcttttccatccagcaacagccaaacctctgagttggcagcattccaagattatccaggcatttatgtcacagggcgagcaccgccaggccctccggtacatccagaccatgaaacctacggttagttcagggaatgatgttatcctgcacctcaccgtccttttgttcaataggtgcatggttgaagcttggaattttttacgccagcattgtaatcggctcaacatagaagagctgctgaagcacatgtacgaggtgtgccaagagatgggactgatggaggacctcctgaagctgcccttcaccgacaccgagcaggaatgcctcgtgaagttccttcagagcagtgctagcgtacaaaaccacgagttcctgttggttcaccatctacagcgggctaactacgtgcctgctctgaaactcaatcagactttgaagatcaacgtgatgaatgatagggatcccagactaagagaacgaagcctagctcggaacagtattctggatcagtacggcaaaattcttccccgtgtgcatcgaaagctggcaattgagagggcgaaaccctaccacctgagcacaagtagcgtttttcggctggtcagtaggccgaaacctctctccgctgttcccaagcaggtcgtaacagggacagttctgacaagatccgtgttcattaataacgtattaagcaagatcggcgaggtttgggcctctaaggagccaatcaactcgaccactccatttaactcatccaagattgaggaaccaagtcctatcgtgtatagcctgccagcaccggaactgccagaggcgttcttcggcacgcccatctccaaagcttcccagaagatcagccgactgttggaccttgtggttcaacccgtgcctagaccatcccaatgtagtgagtttatccagcaatcttccatgaaaagcccactatatctcgtctcaaggtctctccctagtagctcgcagcttaagggatcaccacaggcaatttccagggcctccgagctgcaccttctggaaaccccactcgtagtgaagaaagccaaaagcctcgctatgtctgtcaccaccagcgggttcagcgagttcacacctcaatcgattctacgatctacactgcgttcgaccccactggcttcaccgagcccttctcctggtcggtctccccagcgcttgaaggaaacccgaattagcttcgtagaggaggatgtgcatcctaaatggatccccggagccgccgacgacagcaaactggaagtgtttacgaccccaaaaaagtgtgctgttccagtggaaaccgaatggctcaagtccaaagaccggaccacctcctttttcctaaactcgccagagaaggagcatcaggaaatggacgaggggagtcaatctctcgaaaagttggacgtgagcaagggtaactcctctgtttcaatcacaagtgacgagaccacgctcgaataccaggatgcccccagccccgaggacctggaggaaacagttttcaccgcctctaagccgaagagctcttccacggcacttactaccaatgtcactgagcagacggagaaagatggggataaggatgtgtttgcatccgaggtaacaccatcagacctccagaagcagatgggaaacttagaggatgccgagaccaaagaccttcttgtggcagccgaagcctttagcgagctcaatcacctctctcccgtgcagggaaccgaagcttccctttgtgcgccaagcgtgtatgagggcaagatcttcacccagaagtctaaggtaccagttctcgacgagggcctgacaagcgtcgagacctatactccagccatacgggccaatgacaataagtctatggcggacgtgctgggggatggcggtaatagttcccttacaatatccgaaggcccgattgtctcagagcgcagattaaaccaggaagtggccctcaacctcaaagaggaccacgaggtggaggttggcgttctgaaagagagcgttgatttgccagaggagaaacttcctatatcagattccccacccgacactcaggagatccacgtgattgagcaggaaaaactcgaggctcaggacagcggtgaagaggcccgaaacttgtcctttaacgaactgtacccaagcggaacgctgaagctccagtataacttcgatacaatcgaccagcagttttgcgatttggcggacaataaagacactgccgagtgcgacattgctgaggtggacggggagctctttgtggcacagtcaaacttcacattaatcctggagggagaagagggtgaagtagagcctggcgacttcgccagcagtgacgttctgcctaaggcagctaacacggcaacagaggaaaagttggtttgctcaggcgaaaacgataaccacggccaaatagccaacctaccctcggcggttacaagcgaccaaaaaagccagaaggtcgacactttgccttacgtgcctgaaccgataaaagttgctatcgccgaaaacctgctagacgttattaaagatacaagatccaaagaaataaccagcgacaccatggagcaaagtattcacgagactattccgctcgtatctcagaacatcatgtgcccaactaaactggtgaagtcagctttcaaaactgctcaagagacatcaaccatgacaatgaacgtaagtcaagtggatgatgtggtatctagcaagacccgcaccaggggacagcgaattcagaacgtgaacgtcaaaagtgcccagcaggaggcatcagccgatgtggccactcctaagatgcctggacagagcgtgcgcaaaaaaacaaggaaagcgaaagaaatctcagaggctagtgagaatatctacagtgacgtgagaggccttagtcagaatcagcaaataccccaaaattccgtcactcctcggaggggcagacggaaaaaagaagttaaccaagacatcctggagaacacatcttctgtggaacaggaattgcagatcaccaccggaagggagtcaaagagactcaagtcctcccagctcttggagccagccgtcgaggagacaactaaaaaggaagtgaaagtgagttctgtgactaagcgaacaccacgcagaatcaagcgctccgttgagaaccaggagagcgtagaaataattaacgacttgaaggtttctacagtcaccagtcccagcaggatgatacgtaagctgcggtccacaaatctggacgcctccgaaaatactgggaataaacaggatgacaaatccagtgataaacagctgcgtataaaacacgtgcgcagggtacgggggcgcgaggtcagcccgagtgatgtgcgcgaagatagcaacctggaatcatctcagttaacagtgcaggctgagttcgacatgtctgccatccctcgaaagcgcggccggcctcgcaaaataaatccttccgaagatgtgggaagcaaggccgttaaggaagaacgctcccccaaaaaaaaagaggctccttctatcagaaggcgctcaacccggaacaccccagccaagtcagagaatgttgacgtgggaaaacctgctctcggaaaatccatcctggtccccaacgaagagctgtctatggtcatgagcagtaagaaaaagttgacaaaaaagacagagtcacagagccagaaaaggtccctgcattccgtgagtgaagagcggacagatgagatgacgcataaggagacaaacgagcaggaagagcggctcctagcaaccgcatcattcacaaaatctagccggtcgtcccgaacacgatcatctaaggccattttactacccgacctctctgagcctaataatgaaccgctattcagccctgcctcggaagtgccaagaaaggccaaggccaaaaaaattgaagttcccgcacagctcaaagaactggtgagtgatctttcatcacagttcgttatctcgcccccagctctcagatccagacaaaagaacacgtccaacaagaataagcttgaagacgaactgaaagatgacgcccagtccgtcgagacactgggaaagcccaaggcaaaacgcatacggacctctaagacgaaacaggccagtaaaaacaccgaaaaagagagcgcctggagtccccctcccatagagatacgcctaattagtccactcgcctcccctgctgatggcgtgaagagcaaacctaggaaaactacagaagtaactggaacaggtctgggacgtaatagaaagaaacttagtagctaccccaagcagattctgcggcgtaaaatgctctag

SEQ ID NO: 179613 - DNA, 3567 bp, Artificial Sequence
  Description of Artificial Sequence: Synthetic coding sequence
atgaaggccgccgacgagcccgcctacctgaccgtgggcaccgacgtgagcgcgaagtacaggggggctttctgcgaagcgaaaattaagactgtgaagcgcttagtgaaagttaaggtactgctgaaacaggacaatacgacgcagctggtccaagacgaccaggtgaaaggaccacttcgcgtcggcgccatcgtggagacgcgcaccagtgacggctcgttccaggaagcaatcattagtaaattgaccgacgcctcctggtacacagtcgtcttcgacgatggggatgaacgtacactcaggcggacatcactctgcttgaagggcgagaggcacttcgcagagtccgagacactggatcagctgcctctgacaaatcctgaacatttcgggacccccgtcatcgctaaaaaaacgaaccgggggagacggtcttcccttcccgttactgaagatgagaaggaagaggagtcctccgaggaagaagacgaagacaagcgaaggctgaacgacgaactcttgggaaaagtcgtttccgtggtttccgctactgagcgcacagaatggtatcccgcgctggtcataagcccaagctgtaatgatgacattaccgtcaaaaaggaccagtgtctggtgcgttcgttcattgattctaagttttattctatcgcacggaaggacattaaagaagtcgacattttaaaccttcctgaaagcgaactgtccactaagccaggactgcagaaggccagtatcttcctgaaaacccgcgtcgtgcccgataactggaaaatggacattagtgagatactcgaatcaagttctagcgacgacgaagacggcccagccgaggagaatgacgaggagaaggaaaaggaagccaagaaaaccgaggaggaggttccagaggaggagctggatccggaggaacgtgacaatttccttcagcagctgtacaagttcatggaggaccggggcactccgattaacaagccacccgtcctgggctacaaggatctcaacctttttaagttgtttcgcttggtgtaccaccagggcggctgcgataacattgattctggtgcggtctggaaacagatttacatggacctgggcattcccattttaaactccgcggcttcctacaatgttaagacagcctacagaaagtatctttacggttttgaggagtactgcaggtcagccaacatccagtttagaaccgtccaccaccacgagccaaaggtaaaggaggagaagaaggacttggaggagtccatggaggaggccctgaagctggaccaagagatgcctctaactgaagtgaaatccgagcccgaagaaaacattgattccaactctgaaagcgaaagagaggagatcgaactcaagagcccgagaggtagacgaagaatcgcacgagatgttaatagcatcaagaaggagatagaggaggagaaaactgaggacaagctgaaagacaatgacacggaaaataaagacgttgatgatgactacgagacagcggagaaaaaggagaacgagttactgctgggccgcaaaaataccccaaaacagaaagagaagaagattaagaagcaagaggattctgacaaggacagtgatgaggaggaggagaaatcacaggaacgcgaagagaccgagtctaaatgcgatagcgagggagaggaggatgaagaagatatggagccctgtttgacggggacaaaagtgaaggttaaatacggccgagggaagacgcaaaagatttacgaggcatcaatcaaaagcaccgagattgacgatggagaggtgctgtacctggtacactactatggctggaacgtccggtacgacgaatgggtaaaggcagatcggatcatttggcctctggacaaaggagggcctaagaaaaagcagaagaagaaggctaagaataaagaggacagcgagaaagacgagaagagagatgaggaacggcaaaagtctaagaggggacgccccccactcaaaagcaccctgtcaagtaatatgccttatggtctgagcaaaactgcgaacagcgagggtaagagcgacagttgtagcagtgactctgagactgaagacgctttggagaaaaacctcatcaacgaggagctgtccttgaaggatgagctggagaaaaatgagaatctgaatgacgacaaattagatgaggaaaaccccaagatctctgcccatattctgaaagagaatgataggactcagatgcaaccacttgagaccctaaagctggaggtgggagaaaatgagcagattgtacagatcttcgggaacaagatggagaagaccgaggaggttaagaaagaggccgagaagagccctaaaggtaagggacggagatctaagacaaaggatctgtccctggagattatcaagataagctccttcgggcagaacgaagctgggtcggagccccatattgaagcacattcgctcgagctttctagcctcgacaataaaaacttctctagtgcaactgaagatgagattgatcagtgtgttaaagagaaaaagttaaagcgcaaaatactgggccaatcctcgcccgagaagaagattcgtatcgagaatggcatggaaatgacaaatactgtttcccaggagagaacatcagattgtatcggaagtgagggcatgaagaacctcaattttgaacagcactttgagcgcgagaacgaaggcatgccgtcactaattgcagaatcgaaccagtgtatccagcagttgacaagcgagcgctttgacagcccagctgaggaaacagttaatattccattaaaggaggacgaggacgccatgcccctcattggcccggaaactttggtgtgccacgaggtggacttggatgatctggacgagaaagataaaaccagcattgaggacgtcgccgttgagagtagtgaaagcaacagtctggtatcaatccccccagccttgcctccagtggttcagcataacttctctgtggccagccccctcacactcagtcaagatgaaagccggtctgtcaagtccgagtcggacatcacaatcgaagttgattctatagcagaggaatcccaggaaggcttgtgtgaacgcgagagcgccaacggatttgaaacaaacgtagcctctggaacctgctccataatcgtgcaggagagagagtcgagggagaagggccagaagagaccttctgatggcaacagcggcttaatggccaagaagcaaaagcggactccaaagcggaccagcgccgccgccaagaacgagaaaaacggaactgatgaactagacaatatgaatagcacagaacgtatttcctttctgcaggagaaattgcaggaaatcagaaaatactatatgtcactgaaaagcgaagtggctaccatcgacaggcgccgaaaaagattgaagaagaaggacagagaggtgtcccacgccggagcctctatgtcgtccgcctcttctgatactgggatgtcacctagtagcagtagtcctccacaaaatgtactcgctgtggaatgtaggtag

SEQ ID NO: 179614 - DNA, 3774 bp, Artificial Sequence
  Description of Artificial Sequence: Synthetic coding sequence
atgaaggccgccgacgagcccgcctacctgaccgtgggcaccgacgtgtccgccaagtatagaggcgctttttgcgaggctaagattaagaccgtgaagaggctggtgaaagtgaaagtcttgcttaaacaggataacacaacccaactagtgcaggacgatcaggtcaagggtcctttgagggtcggtgctatcgtggagacaagaacaagcgacggttccttccaggaagcgatcatatctaagctcacagacgcctcatggtatacggttgtttttgatgatggcgacgaaaggacactgcgtcgcacaagtctgtgcctgaagggggaacggcatttcgctgagtctgagactttggatcagctaccacttactaaccctgagcatttcggaacccctgtaatcgccaagaagactaatcgaggcaggaggtcctccctgcccgtcactgaggacgagaaagaggaagaaagcagcgaagaggaagatgaggacaagagacgtttgaatgatgaactgcttgggaaagtggtttcggttgtgagcgccacggagcgaaccgaatggtatccggctttggtgatttccccctcatgtaacgacgatattacagttaagaaggaccagtgcctggtgaggagcttcatcgatagtaaattttattctatcgcccggaaagacattaaggaggtggacatcctaaacctccctgagtccgagctctctactaaaccgggtctccaaaaggctagcatctttctcaagacccgagtcgtccctgataattggaaaatggatataagcgagattctggaatcatctagttcagatgacgaagatgggccagccgaggagaatgatgaagagaaagaaaaagaagcgaagaaaaccgaggaagaggtgcctgaagaagagctcgatcccgaggaacgagataacttcctccaacaactttacaagttcatggaagatcggggcacacctatcaataaacctccggtcttagggtataaggatctgaacttgtttaagctatttcggctggtataccaccaaggcggttgtgacaatatagatagcggcgccgtctggaagcagatctatatggatctgggaattcccatcctcaactccgccgcttcatacaatgtgaaaactgcgtataggaaatatctgtatggatttgaagaatactgtagaagcgctaacattcagttcagaaccgtgcaccaccacgaacccaaagtcaaagaggagaagaaggacctggaggagtctatggaagaggcactgaagctggaccaagagatgcccctgaccgaagttaaatctgaacccgaggagaacatcgattcgaattccgaaagcgaacgagaggaaattgagttgaagtctccacgaggccgcagacgaatcgcacgcgatgtcaactcaatcaaaaaggaaatcgaggaggaaaagaccgaggacaagctgaaagacaacgatacagagaacaaggacgttgatgacgactacgaaacagcagagaaaaaggaaaatgagttgcttctaggtcggaagaatactcccaagcagaaagaaaagaaaataaagaaacaggaagactctgataaggactctgacgaggaagaagaaaaatcccaagagcgcgaggagacggagtctaagtgcgacagtgaaggagaggaagacgaggaggacatggaaccgtgcctgacaggcacaaaagtaaaagtgaagtacgggcgagggaaaacccagaagatctacgaagcttccatcaaaagcacagaaattgatgatggagaggtactatatcttgtgcactactatggctggaatgtgcggtacgatgagtgggtgaaagctgatcgcattatatggccacttgataaaggcgggccgaagaagaaacaaaaaaaaaaggccaaaaataaggaagacagtgagaaagatgagaaaagggacgaggagaggcagaagtccaagcgcggcaggcctcccctgaagagcaccttgagttccaatatgccgtatggcctgtcaaagacggcgaactctgaggggaaaagtgattcatgtagctccgacagtgagacagaggacgccctcgagaagaatttgatcaacgaggaactgagtcttaaagatgagctcgagaaaaatgagaatctgaacgacgataaactggacgaggaaaatccaaagatctcagcgcacatccttaaagagaacgacagaacccagatgcagcctcttgagactctgaagcttgaagtaggtgagaatgagcagatagtgcagatctttggaaataaaatggagaaaacagaggaggttaaaaaggaagccgaaaagtccccaaaagggaaagggcggcgctccaaaaccaaggacctgagcctggaaattatcaagatatcctcctttggtcagaacgaggccggcagcgaaccccacattgaagcacatagtctcgagttgtcatcactggacaacaagaacttcagtagcgcaaccgaagatgaaatcgaccagtgcgtgaaagagaaaaaactgaagaggaagatactgggccaatcatcacctgagaagaaaattcgtatcgagaatggaatggagatgacaaatacggtctctcaggagcgtaccagcgattgtatcggctctgagggaatgaagaacttgaatttcgagcagcactttgaaagagaaaacgagggtatgccctcgctgatcgccgagagcaaccaatgtatacagcagcttacttctgagcggttcgattcgccagccgaggagacagttaatattccacttaaggaagacgaagacgccatgcctcttatcggacccgagacactcgtctgccacgaggtggacctggatgatctggacgagaaagataagacaagcatcgaagacgttgcggtggagtcttctgagagcaacagcctagtgtctattccaccggctctaccaccagtcgtgcagcataatttcagtgttgcatcccctttaaccctgagccaggatgagagcaggtcggtcaaaagcgaatccgacattacaatagaagttgattccatcgccgaggagtcccaggaagggctgtgtgaacgcgagtccgcaaacggttttgagacaaatgtcgcatctggcacgtgctccatcatcgtgcaagaaagagaatccagagagaaaggccagaaaaggcccagtgacggcaatagtgggctaatggctaaaaaacaaaaacgcacccccaagaggacttccgcggccgccaaaaatgagaaaaatggaactggacagtcaagtgattcagaggatttacccgtgttggacaactccagtaaatgcacaccagtgaagcacttaaatgtatcaaaaccacagaagctggctaggagccctgcccgaatctcgccacatattaaagacggtgaaaaggacaagcatcgcgagaaacaccctaattctagtccccgcacttataagtggtctttccagctcaacgaactagacaacatgaattccacggagaggattagtttcttgcaggagaagctccaggaaattaggaagtactacatgtcactcaaatcagaggtcgccacgatcgataggcggcgcaaacgccttaagaagaaggatagggaggtgtctcatgccggggcaagcatgagttcggcatctagcgacaccggcatgagtccttctagcagtagtccacctcagaatgtgctggccgttgagtgccggtag

SEQ ID NO: 179615 - DNA, 3612 bp, Artificial Sequence
  Description of Artificial Sequence: Synthetic coding sequence
atgaaggccgccgacgagcccgcctacctgaccgtgggcaccgacgtcagtgctaaataccggggcgcattctgtgaggcgaaaatcaagacagtgaagcggctggtgaaggtcaaggttctgttgaagcaggacaatacaacacaactggtgcaggatgaccaagttaagggaccgttgagagtaggagctatcgtggagacgcgaacgtccgacgggtcatttcaggaagcaataatctccaaactcaccgatgctagctggtataccgtcgtttttgacgacggggatgaacgcaccctcaggaggacatctctgtgtctcaaaggagaaagacacttcgcagaaagcgagactctggatcagttgcctctaacgaatcccgagcatttcggcaccccagtcatcgccaagaagacaaatcgcgggagaagatcttctcttccagtgacggaggacgagaaagaagaagagtcctcagaggaagaggacgaggataagcgccggctgaacgacgagttgttggggaaggttgtctctgtggtctcagccacagagcgtactgaatggtaccctgcactggtcatcagcccgagttgcaacgatgatattaccgtgaagaaggaccagtgtttggtcaggtcttttattgacagcaaattctattctatcgccagaaaagacataaaagaggtcgacatcctcaatctgcctgaatccgagttgtcgaccaaaccggggctgcaaaaggcaagcatcttcctgaagacaagggtcgtgcccgacaattggaagatggacatctctgaaatactggaaagcagcagctccgacgacgaagatggaccagctgaggagaatgatgaggaaaaagaaaaagaggcgaaaaaaactgaggaggaggtccctgaagaagaactggatccagaagagcgggacaacttcctccagcaactttataagtttatggaggacagagggacgccgatcaataaacctcccgtcttgggctacaaggatcttaacctgtttaagttgtttcggttggtgtaccaccagggcgggtgcgacaacatcgactccggagctgtgtggaaacagatttatatggacctggggatccctatcctgaacagtgcagccagctacaatgtgaaaaccgcatatcgtaaatacctatacggatttgaggagtactgcagatcagctaatatccaatttcggacggtgcaccaccatgagccaaaagttaaagaggagaagaaagaccttgaggaatccatggaagaggccctgaaactggaccaggaaatgccgctgaccgaggtgaagtccgaacccgaggaaaatatagacagcaatagcgagtctgagagggaggagatcgagcttaaatcccctagagggagaagacggattgcacgggatgtcaacagcatcaagaaagaaatcgaagaggaaaagaccgaggataagctgaaggacaacgataccgaaaataaagatgtggacgacgactacgagaccgccgagaaaaaagagaatgagctgctgctcggacgcaagaacactcccaaacagaaagaaaaaaagattaaaaaacaggaagactctgataaagactccgatgaggaggaagagaaatcacaggaacgagaggagaccgagagcaagtgcgactccgagggtgaggaagacgaggaggatatggagccctgtcttactggaacaaaagtgaaggtaaaatacggaaggggtaagacccagaaaatctacgaggccagcatcaagagcacagagattgacgacggtgaagtcttgtacctggtgcattactatggctggaacgtgcgatacgacgagtgggtgaaggctgacagaattatttggcctcttgataaaggtggacctaagaagaaacagaaaaagaaagcgaagaacaaggaagacagtgaaaaggacgaaaagcgcgacgaagagaggcagaaaagcaagcgtggcagaccgccactcaaatccaccctgagttccaatatgccatatggcttatcaaagacagccaatagtgaggggaagtctgatagctgctcctctgattcagaaaccgaggatgccctcgaaaaaaatttgatcaacgaggaactgagtctcaaggatgaactcgaaaagaacgaaaacttaaatgatgataagctggatgaagagaacccaaagatctccgcccatatactgaaggagaatgacagaactcagatgcagcctctcgaaacacttaaacttgaggtgggcgagaacgaacaaattgtgcagatcttcggaaacaaaatggagaaaactgaagaggtcaaaaaagaggccgagaagtcccccaaggggaaggggcgccgtagtaaaactaaggatctctccttagagatcataaaaatctcttccttcggacagaacgaggccggctcagagccccacatcgaggcgcacagtttagagctgtccagcctagataataagaacttttctagtgccactgaggacgaaattgatcaatgcgtcaaggagaagaaactgaagcgcaaaatactggggcaaagtagcccggaaaagaaaatccggatcgagaacggaatggagatgaccaacacagtctcacaagagagaacaagcgactgcataggctccgagggaatgaaaaacctgaatttcgagcagcattttgaaagagagaacgaaggtatgccatctttgatagcagaaagtaaccagtgcatccagcagttgacttctgaacgctttgactcaccagctgaagaaactgtgaatattcccctcaaagaggatgaggatgccatgcccctgattgggcctgagactctcgtgtgccatgaggtggatctagacgaccttgacgaaaaggataagacttcaattgaagatgtcgctgttgaatcatccgagagcaatagccttgtttcaataccacctgccctgcctcctgtggtccagcacaacttttccgtggccagtcccctcacacttagccaggacgagtccagaagcgtcaagagcgaaagcgatatcaccatagaagtggattcaatcgccgaagagagccaggagggtctttgtgagagggaaagcgccaacggattcgagactaatgtcgcctcgggaacctgtagcatcatcgtacaggaaagagagagcagagaaaaaggccagaagagaccttccgacgggaacagtgggctcatggcaaagaaacagaaacgcacccccaaacgcacaagcgctgccgctaaaaatgagaagaacggtacgggacaatcttccgacagcgaagaccttccggttctcgacaacagtaatgaattagacaacatgaacagtaccgagaggatcagcttcctgcaggagaagctccaagaaatacgaaagtactacatgtccctgaaatcagaggttgctacaatcgaccgccggcgaaagagactgaagaagaaagaccgggaagtgtctcacgccggcgcgagtatgtcgtccgcaagttctgacaccggaatgtcccccagctcatccagtcccccccagaatgtgcttgcagtcgagtgtagatag

SEQ ID NO: 179616 - DNA, 165 bp, Artificial Sequence
  Description of Artificial Sequence: Synthetic coding sequence
atgaaggccgccgacgagcccgcctacctgaccgtgggcaccgacgtgagcgccaaataccgcggcgcgttctgcgaggctaagatcaagacagtaaaacgtcttgtcaaggttaaggtgctgttgaagcaggacaatactacacagctggtccaggatgactag

SEQ ID NO: 179617 - DNA, 3567 bp, Artificial Sequence
  Description of Artificial Sequence: Synthetic coding sequence
atgaaggccgccgacgagcccgcctacctgaccgtgggcaccgacgtgtccgcgaagtaccgaggcgccttctgtgaggcgaaaataaaaactgtaaaaaggttagttaaagtgaaagtcctgctcaagcaggataataccacccagctggtccaggatgaccaggtgaaaggccctctgcgtgtgggtgccatcgtggagacccgaacctcggatggatcattccaagaagctatcatcagcaaacttactgatgcatcttggtacaccgtggtcttcgatgacggcgatgagcggaccctgcgacggacctccctgtgcctaaaaggcgagaggcacttcgccgagtccgaaactttggaccagctgccactgacaaaccctgaacactttggaacaccagtgatcgccaaaaaaactaatagggggagacgttcatcactgccagtgactgaagatgagaaggaggaagaatcctctgaggaagaggatgaggataagagaagactaaacgacgagctgctgggcaaagtggtgtcagtcgtgagcgcgaccgaaaggaccgaatggtaccctgcattggtaatttccccaagttgcaatgatgatatcaccgtgaaaaaagaccagtgcctggtccggtcatttatcgatagcaaattctacagtatcgctagaaaagatataaaggaggtggacatattaaatttaccagaaagtgagctatccaccaaaccgggattgcagaaggcctcaatcttcctgaagactcgggttgtgcctgacaactggaaaatggacattagcgaaatcctcgagagcagctcatctgacgacgaggacggcccagccgaagaaaacgatgaagaaaaagaaaaagaggccaagaagacagaagaggaagtacccgaggaggagctggaccctgaggagagagacaactttctgcagcaactgtataaatttatggaagatcggggtactcctatcaataaacccccggttcttggctataaggaccttaacttgttcaagctattccgactcgtctatcaccaggggggttgcgataacatcgactctggcgcggtttggaagcagatatacatggacctcggaatccctattttaaattcagcagcctcctataacgtgaagactgcataccgcaaatatctctatggatttgaggaatattgtcggtcagctaacatacagttcaggactgtgcaccaccacgaacctaaggtgaaggaagaaaagaaggatctcgaagagtctatggaggaagctcttaaactagaccaggaaatgccactgaccgaagtgaaatctgaacctgaagagaacattgactctaattcggagagtgaacgagaggaaatcgagctcaaatcgcccaggggaagacggagaatagcccgtgacgttaactctattaaaaaagaaatcgaggaggagaagaccgaggacaaacttaaggataacgatactgaaaataaagacgtcgatgacgactacgaaacagcagagaaaaaggagaacgaattgctgctgggacggaagaataccccaaaacagaaggaaaaaaaaatcaagaagcaggaagattctgataaggactcagatgaagaggaagaaaaaagccaggagagagaggagaccgagagtaagtgcgactcggaaggtgaggaggatgaggaggacatggagccctgcctcaccgggacgaaggtgaaagtaaagtatggcaggggaaagacccagaagatctatgaggcctcaatcaaaagcaccgagatcgatgatggggaggtgctctacttagtgcactactatggctggaatgtcaggtacgatgagtgggtgaaggcggacaggatcatctggccacttgacaagggaggccccaaaaagaagcagaagaagaaggcaaaaaacaaagaggacagcgaaaaagatgagaagcgtgatgaggagcgtcagaaatctaaaaggggcagaccccctctgaaatcaaccctatcaagtaatatgccctacggtttgtctaaaacagcgaattccgagggcaaaagtgatagttgttccagtgacagtgaaacagaggatgcactggaaaagaacctcatcaatgaggagctgtccctaaaagacgagctcgagaaaaatgagaatctgaatgacgataagctagacgaagaaaaccctaaaatttcggcccacattttgaaagaaaacgaccgcacccagatgcagcccttggagaccctaaagctggaagtgggagagaatgaacagatagtgcagatatttggtaacaaaatggagaagaccgaggaggttaaaaaggaggccgagaaatccccgaaagggaaggggcgccggtccaaaaccaaagatctgtctctcgaaatcataaagatcagctctttcggccagaatgaggccgggtcagaaccacacatcgaggcccacagcctcgagctgtcctcactggacaataaaaatttcagttccgcaacagaagatgagattgaccagtgtgtgaaagagaagaagctgaagcgaaagatccttggccagagttcaccggaaaaaaagattcggatcgagaacgggatggagatgacaaacactgtgagtcaggaacgaacaagcgactgtatagggtcagaaggcatgaagaacctgaattttgaacagcactttgaaagggagaatgagggcatgccatctctcatcgctgaaagtaaccaatgtatccagcagctgacgtcagaacgcttcgactcccctgccgaggaaacagtgaacattcctttgaaggaggacgaagacgccatgcctctgattggacccgaaacactggtatgtcacgaggttgacttggatgatcttgatgagaaagacaaaacctctattgaggacgtagctgttgaaagtagcgaatccaactccctcgtgagcatcccacctgccttgcctcccgtggtacagcacaacttctctgtggcatctcccttaacactgagtcaagatgagagcagatctgttaagtcagaaagcgacataactatcgaagtggatagtattgcagaggaatcccaggaaggtttgtgtgaacgggaaagtgcaaacgggtttgaaaccaatgtagcctctgggacctgtagtatcatcgtccaggaacgtgaatctcgcgaaaaaggacagaagcgcccttctgacggcaacagcggacttatggctaagaaacaaaaaaggaccccaaaacgtactagcgccgccgccaagaacgagaagaacgggaccgacgagctcgacaatatgaacagcaccgaacgaattagctttctacaggagaagctacaagagatccgaaagtactacatgagcttgaaatccgaagtggcaaccatcgataggaggcgcaagaggttgaagaagaaagacagggaggttagtcatgcaggggcaagcatgtcgtccgcgtcaagtgatactggaatgagccctagcagttcctcccctccccagaacgttctcgcagtggagtgccgatag

SEQ ID NO: 179618 - DNA, 3939 bp, Artificial Sequence
  Description of Artificial Sequence: Synthetic coding sequence
atgaaggccctggacgagcccccctacctgaccgtgggcaccgacgtctcagccaagtacagaggtgccttctgcgaggccaagattaaaaccgccaagcgcctggtaaaggttaaagtcactttccgacatgattccagtacagtagaggttcaagacgatcatataaagggacctcttaaggttggtgccatcgtcgaagtcaagaatttggacggggcctaccaggaggcagttatcaacaagctcacagacgcgagctggtatactgtggtatttgatgacggcgacgagaagacactgcgtcgctcctctctatgccttaaaggggagcgacattttgccgagtccgaaaccctggatcagttacctctgactaatcctgagcactttggaacacccgttattgggaagaaaacgaacagaggtaggaggtcaaaccatatccctgaggaagaaagttcttctagtagctctgatgaagacgaggacgacaggaaacagattgacgagctccttggtaaagtcgtctgtgtcgactacatttccctggacaaaaaaaaggccctttggtttccagctttggtcgtttgtccagattgtagtgatgagatagccgtgaagaaagacaacatccttgttcgttctttcaaagacgggaagtttacgagtgtcccgcgtaaagatgtacacgagataacctctgatacagccccaaaaccagatgcagtccttaaacaggcgttcgagcaggcattggaattccataagtctagaacgatcccagcaaattggaagaccgaactgaaggaagactccagcagtagcgaggctgaagaagaggaagaggaggaagacgatgagaaggagaaagaagacaacagcagtgaggaagaggaagagatcgagcctttccctgaagagcgagagaattttctccaacaactctacaagtttatggaggacagagggacaccaattaataaacggccagtgctggggtacaggaacttaaatctttttaagctctttcgactagtacacaagctggggggattcgacaacatcgagtctggggccgtgtggaagcaggtctatcaagacctgggaatcccagtgttaaacagcgctgcaggctataatgttaagtgcgcctacaaaaaatatctctatggatttgaggaatactgccgcagcgcaaatatcgagttccagatggctctgcctgaaaaagtggtcaataagcagtgcaaggagtgtgagaatgtcaaggaaattaaggtcaaagaggaaaacgagactgagattaaggaaataaaaatggaagaagagagaaacatcatcccccgggaagagaaacccattgaggatgaaattgagcggaaggagaatatcaaaccatccttaggaagtaagaagaacttgctggagtctattccaacgcatagcgaccaagagaaagaggtgaatatcaaaaagcctgaggacaacgaaaaccttgatgataaggatgatgacacgacccgggtggacgagagtctgaacatcaaggtggaggcagaggaggagaaggccaagtctggggatgagactaacaaggaagaggatgaagacgacgaagaagctgaagaagaagaggaggaagaggaagaagaagaggacgaagacgatgatgacaacaacgaagaggaggaattcgagtgctatcccccaggcatgaaagttcaagtaaggtatggcagagggaaaaaccaaaaaatgtatgaggctagtataaaggactccgacgttgagggaggagaggtactgtacctagtccactactgcggctggaacgttcgttacgacgaatggatcaaggcggataagatcgtgcggcctgcggacaagaacgtacctaagatcaaacacagaaagaagataaagaacaagttagataaagaaaaagacaaggacgaaaagtacagtcccaaaaactgcaagctcaggagactgtccaagccccccttccagacgaatccttcaccggaaatggtcagcaagctggacttaactgacgctaagaactcagacacagcccatatcaagtcaattgaaattaccagcatacttaacggactgcaggctagcgagtcatccgctgaggactccgaacaggaggacgagcggggagcccaggatatggacaacaatggaaaggaggagtctaaaatcgatcacctgacaaacaaccgaaatgatttgataagcaaggaggagcaaaacagcagcagccttctggaagagaacaaggtgcacgctgacctggtgatttccaagcctgtgagtaagtctcctgagcggcttcgtaaggacatcgaagttttgtctgaggataccgactacgaagaagatgaggttaccaaaaagaggaaggacgtgaagaaggacaccaccgacaagagttccaaaccccagataaaacggggcaagaggcgctactgtaacactgaggagtgcctgaagactggatcacccggcaagaaagaagaaaaagccaagaacaaggaaagtctctgcatggagaatagttccaactccagctctgatgaagacgaggaggagacaaaagccaagatgactcctaccaagaagtacaatggacttgaggagaagcgcaaatccctgcggactactggattttactccgggttctcagaggtagccgagaagaggatcaaactactgaataactctgatgagcggctgcagaactccagggccaaggaccgcaaggacgtgtggagttctatccaaggccaatggcccaagaaaactttaaaggaactgttttctgactcagataccgaagccgcagcctccccaccacacccggcacctgaggaaggtgtggctgaggagtcacttcagaccgtagcagaggaggaaagctgcagcccatctgtggagcttgagaaacctccccctgtgaatgtagactccaagccaatcgaggagaagacagtcgaggttaatgacaggaaggcagaatttccttccagtgggtccaacagcgtgttaaatacccctcccactacacctgagtccccctcctccgtaaccgtaactgagggctctcggcagcagtcatctgtgacagtgtctgagcccctagctccgaatcaggaggaggtcagatctataaaaagtgaaaccgacagcactattgaggttgattccgtggctggcgagctccaggatctccagtcagaaggaaatagctcccccgccggctttgacgcatctgtcagtagctcttcctccaaccagccagaacctgagcatcccgaaaaggcctgcactggccagaagcgagtcaaggatgcccaaggcggcggatcaagttctaaaaagcaaaagaggtctcacaaagcgacagtcgtgaataacaagaaaaagggaaaaggaaccaactcgtcagatagcgaggagctgtcggcaggggagtcgataactaagagccagcctgtgaagtcagtgagtacaggaatgaaatcccacagtaccaagagcccagccaggactcaaagcccaggaaagtgcggtaaaaatggagataaggacccggatctgaaggagcccagcaataggctgcctaaggtctataaatggtcttttcagatgtccgatttggaaaacatgactagcgctgaaagaattactatcctccaggagaagcttcaagaaattcggaaacactacttgagcttgaaaagtgaggtcgcaagtatagatcggcgcagaaaacgtctgaagaagaaggagcgggaatcagccgccactagcagctcttcatcgtctccctccagctcctccattactgctgccgtcatgctgacgctggccgagccatccatgtcatcagccagccaaaatggcatgagtgtggagtgtcggtag

SEQ ID NO: 179619 - DNA, 3681 bp, Artificial Sequence
  Description of Artificial Sequence: Synthetic coding sequence
atgaaggccctggacgagcccccctacctgaccgtgggcaccgacgtgtcggcaaagtatcggggtgccttctgcgaagcaaagatcaagactgcgaaaaggctcgtcaaggttaaagttactttcagacatgacagtagtactgtagaggtgcaggacgaccatataaagggcccccttaaagtcggcgccatcgtggaggtcaagaaccttgacggcgcataccaggaagcagtaataaacaaactgactgatgcttcgtggtatacggtcgtgttcgatgacggagatgaaaagacactgcggcgctctagtctctgcctgaagggtgagcgtcacttcgccgagagcgagaccctggaccagctgccgctcacaaacccagagcattttgggacaccggtaatcggcaaaaaaaccaatcgtgggaggaggagcaatcatattcctgaggaggagtcttcctcttctagctccgatgaagatgaggacgatcgtaagcagattgatgagctgcttggcaaggtcgtctgtgtggactatatttctctagataaaaagaaagctctgtggttccctgctttggtcgtttgtcctgattgctcagatgaaattgccgtaaagaaggataatatcctcgtgcgttcgtttaaggacggaaaatttaccagcgttccgagaaaagacgttcatgagatcaccagcgacaccgcaccaaagccagatgccgtattaaagcaggccttcgagcaagcccttgagttccacaaaagccggaccatacctgctaactggaagaccgaattaaaagaggactctagctcctctgaggcagaggaggaggaggaggaggaagatgacgagaaggaaaaggaagacaactcttctgaagaggaagaagagattgagccttttcctgaggaacgcgagaatttcctgcagcagttgtacaagtttatggaggatagggggacacccatcaacaagagaccagtactcggctatcgaaacctgaatctgtttaagctgtttcgtctggtgcacaagctggggggcttcgacaatatcgaatccggcgcggtctggaaacaggtataccaggatctcggcataccagttctgaattctgccgccggctacaacgtgaagtgcgcttataaaaagtacttgtacggctttgaggaatattgccggtcggcaaacatcgagttccagatggccctgcctgaaaaagtggtgaacaaacagtgtaaggaatgtgaaaatgtcaaagaaatcaaggttaaggaggagaacgaaactgaaattaaggagatcaagatggaggaggaaagaaatatcattccacgagaagagaagccgatcgaagatgaaatcgagcgcaaggagaatatcaaacctagtctcggatcaaaaaagaatcttcttgagtctattcccactcattctgatcaagaaaaagaggtcaacattaaaaagcctgaggacaatgagaatctggacgataaggatgatgacaccacacgggtggatgagtctttaaacattaaggtggaggcggaggaagaaaaagccaaatctggttatgatgagtggattaaggccgataagatagtgaggccagccgataagaatgtgccgaaaattaagcaccggaaaaagattaaaaataagctggacaaagagaaggataaagacgaaaagtactccccaaaaaattgtaagctgcgtaggctttctaaacccccctttcaaaccaatccttcgccagaaatggtcagcaagctcgacctcaccgacgcaaaaaactccgacaccgcacacataaagtcaatcgaaatcacttccattctgaatggcctccaggcctccgagagttcagccgaggattcagaacaggaggatgaaaggggggcccaagatatggataacaatggcaaggaggaaagcaaaatcgaccaccttaccaacaaccgtaacgatctcatatctaaggaagagcagaactcaagttcgctgctagaagagaacaaggtgcacgctgatcttgtcataagcaaacctgtctccaaatctcccgagcgtcttcggaaggacattgaagtcctgtccgaggacacagattacgaggaagacgaagtcacaaaaaaacggaaagatgtgaaaaaggataccacggacaagagcagtaagccccagataaagagagggaaaagaaggtactgtaataccgaggagtgcctcaagactggctctcccggcaagaaagaagagaaggccaaaaacaaggagtccctatgcatggagaattcatccaacagcagttctgacgaagacgaggaggagacaaaagccaaaatgacacctaccaaaaagtacaatggcctggaagagaagcgtaagtccctgcgcacgactggcttttatagcggattcagcgaagtcgctgaaaaaaggattaaactcctgaacaactccgatgaacgcttacaaaacagcagggcaaaggacaggaaggatgtgtggtcctcaatccaaggacagtggccaaaaaaaaccctaaaggagttgttttcagatagcgataccgaagccgcagcctcacccccccaccctgcgccagaagagggagtggcggaagagtccttgcagaccgttgctgaagaagaatcttgctccccttctgtggagctcgagaaacctccacccgtgaatgtggatagtaagcccatcgaggagaaaacagtcgaggtgaacgatagaaaggcagaatttcccagctctggctcaaattccgtgctgaacacacctcctacaacccctgaatccccaagctcagtaaccgtgacagagggaagccgacaacaatcttctgtcaccgtgagcgagcctttagcaccaaaccaggaggaagtgagatccatcaaaagcgaaacagactccacaattgaggtcgatagcgttgcgggggagttacaggacttacagtccgaagggaattccagccccgccggatttgacgcctccgtgtcatcttcctctagcaaccagcccgagccagagcacccagagaaggcctgcaccggacaaaagagagttaaagacgcacaaggcggcggatcctctagtaagaaacagaaacggtctcacaaggccactgtcgttaataataaaaaaaagggcaagggcactaacagtagcgacagtgaagaactctcggcaggcgagtccatcaccaagagtcagccggtgaagtccgtgtcaacgggcatgaaatcccactcaaccaaaagtcctgccagaacccaatcccctggcaaatgtggtaaaaatggcgataaggacccagatctgaaggaaccgagcaaccgacttccaaaggtgtacaagtggagcttccagatgtccgatctggaaaatatgacctccgcggagcgcattacgatcctgcaggaaaaactgcaggaaatccggaaacattatctgagtcttaaatccgaagtggcgagcatcgaccgccgccgcaagagactgaagaagaaggagcgcgaatctgctgccacaagctcatcaagcagtagcccctctagctcctccattactgcagcggttatgctgacactggccgaacccagtatgtcatccgcctcccagaacgggatgtcggtggaatgccgttag

SEQ ID NO: 179620 - DNA, 3939 bp, Artificial Sequence
  Description of Artificial Sequence: Synthetic coding sequence
atgaaggccctggacgagcccccctacctgaccgtgggcaccgacgtgtctgccaagtaccgaggcgctttctgtgaggccaagatcaagaccgctaagagactcgtgaaagtaaaggtaaccttccgtcatgattcttcgaccgtggaagttcaggacgaccatataaaaggcccactgaaggtaggggccatagttgaggtcaaaaatctggatggggcttatcaggaagctgtgattaataagcttaccgacgcatcttggtacactgtggtattcgacgacggagacgaaaagacactgagaaggtcaagtctctgcctgaagggagaacgtcacttcgccgaatccgaaaccctagaccaactcccattgaccaatccagaacactttgggactccggtcataggtaagaaaaccaaccgcgggaggcgttcaaatcatatcccagaggaggagtcctcctcttcatcatcagacgaggacgaggacgatcgtaagcagattgatgaactgttggggaaagttgtttgcgttgattatatctctttagataagaagaaggccctgtggtttcccgctctggtagtgtgccctgactgtagtgatgagatcgcagtgaaaaaggacaatatactcgttcgcagtttcaaagacggtaaattcacgagcgtccctaggaaggatgtgcacgagatcactagtgatacagcacctaagccagacgccgtgcttaaacaggctttcgaacaggccctcgaattccacaaaagcaggaccatacctgcaaactggaaaaccgagcttaaggaggatagctcttcatctgaagctgaagaggaagaggaggaggaagatgacgagaaggaaaaagaagataactcctcggaagaagaggaagagattgaaccttttcccgaggaacgcgaaaattttctgcaacagctttataaatttatggaggatcgcggtacccctatcaataagcggcctgtgcttggttatcggaacctgaatctgttcaaactgtttcgcttagtgcacaagctaggtggctttgataacatcgaaagtggcgccgtgtggaaacaggtttaccaagacctgggtatccccgttctaaacagcgctgcgggatacaacgtaaaatgtgcctacaagaaatacctctatggcttcgaggagtactgtcgcagcgctaacatcgaattccagatggcgctgcccgagaaagtggtgaacaaacagtgcaaagaatgcgagaacgtgaaggagattaaggttaaggaagaaaatgagactgagataaaggaaatcaagatggaagaggagcgcaatatcatcccacgtgaggaaaagccaatagaagatgagatagagcgtaaggagaacatcaagccatccttgggttcaaagaaaaatctgctagagtctatcccgactcactccgatcaggaaaaggaggtgaacattaaaaagccggaggataatgaaaacttggacgacaaggacgacgacacaactcgggtcgatgaatccctgaatatcaaagtggaggcagaagaggagaaggctaaatctggggatgaaacgaacaaggaagaggatgaagacgatgaagaggccgaagaagaagaagaagaggaggaggaagaagaggacgaggacgacgacgataacaacgaggaagaagagttcgaatgttacccacccggtatgaaggttcaggtacgatacggacgaggaaaaaaccaaaagatgtatgaagcctctattaaagacagtgacgtagaaggcggcgaggtgctgtacctcgtgcattattgcggatggaatgtgcgttatgacgaatggattaaagctgacaagatcgtgcgcccagcggacaagaatgtccccaaaattaagcatcgcaaaaagattaagaataagcttgacaaggaaaaggacaaagacgaaaaatacagccctaagaactgcaagttgagaaggctgagtaaaccgccctttcagacgaaccctagccccgagatggtctccaagctggatctgactgacgcaaaaaactctgatacagcgcacatcaaatcgatcgagatcaccagtatcttgaatggactccaagctagcgagtcctctgcagaagattccgagcaggaggacgaacggggtgcccaagacatggacaataacggcaaagaggagtctaagatcgaccacctgactaacaatcgcaatgatttgatttctaaggaggagcagaacagttccagcctcctggaggagaacaaggtacacgccgatctcgtgatatctaaaccagtcagtaaaagcccagagagactccgaaaagatattgaagtactctccgaagataccgactatgaggaagacgaggtgacaaagaagaggaaggacgtgaagaaggataccacagacaaatcctccaagcctcagataaagcgaggcaagcgccggtactgcaatactgaagaatgtctgaagactggcagcccaggcaaaaaggaggagaaagccaaaaacaaggagtctctgtgcatggagaactcctcaaactcatcgtcggacgaggacgaagaggaaacgaaagccaaaatgacaccaacaaaaaagtataacggccttgaagagaaacgaaagtcactccgcaccaccggattctactctgggttttctgaggtggctgaaaaaagaatcaagctgcttaataacagtgacgaacgcctgcaaaattcgagagctaaagaccgcaaggatgtctggtctagcatccagggccagtggcctaagaaaaccctgaaagagctcttttctgattccgacacagaggccgccgccagccctccacacccagccccagaagaaggcgtggcagaggaaagcctgcagacggtggctgaggaagaatcctgttcgccctcagtggaacttgaaaagccaccacctgtcaacgttgactcgaaacccattgaagagaagactgtggaggtcaacgatcgaaaagccgagttcccttcatccggtagcaatagcgtgctgaacacgccccctacaacccccgagtcacctagctctgttaccgttactgagggcagccgccagcagtcctccgttactgtgtcagaacctctggcgcccaaccaggaagaggtgcgttctatcaaaagcgaaactgactctacaatagaagttgactctgttgccggcgaattgcaggacctgcagtctgagggtaattcttctcccgctggctttgatgcatccgtttcatcctctagcagcaaccaacctgagcccgagcaccccgagaaggcttgtaccggccagaagcgcgtcaaggatgctcagggtggaggcagctctagtaagaaacagaagcgatcgcacaaagcgactgtcgtcaataacaagaagaaaggcaagggcacaaatagctccgactccgaggaactcagcgccggggaatcgatcacaaagtctcagcccgtaaaatccgtgtccaccggcatgaagagccactcaacaaagtctcccgcccgcacgcaaagccccggaaaatgcggcaagaatggggataaggacccagacctgaaggaaccatccaaccgcttgcccaaagtgtataagtggtcattccaaatgtctgatctggaaaatatgacatccgctgagagaattaccattttacaagagaagctgcaggaaatacgcaaacattatctgtccctgaagtccgaagtggcttccattgacagacggcgcaagagactgaagaagaaagagagggaaagcgccgccacttctagctcatcttcatctcccagttccagcagtatcaccgcagctgtgatgctgaccctggctgaaccgagtatgtcttctgccagccagaacgggatgtctgtggagtgccggtag

SEQ ID NO: 179621 - DNA, 3462 bp, Artificial Sequence
  Description of Artificial Sequence: Synthetic coding sequence
atgaaggccctggacgagcccccctacctgaccgtgggcaccgacgtcagcgccaaatatcgcggggctttttgcgaggcaaagattaaaactgccaagagactcgtgaaggtgaaagtgactttccgtcacgactcaagcactgtggaggttcaggatgatcacatcaaagggcctcttaaggttggggcaatcgtcgaggtgaaaaatctggacggggcctaccaggaagcggtcatcaataagctcaccgacgccagctggtataccgtggtcttcgacgacggggatgaaaagacactgcgtcgcagcagcctttgtttaaagggcgagcgccatttcgctgagtccgagacacttgaccaacttccactaacgaatcccgagcacttcggcaccccagtgataggtaaaaagacaaatagaggacgtcgaagcaaccacatcccagaagaggagagcagttcctccagctccgacgaggacgaggatgatcgcaagcaaattgacgagctcctgggaaaggttgtgtgtgttgactacatctcattagataagaaaaaagctctgtggtttccagctttggtcgtctgtcctgactgctcagatgagatcgccgtgaaaaaagacaatatcctggtccggagttttaaggacggcaaatttacatcagtgccgagaaaggatgttcacgagatcacctccgataccgcacccaagccagacgccgtgctcaaacaggcttttgagcaggctctcgagtttcacaaatcccgtacaatacccgcgaattggaaaaccgagttgaaggaggattctagctcttcagaagctgaggaagaggaagaagaggaggacgatgaaaaagagaaggaggataactcatctgaagaagaggaggagatagaacctttccccgaagagagagaaaacttcctgcagcaactgtataaatttatggaggatagaggaacccctataaacaagcgccctgttttagggtatagaaacctgaacctttttaagctcttccgccttgtccataagctcggaggatttgacaacatcgaaagcggcgcagtctggaagcaggtttaccaggatcttgggatccccgtgctgaactccgccgcgggctataatgtgaagtgcgcatataaaaaatacctgtacggcttcgaggaatattgtaggagcgctaacatagaatttcagatggcgctgcccgaaaaggtcgtgaacaaacagtgtaaggaatgtgagaacgtgaaagagattaaagtaaaagaagaaaacgagacagagattaaagaaattaaaatggaggaggaaaggaatattataccccgagaggaaaaacccatagaagacgagattgagcggaaggagaacattaaacctagcctcgggagcaagaaaaaccttctggagtcgatacccacgcactcggatcaggagaaggaagtcaacatcaaaaaacccgaggataacgaaaatttggatgacaaagatgacgatacaaccagggtggatgaatccctgaatattaaagtcgaggccgaagaagaaaaagctaagtcaggcgacgaaaccaataaggaggaagatgaggatgatgaggaagctgaggaagaggaagaggaagaagaggaagaggaggatgaagacgatgacgataacaatgaagaggaggagttcgagtgctaccccccaggaatgaaggtccaagtccggtatgggcgcggcaagaatcaaaaaatgtatgaagcaagcattaaagactcggatgtagagggaggtgaggtgctttacctggtgcattattgtgggtggaacgtgcgatatgatgagtggataaaagctgacaagatagtgagaccagctgacaagaacgtcccaaaaatcaagcacagaaagaaaatcaaaaacaagctagataaagagaaggataaagatgagaagtacagtcccaagaactgtaaactgcgccggctcagcaagccaccctttcaaacaaatcccagtccagagatggtgtcaaagttggacttgacagatgctaaaaattccgacaccgcgcacataaagagcatcgagattacctccatcctgaatggtcttcaagcctcagaatcgtctgctgaggacagtgagcaggaagatgagagaggcgcccaggacatggacaataatggaaaagaagagagtaagatcgatcacctgacaaataacaggaacgatttgatttcaaaggaggagcaaaattcctcatccctgttggaagaaaacaaagtccatgccgatctcgtcattagtaagccagtgagcaagtctcccgagagactcagaaaggacattgaggtattatctgaagacactgactacgaggaggacgaggtgacgaaaaagaggaaggacgtaaaaaaggatactaccgacaaatcatccaaaccacaaatcaaacgcggtaaacgaagatattgtaatacagaagagtgcctcaaaaccggaagtccagggaagaaagaggagaaagctaaaaataaggagtctctgtgtatggaaaattcgtcaaattcaagttcagatgaggacgaggaggagactaaggccaagatgactcctacaaagaaatacaacggactggaggagaaacgcaagtcactgcggacaacaggattctatagtggcttcagcgaagtcgccgaaaagaggattaagttgctgaacaactccgatgaacggttacagaattcccgagcaaaagaccgcaaggatgtgtggagttccatccagggtcagtggcctaaaaagaccctgaaggagcttttctccgattccgacactgaggccgcagcctccccgccacatcccgcccctgaagaaggcgtggctgaagaatcccttcagacagtggctgaagaagagagctgctcacccagtgttgagctcgagaagcctccacctgttaatgtggattctaaacccatagaagaaaagactgtcgaagtgaatgatagaaaagccgaattcccctcgtctggtagtaattctgtgctcaatacaccgcccacaacgccagaatccccgagttcggttacggtaaccgaaggctcccgccagcagagtagcgtgactgtgtccgaacccctggcccctaaccaagaggaggtgcgtagtatcaagtccgaaacagattctacaatcgaagttgattcagttgctggagagctccaggacttacagagtgagggcaactctagtcccgccggttttgacgcatcagtcagtagctcttcttctaatcagcctgaacccgagcacccagagaaggcctgcactggccagaaacgggtcaaagacgcacagggtggaggctcttcatccaaaaagcagaaacggagtcacaaagctaccgtggttaataacaagaaaaaggggaagggcatccttccccattag

SEQ ID NO: 179622 - DNA, 1452 bp, Artificial Sequence
  Description of Artificial Sequence: Synthetic coding sequence
atgaaggccctggacgagcccccctacctgaccgtgggcaccgacgtgtccgcaaagtatcgtggggctttctgtgaagctaagattaagacagccaagcggctggtcaaggtgaaagtgacgtttagacatgacagttccaccgtcgaggtgcaagacgatcatattaaaggtcccctcaaggtgggggcgatcgtggaagttaagaacctggacggggcctatcaggaagcggtaattaacaagctgactgatgcatcctggtacacagtggtgtttgacgacggcgacgaaaagactttgagacgcagctcactctgcctcaagggggaaagacactttgctgagtcagaaacactggaccagttgcctctgacgaaccctgagcattttggcacgcctgttattggaaaaaagacgaatcgtggacggaggtctaatcatatccccgaagaggaaagcagcagctcaagctctgatgaagacgaagatgatagaaagcagatcgatgaattgttggggaaggtggtgtgcgtggactacatcagtctggataagaagaaggcactatggttcccagccctggtggtgtgccctgattgtagcgatgagatcgctgtcaaaaaggacaacattctcgtcagaagttttaaggacgggaagttcacatctgtccccaggaaagatgtgcacgaaataactagcgatacagctccaaagcccgatgctgtattaaagcaggcattcgaacaggctcttgagttccacaagtccagaaccatccctgctaattggaaaaccgagctaaaggaggattctagcagcagcgaggccgaggaagaggaagaagaagaggatgatgaaaaggagaaggaggacaattcatcagaagaggaagaagagattgagccatttccagaggagagggagaattttctgcagcagctatacaaattcatggaggacagagggaccccaattaacaagcgaccagtcctgggctacaggaacctcaacctgttcaagctcttcagactcgttcacaaacttggcggtttcgataatatcgagtcgggagccgtctggaagcaggtctaccaggacttggggattcctgtccttaacagcgcggcaggatacaatgtgaagtgtgcctataaaaagtatttgtacgggttcgaggaatactgccggagtgcaaacatcgagttccagatggctctgcccgaaaaagtggtcaataagcagtgcaaggagtgtgagaacgttaaggaaatcaaggtgaaagaggaaaatgaaaccgaaataaaagagattaaaatggaagaggaaagaaacatcattccgcgtgaggagaaaccgattgaagacgagatagagcgcaaagagaatatcaaacccagcctggggtcaaagaagaatcttctagaatctattcccactcactcttag

SEQ ID NO: 179623 - DNA, 1968 bp, Artificial Sequence
  Description of Artificial Sequence: Synthetic coding sequence
atgaaggccctggacgagcccccctacctgaccgtgggcaccgacgtgagcgcaaaataccgcggggcattttgtgaggcgaagatcaagactgccaagcggctcgtcaaggtgaaagtgacctttcgccacgattcctccactgtcgaagtgcaggacgatcacattaaggggccacttaaggtgggggctattgttgaggtgaagaaccttgatggcgcatatcaagaggccgtcatcaataagctaacggatgcttcttggtatactgttgtgtttgatgatggcgatgaaaaaacactgcggcggtcatctttgtgtctcaaaggggaaaggcactttgccgagtcagaaacgctggaccagctccctttgacaaatcctgagcacttcggaaccccagtgatcggtaagaaaacaaacaggggtagaagatcaaatcatatccctgaagaagagtcctctagcagcagctcagacgaagatgaggatgataggaaacagattgacgaactgctcggtaaggtagtatgcgttgactacatctcactggataagaagaaagccttgtggtttcccgctctagtggtgtgccctgactgcagtgatgagattgccgtgaagaaagacaacattcttgtgcggtcatttaaagatgggaagtttactagtgtgccaagaaaagatgtccatgagataacatctgacacggcacctaagccagatgctgtgctaaagcaggcattcgaacaagcactggagttccacaaatccaggaccatccccgcgaattggaaaaccgagctgaaagaagactctagttctagtgaggcagaggaagaggaggaagaggaagatgatgagaaagagaaagaagataactcgtccgaagaggaagaagaaatcgagcctttccccgaggaacgtgaaaacttcctacagcagttatacaaatttatggaggaccgggggactcctatcaataagcgaccggttctgggttaccgcaacttgaatcttttcaaactgtttcgactcgtccacaagttgggagggttcgataatatagaatctggcgctgtttggaagcaagtctaccaagacctcggtatccctgtgctcaatagcgccgccggttacaatgtgaaatgcgcctacaaaaagtacctgtacggattcgaggagtactgtcggtcggccaacatagagtttcaaatggcgctgcctgaaaaggttgttaataagcagtgtaaggagtgtgagaacgtgaaggagattaaagtgaaagaagaaaacgaaaccgaaatcaaagaaattaagatggaggaagagcgaaacatcatccccagagaagaaaagccgattgaagacgagatcgagcgcaaggagaacatcaaaccctcattgggtagcaagaagaatctgctggagtccattccaactcattccgatcaggagaaggaggtgaacataaagaaaccggaagacaatgagaacctcgatgataaagatgatgatacaacaagagtcgatgagtccctgaacatcaaggtggaggccgaggaggagaaagcaaagtctggtgatgaaaccaataaagaggaggatgaggatgacgaggaggccgaagaagaggaagaagaggaagaggaagaggaggacgaggacgacgatgataataatgaggaggaggaatttgagtgttacccccccggtatgaaggtccaggtgcgatatggcaggggcaagaatcaaaaaatgtatgaggcctctatcaaagattcagatgttgaaggaggggaagtgttatacctcgtacattactgcggttggaatgtgcgatacgacgagtggattaaggctgacaagattgtgcgacctgccgataaaaatgtgcccaagatcaagcatcgcaagaaaatcaagaacagcgtgtataaaaaaaagaagaaaaagaaaaacaaatag

SEQ ID NO: 179624 - DNA, 1785 bp, Artificial Sequence
  Description of Artificial Sequence: Synthetic coding sequence
atggccgcccccgtgaagggcaaccggaagcagagcaccgagggcgatgccctggaccctcctgcctcaccgaaaccagccggcaagcagaacggaatccaaaatcctatttccctggaggactcccctgaagcaggaggcgagagggaagaggagcaggaacgggaagaagagcaggccttcctagtttctttgtacaagttcatgaaagagaggcatacccctatcgaaagagtgccccacctggggtttaagcaaattaatttatggaagatctataaggcagtcgagaaactcggagcttacgaactagtgaccggcagaaggttgtggaagaatgtatacgacgagctcgggggatccccgggcagcacttctgcagcaacctgcacccgtaggcactatgaaagactcgtgctcccttatgtgcgccacctcaagggcgaggatgataaacctttacctacatcgaagcctaggaagcaatacaaaatggctaaggagaatcggggcgatgatggtgctacagagcgcccaaagaaggcaaaggaagagaggagaatggatcagatgatgccaggaaagactaaggccgacgctgcagaccccgcccctctgcctagccaggaaccccctagaaacagcacagagcagcaggggcttgcctctggcagtagcgtctcattcgtgggtgcatctgggtgcccggaggcttataagaggctactgtcctccttttactgtaaaggaactcacggaataatgtctccactcgcaaagaaaaagttgctggcccaggtgtcaaaggtggaagccctgcagtgtcaggaggagggatgtaggcatggcgcagaacctcaagcgagtcctgcagtccatctgcctgagagccctcagtcacctaaaggactaactgagaactctcgacaccgtctcaccccccaggagggtcttcaggcccctggagggagcctgagagaagaggcccaggcgggcccctgccccgcagcgccaatctttaaaggttgcttctacacccaccctacagaggtgctgaaacccgtctcacagcatccaagggactttttttcccggctcaaggacggggtgcttcttggccctccaggtaaagaagggctctcagtgaaagagccacagctggtgtgggggggcgacgccaaccgcccctctgccttccacaaaggaggctccaggaaaggaattctctacccaaaacccaaggcttgttgggtctcgccaatggctaaggtacctgccgaatccccaaccctgccccctacctttccaagctctcccggcttgggaagtaagcggagtttggaggaggagggcgctgcacattctggaaaaaggctgagggctgtcagtccctttctgaaggaggcggacgcaaaaaagtgcggggctaaaccagccggctctggattggtaagctgcctgctgggaccagccctgggtccagttcctcctgaggcctatcgaggtactatgttgcactgtcccctcaacttcaccggcactcccggtcccctgaaaggccaggcggccctccctttctcaccgttagtgattccagcctttccagcccatttcctcgcaactgcgggcccgtcacccatggctgcaggtttgatgcatttccccccaacgtcgtttgacagcgcgctgcgtcatcgcttgtgcccagcctcaagcgcttggcacgcaccaccggtcaccacctacgccgcccctcactttttccatttaaataccaagctgtag

SEQ ID NO: 179625 - DNA, 1917 bp, Artificial Sequence
  Description of Artificial Sequence: Synthetic coding sequence
atggccgcccccgtgaagggcaaccggaagcagagcaccgagggcgacgcattggacccccctgcatctcccaaaccagccggtaagcagaacggcatacagaacccaatctcgttagaggacagtccagaggccggcggcgaacgtgaagaggagcaggaacgggaagaggagcaggcatttctcgtgagcctgtataagttcatgaaggaacgccacacgcccatcgaacgggtgccacatctgggcttcaaacaaatcaacctgtggaagatttataaggccgttgagaaactgggcgcatatgaactggtgacgggccgccggctctggaaaaacgtttacgatgagttgggagggtcgcccgggtcaaccagtgcagccacctgcacaaggcggcactacgaacgattagtgctcccctatgtccggcatctgaagggggaggacgataaaccattacctacctcaaaaccccgcaagcagtacaaaatggcgaaggaaaataggggggacgatggtgccaccgaacgaccaaagaaggcaaaagaggaaaggaggatggatcaaatgatgcccgggaaaacaaaggcagacgccgcagatccggcacccctgccttcccaggaaccacctagaaatagtaccgaacaacagggtcttgcgtcggggtcttctgtgtcctttgtcggcgcttcagggtgcccagaggcctataagcggctccttagttcattctattgcaaggggacacacggtataatgagcccattggctaaaaaaaagctgcttgctcaggtcagcaaggtagaagccctccaatgccaggaggagggttgtagacacggcgcagaaccacaagcatctccagctgtacacttgccagaaagcccgcaaagccctaagggcctgaccgaaaactcacgccaccggttgacaccgcaagagggcttgcaagctcctggaggctccctgagagaggaggcgcaagcagggccgtgccccgctgcaccaatctttaaaggttgtttttacactcatccaactgaagtcctgaagcccgtgtcacaacatcccagggatttttttagtagacttaaagatggcgtgcttcttggaccccctgggaaagagggcctgtctgtgaaggagccccaactcgtgtggggaggagacgcaaaccgtcctagcgcttttcacaaaggtgggagtcggaagggcatcctctaccccaaacccaaggcctgttgggtaagtccgatggcaaaggtgcccgcagagtcgccaaccctaccacccacttttcctagttcccccggcctcggaagcaagcgatccctggaagaagaaggtgccgcccattccggcaaacgcctccgggccgtgagcccattcttgaaggaggccgatgccaaaaagtgtggcgcaaaaccagcaggctcaggcttggtatcctgtctgctaggaccagcactgggacccgtccccccggaagcgtataggggcaccatgctgcattgtccactaaattttactggcacgcaccaccaatcacagcccatgcagcggcccacgtcaagcacgtcgacgccgtcttgccgccctgcccatggagtcgtctacactgtggaaagtactggcgcctataacaggcaagtcctgctgcctgggggatcagaactggttcctgctactcaagataccagggccatgcctctcgccgggcagccaggcacctcggaggaagaagggtctgggaagacagggttcatatcgcgccagcagccagagcccaggagccggggaccgagctgttacaaggctcttggggaagacgggcagctgccccttccccagagtggggctcgtagtacccaagtggctcacggaaaatcaaacaaaaaaacccctgtttag

SEQ ID NO: 179626 - DNA, 1581 bp, Artificial Sequence
  Description of Artificial Sequence: Synthetic coding sequence
atgaaggagcggcacacccccatcgagcgggtgccccacctgggcttcaaacaaattaatctctggaagatatataaggcggtggagaagctgggggcatacgagctggttacaggcagaaggctctggaagaatgtctatgatgaactggggggatcccctggcagcacctccgctgcaacgtgcacacggaggcattacgagcgcctggtgcttccctatgtgcggcatttgaaaggggaagacgacaagccactccccaccagcaaacctcgaaagcagtacaaaatggccaaggaaaatcgaggcgacgacggagccacggaaaggccaaaaaaggccaaggaggaaaggcggatggatcagatgatgccagggaaaactaaggcagacgccgcagacccggcccctctgccatctcaggagcctcccaggaattctactgaacagcagggcctggcctcagggagctccgttagcttcgtgggcgcctcaggttgccccgaggcctacaaacgcttgctgtccagcttctactgcaaaggaacccacggcattatgagtccactggccaaaaagaagctgttagctcaggttagcaaggttgaggctctccagtgccaggaggagggctgccgacacggagctgagccccaggcaagccctgccgttcacctgccagaatccccacagtctcctaaggggctcacggaaaacagcagacatcggcttacaccccaggaaggtcttcaggcccccggaggcagtctaagggaggaggcacaggcgggaccctgccctgctgccccaattttcaagggatgcttctatacgcatccgaccgaggtgcttaaacccgtgagtcaacatcccagagactttttcagtcgactaaaggatggtgtgctgctggggccacctggcaaagagggcttgagtgtgaaagagcctcaactggtgtgggggggcgatgccaatcgtccttccgcctttcacaagggagggagtagaaaggggatcctgtaccctaagccgaaagcctgttgggtgtcgccgatggcaaaggtgcctgccgaaagccctaccttgccaccaacgttcccctccagccctggattaggaagtaagaggtcactcgaggaggaaggggccgcccatagcgggaagcggctaagagcggtaagcccgttcttgaaggaagccgacgcaaagaagtgtggtgccaagccggctggctccgggctggttagttgtttgttgggtccagctttggggccagtaccacccgaggcctatcgtggtaccatgctccattgcccacttaactttacaggtacaccggggccacttaagggccaggcagcactgccgttttccccattggtgatccctgcgttcccagcccacttcctggccactgcaggaccttctccaatggcagccgggcttatgcattttccaccaacaagcttcgatagtgcactaaggcaccggctgtgccctgcaagtagcgcatggcacgcgccccctgtcaccacctatgctgcaccccatttttttcacctcaatacaaaactttag

SEQ ID NO: 179627 - DNA, 3567 bp, Artificial Sequence
  Description of Artificial Sequence: Synthetic coding sequence
atggagcccaacagcctgcagtgggtgggcagcccctgcggcctgcatggcccgtatatcttctataaggctttccagtttcacctggagggcaagccccgtattctgtccctgggagacttctttttcgtgcgttgcacccccaaggatcccatctgcattgccgaattgcagctgctgtgggaagagcgaacttcccgccaacttctgagctcatccaagctgtactttctgccggaggatactccccagggcagaaacagcgaccatggtgaagacgaagtaatcgccgtcagcgagaaggtcatcgtcaagctcgaagaccttgttaagtgggtgcattcagacttctcaaagtggagatgcggttttcacgccggtcccgtgaaaaccgaggccctcggaaggaacggacagaaggaggcgctgttaaaataccgtcagagcacactgaattcaggcctgaactttaaagatgtcctgaaagagaaggcggatctgggagaggatgaagaagagactaatgtgatcgtgttaagttaccctcagtactgcagatacagatcgatgttaaagcgcatccaggacaaaccttcaagtattctcacagaccaatttgccctggctctcgggggaatagccgtcgtgtctcggaatcctcagattctgtattgccgggatacattcgaccaccccacactaatcgaaaatgaaagcatctgtgacgagttcgcccctaatctgaagggaaggcctcgcaagaagaagccctgtcctcagcgaagagacagcttttccggcgttaaggactccaataacaatagtgatggcaaagccgttgccaaagtcaaatgcgaggcgcgctctgcactgaccaagccaaagaacaaccataactgcaaaaaagtgtctaacgaggagaagcctaaagttgcaataggtgaagagtgcagagccgatgaacaggcctttctggtggccttgtataagtatatgaaggagcgcaaaacgcccatagaaagaatcccgtatctgggattcaagcaaataaatctctggaccatgtttcaagcggcccagaagctgggaggatacgagaccatcaccgctcgccgtcagtggaagcatatatacgatgagctgggaggaaaccccggtagcacctccgctgccacctgtactcgcaggcattacgagagactgatccttccttatgaacgtttcatcaaaggtgaagaagataagcccctgccaccaatcaaaccaaggaaacaagagaacagttcgcaggaaaacgagaataagaccaaggtttccggaactaaacggatcaaacacgagatcccgaagtccaagaaggagaaggagaatgcaccaaagccccaggatgcggccgaggtgagcagcgagcaggagaaggagcaagaaacgctgatctcacagaaatccattcccgaacccctgcccgccgctgacatgaaaaagaagatcgaaggataccaagaattctccgccaagcccctggccagccgggttgacccagagaaggacaatgaaaccgatcagggctcaaactccgagaaggttgccgaggaagctggggaaaaggggccaacaccccctctgccaagcgccccactggcgccagaaaaagacagcgcattggtgcccggcgcatcgaaacaaccactcacatccccgtccgccctcgtagacagtaagcaggagagtaagctgtgctgtttcacagagtcacccgagtcagaacctcaggaggccagcttccctagcttcccgactacgcagcctcccctggctaatcagaatgaaacagaagatgacaagctgccagcgatggcagactacattgcaaattgtacagttaaagttgaccaactgggctcagatgatattcacaatgccctgaagcagacgccaaaggtattggtggtgcagtcttttgatatgttcaaggataaggatttgactgggccaatgaacgaaaaccatggacttaactataccccattgctctactctaggggcaatcccggtatcatgtctcccctggccaagaagaagctgctgagtcaggtatccggcgcgtccctgagctcgagctatccctacggttcacccccacctctcatcagcaaaaagaaactaatcgcacgcgatgacctttgttcctccttgtcgcagactcaccacggtcagtccacagatcacatggctgtgtcgaggccttccgtcatacagcatgtccagagttttcgctcaaaaccatcagaagagagaaagacaattaatgacatcttcaagcacgagaaactatctcgctccgaccctcatcgatgctctttttctaaacaccatctgaatccactagcagatagttacgtacttaagcaggaaattcaggaagggaaggacaagctgctggagaagagggctctaccacactcgcacatgccttcctttctggccgacttctacagcagtccacaccttcatagcctgtataggcatactgaacatcatctgcataatgagcaaacaagcaagtacccctccagggacatgtatagagaaagcgagaattcatctttcccctcccaccgtcaccaggaaaagctccacgtaaactatctgacgagtctccatctacaggataagaaatccgcagccgcggaagcgcccacggatgaccagcccacagacctttcacttccaaaaaatccgcacaagcccactggcaaagtccttggcctggcgcattcgacaactggtccacaagagtctaagggaatttctcagttccaggtgttgggcagccagtcacgcgactgtcatcctaaggcctgccgggtgtcccctatgactatgtctgggccgaagaagtatccagagtccctgtctcggtccggtaagccccatcatgtccgcctcgaaaacttccgtaagatggagggcatggtccacccaatactccacagaaagatgtcaccccagaatattggagctgcccggcccattaaacgttcccttgaagacttggatctggtcattgcgggaaagaaggcacgggcagtctctccgctggacccaagcaaagaggttagcggtaaggagaaagcttccgaacaagaaagcgagggatccaaggccgctcacggcggccacagtggtggagggagtgaaggccataagctgcctctctcatccccaatatttccagggctttacagtggtagcttatgcaactctgggctcaacagtagactccctgctgggtactcccactccttacagtacttgaaaaaccagacggtactttcccctctgatgcagccgttagcttttcattctcttgtaatgcagagagggattttcactagcccaaccaactcccagcagttgtaccgccaccttgcggcggccactccagtggggagctcctacggcgatctcctgcacaactctatctaccccttggcagcaataaaccctcaggctgccttcccatcctctcaattgtccagcgtgcatccgagtacgaagctctag

SEQ ID NO: 179628 - DNA, 2838 bp, Artificial Sequence
  Description of Artificial Sequence: Synthetic coding sequence
atggcccccaacctgaagggccggccccggaagaagaagccctgcccgcagcggagagattcattcagtggtgtgaaagactccaataacaatagtgatggaaaggctgtggccaaagtgaaatgtgaggctaggagcgccctgactaagcccaagaataaccataactgcaagaaggtatctaacgaggaaaagcccaaagttgcaattggcgaggaatgcagggccgacgagcaggcttttctcgtggccctgtataagtacatgaaggaaagaaagacccccatagaaagaataccctacttgggcttcaagcaaatcaatctgtggacaatgtttcaggccgcacaaaaactcggaggatacgaaaccattacagctaggcgccagtggaaacatatttatgacgagctgggcggtaatccaggcagcacttcagccgctacctgcacccgccggcactacgagagactgattttgccctatgagcgctttattaaaggggaggaggataaacccctgccacccataaagccaagaaaacaggagaattcctctcaggaaaatgaaaacaaaaccaaagtctccggcacaaaaaggatcaagcacgagatccctaaaagcaaaaaagaaaaggaaaacgccccaaagcctcaggatgccgccgaagtttccagcgagcaagaaaaggagcaagagacgctcattagccagaagagcatcccagagcctttgcccgctgcggacatgaaaaagaagatcgagggctaccaggagttctctgccaagccgctggctagtcgcgtggacccagagaaggataacgaaaccgaccagggaagcaattcagaaaaggtcgccgaagaggccggcgagaaggggcccacaccacctctcccctcagccccactggctccggagaaagatagtgcactcgtgcccggagctagtaagcagcccctgacgtctccgagcgcattggtagattcaaagcaggaatccaaactgtgctgtttcacagaatctcccgaaagcgaacctcaggaggcgtcctttcccagcttcccaacgactcagcctccgctggccaatcagaatgaaactgaagacgacaaactgcctgcgatggcagattatatcgctaattgtactgttaaagttgatcagctgggatcagacgatatacataatgctctcaagcaaacacccaaggtcctggttgttcagtcctttgatatgttcaaggacaaggatttgaccggccccatgaacgagaatcacggcctaaattacactcctctgctctattcacgcggaaatccgggcatcatgtcccctcttgccaaaaaaaaactgctgagccaagtaagcggagccagcctcagtagtagttacccatacggaagcccacctcctctcataagcaagaagaaattgatcgcgcgggacgatttgtgctccagtctcagccagactcaccacggacagagcaccgatcacatggccgttagcaggccgtctgtgattcagcacgtgcagtctttcaggagcaaaccgtctgaagagaggaagactataaatgatatctttaagcacgagaaactctcaagaagcgatccccacaggtgttccttttctaaacaccacctcaatcctcttgccgactcgtatgtccttaagcaagagatacaggaaggaaaagacaagcttctagagaagcgcgctctccctcactcacatatgcctagcttcttagccgacttttatagctcaccccacctgcatagcctataccgacacaccgaacatcaccttcataatgagcagaccagcaagtatccttctagggatatgtatcgggagagcgagaactcttctttcccctcccatcggcaccaagagaagttacatgtgaactacctgacatccctgcacctccaggacaagaagtccgctgccgcggaagctcctacagatgaccagccaacagatctctcactccctaagaacccccacaagccaactggtaaagtgctcggtctcgctcacagtaccactggcccccaggagtccaagggaattagtcaattccaggtactgggaagccagtcccgtgactgccatcctaaggcttgtcgagttagcccaatgaccatgtccggtcctaaaaagtatccagagtctctttcgaggtcagggaaacctcaccatgttcgattggagaattttagaaaaatggagggcatggtgcatcccattttacaccgaaaaatgtcaccacaaaatatcggggctgcccgccccataaagcgcagtctggaggacctggacttagttatcgcagggaaaaaagcccgtgccgtcagcccattggacccaagcaaggaagtgtctggcaaagagaaggcgagtgaacaggaatctgagggttccaaggccgcacacggcgggcatagcggcggaggctccgaaggacacaagctgcccttatcaagcccaattttccccggactgtattccgggtccctgtgcaacagcggcttgaacagccgccttccagccggttacagccactccctccagtatttgaaaaaccagaccgtgttgagccccttaatgcagcccctcgcgttccactcgctggtgatgcagaggggcatctttacatcgccgactaatagtcagcagctctaccgccatctcgcggccgccacccctgttgggtcttcttatggcgacttgcttcacaattccatctaccctttggccgctattaaccctcaggctgcattcccatcttctcagctttcatccgtgcatcctagcacgaagctttag

SEQ ID NO: 179629 - DNA, 1134 bp, Artificial Sequence
  Description of Artificial Sequence: Synthetic coding sequence
atgggcaccaccgaggccaccctgcggatggagaacgtggacgtgaaggaagagtggcaagatgaagatctcccgagaccactgcccgaggagacgggggttgagctgctaggctcccccgtagaggacacaagctcacctcctaatactttgaacttcaatggtgcacatcgtaaaaggaaaactctcgtcgccccagaaatcaatatctcgctggatcaatccgagggatccctgctatctgatgactttcttgatacacccgacgaccttgacataaacgtcgacgatatcgaaactcctgatgaaactgattctttagaattcttaggcaatggcaatgaactcgagtgggaagatgatactcccgtggcgactgccaagaacatgcccggagatagcgccgatctctttggcgatgggactactgaagatggctccgccgcaaacgggaggctgtggaggacagttatcattggcgaacaggagcacaggatcgacttacacatgatccgaccctatatgaaggtggtcacccatggaggatattatggagaaggccttaatgcgatcatagtattcgctgcatgttttctgccagattcttctctccctgactaccattacattatggaaaatctttttctgtacgtcatttcatctctggagctattggttgcagaggactacatgatagtctacctgaatggggccaccccccggaggcggatgcccgggattgggtggctcaagaagtgctatcagatgatcgataggcgattacgaaagaacctgaagagcctcattatagtccaccccagttggtttatcagaaccgttctcgccatctccaggcccttcatttctgtaaaatttatcaacaaaatccagtatgtccacagtttagaggacctggagcagttaattcctatggagcatgtgcagattcctgattgcgtactgcagtatgaggaagagagacttaaagcaagacgcgaatccgcgcgacctcaacccgagtttgttctcccaaggtccgaggagaagcctgaggtggcccccgtcgagaaccggagtgccctggtctccgaggatcaagagacgagcctgcaacctctgcatagatcttcatag

SEQ ID NO: 179630 - DNA, 1116 bp, Artificial Sequence
  Description of Artificial Sequence: Synthetic coding sequence
atgggcaccaccgaggccaccctgcggatggagaacgtggacgtgaaagaggaatggcaggatgaggacctcccacgccctttgcccgaagagaccggcgtcgagctattgggctcacctgtggaagacacttctagtccacctaacacgttaaacttcaatggggcccaccgaaagcggaagacactcgtcgctccagagatcaacatttcattggatcaatccgaggggtctctgttgtctgacgatttcctggatacacccgacgacctcgacatcaacgtggatgacattgaaactccagatgagaccgacagcctcgagttcttggggaatgggaatgaacttgagtgggaggatgacaccccggtggccacagccaagaacatgcccggcgatagcgccgatctgtttggagacgggactacagaagacggcagtgccgctaacggtcgattgtggagaacagtcatcatcggggaacaggagcatcggatagatttgcatatgatcaggccatacatgaaggttgtgacgcacggaggctattacggagaaggtcttaacgcgattattgtgtttgctgcgtgctttctgccagattctagcctgccggattaccactacattatggagaatctgttcctgtacgttatcagtagtctcgagcttctggtagccgaagactacatgatcgtgtacctcaatggggccacgccccggagaaggatgcctggtatcgggtggctgaagaaatgctaccagatgattgatagaaggttaagaaaaaatctgaagtcccttatcattgtgcacccgtcttggtttattaggacagttttggccatcagccgcccctttattagtgttaagttcatcaataaaatccagtatgtgcactcacttgaagacttagagcagctgattccaatggagcatgtgcagatccccgactgtgtgctgcagtacgaagaggaacggctgaaggctcgtcgggaaagtgcgaggccccagcctgaatttgttctcccacgatctgaggagaagcctgaagtagcacccgttgaaaacaggtctgctctcgtgagcgaagatcaggagaccaggatgtcttag

SEQ ID NO: 179631 - DNA, 1134 bp, Artificial Sequence
  Description of Artificial Sequence: Synthetic coding sequence
atggccggccggcggagcagccagcccggcatcgccctgcacaaccctgggaatcaccaggtgcagaaccctcagggtaggctggagacagtgcggcccttgccagaagagaccggagtggagctgctaggcagccctgttgaagatacctcctctccaccaaatactttgaactttaacggcgctcaccgcaagagaaaaactctggtagcacctgagattaacatttcgctcgaccaatctgagggctctctcctgtctgatgacttcctggacacacccgatgatctggacatcaacgtggacgatatcgagactccagatgagacggacagcctggaatttctcgggaatggaaatgaactcgagtgggaagatgatactcccgtggctactgctaagaatatgcctggcgacagcgctgacctgttcggcgatggcacgacagaggacggaagcgccgctaacggtcgcctgtggaggactgttattatcggggagcaagagcacaggatagaccttcatatgattagaccatacatgaaagtggttacacatggaggatattacggggagggcctgaatgctataatcgtgttcgctgcatgtttccttccggactcatcgctcccagactaccattacatcatggagaatttgttcctctacgttatctcaagtctcgaactgctggtggccgaagattatatgatcgtttatctcaacggagcgaccccccggagaaggatgcccggcatcggctggcttaagaagtgttaccaaatgattgatcgccggctgcgaaaaaatctgaagagcctcataatcgtccaccccagttggtttatcaggactgtcctggctatcagtcgcccttttatctccgtcaagttcataaacaagatccaatacgtacactccttggaagacttagagcagctgatacccatggaacacgttcagatcccagattgcgtgttacagtacgaggaagagcgacttaaggcccgcagggaatcagctagaccacagcctgaattcgtgctcccccggagcgaagagaagccagaggtagctcccgttgaaaatcggagtgccctggtttcagaggaccaggagaccagcatgtcttag

SEQ ID NO: 179632 - DNA, 1116 bp, Artificial Sequence
  Description of Artificial Sequence: Synthetic coding sequence
atgggcaccaccgaggccaccctgcggatggagaacgtggacgtgaaagaggagtggcaggatgaagacctcccacgacctttacccgaggaaaccggagtcgaactcctgggctcacctgtcgaggatactagctcgccacccaacaccctgaatttcaacggcgcgcataggaagcgtaagacactggtcgccccagagattaacatctctctggaccagtcagagggttcgttattgtcagacgatttcctcgatacccctgatgatttggatataaatgtggacgacattgaaactccagatgaaactgatagcctggaattcctaggcaacggaaacgagttagagtgggaggatgatactccggtcgccacggccaagaacatgcccggcgacagcgccgatctttttggagacggcactacagaagacggaagtgcggcaaacggaagactttggaggacggtcattattggagaacaggagcataggatcgatctgcatatgatccggccctacatgaaagtggtgacccatggcgggtactatggggagggtctgaacgccattattgttttcgctgcatgttttctgcccgattcttctctgcctgattaccactacatcatggagaatctctttctgtacgttatcagttcattggaactactcgtggctgaggattacatgatcgtttatcttaatggcgccactcctaggaggcggatgccaggaatcgggtggctgaagaaatgctatcaaatgatcgacagaagactgagaaaaaatcttaaaagcctgatcattgtgcatccttcatggtttatcagaacagtgctcgcaatttcccgaccatttatcagtgttaaattcatcaacaaaatccagtatgtgcacagcctggaagatttagaacagctgattccaatggagcatgtgcagattccggactgcgtgttgcaatatgaggaagagcgcctcaaggcccgccgagagagcgcaaggccacaacccgaattcgtcctgccaagatctgaagagaagcctgaggtcgcacccgtcgaaaacaggtcagctctagtgtctgaagatcaggaaacctcaatgtcctag

SEQ ID NO: 179633 - DNA, 1050 bp, Artificial Sequence
  Description of Artificial Sequence: Synthetic coding sequence
atgggcaccaccgaggccaccctgcggatggagaacgtggacgtgaaggaggaatggcaagacgaggaccctccaccaaacaccctcaacttcaacggcgcccacaggaagaggaagaccctagttgcccccgagatcaatatttcgctggaccagagcgagggcagcctcctgtctgacgactttctcgatacaccagatgatctggacattaatgtagatgatattgaaacacccgacgagactgactcactggagttcttggggaacggaaatgagttagaatgggaagacgatacgccggtggcaacagcaaaaaatatgcccggggacagtgcagacctgttcggagacgggaccacagaagacggatccgctgccaacgggcgcctgtggcggactgtgattattggtgagcaggaacaccgaatcgacctccacatgatcaggccctatatgaaagtcgtaacccacggcggctactatggtgaggggctcaatgcgattatcgtttttgctgcttgctttttgccggactctagtcttccggactaccactatataatggaaaacctcttcctgtatgtaatatcctctctggaactgctcgtcgccgaagattatatgattgtatacttgaatggcgctactccacggagaaggatgcccggaattggttggcttaagaagtgttatcagatgatcgaccggaggctcaggaaaaatctgaaatctttgattatagttcacccatcctggttcatccggactgtcctggcaataagcaggccattcatctctgtgaagtttatcaacaagattcaatacgtccatagcttggaagacctggaacaactgattcccatggagcacgtgcaaatccctgattgcgtgctgcagtacgaagaagaacgcctcaaagcgcggcgggagtccgcccgaccccagcccgagtttgttttgccccggtccgaggaaaagccagaggtggctcctgtggagaacaggagcgctctggtttcggaagaccaggagacccggatgagctag

SEQ ID NO: 179634 - DNA, 2448 bp, Artificial Sequence
  Description of Artificial Sequence: Synthetic coding sequence
atgaagagcaaccaggagcggagcaacgagtgcctgccccccaagaaaagggagatccccgctacatcccgcagttcagaggagaaggcacctactctgccaagcgataaccaccgagtggagggaaccgcatggctccctggcaaccccgggggcagaggtcacggcggcggaagacatgggccagcagggacaagcgtcgagctaggcttacagcagggcatcggccttcataaagctctgtccaccggcctggactactctcccccctccgcaccgcgctccgtccctgttgctacaactctccccgcggcctatgctactcctcaaccaggcacaccagtgagcccagtgcagtatgcgcatctcccacatacctttcagtttatcgggagctcccaatactcaggcacctatgcctcctttatcccatcccagcttatcccacccaccgccaatcccgtcactagcgcagttgccagtgcagctggcgcgacaacacctagccagagatcacaactggaagcctacagtacccttctggcaaacatgggctctttgagccaaactcccggccacaaggcggagcaacagcagcagcaacaacaacagcagcaacagcagcatcagcatcagcaacagcagcagcagcaacagcagcaacaacagcagcagcacctgtccagggcaccaggactcataacgcccgggtctcccccacccgcccagcagaatcagtatgttcatattagcagctctccccaaaatactgggcggaccgcgtctcctcccgccattcctgtgcatctccatccacatcagacaatgattccgcataccctcactctcggcccgccctctcaggtcgtcatgcaatacgctgattctgggagtcattttgtgccaagggaggcaaccaagaaagcagagtccagtaggctgcaacaagcaatacaggccaaggaggtcctgaatggagaaatggagaaatcacgccggtatggggccccttccagtgccgacctgggcctgggcaaggccggcgggaaatctgtgcctcatccttacgagtcacgccatgtggtggtacatccatcaccctccgactactccagtagagacccatctggggtcagggcctcagttatggtcttgcccaattctaatactcctgccgccgacctggaagtgcagcaggccactcaccgcgaagccagcccatccacattgaatgacaaatcaggtctgcacctggggaagcctgggcacagatcttacgctctttctccacataccgtgattcagaccactcactcagcctctgagcctctacccgttggcctcccggctacagcattctacgcgggcacccagccccctgtgataggctaccttagtggtcagcagcaagctattacatacgccggctccctgccccaacacctggtgatccctggaacgcaacctcttctcatccccgttggatctactgacatggaggccagtggagcggctcctgcaatagtaacttctagtccccaattcgcggctgtccctcacacattcgtgacaactgctctccctaaatcagagaatttcaatcctgaagcccttgtaactcaggccgcttatccagccatggtgcaggcccagattcatttgcccgtggttcagtccgtggcctctcccgctgcggcccctcctaccctgcccccctattttatgaaaggttcaattattcagctggccaatggcgaactcaaaaaagttgaagacctaaaaacagaggactttatccaatcagcggaaattagcaatgatcttaaaatcgatagttccactgttgaaaggatcgaggattctcacagtccaggagtggccgtcatacagtttgcagtgggagagcatcgggcccaggtgtctgtagaagtcctggtggagtaccctttttttgttttcgggcagggatggagctcctgctgccctgaaagaacatcccagctgttcgatctgccctgttctaagctttccgttggagacgtgtgtatatccctcaccttaaaaaacttgaagaacggaagcgtcaaaaaaggtcagccagtcgatcctgcgtctgtgctgctgaaacactcaaaagccgacggactggctggctccaggcatagatacgcagagcaggagaatgggatcaatcagggatctgcacagatgctctcagaaaatggcgagctgaaatttcccgagaagatggggttgccagctgcccccttccttactaaaatagaacctagtaagccagcagctacccgaaagagacgatggtccgcccccgaatcccggaaactggagaagtccgaagatgagccccccctaacactcccgaaaccctcattgattccacaggaggtcaagatctgcatcgagggtagatccaacgtggggaagtag

SEQ ID NO: 179635 - DNA, 2448 bp, Artificial Sequence
  Description of Artificial Sequence: Synthetic coding sequence
atgaagagcaaccaggagcggagcaacgagtgcctgccccccaagaaacgggagatccccgccacctctcggtctagcgaggaaaaagcaccaacactaccctctgacaatcatcgggtcgaagggacagcatggttacctggtaaccccgggggcaggggacatgggggaggaagacacgggcctgcgggtaccagtgtcgagttgggtctccagcaaggtatcgggctacataaagcgctaagcactggactggattactctcctcctagtgctcctcgcagcgttcccgtggctactacactgccagccgcttatgcaactcctcagcctgggactccagtttcaccggtgcaatacgcccacctaccgcatacattccagttcattggatctagccaatactctggaacttacgcgtcatttattccttcccagctgatcccgcccacggccaacccggtcacttctgcagtagccagtgccgccggagccacaacaccctcacagagaagccaactggaggcctattcgaccttgctggccaatatgggctctctgtcacagacgcccggacataaagcagaacagcagcaacagcagcagcagcagcaacagcagcagcatcagcaccaacagcaacaacagcagcagcagcaacagcagcagcaacagcatctctcccgcgcccccggcctaattactccaggaagccccccgcctgcccagcagaatcagtacgtacacatctcttctagcccccagaacaccggccggacagcgtccccacccgccattcctgtgcaccttcatccccatcagactatgataccacataccctaactctcggacccccgtcacaggtagtgatgcaatacgccgacagtggttcccactttgttcccagagaggcaacaaagaaagccgagtccagtaggctccaacaggcgattcaggccaaggaggtgttaaacggcgagatggaaaagtctcgacggtatggcgctcctagttctgcggacctgggtctcggtaaggcaggaggtaagagtgttccacacccttacgaatctcgccatgtcgtggtgcacccctcaccatccgattacagctcccgcgacccgagtggtgtgagagcaagcgtcatggtcctgcccaatagcaacacacccgcggctgatctggaagtacagcaggccacccaccgggaagcgagcccaagcaccctcaatgacaaatcaggcctgcacctcggaaaaccagggcataggagctacgccttgtcaccacacacagtaatacagacaacccatagtgcttcagaaccactgcctgtgggcctgccagcgacagcattctacgctggaacccagcctccggtgataggatacttaagcggccagcagcaggctattacctatgcaggcagtcttcctcagcatctggtgatccccggaacccaaccgcttttaatccctgtaggttctaccgatatggaagctagcggcgccgcccctgctattgtgacttcctcaccacaattcgccgcggtacctcacacttttgtcactaccgctctcccgaagtcagagaatttcaatcctgaagccctcgtgactcaggccgcataccccgccatggtgcaagcgcagattcacctaccagtggtacagagcgtggcatctccagcagcggcccccccaactctgcccccgtattttatgaagggatcaattatccaattagcgaatggcgagttaaagaaggtcgaagatctgaagacggaggattttatccagagcgcagagatatcaaacgacttgaagatagactcttccacagtcgagcgaattgaggactctcattcccccggagtggcagtgattcaattcgccgtgggcgagcacagggcgcaggtctccgtggaagtgttggttgagtacccgttcttcgttttcgggcaaggctggagcagttgctgtcccgagagaacttctcagttgtttgatctgccgtgcagtaaactttccgtgggagacgtctgcatcagcctgacactcaagaacctaaaaaatggatcggtgaaaaagggtcagcccgtagatccagcaagcgtgctgttgaaacacagtaaagccgatggtctggcaggcagccggcacaggtacgccgagcaggagaatggcatcaaccagggctccgctcagatgctttccgaaaacggggagctgaaatttcctgaaaaaatgggcttgcctgccgccccctttctcaccaagatcgagccatcgaagcctgccgccactcggaagcggcggtggtccgctcctgagtcgcgtaaactcgagaaatccgaagatgaaccccctctgacccttccaaagccttcactgattccccaggaggtaaagatatgtatagaagggagatctaatgtgggcaagtag

SEQ ID NO: 179636 - DNA, 2448 bp, Artificial Sequence
  Description of Artificial Sequence: Synthetic coding sequence
atgaagagcaaccaggagcggagcaacgagtgcctgccccccaagaaaagagagatacctgccacctctcggtctagcgaagaaaaagcacctaccttaccatccgacaaccatagggtggagggcacagcttggctgccgggtaacccagggggtcgcggtcacggtggcgggagacacggcccagctgggaccagcgtcgagcttgggctgcagcagggtattggtctacacaaggccctgtccacaggcctggattattccccaccttcagccccaaggtcggtgcctgtggcaacaaccctaccggccgcctacgccaccccccagccagggacccccgtatctccagtgcagtatgctcatctgccacataccttccaatttatcggaagtagccaatactcagggacgtatgcctcgttcattccttcccagctgatcccccccaccgcgaaccccgtaactagcgctgtggcctcagcagccggcgcgacaactccctcgcagcgctcccagctggaggcatatagcacactcctcgccaacatggggtcgctgagtcagacccccggccacaaggcggagcagcagcaacagcagcagcagcagcagcagcagcagcatcagcaccagcaacagcaacagcagcagcaacagcagcagcagcagcagcatctgagtagagcgccagggctgatcacacctggcagcccaccgccggcacagcagaaccagtacgtgcacatctcttccagtccgcagaacactgggcgcacagcctctcctccagcgatacctgtgcacctccatccccaccagactatgattccacacacactcacattgggcccaccttcacaggtagtcatgcaatatgccgactccgggtcccatttcgtgcctagggaggccactaagaaggcagaaagttcacgtttacagcaagcaatccaggccaaggaagtgcttaacggcgagatggagaagtccagacgctatggcgcaccctcaagtgccgacctgggccttggcaaagcagggggcaaaagcgtaccacacccttacgaaagcagacatgtggtggttcatccctccccctcagattattctagccgcgacccctccggggttcgcgcatctgtgatggtccttccaaattcaaacacccccgcagctgacttagaggtgcagcaggcgactcaccgcgaggccagccctagtaccctgaacgacaaaagcggcttacacctggggaagccagggcatcgctcatacgccctgagtccccacacagtcatccagacaacacactcagcaagtgagccgctgcccgtgggcctgcctgctaccgcattctacgctggtacccagcctcctgtgatcggatatctgtcagggcaacagcaggcaattacatacgccggttctctgccccagcatcttgtaatccccggcacacagccgcttttaatccctgtaggcagtaccgatatggaagcctctggcgcggcccctgccatcgtgacctcgtctcctcagtttgcagccgtaccacatacctttgtaactacggctctgccgaagtcggagaactttaaccccgaagccttggtgacccaagcggcctaccctgctatggtgcaggcgcaaattcacttgcccgtagtgcagtctgtggcctcacctgcagcggcccctccgacacttccaccttacttcatgaaagggtcgatcattcaattggccaacggagagctgaaaaaggtggaagatctcaaaacggaagattttatccagagcgcggagataagtaacgatctcaagatagatagcagtacagtggaaaggatagaagattctcattctccaggcgtcgcggtaattcaatttgccgtaggggagcaccgggctcaagtctctgtggaagtccttgttgaatatcccttttttgtttttggccagggctggtcaagctgctgccccgagcgtactagccagctattcgacctcccatgtagcaaactaagcgtcggcgatgtgtgtataagcttaaccctgaaaaacctgaagaatgggtcagtgaagaaaggccagcctgtggaccccgcctccgtgttacttaagcattctaaagccgatggcctggcaggcagtcgccacaggtacgctgagcaggaaaacggcatcaatcaaggcagtgcccagatgctctcagagaacggcgaattgaagtttccagaaaagatgggactgcccgccgctccgtttctgacgaagatcgaaccatcgaaacccgcggcaacgaggaaacggcgatggtctgcaccggagtcacggaagctggagaaatccgaagacgaaccccccttgacgttgccaaaaccctctcttattccacaggaggtgaaaatttgtatcgagggcagatcgaatgtcggaaagtag

SEQ ID NO: 179637 - DNA, 1428 bp, Artificial Sequence
  Description of Artificial Sequence: Synthetic coding sequence
atggccgccccccggcccccccccgcccggctgagcggcgtgatggtgccagctccaatccaggacctcgaggcactaagagctcttacggcacttttcaaagaacagagaaacagggagaccgcaccgaggaccatcttccaaagggtcctcgatatactgaaaaagagtagccacgccgtggagcttgcgtgtagggacccatcacaggtcgagaaccttgctagcagtctgcagttaataaccgagtgctttcgatgtctccgcaacgcctgtattgaatgcagcgtgaaccagaattccatccggaatctggatactattggagtagccgtggaccttatactcctgttccgagaactcagggtggagcaggagtcactgctcaccgcctttcgctgtggcctgcagtttctcggaaacattgcttctcggaatgaggattcacagtctattgtgtgggtccatgcctttcccgaactgttcctgtcctgtctgaatcaccccgacaaaaaaatcgtggcatatagcagcatgattctcttcacctccctcaaccacgagaggatgaaggagctcgaggagaacctcaatatcgccatcgatgtcattgatgcctatcaaaaacatcctgagtctgagtggcctttcctgatcattactgacctgttcctcaaatccccagagctggtccaagctatgttcccaaagcttaacaaccaagagagggtgactcttctggatttgatgatcgccaaaatcacgagcgatgagcccctgactaaggacgatattcctgtgtttcttagacacgcggaattaatagcctctacattcgtagaccagtgtaaaacggttctgaagctcgcctccgaggaacctcctgacgacgaggaagctctggctaccattagactcttggatgtgctgtgtgagatgacagtgaatactgaactgctcggttatctgcaggtgtttccgggcctgttagaaagagtgatcgatctgctgcgcgtaatccacgttgcggggaaagagacaaccaatattttttccaattgtggttgcgttcgtgccgagggcgacatcagcaatgtggctaacggctttaaatcacatcttattcgactgatcgggaacctctgttacaagaacaaagataatcaagataaagtcaatgaattggacggcatccctctgatactggataactgcaacattagcgactccaacccatttctcacacagtgggtcatctacgctatccggaacctcactgaagacaattcccagaaccaggatctgatcgctaaaatggaagagcagggcctggctgatgcttcgctccttaaaaaagtgggttttgaggtcgagaaaaagggtgaaaaactgattctcaagagcacacgagatactcctaaaccctag

SEQ ID NO: 179638 - DNA, 1236 bp, Artificial Sequence
  Description of Artificial Sequence: Synthetic coding sequence
atggccgccccccggcccccccccgcccggctgagcggcgtgatggtgcccgcgcccatccaggacctcgaagcgttgagagcgctgacagcactgtttaaggagcagcgcaatcggaaccttgacacaattggagtcgcagtcgatttaatcctattgttccgggagctgcgagtcgaacaggaatcattactgacagcattcagatgcggtctgcagttcttgggtaacatcgccagtcgcaacgaggatagccagtctattgtctgggttcacgctttcccggaactgttcctgtcctgcctgaaccaccctgataagaaaatcgtcgcgtatagctccatgatcctcttcacctctctgaaccacgaaagaatgaaggaactggaagagaacctgaacattgctatcgatgtcattgatgcctaccagaaacaccctgagtctgaatggcctttcttgattattacagacctctttctaaagagtcctgagttagtgcaggcaatgtttcccaaattgaataaccaggaacgggtgactctcctggacttaatgattgcaaaaatcacgtcggatgagccacttactaaggacgatattcccgtatttcttcggcatgccgaattaatcgcgagcacctttgtcgatcagtgtaagacggtactgaagctggcctctgaggaacccccagatgacgaggaagccttagcgaccatccgactgctcgatgttctttgtgagatgactgttaataccgagttgttaggttatttgcaggtgttcccagggctgttagaaagggtgattgatctactacgggtgatccacgtcgcaggtaaagagaccaccaacatcttcagcaactgcgggtgcgttcgggcggagggcgacatctctaacgtcgccaacgggtttaagtcccatttgattcgtttgattggcaatctctgctacaagaacaaagataatcaagacaaagtgaacgaactcgatgggatcccgctcatcctggacaattgcaatatcagtgatagtaacccattcctgacgcagtgggtgatatacgccatcagaaatctgacggaggataactcccagaaccaagatcttatcgctaagatggaggaacaggggctggcagatgcgtcacttctgaaaaaggtcggtttcgaagtggaaaaaaagggagaaaaactgattcttaagagtactcgagacactccgaagccctag

SEQ ID NO: 179639 - DNA, 1362 bp, Artificial Sequence
  Description of Artificial Sequence: Synthetic coding sequence
atggccgccccccggcccccccccgcccggctgagcggcgtgatggtgcccgcgcctatccaagacctagaagctctccgggccctgacggctctgttcaaggaacaaaggaatcgcgaaactgccccccgaacaatattccagcgggtgttggatattcttaagaagtctagtcacgccgttgaactggcatgccgggacccctcccaagtcgagaacctggcgagtagtcttcagctgattactgaatgttttcgctgtcttcgcaatgcctgtatcgaatgttcagttaatcagaactctatccggaatctggatactataggggtggccgtggatctcatactgcttttcagagagttgcgtgtggagcaggaatcattgctgaccgcttttcgctgcggtttgcagttccttggcaacattgcaagtagaaacgaagactcacagagtattgtgtgggtccacgctttcccggagctgttcttatcttgcctgaatcacccggataagaaaatcgttgcgtactcaagtatgatccttttcaccagcctaaatcatgaacgcatgaaagagcttgaggaaaatctgaacatcgccatcgatgtgattgacgcatatcagaaacatccagagagtgaatggccattcctgatcatcacagatctgttcttgaaaagcccagagctagtgcaggctatgtttcctaagttaaacaatcaggagcgcgtgaccctcctggatctgatgattgcaaagatcacatctgacgaaccgctaactaaggacgatatccccgtcttcctgcgtcacgccgagcttattgctagcacctttgtggatcaatgtaagacagtcctcaaattggcgtctgaagagccgcctgtgatgtacccctatatgcgtatcgttggaaaatttcggctgcttgacgtcttatgcgagatgaccgtgaatacagaactgctcgggtatctgcaggtgttcccaggtctgctggagcgggtcatagatctgctgagagtaatacatgtggctgggaaggaaaccacaaacattttttcaaattgcggatgcgtgcgagctgaaggtgatatctctaatgtggcaaacggcttcaagagtcatctgattagactgattggcaatttgtgctacaaaaacaaagacaatcaggacaaagtgaatgagctggatggaatcccacttatcctggataactgtaacatctccgattccaacccgtgcagcgaccctgtcggagatatctgccaccctaaaccttacagacgccagcagcccaagcccaggttcgactgcaaggacggaggcaccggagctgggaggtgcattccaacctag

SEQ ID NO: 179640 - DNA, 2070 bp, Artificial Sequence
  Description of Artificial Sequence: Synthetic coding sequence
atgaagcccgtgcacgagcggagccaggagtgcctgccccccaagaaacgagatctgcccgtgacatctgaagacatgggtcgaaccacaagttgttcgactaaccataccccaagcagtgatgcatctgagtggtcccgcggagtcgtcgtggcgggacaaagccaggcaggagcgcgagtctctctcggaggagatggcgccgaggccattactgggcttaccgtggaccagtacggtatgttgtacaaagtggccgtgcccccagccacattctcaccaaccgggctgccaagcgtggtgaacatgtcacccctgccgccaactttcaatgtggcttcatcattaatccagcatcccgggattcattatcctccgctccattacgctcagctgcctagtaccagtctccagtttatcggctctccctattcccttccttatgctgtgccacctaatttcctccccagccctttactttcacccagcgccaatctggctacctcccatctgcctcatttcgtgccatatgccagccttctcgccgagggtgccacacccccgccacaggccccctctcctgctcattcttttaataaggcacccagcgcaacaagtccttccgggcaattgccccaccactcttcgacccaacctctcgacctcgctcccggccgcatgcctatatattaccagatgtcaaggctgccagccggttacactctacacgaaactccgccagccggtgcatcccccgtccttacgcctcaggaaagccaatccgcactcgaggcggctgctgcaaacggcggtcaacgcccacgggaacgaaatctcgtgagacgcgagagcgaggctctggattccccaaattccaagggcgagggacagggcttggtcccagtcgtcgagtgtgttgtcgatggccaattgttttctgggtcacagacccctcgagtggaagtcgccgccccagctcatcgcggcaccccggataccgatctcgaggtgcagcgggtcgtgggcgccctggcgtctcaggattatcgcgtggtggcagcacagcgcaaggaggaacccagcccactcaatttgtctcaccacacacctgaccaccaaggagagggccgcggatctgccagaaatccagcagagctggcagaaaagagtcaggccagaggcttctatccacagtcccaccaggagcctgtgaagcaccggcccctccccaaagctatggtggtggccaacggtaacctagttcccaccgggactgattcaggtctactgcccgtgggcagtgaaattcttgtcgctagctcactggacgtgcaggctcgggccacattccctgacaaagaacccactcctccacctatcacctcaagtcatttaccatctcactttatgaagggagctattattcagcttgcaacaggcgagctgaaacgggtggaggaccttcagactcaagattttgtgaggagtgctgaagtgagcggcggtctgaagattgactcatccaccgtggttgatattcaggaaagtcagtggcccggatttgtcatgctccactttgtggtgggggaacagcagtcaaaagtgagtatagaggtcccgccagaacaccctttttttgtgtatggtcagggctggagctcctgttcaccaggcagaacgacacagctattttccctcccttgtcaccgattgcaagttggcgacgtgtgtatttcaattagcctccaatcgctcaattccaattcagtgtcccaggcatcttgcgccccccctagccagttggggccaccacgcgagcggccggaacgcaccgtgttgggctctagagagctttgcgactctgagggaaaaagccagccggccggagaaggaagcagagttgtggagccctcccagcccgaatcaggtgcccaggcatgctggcccgctccaagctttcagcggtacagcatgcaaggagaagaggcacgtgcggcgctgctgagaccaagtttcatcccacaggaggtcaagttatcaatcgaagggcgctcaaacgctggaaaatag

SEQ ID NO: 179641 - DNA, 3942 bp, Artificial Sequence
  Description of Artificial Sequence: Synthetic coding sequence
atgcggagcgccgccgccgccccccggagccccgccgtggccaccgaatccaggaggtttgctgctgcccgatggcccgggtggcggtcactccagagaccggcccgtcgatcaggaagaggcggtggaggcgctgcaccgggtccttatccctccgccgccccccctccacctggaccgggccctcctccaagcagacaatccagccccccctcagctagcgattgctttggtagtaatggcaacggcggaggggctttccgaccaggcagccggcgcttgttaggccttggaggtcccccgaggccttttgtggtcctcttgctgcccctggcatccccaggagctccaccagccgcccccacccgcgcgagcccgctgggggcccgcgcatcccctcctcggagcggtgttagtcttgcccggccggccccgggctgtccgcgccctgcttgtgagcccgtgtacggcccactcaccatgtctctcaagccccagcaacagcaacaacagcagcagcagcagcagcagcagcagcagcaacagcagcagcagcagcagcaaccccctccagccgccgcgaacgtccgaaagccaggaggcagcgggttgttggcaagccccgccgctgccccatctccatcctcgtctagtgtgtcgtcctcttctgctactgctccatccagtgtggtggcagccacatctggaggaggacgcccaggcctcggccggggacggaactctaataaaggcttaccacagtcaaccattagctttgatggcatctacgccaatatgcgcatggtacacatcctgacatccgtcgtgggctctaagtgtgaagtccaggtaaagaacggtggcatctatgaaggcgtgtttaagacgtactcccccaagtgcgacctggtgctggatgcagctcacgagaaatcgaccgaatcatcgtctggtcctaagagagaagagataatggagagcatccttttcaagtgtagtgatttcgtggtggtgcagtttaaagacatggatagctcatacgccaaacgtgatgcctttaccgattccgctattagtgcaaaagtcaatggtgagcataaggaaaaagatctggaaccttgggatgcaggggagctcacagccaacgaggagctcgaagctctagaaaacgacgttagtaacgggtgggacccaaacgacatgtttcggtataatgaggagaactacggagtggtgtcgacttatgattcatccctgagctcctacaccgtcccccttgaacgggacaattccgaggaatttctaaagagagaggcccgcgccaaccagctcgccgaggagatcgaatccagcgcgcagtataaggcccgggttgctctcgagaacgacgatcgaagcgaggaggagaaatatactgccgttcaaaggaactcctctgagcgagaggggcacagcatcaatactcgcgagaacaagtacatcccacccgggcaacggaaccgggaggtgatttcatgggggtccggccgtcagaatagtccacggatgggacagcccggatctggcagcatgccttcacgtagcacctcgcacactagcgatttcaaccctaactcaggctctgatcagcgagtggtgaatggtggagttccttggccaagcccctgcccctcgccctctagcaggcccccttctaggtatcaatctggtcctaattccctaccacctcgggcggccacccccacacgccccccctcccgtcctccaagcagaccctcccgaccaccttctcacccctccgcccacggctctccagcccccgtctccacaatgcctaagcgtatgtccagcgaaggcccaccacggatgtcccctaaagcccagcgccatcctaggaaccatagagtgtcagcagggaggggctccatctcctcaggcctcgaattcgtgtcccacaatcctccatctgaggctgctacccctcccgtggcccgaacctctccatccggcggaacctggagcagcgtggtgtcaggtgtgcctcgtctctcacctaagacgcaccggccgcggtcaccgagacagaacagcataggtaatacaccttctggtcctgtgctggcctcccctcaagccgggattatccctacagaagcagtggctatgccaattcccgctgcctctcctactcccgcaagtcccgctagtaatcgtgcggtgactccatcatcagaagctaaagactctcgtctgcaggaccaaaggcagaacagtcctgccggtaacaaagagaatatcaagccaaatgaaacatcacctagtttttccaaagctgagaacaagggtatcagccctgtggtgtctgagcataggaaacagatcgatgacctcaagaaattcaagaacgacttccgcctgcagcctagttcaacaagcgagtctatggaccagctgctgaataaaaatagggagggcgaaaaatccagggacttaattaaagacaagatcgaaccatcggccaaggatagttttatcgagaattcaagtagcaattgtacaagcgggagttcaaagcccaactctccttcaatcagcccttccatcctttctaacactgagcacaagcggggtcccgaggtgacgagccagggagtccagaccagttcccccgcctgcaagcaggagaaggacgacaaggaggagaagaaggatgccgccgagcaggtgcgaaagtccacactcaaccccaacgcaaaagaatttaatcccagatctttctcacagcccaagcctagcaccacgccaacctcccctaggcctcaagcacagcccagtccaagcatggtaggccaccaacagcctactccagtgtacacacagccagtgtgcttcgcaccaaatatgatgtatccagttcccgtcagtcccggcgtacaacctctttaccctatccctatgaccccaatgccggtgaaccaggctaagacgtacagggcagtcccaaatatgccccagcagagacaggaccaacaccaccagtctgcaatgatgcaccccgcctccgcagcaggtcctcccatagccgctacacctcccgcgtactctacacaatatgtagcgtacagtccccagcaatttcctaatcaaccattggttcagcacgtcccacattaccagagtcaacacccacatgtgtatagtcccgtaatccaaggcaacgctagaatgatggctccaccaacacacgcccagcctgggctggttagctcctcagcaacacagtatggggcgcacgagcagacccacgcgatgtatgcctgccctaagctgccttacaataaggagacatcaccttctttctattttgccatctctacaggaagcctggctcagcagtatgctcatcccaatgccactttacaccctcacactccccatccacagcccagtgccacccctactgggcagcagcaaagccagcatgggggcagccatcccgcccctagccccgttcagcatcatcaacaccaggcggcccaggcgttgcacctggcgtccccccagcagcagtcagccatctatcacgctggcctggccccaactccaccttctatgacccccgcctctaacacacagtctcctcagaactcatttcctgcagcgcaacaaacagttttcacaatccacccatcccacgtccagcctgcctacaccaacccccctcacatggcccacgtacctcaggcccacgtgcagtcgggaatggtgccatcacaccctaccgcccacgcacctatgatgctcatgactactcagcccccgggcggcccgcaggcggcgctggctcagtctgcgctccaacccatcccagtttccaccaccgctcacttcccctacatgactcaccccagcgtccaggcccatcatcagcagcagctctag

SEQ ID NO: 179642 - DNA, 2988 bp, Artificial Sequence
  Description of Artificial Sequence: Synthetic coding sequence
atgcggagcgccgccgccgccccccggagccccgccgtggccaccgaatcccgacgttttgccgccgcccgatggcctggatggagatcacttcaaaggcccgccagaagatctggcaggggaggaggaggtgccgcacccggaccatatccatctgccgcccccccaccacctggccccggcccgcctccatcacggcagtcctctcctcccagcgcctctgactgctttgggtccaacggtaacggaggtggcgcattccgacctggcagccggagacttctcgggctgggcggcccaccccggccctttgttgtgctccttctacccctagccagtccaggggctcccccagcagcacccactcgtgcgtcacccctcggcgcccgagccagcccccctagaagcggagtttctttggcacgacccgccccaggctgcccaaggccagcctgtgaacccgtgtatggtcccctcacaatgtcactcaagccgcaacaacagcagcagcagcagcagcagcagcaacagcagcaacagcaacagcaacagcagcagcagcaaccgcctcccgccgccgctaatgtgcgaaagcccggcggctctggactgctcgcctcccccgccgccgcaccaagcccatcttcgtcctcagtgagtagttcatcggctacagcccccagctccgtcgtggcagccacctcgggcggggggcgccctggcctgggacgaggccggaattctaataaaggcctccctcagtccaccataagttttgacgggatctacgccaatatgagaatggtacatatccttacttctgtagtaggctccaagtgtgaagtgcaagtgaagaatggaggcatctacgagggggtgtttaaaacctatagccctaagtgcgatctggtcctggatgctgcccacgagaagtccaccgaaagttcttccggacccaagcgagaagagataatggaaagtatcctgttcaagtgcagtgattttgtcgtggtgcagttcaaagacatggacagtagctatgctaaaagggatgcattcactgattcggctatctccgctaaagttaacggggagcataaggaaaaagaccttgagccctgggatgctggagaattgaccgctaacgaggagctggaagccctggaaaatgacgtgagtaatgggtgggaccccaatgacatgttccggtataacgaggagaattacggagtagtatctacatatgattccagcctctcatcctacactgtgccattggagagagacaacagcgaggagtttctcaagcgcgaagccagagccaaccagttggcagaggaaatcgagagctccgcccagtacaaagctcgtgtggcactggaaaacgacgatcgctccgaagaggaaaaatacacagctgtacaacgcaactcctccgagcgcgagggacattctattaacacacgcgagaataagtatataccgccaggacagcgtaaccgtgaggtaatcagttggggatccggccgtcagaattctccaaggatgggacaacccggttctggctctatgccctcgcgttccacctctcatacgtccgatttcaacccaaatagtggtagcgatcagcgagtggtcaacgggggagtgccttggccgtcaccatgcccttccccgtcatcccgtccgccatctcgctaccaatccgggcctaattctctgccacctcgagcagctacgcctacacggccaccatcacgacccccatctcggccctctcgcccaccgtctcacccttctgctcacggcagtccagccccagtgagtaccatgcctaagcgcatgagcagtgaagggccgccacgtatgtccccgaaggcccagcgccacccaagaaaccacagagtttcagcgggcaggggctccatttctagtggcttggagttcgtgtcccacaatcccccttctgaagcggcaactcccccggttgcgaggacgtccccaagcggcggcacttggagctctgtggtgtcaggagtaccgcgtcttagccctaaaactcatcggccacggagtccccgtcagaacagcattggcaacacccccagcggcccagttctggcgtcgccccaggccgggattatcccaaccgaggcggtcgctatgccaatacccgccgcgtctccaaccccagctagcccagcttcgaacagggcggtaaccccgtccagcgaggcaaaggacagtcggctgcaggatcaacgccagaatagtccagccggtaataaagagaatataaaaccaaacgaaaccagcccatcattctccaaggctgagaataaaggcatcagtccggtcgtgtcggagcaccggaagcaaattgacgatctgaagaaattcaaaaatgactttcgcctccagccttcgagtactagtgagtccatggatcagctacttaacaagaatcgggagggcgaaaaatcaagggatctgataaaggataagatcgagccctccgctaaggactccttcatcgaaaacagcagtagcaactgtaccagtgggagctctaaacctaattctccttccatatctccgtccattctctctaatacagaacataagagggggccggaggtgacctctcaaggtgtccagaccagtagtcccgcctgtaagcaggaaaaagacgacaaggaagagaagaaagacgccgcagagcaggttcggaaatcaactctgaatccgaatgccaaggaattcaatcctagaagtttctctcagccaaagccgagtaccaccccaaccagccctcgacctcaggctcaaccgagtcctagcatggtaggacaccagcagccgaccccagtctatactcagcctgtgtgcttcgcccccaacatgatgtaccccgtacctgtctcgcctggcgtgcagtaccagatttgtccgaactccggaaaaacatcaataattcgcgtgccctag

SEQ ID NO: 179643 - DNA, 3189 bp, Artificial Sequence
  Description of Artificial Sequence: Synthetic coding sequence
atgctgaagccccagcccctgcagcagcccagccagccccagcagccaccacctacgcagcaagctgtcgctcggagaccccctggaggaacgagtcctcccaatgggggtcttccagggccactggcaactagtgcagccccacccggaccccccgctgcagcctctccctgtctggggcctgttgcagcagccggctctggcctgcggaggggtgcagaaggcatcctcgcgccccaacccccgcctccgcagcagcaccaggagagaccaggcgccgccgctattggaagcgctagagggcaaagcacaggtaaaggtccgccacagtccccagtttttgaaggagtctataacaattctcggatgttgcacttcctcacagccgttgtgggaagcacatgcgatgtgaaggttaaaaacggaacgacctacgagggaatatttaaaacccttagctctaaatttgaactcgctgttgacgccgtccataggaaagcctccgaaccagctggagggccacgtcgcgaagacattgtggataccatggtgtttaaacctagcgatgttatgctggttcactttagaaacgtcgacttcaattacgctaccaaagataaatttactgacagcgcaatcgcgatgaattcaaaggtgaatggcgaacataaagagaaagttctgcagcgatgggaaggaggggatagtaactctgatgattacgatctcgaatctgatatgagtaatggttgggaccctaatgagatgtttaagtttaatgaggagaactatggcgttaaaaccacctacgatagcagcttaagcagttacacagtcccgctggagaaggataattcggaagagttccgccaacgagagctgcgcgcagcacagctggcccgagagatagagagctctcctcagtacagactccggatcgccatggaaaatgacgatgggagaactgaggaagaaaagcactccgccgtgcagcgccagggttcaggacgtgagtccccttctctcgcctcccgagagggaaagtacattccactccctcaaagagtacgcgagggccccaggggaggagtgagatgttccagctcccggggcgggcggcctgggctcagttctctcccaccacgcggtccgcaccatctcgacaatagctctccgggtccagggtctgaagccagaggcataaatgggggaccatctaggatgtcccctaaagcccagaggcctctgcggggcgcgaagactttaagttcaccctcaaatcggcccagtggagagaccagcgtgccccctccccccgcagttggcagaatgtacccccctaggtcacctaaatcagccgcccccgctcctatcagcgccagctgcccagagccgcccatagggtccgccgtgcctacgtcctccgcaagcatcccagtcacgagcagcgtgagcgatccaggggtgggttcaattagccccgcctcacccaaaataagccttgcaccaactgatgtgaaagaattatcaaccaaagagcctggtcgtacattggagccacaggaactggctcggatcgccgggaaggtgccgggcctccaaaatgagcaaaagcgctttcagctcgaggagttaaggaagtttggagcccagtttaagctgcagccttcgagcagtccagaaaacagcttggacccctttccaccccggatcctaaaagaggaaccaaaaggcaaggagaaagaggtggacggccttctcacctcggaaccgatgggcagcccagtgtctagtaagactgagtctgtgtctgataaggaagataagcccccattggcaccatccggggggactgaaggtccagagcagcccccccccccatgtccttcacagacagggtccccgccagtcggtctgattaagggtgaggataaggacgagggacctgtcgctgagcaggttaaaaaatctaccctgaaccccaatgctaaggagttcaacccgacgaaacccctactatccgtgaacaagtccacatccacacctacaagtcctggccccaggacccactccactccgagcatccccgtcctgacagctgggcagtctgggctttattcacctcagtacataagctacatccctcagattcatatgggcccggccgtgcaggctccccagatgtatccctaccccgtgagcaactcggtgcccggacagcagggaaagtaccgcggggctaaaggctcactccccccacaacgttccgatcagcaccagcccgccagcgcgcctccaatgatgcaggccgccgcagccgccggtccacccctagttgccgccacaccgtattcttcctacattccatacaatccccagcagtttccagggcaaccggctatgatgcagccgatggctcattatccgagccagccagtgttcgcacccatgctacagtcaaaccccaggatgttgacaagtggttctcacccacaagccatcgtgtcgtcatcgactcctcagtatcccagcgccgaacaacccaccccacaagctctgtatgctactgtgcaccagagctaccctcatcatgcgacgcagctccacgcccatcagccccaacctgccaccacaccaaccgggtcccagccacagtcacaacacgctgcgcctagtccagtgcaacaccaggctgggcaggccccccacctgggctcaggccaaccccagcaaaacctataccaccctggggctctgactgggaccccaccaagtcttcctcctgggccctccgctcagagcccccagtcctccttcccccagcctgctgccgtgtacgcaatccaccaccagcagcttccacacggcttcaccaatatggcacatgtgacgcaggcccatgtccagaccggcatcactgccgcaccaccgcctcacccaggtgctccacaccccccccaagtgatgctgcttcatcctccccagagtcatgggggtccaccacagggagcggttccccagtctggggtgcccgctctgtctgctagcacccccagtccttacccctacatcggtcaccctcaaggcgagcaacctggtcaggccccaggattcccagggggcgccgacgatcgaatcccacctctcccacctcctggggagttaaagattgtccttgccgccacctag

SEQ ID NO: 179644 - DNA, 3228 bp, Artificial Sequence
  Description of Artificial Sequence: Synthetic coding sequence
atgctgaagccccagcccctgcagcagcccagccagccccagcagccccctccaacccaacaggcagttgcccgtcggccccctggaggaactagtccaccaaatgggggcttgccaggcccactagccaccagcgctgccccacccggcccgcccgctgccgcatctccttgcctggggcccgtcgccgccgctggcagtggtctcagacgcggagcggagggaatcctggctccccagccccccccgccacagcaacatcaggaacgacctggtgctgcagccatcggatctgcccgaggccagtcgactgggaagggaccgccacagtcacccgttttcgagggcgtgtacaataacagtcgcatgctccatttcctgacagcagtagtgggttccacatgcgacgtgaaagtgaaaaatgggaccacgtacgagggaatctttaaaaccctgtcctcaaagttcgagcttgccgtagacgctgtgcaccggaaggcgtccgagcctgcaggggggccccgtcgggaagatatagtggacactatggtttttaagcccagcgatgtcatgctggtccactttagaaacgttgacttcaattacgcaacgaaggataaattcaccgactccgcaatcgcaatgaattccaaggtcaatggcgaacataaagaaaaagtgctgcagaggtgggaggggggggacagcaatagcgatgattacgatctggagtccgatatgtctaatggatgggaccccaatgagatgttcaaattcaacgaagaaaactacggcgtcaagaccacatatgattctagcctgtctagctatactgtgcctctagaaaaagacaactctgaggaatttcgccaacgagaactacgcgctgctcagctggcaagagagatagagagctccccgcagtacaggttgcgtatcgcaatggagaacgacgacggacgcactgaggaggagaaacatagcgccgtacagagacagggatctggccgagagagcccatccctggcatcccgcgaaggcaaatacattcctctgccccaaagagtgcgggagggtcctagaggcggggtgagatgctcatcttcacggggcggaagaccaggcctttcttcattacccccaagaggtccccatcaccttgacaacagttctccaggaccaggctctgaggcacgaggcattaatggcggcccaagtcgaatgtctccaaaggcccagaggccgctgcggggcgcaaagaccttaagtagcccctcaaacaggccaagcggcgaaacaagcgtcccaccccctcccgccgtaggcagaatgtatccaccacggtccccaaagtctgctgcccctgcccctatcagcgcctcttgcccagagcctcccattgggtctgctgtgcccacaagttctgcttctattccagtcaccagctctgtgtctgatccgggtgttgggtctatctctcccgccagtcccaagattagtctggcccctaccgatgttaaggaattgagtaccaaagaacccggaagaacactcgaaccacaggagctcgctcgcattgcgggtaaggtccccggccttcagaatgagcagaagcgctttcagctggaggaactgagaaagttcggagcccagtttaagcttcagccctccagcagcccggagaattcacttgatccctttcccccacgcatactcaaagaagagcccaaaggcaaggagaaggaggtcgacggccttcttacatccgaaccaatgggatccccagtgtcttcaaagactgagagcgtcagcgacaaagaagataaaccacctttggctcccagcggtgggaccgagggccctgaacagccgcctcccccttgcccctcccagacagggagccctcctgtcgggctaattaaaggggaggacaaggatgaaggacccgtggcagagcaagtgaagaaatctactctgaatccaaacgctaaggagttcaatcctaccaagcctctgctatccgtaaataaaagtacatctaccccaacaagccccgggccacgcacccactcaacacctagcatccccgtgctcactgcagggcaatcagggctgtactctccacaatatattagctacatcccgcagatccacatggggcccgcagtccaagccccacagatgtatccatatccagtctctaacagtgtacccgggcagcaggggaagtatcggggcgcaaaaggcagtctccccccccaaaggtctgatcaacatcaacccgcttcagccccaccaatgatgcaggcagcagccgctgctgggccacccctggttgccgcgacgccctactcatcctacattccgtacaatccccagcaattccccgggcagcctgcaatgatgcagcctatggctcactacccttcccaacccgtgttcgcgcctatgctgcagagcaatcctcggatgctgacttccggaagccatccacaggctatcgtgtcgagttcaacacctcagtaccccagcgccgaacagcccaccccccaggccctctacgcgactgtgcaccagtcctacccgcatcatgccacacagctgcatgcccaccaaccgcagcctgccactacacccactggctctcagccccaaagtcagcatgcagcccccagccccgtccagcaccaggccggtcaagcccctcacctgggttccggccagccccaacaaaacctctatcaccccggagctctcacggggacgccaccatctctcccccctggccccagtgcacagtctccccagagctcgttcccacaaccagctgccgtgtacgcaattcatcatcagcagctgcctcacggcttcaccaacatggcccatgttacccaggcccatgtgcagactggaataaccgccgcgcctcccccccacccaggcgcaccccacccaccgcaggtcatgctgctgcatccgccacagtcccatggtggtccccctcagggtgcggttccccagagcggagtacctgctttatccgcctccaccccctccccctacccctatatcggccacccgcagggggagcagccaggccaggcacccggcttccccggaggagctgacgatcggattcgggagttctccctggcaggcggcatatggcacggtcgcgcggaaggcctgcaggttggccaagacgctcgcgtcctgggcggagagtag

SEQ ID NO: 179645 - DNA, 3135 bp, Artificial Sequence
  Description of Artificial Sequence: Synthetic coding sequence
atgctgaagccccagcccctgcagcagcccagccagccccagcagccgcctcccacccaacaggcagttgcccgaagaccacctggggggacttcaccgcctaacggtggtctccctggacctctggccacgtcagccgctcctcccgggccccctgccgccgcctcaccctgccttggtccggtggctgccgctggcagtggtctccggagaggagctgaaggaatactagcaccacagcctccccctccccaacagcaccaagaacgccccggagcagcggcaatcggctctgcgcgagggcaatctacaggcaaaggtcctccccagagtcctgtgtttgaaggagtgtacaataacagtcgcatgctgcatttcctgacggcagtcgtgggctcaacttgtgatgtgaaagtgaaaaatggtacaacctacgagggtattttcaagaccctcagctccaagtttgagctcgctgtggatgctgtccacagaaaagctagtgagccagcaggcggaccgcggcgtgaagacatcgtggatacaatggttttcaagccctcagatgttatgcttgttcatttccgcaacgtagacttcaactacgccacaaaagacaagttcacagactctgccatcgcaatgaattccaaggttaacggggaacataaggaaaaagttctgcaaagatgggaaggcggagattctaactcggacgactacgatctggagtccgacatgagcaatggctgggatccgaatgagatgttcaagttcaacgaggaaaattacggcgtcaaaaccacgtatgattcgtcactgtcaagctacaccgttccccttgagaaggataattcggaagagttcagacagcgcgagcttagagccgcacaattggcgcgtgagatcgaaagctcccctcagtatagactgagaatagccatggagaacgatgacggccgaaccgaggaggagaaacactccgctgttcaacgccaggggtccgggcgggagagccctagcctggcctctcgggagggtaaatatattccactgcctcagcgcgtccgggaaggccctagaggcggcgtacgatgttctagttccaggggaggcaggcccggcctcagttctcttcccccccggggtccccatcacctagataatagctcccccggtccaggatccgaggcaagaggcatcaacggtggcccaagccggatgagcccaaaagcacagcggccgcttcggggcgcgaagaccctgtcaagtccctctaataggcctagcggcgagactagcgtaccaccgccacccgctgttggtagaatgtacccccctcggagtcctaaatcagcagccccagctccaatttcagctagctgccctgagcctccaatcggcagcgctgttccaaccagttccgcctctattcctgtgacctctagcgtttctgaccccggtgtcggtagcatttcacctgcctccccaaagatcagcttggctcccactgatgtgaaggagctttctactaaggagccaggcaggactctcgagccacaggaactagcacgaatcgccggcaaggtccccggactgcaaaacgagcagaagagatttcaactggaagaactccgcaagtttggagctcagttcaagttacagccctctagctcgcctgagaatagcctggatcccttccctccccgaatcttaaaggaagaaccaaaggggaaggagaaggaagtcgatggcttactgacaagtgagcccatgggaagcccggtgtcatccaagaccgaatctgtgtccgataaggaagacaaacctccccttgcaccctccggcggaaccgaaggccccgagcaaccaccacccccttgcccatcccagacaggctcaccgccagtcggcctgattaagggggaggataaagatgaaggccctgtcgccgagcaggtcaagaaaagtacccttaatccaaatgctaaggaatttaacccaacaaaaccactgctgtcagttaataaaagcacctcaacgcccacgagccctggccctagaactcacagcacccccagtattcccgtgctgactgcaggacagtccggcttatatagcccacagtacataagctatatcccacagattcatatgggacctgcagtgcaggcccctcagatgtatccttatccggtgagtaatagcgtgcccgggcagcaaggaaagtataggggtgcgaaaggcagtctgccacctcaaaggtcagatcagcatcagcctgcatctgccccgcccatgatgcaggcagccgctgctgcaggaccaccattagttgccgctacgccctactcctcctatattccctataatcctcagcagtttcccgggcaaccagccatgatgcagcccatggctcattatccttctcagcccgtctttgccccgatgttacagagtaacccacgaatgctgacatccggatctcatccccaagctatcgtgagcagcagtacacctcaataccctagcgccgaacagccaactccacaagctctttacgcgaccgtgcaccagagctacccccatcacgcaacacaactgcacgcacaccagcctcagcccgctacgactccaactggtagtcagccccagtctcagcacgcagcgcccagcccggtgcagcatcaggccggccaagctccccatctaggaagtggacaaccgcagcaaaacctctatcaccctggagccctcacgggaacacccccaagtcttccaccaggcccctcagcccagtctcctcaatccagtttcccccaacccgccgccgtctacgctatccatcatcagcaactgcctcatgggtttaccaacatggcacatgtcacccaggcccacgtgcagactggcataacagcagcccctcccccccacccgggcgccccacatccgccgcaggtcatgctactccatcctcctcagagtcatggaggtcctcctcaaggcgcagtcccccagtcaggggtgcctgcactttccgcatctactccctccccctatccttacattggccaccctcaggtccagtctcatccttcccagcagctgccctttcacccacccggtaactag

SEQ ID NO: 179646 - DNA, 1203 bp, Artificial Sequence
  Description of Artificial Sequence: Synthetic coding sequence
atgctgaagccccagcccctgcagcagcccagccagccccagcagccaccgccaactcagcaggcggttgccaggcgtcctcctggcggcacatctcctcctaatggcgggttgccaggccccttggcaactagcgcagcaccccccggcccacctgctgccgcttctccttgcctaggcccggttgcggctgccgggtcagggttacggcgcggagcggaaggaattttggctccgcagcctccaccccctcagcagcatcaggaaagacccggggccgccgctataggcagtgctcgaggacagagcaccggaaaaggcccaccccagtccccagttttcgagggagtgtacaataacagccgcatgttacacttccttactgccgtggtaggctctacatgcgacgttaaggttaagaacgggacaacatacgaaggcatttttaaaactttgagttccaaattcgagttagccgtagacgccgttcaccggaaggcgtctgagccagccggcggccctcgccgggaagatattgttgatacgatggtctttaagccttcagacgtgatgttggtgcacttcagaaacgtggacttcaattacgcaaccaaagataagttcactgactcggccatcgccatgaattccaaagtgaacggtgagcataaagagaaggtcctgcagcgatgggagggaggggacagtaattcggatgactacgatctggaaagcgacatgtctaatggttgggacccgaatgagatgttcaagttcaatgaagaaaactacggggtgaagacgacatacgactcctctctgagtagttacacagttcccctcgagaaagataatagcgaggaattcaggcagcgggagttgagggcagcccagttggcacgagaaatagagtcttctcctcagtatcgcctgcggatcgccatggaaaatgatgacgggcggaccgaagaggagaagcacagcgcagtccagaggcaggggagtggaagggaatcaccttcccttgcttcgcgagagggcaagtatatccccctgccccctcaccgcggccagggacagggaccagccggtgtgggagggtcctgctcagcccctgcccgaccccaccctgttcttccatcccatccactcatctactcacccgcaggtgatggaagaagtttcatcttttattacctgtag

SEQ ID NO: 179647 - DNA, 3135 bp, Artificial Sequence
  Description of Artificial Sequence: Synthetic coding sequence
atgctgaagccccagcccctgcagcagcccagccagccccagcagcctccacccacccagcaagccgtggcacgccggccacctgggggaacaagccccccgaacggtggacttcctgggccactagctacgtccgctgctcccccaggaccgccagcagccgcttccccctgcctcgggccagtggctgccgctggctccgggttacgtcgtggggccgagggtatcctggcgccccagcccccccctcctcagcagcatcaggagcgccctggggctgcagcaatcggaagcgccagaggtcagagtaccggaaaagggcctcctcagtcccccgtgtttgaaggagtgtacaacaactctagaatgctgcactttctcacagcggtcgtcggtagcacatgcgacgtcaaagtgaagaatggcaccacttatgagggaatttttaaaacactctcatcgaaattcgagctggccgtagacgctgtgcatcgtaaggccagtgagccagctggcggacccagaagagaagacatcgttgacacaatggttttcaaaccctctgatgtgatgctcgtgcacttccgaaacgttgattttaactatgccactaaggacaagtttaccgacagcgctattgcgatgaactccaaagtcaacggagagcacaaagaaaaggtgctccagcgatgggaggggggcgattctaactcagatgattatgacctggaatcggatatgagtaatggttgggatccaaatgagatgtttaagtttaacgaggaaaactacggtgttaaaacgacctatgatagctctctcagcagttatactgtgccgctggaaaaagataactccgaagaattcagacagagggaattacgcgccgcgcagctggcgcgagagatagaaagttccccccaatatcgccttcggatagcaatggagaacgacgacgggcgcacggaagaagagaagcacagtgcagtacagcggcaggggagcggccgggagagtccatctctggcctcccgcgaaggcaaatacattccgctgccacagagagtgcgggaggggcctagagggggcgtgcgctgcagcagttccagagggggtcgccccgggttaagttcattacccccccgcggacctcaccacctcgataattcaagtcccgggcctggttcagaggctcggggcataaatggcgggccctcccggatgtcacctaaggcgcaaaggccattgagaggggctaagaccctcagcagccctagtaaccggccctctggcgagacatcagttcccccgccccccgcagtcgggagaatgtatcctccccgttccccgaagtccgcggcaccagcccccatttccgcctcgtgtccagaacctcctattgggtccgctgttccgaccagtagtgccagtatccctgtgaccagttctgttagtgatcccggggtggggtccattagccccgcctcccccaagatcagtctggctcccaccgacgtgaaagagctatctacaaaggaacctggccgcaccttagagccccaagaactagcgcgcatcgccggcaaagtccccggtctgcaaaacgagcagaagcggtttcagcttgaagagttgaggaaattcggggcccagttcaagctacagccttcatcatcacccgaaaatagtcttgatcctttccccccaagaatcctgaaggaggagcctaagggaaaggagaaggaagttgatgggttgttgacatccgagcccatggggtcccccgtttcttcaaaaactgaaagtgtctccgataaggaggacaaaccgccactagcaccatctgggggcaccgaggggccggagcagccaccccccccatgcccaagtcagactggatccccacccgttggcctgataaaaggtgaagataaagacgaaggtccagtcgccgaacaggtaaagaaatctacactgaatcccaatgccaaggaatttaacccaaccaaacctttattaagcgtcaataagtctacttctacacctacttccccaggaccccggacccacagcaccccgtctatccccgtgcttactgccggtcagtccggcctttactctccccaatacatttcgtacattcctcagatacatatgggcccagccgttcaggcgcctcagatgtacccatatcccgtaagcaatagtgtgccaggccagcagggcaaatatcgcggggcaaagggctctttgccaccgcaacgtagcgatcagcatcaaccggcctctgccccacccatgatgcaggccgcagcagctgccggaccaccgcttgttgcagccacgccctacagctcttacattccttataaccctcagcaattcccagggcagcctgctatgatgcagcctatggcccattatccctcacagcctgtgtttgcaccaatgttgcagtctaaccccaggatgctgacgtccggatctcatcctcaggcaattgtctcatcatcaaccccacagtatccttccgctgagcagcctacaccacaggctctctatgcaacagtacaccagtcttatccacaccatgccacccagttacacgcacatcaaccacagccagccacaacacctactggctcccaaccccagagtcaacacgccgctcctagtcctgtccagcaccaggcgggtcaggctccccacctgggatctggccagccgcagcagaatttgtatcacccaggggctctgaccggcaccccccccagtctgcctcccggcccttcagcgcagtccccccaatcttcctttccacaaccggcagcggtgtacgctatacatcaccaacagctgccacatggcttcactaatatggcccacgtcactcaggcgcacgtgcagacgggcatcactgccgcaccgcctcctcatcccggcgctccccacccaccacaggtcatgttactccatccgccgcaaagccacggcggcccaccacaaggggccgtgccacaatcaggagtaccagcactgagcgcatcaactcccagcccctacccttatatcggacatccacaggcaccactccctccaccaggcgagctgaaaattgtcctggctgccacttag

SEQ ID NO: 179648 - DNA, 3294 bp, Artificial Sequence
  Description of Artificial Sequence: Synthetic coding sequence
atgctgaagccccagcccctgcagcagcccagccagccccagcagcctccacctacccagcaagctgttgccaggaggccccctggcggaaccagcccacccaatggcggactcccagggccccttgctactagcgctgccccgcccggtccgcccgcagccgcctccccatgtctaggacctgttgccgccgcaggcagcgggctgcgcaggggagcggaggggatcctcgcaccccaacccccccctccacagcaacaccaggaaaggcctggagcagccgcgatcggcagcgcgcggggccaaagtacggggaagggcccgccccagtcccctgttttcgagggtgtctacaataatagccggatgcttcatttcctgaccgcagttgtgggctccacctgtgacgtcaaggtaaaaaacggaacgacatacgaaggcatcttcaagacgctgtcgtccaagtttgagcttgctgtagacgcagttcaccggaaggcctctgaacctgcagggggccctcggcgcgaagatatcgttgacactatggtgttcaaaccgtcggacgttatgctcgtccacttccggaacgtcgattttaactatgccaccaaggataagttcacagactctgccatcgcaatgaatagcaaggtgaatggtgaacacaaggagaaagtcctccagaggtgggagggaggcgattccaatagcgacgattacgacctggaatcagatatgtctaacggttgggatccaaacgagatgtttaagttcaacgaggaaaactacggagttaaaaccacttacgattcaagcctaagctcatatactgtgcctctggagaaggataatagcgaggaatttagacagagagaattacgagccgctcagctcgctagggagatagaaagcagccctcagtatagactgcgcatcgcaatggagaacgatgacggtcgcactgaagaagaaaagcatagcgccgtgcaaaggcagggcagcggcagagagtcaccctccctcgcctctagagaaggtaagtacatacccctacctcagagagtccgggaaggcccgcgcggaggcgttcgttgttctagttctcggggaggcaggcccgggctttcaagtttaccacccagaggcccgcatcacctcgacaactcttccccaggcccaggctccgaggcccgtgggatcaatggtggacctagcagaatgtctccaaaggcccagcgtcctttaaggggagccaaaactctcagctctcccagtaaccgcccaagcggagagaccagtgtgccaccacccccagctgttggcagaatgtacccgccacggtccccgaaatcggccgctcctgcacccattagcgcaagttgccctgagccgcctattggctccgcagttcctacgagctccgcctcgattcccgttacatccagcgtctctgaccctggagtaggctccatcagcccagcatctccaaagattagtctggccccaactgatgtcaaggaacttagcacaaaggagcctggccgcaccctggaacctcaagaactggcccgtatcgctggcaaggtccccgggctgcagaatgagcagaagcgctttcaactggaggagctccgaaagtttggggcccagttcaaactccagcctagcagctctcctgaaaatagtctcgacccatttcccccacggatactcaaggaagagccaaagggcaaggagaaggaggttgacggcctattaacatccgagcctatgggttctccggtcagctcaaagactgagtcagtgagtgataaggaagacaaacccccacttgcccctagtggaggcaccgagggccctgagcagcctcctcccccgtgtccgagccagaccgggtccccccccgtaggcttaataaagggagaggacaaggatgaaggccccgtagcagagcaggtcaagaaatccactctgaaccccaatgctaaggagttcaatccaactaagcctctcctgtctgtgaataagagtacatccacccctacatctccaggcccccgcacacattccacaccgtccatccctgtgcttaccgcaggacaatcaggcctgtactcgccacagtatatcagctacataccccagatccatatgggacccgctgtccaagctcctcagatgtacccttatcccgtcagtaactctgtgccgggccaacagggaaagtaccgtggtgcgaaaggatcattaccacctcaacgatcagaccagcaccagccagcgtctgcccccccgatgatgcaggccgctgcagctgcgggacctccattagtggcagcaacgccctactcatcgtatataccctataaccctcagcagtttccaggacaacctgccatgatgcagccaatggcacattatccctctcagcctgtttttgctcctatgctgcagagtaacccacgaatgttgacttccggttcacacccacaagccatagtttcgagtagcacccctcagtatccgtcagccgagcagcctacacctcaggctttgtacgccaccgtgcaccagtcttatccccaccatgcaacacagctgcacgcccatcagccccagcccgctacgacacccacgggctcgcagccccagtcacaacacgccgcaccctcccctgttcaacaccaagcaggccaagctccacacttaggcagtggccaaccacagcaaaatctgtatcatcccggcgctctcacgggcaccccaccgtcgttacctcccggccctagtgctcagtctccccagagttcttttccacagccagcagcagtctacgcgattcatcaccagcaactgccccatggatttactaatatggcacatgtgactcaggcacacgtgcagacaggaataaccgcggcccctcctcctcaccctggagctccgcacccgccccaggtgatgcttcttcaccccccccagtcccacggcgggcccccacagggggccgtgcctcagtccggcgttccagccctgtctgcgtctactccttccccctacccctatattggacacccccagggtgagcaacccggccaagcccccggattcccggggggggcagatgacagaatcctttgccgcgtgggaagaagtcattcaaggaggaggcagggcctggcgcccggaagtgttctgtgttttccccctagctccttgagctgtgaccccgcagcacctctcccaacagcaagccctgccctgtcagatcccgactgtctcctcacgtag

SEQ ID NO: 179649 - DNA, 2679 bp, Artificial Sequence
  Description of Artificial Sequence: Synthetic coding sequence
atgagcgagcgggccgccgacgacgtgcggggcgagccccggcgggctgctgcggccgccggcggagccgccgccgcggcagcgagacaacagcagcagcagcagcagcagcaacagcctccccccccacagccccagcgccagcagcatccccccccccctccccgacgaactcgtcccgaggatggcggcccaggcgctgcctctacaagcgccgctgcaatggcaaccgtaggggagaggcgccctttgccatcccctgaggtgatgcttggccagtcttggaacttatgggtggaggcaagcaagcttccaggcaaggacggcactgagctggacgaatcgtttaaagaatttgggaagaaccgcgaggtaatggggctctgtagggaggatatgcccattttcggcttctgccctgcacacgacgatttctatttagtggtctgtaacgattgtaatcaggtggtcaagcctcaggcatttcaaagtcattatgaaagaagacattcatcctcatctaagcctccactagccgttccccccacctcagtcttctcattctttccttccctgagtaaaagcaaggggggctccgcatccggttcaaacagaagctctagcgggggcgtcttgtccgcttcaagctctagttccaagctgctgaagtcaccaaaggagaagctgcagctccgtggcaatacaagacccatgcatccaatacagcagtctcgggttccccacggccggattatgacaccaagcgtgaaagttgagaagattcacccaaagatggacggcactctgctcaagtctgctgtcggacctacttgtcccgcaaccgtgtcctcactcgtgaaacctggtctgaattgcccttcaatccctaagcctactctcccctcccctggtcagattttaaatggcaagggtctgcctgctccgccaactttagaaaagaagccggaggataactccaataacaggaagtttctgaataaaaggctgtctgaacgcgagtttgatcctgatatccactgcggagtgatcgacctggatacaaagaagccgtgtaccagaagcctaacctgcaaaacacattctctgacccagagacgcgcggtgcaggggaggcgaaagcggtttgatgtattattagctgagcacaagaacaagactagggaaaaagaacttattcggcacccagacagtcagcagcccccacagccacttagggaccctcaccccgcacctccccggacctcacaggaaccgcaccagaaccctcatggggtgatcccgtcggagtcaaagccttttgtcgcctctaagcctaagcctcacactccctcactcccacggccgcccggctgccccgcccaacagggggggtcagccccaatagatcccccaccagtgcatgagtcaccacatccacccctccctgccacagagcctgcaagccgcctgtcaagcgaagagggggagggggacgacaaagaggaatccgtggagaagctcgactgccactattccgggcatcatcctcagcctgcatctttttgtacatttggaagtcgccagataggaaggggatattacgtgtttgactccaggtggaataggctcagatgcgctttgaacctgatggttgaaaaacacctcaatgctcagctttggaagaagatccctcctgtgccctccaccacatcccctatttctacgcggatcccccacaggaccaacagcgtgcctactagccagtgcggagtctcctacctggctgcggccaccgtgagtacttcccccgttctcctttcatctacctgtatatccccaaacagtaagagcgtacctgcccatggaacaaccctcaacgcgcagcccgcagcaagtggagctatggatcctgtgtgtagcatgcagtccagacaagtaagctcaagttccagctccccttcaactcctagcggcctgtcatccgttccttcttctcccatgagcaggaagcctcagaagctcaagtcttctaaatccctccgccccaaggaatcaagcggtaactctaccaattgccagaatgcatctagcagcacatctggcgggagtggcaagaaacggaaaaactcatcaccactattggtgcattcctcaagctctagttcctcaagttcatctagcagccacagcatggaatcgtttagaaaaaactgcgtcgcccattccggacctccttaccctagcactgtgacctcatcacactccattgggctcaactgcgtgactaacaaggctaatgcagtgaacgtacgacacgaccaaagtggaagaggcccacctaccggatcaccagcagaatccattaagcggatgtccgtaatggtaaacagttccgattctaccttgtctctcggaccgttcattcatcaatccaatgaactgccagtgaactctcacgggagtttttcccactcccacacccccctcgataaactaattgggaaaaagaggaaatgcagccccagctcaagtagcatcaacaacagctcaagtaaaccaaccaaggttgcgaaagtccctgctgtcaataatgttcacatgaagcacaccggtacgattccaggggctcaggggcttatgaacagttctctactccaccagccaaaggcccgaccctag

SEQ ID NO: 179650 - DNA, 2838 bp, Artificial Sequence
  Description of Artificial Sequence: Synthetic coding sequence
atgagcgagcgggccgccgacgacgtgcggggcgagccccggcgggcagctgccgctgcaggcggcgccgcagcagccgccgccaggcagcagcagcagcagcaacaacagcaacagccccccccgccccagccccaaaggcagcagcatcctccccccccaccccgcagaacaaggcccgaggacggtggtcccggagctgcaagtacttctgccgctgcaatggcaacagtaggcgaacgccgtcctctaccaagcccagaggtaatgctcgggcagtcatggaatctgtgggtcgaggctagtaagttacccggcaaggacgggaccgaattggatgaatccttcaaggagtttggaaaaaatagagaggtgatgggactttgccgagaagacatgcctatatttgggttctgtccagctcatgatgatttctatcttgtggtgtgcaacgattgcaaccaggtcgtgaagcctcaagcgtttcagagccactatgagagaagacattcatctagctccaagccccccctggccgttccacccacgagtgttttctcattcttcccctcactgagtaagtcaaaggggggctccgcctccggctcgaatagatcctcctctggaggagtgctgtcagcctcctcctcaagcagcaagttgttgaagtcccctaaagaaaagttacagcttcgggggaatactaggcccatgcaccccatccagcagagccgtgttccacacgggaggatcatgactccctccgttaaggtagaaaaaatccatcccaagatggacggaaccttgctgaagtccgccgttgggcctacctgccctgccaccgttagctcattagtgaaacctgggctcaactgtcctagtatccccaagcctactctccctagccccgggcagatcttgaatggcaaaggtcttcccgcaccaccgacattagagaagaaacctgaggataactctaacaatagaaagtttttaaacaagcgcctaagcgagcgagagttcgatcctgatatccattgtggggtaattgatctagatacaaaaaagccatgcactcgctcactgacatgtaaaactcactctctcacacaaagaagagcagtacaggggagaagaaagcggttcgacgtgctgctcgccgaacacaaaaacaagacgcgggagaaggagttgattcgccatccagacagccaacagcctccacagcccctaagagacccccaccccgccccacccagaacgtctcaagagccccatcaaaacccgcacggcgtgatcccttccgagtcaaagcctttcgtggcctcaaagcctaaaccacacacaccttctctcccacgaccgccaggctgtccagctcagcagggcggctcagctccaattgatcctccacctgtacatgagtccccccaccctccactgcccgcgacagaaccagctagccgcctatcctccgaggagggtgagggggacgataaagaggagtcagtagagaagctcgattgccactactcaggtcatcatcctcaaccagcttctttctgcaccttcggatcacggcagatcgggagaggatactatgtgttcgattccaggtggaaccgccttcgctgtgctctgaatctcatggtcgagaaacacctcaacgcccagctatggaagaaaattcctccagtcccctctactacttcacccatctcaactagaatcccccaccgcactaactccgtaccaacttcacaatgtggggttagctatctggcagctgctacagtgagtacctcccccgtgctattgtccagtacttgcatcagtcccaattccaaatccgtgcccgcacatggtactacgttaaatgctcagcccgccgcctccggagctatggatcccgtatgcagcatgcaaagcagacaggtgagcagcagctcaagctcaccaagcacgccatcaggcctgagcagcgtaccttcaagtcctatgtccagaaagcctcagaagctcaaatcctcaaaaagcctgagacccaaggagtcgagtggaaacagcaccaattgccaaaatgctagctcatccacgagcggagggtctggaaaaaaacggaaaaactcatcacccctgctcgtgcattcgtcctcctcatcatctagctcatcgtcaagctctcactcaatggagagcttcaggaaaaattgtgtggctcatagcggccccccatacccctctactgtgacctctagccactccattgggctgaactgcgtcacaaataaggctaacgccgtaaatgtacgccatgatcagtccgggcgagggcctcctaccggaagcccggctgaatcaattaagcggatgtcagtaatggtgaacagtagtgattccaccctgagcttgggaccctttattcatcagtccaacgagctgcccgtcaactcacacggctcatttagccactcccacaccccgctcgacaaactcatcggaaaaaagaggaagtgctcaccaagtagcagttccattaacaattcctccagcaagccaactaaggtagctaaggtgccagccgttaacaatgtacatatgaaacatacaggcacaatccccggtgcacagggcctgatgaattcgagtctgctgcaccaggacattagttccccatgtctgcgcaccggcatttcagcgaccagcccacagagtcctgacctgaaatccaagggtacctccctgaccgcggagaatagcaccggcaggaataatgccgatacctttgaagataaactgcaccttcatagtgcactgtggactccccgctgtctttag

SEQ ID NO: 179651 - DNA, 81 bp, Artificial Sequence
  Description of Artificial Sequence: Synthetic coding sequence
atgagcgagcgggccgccgacgacgtgcggggcgagccccggcgggcagcggcagcggctggaggggccgccgcggcttag

SEQ ID NO: 179652 - DNA, 2679 bp, Artificial Sequence
  Description of Artificial Sequence: Synthetic coding sequence
atgagcgagcgggccgccgacgacgtgcggggcgagccccggcgggcagcggcggcggccggcggggccgccgctgctgccgcaagacagcagcaacagcagcagcagcagcagcagccccctcctccccaaccccaaaggcagcagcatccccctccgcccccacggcggaccaggcccgaagacgggggacccggggccgcaagtaccagcgcggccgccatggcgactgttggcgaaagacgccctttaccgagtcccgaggtcatgctggggcagtcttggaatctctgggtggaagctagcaaactccccgggaaggacggaactgagctcgacgagtcctttaaagaatttggtaagaatcgggaggtcatgggtctatgtcgcgaggatatgccaatcttcggtttctgcccagctcacgatgacttttatttagtggtgtgcaacgattgcaaccaagtggtcaaaccccaagccttccagagccactacgagaggcgccatagcagtagcagcaaaccccccctcgctgttcctccgacttcggtgttcagcttcttccctagtctttcaaagagtaagggtgggagcgctagcggttcaaatcgctcttcgagtggtggggttctcagcgcttcctcgtccagcagcaagctgctcaaatcaccaaaggaaaagctgcaactccgtggaaacaccaggccgatgcacccaatccagcagagtcgtgttcctcatggaagaattatgactccgtctgtgaaggtggagaagatacaccctaaaatggatggcacgctgttaaagagcgccgtcggcccaacctgtcccgccaccgtgagctctttggtgaagccaggcctcaactgcccttctattcccaagcctactttaccttcacctggccagattctgaatgggaagggcttaccagccccgcccacactggagaaaaaaccggaagataatagtaacaatagaaagttcttgaacaaaagactgtcggagcgcgagtttgacccggatattcattgtggggtgattgacctcgacaccaagaagccatgcaccaggtcattgacctgtaagacccatagcttgacacagaggcgggcagtacaaggacgcagaaaacgcttcgatgttctgcttgctgaacacaagaacaagactcgggaaaaagaactgatccgtcatcctgatagccagcagcctccacagccccttcgagatccacacccggcacctcctcgcacatcgcaagagccccatcagaacccacatggagtcataccgtcagagagcaagcccttcgtggcaagcaagcctaagccccacaccccatctctgcctaggccgcccgggtgcccagcccaacaggggggaagcgcgcccatcgatcctcctccagtccatgaatcaccacacccaccactgcccgcaacggaaccagcatctcgtctgtcttcggaggaaggcgagggcgacgacaaggaggagtctgtggagaagctggactgccattacagcggtcaccatccccagccagccagcttctgtacctttgggtctcgacagatcggaaggggttattatgtcttcgactctcgatggaacagattgcgctgtgcactgaatctcatggtggaaaagcatcttaatgctcagctctggaaaaaaatcccccctgttccatctacaacctcccctatatccaccaggatcccacataggactaattccgtgcctacctcccaatgtggtgtttcttacctggccgccgctaccgtgtcaaccagtcctgtgctgttgtcttctacatgcatatctcccaacagtaagtcagtgcctgcccacggcaccacgttgaacgcacaacctgcggcctccggcgcaatggaccccgtctgctcaatgcagagcagacaggtgtcctcatcgagcagtagcccttcgacgccgagcggcttaagtagcgtcccatctagccctatgtctcggaagccgcagaagctgaaatctagtaagagtctgaggccaaaggagagcagcgggaactcaaccaattgtcaaaacgcctcgtcgagcacctccgggggtagcggcaaaaagcgtaagaacagctctccgctgttggtgcatagttcaagctcctcatcctcctcctcctcctcctcccactctatggaatcctttcgcaaaaattgtgtagcacatagtggacctccttatccatccacggttacatcatcacacagcatcgggctcaactgcgtgaccaataaggctaatgccgttaacgtcaggcacgatcaaagcgggcgcgggccacccacgggctctccggctgaatctattaagcgcatgtccgtcatggtaaatagcagcgattctaccctgagcctgggtccttttatccaccaatctaatgagctgcctgtgaattctcatggcagctttagccacagtcacacacctcttgataaattgattgggaagaagcgcaagtgcagcccatcatcgtcttcaataaataatagcagcagtaaaccaacgaaggttgctaaggtgccagccgtaaacaatgtgcacatgaagcataccgggacaatccccggagcacaaggattaatgaattcctctcttctccatcagccaaaggctaggccatag

SEQ ID NO: 179653 - DNA, 2838 bp, Artificial Sequence
  Description of Artificial Sequence: Synthetic coding sequence
atgagcgagcgggccgccgacgacgtgcggggcgagccccggcgggccgctgccgcagccggcggggccgctgccgctgctgctcgacagcagcagcagcagcagcaacagcaacagcccccacccccccagccacagcggcagcagcatccacccccacccccaaggaggacacggcctgaggatggaggacccggggccgcgtccaccagtgcggcggctatggccaccgttggagagaggagaccactgccaagccctgaggtgatgctgggtcagagctggaacctgtgggtcgaagccagcaaactccccggaaaggacgggacagaacttgacgaatcttttaaagagtttggaaaaaatagggaggtcatgggtttatgccgcgaggatatgccaatattcggattctgtcccgcacacgacgatttttacctggtggtatgcaacgactgcaaccaggtcgtaaaaccgcaggctttccaaagccattatgaaaggaggcactcttcttctagcaaaccgcctctggctgtcccgccaacctccgtgttctctttttttccttcactcagcaagtctaagggcggtagcgcatcaggatctaacaggtcatcttccgggggtgtgctcagcgcctcctcaagcagctcaaagttgctgaagtctcctaaagagaagttacagttgcgcggaaatacacgtcccatgcaccctatccaacagtctcgagtcccgcatggaagaatcatgactccttctgtgaaagtggaaaaaattcatcctaagatggatgggactctgcttaagagcgccgtgggaccaacttgcccagccaccgtgtccagcttagtaaagcccggtctgaactgccccagtatccctaaacctacactccctagccctggccagattctgaacggcaaggggctccctgcacccccaaccttagagaagaagccggaggataatagcaacaaccggaaatttctgaacaaacgcctgtccgaacgagagttcgaccctgatatacactgtggggttattgacctagatacaaagaaaccctgtacccggtccctgacatgtaagacccattccttgactcagcgccgtgctgtgcagggccggcgaaaacgcttcgacgtccttctggccgagcataagaataaaacgagagaaaaagagctgattagacaccctgattcccagcagccaccccagcctctgagagatcctcatcccgcccctcctcgaactagccaggaaccccaccagaacccccacggcgtgatcccgtctgaaagcaagccattcgtggcttccaaaccaaagccccataccccgtccctgcctagacctccaggttgtcccgcccaacaggggggctcagcgcccatcgatccaccgccagtccatgagagccctcatccacccttaccggccactgagcccgcatcccgcctcagttcagaagagggggaaggcgacgacaaagaagagtcggtggagaaactcgactgccactattctgggcatcatccacaacccgcctccttttgcacgttcggctccagacagattggccgggggtactacgtgttcgacagtaggtggaaccgtctcagatgcgccctgaacttgatggtggagaaacacctgaatgcccaactctggaaaaaaatacccccggtacctagtacaaccagccctattagcacgaggatccctcatagaaccaactctgttcccacctcacaatgcggcgtgtcctacctggcagctgcaacagtgtcaacctctccagtgttgctgtcatctacttgcatcagtcctaacagcaagagtgtccctgcccacggaaccacgctcaacgcgcagcctgctgccagcggagccatggaccccgtgtgttccatgcagagtagacaggtctcctcatcctccagttccccatcaaccccaagtgggctgagtagtgtacctagtagccccatgtcgagaaaaccccagaagcttaagtcttcaaaatccctacgacccaaagagagctccggtaactctacgaactgtcaaaacgctagtagttccacatcaggcgggtcagggaagaagcgtaaaaacagctccccactgttagtgcactccagctctagtagctcctcctcatcctcttcctcccacagtatggagtctttccgtaaaaactgcgtggcccactccggcccgccataccctagtaccgtgaccagttcacactcaatcggcttaaattgtgtcactaacaaagcgaacgcagttaatgtgcggcacgatcaatccgggcggggacctcctaccggcagtccagcagagtcaatcaaacggatgagtgtaatggttaatagtagtgactctaccctgtctcttggtcctttcattcatcagtccaacgaacttccagtgaacagccacggctcattctcccactctcacaccccccttgataagttgattgggaagaaacggaagtgcagcccatcttcatcatccattaataactcctcctctaagcctactaaggtggctaaggtgccggctgttaacaacgtgcatatgaagcacacaggtactatcccaggggcacaggggctcatgaatagttccctcctgcatcaagatatcagcagtccctgcctccggacgggaatctccgcaacttcaccgcaatccccagatctgaagagtaagggcacctcactgacggctgagaatagcactggaaggaacaacgccgatactttcgaggacaagcttcatttgcattcggctttatggactccaaggtgcctgtag

SEQ ID NO: 179654 - DNA, 393 bp, Artificial Sequence
  Description of Artificial Sequence: Synthetic coding sequence
atgagcgagcgggccgccgacgacgtgcggggcgagccccggcgggccgcggctgcagcgggaggagccgccgcggcagcagcacgccagcagcagcaacagcagcagcagcagcaaccacccccgccgcagcctcaacgccagcagcatccgccacctcctcctcgccgtacccgtccagaagacggagggcccggggcagcctctacatccgccgcggctatggccaccgtcggagagcgcaggccgctcccgtcgcccgaggttatgctggggcaatcctggaacttgtgggttgaggcctctaagctgccagggaaggatggagacagaattggacgcaaattccagggagtgtggaatcgagaagtgatgggcctgtgtcgggagtag

SEQ ID NO: 179655 - DNA, 2244 bp, Artificial Sequence
  Description of Artificial Sequence: Synthetic coding sequence
atggagggcagcaagacccccctgcagagcagccccagcgcccaggagcttaaggcacctctagagaggcggcacagctcttccagcaagcctcccctggccgtgcctccaacaagcgtgttttccttctttccatctctgtcgaagagtaagggcggcagcgccagcggcagcaatagatcaagttcaggcggagtgctttccgcctcgagcagctcttccaaactgttgaaaagccccaaagagaagcttcagctcagagggaatactagacccatgcacccaatccagcagagtagggtgcctcatggacggatcatgacaccttctgttaaagtggaaaaaatccatccaaagatggatggtacactacttaagtccgccgtgggccccacttgtcctgcaacggtatctagcctggtgaagcctggccttaactgcccttcaattcctaagccaactctgcccagtcctgggcagatccttaacggcaaaggacttcccgccccccccactctggagaagaagccagaagataacagtaataaccggaagttcttaaacaagcgcttgtcagaaagggaatttgaccctgatattcactgtggggttattgacctcgataccaagaagccttgcactcggtctctaacatgtaagacccatagtctcactcagagacgggccgtgcaaggcagacgaaagaggttcgatgtgttactcgctgaacataagaacaagacacgtgaaaaggaattgataaggcatcccgattctcagcaacctccccagccattgagggatccccatcctgctcctccccggacctcacaagagccccatcaaaacccacacggtgtgattccttcagaatcgaaaccatttgttgcatcaaagcccaaacctcataccccaagtttacctaggcccccgggatgtcccgcccaacagggaggaagcgcccctatcgaccctcctcccgtgcacgaatcaccacatcctcctttgcccgccacagagccggcttctcggttgagttcggaagagggagagggggatgataaggaagagagtgtcgaaaagctagactgccattacagcggccatcacccccagcctgccagcttctgtacgttcgggtccagacagattgggaggggctattacgtctttgacagtcgctggaacagactgagatgcgcactgaatctcatggttgagaagcatttgaacgcccagctgtggaagaaaatcccacctgtaccatcaaccacctcaccaatttccacacgaattcctcacagaacgaatagcgtaccaactagtcagtgcggagttagctaccttgctgcagctactgtgtctactagtccagtcctattatcgtccacgtgtatctcgccgaattccaagagtgtacctgcccacggaacaacactgaatgctcagcccgccgctagcggcgccatggaccccgtctgttcaatgcagagcaggcaggtgtcaagctctagctcttctccttccacccctagcggcctatcctctgtgccctcgtctccaatgtctaggaagccacagaagctgaagtcttcaaagagtcttaggccgaaagagagcagcggcaactcaacaaattgccagaacgctagtagctccacttccggcggttccggcaagaaacgcaagaacagctctcctttactagtccatagctcttccagttcctcctccagctcttcaagcagtcatagtatggaatcttttaggaaaaactgtgtggctcatagtgggccaccatacccatcgactgttaccagttcccacagcatcggtttaaactgtgtgactaataaggccaatgccgtgaacgtgcgacatgatcagtctggacgggggcctccaactggcagtcctgctgaatccattaaaaggatgagtgtgatggttaactctagtgacagtactttgtcactgggtccctttattcaccagtccaatgagctgcctgtgaatagtcacggtagtttctcccatagccatactcccttagataagctgatcggcaagaagcgcaagtgcagccccagttcaagctcaatcaataatagttcatctaaacctactaaggtggccaaggttcccgccgtaaataatgtccacatgaagcatactggcactatccctggcgcccagggacttatgaatagtagcctgctgcaccagccaaaggccagaccatag

SEQ ID NO: 179656 - DNA, 663 bp, Artificial Sequence
  Description of Artificial Sequence: Synthetic coding sequence
atggaggaggacgagttcatcggcgagaagaccttccagcggtactgtgccgagttcatcaagcactcacagcagataggagattcctgggagtggcggccctcgaaggactgctccgatggatacatgtgtaagatccatttccagattaagaatgggtccgtgatgagtcacctgggggcaagtacacatggccagacctgcctgccaatggaagaggcgtttgagctgcccctcgacgactgtgaggttatcgagacagctgccgcatctgaggttatcaagtatgaataccatgtcctttactcatgctcttatcaggtaccagtcttgtacttccgtgcgagctttctggatggtcggcctctgactttgaaagatatttgggagggcgttcacgagtgctataagatgaggttgcttcagggaccctgggatacaatcacccagcaagaacacccaatactcggccagccattctttgtgctgcacccgtgtaagactaacgagttcatgactcccgtactgaaaaatagccaaaaaattaacaaaaacgttaattacatcacttcttggcttagtatagtcgggccagtcgttggactcaacctgccactcagctatgcaaaagccacgtctcaggacgaacggaatgtgccctag

SEQ ID NO: 179657 - DNA, 378 bp, Artificial Sequence
  Description of Artificial Sequence: Synthetic coding sequence
atggaggaggacgagttcatcggcgagaagaccttccagcggtactgtgcggaattcattaaacacagccagcagataggcgattcgtgggaatggagaccttccaaggactgctccgacggctacatgtgtaagatccatttccagatcaaaaatggttccgtgatgtcacaccttggggcttctacacatggacagacttgccttccgatggaagtcaaatcttgctcagtcacgcaggcgggcgtgcagctacgagatctgagtagccttcagccacctccatccggatttaaacagttctcctgcttgagtctcccttctaactgggattacaggggcagtcctttgcacctggcgaacttcctgtatttctag

SEQ ID NO: 179658 - DNA, 663 bp, Artificial Sequence
  Description of Artificial Sequence: Synthetic coding sequence
atggaggaggacgagttcatcggcgagaagaccttccagcggtactgcgcagaatttataaagcatagccagcagattggcgattcatgggagtggaggcctagtaaagactgttccgatggctacatgtgtaagatccatttccaaataaagaacggctctgtcatgtcccacctgggagccagtacccacgggcagacatgccttcccatggaagaagcattcgagctgcccctggacgattgcgaagtcattgagactgccgccgctagtgaagtgatcaagtacgagtaccacgttctctattcttgctcttaccaggtgcctgtcttgtattttagggcaagcttcctggacgggcggccactgactttgaaggacatttgggaaggcgtgcacgagtgttataaaatgagattgctgcagggcccatgggataccattacacagcaggaacaccctatactaggccagccattcttcgtacttcatccgtgtaaaaccaacgaatttatgactcccgtcctaaagaactcgcagaagattaataaaaatgtaaattacatcacatcatggttgagcatcgtgggtccggttgtgggattgaacctcccgctctcttatgctaaggccacatcccaggatgaacgcaatgtgccgtag

SEQ ID NO: 179659 - DNA, 882 bp, Artificial Sequence
  Description of Artificial Sequence: Synthetic coding sequence
atggaccggcgggtgaagctgtgggaggtgttcggcgagaagtgcgaattcaagggcagcttaagcggctctaatgcgggaatcacaagtatcgaattcgacagcgccggatcctatttgctcgccgcatctaatgactttgcttccagaatctggaccgtggacgactaccgactgcggcatacactcactggccacagcggaaaggtactgtccgccaaatttctgctggacaacgctaggattgtgtctgggtcccacgaccgcacactgaagctatgggatctaaggagtaaggtgtgcataaagaccgtgtttgccggcagttcctgcaatgatatcgtgtgcactgaacagtgtgttatgagcggacattttgacaagaagatacgtttttgggatatcaggtcggagtcgattgtgagagaaatggagttgctgggcaagataaccgccctcgatctgaatcccgagaggaccgaactgctatcgtgctctcgcgatgacctgcttaaagttattgacctccgcacaaacgctattaagcagacatttagcgctccagggtttaagtgtggcagcgactggacccgcgtggtttttagcccggatgggtcctatgtcgccgcaggtagtgccgagggatccctgtacatctggtccgtcctgacagggaaagtggagaaggtattatcgagttcgacagctcatcctagcatgaggtggcggggtaggcccttggcaagaacgttgtccgtgtggaccaaagacgcaaaactttgctgcggtcattccacagatggagcgctcagggctggaaggaccccagtgccctctagcgaggaagcccatggtttattgcagccatgccccgggcgctag

SEQ ID NO: 179660 - DNA, 1335 bp, Artificial Sequence
  Description of Artificial Sequence: Synthetic coding sequence
atgagcagcggcctgcgggccgccgacttcccccggtggaagcggcacatcagtgaacaactgcggaggagagaccgtttgcagaggcaagccttcgaggagatcattctccagtacaataaactgcttgaaaagagcgatctacactccgtgcttgcgcagaaacttcaggctgagaagcatgacgtgcccaacaggcatgagattcgcaggagacaagccaggctgcagaaggagctggccgaagccgctaaagaacctcttcccgttgaacaggatgacgacattgaagtcatcgtcgacgaaaccagcgatcacaccgaagagacttcaccggtcagagcaatctcacgtgcagccactaggaggtcagtctcatccttcccagtaccccaggacaatgtcgatacccaccctggcagtggtaaagaagttcgggttccagcgaccgccctgtgcgtgtttgatgcgcacgacggcgaggtgaatgcagtccagttcagcccgggatcccgtctactagctaccggaggcatggaccggcgggtaaaactgtgggaagtgtttggcgagaagtgcgaatttaaagggtcgctttcaggaagcaatgccggtattactagcatcgagtttgacagcgccggcagctatcttttagccgcctcaaacgactttgcctcaagaatatggacagtggatgattataggcttcggcacacgctaactgggcacagcggaaaggtactgagtgcaaaatttctcctagataacgccaggatcgtgtctggaagtcacgacaggactcttaaattgtgggacctcaggagcaaggtatgcattaaaacagtcttcgcaggttcatcatgcaatgacattgtgtgtacggaacagtgtgtgatgtcaggacatttcgacaaaaaaatccgattttgggacatccgctctgaaagcattgtgagagagatggaactgttgggtaaaattaccgccctggatttaaaccctgagcgaactgagctattgtcatgttctcgagatgatctcctgaaggtaattgatttaaggactaatgccataaagcaaactttcagtgcccctgggtttaagtgtggcagtgattggacaagggtggtgttttcaccggatgggtcttacgtagccgctggatctgctgaaggcagtttatatatctggtccgtgcttaccgggaaagtggagaaagttctatcaaagcagcactcttccagcatcaacgcagtggcgtggagtccctccggatcccacgtggtctccgtcgacaagggttgtaaggcagtgctgtgggcccagtactag

SEQ ID NO: 179661 - DNA, 1287 bp, Artificial Sequence
  Description of Artificial Sequence: Synthetic coding sequence
atgagcagcggcctgcgggccgccgacttcccccggtggaagcggcacatttccgaacagctcagacggagagacagacttcaaagacaggcattcgaggaaattatccttcagtacaacaaactgctcgagaagtcagatcttcactcagtcctggctcagaagctccaggccgaaaagcatgacgttccaaacaggcacgaaattaggcgacgacaagccagattgcagaaagaactcgcagaggctgccaaagaaccgctccccgttgaacaagatgatgacatagaagtgatagtggacgagacgtccgatcacactgaagagaccagccccgtgagagccattagtcgggccgccaccaaacggctgtcccagccagcaggcggtctgctggactcaataacaaacatattcgggcgaagatccgtgagttcatttcccgtgccccaggacaatgtggatactcatcccggctcaggtaaagaggtccgggtgcccgcgactgctctctgtgtgttcgatgctcatgacggcgaggtcaacgccgttcaattctcaccaggaatcaccagtatcgagttcgactctgcaggcagttaccttctagccgcctctaacgattttgcaagtcgtatctggaccgtcgatgactatcgcctgcgccacaccctgaccggccactcaggaaaggtgttgtccgctaagtttcttcttgataacgcccgcattgtgagcggttcccatgaccgaacactcaagctatgggacctgaggtccaaagtctgtataaaaactgttttcgccgggagtagctgcaatgatatcgtgtgcacggagcaatgtgtcatgagcggacactttgataagaaaattaggttctgggatatccgcagtgagtcgatcgtacgtgaaatggaactgctgggcaaaattacagcacttgaccttaatcctgagcgcactgaactgctttcttgctccagagacgatctgttaaaggtgattgatctgagaaccaacgccattaaacagacctttagcgctcctggcttcaaatgtggctccgactggacgcgagtggtattttctcccgatgggtcttacgtagccgccggctccgcggaaggctctctatatatctggtccgtgctgactgggaaggtggagaaagtgttgagcaagcagcattcgtcatctataaatgcagtggcctggtcgccctcaggctctcatgtcgtgagcgttgacaaggggtgcaaggccgtgctgtgggctcagtactag

SEQ ID NO: 179662 - DNA, 1824 bp, Artificial Sequence
  Description of Artificial Sequence: Synthetic coding sequence
atgagcagcggcctgcgggccgccgacttcccccggtggaagcggcacatatctgagcagttgagacggagggatagacttcagagacaggcattcgaagaaattatcctacaatataacaagttgctggagaagtctgacttacactccgtgctagcccagaagctgcaggctgaaaaacacgacgtgccaaataggcacgagatctccccagggcatgacggtacttggaatgacaaccaacttcaggaaatggcacagcttcgaatcaaacaccaggaggagctgacggagttgcataagaaacggggagagctggcacagctagtgatcgacctgaataatcagatgcaacggaaagatcgcgagatgcagatgaatgaagccaagatcgcagagtgtcttcagactattagtgacctggaaacagagtgcctcgacctaagaacaaaactctgtgacctggaaagggctaatcagaccctcaaggatgaatatgatgccttgcagatcacattcaccgccctggagggaaagttacggaagacgaccgaggagaaccaggaactggtgaccagatggatggccgaaaaggcgcaagaggcgaacagactgaacgccgagaatgaaaaagactctagacggagacaagcccggctgcaaaaggagctagccgaggccgccaaggaacctttacctgttgagcaggatgacgatatcgaggtgatagtagacgagacgtcagaccacacagaagaaaccagccccgttagggcaatctccagagccgctaccaagaggctttcccagcctgctggcgggctcctggattccattaccaacatttttgggagacgctccgtgagctctttccctgtgccccaagacaacgttgacacacaccccggcagtggtaaggaagtcagagtgcccgccacagcactctgtgtcttcgacgcccatgatggtgaagtgaacgcggtgcagttctcccccggaagtaggttgctggcaaccggcggaatggatcggcgcgttaagctatgggaggtctttggcgaaaagtgtgaatttaaagggagcctgtccggtagcaatgccgggatcacgtccattgaattcgactccgctgggtcttatctgctggccgcatccaatgattttgcttcccgcatctggaccgtggatgactacagactgcgacacaccctcaccggccactccggtaaggtcctcagtgcaaaattcttacttgataatgcacggatagtgagcgggtcacatgataggaccttgaagctgtgggatcttcgctccaaagtttgcattaagaccgtttttgctggttcttcttgcaatgatattgtgtgtactgagcagtgcgtgatgtctgggcatttcgacaaaaagattagattttgggacatcaggagcgaaagcattgtccgagagatggaactgctgggaaaaattaccgcacttgatttaaaccccgagcggacggagctgcttagctgctccagagacgatctcctgaaagttatcgacctacgcactaacgcaatcaagcagaccttcagcgcgcccggcttcaagtgtggatctgattggacacgcgtggtattttcccctgatggaagttacgttgctgcaggaagtgctgaagggtccctttacatttggtccgtgctgactggcaaggtggagaaggttttatctaaacagcactctagctccattaatgcagtcgcttggagtccctccgggtcgcacgtggtgagcgtggataagggctgtaaagctgtgctctgggcacagtactag

SEQ ID NO: 179663 - DNA, 1875 bp, Artificial Sequence
  Description of Artificial Sequence: Synthetic coding sequence
atgagcagcggcctgcgggccgccgacttcccccggtggaagcggcacatttccgagcagcttcgcaggcgggacagattgcagagacaagccttcgaggagatcatcctccagtataacaagctcctggagaagtccgacctccatagcgtattggcccaaaagctgcaggctgagaagcacgatgtccctaatcgccacgagatcagccccgggcacgacggaacgtggaatgataaccaactacaggagatggcgcagttacgaatcaagcaccaggaggaactgaccgagttgcacaaaaagaggggtgaactggcacagctagttatagacttgaacaatcaaatgcaaagaaaggacagagaaatgcaaatgaatgaagccaaaattgccgagtgccttcagacaatcagcgacctggagactgaatgtctggatctgaggacaaagctgtgtgatcttgagagagccaaccagacattaaaagacgagtacgatgctttacagattacctttaccgcactcgagggaaaacttagaaaaaccacagaagaaaatcaggagcttgttactcgttggatggcagagaaagcccaggaagcaaatcgcttgaacgccgaaaacgagaaagatagcagaagacggcaggccagactgcagaaggagttggctgaggcagctaaagaaccactcccagtggagcaagatgatgatattgaagttatcgttgatgaaacctccgaccacaccgaggagaccagtccggtcagagcaatctctcgggccgctacaaagcgcctgtctcagcccgccgggggactcctggacagcataactaatatcttcggcctgtccgaatcaccgcttctggggcaccattcgtcttctgacgccgccagaagacgaagtgttagttctttcccagttccccaggataatgtcgatacacacccaggctctgggaaagaggttagggtacccgctactgcactgtgtgtatttgatgcccatgacggagaagtgaacgcagtgcagttctcgcctggcagcaggttattagcgaccggcggaatggaccggagggtaaaactgtgggaagtgttcggagagaagtgcgagtttaagggatccttatccggaagcaatgccggcattacctctatcgagttcgactctgcaggcagctacctcctggcggcctctaatgacttcgccagtagaatctggaccgtggatgactataggctgaggcacactctcaccggccattcaggcaaggtcctatctgcaaaattcttgcttgataacgcccgtatcgtttctgggtcccatgatcggactctgaaattgtgggacctgcggtccaaagtttgcatcaagacagtgtttgccggctcttcctgtaacgacattgtgtgtacagaacagtgtgtgatgtctggtcacttcgacaaaaagatccgcttctgggacataaggtccgagtcaatagtgagggaaatggaactgctgggcaaaattaccgccttagacctgaatcctgagaggaccgagctgttgtcttgttccagggatgacctactcaaagttattgaccttagaactaacgccataaaacagactttcagtgctcctggttttaagtgcggcagcgactggacaagagtggtctttagtccagatggcagctatgtcgccgctggctccgcagagggctctctatatatctggagtgtactgaccgggaaggtcgaaaaggtgctgtccaagcagcatagttcttccattaacgccgtggcatggtcccccagcgggtcacacgtggtgagcgtggataaggggtgtaaggctgtgttgtgggctcaatattag

SEQ ID NO: 179664 - DNA, 1767 bp, Artificial Sequence
  Description of Artificial Sequence: Synthetic coding sequence
atgagcagcggcctgcgggccgccgacttcccccggtggaagcggcatatctccgagcagctacgcaggagggatcgcctccaacggcaggcctttgaagagattattctgcagtataataagctcctggagaagagcgatctccacagcgtgttggcgcagaagctgcaggcagaaaagcatgacgtccccaatagacacgagatctcacccggccatgatgggacgtggaatgacaatcaacttcaagagatggctcaattgagaattaagcaccaggaggaacttactgaactacacaaaaaaaggggagaacttgcgcagctggtaattgatctcaataaccaaatgcagcgcaaggacagagagatgcagatgaatgaagccaaaatcgccgaatgtttgcagactatctctgatctagagacagaatgtctggacctcaggacaaaactgtgcgacctagaaagagctaaccagacccttaaagatgaatatgatgcgctgcaaataacatttactgcgctggagggtaagctgaggaagacgaccgaggagaatcaagagctggttaccagatggatggcagagaaggctcaggaggcgaatcggctgaatgcggagaacgagaaagacagtcgccgcagacaggctagactgcaaaaggagttagccgaggcagctaaagaaccccttccggtggaacaggacgatgacattgaggttatcgtggacgagacaagtgatcacaccgaagaaactagcccagtcagagctatttcaagggctgcaactcgcagatccgtgtcttcatttccagtacctcaggataatgtagatacccatccaggctccgggaaggaggtgagggtgcctgctaccgcactctgcgtgtttgatgcacacgatggcgaggttaacgccgtgcagttctcaccaggctctcgactcctcgcgaccgggggcatggatcgccgagtgaagctttgggaggtgttcggggagaagtgcgaattcaaaggcagcctctccggctctaatgctggtatcacatcaattgagttcgactctgcaggctcttatctgctcgccgcttcaaatgatttcgcctcaagaatatggacagttgacgattatcgactccgccacacgcttactggacatagcggtaaggttctcagcgcaaagttcctgttagacaacgcaaggattgtaagtgggtcacatgacagaacattaaagttgtgggatttgaggagcaaggtgtgcatcaagacggtcttcgcaggctccagctgcaatgatattgtttgtaccgagcagtgtgtgatgtccggccactttgacaaaaagatccggttctgggatatccggtctgagagtatagtgagggagatggagctgctcggcaaaattaccgctctcgatctgaaccccgagagaaccgagctcctcagttgtagcagggacgatctgcttaaagtgatagaccttagaaccaacgccatcaagcagaccttttctgcgcccggatttaagtgcgggagcgactggactcgtgtggtcttcagccctgatggctcctacgtggccgctggatccgccgaaggctccctgtacatctggagcgtattgactggtaaagtagagaaggtgctgagtaagcagcactcttcaagtatcaacgccgtggcttggagcccgagtggttctcatgtggtgagcgtcgataagggctgtaaggccgtgctttgggcacaatattag

SEQ ID NO: 179665 - DNA, 2520 bp, Artificial Sequence
  Description of Artificial Sequence: Synthetic coding sequence
atggcccagttcgacaccgagtaccagcggctggaggccagctacagtgactcccctcccggcgaggaagatctacttgttcatgtggccgaaggctctaagtctccttggcaccacattgaaaatctagacctattttttagtagagtttataacctccatcagaaaaacggattcacgtgcatgctaataggcgagatttttgagcttatgcagttcctgttcgtggtggcgtttacaacatttctcgttagctgcgtggactatgacatccttttcgccaacaagatggtcaaccactcactccacccgaccgagccagtgaaagtcacccttcccgatgccttcctgcctgcgcaggtgtgttccgccaggatccaggagaacggttccctaatcaccatcctagtcattgccggcgtgttttggatccatcgcctgataaagtttatttacaacatatgttgttactgggagattcactcattttatctgcacgcattaagaattcctatgtcagctctcccctactgcacgtggcaggaggtacaggcccgcattgtgcagactcagaaggaacaccagatttgcattcataagcgggaactcactgagctagatatttaccatcgcattctgcgcttccaaaattacatggtggccctggtcaataaaagcctgctgcctctgagattccggttgccaggactgggggaggcagtattttttaccagaggactgaagtataacttcgaactcatattattctggggtcccggatccttgttcctgaatgaatggagtctgaaggcagaatataaaagaggtggacagagactggaactggcgcagcgacttagcaacagaatcctgtggataggcattgcgaacttcctcctctgccccctgatactgatttggcagattctttatgcttttttcagttacgcagaggtgctgaagcgagaacctggcgccttgggagccagatgctggtccctgtacgggcggtgttacttgaggcattttaacgaacttgaacatgaacttcaatctagactcaatcgcggttataaacctgcttcaaaatacatgaattgcttcctcagcccattacttacactgttggccaagaacggcgccttctttgctggctccatcctggctgttcttattgcactgactatttacgatgaggatgtcctcgctgtcgagcatgtcctcacaacagtgactttactgggcgtgacggtcaccgtctgtaggtcatttattcccgatcaacacatggtgttctgccctgagcagcttctgcgcgtcatccttgctcacattcattacatgccagatcattggcagggaaatgcccaccgctcgcaaactcgcgatgaattcgcccaactcttccagtacaaagcagtctttatactggaggagttattgtcaccgatcgtgactcctctgattctcatattctgtttacgcccacgggctcttgagattatcgattttttcagaaattttacagtcgaggtggtgggcgtcggcgatacttgttcattcgcacagatggacgtccgtcagcatgggcaccctcagtggctctccgccggacaaaccgaggctagtgtgtaccagcaagccgaggacggtaagactgagctgtctctcatgcattttgcaattacaaaccccgggtggcagcctccgcgtgagtcaactgcatttctgggctttttgaaagagcaggtccaaagggacggggccgccgcgagtttggctcagggggggttgctccctgagaatgccctgtttacatctattcagtctctccagagtgaatctgagccgctctccctgattgctaatgtggttgctggttccagctgccggggcccgccgttaccaagagatctccagggtagcagacaccgcgccgaagtcgcaagtgctcttaggtctttcagcccacttcagcccggccaggcacctacgggaagagctcacagcacaatgaccggcagcggggttgacgcccgcaccgcgagctcaggctcatccgtgtgggaaggacagttacaaagtctcgtcctgagcgaatacgcttcgactgagatgagtctgcacgccctgtatatgcaccaactacacaagcagcaagcgcaggccgaacccgagcgacatgtatggcatcggcgagaaagcgacgagtccggggaatcagcacctgacgaaggaggcgagggagcccgcgcgccccagagcatcccacggagcgccagctacccctgtgccgctccccggccaggcgcacccgagacaactgcactgcatggcggctttcagcgccgatacggagggattacagacccaggaactgtgcccagggtgcctagtcatttttcaaggctaccccttggtggttgggccgaagacgggcagagcgcctcccgccatcccgaacctgttcccgaggaggggagcgaagacgaacttccaccacaggtgcacaaggtgtag

SEQ ID NO: 179666 - DNA, 2520 bp, Artificial Sequence
  Description of Artificial Sequence: Synthetic coding sequence
atggcccagttcgacaccgagtaccagcggctggaggccagctacagtgattccccaccgggggaggaggacttgctggttcatgtggcagaaggcagcaagtccccctggcaccatatcgaaaatttagaccttttttttagtagagtttacaatctccatcagaagaacgggttcacatgcatgctcatcggcgaaatctttgaactcatgcagtttctgttcgtagtcgctttcactacatttcttgttagctgtgttgactacgatattctgtttgctaataaaatggtcaaccactcactgcaccccactgagccagtgaaagtgacccttcctgatgcctttcttccagcgcaggtgtgttctgcacggatccaggagaatggatccctcattacgatcctggttattgccggtgtgttttggatccacaggctgataaagttcatctataacatctgctgttactgggagatccactctttttatctacacgccttgcgaatacccatgtccgcccttccctattgcacttggcaggaggttcaagcacgcattgtgcagacacagaaagaacaccaaatttgcattcataagagggagctcacagaactcgacatttaccatcggatcctgcgctttcaaaactatatggtagcgctcgtgaataagtctctgctgcccctgcgcttccgtcttcccgggctcggagaagctgtgttctttactcgtgggctgaaatataattttgaactcattctgttttgggggccaggatcactctttctgaatgagtggtccttgaaggcagagtataagcggggcggtcagcggctggagctggcgcagagactgtccaataggatactgtggattggaatagcgaatttcttgttgtgcccactgatcctgatatggcagattctgtacgcctttttttcgtacgctgaagtgctgaagagagaacctggggctcttggcgccaggtgctggtcactttacggccggtgttacctccggcacttcaacgagctagaacatgaattgcagtctcggctcaatcgcggctacaaacccgcctccaagtacatgaactgttttctaagccctctgctgaccctactggctaagaacggtgccttcttcgcggggtccatacttgctgtgctgatcgcactcacaatctacgatgaggacgtacttgcagtggaacatgtgctcactaccgtgaccctccttggtgtcacagtaacagtgtgtcggagctttattcctgaccagcacatggtgttctgccctgagcagctcctaagggtgatactcgctcacattcactatatgccagaccactggcagggaaacgcgcacagaagccagactcgggacgagtttgctcagctgtttcagtacaaagcggtattcatcttggaggaactcctatctcctatcgtgaccccactgatcctcattttttgcctgcgcccccgggctctagaaattattgatttcttccggaacttcactgtcgaggtggttggcgtaggggacacctgcagcttcgcccagatggatgtaagacagcatggacatcctcagtggctctctgccggtcagaccgaggcctcggtttatcagcaagctgaggatgggaaaactgaactttccctcatgcactttgcaatcaccaatcccggatggcagcctcctcgcgagtccaccgcttttctcggcttcctcaaggagcaggtgcagcgggatggcgctgccgccagcttggctcagggagggctgctgccagaaaatgctctgttcacctccatccagagcttacagagtgagagtgagccgttgtcattgatagctaacgtggtggcaggcagtagttgccgcggccccccgctacccagagaccttcagggatctagacacagggctgaggtcgcctccgcactgcgcagcttttcccccctgcaaccaggccaggcacctacaggtcgggcccacagtactatgacgggttcaggagtggacgccaggaccgcctctagcggcagcagtgtctgggagggacagctgcagtctttggttttatcagagtatgcctctacggagatgagtttgcacgctctttatatgcatcaattacacaagcaacaggcgcaggccgagcccgaaagacacgtgtggcataggcgggaaagcgacgaaagtggggagtccgcaccggatgaggggggggaaggggcaagagctccacagtctatccccagatcggccagctacccctgcgcagcacctaggcctggcgctcctgagacaactgcattgcacggcggtttccaacggcgctatggcggtatcactgatccgggcacagtgcctcgggtcccttctcacttctccagactgccactgggcggatgggccgaagatgggcagagcgcttcccggcatcccgaaccagttcccgaggaaggatcagaagacgagttgcctccccaggtccataaggtatag

SEQ ID NO: 179667 - DNA, 2337 bp, Artificial Sequence
  Description of Artificial Sequence: Synthetic coding sequence
atgctgatcggcgagatcttcgagctgatgcagttcctgttcgtggttgccttcactacgtttctagtctcttgcgtcgattatgacatactgttcgccaataagatggtaaaccactcccttcacccaactgaaccggtgaaggtaaccttgcccgacgcattcctgcctgctcaggtctgctcagctagaatccaagaaaatgggagtttaatcacaattctggtcatagcgggcgtgttttggatccataggctcattaagtttatatacaatatttgctgttactgggagatccactccttctacttgcacgcgctcaggattccgatgtctgcgcttccctactgtacttggcaagaggtgcaggcccgcattgtgcagactcagaaggagcaccagatatgtatccacaaaagagagcttaccgagttagatatctaccatcgcatccttagatttcagaactatatggttgcgctggtaaacaagtctcttctgcccttgcgcttccgcctccctggactcggggaagctgtcttttttaccagagggctcaagtacaacttcgaactgatcctgttttggggccccggatcgctgttcctaaacgagtggagcctgaaagctgagtacaagcgaggaggccagaggttggaactggctcagcggctctccaatcggattctttggataggtatcgcaaacttcctcctgtgcccactgattctcatttggcagattttgtatgccttcttctcctacgctgaggtcctaaagcgcgaaccgggcgcgctcggcgccaggtgctggtccctatacggaaggtgctacctgagacattttaacgaactcgagcacgagctgcagagtcgcctgaatcgcggctataagcccgcgagcaagtacatgaactgtttcttaagccctctgctgactcttctcgctaaaaatggggcattcttcgccgggtcgattttggctgtgctgatcgcattaaccatttatgatgaggacgtcctggcagtggaacacgtgttaaccacagtaacccttttgggcgtcacggttacagtatgtcgaagtttcattcctgaccaacatatggtattctgccccgagcaacttctccgggtgattcttgcacacattcattatatgcccgaccactggcagggaaacgctcaccggtcacagactcgcgacgagtttgctcagctgtttcagtataaggccgttttcatcttagaagagctgttgtcacctattgtaaccccgctgatactgattttttgtctccgacctcgagccctggagataattgatttctttcgcaatttcactgtcgaagtagtcggcgtgggtgatacttgctctttcgctcagatggacgtcagacagcacggtcacccacagtggctatctgcaggtcagaccgaggcgtcagtatatcagcaagctgaagatggcaagacagaactttcgttaatgcatttcgcgattacgaaccccgggtggcagccccccagggaaagcacagcgtttctgggttttctgaaggaacaggttcagcgggatggcgctgcagccagcttggcacagggaggactgcttcctgagaacgcattgttcacttccatccagtcgttacagtcggaatcagagccattgtccctgattgccaatgtggtcgctggatcatcgtgtaggggccctcctctgccccgcgacctgcaggggagcagacatcgggcagaggtcgctagtgccttgagatccttttccccactccaacccggccaggcccccacgggccgggcgcacagtacgatgactggctctggggttgatgcccgcactgctagcagcgggtcttctgtctgggagggacagcttcagagcctagtactatctgagtatgcttcaacagagatgtccttgcatgccttatacatgcatcagcttcataagcaacaagcccaggccgagcctgagaggcacgtgtggcatagaagagagtcagatgaaagcggcgagtcagcccctgatgaagggggggagggcgccagggccccacagtccatccctcgcagcgcctcttatccatgcgctgcccctcgaccaggtgcaccagaaaccaccgctttacatgggggattccagagaagatacggtggtattactgatcctggcacagtgccaagagtgcccagccatttttcaagactgccactgggtgggtgggcagaggacggtcagagcgcaagtagacatccagaacccgtgcctgaggagggcagtgaagacgaactgcccccccaagtccataaagtatag

SEQ ID NO: 179668 - DNA, 2520 bp, Artificial Sequence
  Description of Artificial Sequence: Synthetic coding sequence
atggcccagttcgacaccgagtaccagcggctggaggccagctactcagactctcctccaggcgaggaggacttgcttgtgcacgtagctgaaggctccaaaagcccctggcaccacatcgagaatttagacctgttcttctcacgggtttataacctgcatcagaaaaatggcttcacctgtatgctcatcggcgagatcttcgagctgatgcagtttctgtttgtggtggccttcacgacatttctcgtgtcctgcgtcgactacgatatcctgttcgccaacaaaatggttaaccacagtctgcacccaacagaacctgtcaaagtgaccctaccagatgcttttcttcctgcacaggtgtgttcggccaggatacaagagaatggttctctgataacaattctggttatcgccggagtgttctggatccacaggcttatcaagttcatctacaatatctgctgctactgggagatccattcattttacctccacgccctgcgcattccaatgtcagctctgccttattgcacatggcaggaagtgcaggcccggatcgtgcaaactcagaaggagcaccaaatctgcatacacaagcgagagctgacggaattagacatctaccaccggatcctgcggttccagaactacatggttgctttagtcaataagagtttgctaccactgcgtttccgactgcctggcctgggggaggctgtgttttttacacggggtctcaagtacaattttgaattaatacttttttggggacccggcagtctgtttctgaatgaatggagtctaaaggctgagtataaaaggggtggacagcggctcgaattggcccaacggttgtctaaccgcattctctggataggcatcgctaattttttgctctgtccactcattttgatttggcagattttgtacgcattcttcagctatgctgaagtcctgaagcgagaacccggggctttaggggctagatgctggtccctgtatggccgttgctatctccgccacttcaacgaactggagcacgagctccagagcagattgaatcggggctacaagcctgccagtaaatacatgaattgttttttatccccgctcctgacactgctcgcaaagaacggggcgtttttcgcaggatcaatcttagccgtactaattgccctgacaatctacgacgaggatgtgctggcagttgaacacgtgctgactactgtgacacttttgggagtcactgtgacagtatgccggtcctttattccggaccagcacatggtgttttgtcccgaacagctgctccgcgttatcctcgcgcatattcactacatgccagaccactggcaggggaatgcccaccgtagccagactcgcgatgagtttgctcaactcttccagtataaagccgtcttcatcctcgaggagttactctctcccattgttacacctctaatattaattttttgcctaaggcctcgcgccctagagataatcgatttttttcgcaatttcactgtcgaagtggtgggggtgggtgacacttgctcttttgctcaaatggatgtgcgacagcatggccacccacagtggctttccgcaggacagactgaagccagcgtctaccaacaggcagaggacgggaagaccgagctctcactgatgcactttgcaatcacaaatccgggatggcagccccctagagagtccactgcttttcttggctttttgaaagagcaagtgcaaagggatggcgccgcggcaagcctggctcagggcggtctgctccctgagaatgcactcttcacttccattcagagcctgcagtccgagagcgaaccccttagtttgatagcgaatgtagtcgcgggctctagttgccgcggtccacctctgccacgggacctgcaaggttcaaggcaccgcgccgaagtggcatctgcacttcgaagcttctcccccttgcagcccggccaagccccaaccggtcgcgcgcatagcacaatgaccggctcaggcgtcgatgctaggacagcgagctccggatcctctgtgtgggaaggacagttgcaatcgctggtgctgagcgaatacgcatctaccgagatgagcctccacgctctgtacatgcaccagctgcataaacagcaggcccaagctgagccggaacgccacgtctggcatcggagggagagcgatgagagtggcgaatccgcgcctgatgagggcggcgagggggcccgggcacctcagagcattccccggtccgctagctacccctgcgctgcaccaagacccggcgcccctgaaactactgccctgcacggggggtttcagcgaagatacggtggtattaccgatcccggcacggtgccaagggtcccaagtcacttctccagacttcccctcggcgggtgggctgaggacgggcagtctgctagtaggcatcctgaaccagtgcctgaggagggcagtgaggacgaattgcccccccaagtgcacaaggtgtag

SEQ ID NO: 179669 - DNA, 510 bp, Artificial Sequence
  Description of Artificial Sequence: Synthetic coding sequence
atggcccagttcgacaccgagtaccagcggctggaggccagctacagcgattcaccccccggagaggaggatctgctagtccacgttgctgaaggctctaagtcaccctggcatcacatcgagaacctggaccttttcttttcccgagtgtacaaccttcaccagaaaaatggattcacatgtatgcttatcggcgagattttcgagctgatgcagtttttattcgttgtcgccttcactactttcctagtgagttgcgtcgactatgatattctcttcgcgaataaaatggtcaatcacagccttcacccaactgagccggtaaaagtgactctgcccgatgcatttcttcccgctcaggtgtgttctgctaggattcaggaaaacggaagtctgatcacaattctcgttatcgccggggtgttctggattcacaggctgattaagttcatctataatatttgttgttattgggaaatccactccttctatcttcacgcactcagatag

SEQ ID NO: 179670 - DNA, 435 bp, Artificial Sequence
  Description of Artificial Sequence: Synthetic coding sequence
atggcccagttcgacaccgagtaccagcggctggaggccagctactcagattcccctcctggcgaggaagacctgctcgtgcacgtcgccgaagggagcaaaagtccatggcaccacatagaaaatctggacttgttcttctctagggtctacaacctgcaccagaagaacggattcacctgcatgcttattggcgaaattttcgagctaatgcagtttctcttcgtcgtggcatttaccactttcctggtgtcctgcgtcgattatgacatcttgtttgccaacaagatggtgaatcatagtctccaccctaccgagcccgttaaggtaaccctccctgacgcattcctgcctgcacaggtgtgcagtgctaggatccaggagaacgggagcctcatcacaattttagtgatagccggcgtgttttggatctag

SEQ ID NO: 179671 - DNA, 282 bp, Artificial Sequence
  Description of Artificial Sequence: Synthetic coding sequence
atggcccagttcgacaccgagtaccagcggctggaggccagctacagcgactcccctcctggagaggaagatcttctcgtgcatgttgctgagggtagtaaatcaccatggcaccacatagaaaacctggatctgtttttctctagggtgtataatcttcaccaaaagaacggattcacctgtatgctcataggagaaatctttgaacttatgcaatttttgttcgtggtcgcattcacaacatttctggtctcgtgcgtggattacgacattctcttctag

SEQ ID NO: 179672 - DNA, 567 bp, Artificial Sequence
  Description of Artificial Sequence: Synthetic coding sequence
atggcccagttcgacaccgagtaccagcggctggaggccagctacagcgatagtccgccaggcgaagaggatctgctcgttcacgtggccgagggtagtaagagcccgtggcatcacattgaaaatctcgatctgtttttctcgcgggtgtataacctgcatcagaaaaatggtttcacttgcatgcttattggcgaaatcttcgagttaatgcagtttctctttgtggtggcgtttacaacctttctggtgagttgtgtggactacgacattctgttcgccaacaaaatggtgaaccactcactccaccccacggagccggtgaaagtaaccctgccagatgcgtttctccccgcccaggtatgcagtgcccggatacaagaaaacggtagtctgataactattctggtgattgccggagttttctggattcaccggctcattaagtttatctacaacatctgttgttattgggaaatacatagcttctacctgcacgctctgagaatccccatgagcgctttgccctactgcacgtggcaggaagtgcaggcaaggattgtgtag

SEQ ID NO: 179673 - DNA, 396 bp, Artificial Sequence
  Description of Artificial Sequence: Synthetic coding sequence
atggcccagttcgacaccgagtaccagcggctggaggccagctacagcgactcccctcccggtgaggaagacctcctggtgcatgtggcggagggcagtaagtctccttggcaccatatcgagaatctggacttattcttctctcgagtttacaatctccatcagaaaaacgggtttacctgcatgctgattggcgagatatttgaattgatgcagttcttgtttgtggtcgcattcacaacctttctggtatcgtgcgttgactatgacattttgtttgcaaataagatggtgaaccatagtctgcatccgaccgagccggtgaaagtcaccttgccggacgctttcctacctgcccaggtgtgcagcgcccggatacaggaaaacggatcctag

SEQ ID NO: 179674 - DNA, 294 bp, Artificial Sequence
  Description of Artificial Sequence: Synthetic coding sequence
atggcccagttcgacaccgagtaccagcggctggaggccagctacagtgactctccccctggcgaagaggaccttctggtgcatgtcgccgagggctctaagagcccctggcatcacatcgagaacctggatttattcttcagccgcgtatacaacctgcaccagaaaaacggctttacttgtatgctcataggcgagatttttgaactgatgcagttcctgtttgtcgtcgctttcacaacattcctcgttagctgcgtcgactacgacatcttgttcgccaacaaaatgtag

SEQ ID NO: 179675 - DNA, 519 bp, Artificial Sequence
  Description of Artificial Sequence: Synthetic coding sequence
atggcccagttcgacaccgagtaccagcggctggaggccagctactcagactcgccgccgggcgaagaggatctgctcgtacacgtcgctgaggggagcaaaagcccttggcatcacatagaaaatctcgatctgttcttcagccgggtgtataatctccaccagaagaatgggttcacatgcatgctcatcggggaaatttttgagctgatgcagtttttgttcgtcgtcgctttcaccaccttcctcgtgtcctgcgtcgattacgacatcctgttcgctaataagatggttaaccactccctgcaccccactgagcctgtgaaggtcaccttgccagacgcttttctgcccgcccaggtttgttcagcccgaatccaggaaaacggttccttgataacgatactggtgattgccggtgtcttctggattcaccgtctgattaagttcatttataacatatgctgctattgggagatccactctttctaccttcatgctctgagaattccgatgtag

SEQ ID NO: 179676 - DNA, 1662 bp, Artificial Sequence
  Description of Artificial Sequence: Synthetic coding sequence
atggccaagaaccggcgggaccggaacagctggggcggcttcagcgaaaagacatacgagtggagctccgaagaggaagaacccgtaaaaaaagcaggccccgtccaggtgttgattgtcaaagacgatcactccttcgagcttgatgagaccgccttgaacagaatccttctgtctgaagcagtcagggacaaagaggtggtggcggtctcagtcgctggcgcttttagaaaagggaagagctttttgatggatttcatgctgcggtacatgtacaaccaggaatccgttgactgggtgggggattataacgagccactaacagggttctcctggaggggcggatctgaaagagaaaccacaggcattcaaatctggtccgagatttttctcataaacaaaccagatggaaaaaaagtggccgtgttgctgatggatacccaaggtactttcgacagccagtccacattgagggactctgcgaccgtcttcgcactttccaccatgatctctagcatccaggtgtataacctgtcgcagaacgtgcaggaggatgaccttcagcacctgcagttgtttaccgaatacgggcggctggctatggaggagacgttcctgaagcccttccagtcgctgatctttctcgtgagggattggagtttcccttacgaattttcttacggcgcagatgggggcgccaagttcctggagaagagactgaaggtctcggggaatcagcatgaagagcttcaaaacgtgcgaaagcacatccattcatgcttcaccaacatcagctgcttccttctgccgcaccccggattgaaagttgccaccaaccccaacttcgacgggaagcttaaagagattgatgatgagttcatcaagaacctgaagattctaataccctggctattaagcccggagagtctagacatcaaggaaatcaatgggaacaagattacgtgtcgaggactagtggagtactttaaagcgtatattaaaatctatcaaggagaagagcttcctcatccaaagtcaatgcttcaggcaactgcagaagctaataatttagcagccgtcgctactgccaaggatacctacaacaaaaagatggaggagatctgtgggggggacaagccttttcttgctcccaacgatctacaaacaaaacaccttcaactgaaggaagaatccgtcaaactcttccgcggcgtcaaaaagatgggcggcgaagaattttctcgccggtacttacagcagctggaaagcgaaatcgatgaactgtacattcagtacataaaacacaacgattccaagaatattttccacgccgctcggactcctgcaaccttgtttgtagtgatcttcatcacatacgtcatcgcaggcgtgactgggttcataggcctggacataatcgcatcactgtgcaatatgattatgggactcacgctgatcactctgtgtacgtgggcctacatcagatactcgggggaatatagagagctcggggccgttatagatcaggtagctgcggccctgtgggaccaggcattgtataaactctactccgccgcagccacacaccgccacctttaccaccaggcttttcccacccctaagtcggaaagtaccgaacaatccgaaaaaaagaagatgtag

SEQ ID NO: 179677 - DNA, 1677 bp, Artificial Sequence
  Description of Artificial Sequence: Synthetic coding sequence
atggccaagaaccggcgggaccggaacagctggggcggcttcagcgagaaaacttacgaatggtctagcgaggaggaagaaccagtgaaaaaggccggccccgtccaggtcttgatcgtgaaggacgaccactctttcgagctggatgaaacagccctgaatcggatcctccttagtgaggccgtgcgtgacaaggaagtcgtagcagttagtgtggcaggggccttccgaaagggaaagagtttcctgatggacttcatgttacggtacatgtacaatcaggagtccgtcgactgggtgggtgattacaatgagcccctaacagggttttcttggaggggcggctccgaacgcgagaccaccgggattcaaatttggagcgagatcttcttgatcaataagcctgacggtaagaaagtggccgttcttctcatggacactcagggcacgttcgactctcagtcaaccctgcgggactccgctactgtgtttgcccttagcactatgatttcatccatccaagtttacaacctgagccagaatgtccaggaagatgacctgcagcatctgcaactgtttacagaatatgggcggttggcaatggaagagacctttctgaagccctttcagagcctcatatttctcgtcagggattggtccttcccgtacgagttcagctacggtgctgatggaggtgccaagttcctagaaaaacgactgaaggtatctgggaaccagcacgaggaactgcagaatgtgaggaaacacattcacagttgtttcaccaacatatcttgttttctgctccctcaccctgggctgaaggtggccaccaatcccaactttgatggtaagctgaaagaaattgatgatgagtttattaaaaacctgaagatcctgataccctggctgttaagtccagagtccctggatattaaagagataaatggcaacaagattacctgccgagggctagtggaatacttcaaggcttatattaaaatctatcagggagaggaactcccccatccgaagagtatgcttcaggctacagcagaggccaataatctagctgcagtggcgaccgccaaggacacctacaacaagaagatggaggaaatttgcggaggggacaaaccctttctggcaccaaacgatctgcaaaccaagcatcttcagctcaaagaggagtctgtgaaactgttccgcggtgtcaagaaaatgggcggagaggagttctctcgacggtatctgcaacagctggagagtgagattgatgagctctacattcagtacatcaagcacaatgacagcaaaaatatctttcacgccgctagaactcctgcgacgttgtttgttgtcatcttcatcacttatgtgatcgccggcgttacaggattcataggtctggatattatcgcatcactgtgtaacatgataatgggccttaccctgatcactctctgcacctgggcttatattcgctattctggggaatatcgagagttgggggccgtgattgaccaggtggcagccgccttgtgggatcagggaccaagtcatcaggccctgtataagctctactccgccgcagccacccatcgccatctgtatcaccaagctttccccacgcccaagtctgaatccaccgaacagagcgagaagaagaagatgtag

SEQ ID NO: 179678 - DNA, 1677 bp, Artificial Sequence
  Description of Artificial Sequence: Synthetic coding sequence
atggccaagaaccggcgggaccggaacagctggggcggcttcagcgagaaaacctatgaatggtcaagtgaagaggaggaacccgttaaaaaagccggccctgttcaagtcctgatcgtcaaggacgatcattcttttgagctggatgagaccgcactcaatcgcatcctgctttccgaagcagtgcgcgataaggaagtcgtcgctgtgagcgtggctggtgcgttccgaaaggggaagagttttcttatggatttcatgctgagatatatgtacaatcaagagagcgtggactgggtgggggattacaatgagcccctgaccggattctcctggagaggtggatccgagagggagactacagggatccagatttggagcgaaattttccttatcaacaagccagatgggaaaaaagtggcagtgctgctaatggacacacagggaacttttgattctcaaagcactctgcgggattccgccactgtctttgcactgtcgactatgatcagctccattcaagtgtataacttgagccagaacgtccaagaggatgacttgcagcatcttcagctcttcacagaatacggaagactggccatggaggaaaccttcctgaagccgtttcaaagcctgatatttctcgtgcgggactggtccttcccatacgagttcagctatggcgccgatggaggtgcaaagtttctggagaagcgcctgaaagtttcgggcaaccaacacgaggaactacaaaacgtgagaaagcacatccactcttgtttcaccaatatctcgtgttttttgctgccacacccaggcctgaaagtggctacaaatcccaactttgacgggaagctcaaggaaatcgatgatgagtttattaagaatctaaaaattctgatcccatggctcctatcccccgaaagcctagacattaaggagattaatggaaacaagattacttgtagagggcttgtggagtactttaaagcttacatcaagatctaccagggagaggaattgccccatcccaaatcaatgctgcaggccacagctgaagctaacaatctggccgccgtcgccacggcaaaagacacctacaacaagaaaatggaggaaatctgcggtggagacaagcccttccttgcaccgaacgatttgcagaccaaacacctgcagctgaaggaagaaagcgttaaactctttcgtggcgtaaagaagatgggcggcgaggagttctcacgaaggtacctgcagcagttagaaagcgaaattgacgagttgtacatccagtatatcaaacataacgacagcaagaacatctttcacgcggcgcggacaccagccacattattcgtggtcatttttatcacttacgtgattgcaggggtgacgggatttatcggtctagatatcattgcttccctttgcaacatgatcatgggcctgaccttaatcaccctgtgtacatgggcttacattcgctacagtggtgaatatcgggagctgggcgcagtaatcgaccaggtggctgccgccctctgggatcagggttccacgaatgaagcattgtacaagctttacagtgctgccgcgacccaccgccacctttaccatcaggccttccccacccccaagtcagaatccacagagcagtctgaaaaaaagaagatgtag

SEQ ID NO: 179679 - DNA, 1662 bp, Artificial Sequence
  Description of Artificial Sequence: Synthetic coding sequence
atggccaagaaccggcgggaccggaacagctggggcggcttcagcgaaaaaacctacgagtggagctctgaggaggaggagcccgttaaaaaggcgggcccagtgcaggtgctgattgtgaaagatgatcacagcttcgagctggacgagaccgccctgaatcgcatcctactgtctgaagcagtgagagataaggaggttgttgcggtgagtgtggccggggcatttaggaaggggaagtcgtttttgatggatttcatgctgaggtatatgtataaccaagaatcagtagactgggtaggcgattataacgaacctctcaccggattcagctggagaggaggaagtgaacgagagaccacaggaattcagatatggagcgaaatattcctgattaataaacctgatggcaagaaagttgcagtgctcctaatggacacccagggcacatttgattcccagtctactcttcgcgactccgccactgtgtttgcactatcgactatgatcagtagtatacaggtttataacctctcccagaacgtgcaggaagatgatcttcagcacctgcagctgtttactgaatacgggcgactggcaatggaagaaacctttctgaaaccctttcagagtttgattttcctcgtgcgggactggagctttccatacgagttcagctatggcgccgatgggggggccaagtttcttgagaagcgcctcaaggtctccggaaatcagcatgaagagctacagaacgtgcgtaagcatatccacagttgttttacgaacataagctgtttcctgttgccccacccgggcctgaaggttgcaactaacccaaattttgatggcaaacttaaggaaatagacgacgaattcatcaaaaaccttaagatccttattccttggctattatcacccgaaagtttagatattaaggagattaacgggaacaagataacctgtagaggcctggtcgagtattttaaagcctatatcaagatttatcagggggaagaactgccccatcccaagagtatgctacaagcgacagccgaggcaaacaacctagctgccgtggcaacagcgaaagacacctataacaagaaaatggaggagatttgcggcggtgataagccattccttgcccctaatgacctccagacgaaacacttgcagttgaaagaggagtcagtaaagttgttccgcggggtgaagaaaatgggtggtgaagaatttagtagacggtacctacagcagctggaaagcgagatcgatgaactttacatacaatacattaaacacaacgatagcaagaacatatttcatgccgccagaacacctgccaccctgttcgtggtgatcttcatcacgtacgtcatagctggggtcaccgggttcatcggcctggacatcattgcctccctgtgcaacatgattatgggactaacgctgattacactgtgcacatgggcatatattaggtattcaggcgagtaccgcgaactgggggccgtcatagaccaggtagctgcagccttgtgggaccaggccctgtacaagctatacagcgcagcagccacacaccggcatctgtaccaccaggcctttcccactcctaaaagcgagagcaccgaacagtcagagaagaagaagatgtag

SEQ ID NO: 179680 - DNA, 90 bp, Artificial Sequence
  Description of Artificial Sequence: Synthetic coding sequence
atggccaagaaccggcgggaccggaacagctggggcggcttcagcgaaaagacctacgaatggtcctcagaggaagaggaaccggtgtag

SEQ ID NO: 179681 - DNA, 303 bp, Artificial Sequence
  Description of Artificial Sequence: Synthetic coding sequence
atggccaagaaccggcgggaccggaacagctggggcggcttcagcgagaaaacctacgaatggtcatctgaggaagaagaaccagtgaagaaggctggacctgtccaggttctgatagtcaaggacgaccacagctttgagctcgatgaaaccgcacttaaccgtattctcctgtctgaggccgtgcgcgacaaggaagtggtggcagtgtccgttgctggagctttccggaagggcaagtcgttcttgatggacttcatgcttcggtacatgtacaaccaggagtccgtggattgggtatag

SEQ ID NO: 179682 - DNA, 1701 bp, Artificial Sequence
  Description of Artificial Sequence: Synthetic coding sequence
atggtgctgaagaagggcatcaagttcttccagcggctgatcaactctaaatccctgaggtttggtgaaaattatgaggacgacgacctggtgaattccgacgaggtgatgaagaagccgtgcccggtacagatcgtgcttgcccacgaagatgatcacaatttcgagctggatgaagaagccttagaacagattttactccaggaacacatcagagatcttaacattgtagtggtgtccgtagcaggcgcatttcggaagggtaaatcctttctcctcgatttcatgctccgttatatgtacaataaggacagccagtcctggattgggggcaacaatgaacccctgaccgggttcacatggcgcgggggatgtgagagagagacgacaggcattcaagtatggaatgaagtgttcgtgatcgatcgtccaaacgggactaaagttgcggtactgcttatggacacccagggcgcctttgattcacagtcgaccatcaaagattgtgctacggtgttcgcgctaagcactatgacctctagcgtccaggtatacaatcttagtcagaacattcaagaggacgatttacagcacctccaactgtttaccgagtacggtcggctggcaatggaagagatttatcaaaaaccgtttcaaacacttatgttcctgattcgggattggtcttatccgtatgagcactcgtatggactggagggcggcaaacagttcctcgagaaaagactgcaagtgaagcagaaccaacacgaggagttacagaatgtgcgcaagcacatacacaactgtttctccaatttgggatgctttcttctgcctcaccccggcctgaaggtagctactaatccctccttcgatgggagattgaaagacatcgacgaggactttaagcgagaacttaggaatttagttcccctgctcctggcacccgaaaacctggtcgaaaaagagatctccggaagcaaggtgacctgtagagacttagtggagtacttcaaagcatacataaaaatctaccagggagaagaactgcctcatccgaaatcgatgctgcaggccacggccgaagccaataatttggcagccgtggcaggagcccgagacacctactgcaaaagcatggagcaagtgtgcggtggagataagccttacatcgccccctcggacctggaacgcaaacacctcgatctaaaggaagtcgcaatcaaacagttcaggtcagtgaagaagatgggtggcgatgagttctgccggcgctatcaagatcagctggaagccgaaatagaagaaacctacgccaatttcatcaagcataatgacggtaaaaacatcttttacgctgccagaactcctgcgactctgtttgcagtgatgttcgctatgtatatcatctccgggctgacaggtttcataggcttaaattcaatcgcagtcctatgcaatctcgttatgggcctcgctctgatttttttgtgcacctgggcctacgtcaagtactcaggtgaatttcgggaaatcggtactgtcatcgatcagattgcagagacgttgtgggagcagcggagtcctaggaaagttttcagcaagcttttcgaggtcacccggagaaggatggttcacagggccttaagttctgcacagagacagaggctgtcaagtaacaataacaagaaaaagaattag

SEQ ID NO: 179683 - DNA, 1752 bp, Artificial Sequence
  Description of Artificial Sequence: Synthetic coding sequence
atggccgagggcgacgaggccgcccggggccagcagccccaccagggactgtggagacgtagacgaaccagcgacccttccgccgcagtgaatcatgtgagtagcactacatccttaggcgagaactatgaggacgatgatctggtaaattccgatgaagtcatgaagaaaccctgtcccgtccagattgttctggctcacgaggatgatcataattttgagctggatgaggaagccctggaacagatcctgttgcaggaacacatcagggacctcaatatcgttgtggtctctgttgctggcgccttcagaaaaggcaagtccttcctgcttgatttcatgctgaggtacatgtataataaagattcccagtcttggatcggaggcaacaacgagcccctcacaggattcacctggcgcggtggatgcgagcgcgagactaccggtatccaggtatggaatgaagtgtttgtgatcgacagacccaacggtacaaaggtggccgtgctgctgatggacacacagggtgcgtttgattcccagagtacgattaaagactgtgccacagttttcgcccttagtaccatgaccagttccgtgcaggtgtataacctgagccagaatattcaagaagatgacctacaacatctgcaactattcactgagtacggcaggctggctatggaggagatttatcaaaagccctttcagacactaatgtttttgattcgtgattggtcatatccctatgagcacagctacggcctggagggagggaaacagttcctggaaaaacgtctccaggtcaaacagaatcaacacgaagagttgcagaatgttaggaagcatattcacaactgtttttccaatttagggtgttttctcctgccccacccaggcctgaaagtagccaccaaccccagtttcgacggtcggctgaaagacatcgatgaggactttaaaagagagcttaggaatctagttccgctgctactcgctcctgaaaatctcgtagagaaagagatcagcgggtcgaaggtgacctgcagggacctggtggagtacttcaaggcatatattaagatatatcagggtgaagaactcccacacccgaaatccatgctgcaggcaaccgctgaggccaacaatctagcagccgtggcgggagctcgggacacatactgcaagagtatggaacaggtgtgcggcggcgacaagccttacatcgctccctccgacctggagaggaagcacctagacctcaaggaggttgctattaaacagttcaggtccgtgaagaaaatggggggcgatgagttctgcaggcggtatcaagatcagttggaggcagagatcgaggagacatatgccaatttcatcaaacacaatgacggtaagaatatcttctacgcagctagaacacccgccactctgttcgccgtgatgttcgccatgtatattatctctggtctgactggctttattgggttgaatagtatagccgtcctgtgtaacctagtaatgggattggctctaatatttctgtgtacatgggcatatgtgaaatacagtggggaatttcgagagattggaacagtgatcgaccagatcgccgaaacactctgggaacaagtgctgaaaccactcggtgacaatctgatggaggagaacatccgacagtctgtcactaactctataaaggcagggctgactgatcaggtgagccatcacgctcgccttaaaacagactag

SEQ ID NO: 179684 - DNA, 1239 bp, Artificial Sequence
  Description of Artificial Sequence: Synthetic coding sequence
atggacacccagggcgccttcgacagccagagcaccatcaaggactgtgccacggtcttcgctctgtctactatgacctcctctgtccaggtgtacaatctctcacaaaacatccaggaagatgatcttcagcacctgcagctctttacagaatatggtcgcctggccatggaggaaatttatcagaagccattccagactttaatgttcttaataagagattggtcgtacccctacgagcacagctacggactcgagggcggcaagcaattcctcgagaagcgcttgcaggttaagcagaaccaacatgaagaacttcagaacgtgcggaaacatattcacaattgcttctccaatctcggctgcttcctccttccccatccaggtctgaaggtcgcgacaaatccttcgttcgacggcagactcaaagatattgatgaggactttaagagggaacttcgcaatctggtgccattgttgcttgcccccgagaatctggtagaaaaggaaatatccgggtctaaagtgacatgcagagacctcgtggagtactttaaggcctatattaaaatctaccaaggagaagaattgccccaccccaagtctatgctgcaggccaccgccgaggccaacaatctcgcagctgtcgcaggcgcccgagacacctattgtaaatccatggaacaagtctgtgggggggacaagccttacatagccccctccgatctcgaacgtaagcatctggatctcaaggaggtggctatcaagcagttccgctctgttaagaagatggggggtgatgagttttgccgtagatatcaggatcagctagaagccgagatcgaagagacttatgcaaatttcattaaacacaacgacggcaagaacatcttctatgccgcaaggaccccagccacactgttcgcagtcatgtttgcgatgtatataatctccggcctcactggcttcataggcctgaattctattgccgtactgtgtaacctggtgatgggtctcgctctgatttttctatgcacctgggcctatgtcaaatatagcggggaatttagggagatagggacagtgatcgaccagatcgcggaaactctgtgggagcaagtgctgaaacctttgggcgacaacctgatggaggagaacattagacagagtgtgacaaattctatcaaggcaggtctgaccgaccaagtctcacaccacgcaaggctcaaaaccgactag

SEQ ID NO: 179685 - DNA, 1740 bp, Artificial Sequence
  Description of Artificial Sequence: Synthetic coding sequence
atggccgagggcgacgaggccgcccggggccagcagccccaccagggactctggcgccgtcggcggacatccgaccctagcgctgcagtaaaccatgtctcatcaacaaccagcctaggtgagaattacgaagacgatgacctggttaactccgatgaggtcatgaaaaagccttgcccagtgcagatcgtgctggcacacgaggatgatcacaatttcgaattagacgaagaagcgttggaacaaattctcctgcaggaacatatcagagatctgaacatcgtggtcgtgtctgtcgctggggccttccggaagggaaaatcatttttgttagattttatgctccgctatatgtataataaggattctcagagttggattggtggcaataacgaaccactgacaggatttacttggcggggcggttgcgaaagagagactactggaatccaggtctggaatgaagtgtttgtgattgaccgtccgaacgggacaaaggtcgcagtgttattaatggacacccaaggagcgttcgattctcagagcacaatcaaagactgtgcaaccgtgttcgccttgtccactatgacaagtagtgttcaggtgtataacctaagtcaaaacattcaagaagatgatctccagcatctgcagctgttcaccgaatacggtcggcttgcaatggaagaaatttaccagaaaccttttcaaaccttgatgttcctcatccgggactggtcatacccgtacgaacattcttacgggctcgagggcggcaagcagttcctagagaaacgattacaggtgaagcagaatcaacatgaagaactgcagaacgtccggaagcacatccacaattgttttagtaatctcggctgtttccttctgccacaccctgggctgaaggtggcaacaaatccttcatttgacggacgtctgaaagatatcgacgaagacttcaagagagaacttcgcaatttggtgccattgctgcttgcaccagagaatctcgtggagaaggaaatctctgggagcaaggtcacttgtcgcgacctggtggagtatttcaaggcctatatcaagatataccagggggaggagctgccacaccctaagagtatgcttcaggccactgctgaggcaaataacttggcagcagttgctggcgcaagagacacctattgcaagagcatggagcaagtgtgcggaggagacaagccttacatcgcccccagtgacctggaacgcaagcatctggatttaaaggaggtagctatcaagcagtttcgcagcgtgaagaaaatggggggggatgagttttgccgccgctatcaggatcagttggaagcggaaatcgaggaaacatacgccaacttcataaagcataatgacggaaaaaatattttctatgctgccaggacacccgctaccttgtttgctgttatgtttgccatgtacattatttccgggctgactggctttatcggcttgaactctattgccgtcctgtgcaacttggtcatgggactggctctgattttcctgtgcacctgggcctacgtgaagtactccggggagttcagagagatcgggactgtgatcgaccagattgcagagaccctgtgggagcaagtgttctccaaattgtttgaggtgactaggcggcgtatggtgcaccgagccctttcgtcggctcaaagacagcgcctgtcctcgaataataacaagaaaaagaattag

SEQ ID NO: 179686 - DNA, 1239 bp, Artificial Sequence
  Description of Artificial Sequence: Synthetic coding sequence
atggacacccagggcgccttcgacagccagagcaccatcaaggactgtgctaccgttttcgccctctccacaatgacatcctcagtccaggtgtacaatctgtcacagaacattcaggaagacgaccttcagcatctccaacttttcactgagtacggaaggctcgccatggaagagatatatcaaaaaccgttccagactctcatgtttctgatccgggattggagctatccgtatgagcactcttatggtctggagggaggtaaacagtttcttgagaagcgtctccaggtcaaacagaatcagcatgaagagctccaaaatgtccgcaagcacattcacaactgctttagcaatctggggtgtttcctgttgccccatcctgggttgaaggtggccacaaatcccagtttcgacgggagactcaaggacatcgacgaggacttcaaacgagaacttaggaacttagtcccccttttactggcgccagagaacctggtcgagaaagagatctccggaagtaaggttacttgccgcgacctcgtggaatacttcaaggcttacattaagatctatcagggggaagagctgccccaccctaaaagcatgctccaggccactgcggaggccaacaacctggccgccgtcgccggcgcgagagacacttattgcaagtctatggagcaggtctgcggaggcgacaagccgtatatcgcgccttcagatttggaacgcaagcatttggacctgaaggaagtagccatcaagcagttccgcagtgttaaaaagatggggggggacgaattctgtaggcgctaccaagatcaattggaggccgaaattgaggagacttacgcaaattttatcaaacacaatgatggcaaaaacatattctacgccgcaagaacacccgccacactctttgccgtcatgtttgctatgtatatcatcagtggcctgacaggatttattggtttgaattctatcgcggtgttatgtaacttagtgatggggctggccttaatctttctgtgcacctgggcctacgtcaagtactcaggagaattccgtgagattgggacagtcattgatcagatcgctgaaaccctgtgggaacaggtgcttaagccgctcggtgataacttgatggaggagaatatcagacaatccgtgaccaattccattaaagcagggcttaccgatcaggtctctcatcatgctcgtctgaagacagattag

SEQ ID NO: 179687 - DNA, 1242 bp, Artificial Sequence
  Description of Artificial Sequence: Synthetic coding sequence
atggacacccagggcgccttcgacagccagagcaccatcaaggactgcgccaccgttttcgcgctatccaccatgaccagcagtgtgcaggtatacaacctgtcccaaaatattcaggaggatgatcttcagcaccttcagttgttcactgaatatggaaggttggccatggaggagatctatcaaaagccgtttcaaaccctgatgttcttaatcagggattggagttacccttacgagcattcttatggccttgaggggggcaagcagtttctggagaagcgcctgcaggtgaaacagaaccagcacgaagagctgcaaaacgtacgtaagcatattcataattgtttttccaacctcggctgcttcctgctcccccacccaggcctgaaggtggccaccaatccgagttttgacggcagactgaaggacattgacgaagactttaagcgcgagctgagaaacctggtccctctgctactggcccccgaaaatctggtcgaaaaggagattagcgggtccaaggtcacctgcagagatttggtcgagtattttaaggcgtatattaagatctatcagggagaggaacttccgcatcctaaaagtatgctgcaggccacagccgaagcaaacaacctggccgccgtcgctggcgcccgcgatacatattgcaaatcgatggagcaggtgtgtggcggcgataaaccatatatcgcaccctctgacctggaacgcaagcatctggatttaaaagaagttgctatcaagcagttccgaagtgtgaagaaaatggggggcgatgagttctgtcgtagataccaggaccagctggaagctgagatagaggagacatacgccaactttattaagcataacgacggcaaaaacatcttctacgccgcgagaacgccagcaactctgttcgctgtgatgtttgccatgtatattattagcggcttgacaggatttattgggttaaatagtattgctgttctgtgtaatctggtgatgggcctcgcgctgatcttcttgtgcacttgggcctacgtgaaatatagcggcgagttcagagaaatcggaacggtaatagatcagattgctgaaaccctttgggagcagagatctccgaggaaagtcttcagtaaactgttcgaggtgactaggcgaagaatggtgcacagggcactgagctccgcccagcggcagagactgagtagtaataacaataagaagaagaattag

SEQ ID NO: 179688 - DNA, 1707 bp, Artificial Sequence
  Description of Artificial Sequence: Synthetic coding sequence
atgcggaccgccggccgggaccccgtgagcgccggcctgcagttccctaaagatggctccacccagcgccctgcaaatcgtgcccgattcgtacccgcacgcactaggccatcccctcttcacccttgctgtttttgcttcgagggggggggctctatgttatcccctcaacgggttgctgccgctgcttcacgaggtgctgatgatgcaatggagtcttccaatattctgctacaggatcatatcagagatcttgatgtcgtcgtggtgagcgttgccggggcatttcggaaaggtaaaagcttcattctggactttatgctcagatacctctacagtcagaaagagtctggacacagcaactggctgggggaccccgaggagcccctcacgggcttcagctggcgaggcggcagtgaccccgaaacgaccgggatccagatctggtctgaagtgtttaccgtcgaaaaaccagggggaaaaaaggtggcagtggtactgatggatacccaaggcgctttcgactcgcagagcactgtcaaggactgcgccaccatttttgccttgtccaccatgacgtcttccgtgcagatctacaacctgagccaaaacatacaggaggacgatctgcaacaactgcagctgttcacagaatacggtaggttagctatggacgagattttccagaagccttttcagacactcatgtttctggtgagggactggtcgttcccctacgagtacagctatggccttcaggggggcatggccttcttggacaaacgcctgcaggtgaaagaacaccagcatgaagaaatacagaacgtcaggaaccacatccattcatgcttttctgacgttacatgctttctgctaccccaccctggcctgcaagtggcaacatcaccagattttgacgggaaacttaaggatatcgccggcgagtttaaggagcagctgcaggccttgatcccttatgtgctgaacccgtccaaactcatggaaaaggagattaacggcagcaaggttacatgtcgcggtttgcttgaatactttaaggcttatatcaaaatctaccagggcgaggaccttccccacccaaaatcaatgctccaggctaccgcagaagccaataatcttgctgcggctgcaagcgccaaggacatctattataacaatatggaagaggtttgcggtggggagaagccatatttgtcgcccgacattctcgaggaaaaacattgcgagtttaaacagcttgcacttgaccactttaaaaagactaagaagatgggcggaaaggacttcagctttcgctaccaacaggaactggaggaggaaataaaagaactgtatgagaacttctgtaaacataacggaagcaagaatgtgttcagcacgtttagaactcccgccgtgttattcaccgggattgttgccctttacattgcgtcaggtctcacgggcttcattggactggaagttgtggcacagttgttcaactgcatggttgggctgcttctcatagccctgctgacgtgggggtacattaggtacagtggtcaatatcgagagctcggcggagctattgacttcggggctgcatacgtgctggaacaggcctcaagccatatcggaaactcgacacaggctactgtgagagacgcagttgtcggcagaccgagtatggacaagaaagcccaatag

SEQ ID NO: 179689 - DNA, 1626 bp, Artificial Sequence
  Description of Artificial Sequence: Synthetic coding sequence
atgctgagcccccagcgggtggccgccgccgccagccggggcgccgatgatgccatggagagctccaaacccgggcccgtgcaggttgtgctggtacagaaagatcagcactctttcgaactggatgagaaagctctcgcttctatactgctacaagatcatatccgcgacttggacgtggttgtggtgagtgtggcgggggcctttcgcaaaggtaaatcgttcattttggacttcatgctgcgctatttatactctcagaaagaatctgggcatagtaactggctaggagaccccgaggaaccacttactgggttcagttggcgaggaggtagcgacccagaaaccaccgggatacagatctggagcgaggttttcaccgtggagaaaccaggagggaagaaagtggcggtggtcctgatggacactcagggcgcttttgattctcagagcacagtcaaagattgtgcaacgatatttgcccttagcacgatgaccagttccgttcagatttacaatttgtcacagaatatccaggaagacgaccttcagcagttacagctgttcactgagtacggaagactcgctatggacgaaatcttccagaagcccttccaaacactgatgtttttagttcgggactggtctttcccctacgagtacagttacggtctgcaaggtggaatggctttcttggacaagcggttacaggttaaagagcatcagcacgaagagatacagaatgtgaggaatcacattcatagctgtttcagcgatgtcacatgctttctgctgcctcaccccggtctgcaggtcgctacttcccccgacttcgacggcaaactcaaggacatcgcaggggaattcaaggaacagctgcaggcgctgattccttatgtgctgaatccgtctaaattgatggaaaaagaaatcaatggaagtaaggtgacatgtcgcgggctcttagagtactttaaagcatatattaagatttatcagggcgaggatctgcctcaccccaaaagcatgctccaggccacagctgaggccaataatttagccgctgctgcatccgccaaggacatttattacaataacatggaggaggtgtgcggcggcgagaagccttatctgagccctgatatcctggaagagaagcactgcgaattcaaacaactcgccttagaccattttaagaagaccaagaagatgggaggaaaagatttctcattcagatatcagcaggaactggaagaagaaatcaaagaattatacgagaatttctgtaagcataacgggtctaaaaatgtcttttccacttttaggacacctgccgtgttgttcacaggcatagtagccctgtacatcgcgtccggcctgaccgggttcataggactggaggtcgttgcacagctgtttaactgtatggttgggcttctgctaatcgccctgctcacttgggggtatatacggtattccggccaatatagagaactgggcggagctatagacttcggcgccgcgtacgtgttagagcaagcttcatcacacatcggaaatagcacccaggcgacggtaagggacgcagtcgttggcaggccttctatggacaagaaagcccagtag

SEQ ID NO: 179690 - DNA, 1065 bp, Artificial Sequence
  Description of Artificial Sequence: Synthetic coding sequence
atgagccggctgctgcacgccgaggagtgggccgaggtgaaggagctgggcgaccaccatcggcagccacagcctcatcacttgccacagccacccccccctcctcagcccccagctaccctacaggcaagggaacaccccgtttacccccccgaactttctctcctggacagcacagatccgagggcatggctcgcccctactcttcagggaatatgtacggcacgggcggcccagtatctcctccacagtcctgaactaggcgcttcagaggccgccgctcctagggacgaagtcgacggccgtggagagctggtaagacgcagcagtgggggcgctagttcctccaagagccctgggcctgttaaggttagagagcagctgtgcaagctaaaaggcggcgtggtcgttgacgagctgggttgttctagacagagagctccctcaagcaaacaagtcaacggcgtgcaaaagcagcgacggctcgccgccaacgctcgtgagagacgacgcatgcacggactgaaccatgctttcgaccaactgcgtaacgtaatcccatcttttaacaatgacaaaaagctatcgaaatatgagaccttacagatggcacagatctatattaacgcactgagcgagctcctccaaaccccatcggggggcgaacagcccccccctccacctgcttcttgtaaatcagatcatcaccacctccggactgctgcttcctacgagggcggggctgggaatgctaccgctgccggagctcaacaggcatccggcgggtctcaacgtccaactccacctggctcctgtagaaccagattctcagcacctgccagtgcaggtggctacagcgtccagttggacgccctgcacttctccactttcgaggattccgcacttacagcgatgatggctcagaaaaatctgtccccttctctgccaggtagtatattacagcctgtgcaggaagagaattcaaagacatccccaagaagccaccggtccgatggcgaattttccccccactcacactactctgactcagacgaggcatcctag

SEQ ID NO: 179691 - DNA, 459 bp, Artificial Sequence
  Description of Artificial Sequence: Synthetic coding sequence
atgaagagctgcaagcccagcggcccccccgccggcgcccgggtggcccctccctgcgccgggggtactgagtgtgccggtacctgtgccggagccggacgcctggagagtgccgcacgccgcaggctggccgccaatgccagggagaggagaagaatgcaaggcttgaacacagcctttgacagactgagaagagtggtgccgcagtggggacaggacaagaaactttcaaaatatgagacattgcagatggccttaagctatatcatggcactaacgcgcatcctggccgaggctgagaggtttggatcagaacgtgattgggtgggcctgcattgcgagcatttcggacgggatcactatctcccattccccggggctaagttaccaggggagagcgagttgtattcccagagactgtttgggtttcagcctgaacctttccagatggccacctag

SEQ ID NO: 179692 - DNA, 627 bp, Artificial Sequence
  Description of Artificial Sequence: Synthetic coding sequence
atgtggcggagctgcctgcggctgcgggacggcggccggcggctgctgaatcgtcccgctggcggcccctctgcaagtatgagtcccggcccgacgattccttctccagcccgtgcctacgctccacccaccgaacgcaaacgtttttatcagaatgtgagtattactcagggggagggtgggtttgaaataaatctggaccatcgaaagctgaagacccctcaagctaaactgtttaccgtcccaagcgaggccctggctatcgccgtcgcgaccgaatgggattcccagcaggacacaatcaaatactacaccatgcacttgacaactctgtgtaatacaagtcttgacaaccctacccagagaaacaaggatcagctgattcgcgcggccgtgaagttcctagacactgacacaatctgctatcgagtggaagaaccggagactctcgtcgagttacagagaaacgagtgggatcccattatagagtgggcagagaagcggtatggggtggaaataagttcttccacctcaattatggggccatccatccctgccaaaaccagggaagtgttggtctctcatctcgccagttataatacgtgggccttgcagggcatggattag

SEQ ID NO: 179693 - DNA, 618 bp, Artificial Sequence
  Description of Artificial Sequence: Synthetic coding sequence
atgtggcggagctgcctgcggctgcgggacggcggccggcggctgttaaaccggcccgccggcggaccctcagcaagtatgtcccccggacccacgatcccatcccctgcacgcgcttacgccccacctacagaaaggaagaggttttaccagaacgtgagtatcacacagggcgaaggaggcttcgaaattaacctcgatcaccggaaactgaagaccccccaggcaaagctgtttaccgtgccttctgaggcactcgcgatagccgtggctaccgagtgggacagtcagcaggacactataaaatactataccatgcacctgacaactctgtgcaataccagcctcgacaaccctactcagcgcaacaaagaccagctgatccgcgcagctgtgaaattcctggatactgacaccatctgttatcgcgtagaagaacctgagacccttgttgagcttcagcggaacgaatgggaccctattatcgaatgggctgaaaaacgctatggggtggaaattagtagctctacgagtattatgggaccgagcatcccggccaaaactagggaggtgttggtgtcacatttggcatcttataatacatgggctcttcagtag

SEQ ID NO: 179694 - DNA, 870 bp, Artificial Sequence
  Description of Artificial Sequence: Synthetic coding sequence
atgtggcggagctgcctgcggctgcgggacggcggccggcggctgttgaaccggcctgccgggggtccatctgcttccatgtctcctggccctactattccctctccggctagagcatatgctccaccaactgagcgcaaacgtttctaccaaaatgtctcgattacgcagggcgagggaggcttcgagattaacctcgatcataggaaactcaagacaccccaggccaaactctttaccgtgcctagcgaagccctggccattgccgtggccactgaatgggattctcagcaagataccatcaagtattatacaatgcacctcactactctgtgcaatacatctctagacaatccaacgcagcgaaataaggatcaactgattagagctgcagtcaagttcttggataccgacacaatatgctatcgcgtggaggagcctgagaccctcgtcgagcttcagagaaatgagtgggacccaatcatcgagtgggccgaaaaacgttatggggtcgagatttccagctctacttcgattatgggcccgtcaatacccgctaagacccgcgaggtgctcgttagccacctggcctcttacaacacttgggcgctacaggggattgaattcgtggctgcacagcttaagagtatggtccttaccctcggcttgatagacctgagactaactgtcgagcaggccgtgctcctgtctaggctggaagaagaataccaaattcagaagtggggaaacattgagtgggctcacgactatgaactccaggaactgcgggcacgaactgcggctggcactttgtttatccacctgtgctctgagtccaccactgtgaagcataagctgctcaaggagtag

SEQ ID NO: 179695 - DNA, 1590 bp, Artificial Sequence
  Description of Artificial Sequence: Synthetic coding sequence
atgctgggcttcgtgggccgggtggccgccgcccccgccagcggcgcattgaggcgacttaccccatccgcctctctgccgcccgcccaattacttctacgggcggctccaaccgcagtgcaccctgttagggactatgccgcccagacgagcccttcccctaaagccggagcggccacgggcaggatcgtcgccgtgattggtgcagttgtagacgtccagttcgatgagggcttaccaccaattctgaacgccctcgaggtgcaggggcgcgaaacaagactggttctggaggttgcccagcatctgggcgagtccaccgtgcgcactattgccatggatgggacagaaggattggtcagggggcagaaggtgttagactctggcgcccccatcaagattccggtaggtccagagacactcggacggattatgaatgtgattggtgaaccaatcgacgaacgcggcccgattaagacaaagcagtttgcccctatacacgccgaagctccagaatttatggaaatgtctgtggagcaagaaattctcgttaccggcatcaaagtagtggatctgctggcaccgtatgctaaaggggggaagattggcctctttggtggggccggcgtcggaaaaacggtgctgatcatggagctgataaataatgtggccaaagctcacgggggctacagtgtgttcgccggcgttggcgaacggactcgcgagggtaacgatctatatcacgaaatgattgagtccggtgtgatcaatctgaaggatgcgacaagcaaagtggctctggtttacgggcagatgaatgaacccccaggcgcacgagccagagttgcattgacaggtttaactgttgccgagtattttcgtgatcaggaaggtcaggacgtgctcctgtttatagataacatcttccgttttacacaagcaggttctgaggtttcagcgctcctaggcagaatcccttcagctgtggggtatcagcccacgcttgctacagacatgggcacaatgcaggagcggatcaccacaactaaaaagggcagtatcacatccgttcaagcaatttacgttccggctgacgaccttacggatccagcccctgcgacgacctttgcccacctggatgcaaccaccgtcctgagtcgggccattgcagaattgggaatctaccccgccgtggatccgctggattccaccagccgtatcatggatcctaatattgtaggtagcgaacactacgacgtggcacgcggagtgcaaaagatcctgcaggactacaagagtctgcaggacattatcgccattcttggtatggatgagctgagcgaggaagacaaactcacagtcagtcgcgctagaaagatacagcggtttctttcccaaccttttcaggtggccgaggtgttcaccgggcatatggggaaactcgtccccctcaaagaaaccataaaagggtttcaacagatcctagccggcgaatatgatcaccttcctgagcaagctttctacatggtcggccctattgaggaggcagtggctaaggctgataaactagccgaggaacacagctcatag

SEQ ID NO: 179696 - DNA, 156 bp, Artificial Sequence
  Description of Artificial Sequence: Synthetic coding sequence
atggtggcctactggcggcaggccggcctgagctacatccggtacagccagatatgcgcaaaggcagtgagggacgccctgaaaacagagtttaaggcaaatgccgaaaaaacatcaggatcgaacgtcaaaatcgtgaaggtgaaaaaggaatag

SEQ ID NO: 179697 - DNA, 156 bp, Artificial Sequence
  Description of Artificial Sequence: Synthetic coding sequence
atggtggcctactggcggcaggccggcctgagctacatccggtacagccagatatgtgcaaaggccgtaagagacgccttaaagaccgaattcaaggctaatgctgagaagacttcaggaagtaacgtcaagatagtaaaggtgaagaaggagtag

SEQ ID NO: 179698 - DNA, 156 bp, Artificial Sequence
  Description of Artificial Sequence: Synthetic coding sequence
atggtggcctactggcggcaggccggcctgagctacatccggtacagccagatctgtgcaaaggccgtccgggatgcgctcaaaacagagtttaaggcgaatgcggagaagacctctgggtcaaacgtgaagatcgtgaaggtgaaaaaagagtag

SEQ ID NO: 179699 - DNA, 894 bp, Artificial Sequence
  Description of Artificial Sequence: Synthetic coding sequence
atgttcagccgggccggcgtggccggcctgagcgcctggaccctgcagcctcagtggatccaggtacgcaacatggccacattaaaggacattactaggcgactcaagtccataaagaatatacagaaaattacgaagtcaatgaaaatggtggctgccgccaaatatgcccgggctgaaagggaactgaagccggcgaggatatacggcctcggctctctagccttgtatgagaaggctgacatcaaaggcccagaggataagaaaaagcacctcctgattggagtgagtagcgatcgaggtctttgtggcgctatacactcatctatcgccaaacagatgaagtcagaagttgccaccttgactgccgccggcaaagaggtaatgctggtcggaataggagacaagatccggggaatcttatataggactcattccgatcagttcctggtggcctttaaggaagtcggccgcaagccccctaccttcggcgatgcatctgtgatcgctttggagctgctgaatagtggctatgagttcgacgagggtagtatcatcttcaacaagtttcgctccgttatttcgtacaaaaccgaggagaaacccatttttagtcttaatactgtagccagtgctgatagcatgtccatttacgacgacattgatgccgacgtgctgcagaactaccaggagtataacctggccaatattatctattacagcctcaaggagtccacaactagcgagcagtcggcaaggatgaccgcaatggataacgccagtaagaacgccagcgagatgatagacaagttgacacttacgttcaaccggactcgacaggccgtgattacgaaggagttgatcgaaattatctccggagctgcagcactctag

SEQ ID NO: 179700 - DNA, 897 bp, Artificial Sequence
  Description of Artificial Sequence: Synthetic coding sequence
atgttcagccgggccggcgtggccggcctgagcgcctggaccctgcagccccagtggatccaggtgcgcaacatggccactctcaaagacattacccgcagactgaaatctattaaaaatatccagaaaatcaccaagtcaatgaaaatggtcgcggcagcgaaatatgcccgggccgagagagaactgaagccagcgcgaatatatggcctgggttccctggccctgtatgaaaaagcagatatcaagggcccagaggacaaaaagaagcacctgctcatcggagtatcctctgatcggggactctgtggagccatccactcaagcatcgcaaaacagatgaagtccgaggtggctaccctcactgcagcaggcaaggaggtgatgctggtggggatcggcgacaaaattagggggattctgtaccggacccacagtgaccagttcctggttgcattcaaagaggtcgggaggaagccccccactttcggggacgccagtgttatcgccctggaactgttgaatagcggatatgagtttgatgagggttctattatctttaacaagttcagatcagtaatctcatacaaaaccgaagagaagcccatattctcactcaacacggtcgccagtgcagactctatgtccatctatgatgatatcgacgccgacgtcttgcagaactaccaggaatataacctcgccaacataatctactattcgttaaaggaatccacgacatcggaacagtcggcaagaatgaccgccatggacaacgcctccaaaaatgcctccgagatgattgataagctcacccttacttttaaccggaccaggcaagcagtgatcacaaaggaattaattgagatcattagcggtgctgcggctcttgattag

SEQ ID NO: 179701 - DNA, 753 bp, Artificial Sequence
  Description of Artificial Sequence: Synthetic coding sequence
atgaagatggtggccgccgccaagtacgcccgggccgagcgggagctcaaaccagccagaatttatggcttagggtccttggctctttacgaaaaggctgatattaaaggtcctgaagacaagaaaaaacatctgctgattggagtaagttccgatcgggggctatgcggtgcaatccacagctcgattgccaagcagatgaaatcagaggtggcaacgctcaccgcagcaggaaaggaagtgatgctcgtaggcataggggataaaatcagagggatcttgtaccgcacacactcagaccaattcctcgtcgcttttaaggaggttggccgcaagccccccactttcggggacgcatcagtgatcgcacttgaactgctaaactctggatacgagtttgatgaggggagtatcatcttcaataaatttagaagtgtgatatcttataaaaccgaagaaaagcccatattttcactgaacactgtagccagcgcagacagcatgtctatctatgacgacatcgatgccgacgttctccagaattaccaagagtacaatctggcaaacatcatatattatagcttaaaggaatccaccacttcggaacagagcgccagaatgacagctatggacaacgcgtcgaagaatgcttccgagatgattgacaagctgacattaaccttcaaccgcaccagacaggctgtcatcaccaaagagctgattgagataatctccggggctgcggccctgtag

SEQ ID NO: 179702 - DNA, 642 bp, Artificial Sequence
  Description of Artificial Sequence: Synthetic coding sequence
atggccgcccccgccgtgagcggcctgagccggcaggtgcggtgcttctctacatccgtcgtccggccatttgctaagctcgtgagaccacccgtccaggtttacggcatcgagggaaggtacgccactgccttgtatagtgcagccagcaagcagaacaagcttgagcaggttgaaaaagagctcttgcgcgttgcccagatcttaaaagagccaaaagtcgccgcgtcagtgctgaacccctacgtgaaacggagcattaaagtaaaatcactcaatgacatcaccgcaaaagagcggttctctccactgactacaaacctgattaatctgttggccgagaatggacgcctgagcaacacccagggggtcgtcagcgctttctcaaccatgatgagtgtgcaccggggagaggtgccatgtacagttacctccgcgagcccattagaggaggctactctcagtgagcttaagaccgtgctgaagagcttcttatcccaggggcaagtgctgaagctggaagctaagacggatccaagtatcctgggtggcatgattgttcgtattggcgaaaagtacgtggatatgtctgtaaagactaagattcagaaactcggcagggctatgagggagatcgtttag

SEQ ID NO: 179703 - DNA, 411 bp, Artificial Sequence
  Description of Artificial Sequence: Synthetic coding sequence
atgcagaccgccggcgccctgttcatcagccccgccctgatccggtgttgcacaagagggctgattaggccagtgtctgctagttttttgaacagtccagtgaattccagcaagcaaccctcctactcaaatttcccactgcaggtcgcgagacgggagttccaaactagcgtcgtgtccagagacatcgatacagccgccaaattcatcggggcgggcgcggcgaccgtgggtgttgctggctccggcgctggcattgggaccgtctttggatccttgatcatcgggtacgcccgtaacccctcactgaagcagcagctgttcagctatgccattctgggctttgcattatcggaagccatgggcttattctgcttgatggttgcatttcttatcttgttcgcaatgtag

SEQ ID NO: 179704 - DNA, 411 bp, Artificial Sequence
  Description of Artificial Sequence: Synthetic coding sequence
atgcagaccgccggcgccctgttcatcagccccgccctgatccggtgctgtactcgtgggttaattaggcccgtgtccgcgtctttcctaaacagtccagtaaattctagcaaacagccctcctactctaattttccactccaggttgcccgacgtgagtttcagactagcgtcgtgtcaagagacatcgataccgccgccaaattcatcggagcgggagccgccactgtgggagttgctggctccggtgcgggcatcggaaccgtcttcggctcgctgatcattggttacgctaggaaccccagtctgaaacaacagctgttttcttacgctattcttggcttcgcccttagcgaggccatgggtctcttttgtctcatggtagcctttctgatcctcttcgccatgtag

SEQ ID NO: 179705 - DNA, 474 bp, Artificial Sequence
  Description of Artificial Sequence: Synthetic coding sequence
atgcccgagctgatcctgagccccgccaccgccccccaccccctgaagatgttcgcctgctctaaattcgtttcaacaccctccctggtcaagtccacgagccaactcttgtctcggccacttagtgcggtcgtgctcaagcgaccggaaatcctgactgatgagtccttatcgtccctagccgtgtcttgtcctttgacatcactggtgtcgtccaggtcattccaaacaagtgcaatctcccgcgatatcgataccgcagccaaattcatcggagctggcgccgctacagtcggcgtcgctgggagcggagctgggatcggtaccgtcttcggctccctaataattgggtatgcgcggaatccttccctcaaacaacaactcttttcttacgctatattaggttttgccctgagcgaggctatgggactcttttgtctcatggtcgcattcttgatcctgtttgcgatgtag

SEQ ID NO: 179706 - DNA, 597 bp, Artificial Sequence
  Description of Artificial Sequence: Synthetic coding sequence
atgcccgagctgatcctgtacgtggccatcaccctgagcgtggccgagcggctggtggggcctgggcacgcttgtgcggaacctagctttagaagcagccgctgcagcgctcccctctgccttctgtgcagcggctcctcgagtccggcgactgctccacatcccttaaagatgtttgcctgtagcaagtttgtgagcaccccttcccttgtgaagtccacaagccaattgctgagtcgccccttatccgctgtggttctcaagaggccagagattctgactgacgaatccctgtccagcttggcagtgagctgccctcttacatccctggtgagtagccgctcatttcaaacaagtgccatctcccgggacatcgacactgcagccaaattcatcggggccggggcagctaccgtgggcgttgccgggtctggggccggaatcgggacagtgtttggatctctcatcataggttatgcgcgcaacccttcgcttaaacagcagcttttctcctatgccattctcggctttgccttgtccgaagccatgggacttttttgtctgatggtcgcctttttgattctgttcgctatgtag

SEQ ID NO: 179707 - DNA, 426 bp, Artificial Sequence
  Description of Artificial Sequence: Synthetic coding sequence
atgttcgcctgcagcaagttcgtgagcacccccagcctggtgaagtccacctcgcaactcctgtctcggccattgtccgcagtggtgctgaagcgcccagaaattttgactgacgagtctctcagtagcctggcagtgagttgcccacttacaagcctcgtgagctcaaggtcatttcagaccagtgctattagccgcgatatagacactgcagccaagtttattggcgcaggagctgccactgtgggcgtggctggttctggtgccggcataggtacagtgttcggctcacttattatcggctatgctcgaaatccctctctgaaacagcaactctttagttatgcgatcctcggttttgcactgtctgaagctatgggcctgttttgcttaatggtcgccttcctcatcctgttcgccatgtag

SEQ ID NO: 179708 - DNA, 429 bp, Artificial Sequence
  Description of Artificial Sequence: Synthetic coding sequence
atgttcgcctgcgccaagctggcctgcacccccagcctgatccgggccggcagcagagtggcctaccgcccaatttctgccagcgtcctgagccggcctgaggctagcagaacaggggaaggatccactgtattcaatggtgcgcagaatggggtctctcagctaatacagagggagtttcagacctcggcgatctctagagatatagacacagctgctaaattcatcggtgccggggccgctactgtaggagttgccggaagcggagcaggcattggcacagttttcggctctctcatcatcggctacgccagaaaccccagcttgaagcagcagctctttagttatgcaatactggggttcgctcttagtgaggccatgggccttttttgcctgatggttgcctttctgattctgttcgcaatgtag

SEQ ID NO: 179709 - DNA, 429 bp, Artificial Sequence
  Description of Artificial Sequence: Synthetic coding sequence
atgttcgcctgcgccaagctggcctgcacccccagcctgatccgggctgggtcccgagttgcctatcggccgatatccgcgtccgtgctaagccggcccgaggctagtaggacgggagagggttctacggtcttcaatggtgctcagaacggagtgagtcagctgatccagcgcgaattccaaaccagcgctatcagtcgcgacattgacaccgccgccaagtttataggagccggggccgccacagtcggcgtggctggaagtggtgccggcattgggaccgtgtttggaagtctgattattggttacgcccgcaacccttctcttaaacaacagttgtttagctacgccatactgggcttcgccctcagcgaagccatgggcctgttctgtctaatggttgcattcctgattttgttcgcaatgtag

SEQ ID NO: 179710 - DNA, 429 bp, Artificial Sequence
  Description of Artificial Sequence: Synthetic coding sequence
atgttcgcctgcgccaagctggcctgcacccccagcctgatccgggcaggcagccgtgtggcgtaccgacccatttcagcttcagtgctcagccgtcccgaagcttcaaggacaggcgagggttccacggtcttcaacggagcccaaaacggagtatctcaattaatacaacgcgagtttcaaactagcgccatcagccgcgacatcgacactgccgccaagttcatcggcgcgggggccgcaacagtcggagtggctggcagtggcgccggtatagggaccgtgttcggcagcctgataatcgggtacgcccggaaccccagcctgaaacagcagttgttcagctatgcaattctgggctttgccctgagcgaagccatgggtctgttctgtctgatggtggctttcttaatccttttcgccatgtag

SEQ ID NO: 179711 - DNA, 210 bp, Artificial Sequence
  Description of Artificial Sequence: Synthetic coding sequence
atggtgccccccgtgcaggtgagccccctgatcaagctgggccggtactcggcactgttcctgggagtcgcgtatggcgcaacaagatataattacttaaagccaagggctgaggaggaacgacgcattgccgcagaagagaaaaaaaagcaggatgagttaaagcgtatcgcaagagagctggccgaggacgactctattctcaagtag

SEQ ID NO: 179712 - DNA, 327 bp, Artificial Sequence
  Description of Artificial Sequence: Synthetic coding sequence
atgatcctgcagcggctgttccggttcagcagcgtgatccggagcgcagtctcagtgcatttaaggagaaatattggtgtgaccgccgtggccttcaacaaggagcttgaccctatccagaaactttttgttgataagattagagaatataaaagcaagagacaaacatcaggcggccccgtcgatgcttcttctgagtatcaacaggagctcgaacgcgagctgtttaaactgaagcaaatgtttggcaatgccgatatgaatacctttccgactttcaaattcgaggatcccaaattcgaagttatcgagaagcctcaagcctag

SEQ ID NO: 179713 - DNA, 327 bp, Artificial Sequence
  Description of Artificial Sequence: Synthetic coding sequence
atgatcctgcagcggctgttccggttcagcagcgtgatccggagcgctgtctctgtccacctgaggagaaatatcggtgtgacggccgttgcctttaataaagaactggatcctattcagaagctgttcgtggataaaattcgcgagtacaaatcaaagagacagacttctggtggacctgtggatgcatccagtgagtaccagcaagagctggagcgggaactgtttaagctgaagcagatgttcgggaatgctgacatgaacacattccccacctttaaatttgaggacccaaagttcgaggtgattgagaaaccgcaggcctag

SEQ ID NO: 179714 - DNA, 327 bp, Artificial Sequence
  Description of Artificial Sequence: Synthetic coding sequence
atgatcctgcagcggctgttccggttcagcagcgtgatccggagcgctgtctccgttcacctgaggcggaacattggcgtgaccgcggtggcatttaataaggagctggacccaatacaaaaactgttcgtcgacaaaatccgcgagtataagtctaagcggcagacaagcggcgggcctgttgatgcctcctcggagtatcagcaggagctggaaagggagctcttcaagttaaaacagatgttcggcaacgctgatatgaacacttttcctacatttaagtttgaagaccctaagtttgaggtgattgagaaacctcaagcctag

SEQ ID NO: 179715 - DNA, 327 bp, Artificial Sequence
  Description of Artificial Sequence: Synthetic coding sequence
atgatcctgcagcggctgttccggttcagcagcgtgatccggagcgcagtgtccgtgcacctgcgcagaaatatcggggtgaccgctgtagcattcaacaaggagctggatcctatccagaagctctttgtggataagatcagagagtataaatccaagaggcagacatcaggcgggccagtcgatgccagttctgaataccagcaagagctggaacgggagctgttcaaacttaagcaaatgtttggcaacgctgatatgaacacttttcccacgttcaagttcgaagaccctaagtttgaagtgatagagaaacctcaggcctag

SEQ ID NO: 179716 - DNA, 327 bp, Artificial Sequence
  Description of Artificial Sequence: Synthetic coding sequence
atgatcctgcagcggctgttccggttcagcagcgtgatccggagcgccgtaagtgtgcatctcagacgtaacatcggggtgacagccgttgcctttaacaaagagctggatcctatacagaagctctttgttgacaagatccgcgagtataagtcaaagaggcaaaccagtggggggcctgtagacgcttcctctgaatatcaacaggagttagaaagagagctgttcaaactgaagcagatgtttggaaacgctgacatgaacactttccccactttcaaatttgaggatcctaaattcgaggtcatcgagaagccccaggcttag

SEQ ID NO: 179717 - DNA, 351 bp, Artificial Sequence
  Description of Artificial Sequence: Synthetic coding sequence
atgcactgcgacggcggcatcagcatgatcctgcagcggctgttcaggttctcaagtgtgattcgcagcgctgtgagcgtacatctacgtaggaacataggggtaactgcagtggcttttaacaaggaactggacccaatccagaagttgtttgttgacaagatccgcgaatataaatcgaagaggcaaacctctggtggccccgtggatgccagcagcgagtaccagcaggagctcgaacgcgagctgttcaagctgaaacagatgttcgggaatgccgatatgaacacctttccaacatttaagtttgaagacccaaaattcgaagtcatcgagaaaccccaggcctag

SEQ ID NO: 179718 - DNA, 567 bp, Artificial Sequence
  Description of Artificial Sequence: Synthetic coding sequence
atgaccgccaagggcagcaccggcatggagatcctgctgagcaccttagagaacaccaaagacctgcagaccacactgaacattctgtccattctggttgagctggtgtctgcagggggcgggcgaagggtgtcttttcttgttaccaaaggcggatcgcagatcttgctgcaactactgatgaacgccagcaaggagtccccccctcacgaggacctgatggttcagattcactccatacttgcaaaaattggcccaaaggacaaaaaattcggcgttaaagccagaattaacggagctttaaacatcacattaaaccttgtgaagcagaacctgcagaaccatagactggtcctcccctgtcttcaactgctgagggtttatagcgctaatagtgtcaattcggtgagtcttggaaaaaacggagtcgtcgaactgatgtttaagatcatcggaccgttctctaagaagaactcctctctaattaagaacaagtgccaggagagttgcaggcaaaggatctgtccttcagcctttaataacctttgtaggctggcacccccttag

SEQ ID NO: 179719 - DNA, 3681 bp, Artificial Sequence
  Description of Artificial Sequence: Synthetic coding sequence
atgagcaagctgaaggtgatccccgagaagagcctgaccaacaacagccgcattgtgggtttgcttgcacagctggagaagattaacgccgagccctctgaatcagatactgcccgttacgtgacctcaaagatcctacaccttgcccagagtcaggagaaaaccaggcgagagatgaccgcgaaaggctcaaccggcatggagatcctgctttccaccctggagaacacgaaagacctccagaccacccttaacatcctgtctatcctggtggagttggtgtccgccgggggtgggcggagagtgagctttttggttacgaaaggcgggtcccaaatcctgctgcagctccttatgaatgcaagtaaagaaagtccgccacacgaggacctgatggtccagatccactccattttggccaaaattggtccgaaagataagaaattcggggtcaaggccaggataaatggggcacttaacatcacactgaacttggtgaaacagaatcttcagaaccaccggctcgtgctcccctgtctccagctccttcgggtctactcagctaattctgttaactccgtgtctctcggtaagaatggcgtagtggaacttatgtttaagatcatcggtccattttccaagaaaaactcatcactgattaaggtcgccctggatactctggcagccctgttgaagtcgaaaacaaatgcaaggcgggcagtggacagagggtatgtccaagtccttctcacaatttacgtagactggcataggcatgataatcgacatcgaaatatgttgatccgcaagggaattcttcagtcacttaaatccgttaccaacattaaactgggtcgcaaagcatttatcgacgccaatgggatgaagattctttataacactagccaggagtgcctcgccgtgcggaccttggaccctcttgtcaatactagttctctcattatgcggaaatgtttccctaaaaatagacttccactccccacgattaagagcagttttcacttccagctgccagttattcccgtgactggacccgtagcgcaattgtatagcttgccgccagaggtggatgacgtggttgatgagtcagatgataacgatgatattgacgtggaagccgaaaacgagaccgaaaatgaagacgatttggatcaaaatttcaagaatgacgacattgagacagacatcaataaacttaaaccgcagcaggaaccaggccgcactatagaagacttgaagatgtacgagcacctgtttccagagcttgtggatgactttcaagattatgacctgatctcaaaagagccaaaacccttcgtgtttgagggcaaggtgcggggcccaattgttgttcccacagcaggtgaagagacttctgggaatagcggcaatcttcgtaaggtcgtaatgaaggagaacatatctagcaagggcgacgaaggggaaaagaaaagcacattcatggatttggccaaagaggacattaaggacaacgatcgaacgctgcaacaacagccaggcgaccagaatcgaacaatcagctcagtacacggacttaataacgacatcgttaaggctcttgacagaatcactcttcagaacatcccttcacaaacagctcccggatttacggctgaaatgaagaaagactgctcgctcccactgaccgtgcttacatgtgcgaaagcttgcccccacatggccacttgtggaaacgttcttttcgagggccggacagtccagttgggaaagctgtgttgcacgggcgttgagacagaggacgatgaggatacagaatcaaacagttctgttgaacaggcttccgttgaggtgcctgacggacccaccttgcacgaccctgacttgtatattgaaatagtgaagaacactaagagtgtgccagaatattcagaagtggcctaccccgactatttcggccacattccccccccgttcaaggagcccatcctggagaggccatatggcgtgcagagaactaaaattgctcaagacatcgaacgtctgattcaccagagtgatatcatcgaccgcgtggtgtacgacttagacaatcccaattacaccatccccgaggaaggggacattctgaaattcaacagcaagtttgagtccgggaatctccgcaaggtaatccagatccggaagaatgaatatgacctcatactgaactcagatataaattccaaccactaccatcagtggttctacttcgaagtcagtggaatgcggcccggcgtggcctaccggttcaatatcatcaactgcgagaagtctaacagccagtttaattatggaatgcagccgctaatgtatagtgtccaggaggctctcaacgcaaggccttggtggattcgtatgggaacagatatatgctattacaagaatcacttcagccgaagcagtgtggccgccggaggccagaaagggaagagctactacacaatcacattcaccgtgaactttccccacaaagacgacgtgtgctattttgcctaccattacccatacacatactccaccctgcaaatgcatttgcagaaattggagtcagcgcacaacccccagcagatctacttccgtaaagatgtgctgtgtgagaccctttcaggcaactcatgccccctcgtaacaattacggccatgccggaaagtaactattatgagcacatctgccatttcaggaatagaccttacgtgttcctgtccgcccgcgtgcatccaggcgaaacaaatgcatcttgggttatgaagggaacccttgaatacttaatgagcaacaatcccactgctcaatccctgcgtgagtcatacatctttaagatcgttccaatgctgaatccagatggggtcattaacggaaaccacagatgctcactgagtggagaagacctcaaccgacagtggcaaagtccgagccctgacctgcaccccaccatttaccatgccaagggtctgctacagtatctggcagccgttaaaaggctcccactcgtgtactgtgattaccatgggcatagccggaagaaaaacgtgtttatgtatggttgctcaatcaaagaaaccgtctggcacacgaacgataatgcaacctcttgcgatgtagtggaagatacaggctatcggacgctgcccaaaattctttcgcatatcgcacccgccttctgtatgagctcatgctcttttgtggtagagaaaagcaaggaatcaactgctcgtgttgtcgtgtggagggagatcggagttcagagatcttacacaatggagtccacactgtgcgggtgcgaccagggaaagtacaagggattgcagattggtactcgagagctcgaggagatgggggcgaagttctgtgttggtctgctcaggctcaagaggttgactagcccgcttgagtacaacctgccatctagcctgctggacttcgagaacgatctgatcgaaagttcttgcaaagtgacatcccccacaacctacgttctggatgaggatgaaccaaggttcctggaggaggtggactactctgccgaatcaaatgacgagctcgatatagaactggctgaaaacgttggagactatgagccaagcgctcaggaggaggttctttctgacagtgaactatcgcgtacctacctcccctag

SEQ ID NO: 179720 - DNA, 567 bp, Artificial Sequence
  Description of Artificial Sequence: Synthetic coding sequence
atgaccgccaagggcagcaccggcatggagatcctgctgagcaccctcgaaaacacaaaggatttgcagactaccctgaatatactctcgattcttgtagagctcgtgtcggcgggaggtgggaggagagtaagttttctggttaccaaaggtgggtcccaaatcctgcttcagctcttgatgaacgctagtaaagagtccccgccgcatgaggacctcatggtccagatccactctattttggcaaagattggacccaaagacaaaaagtttggagtgaaggctcggatcaacggggcactaaacatcacgttaaatctggtcaagcagaaccttcagaaccacaggctggttttaccctgtctgcagctacttcgtgtgtattcagccaacagcgtgaacagtgtgtccctggggaaaaatggtgtcgtggaactgatgttcaagattattggcccattcagtaaaaagaactcctctttgataaagaacaaatgccaagagtcatgcaggcagaggatctgcccatcagcattcaataacctctgcaggctggctcctccatag

SEQ ID NO: 179721 - DNA, 714 bp, Artificial Sequence
  Description of Artificial Sequence: Synthetic coding sequence
atgagcaagctgaaggtgatccccgagaagagcctgaccaacaacagccgaatcgtgggcttgttggcgcagttagaaaaaataaatgccgaacccagtgagtctgacacagcacgttatgtgacttctaagatactccacctggcccagtcgcaggagaagacgaggcgtgagatgacagcaaagggttctacgggaatggaaattttattgagtaccctagagaataccaaagatctccaaacaactcttaacatattgtccatcctggtggaacttgttagcgccgggggggggcggcgcgtttcctttctcgttaccaaagggggctcccagatcctactccagttgctcatgaacgcaagtaaggaaagtccacctcatgaagatctgatggtgcagatccattctatactcgctaagattggccccaaggacaagaaatttggagtgaaagcacgcattaatggagcactgaatattacattgaacctggtgaagcagaacctccagaaccaccgccttgtgctgccctgtctccagctcctgcgtgtttatagcgccaattcagtcaattcggtctctctaggcaagaacggcgtagtcgagctgatgttcaagatcataggaccgttctctaagaagaactcctctttgatcaagaacgtttggcagagcggactgtggatcctcctctctataccacctgtgtag

SEQ ID NO: 179722 - DNA, 3561 bp, Artificial Sequence
  Description of Artificial Sequence: Synthetic coding sequence
atgagcaagctgaaggtgatccccgagaagagcctgaccaacaacagccgcatagtggggcttttagcccaacttgagaagattaacgcagagccatccgagagtgacacagcacgttacgtaaccagcaaaatcctacacctggcccagtcccaggaaaagacgagacgagagatgaccgccaagggcagcacaggcatggaaatcctgctgagtacccttgaaaatacaaaggaccttcaaacaaccctgaacatcctatctattcttgttgaacttgtctccgccgggggtggtcggcgcgtgtccttcctggtgacaaaagggggctctcagatcctgttacaattgctcatgaatgcgagcaaagaatcccctcctcacgaagatctcatggtacagatacatagcatcttggctaaaatcgggcctaaggataaaaaatttggcgtgaaggccagaattaatggggctttgaatataacactgaatcttgtgaagcagaatctgcaaaatcacaggctcgttctcccttgccttcaactgctcagagtgtattctgcgaatagtgtgaacagcgtgagtttgggcaaaaatggtgtggtggagctcatgtttaagatcattggccctttttcaaagaagaactcctcactgattaaggtggccctggataccctagccgccctcctgaagtccaaaacaaatgctcgtcgggcggttgataggggttacgtccaagtgctgctcacgatctatgtcgactggcacagacacgataataggcaccgtaatatgctaatccgtaaggggattctgcagagcttaaaatccgtgaccaatattaaactgggccgcaaagctttcatcgatgctaatgggatgaagattttatacaacacctcccagctacccgttatacctgttactggtccagtggcacaactatactccctcccacctgaggtcgatgatgtcgtcgacgagtcagatgataacgatgatatcgacgtcgaggcagagaacgagaccgagaacgaggacgatttagaccagaattttaaaaacgatgatatcgaaaccgatattaataaacttaaaccacaacaggagcctgggaggactatcgaggacttgaaaatgtacgaacacctgttcccggaactggtcgatgactttcaagactatgatttgatctctaaagaacccaagcctttcgtgtttgagggcaaagtccggggcccgatcgtcgtccctactgcaggtgaggagactagtggaaactcagggaatttgcggaaggttgtgatgaaggagaatattagttctaagggagacgagggggaaaaaaagagtactttcatggatttggctaaggaggacatcaaggataacgatcgtactctgcaacagcagccaggtgatcagaacaggaccatatcgtcggtgcacggcttgaacaatgacatagtcaaggccttggaccgcatcacgctgcagaatattcctagccagacagcaccagggtttacagccgaaatgaaaaaggattgcagtcttcccctgaccgtcctcacttgtgcaaaggcatgcccgcatatggcaacatgcggtaatgtgctgttcgagggccgtaccgtccaacttgggaagctgtgttgcaccggggttgagactgaggatgacgaggacaccgagtccaatagctcagtggagcaggctagtgtggaagttcctgatggaccgacacttcatgatccagatctgtacatcgaaatagttaagaataccaaatccgtacctgaatacagcgaggtggcctatccagattactttgggcacattcctcctccttttaaggaaccaatcttggagcgcccctatggagtccagcgtaccaagatcgcacaggatatagaacgcctgatccatcagtctgatatcatcgatagggttgtgtatgacctagataatccgaattataccatccctgaggaaggagatattctgaaatttaattccaaatttgagtctggtaacttacgtaaggttattcagatccgcaaaaatgaatacgacctgattctcaattccgacattaattcaaaccactaccaccagtggttctacttcgaggtgagcggcatgaggcctggggtagcgtatcggttcaacattatcaattgtgagaagagcaatagccagttcaactatgggatgcaacctcttatgtactctgtacaagaggctctgaatgcacgcccttggtggatccggatggggaccgatatttgttactacaaaaatcacttttcaagaagctccgtcgctgcggggggacagaagggaaagagctactataccattacgttcaccgtgaacttcccccataaagacgatgtgtgctactttgcctatcactatccctatacatactctacactgcagatgcacctgcagaagctggagtcggcacacaacccacagcagatctacttccggaaggacgtgctgtgcgagaccctcagcggcaacagctgtcccctggtgaccatcaccgccatgccagaaagtaactactacgagcatatatgtcacttcagaaatagaccttacgtattcctgtccgccagagtgcaccccggtgagacaaacgcgagttgggtgatgaaaggtaccctggagtaccttatgtccaataatcctaccgcccaaagcctccgcgaatcctacattttcaagatcgtccccatgttgaatcctgacggcgtgatcaatggcaaccacaggtgttctctgtctggcgaggacctgaacaggcaatggcagagccccagccccgacttgcatcccactatctaccatgccaaaggtctgctccagtaccttgctgccgtgaagcggcttcccctggtgtactgcgattatcacggtcattcccggaagaagaacgtgtttatgtacggctgtagcatcaaggagacagtgtggcacaccaacgacaatgcaacttcttgtgatgttgtggaggacactgggtacaggaccttaccgaagatcctctcccacatcgctcccgctttctgcatgtcaagctgctctttcgtggtggaaaaatccaaggagtccacggctcgcgtggtggtgtggagagagattggtgtgcaacggtcctacaccatggaatccacactctgtgggtgcgatcagggaaaatataagggcttacaaattgggacccgagagttggaagagatgggtgccaaattctgcgtgggcctgcttcggctgaagcgcctcaccagcccattggaatacaacctgcctagctcgctgctggattttgaaaacgacctgatcgagtccagctgtaaagtcacatcacccacaacgtatgtcctcgatgaggatgagcccaggttcctggaggaggttgactactccgccgagtccaatgacgagcttgatattgagctagccgaaaacgtcggtgattatgaaccttctgctcaggaagaggtactttctgactcggagctcagtcggacttacctgccatag

SEQ ID NO: 179723 - DNA, 3717 bp, Artificial Sequence
  Description of Artificial Sequence: Synthetic coding sequence
atgcggaccggcagcgccgccagcagcgccgccgccgccgccgccgcagccgccgcctccgcttctccggccaccggggtgtgcatgaaaacacccggcggaggcagacgggggattagacgcgatccgggagctgaacccggagccgctgccctcagaggcccacggcagaggcctatcctgtcaaggcttaccaataactcacggatcgtgggactgctggcgcagcttgagaaaattaacgccgagcctagcgaaagcgacaccgctcgctacgtgaccagtaagatcctccatctggcccagagtcaggagaaaactagacgggagatgactgccaaaggttcaactgggatggagatactgctatcaacactggaaaatacaaaggacctccaaactaccctgaacatcctatctattctggtagaactcgtctctgccggagggggacggagagtcagctttctcgtgactaagggaggcagtcagatcctgctgcagctcctcatgaacgccagcaaagaaagtcccccccacgaggatctaatggttcagatccatagtatccttgccaagattggcccaaaggacaagaaatttggcgtcaaagcaaggattaacggcgccctgaatattactcttaacctggttaagcagaacctgcaaaatcacaggctggtgctgccatgcttacagctgctccgtgtttactcagcaaattccgtcaattcagtgagcctggggaagaacggtgtcgtggagttgatgttcaagatcatcggacctttcagcaaaaagaattcaagccttattaaagttgccttagataccctggctgccttgctgaagagcaaaacaaatgctcgaagggcagtggacagaggatatgttcaggtactgcttacaatttatgtggactggcaccggcatgacaatcggcataggaacatgctgatccgtaaggggattctgcagtcactcaagagcgtgaccaacatcaaactaggacgaaaagcattcatcgatgctaatggtatgaaaatcttgtacaacaccagccagctacctgtgatccccgtcacagggcctgtggcccagctgtacagcctgccacccgaggtagacgatgtagtggatgaaagtgacgataatgacgatatagacgtcgaagcagagaatgagacagaaaacgaagatgatctggaccagaatttcaaaaacgatgatatcgaaaccgacatcaacaagctgaaaccgcaacaggaaccagggcggacaatcgaagatctgaagatgtatgaacacctcttccccgagctggtggatgacttccaggattacgatctaattagtaaagagccaaaaccatttgttttcgaaggaaaggtgcgcggcccgatcgttgtgccaactgccggcgaagaaacgagcggaaattcagggaatctacgcaaggtcgtcatgaaggagaatatatcgtccaagggagatgaaggagagaagaagtcaaccttcatggatcttgcaaaagaagacattaaagataacgataggacactccagcagcaaccgggcgatcagaatcgcacaatcagcagcgtccacggacttaataacgatatagttaaggctcttgatcgtatcactctccaaaacatcccctcacagaccgcccctgggtttactgcagagatgaagaaagattgcagtctgcctctgacagttcttacgtgtgctaaagcatgcccgcatatggccacttgtggcaacgtcctattcgaaggacgcactgttcaactgggaaagctgtgttgcacaggtgtggaaactgaggacgatgaagataccgagtccaactcatctgtggagcaagcatcagtggaagtaccggacggccctaccctgcacgacccggacctgtatatcgagattgtgaaaaacactaagagtgtgcctgaatattcagaagttgcttaccctgattacttcggccacattcctccaccgttcaaggagccaattttggagcgaccttacggggtacaaaggacgaaaatcgcccaggatatagaacgcctaattcatcagtccgatatcatagacagggtcgtctacgacctcgacaacccgaattacacgatccccgaggaaggagacatcctgaagtttaatagtaagttcgagagcggcaatctccggaaggtgattcaaattcgtaaaaatgaatatgacctgatcctgaactcggacattaactccaatcactaccaccaatggttttacttcgaggtgtctgggatgaggccgggagtggcctaccggtttaacatcatcaattgtgagaaatccaactctcaattcaattatggaatgcagcccctgatgtatagtgttcaggaggctttgaacgctcgcccgtggtggatccgaatggggaccgacatatgctattataaaaaccacttcagtcgctcaagcgttgctgctggggggcagaaggggaaaagctattacacaattacctttaccgtcaactttccacacaaagacgacgtgtgctacttcgcatatcactacccttatacctactctacattacagatgcatctgcaaaaacttgagtccgcccataacccacagcaaatctatttccgcaaggacgtactgtgcgagactctgtccgggaacagttgccctctggtcactataacagccatgccagagagtaattactacgagcacatttgccattttcgcaaccgcccttatgtcttcctgtccgcgcgcgtacatcccggagaaactaacgcaagctgggtcatgaaaggcaccctggagtacctaatgtccaataacccgaccgcccagtctctcagagagtcctatatttttaagatcgttcccatgcttaaccctgatggtgtgattaacggaaaccaccgctgctccctgagcggagaagatctgaatcggcaatggcagtcaccctctcctgacctgcacccgacaatttaccacgcaaagggattgcttcagtatctggccgcggtcaagagacttcctcttgtgtactgcgactatcatggccacagtcgcaagaaaaacgtgtttatgtacgggtgttcaattaaagagacagtgtggcataccaacgataatgcgacttcctgtgacgtcgtggaggataccggatatagaacgttgcctaaaattctttctcacatcgcaccggccttctgtatgagttcttgttctttcgtggtggaaaagtccaaagaatccactgctcgtgtagttgtgtggagggaaataggcgtgcaacgttcatacactatggagagtacactgtgtggatgtgaccagggaaaatacaaggggctccaaatcggaaccagggaattggaggagatgggagcaaagttttgcgtgggcctgttacgactaaagcgtttgactagtcccctagagtacaatctgccaagctccctgctcgattttgaaaatgatctgatcgagagttcctgcaaggtcaccagcccgacaacatatgtgcttgacgaagatgagcccaggtttctggaagaagtggactactcagctgaaagtaatgatgaactggatatcgagctggccgagaatgtaggcgattacgaaccatccgcgcaagaggaagttctctccgattcagagttatctcgcacctatctcccatag

SEQ ID NO: 179724 - DNA, 1932 bp, Artificial Sequence
  Description of Artificial Sequence: Synthetic coding sequence
atgaacgccagcaaggagagccccccccacgaggacctgatggtgcagatccattccattcttgccaagattggacctaaagccgtcaacagcgtaagtctcggtaagaacggagtagttgaactcatgtttaaaatcatcggaccttttagcaaaaagaactcctcgctcatcaaagtggcgctggatacactagctgcgttgctaaaatccaaaacgaatgccaggagagctgttgatagaggatacgtgcaggtgctgcttacaatctatgtagattggcatagacacgacaatagacaccgtaatatgttgataagaaagggcatcctgcagtccctgaagagtgtgaccaacattaaacttggcaggaaggcttttatagacgcaaatggaatgaagattctgtacaatacttcacaggaatgtctggcagtacggacactggatcccctggtcaacacctcgtcacttattatgcgcaaatgcttcccaaagaatagactgcccctgcccactatcaagtccagcttccacttccagctgcctgtgatccccgtgaccggacctgtggcccagctgtacagtctgccgcccgaagtggatgatgttgtagatgaaagcgacgataacgatgacattgatgtcgaagccgagaacgaaaccgaaaatgaagacgacctggaccagaacttcaaaaacgacgacattgagacggatattaataagttgaagcctcaacaagaaccaggtcggactatcgaagacctaaagatgtacgaacacctctttcctgagctggttgatgattttcaggactatgaccttatttccaaggaacctaagccattcgtattcgaggggaaggtacgaggacccatcgtggtccccacagctggtgaagagacttcaggaaactctggaaatctcagaaaggtggtcatgaaagagaacattagcagcaaaggcgacgaaggcgagaagaagtccacgttcatggaccttgcaaaggaggacattaaagataatgataggacacttcagcagcaaccaggagaccagaatcgcactatttcatctgtacatggactcaataacgatatcgtgaaggcactggaccggatcactctgcagaacatcccttcacagaccgcccccggtttcactgcagagatgaaaaaggactgctctctccctttaacagtactaacttgcgctaaggcttgtcctcacatggcaacatgtggaaatgttttgttcgaagggaggacagtacaactgggcaaactgtgctgtacgggtgtggagacagaggacgacgaggacacagaatccaacagctccgtagaacaagcgtctgtggaagtgcctgacggacccaccctgcacgaccccgatctgtacatcgaaatcgtcaaaaataccaagtctgtgccagagtattcagaagtcgcttatcccgactactttggccatatacccccccccttcaaggagcccatcctcgagagaccctatggggtgcaaaggactaagatcgcccaggacattgagcggctgattcaccagtctgatattatcgacagggtggtctacgacttggataatccaaattatactatcccagaagaaggagacattttaaaatttaacagtaagttcgaaagcggaaatctccgaaaggtaatccagatccgcaagaatgagtacgacctgattctcaactccgacataaatagcaaccactaccaccagtggttttactttgaagtgagcgggatgcgtcccggggtggcttataggtttaacattataaattgcgaaaaatcaaatagccaatttaattatgcccttccactcatgagctggatgaaaatgaaccttgactccctcaagaagctgatcaccgtccaaaaagtgatgatgtcctag

SEQ ID NO: 179725 - DNA, 1086 bp, Artificial Sequence
  Description of Artificial Sequence: Synthetic coding sequence
atggtgcacgccgaggccttcagccggcccctgagccggaacgaggtcgtgggcctcattttcaggctcaccattttcggcgccgtgacatattttacaattaaatggatggtggacgctatagatcctacaagaaagcagaaagtggaagcccagaagcaggccgagaagttgatgaaacagatcggagtgaagaacgtgaagctatctgagtacgaaatgtcaatcgccgctcatcttgtcgacccactgaacatgcacgtcacttggtccgatatcgccggcctggacgatgttatcacggaccttaaggacactgttattctgcctattaaaaaaaagcatctgtttgagaattcccgcctcctccagcctcctaagggagtgctcttgtacggcccccccggctgcgggaaaaccttgatcgctaaggctacggcaaaagaggctgggtgtagatttataaaccttcagccaagtaccctgacagataagtggtatggcgagtcacaaaaactggccgcggctgttttcagcctcgctattaagttacagccatcaataatcttcatcgacgagattgatagtttcctcagaaaccgttctagttcggaccatgaggcaacagccatgatgaaagctcaattcatgagtctgtgggacggactggatactgaccacagttgtcaggtgattgtaatgggcgctacaaaccggccgcaggacctcgactctgccataatgcggcgtatgcctaccaggttccacattaaccaacctgcacttaagcagcgcgaggctatcctgaaactgattctcaagaacgaaaacgtcgaccgccatgtggatctgctggaggttgctcaagaaaccgacggattttcgggctctgatttaaaagagatgtgcagagatgccgcattactatgtgtgcgcgaatatgtgaacagcacgtccgaagaaagtcacgatgaggatgaaatccgtcctgtacaacagcaggacttgcaccgcgccatcgaaaaaatgaaaaaatccaaggacgctgcctttcagaatgtgcttacacacgtatgtcttgattag

SEQ ID NO: 179726 - DNA, 1086 bp, Artificial Sequence
  Description of Artificial Sequence: Synthetic coding sequence
atggtgcacgccgaggccttcagccggcccctgagccggaacgaggtcgttggcttgatttttcgccttactattttcggggccgtaacctattttaccattaaatggatggtggacgctatagaccccaccaggaagcagaaagtggaggcccagaagcaggcagagaaactgatgaaacagattggagtcaagaacgtcaagctctctgagtatgagatgtcaattgcggcgcatctagtcgatcccttgaatatgcacgtaacctggagtgacattgcaggtctagatgacgtgatcaccgatctcaaggataccgttatcctccctattaaaaagaaacacctttttgaaaactctcggcttcttcagcccccgaaaggtgttctgctatacgggcctccgggctgcggtaagacactgatcgccaaggctacagccaaggaagctggctgcaggtttataaatctgcaaccttcaactctgactgacaaatggtatggggagtcccaaaaactggcagccgcagtcttttccctcgctattaagctacaaccctccattatttttattgatgagatagatagcttcttacgaaacaggtcatcctccgaccacgaagcgacagccatgatgaaggcacagttcatgtctctgtgggatggcctcgacaccgaccacagttgtcaagtgatagtcatgggagccactaatcgccctcaggacctcgattccgccattatgagaagaatgcccacaaggttccacatcaaccagcccgcgctgaagcagcgagaggctatcctgaagcttatcctgaagaatgagaatgttgataggcacgtggatctgctggaggtggcccaggagacagacggtttttccgggtctgaccttaaagagatgtgccgggacgccgccctcctgtgtgttagagaatacgtgaactcaacttcagaggagtcccatgatgaagatgaaattaggcccgtgcaacagcaggacctacatcgagctattgaaaaaatgaaaaagagcaaagatgccgcatttcagaacgtccttactcatgtgtgcctagactag

SEQ ID NO: 179727 - DNA, 822 bp, Artificial Sequence
  Description of Artificial Sequence: Synthetic coding sequence
atgaagcagatcggcgtgaagaacgtgaagctgagcgagtacgagatgagtattgcagcccacctggtcgatcccctaaatatgcacgttacttggtccgacattgccggcctcgatgatgtcatcaccgacctaaaggacaccgttattctgccaattaaaaagaaacacttatttgagaacagtcgccttcttcaaccccccaaaggtgtgctgctttacgggcctcccggctgcggcaagaccttgattgccaaagcaacagcgaaagaggcaggctgccgcttcattaatctgcagcccagcacccttacagacaagtggtacggtgagtctcagaagctggccgccgctgtcttctctttggcaattaaacttcaaccctctattatcttcatcgacgaaattgacagctttctgcgtaaccgctcatcaagtgaccatgaggccacagcaatgatgaaagcacagttcatgagcctgtgggatggcctggataccgatcacagctgccaagcactgaaacaacgagaggccattctcaaattaattctgaaaaacgaaaacgtcgatcggcacgtggatctgctagaggtcgcccaggagaccgatggctttagcggatctgacctcaaggaaatgtgccgagatgccgctttgttgtgcgtccgcgaatatgtgaattctacctccgaagagagccacgacgaggacgagataaggcctgttcaacagcaggacttgcaccgcgccattgagaagatgaaaaagagtaaggatgctgcttttcaaaacgttctaacccacgtgtgcctcgattag

SEQ ID NO: 179728 - DNA, 864 bp, Artificial Sequence
  Description of Artificial Sequence: Synthetic coding sequence
atggtgcacgccgaggccttcagccggcccctgagccggaacgaggtggtgggtctcattttcagactgaccattttcggtgctgtaacatattttacaattaagtggatggtagatgccatcgaccccacaagaaaacagaaagtggaagctcagaagcaggccgagaaactcatgaaacagattggcgttaagaatgtcaagctctccgagtacgagatgtctattgcagctcacctggtggatccccttaatatgcacgtgacatggtctgatatcgccggtctggatgatgtgatcacggaccttaaagacacggtgattttgcctattaagaagaaacacctctttgaaaactcccgtctgttacagccgcccaagggtgtgctgctttacggaccgcctgggtgtggaaagacactgattgccaaagctactgccaaggaggcggggtgcagatttatcaacctccaaccctctactctaaccgacaaatggtatggggagtcccagaagctcgcagctgccgtattttctctggccattaagcttcagccaagcataatttttattgatgaaatagatagcttcctgaggaatcggtcaagcagtgaccatgaagccactgccatgatgaaagctcagtttatgtccctttgggatggtctggatacagaccatagttgccaggttattgttatgggtgccacaaataggccccaggatctggattcagccataatgagacggatgcccacacgtttccacattaatcagcccgcattgaagcagcgggaggcgattctgaaactgatcttgaagaatgagaacctccgaaagttgaagcctcgagaggtgctttag

SEQ ID NO: 179729 - DNA, 4173 bp, Artificial Sequence
  Description of Artificial Sequence: Synthetic coding sequence
atggtggtgctgcggagcagcctggagctgcacaaccacagcgccgctagtgcaacaggatcacttgatctgagctccgacttcctctccttggagcatatcggtaggagacgtctgcgttccgctggcgctgctcagaagaaacccgcggccaccacagccaaggcaggagacgggtcttccgtcaaggaggtggagacttatcaccggactcgggctctgaggtccctccgaaaggatgctcagaactcctctgactcaagtttcgagaaaaacgttgagattactgaacagctggctaacggacggcattttactaggcagctcgcacgtcagcaggccgacaagaaaaaggaagagcatcgggaggataaagtgattcccgtgacacggagccttagggcacgaaacattgttcaaagtacagagcacctccatgaggataacggcgatgtggaggtgcgtcgcagctgcagaatccgatcccggtatagcggggtaaatcagagcatgctctttgacaagcttataacaaacaccgcggaggccgtactgcagaagatggacgacatgaagaagatgaggcggcaaagaatgagggagctcgaagatttaggggtgttcaacgaaacagaagagagcaatcttaatatgtatacacgcgggaagcaaaaagacattcagcggacggatgaagaaactactgataaccaggagggctccgtcgagagctcagaagagggcgaggaccaagagcacgaagatgacggagaggacgaagatgatgaggacgatgatgatgacgacgatgatgacgacgacgacgatgatgaagatgatgaggacgaggaagatggcgaggaggaaaatcagaaaagatactacctcaggcagcgcaaggctaccgtgtattatcaggcccctcttgagaagcccagacaccagcgaaagccgaacatattctactctggaccggctagcccagccagacctaggtacaggttgtcaagtgccggccctcgttctccatattgcaagcgaatgaaccgcaggcgccacgccatacatagttccgacagtacttcctcaagtagctccgaagacgaacagcacttcgagcgacggaggaagagaagcaggaacagagcaatcaaccgctgtctcccgttaaattttcggaaggacgaactcaagggcatatacaaggatcgcatgaagattggggcttctctggctgacgtggaccccatgcaactggatagctctgtccggtttgacagcgtggggggcctgtcgaatcacattgccgcgttaaaggaaatggttgtgttcccattgctgtatccagaagtctttgagaaatttaagatacaaccccctcgcggatgcctgttttacggacctcccggtactgggaagacccttgttgcaagagccctggcaaacgaatgctctcagggagacaaaagggttgcttttttcatgagaaaaggcgcggattgtctgtccaagtgggtaggagaatccgagcggcaactgcgcctgttgttcgaccaggcttaccagatgcggccgagcatcatctttttcgatgaaatcgacgggctcgccccagtgcgctcatctcgccaggatcagatccatagcagcattgtgtcaaccttgttggcacttatggatggtttagatagcaggggtgaaatcgtagtaatcggcgctaccaatagactggatagcattgatccagccctcaggagaccgggccgattcgaccgggagttccttttctcacttcccgacaaagaagctagaaaggaaatactgaagattcacacaagagattggaacccgaagcctcttgatacttttctggaggagctggccgagaattgcgtagggtactgtggcgcagacatcaaatcgatctgtgccgaggccgcactatgcgccttgcgcagacgctatccccagatttacacaacctctgagaaacttcagctagatctgagctcgataaatatttccgccaaggatttcgaggttgccatgcagaaaatgattccagccagccagagggccgtcaccagtcctgggcaggcccttagtacggtggtgaagcccctactgcaaaataccgtcgataagattctcgaggcgcttcagcgggttttcccccatgccgaatttaggaccaataaaacccttgattcggatatctcctgtccgctgttggaaagcgatcttgcgtacagcgacgacgacgttcctagcgtttacgagaatgggctgtcacagaagtccagtcacaaagctaaagacaatttcaacttcctccatctgaaccggaatgcctgctaccagccaatgagcttccgacctaggattttaatcgttggggaacctgggttcggacaagggtctcacctagccccggccgtgatccacgcccttgagaagttcactgtgtacaccctcgatatccctgttctctttggggttagtactacgtcacccgaagagacatgcgcccaggtcatccgcgaagccaaacggactgcaccgagcatcgtatacgtgcctcatatacacgtgtggtgggaaattgtggggcctaccctgaaagctactttcacgaccctcctccagaatattccctcttttgcaccggtgttgctcctggcgacgtcagataagcctcacagtgcactccccgaggaagtccaggagctatttatcagagattatggcgagattttcaatgtgcagctgcccgataaggaggagaggacgaaattttttgaggacttgatacttaagcaggccgcaaaacccccaattagcaaaaagaaggcagtcctgcaagcgcttgaggtgctccctgtagctccccctccggaaccaagatcactaaccgctgaggaagtaaagagacttgaagaacaggaagaagacacatttcgggagctccgaatctttctgagaaatgtgactcaccgcctcgcaattgacaagcgcttcagagtctttaccaaacccgtggaccccgatgaggtccctgactatgttaccgtgataaaacaaccaatggatctgagctcagtcatcagcaagattgacctccataaataccttactgtcaaagattacctgagggatatcgacctcatctgcagcaatgcgcttgaatacaaccctgaccgagatcctggagatagactcattcgccatcgcgcctgcgccctccgggacaccgcctacgcaattatcaaagaggagctggatgaagacttcgagcaattatgtgaggaaatccaggagtcaaggaaaaagcgcggctgtagttcctcaaaatacgccccgtcttattaccacgttatgcccaaacagaactccacattagtcggcgataaacggtctgaccctgagcagaatgagaagcttaagacgccttccacgcctgtcgcttgttccaccccagcccagctcaaacgcaaaatccgtaagaaaagcaactggtacctgggaaccatcaaaaagaggcgtaagatctcccaggctaaagatgacagccagaacgccatcgaccataagattgagtccgacaccgaggaaactcaggatacctccgtggaccacaatgagactgggaacaccggagagtccagtgttgaggagaacgaaaaacagcagaacgcctctgaatcaaagttggaactacgcaataacagcaatacttgcaatattgagaacgaattggaagacagtcgtaaaaccactgcatgcactgagctgagagataaaatcgcctgcaatggcgatgcctctagttcccagataatccacattagcgatgagaacgagggtaaggaaatgtgcgttttgcgtatgacaagagcacgccggtctcaagtggagcagcaacagttgatcactgtggagaaggcgctagctatactgagtcaacctaccccaagcttagtggtagaccacgagagattgaagaaccttctgaagactgtagtgaagaagagccagaattacaacatcttccagctcgagaacctctacgccgtgatttcccagtgtatttatagacaccgaaaggaccacgacaagacaagtctgatccaaaagatggaacaggaagtcgagaacttcagttgctcacggtag

SEQ ID NO: 179730 - DNA, 1719 bp, Artificial Sequence
  Description of Artificial Sequence: Synthetic coding sequence
tgaggcgccctggccctggccgccccccggcggtgccggcagcccctaccaggccgcgattgcgcaccaggcgctccaccagccggggccgtgtcgagggccgggcgcattggactcttcccctcgccagtgtgtacctccgcagcagttcgtagcgggtctgggtatgctaaagacgcactaaacctggcccagatgcaggaacaaacattgcaactggagcagcagtcaaagctgaaggagtatgaggctgccgtggagcagctgaaatctgaacaaattagggcccaagctgaggagcgacggaagaccctgtccgaggagacccggcagcaccaggctcgggcacagtatcaggataagctggcccgccaacgttatgaggaccagctcaagcagcaacaactcctgaacgaggagaatctgcggaaacaggaggaaagcgtgcagaaacaggaggccatgagacgagctaccgttgaaagggaaatggaacttaggcacaagaacgaaatgctgcgggtggaagctgaagctagagcaagagctaaagccgagcgggagaatgccgatattattcgcgagcagattcgattaaaagctgccgaacacagacagactgtcttggagagcattaggacagcaggtactctgttcggcgagggatttagggcttttgtaacagattgggataaggttactgctaccgtcgctggactcactttactcgcggtcggggtgtactctgcaaaaaacgcgacactggttgctggccggttcattgaggccaggctcggcaagccttccttggttagagaaacctcccgcatcacagtgctggaggcactccggcatccaattcaggtgagtcggaggctgctgagccgcccacaagatgctctcgagggagtagtcctttctccatctcttgaagcccgcgtccgtgatattgccattgcgactagaaacacaaaaaagaaccggtcactgtaccgcaacatactgatgtatggcccccctggcacgggcaaaacactgtttgccaaaaagcttgccctgcacagcggaatggactatgcgatcatgaccggaggtgatgtggctcccatgggcagagagggcgtgaccgccatgcataaacttttcgactgggctaatacttcgcggaggggcctcctactgtttgtggatgaggccgatgcattcctgcgaaaaagagctacggaaaagatctcggaggaccttcgtgccaccctaaacgcattcctgtaccgtacaggacaacactccaacaaatttatgctagttctggcctccaaccagcctgagcaattcgattgggcaattaatgacagaattaatgaaatggtgcatttcgacttgcctggacaggaagaacgtgaaaggctggtgcgcatgtactttgataaatatgtcctaaagccagccactgaagggaagcagcggctcaagttggctcagttcgactacggacgtaaatgcagcgaggtggctagacttacagaggggatgtcaggcagggaaattgcccagctggcagtgtcctggcaagctacagcatacgcatcagaagatggcgtgctgaccgaggcaatgatggacactcgcgttcaggatgcggtacagcaacatcagcagaaaatgtgttggttgaaagccgaagggcccggcaggggcgatgaacctagccctagctag

SEQ ID NO: 179731 - DNA, 1905 bp, Artificial Sequence
  Description of Artificial Sequence: Synthetic coding sequence
atgagctggctgttcggcatcaacaagggccccaagggcgagggcgctggcccacctccccccctgccccccgcccagccaggcgccgagggtggtggggacagaggactgggtgatagacccgctcctaaagataaatggtcaaactttgatcctactggactggagcgagctgcaaaggctgcacgcgaactggaacactcacgctacgccaaggatgccctcaatctggcacaaatgcaggagcagactttgcagttagagcagcagagtaagctcaaaatgagactggaggcactgagtctgctgcatacactggtttgggcctggagtttgtgtcgggcaggagccgtgcaaactcaggaacgcttgtctggaagcgcctcacctgagcaggtccccgccggggagtgttgtgctctgcaggagtacgaagctgccgtggaacagctgaaatctgagcagattagggcccaggcagaggaaaggcgtaaaaccctctcagaagaaacccggcagcatcaggccagagcccaataccaggataagttagcgcgccagcgctatgaggatcagttgaaacaacagcagctcctgaatgaggaaaaccttcgcaaacaggaggagtctgtccagaagcaagaagctatgcgacgcgcgaccgtggagagagagatggaactgcgccacaagaatgagatgcttcgcgtagaagctgaagcgcgagccagagctaaggccgagcgagagaatgctgacattatccgggagcagatcaggctgaaagccgcagagcatcgccaaactgtcctggagtccatacgtacagccggaaccctgtttggagaaggatttagggccttcgtgacagattgggataaggttaccgccaccgtcgcaggcctgactctcctagccgttggggtctactccgcaaagaacgccactctcgtggccggcagatttatagaagcacgcctggggaagccctccctagttagagagacgtctcgcatcaccgtgctggaggctttgaggcatccaattcaggtatcccggagactgttgtcgcgacctcaggatgctttggagggtgttgttctttctccatctctcgaggctcgcgtcagggacatcgccatcgcgacccgcaacacaaagaagaaccggtcactgtaccgcaacattttgatgtacggaccgcctggcaccggcaagacgctgtttgcaaaaaaactagccctacacagtggaatggattatgctatcatgacaggtggcgacgtcgcgccaatgggtcgcgagggagttactgccatgcacaagctgttcgattgggcaaacacctcccggaggggccttctgcttttcgtggatgaggcagatgcttttctgagaaaaagggccacggagaagatctcagaggatctgcgtgcaaccctgaacgcctttctgtaccggacaggccagcactcgaacaaattcatgctggtgttagccagcaaccagcctgagcagttcgactgggccatcaatgatcgaattaacgaaatggtgcacttcgatcttcccggccaggaggagcgggagaggttagtgcgcatgtatttcgacaaatatgtcctgaaacccgcaactgaaggaaaacaacggctgaaattggcccaattcgactatgggcgcaaatgcagcgaggtggctcggctgaccgagggcatgtcaggtagggaaattgcacaactagccgtgagttggcaggccacagcttacgcttcggaggatggcgtcctgactgaggcaatgatggacacacgcgtgcaggatgcagtgcaacagcatcagcagaagatgtgttggcttaaggccgaaggaccagggcggggtgatgagccgtcaccctcttag

SEQ ID NO: 179732 - DNA, 1761 bp, Artificial Sequence
  Description of Artificial Sequence: Synthetic coding sequence
atgagctggctgttcggcatcaacaagggccccaagggcgagggcgcagggccaccgcctccgttaccccccgctcagccaggagccgagggtggaggagaccgcggcctgggtgaccggccagcccccaaagataagtggtctaattttgacccgaccggactagaaagagctgcaaaggctgcgcgagagctcgagcactctagatacgcaaaggatgccctaaatcttgcccagatgcaggagcagacactgcagttggagcagcagagcaagcttaaggagtatgaggccgctgtcgagcaacttaagtcggaacagatcagagcacaagctgaggagcgccggaagaccctatcagaggaaacgcgccagcaccaggcccgtgcccagtatcaggataaattagcccgccagagatatgaggaccagctgaaacagcaacagctgctcaacgaggagaacctcagaaagcaggaagaatcagtgcagaagcaggaggctatgcgccgagcgacggttgagagggaaatggagctccgacataaaaatgagatgcttcgcgtggaggctgaggctcgcgcccgggccaaagccgagcgtgagaacgccgacatcatccgtgaacaaatccgtctcaaagcggctgaacacaggcaaactgttttggaaagtatccgaacagctgggaccctgttcggggagggcttcagggccttcgtcacagactgggataaagtgaccgccacggtggctggcttgacgctgctcgcggtcggggtctatagtgcaaagaatgccactttggttgccggccgcttcattgaagctcgtctgggtaaaccgagcttagtgcgcgaaacatccagaatcacagtccttgaggcactgcggcaccctatacaagtctcccggcgactcctcagtagaccccaggatgccctggaaggagtagtcctgtcacctagcctagaggctagagtgcgagatatcgcaattgctacacgcaacaccaagaagaacagaagcctgtatagaaacattctgatgtacggcccaccagggaccggtaagaccctgttcgcgaaaaaacttgccctccatagcggaatggattacgcgattatgactggcggcgatgtggctcccatgggcagagagggagtgacagcaatgcataagttgttcgattgggcaaacacgtctcgccgggggttgctgcttttcgtggatgaggccgacgccttcctcagaaaaagggctaccgagaagatctcagaagatttaagggcgacgttgaacgcattcctgtaccgcacaggccagcattcaaataaatttatgctggtcctcgctagcaaccaaccagaacagtttgactgggccataaatgaccgcattaacgaaatggtccatttcgacctgcccggacaggaggagagagaaagactcgtgagaatgtatttcgacaaatacgtgctgaagccggctactgagggaaagcagagactgaagttagcccagttcgattacgggcggaaatgctctgaagtggccaggttgaccgagggaatgagcgggagggaaatagctcaactagcggtcagctggcaggcaacagcctacgcaagcgaggacggcgtactgactgaagctatgatggacacaagggtgcaggacgccgtccagcaacatcagcaaaaaatgtgttggttgaaagctgagggaccgggacgcggcgatgagccttccccaagctag

SEQ ID NO: 179733 - DNA, 792 bp, Artificial Sequence
  Description of Artificial Sequence: Synthetic coding sequence
atgtacggcccccccggcaccggcaagaccctgttcgccaagaagctggcactgcattcgggaatggattatgccataatgaccgggggagacgtcgccccaatgggacgggagggggtgaccgccatgcacaagcttttcgattgggcaaacacttcacgccgcggcctgctattgtttgtggatgaggccgatgccttcttgcgaaagagggctacggagaagatttccgaggatctgcgtgccactttaaatgcctttttataccggaccggacagcacagcaacaacccttcacacgtgtcacacggcggatcctctccggctggtcgtccctggctgacaccgcaggcaagatgggctccgcggtttatgttagtgctggccagcaatcagcccgaacaattcgattgggctattaatgatagaattaacgaaatggtgcacttcgaccttccagggcaggaagagcgagagcgtctggtgcggatgtacttcgacaagtatgttctgaaacccgccaccgagggcaaacagagattgaaactcgcacagtttgactatgggaggaaatgtagcgaggtggccaggctcacagaagggatgtccggcagggagattgctcaactggcagtttcctggcaagcgaccgcctacgcttccgaagacggcgtgttgacagaggcaatgatggatactagagtgcaggacgctgtgcaacaacaccagcagaaaatgtgctggttaaaagcagagggaccaggccgaggagatgagccgagtccatcttag

SEQ ID NO: 179734 - DNA, 606 bp, Artificial Sequence
  Description of Artificial Sequence: Synthetic coding sequence
aagctggccctgcacagcggcatggactacgccatcatgaccggcggtgatgtggcccccatgggccgggagggcgtcaccgctatgcataagctcttcgactgggctaatacctctcggagagggctgctgctcttcgtggacgaggccgacgccttcctgaggaagcgtgcaaccgagaaaatatccgaggacctcagagcgaccctgaacgccttcttataccgcacagggcagcatagcaacaatccgtcccatgtgtcacatggcgggagcagcccagccgggaggccatggctgacaccacaggctaggtgggccccgcgattcatgctcgtacttgcctccaaccagcccgaacagttcgattgggccattaatgaccgcatcaacgaaatggtccactttgacctgcccggccaggaggaacgggaaaggctggttagaatgtatttcgataaatacgtgctcaaacctgccactgaggggaagcagagactcaagctggctcagttcgactacgggagaaagtgcagtgaagtggcaaggctgactgagggcatgtctggcagagagatcgctcagctcgcagtatcttggcagtag

SEQ ID NO: 179735 - DNA, 435 bp, Artificial Sequence
  Description of Artificial Sequence: Synthetic coding sequence
atgtgcctgtgccggcccctgctgccccagcgggcccagtaccaggacaaactagctaggcagcgatacgaagatcagctgaaacagcaacagctcttgaacgaggagaacctacggaagcaagaagaatccgtccagaagcaagaggccatgcgtagagccaccgtggagcgcgagatggaactgcggcataaaaatgagatgttgcgagtggaggctgaagcaagggctcgggccaaagctgagagagaaaatgcagacataatcagagaacaaatccgactgaaggcagctgaacacagacagacagtgctagagagcattcggaccgcggggacactcttcggcgaaggatttcgggcatttgtcacggactgggacaaggtaacagcaaccgtggctggcttgacattgctcgctgtcggcgtgtactag

SEQ ID NO: 179736 - DNA, 309 bp, Artificial Sequence
  Description of Artificial Sequence: Synthetic coding sequence
atgcggctggaggccctgagcctgctgcacaccctggtgtgggcctggtcgctgtgtagggcaggtgctgttcagacccaagaaagactgtccgggagtgcctcccctgagcaggtgcctgccggagagtgctgcgcccttcaagagtatgaggccgctgtggaacagctgaaaagcgaacagatccgtgcgcaggccgaggagagacggaaaaccttgagtgaggaaactaggcaacaccaagcccgcgcccagtaccaggataagctcgcccggcagaggtatgaggaccagctgaagcagcagtag

SEQ ID NO: 179737 - DNA, 1524 bp, Artificial Sequence
  Description of Artificial Sequence: Synthetic coding sequence
atgcaggagcagaccctgcagctggagcagcagagcaagctgaaggaatacgaagccgcagtggaacagctgaagtctgaacaaataagagcacaagcagaagaaaggagaaaaaccctcagtgaggaaaccagacaacaccaggcccgtgctcagtaccaggacaaactagctcggcagcgatatgaggaccagcttaaacaacaacaactgctgaatgaggagaacctaaggaagcaggaggaatcagtgcagaagcaggaggccatgcggagggctaccgtggaaagagagatggaattgcgtcacaagaacgaaatgctgcgcgttgaggccgaggcccgagccagagcaaaagcagagcgagagaatgcagatatcatacgggagcagatcaggttaaaagccgcagaacacaggcagactgtgctggagtcaatccggacagctggaaccctttttggagagggattccgggcctttgtcacagactgggataaggtcactgcaacagtggctgggctgaccctcttggccgtaggagtatatagcgcgaaaaacgccacactagttgccggacgatttattgaggcccgcctcggaaagccatctctggttagagaaacctccaggatcaccgtgctagaagctctcaggcaccctatccaggtcagtaggcggctgctgagccgtccacaggacgccctggaaggcgtcgtgttatctccctctttggaggcccgggtacgagatatcgcaatcgcaacaagaaataccaagaagaaccggagtctgtacaggaatattctgatgtacggaccccccggaactggcaagactctctttgccaaaaagctggcactgcattccggaatggattatgctatcatgaccggcggagatgtggcccctatgggtcgtgagggggtgaccgcaatgcataagttatttgactgggctaacacttctcggagaggactgttgttgttcgtggacgaggccgatgctttcctgagaaaaagggccaccgagaaaatttcagaggatttgagggccaccctgaacgcttttctgtaccgtaccggacagcactctaacaaatttatgctggttctggcatcgaaccagccggaacaattcgactgggccattaacgataggattaacgaaatggtccattttgatctgcccggtcaggaggagagggaaagactggttagaatgtattttgacaagtacgtcctgaaaccagctacagagggcaagcagagactcaagctggctcagttcgattacggacgcaaatgttcggaggtggcacgactcacagagggaatgagtggccgggaaattgcccagctagcagtgtcttggcaggctacggcctatgcctctgaagatggcgtcctcacagaagctatgatggatactcgggtccaggatgccgtgcagcaacaccagcaaaaaatgtgctggctcaaagctgaaggaccagggagaggcgatgaaccatcccctagctag

SEQ ID NO: 179738 - DNA, 1947 bp, Artificial Sequence
  Description of Artificial Sequence: Synthetic coding sequence
atgagctggctgttcggcgtgaacaagggccccaagggcgagggcgccggacccccaccaccgctcccaccagcccaacccggggcagagggcggcggcgatagaggcctgggcgataggccagctcccaaggataaatggtctaacttcgatcccaccggactcgaacgagctgccaaggctgctcgggaactcgagcatagccgatatgccaaggaagcactgaatctggcgcagatgcaggaacagaccctccagctagagcaacagagtaaactcaaagagtacgaagctgcagtggagcagctgaaatccgagcagattagagcgcaggcggaagagcggcgtaaaactttgtctgaagagacacgacagcaccaagctcgcgcccaatatcaggacaaactggcacgacaaaggtatgaagatcagctcaaacagcagcaattactcaacgaggaaaacctgcggaagcaggaagagtccgtccagaaacaagaggcaatgcgccgggcaaccgtggagcgagaaatggagctccgacacaagaatgagatgcttagggtggagacagaggcccgggcgcgcgctaaagcagagagggaaaacgccgatatcatcagggagcagatcagactaaaggcatctgagcaccgacaaacggttctcgaaagtattcgtaccgccggcacactgtttggagagggttttcgagcatttgtcacagatagagacaaggtgactgcgactgtggctggactcacgctgctagctgtgggggtttacagtgcgaaaaatgcaacagctgtcactgggcggttcatcgaggccaggctgggaaagccgtccctcgtgagggagacatcccggatcaccgtgctggaggctctgaggcacccgatccaagtaagccgcaggctcctgtctagaccccaggacgtgctggaaggcgtagtgctgagtccctcactcgaggctagggtacgagacattgccattgcaacaaggaacactaagaaaaacagaggcctgtatcgacacattctattgtatggccctcctgggacaggcaaaacactgtttgcaaagaaactcgctttgcatagcggcatggactatgccattatgaccggtggagatgtcgctcccatgggacgggagggtgtaaccgctatgcataagctgtttgactgggctaatacgtctagacgaggcttgctgctcttcatggacgaggccgatgcattcttaagaaaaagagctactgaggaaatcagtaaagacctcagggcgaccctaaatgccttcttgtatcacatgggccagcactcaaataagttcatgctggtcttagcgtctaacttgcctgaacaatttgattgcgcaatcaatagcagaatcgacgtcatggtgcacttcgacctaccgcagcaggaggagcgagagcggttagtcaggttacacttcgataattgtgtcctgaaacccgccaccgaaggaaaacgcagactaaaactggcccagtttgactatggacggaagtgtagtgaagtggccaggctgacggagggcatgagtggacgggaaatcgctcagctggccgtgagttggcaggccacagcgtacgcctccaaagatggagtgcttaccgaagcaatgatggatgcctgtgtgcaggacgctgtccagcagtacaggcagaaaatgcgatggttaaaagctgagggtcctggaagaggagtggaacaccctttgagtggtgttcagggggagaccctcacaagttggagcctagctacagatcccagttacccatgcttggccgggccgtgcactttcaggatttgcagctggatgggcactggactatgcccaggtcccttgtctcctagaatgagctgtggagggggtcggcccttttgtcccccggggcacccacttctgtag

SEQ ID NO: 179739 - DNA, 900 bp, Artificial Sequence
  Description of Artificial Sequence: Synthetic coding sequence
atgagctggctgttcggcgtgaacaagggccccaagggcgagggcgcaggtccaccgccaccattgccccccgcccaacccggcgccgaaggcggcggtgatcgcggtctcggtgaccgtcctgctcccaaagacaaatggtcaaattttgatcctacaggcctcgagcgtgccgctaaagcggccagagaactggagcactctaggtatgcgaaagaagctctcaatttggcacagatgcaggagcagacactgcagttggaacaacagagcaaactaaagcagttgctcaacgaggagaatctgcgcaaacaggaggagagcgtgcagaaacaccggcaaaccgtccttgaatcaattcgaactgctgggaccttatttggggagggtttccgagctttcgtgactgatagagataaggtgacagcaacggttgccggattgaccttgcttgctgtaggggtgtactccgccaagaacgccacagctgtgaccggaaggttcatcgaagccagactggggaagcccagtcttgtacgagagacttctaggatcaccgtcttagaggcactgagacacccaatacagcaggtatcaaggcgcctgctttcacgaccccaggatgttctggaaggggtggtcttgtccccttccctcgaggcgcgggttcgggatatagcgatcgctacgcgcaatactaagaaaaacaggggactttatcgccatatactcttatatggtcccccgggaaccggcaagactctgttcgccaagaaacttgctctgcatagtgggatggattatgcgataatgactggcggagacgttgcacccatgggacgcgaaggcgtgacggccatgcacaagctgtttgactgggctaacacttccagacggtag

SEQ ID NO: 179740 - DNA, 351 bp, Artificial Sequence
  Description of Artificial Sequence: Synthetic coding sequence
atgcggcgggccaccgtggagcgggagatggagctgcggcacaagaatgaaatgctgagagtcgaaacagaggccagggcccgcgccaaagcggagcgagagaatgcggacattatcagggaacagatcagattgaaggcctcagaacatcgtcaaaccgtgctggaatccatccgcaccgcaggtaccttgttcggcgaggggttccgggcctttgtaaccgatagagacaaagtgaccgccactgtcaatatcttcattaaacaggggtggcaagttgcggagcgccagcacttcaggcggcgcaggtgggctgaccacgaggttcggcggtcgcgctcgagctggtag

SEQ ID NO: 179741 - DNA, 1449 bp, Artificial Sequence
  Description of Artificial Sequence: Synthetic coding sequence
atgctgcgggtggagaccgaggcccgggcccgggccaaggccgagagagagaacgcggatattatcagagagcaaattcggctgaaggcgagcgaacaccggcagaccgtgttggagagtatccgcactgcagggactctgttcggggaagggttccgagctttcgttactgatcgggacaaggtcaccgcaaccgttgccgggctaaccctcctggcagtcggggtatattctgcaaaaaatgctactgcagtcacaggtcggttcattgaggcccgcctcggcaagccaagcctggtgcgtgaaacatccagaattaccgtacttgaggcgttgagacaccccattcaggtttcccgccggctgctctcgcgccctcaggacgtcctggagggcgtggttctctcagtgtcccccagcctggaggcgcgtgtgagagatattgctattgcgacgcgcaacacaaagaagaacagaggcctataccgacatatcctcctgtatggaccgccaggcaccggcaagacactcttcgctaaaaaactagccctccattcgggaatggactatgctataatgactgggggtgacgtggctccaatgggacgcgagggtgtgacagcaatgcataagctctttgactgggcaaatactagccgacgggggctacaggaagagatctccaaagacctgagagccacactgaatgctttcctttaccacatgggccaacactccaataaccgttttatgctggtcctggcctctaatttacctgagcagttcgactgcgccatcaacagtcggattgatgtcatggtgcacttcgatctccctcagcaggaggagcgcgagcgcctcgtacgattacacttcgataactgtgttctgaagcccgctacagaaggcaagaggatgggcgtcggccagctgccggtcttcagaccccccccccatggcgtgggttccgctgctttggccgccagcttgggtaattcatttccaaggcgattaaagttagcccagtttgactacgggcgcaagtgcagcgaggtggcccgactcaccgagggtatgtccgggagggaaatcgcccagttggccgtcagttggcaggctacagcctacgcgtcgaaagatggagtcctaactgaagctatgatggatgcctgtgtccaagacgcagtccagcaatacaggcagaagatgcggtggctcaaagctgaaggcccaggtcggggcgtcgaacaccctctgagcggggtacagggtgagacgctgacgagttggagtctcgccacagatcccagctacccatgcctcgctggcccttgcacttttcggatctgctcctggatggggaccggactctgtccaggaccactatcgcctaggatgtcctgcggcggggggcgcccattttgccccccgggtcatcccctactctag

SEQ ID NO: 179742 - DNA, 354 bp, Artificial Sequence
  Description of Artificial Sequence: Synthetic coding sequence
atgcggcgggccaccgtggagcgggagatggagctgcggcacaagaatgaaatgttaagggtggaaactgaagcaagggccagagcgaaggcagagcgagaaaacgcagatattattcgggagcaaattcggctaaaggcgtcggaacatcggcagaccgtattagagtctatacgcacagccggaaccttgtttggggaggggtttcgggccttcgtgaccgatcgtgataaagtgactgcgactgtcaatattttcattaagcagggctggcaggtcgcagaaaggcagcaccatttcagacgccgccggtgggcagatcacgaggtccgccgctcccgttcatcctggtag

SEQ ID NO: 179743 - DNA, 5535 bp, Artificial Sequence
  Description of Artificial Sequence: Synthetic coding sequence
atggtgggcgtgctggccatggccgccgccgccgcccccccccccgtcaaggactgtgaaatcgaaccgtgtaagaagcgaaagaaggatgatgacacctccacatgcaagactattaccaagtacctaagcccactcggcaagactcgagacagggtgttcgcaccacccaagccgtccaatatcctcgactattttaggaaaacctccccaacaaacgagaagacccaactaggaaaggaatgcaagatcaaaagccctgaatccgtgccagtggatagcaacaaagattgtaccacacctttggaaatgtttagcaatgtcgaattcaagaaaaaacgtaaacgcgtgaacttaagccaccagctgaacaacatcaaaacagaaaatgaagcgccaattgaaatcagttccgatgactcaaaggaagactacagcctgaataatgacttcgtcgaatcttctaccagcgtgctgcgctacaagaaacaagtcgaggtcctggctgagaatatccaggatactaagtcgcagccgaacaccatgaccagcctgcagaattctaagaaggtaaaccctaagcaagggacaactaagaacgactttaagaagctgcgtaagcggaagtgtagggacgtggtcgatcttagcgaaagcctccctttggccgaggaactcaacctgttgaagaaggacggcaaggatacaaagcaaatggaaaatacaacaagccacgcaaacagcagggacaacgtcaccgaagctgcgcagctgaatgatagcatcatcactgtgtcctacgaggagtttctgaagagccataaggagaacaaggtcgaagaaatacctgacagcactatgtctatttgtgtgccttccgagactgtggacgagatagtcaagtcaggctatatctcagagtccgagaactccgaaatttcccagcaggtaagattcaagactgttaccgtgctagcccaggttcacccaatccctcccaaaaaaaccggaaagataccaaggatttttttaaaacagaagcagtttgagatggagaactctttgtcagatccggagaatgaacagacagtccagaagcggaagtcgaatgtggtcatccaggaggaagaactagagctggcggtcctggaagcgggctcctctgaagcagtgaaacctaagtgtacactcgaagagcggcagcagttcatgaaggcattccggcagcccgcttctgacgccttgaaaaacggtgtgaagaaatcaagcgacaagcaaaaggatctcaatgagaagtgtctgtatgaagtgggaagggatgataattctaagaagataatggagaacagtgggatccagatggtcagtaagaatgggaatctgcagctgcacaccgataagggctccttcctcaaagaaaaaaataagaaactgaaaaagaagaacaagaaaaccctggacactggagctattcccgggaaaaatagagagggcaacacacagaaaaaggaaacgactttctttctgaaagaaaaacagtatcagaataggatgtcacttagacagagaaaaaccgagttttttaagtcatccaccttattcaataatgaatccctagtatacgaggatatcgcaaacgacgatcttctcaaggtctcttcgctttgcaataacaacaagctcagtcggaagacttccattcccgtcaaagatataaagttaacacagtctaaggctgaatcagaggctagtctccttaacgtatctacaccaaaatctacccgccggagcggccggatcagtagcacaccgacaaccgagacaatcagaggtatcgatagcgacgacgtccaggacaattcgcaactgaaagcctccacccagaaggcagccaatctttcagagaaacacagtctttataccgccgagctcatcacggtcccttttgattctgaaagccctatacgcatgaaattcactcgcatcagcacccccaagaagtctaaaaaaaagtcaaacaagcgctccgaaaagtctgaagccacagacggcgggttcacttcacaaattcggaaagcttcaaatacctctaagaatatctccaaggctaaacagttaattgagaaggctaaggcactgcatatctcaaggtctaaagtgaccgaggagatcgccatcccactacgccgctcttccaggcatcaaaccctaccagagcgtaagaagctgtccgagaccgaggattctgttatcattatcgattcctctcccacggccttaaagcatccggagaaaaaccaaaaaaaactgcaatgcctcaacgacgtgctaggcaagaagctgaatacgtctacgaaaaatgtgcccgggaagatgaaggttgcccccctgtttctcgtgagaaaggcccaaaaagccgctgatcccgtgccttcctttgacgagtcaagtcaggatacatccgaaaaatctcaggactgcgacgtgcaatgcaaggctaagagagattttctgatgagcgggctgccagacctgttaaaacggcagattgcgaagaaagccgccgctttggatgtgtataatgctgtgtctacctcctttcagcgggtggtacacgtgcaacagaaggacgacgggtgttgcctgtggcatctaaaacccccctcctgtcctctgctgactaaatttaaggagctcaatactaaggtaatagatttatccaagtgtggaattgcacttggggagtttagcactcttaattctaaacttaaaagcggtaatagcgctgctgtattcatgaggacccggaaggaattcaccgaagaggtacgcaatctgctgctcgaggagattcgctggtccaacccagaatttagccttaagaagtattttcctctgttactgaagaaacaaatagaacaccaggtattgtcaagcgaatgccacagcaagcaggagctggaagctgatgtgtcccacaaagagaccaagaggaaactcgtggaagccgagaacagcaagagcaagcgcaagaaaccgaatgaatactctaagaatctagagaagacgaacaggaaatctgaggaactgagcaagaggaataacagctccggtattaaactggattctagtaaagacagcgggactgaagacatgctttggactgaaaagtaccagcctcagaccgcatcagagctgatcgggaacgagttggccataaaaaaactgcactcctggctcaaggactggaagagaagagctgaactcgaggagagacagaatctgaagggaaaacgggacgaaaagcacgaagatttttccggtggcatcgacttcaagggctcctctgatgacgaagaggaaagtaggctgtgcaatacagttttgattaccggcccgaccggagtgggtaagaccgccgctgtttacgcatgcgcccaagaactgggcttcaagatcttcgaggtcaatgcgtcgtcccagagaagcggtaggcagatcctgtctcaattgaaggaggccactcagtcacatcaggtcgacaaacagggtgtgaactcacaaaaaccatgtttttttaattcctattacattggcaagagccccaaaaagatctcctcacccaagaaggtggtgaccagccctcggaaagtgccccccccttcacccaagtcttctggtccaaagcgggccctcccacctaaaacactcgccaactattttaaagtctcgcccaagccaaaaaataacgaggagatcggcatgctgctggaaaataataaagggattaagaatagtttcgagcagaagcagatcacccaaacaaagtctacaaacgctaccaattcaaatgttaaagatgtaggtgcggaggaaccaagcagaaagaacgctacaagtctgatcctgtttgaagaggtagatgtgattttcgatgaagatgctgggttcctgaacgcgattaagacttttatggctacaacaaagagacctgtcatcctgaccacaagcgatcctacattttccctgatgtttgacggctgttttgaagagatcaagttttcaacgccttccctgctaaacgtggccagttatctgcagatgatatgtcttacagagaatttcaggactgatgtaaaagacttcgtaacactgctgacagccaatacttgcgacatcaggaaatccatcctgtacctgcagttctggattcgttctggcggtggggtactggaagaacggcctctgacactgtatcgaggtaactctagaaatgtgcaactggtctgtagcgaacacggacttgacaacaagatttaccctaaaaacacgaagaaaaaaagggtcgatctgcctaagtgtgatagcggttgcgctgaaactctctttggattgaaaaacatattttctcccagcgaggacctgttctcctttctgaagcacaagatcacaatgaaagaggagtggcacaaattcatccaactgttgactgagttccagatgcgtaatgtagatttcctgtacagcaatcttgagttcatcctaccactacccgtcgacactatccctgagactaagaatttttgcgggccttcggttaccgtcgatgcctcagcggccaccaaatccatgaattgcctcgctcgcaagcatagcgagcgggaacaacccttgaagaagagccaaaaaaagaagcagaaaaagactctggtcattctggatgactccgacctgttcgataccgacctcgattttccagaccagtccattagcttatcttctgtgtccagcagctccaacgcagaagaatcaaaaaccggtgatgaggagtccaaggcgcgggacaaggggaataacccagagactaaaaagtccataccatgcccaccaaagacaacggccgggaagaagtgcagtgccttggtttcacactgtctgaacagcctctcagagtttatggacaatatgtcattccttgatgcactgctcactgacgttcgggagcagaacaagtatggacgtaacgacttcagttggaccaatggaaaagtgacaagcggcctgtgtgacgaattcagcctggaaagcaatgacggctggacttcacagtcctctggcgaacttaaggccgcggccgaagccctctctttcaccaaatgctcgtcagcaatctcaaaagcccttgagactctcaattcttgcaaaaagttgggtcgggacccgactaatgacttgactttctatgtgtctcagaagcggaataacgtctacttctcacagtctgctgccaacttggacaatgcatggaagagaattagcgtgatcaagagcgtgttttccagtcgaagcctgctgtacgtggggaaccgtcaagctagtattatagagtatctgcccacgttgcggaacatctgtaaaactgagaaactcaaggaacaggggaagagtaagcggcggtttcttcactatttcgagggcattcacctcgacatcccgaaggaaacggttaacaccctggcggcagattttccttag

SEQ ID NO: 179744 - DNA, 3543 bp, Artificial Sequence
  Description of Artificial Sequence: Synthetic coding sequence
atgagcgccgacagcagccccctggtgggcagcacccccaccggctacgggacactgacaattggaacctccattgaccccctgtcatcctccgttagctccgtaaggctctctgggtattgcgggtccccgtggagggtgattggctatcatgtggtcgtgtggatgatggccggtatccccctgctcctcttcaggtggaaacctctctggggagtgaggcttcggctgaggccctgtaacctcgcccatgccgagacccttgtgatcgaaattcgcgacaaggaggattccagctggcagcttttcacagttcaggtgcagaccgaggcaatcggggaaggctccctcgaaccaagtcctcagtctcaggctgaagacgggagatcccaggccgctgtgggcgctgttcccgaaggggcctggaaggatacagctcagctgcacaagagcgaagaagcggtcagcgttggccagaaacgggtcctgcggtattacttattccaggggcagcgctacatctggatcgagacccagcaagctttctaccaggtctctctcctggaccatggacggagctgtgacgatgtgcacaggtcacgccacggactctcgctgcaagatcaaatggtgcgcaaggccatctatggacctaatgtaatatccatccctgtcaagagctaccctcaactcttggtagatgaagctctgaatccatactacggatttcaggcctttagtatcgctctgtggcttgcggaccattattactggtacgcattgtgcatcttcctcatctcatcgatcagtatatgcctgtcgctatacaagacgagaaagcagtcccaaacattaagagatatggtgaagctgagtatgcgggtgtgcgtttgtcgtcccggaggcgaagaagaatgggtagactcgtctgaactagtccccggcgactgcttggttctacctcaagaaggtgggctgatgccatgcgacgccgccctggttgctggcgagtgtatggtgaatgagtcctcactgacaggcgagagcatccctgtgctcaaaacagcgctgcctgaggggctgggtccatactgcgcagaaactcaccgcaggcatactctgttctgtggcacgttgattcttcaggctagagcgtacgttggccctcatgtcctagccgtggttaccagaactggattttgtacagctaagggaggactagtttcgagtatccttcatcctaggccgattaattttaaattctataaacactcgatgaagttcgtggccgcactgtcagtgttagctctcctcgggactatctactccatttttattctgtatcggaaccgggtgccactgaatgaaattgtaatccgggccctggaccttgtgactgtggttgttccccccgcactacccgccgcgatgaccgtgtgcacactctacgctcagagcaggttgcgaaggcaaggcattttttgcattcaccctctgcgcattaatttgggcggcaaactgcagcttgtctgttttgacaaaacaggaaccttgactgaggacggactggacgtcatgggggtagtcccactgaagggacaggcatttctcccacttgttccagagccccggagactccctgttggccccctgctgcgagcactggccacttgccatgccctctcgaggctgcaggatacgcctgtgggtgatccaatggacctcaaaatggttgaaagtaccggctgggtcctggaggaagaaccagccgccgactctgcctttggtacgcaggtgcttgccgtcatgcggccacctctgtgggaaccccagctgcaggcaatggaagagcccccagttccagtgtctgtcttacaccgcttccccttttcaagtgcactccaacgcatgagcgtcgtcgtcgcgtggcctggagctactcagcccgaagcctatgtgaagggttctcctgagctggttgctggtctgtgtaaccctgaaacagtgccaacagattttgcccagatgctacaaagttacaccgcagccggttacagagttgtggccctcgcttcgaaacccctccctacagtcccctcattagaggctgctcagcagctcacccgagacacggtcgaaggggacctcagcctcctggggctgctagtgatgcgtaacttgctcaaaccgcagactacgccagtcatacaggcacttagaaggactcgcatcagagcggtgatggtgacgggagacaatcttcagacagcagttacagtagcacgcggatgcggcatggtagcccctcaggagcacctgatcattgtgcatgccacgcacccagagagaggacaaccagcgtccctggaatttctgccaatggagtcaccaacagctgtgaatggggtgaaggatccggaccaggccgcatcttacacagtcgagcctgacccccgatccagacatctggcgctgtctggacctacatttggaatcatcgtcaagcatttccccaaactgcttcccaaggtattagttcagggaacagtgtttgcccggatggcgcctgagcagaagactgagctcgtgtgtgagcttcagaaactgcagtactgtgtgggcatgtgcggcgacggggccaacgattgcggagccctcaaggccgccgacgtcggcataagtctgtctcaggccgaagcgagcgtggtgtcaccgtttacgtccagcatggcctcaatcgaatgtgtgcccatggtgatacgagaggggagatgcagcttagataccagcttttctgtattcaaatacatggccctgtacagcttaacgcaattcatctccgtattgatcttatatacaatcaataccaacctcggagacctccagtttctggcaatcgacttagtaatcactacaaccgtggctgttctgatgtctcgcaccggcccagccctcgtgttagggagagtccggcccccaggtgcgctcctcagcgtgcccgtgctgtcatcactgcttttgcagatggtcctggttacaggggtccagctcggcggctacttcctaaccctagcccagccttggttcgtccccctcaatagaacggtcgcggcccctgacaatcttcccaactacgaaaatactgtggtgttctccctaagctcatttcaatacctgattctggcggccgctgtgagtaaaggggcacctttccggcggcctctgtacaccaacgtaccatttctggttgcgctggctctgctgagttcagtgttggtcgggctggtgctagtacccggcctcctgcaaggccccctggcactgagaaatattacagatacaggctttaaactgcttctgcttggtctagttaccctgaattttgttggcgcctttatgctggagtccgtgctggaccagtgcctgcctgcctgtttacggcggcttagaccgaagagggctagcaagaaacgttttaagcagctggagagagagctggccgaacagccatggccccccctgcccgctggaccactgaggtag

SEQ ID NO: 179745 - DNA, 3477 bp, Artificial Sequence
  Description of Artificial Sequence: Synthetic coding sequence
atgagcgccgacagcagccccctggtgggcagcacccccaccggctatggaacactgactattggaaccagcattgatccccttagctcatccgtctcctctgtcagattgagcggctattgtggctctccctggagggtgatcgggtatcatgtggtcgtttggatgatggctggcattcccctgttgctttttagatggaaaccgctgtggggcgtgaggctgcgtcttcggccttgcaacctagcccacgctgagacattagtcatcgagattagagacaaggaggacagcagttggcagctgttcaccgtccaagtgcagaccgaggcaatcggcgaggggagtctggagcccagccctcagagtcaggcggaagatggacgttcccaggcagctgtcggggcagtgccagagggcgcgtggaaggatacagcccagctgcacaagtctgaggaagccaaaagggtgctgcgttattatttgtttcaaggacagcggtacatttggattgagacgcagcaagcattttatcaggtaagtcttttggatcacggaagatcctgtgatgatgtgcataggagcagacatggcctgagcctccaggaccagatggtcaggaaggccatctacggccccaacgttatctctatcccagtaaaatcctacccccagttgctggtcgacgaggccttaaacccatactacggtttccaggctttctctattgccttatggcttgccgatcattattactggtatgccctgtgcatatttctgattagttccatcagcatttgcttgagcctttataagacccgcaaacagagccagacacttcgggatatggtcaagctgtccatgcgggtctgtgtctgcagacctgggggagaggaagagtgggtagatagctctgaattagtgccaggggactgcctggtcttgcctcaagagggggggcttatgccttgcgatgctgctcttgtggcaggagagtgtatggtcaatgagtctagtctgacaggcgaatccatccccgtcctgaaaacagcccttccggaaggactgggcccgtactgcgcggagacccataggagacacacgcttttctgcgggacgctgatcctccaggcaagagcgtatgttggtcctcatgtgctcgctgtggttacgaggaccggattttgtacggctaagggtggactcgtgagcagcatcctccatcctagaccaatcaatttcaagttctataagcattccatgaaattcgtggcggctcttagcgtcctggccctgttaggaaccatctatagcatattcatcctgtataggaatagagtacccctaaacgagattgtaatccgagcactcgatctcgttacagtggttgtgcctcccgccttacccgctgccatgacagtctgcactctgtacgctcagtctcgtttgcgtcggcagggcatcttttgcatccacccgcttcggattaacctggggggaaagttgcagctggtatgcttcgacaaaacgggcacacttaccgaagacggcctcgatgttatgggagtcgtgcccctcaagggccaggctttcctcccccttgtgccagaaccacgtcgtttaccagtgggtcccctcctacgggccttagctacctgtcatgccctgagccgccttcaagacacccccgtaggggaccccatggacttgaagatggtggagagcactgggtgggtgctggaggaggagcctgccgccgactctgcttttgggactcaggtcctagcggtgatgcggccacctctctgggagccccagctccaagccatggaggagccacccgtgcctgtgtcggtgctgcatcggtttcccttctcatcagccctgcaaagaatgagtgtggtggtggcttggccaggcgccacccagcctgaagcctacgttaaggggtctccggagctggtggctggactatgcaaccctgagaccgtgcccaccgacttcgcacagatgctacagtcctatacagctgcagggtatcgggttgtggctctcgcatcaaaacccctgccaacggttccttctctggaggccgcgcaacagcttacccgtgacacagtcgaaggggatctctcattattgggactgctagtgatgcgcaatctgttgaagcctcaaaccacgccagttattcaggctcttcgaagaacccgaattagagccgtgatggttacaggggacaatctgcagacagcagtcaccgtggcccgcggctgcggaatggtagccccccaggaacatttgattatcgtgcatgctacccaccctgaaaggggccaaccagctagtttggaatttctgcccatggagtctcctactgcagtgaacggggtcaaggtcctggtccagggtaccgtgttcgctagaatggccccagagcagaagaccgaactcgtctgcgagttgcagaagttacaatattgtgtgggtatgtgcggagatggagcgaatgactgcggagccctcaaggccgctgatgttggaatctccctgtcacaagctgaagccagcgtcgtgtcgccctttacctcttccatggccagcattgaatgtgtgcccatggttataagagaaggccgatgctcccttgatacatctttttctgtatttaagtacatggcactgtatagtcttacccaattcattagcgttctcatcctgtacaccataaatacaaatctgggtgatttgcagttcctggcaattgatctggtcatcacaacaaccgtggccgtgttaatgagccgcacgggacctgccctggtgttaggaagagtccgacctccgggtgccttactgtcggtcccggtacttagttcattgttgctccagatggtcctggttactggtgtgcagctgggcgggtattttctcacgcttgcccaaccttggtttgttcctttgaacagaacagtggccgcccctgacaaccttccaaattacgagaacacagtggtgttctcactctccagctttcaatacctaatccttgcggccgccgtttccaaaggcgccccttttagacgccctctgtacacaaatgagcgagccaggcccgtgccccccaggctgcctgcccctcccccagcccaggccggtctccaagaggctctgcaggccgcgggcactcgcgctgggcgggccgctttagcagccgctgcaaggcgccccccggaggtcgtacaggcccacggtcatccaaggcactggaactcattgcccttgtcacaccagctagacccctcccccgctacccccccaccaccccctcccacaagcttaagactggccacggtgtatacaccgccccctcgaccgccccccccatggggatcggtcgattactgtcctttaccatggacaatcccgcgcagggggggatcaccccagctgccaagcgttttgctcagcgtgtag

SEQ ID NO: 179746 - DNA, 3528 bp, Artificial Sequence
  Description of Artificial Sequence: Synthetic coding sequence
atgagcgccgacagcagccccctggtgggcagcacccccaccggctatggaactttgactatcgggacctccatcgaccctctatccagttcagtgtcctctgtgagattatctgggtattgtggcagtccctggagagtcatcggctaccatgtggtggtctggatgatggccggaattccgctgctgctcttccgctggaagcctctctggggggttcggctgcgtctccgtccctgtaacctggcacatgccgagactttggtcattgaaattcgcgataaggaagacagttcttggcaactgtttactgtacaagtacagaccgaagctatcggagaaggctccctggagccttctccccaatcccaggccgaagacggaagatcacaggccgccgtgggcgccgttcccgaaggcgcgtggaaagacacagcacagctgcataaatcagaggaagcgaagcgggtgctccggtattatctctttcagggacagcgctatatctggattgagactcagcaggcattctatcaagtgtcactgctcgatcatgggaggagctgtgacgatgttcatcggagtaggcacggactgtctctgcaagaccagatggtccggaaagctatctacggccctaacgtgatcagtatcccagtgaagtcctacccgcaactgctcgtggacgaggctcttaatccctactatggctttcaggcattctccatagccttgtggctggccgaccattattattggtatgctctttgcatcttcctcatatccagcataagcatctgcctctccctttacaagactagaaaacagagtcagaccttgcgcgatatggtgaagctgagcatgagggtgtgcgtctgccgtcccggcggggaggaagaatgggttgatagtagcgagcttgttcccggagactgcctggtactgccgcaggaaggtggattgatgccgtgcgacgcagcactggtggccggcgaatgcatggtcaatgaatcttcccttaccggggagtccattccagtcctgaagaccgcattacctgagggactgggaccctactgtgctgagacccatcggcggcatacgttattttgcgggacattaatcctgcaggcacgggcctatgtcggaccacacgtgttagccgttgtcacaaggacgggattttgcacagcaaagggaggcttagtgtcttcaatactccacccccgtcctatcaattttaagttttacaaacacagcatgaaattcgtggcggctctgtcagtgttggctctgctcggcactatctacagtatattcatcttgtatcgtaaccgtgtccctctgaatgagattgttatccgggctcttgacctcgtgaccgtagtggtcccgcccgctctgcctgcggcaatgaccgtgtgtactctgtatgcacaaagtcgactgcgcaggcaagggatcttctgcatccacccacttagaatcaatcttggaggcaagctgcaattggtgtgttttgacaagacaggaacccttacggaggacgggctggatgtgatgggggtcgttccactgaaaggtcaggcctttcttccactggtgcccgagccaagaagactgcctgtgggaccactgttgcgcgcactagctacgtgccatgcgctatcccggctccaggacaccccagtgggcgaccccatggacctgaaaatggtggaaagcactggctgggtgctggaggaggaacccgctgcggattccgcctttggtactcaggttctggcagtgatgcggccccccctctgggaaccacagctacaagccatggaggaaccgccagtgccagtttccgtcttgcaccggtttcccttctcctctgcgttgcagagaatgagtgtcgtagtggcctggcctggagccactcagcccgaggcctatgttaagggttccccagaattggtggctggcctctgcaatccggaaaccgtccctaccgatttcgcccaaatgctgcagagctacacggccgctggttaccgggtcgtggccctggcttctaagccactgcctacggtcccttcgctggaagcagcccagcagctgactcgcgatacagtggagggtgacctgtccctgttaggcttgctcgtgatgagaaatctcttgaaaccccagactacccccgtcatccaagccctcagaaggactcgaatcagagccgtcatggtgactggtgataatctgcaaactgccgtgacggtcgcacgagggtgtggaatggtcgccccccaggaacacttaataattgttcatgcgacccaccctgagcggggccagcctgcctcactggagttcttaccaatggaaagcccgacagcagtgaatggcgttaaggaccccgaccaggcagcttcttatactgtggagccagacccacgcagtagacacctggctctctccgggcctacttttggcatcattgtgaagcactttcctaaactgttgcccaaggtccttgtccaagggacagtgtttgcccgcatggccccagagcagaaaactgagctcgtatgtgagctgcagaagctgcagtattgcgtggggatgtgcggggatggagccaatgactgtggcgccctcaaggccgctgatgtcggaatttctttgagccaggcagaggccagcgtagtgtctccttttaccagcagcatggcctccatcgaatgcgtgccaatggtgatacgcgagggccggtgttcactggacactagtttttctgtttttaagtatatggccttgtattccctcactcagtttatcagcgtgttgatcctgtacacgatcaataccaatttgggggacctgcagtttctggccatcgatttggtcattaccaccaccgtggccgtactaatgagccgtacggggcccgccctggtgctcggaagggtgagacctccaggagcgctgcttagtgtgcccgtgttgtcgagtctgttgttacagatggttctcgtgaccggagtgcagctgggcggctatttcctgaccctggcccagccatggttcgtacccctgaatcgtaccgtggccgcaccagacaatctgccaaattacgagaatacggtggtgttctcactcagtagcttccagtatctcattctggcagccgccgtgtccaagggcgcaccctttagacgacctttgtacaccaacgtgccatttctggtggccctggccttgctgagctccgttttggtgggtcttgtgctcgttcccggtctgttacagggccccctagcactgcgcaatatcaccgacaccggctttaagctcctgttgcttggtctagtcacgctcaactttgtaggcgcattcatgttggagtccgtgctcgaccagtgtctgccggcatgcctgagaagactgagacctaagagggcttcgaagaagaggttcaagcagctggagagggaactcgctgaacagccctggccccccctccccgccggacctttgcgctag

SEQ ID NO: 179747 - DNA, 3372 bp, Artificial Sequence
  Description of Artificial Sequence: Synthetic coding sequence
atgagccgggccaccagcgtgggcgaccagctggaggcccccgcccgtacaatctatcttaaccagccccacctgaacaaatttcgcgacaatcagatctccacagccaaatattcggttctaactttcttgccgagattcctgtacgagcaaattcggcgggccgccaacgctttcttcctgttcattgctctgctgcagcagatcccagacgtaagcccgaccggaagatacaccaccttggtgcctctgataataattctgaccatcgcaggcataaaggagatcgtcgaagacttcaaaaggcacaaagctgacaatgctgttaacaagaagaagaccattgttctgcggaatggtatgtggcacacaatcatgtggaaggaagttgccgtgggagatattgtgaaagtggtgaacggtcagtacctgcctgcagacgtggtgctgctgtcctcctctgagcctcaggctatgtgttatgtggaaacagccaatctggatggggagaccaatctgaaaatcagacagggcctgagccataccgccgatatgcagacccgggaagtcctaatgaagctcagcgggaccatagagtgtgagggcccaaacaggcatctctacgacttcaccgggaatctaaatctcgacggaaaaagcttggtggccctggggcccgaccagatactgctgcgaggcacacaactgagaaatacccagtgggtatttggcatcgtggtatatacgggacatgacactaagctaatgcaaaacagtacaaaggcccctctcaaacggtcgaacgtcgagaaggtgactaatgttcaaatcttggtcctatttggcattcttctggtgatggctctcgtttcaagcgccggcgccttgtactggaaccgctcgcacggtgagaagaactggtacatcaagaagatggacaccactagcgacaatttcggctacaatctgctaactttcattattctgtataataatctgattcctatctcactgctggtcaccctggaagttgttaaatacacccaggcgctttttatcaactgggataccgatatgtattacatagggaatgacacccccgccatggcacgcacatcaaacctcaatgaggagctcggccaggttaagtacctgttctccgacaaaacaggaacgctcacatgtaatataatgaattttaagaagtgtagcattgccggcgttacatatgggcactttccagagctggcccgcgaaccctctagtgacgatttttgcagaatgccccccccttgctcggatagctgtgattttgatgatccaagactgttgaaaaacatagaagataggcacccgacagcaccctgcattcaggaatttctgaccctattggcagtctgtcataccgtggtgcccgagaaagatggggacaatataatttaccaggccagtagtcccgatgaggccgcactggtcaagggggccaagaaacttgggttcgtgttcaccgctagaaccccatttagtgtgatcatcgaggctatgggacaggagcaaactttcgggatcctaaatgtcctggaattcagctcggacaggaagcggatgtcagtgatcgtgaggactcctagtggccgacttcgtctttattgtaaaggcgctgataatgtgatctttgaacggctgtctaaggacagtaagtacatggaggagaccctgtgtcacttggagtactttgcgacagaaggcctcagaacactctgcgttgcctacgctgatctctccgaaaacgaatatgaggaatggctgaaagtctaccaagaggcttcaacaattctaaaagatagggcacagagattagaggaatgctatgagatcatcgagaaaaatctcctgctcctcggcgccacagccatcgaggaccggctccaagccggggtacctgaaaccatagccactctgttaaaggccgagatcaaaatctgggttttaacaggggataagcaggagaccgcaataaatataggatattcatgtaggctggtgagtcaaaatatggcactgattctcctgaaggaggacagtctcgacgccacacgtgcagccatcacacagcactgtacagatctaggaaatctgcttggtaaggaaaacgacgtggccctgatcattgacggccacaccctgaaatacgctctcagcttcgaggtgaggcgtagctttttggacttggccctatcctgtaaggctgtgatttgctgcagggtttccccactgcagaagtcggagattgtagatgtggtgaaaaagagggtgaaagcgatcactctggcaattggagacggggccaacgacgtgggcatgattcagactgctcatgtgggcgttggcatctctggcaacgagggaatgcaggccaccaataacagtgactatgcgattgctcagttctcttatctggagaaactgctcctcgtgcacggtgcgtggagctacaatcgcgttacaaagtgcatactctactgtttctataagaacgttgtgctttacatcatcgagatcttcacagccttgccaccatttacactgggtatctttgaacggagctgtactcaggagtccatgctgcgctttccacagttgtacaagattacacagaatggagaaggctttaatactaaggtgttttggggccactgtattaatgctctggtgcactccctgattttgttttggtttccaatgaaagcactcgagcacgataccgtactgacaagtggccacgctactgactacctgttcgtgggaaacatcgtgtatacatatgttgtagtcactgtgtgtctgaaggcaggcctggaaaccaccgcatggacaaaatttagccacctcgctgtgtggggttccatgcttacttggctcgtgtttttcggcatttattcaactatttggcccacgattcccattgccccagacatgcgcggccaagccacaatggtcctttcctctgcgcatttttggctgggattgtttctggtcccaaccgcatgtctgattgaagatgtcgcgtggcgcgccgccaaacatacatgtaagaaaaccctgttagaggaggtccaggagctcgagaccaagagcagagtcctgggtaaggctgtgctcagggactcaaacggtaaacggctgaatgagcgcgacaggctcatcaaacggcttgggagaaagactcctccgaccctgttccggggtagttcactgcagcagggggtgccgcatggctacgcattttctcaggaggagcatggcgccgtcagtcaggaagaagttatccgggcttacgataccacaaagaaaaaatccagaaagaaatag

SEQ ID NO: 179748 - DNA, 426 bp, Artificial Sequence
  Description of Artificial Sequence: Synthetic coding sequence
atgagccgggccaccagcgtgggcgaccagctggaggcccccgcccgaactatctacctcaatcagccgcacctgaataaattccgggataaccagatctcgacggccaaatacagcgtcctgaccttccttcccagatttctatacgagcagataaggagagccgccaacgcgtttttcctatttatagcactgctccaacagattcctgacgtatctcctacaggtcgatacacaactctcgtccccctgatcatcatcctgaccattgcgggtatcaaagaaattgtagaagattttaagcgtcacaaggctgacaatgccgtgaacaagaagaagactatcgtcttacgcaatggcatgtggcatacaatcatgtggaaggaggagaacagccctcctttcaaggagatatcacccctgtag

SEQ ID NO: 179749 - DNA, 3567 bp, Artificial Sequence
  Description of Artificial Sequence: Synthetic coding sequence
atgctgaacggcgccggcctggacaaggccctgaagatgagcctgccacgccgatctaggataagatcgtccgtcgggccggtccgctctagcctgggctacaagaaggccgaagacgaaatgagccgagccacctctgttggagatcaactcgaagctcccgcccggactatctacctgaatcagccccatcttaacaagtttagagataaccaaatttcaactgccaagtattccgtcttaaccttcttgccgaggtttctgtatgaacagatccgaagagccgccaacgccttctttctcttcatcgctttactgcagcagatcccggacgtttctccaactgggagatatactactcttgtgccgcttattattatactgaccatcgccggaatcaaagagatcgtcgaagattttaaaaggcataaagcggataacgcagtcaacaagaaaaaaaccattgtgctccggaacggaatgtggcacaccataatgtggaaggaggttgctgtgggtgacatcgtgaaggtggttaatgggcagtacttgccagctgacgtggtgctccttagcagttcagaaccccaagctatgtgttacgtggagaccgctaatttagatggggaaactaacctaaaaatccgccagggactttctcacactgcggacatgcagacccgcgaagtgctgatgaagttgtccgggaccattgagtgtgagggtcccaacagacacctatatgacttcacggggaacttgaatctggacggaaagtccctggttgccctgggacccgatcaaattttgctgaggggcacgcagctgcgcaacacccagtgggtgtttggcatcgtcgtctataccggccatgacactaaattgatgcaaaattcaaccaaagcaccattgaagaggtcgaatgtggagaaagtgacgaacgttcagattttggtgctcttcggaatcctgctcgtgatggctctggtctccagcgccggagcactgtattggaatcgaagtcacggggaaaaaaattggtatatcaaaaaaatggataccaccagcgacaactttggatacaacctgttgaccttcatcattctgtacaacaaccttatccccatctctctcctggtcactctggaagtggtgaaatacacccaggcgctctttatcaactgggacaccgacatgtactacattggtaatgacaccccagccatggcccggacaagcaatctgaacgaggagctcggccaggtaaaatacctgtttagcgacaagaccggtaccttgacttgtaatataatgaattttaaaaaatgttctattgctggggtgacctacggccactttccagaacttgcacgtgaaccatccagcgatgatttttgtcggatgccacctccatgtagtgatagctgtgacttcgacgaccccagactcctcaagaacatcgaggataggcatcctaccgcgccgtgcatccaggagtttctgacgctgctcgcagtctgccacaccgtcgtcccagagaaggacggggacaatatcatttatcaagcttcatcccccgatgaggcagcactggtcaagggagctaagaagctgggattcgtctttacagcccggaccccttttagcgtcatcatcgaagctatgggccaggaacagaccttcggcatcttaaacgtgctcgagttctcctcagataggaaacggatgagcgtaatcgttcgcacccccagcgggcggctccgactgtactgcaaaggggccgataatgttatttttgaaaggctgtctaaggactctaaatacatggaggaaaccctgtgtcacctggagtattttgcgacggaaggcctgagaactctatgtgtcgcttacgccgatctgagtgagaatgagtacgaggagtggctgaaggtttatcaggaagcatccacaattctcaaagaccgggctcagcgactggaggagtgctacgaaattattgaaaaaaatctcctgcttctgggcgcgacagctatcgaagacagattgcaagccggggtccccgaaacgatcgctacactcctgaaagctgaaatcaagatttgggtcctgacgggggataagcaggaaaccgccatcaacattggctactcttgcaggctcgtgagtcaaaatatggcactcatcctcctgaaggaggacagtttggatgctacccgcgcagcaatcacgcagcactgcacagatctgggaaatctactcggtaaagagaatgacgttgctttgataatcgacggccacacccttaagtacgccctgtcattcgaagtgaggagaagctttttagatttagccctctcctgtaaagcagttatatgttgtagagtcagccctcttcaaaaatccgagattgtagatgtggtgaaaaaaagggtgaaagctatcacactcgcgataggcgacggagctaacgacgtcggtatgatccagactgcccacgtgggtgtgggaatctcaggcaatgaaggcatgcaggctaccaacaactcagattatgctattgctcagttctcttacctcgagaaactcctgctggtccacggggcgtggagttacaacagagtcacaaaatgtattctgtattgtttttataagaacgttgttctgtacatcattgagctgtggtttgccttcgtaaatggttttagcggccagatcctctttgaaagatggtgcatcggcctctacaacgtaatctttactgctttgccaccttttaccttgggaatctttgaaaggagctgtactcaagagagcatgttgcgtttccctcagctgtataagatcactcaaaatggcgaaggttttaacacaaaggtgttctggggccattgcattaatgcactggtacattctcttatactcttttggttccctatgaaagccctggagcacgatacagtgctgacctcgggacatgccaccgattatctctttgtgggcaatatcgtctatacctatgtagtagtgacagtgtgtctgaaggcgggactggaaacaacagcgtggacgaagttttctcatcttgctgtttggggctccatgctcacatggttagtctttttcgggatctattccaccatttggccgaccatccctattgccccagacatgcggggtcaagccactatggtcttatcttctgcgcatttctggctcggcttattccttgtgcctacagcctgtctgattgaagatgtggcctggagagcggctaaacacacatgcaaaaaaactctgctcgaagaagtccaagagctcgaaacgaaatctcgtgtcctaggaaaagccgttctcagagatagcaatggcaagcggttgaacgaaagagaccggctcatcaagaggctaggaagaaagacaccccccaccctgttcagggggagttccttgcagcagggcgtgccacatgggtatgctttctctcaagaggaacatggcgcggttagccaagaagaagtcatacgcgcatacgacaccactaagaagaagagtcggaagaagtag

SEQ ID NO: 179750 - DNA, 2907 bp, Artificial Sequence
  Description of Artificial Sequence: Synthetic coding sequence
atgcggtgccccggcccccggctgctggagaccagctggcggcaccctcctgccccatttacatctaccaatcgccatctctacgacttcaccgggaacctcaatctagatggaaagtccctggtggctttaggccctgaccagatcctgctgcgcggcactcagctcagaaatacccagtgggtgttcggcatagtagtgtatactggccatgacacgaagctcatgcagaacagtaccaaagcccccctcaaacgaagcaatgttgaaaaggttaccaatgttcagatcttagtcttgtttggaatccttctggtgatggcgttggtcagctctgccggtgctctctactggaataggtctcacggagaaaaaaattggtatattaaaaaaatggacacaacctcagataatttcggatacaatctgctgacgtttatcatactctacaataatctgattccaatatctctcttagtgactctcgaagtggtaaaatatacccaggcgctgtttattaattgggatacggacatgtattacattggaaacgatacacccgccatggctcgaacaagcaatctgaatgaggagctgggtcaggtgaagtacctcttctctgataaaactggaactcttacttgtaatattatgaacttcaagaagtgctctatcgcaggcgtgacttatgggcacttccccgaactcgcaagggagcctagtagtgacgatttttgtcgcatgccgccaccatgcagtgatagctgtgatttcgatgatcctcggctattaaaaaatattgaggaccggcacccaacagccccctgcatccaggagtttctgacactcttagcagtttgccacacagtcgtccctgaaaaagacggcgacaacattatataccaggcctcctctcccgatgaggccgcgctggtcaagggtgccaaaaagctggggtttgtgttcacagccagaactcccttcagtgttattattgaggctatgggtcaggagcagacttttggaatactgaacgtgctagagttctctagcgaccgcaagcgaatgagcgtcatagtccggacccctagtgggagactgagattgtactgcaaaggcgctgacaacgttattttcgagagactaagtaaggatagtaaatacatggaagaaactctgtgccacctggaatacttcgctaccgaggggctcagaaccttatgtgtggcttatgctgacttgtccgagaatgagtacgaggaatggctgaaggtgtaccaagaagctagtacaatcctgaaggacagagctcagaggctggaagaatgttatgagattattgaaaaaaatctcctgctgctcggggcaacggcaatcgaggatcgacttcaagcaggtgtgcccgaaactattgccacgctgctaaaggctgagattaagatctgggtgttaactggcgataagcaggaaacagccatcaacatcggatacagctgtagactggttagtcaaaatatggccctgattcttctcaaggaagattccctggatgccacacgggcagccataacacagcactgcacagatctgggcaatctgttagggaaggaaaatgacgtggcactgattatagatgggcacaccctgaagtatgccttgtcatttgaagtgaggaggagtttcctcgacctcgcgttgagctgtaaggctgtgatctgctgtagagttagccccttgcagaagagcgagattgtggatgtagtcaaaaagagggtgaaagccatcaccctggcaataggagatggcgctaatgatgtgggtatgatacagactgcgcacgtgggtgtgggcatctctggcaacgagggtatgcaggctaccaataacagcgactatgcaatcgcccagttctcctacctggagaagctgctcctggtgcatggtgcctggtcttataatagggttactaaatgcattttatactgcttttataagaacgtcgtgctatacattatagagctgtggtttgctttcgtgaatggattcagcgggcagatcctgttcgaaagatggtgtattggactttataacgtgatattcactgctttgcctccgtttactttagggattttcgaacgtagctgcacacaggaaagcatgttgcgcttccctcagttatacaagattacacagaatggagagggcttcaacaccaaggtcttttgggggcattgtattaatgctctcgtgcactctttgatcttgttctggtttcctatgaaagccctggaacatgatactgtgctcacatctggacatgctacagactacctcttcgtggggaacatcgtatacacctatgtcgtagtgaccgtttgtctgaaagcaggacttgagacgacagcgtggacgaaattttctcatttagctgtttggggttctatgctcacatggctcgtgttttttggtatttatagtactatatggccaacaattccaattgcacctgatatgcgggggcaggcaacaatggtattatcttccgcgcacttttggctgggattatttctcgtcccgacggcctgtcttatcgaagatgtcgcctggagggcagctaagcatacatgcaaaaaaaccttgttagaggaagtgcaggagctggagacaaagtctcgcgtgctgggcaaggcagtattgagagattctaacgggaagcgcctgaacgagcgagaccgactgattaagaggttgggccgaaaaactcccccaaccctctttcgtgggagctctctgcagcagggcgtacctcatggatatgcattctcgcaagaggaacacggtgctgtgagccaggaggaggtcatcagggcgtacgacaccacaaagaagaagtctcgcaaaaaatag

SEQ ID NO: 179751 - DNA, 3903 bp, Artificial Sequence
  Description of Artificial Sequence: Synthetic coding sequence
atgggcaccggccccgcccagaccccccggagcacccgggccggcccagaaccaagtcccgctcctcctggacccggagacaccggagactccgacgttactcaagagggctccgggccagccggtattcgggggggggagaccgttattcgagccggcatgggtgattcgcccggccggggcgcacccgagcgccgacacaaggcacagccagggcgcgcgaggaaatacgagtggaggcctgaagggcccaccagtatgggctccctgggacagagagaagaccttcaggacgaggatcgcaacagtgcctttacctggaaagtgcaggccaacaacagagcatacaacggacagtttaaagagaaagtgatcctgtgctggcagaggaagaagtacaagaccaacgtgatcagaactgctaagtacaacttctactcttttctgcctctgaacttgtatgagcagtttcatcgcgtgtctaacctgtttttcttgataatcattatcctgcaatccatccccgatattagcactctcccatggttcagcctgagtacccccatggtgtgcttgctcttcatccgtgccaccagggatctggtggatgacatgggcagacataagtccgaccgggctatcaacaaccgcccttgccagatccttatgggcaaatcttttaaacagaagaagtggcaggacctgtgcgtgggagacgtagtatgcctgcgaaaggacaacatcgttcctgcagacatgctgttactcgcatctaccgagccatcatcactttgctatgtagagaccgtggacatagatggcgaaacaaacctgaagttcagacaggcattgatggttacgcacaaggagcttgcaactatcaaaaagatggcctccttccagggcacggttacgtgcgaagctcccaactcccgcatgcaccacttcgtgggttgccttgaatggaacgataaaaaatactccttggacatcggcaacctgttactccgcggctgcaggatccgcaacaccgatacctgctacgggttggtgatatacgccggtttcgacacaaaaatcatgaagaactgtggcaagattcatttgaagagaactaagctggatttgttgatgaacaagctggttgtggtaattttcatctctgtggtcttagtctgcctggtgctcgcatttggctttgggttctctgttaaggagttcaaggatcaccactactatttgagcggcgtccatggcagcagtgtagccgcagaaagtttcttcgtgttctggagttttttgattctgctctcggtgactatcccaatgtctatgttcatcctctctgagttcatttaccttggcaattcggtgttcatagactgggacgtgcagatgtactataagccacaagatgttcctgccaaagctaggtccacttctctcaacgatcatctgggtcaggtcgagtatattttttcggataaaacaggcacactcactcagaatattttgacctttaacaagtgttgtatcagtggaagagtatatggccccgattctgaagccacgacacggcctaaggagaacccatatctgtggaacaagtttgctgatggaaaactcttattccacaatgccgcccttctgcatttagtgaggaccaatggagatgaggctgttagggagttctggcgtcttttggcaatctgtcacaccgttatggtgcgtgagagtcctcgggaaagacccgaccagctgctgtatcaggcagcctcgccagacgagggcgccctggtcacagctgcccgcaacttcggatacgtttttttgtctaggacccaggacaccgtcacaattatggaacttggcgaggaaagagtatatcaggtgctggcaataatggattttaattctactaggaagcggatgtcagtgctggtacgcaaacctgagggagcaatatgtttgtacaccaaaggcgccgatacagtaatttttgagaggctgcaccgccggggagccatggagttcgccactgaggaagcgttggccgctttcgcgcaggaaaccctgagaaccttatgccttgcctatagagaggtcgcagaggacatctacgaggactggcagcagagacaccaagaggcctcactactgttgcagaaccgcgcccaggccctgcaacaacttctgggggctactgccattgaggacagactgcaggatggggtacctgagacaataaagtgtcttaagaaaagcaatatcaaaatttgggtgcttacgggcgacaagcaagaaactgcagtcaacatcggttttgcatgcgagttgctgtccgaaaatatgctgattctggaggaaaaggaaatttcgaggattctggagacgtactgggagaactcgaacaacctgctgacccgcgagtctttaagtcaagtcaagctggccctggttattaacggagatttcctcgacaaactcctcgtgtccctgcggaaggagccacgggcattggcacaaaacgtcaacatggatgaggcctggcaggagctgggacaatctaggagagatttcctgtacgcaaggaggctgagcctcttgtgtcgccgatttggcttgcccttggcagctcctccagcccaggactcaagggcccggcggtcatcagaggtcttgcaggagcgggcttttgtggacttagctagcaaatgtcaagccgtcatctgctgccgagtcacaccgaagcagaaagccctcattgtcgcgttggtcaaaaaatatcatcaggtcgtcaccttagccattggagacggggcgaatgacataaatatgatcaagactgcggacgtgggggttggtcttgccggccaagagggtatgcaggctgtccagaatagtgactttgttctgggccagttctgctttcttcagcgactgttgctggtccatggaaggtggtcctatgtgaggatctgcaagttcttgaggtactttttctacaaaagtatggcctctatgatggtccaagtctggttcgcatgctacaatggatttaccggacaacccttgtacgaggggtggttccttgctctattcaatttgctctacagcactctgccagtgttatatatcggcctctttgagcaagacgtctccgccgaacagtccctggagaagcccgagctttacgttgtcggccaaaaagacgagcttttcaattactgggtttttgtgcaggccatcgcccacggggtcactaccagcctggtaaacttttttatgaccctgtggatctcaagagacaccgccggtcctgcctctttttcagatcaccagtcatttgctgtcgtcgttgccctgtcttgtttactctctataacgatggaagtgattctgattatcaaatattggaccgctctgtgtgttgccaccatcttactgagccttgggttctatgctataatgacaaccacaacccagagcttttggctcttccgcgtaagtccaactacgtttccattcctgtatgctgacctctcagtgatgagcagccctagcattctcttagtagtgcttctgagcgtttccattaacactttccccgtcctggcattgagggttatattccctgccttaaaagaactccgcgcgaaggaagagaaagtcgaggaaggcccatcagaagagatcttcacaatggagccattgcctcacgttcacagggagagccgtgcgcgccgttcaagttatgccttttcacacagagagggctacgctaatctgatcacccagggaacaatcctcaggcgagggcccggcgtctcgagtgatattgcctctgaatcactggacccttccgacgaagaagcggcctccagcccaaaggagtcccagtag

SEQ ID NO: 179752 - DNA, 1737 bp, Artificial Sequence
  Description of Artificial Sequence: Synthetic coding sequence
atgggcgacagccccggccggggcgcccccgagcggcggcacaaggcccagcccggacgggcacgaaaatacgagtggcgaccagagggccctacaagcatgggctctttggggcagagggaagatctccaggacgaggaccgcaattcggctttcacatggaaggtccaagcgaacaatcgggcctacaatggccagtttaaggagaaagtgattttgtgttggcagagaaaaaagtacaagaccaatgtgattcgcacagctaaatacaatttttactctttcctgcccctgaatttgtatgagcagttccacagagtctccaacctgtttttcctgatcatcattattctgcagtcgatacccgacataagcactctgccatggtttagcttgagtactcccatggtgtgtctgctcttcattagggcgacacgggacttagtggatgatatgggacggcacaagtccgatagagccattaacaatcgcccgtgtcaaattctgatgggcaagagtttcaagcagaaaaaatggcaggacctgtgtgtgggggatgtcgtgtgcctgcggaaagataatattgtgccagctgatatgctgttgttggcgtctaccgagcccagttccctatgctatgtggagactgtggacattgatggagaaaccaatctgaagtttcggcaagccttgatggtgacccataaggaactagcaacaattaagaaaatggcttcttttcaagggacggtgacatgcgaagctcccaacagccgaatgcatcacttcgtcggttgtttggagtggaacgacaaaaaatatagccttgacatcggaaatttactgctgcggggctgccgaatacggaacaccgatacctgctatgggctcgtgatatacgctgggtttgatactaaaattatgaagaactgtgggaaaatccaccttaagcgcacaaagctggacctactgatgaacaagttggtcgtggtgatctttatcagcgttgtgctggtgtgtctagtgctcgcttttggcttcggttttagcgtgaaagagtttaaggatcaccactactacctgagtggtgtgcacggctctagcgtcgcagccgagagctttttcgtcttttggtcattcctcatcttactctcagtaacaatccccatgtccatgttcattctctcggagttcatttacctcggtaattctgtctttatagactgggatgtgcagatgtactataagcctcaagacgtgcctgccaaagcccgatccacctcactgaacgatcatctcggacaagtcgaatacattttttcagacaaaactggcaccctgactcagaatattctgactttcaataaatgttgcatttctggccgcgtatacggggctgctcctactcccgagctgccggcgggctcatctattttcaaaggcttgcgcgtccccgagaaccaaagtcatgtgtggccacacgcccagcacctgagaccgaatctgaaccaaggcacagttgctagatggcctggctttctgtggagaggcccaggtaaattcttcttctttctgagacagtccttgacgctttcaactcaagccgggatgcagtggtgcaatctgggatcactgcagtctccgccacctaggttcaaacgattctcatggctgagcctgccctcctcatgggattaccgccatttaccacctcacctgatcttcttgtatttctag

SEQ ID NO: 179753 - DNA, 3792 bp, Artificial Sequence
  Description of Artificial Sequence: Synthetic coding sequence
atgggcgacagccccggccggggcgcccccgagcggcggcacaaggcccaacctggtcgagcgagaaagtacgaatggaggcctgagggccctaccagtatgggtagccttggccagcgcgaagacctgcaggacgaggatcggaatagcgccttcacctggaaagtgcaggcgaacaatcgcgcttacaatggccagttcaaggagaaggtcattctttgctggcagagaaagaaatacaaaacaaacgttatcaggacggcgaagtataatttctacagcttcctcccattgaacctctatgaacaatttcatcgggtttcaaatcttttttttctgattatcatcatcctgcaatccattcctgacatatccactttaccatggttttcccttagcaccccgatggtttgcctgctgtttatacgggcaactcgtgaccttgtggacgatatgggtaggcacaaaagtgatcgagccatcaacaaccgaccatgccagatcttgatgggtaagtcattcaagcagaaaaaatggcaggacctgtgtgttggcgacgtcgtgtgtttacgaaaagacaatattgtccccgctgacatgctgctgcttgcaagcactgagcccagttcgctctgctatgtcgagacagtggatattgacggagagaccaatctcaagttccggcaggcacttatggtcactcataaggagttggcaactatcaagaagatggcaagtttccagggcaccgtgacgtgcgaagcacccaattcacgtatgcaccatttcgtgggttgtctggaatggaacgataagaagtatagcctggatatcggaaatctcttgttacgcggctgcagaatcaggaataccgacacctgctatggattggtcatctacgccgatggatacatgtttgtcggcttcgatacaaagattatgaagaattgcggtaaaatccatctgaaaaggactaagctcgaccttctgatgaacaagctcgtggttgtgattttcatttctgtggtccttgtttgtctagtgttggcgttcggatttgggttttccgtcaaggagtttaaagaccatcactactacctgtctggagtgcatggctcatctgtggccgctgagtccttcttcgttttttggtccttcctcattctgttatcggtgactattcccatgtctatgttcatcctatctgagttcatctatctgggtaactctgtgttcattgattgggatgtccagatgtactacaaaccccaggatgtccccgcaaaggcgcgctcaaccagtctgaatgaccatctgggccaggtagagtacatcttctcagataagactggtaccttgacccagaatatcttgacattcaataaatgctgtatttccgggcgggtgtatggtccagattctgaggcaacaacccggcccaaagagaatccctatctatggaacaaattcgcagacggaaaactgcttttccataacgcagctctcttgcacttagtgcgaaccaacggtgatgaggcagtgcgcgaattttggagattgttagcgatatgtcacacagtaatggtgagagagtcaccgagggaacgacctgatcagcttctctaccaggccgcgtcacccgatgagggggcactagtgacagcggcacgtaactttgggtatgtgttcctctctcgaactcaggataccgttaccattatggaactaggcgaggagcgcgtctatcaggtgttggctattatggactttaattccacccgtaagcggatgtctgtgcttgtacgcaagcctgagggcgccatatgtctgtacacaaaaggcgcagacactgtcatcttcgagcgcttgcacaggcgcggggccatggaattcgcaactgaagaagcactcgccgcctttgcccaagagactctcaggactctgtgcctggcctatcgcgaggttgctgaggacatatacgaagattggcagcagaggcatcaagaagccagcctgctcctgcaaaatcgagctcaggcccttcagcaagtttacaacgaaatggagcaggatctgaggctcctgggagcgaccgcgatcgaggatcggttacaggatggggttccagagaccattaagtgcctcaagaaatctaacattaaaatctgggtcttgaccggggacaagcaggagacagccgtgaatattggcttcgcctgcgaactgctttcggaaaacatgttgatcttagaagagaaagagatctctaggattttagagacctattgggaaaattcgaataacctcttgacgagagagtcactgtcgcaagtgaagctggctctggtgattaacggcgatttcttggacaagctcctggtgtcactgcgtaaagaacctcgggctctggcccagaacgttaacatggacgaagcatggcaggagcttggtcagtcgaggagagacttcttatatgctcgccgactcagtctgctgtgccggcgttttggcctccctctcgcagcacctcctgcgcaggacagtcgtgctaggcgaagttctgaggtgctccaggagagggcctttgttgatctggccagcaaatgccaagccgtgatctgctgccgagtgacacccaaacagaaggctctgattgtggcactggtgaagaagtaccatcaagtagtcactctggccattggcgacggggccaatgacattaatatgattaagactgccgatgttggggtcggcttggctggccaggaagggatgcaggcagttcagaactccgactttgtcctcggacagttctgctttctccaacggctgctacttgttcatgggcggtggtcatacgtccggatctgcaaatttctgagatacttcttctataagagtatggcatccatgatggtgcaggtgtggttcgcttgctacaacggcttcacgggtcagcccctgtacgagggctggttcctggcactcttcaaccttctgtattctacactgccagtgctttacataggactattcgagcaggacgttagcgccgaacagagcctcgaaaaacccgaactgtacgtagtgggacaaaaggacgagctgtttaattattgggtattcgtccaagcaattgctcacggagtgactacaagtctcgtaaactttttcatgaccttgtggatatcccgagataccgcgggaccagcatcttttagcgatcatcagagcttcgctgttgtggtcgcactaagctgtcttctcagcataacaatggaggtcatcctgatcattaaatactggacagcactttgcgtcgctactattctcctgtctctcggcttttacgccattatgacaaccacgacacagagcttctggttgttcagagtctccccaaccacgttccctttcttgtatgctgatctctccgtgatgtctagcccctccatcttgttagtggtcctgttgagtgtgtctattaacacttttccagtgcttgctttaagagttatatttcccgccttaaaagagctcagagcgaaggaggaaaaagtggaagaggggccttccgaagaaattttcaccatggagcctttgccacatgtgcatagggagtctcgcgcccggcgcagtagctacgccttctctcaccgtgagggatatgccaatctgatcacacagggtactatcctgaggcggggccctggggtatctagcgacatagcctcagagtccctggacccctccgacgaagaagcggcatctagcccaaaggaaagccagtag

SEQ ID NO: 179754 - DNA, 3933 bp, Artificial Sequence
  Description of Artificial Sequence: Synthetic coding sequence
atgggcaccggccccgcccagaccccccggagcacccgggccggcccggaacctagccccgcgccacccggccctggtgacacaggggatagcgatgtaacgcaggaggggtctggacctgccgggattcgggggggagaaacggtgatcagggccggcatgggggatagtcctggaaggggtgcgcccgagaggcgccacaaagcacagcccggacgcgcccggaaatatgagtggagacccgagggacccaccagtatgggctccctgggacaacgggaggatttgcaggacgaagataggaattccgcattcacctggaaagttcaggcaaataacagagcctacaatggacagttcaaggagaaagtgattctgtgttggcagcgaaagaagtacaagacgaacgtaatccggactgccaagtacaacttttactcattcttgcccctgaacctctatgaacagttccaccgggtatccaacttattctttctgatcattataatcctccagagtatcccagatatctcaacattaccttggttcagtttatcaacgccaatggtttgcctgctctttattcgtgctaccagggacctggtagatgatatgggcaggcataaatctgacagggctataaataatcggccgtgtcagatattgatgggtaaatccttcaaacaaaagaagtggcaagacctctgtgttggggacgtggtctgtctaagaaaagacaacattgttcctgccgatatgctacttctggcttccacggaaccttctagcctctgttatgtcgaaacagtggacattgacggagaaactaatctcaagttcagacaagccttgatggtcacacacaaggagctcgccactattaagaaaatggcctccttccaggggacggtgacttgcgaggctccaaattctaggatgcaccactttgttggttgcctagagtggaacgataaaaagtattctctcgacattggtaacctgctgctgcggggatgtagaatccgaaacactgatacttgttacggccttgtcatctatgctggctttgacaccaagatcatgaaaaattgtggtaaaatccatttaaagcggaccaaactggacctcttgatgaataagctggtggtggtaatattcatctctgtagttctggtttgtctcgtgcttgcgtttggctttgggttctccgtgaaagagtttaaggaccatcattactatctgtccggcgtgcacgggtcgtctgtggccgccgaatcctttttcgtgttctggagctttctcattttgttgtccgtaacaattcccatgagtatgttcatcctcagtgagttcatctacctggggaacagcgtgttcatcgactgggatgtgcagatgtattataagcctcaagatgtccctgccaaagccagatccacttcgctcaacgatcacctggggcaggtggaatatatcttttccgacaagacagggacactcactcagaatatcctgacctttaacaagtgctgcatcagcggtagggtgtatgggcctgactcagaagctaccacccgtcccaaagagaacccctacctgtggaacaaatttgcggacggaaagctgctctttcacaatgcggcactgctgcatctggtgagaacgaatggtgacgaagcagttcgagagttttggagacttctcgccatatgccatactgtaatggttagagaatctccaagggagcgacctgaccagcttctttaccaagcagcctcccccgacgagggagcactcgttaccgctgctcgcaatttcggatatgtgtttctcagtagaactcaagacactgtgacaatcatggagctgggggaggaacgggtctatcaggtgttggcgataatggattttaacagtactagaaagcggatgagcgtgctggtcagaaaacctgagggtgcaatttgcctttataccaaaggagccgatactgtgatcttcgagagactccatagacgcggagctatggaatttgccaccgaggaggccttagctgcgtttgcgcaggaaaccctgcggacattatgcctggcttacagagaagtcgcagaggacatatacgaagattggcaacagcggcaccaggaagcttccttgcttctccagaaccgcgcacaggccctacagcaggtgtataacgagatggaacaggatcttagattactgggcgccactgcaatagaagatcgcctgcaggacggtgtgccagaaacaatcaagtgtctgaaaaagtcaaatataaagatatgggtgctaaccggcgacaagcaggagacagctgtcaatattggttttgcatgtgagctcctctctgagaacatgctaatcctggaggaaaaggaaatctcccgcatcctagaaacctactgggagaatagtaacaatcttttgacccgagagagtctgagtcaggttaagctggccctggtcatcaacggcgatttcctggataagctgctggtgtccttgagaaaggaaccacgcgccctggctcaaaatgtaaacatggacgaagcctggcaggagctgggccagagtcggagggatttcttgtatgcacggcgattgtctctactgtgcagacgattcgggctgccattggcagccccccccgcgcaggactccagagctcgccggagcagcgaggtattgcaggaacgagccttcgtcgatctagccagcaaatgtcaggccgtcatttgttgtagggtgactcctaagcagaaggccttgatcgttgcattggtgaagaaatatcatcaggttgtcaccctggccatcggggacggagccaacgacattaacatgattaagactgcagacgttggcgtgggcctagctgggcaggagggcatgcaagctgtgcagaattcagatttcgtgctcgggcagttctgcttcttgcagagactcttactggtccacggacggtggtcttatgttcgaatttgcaagtttttgagatattttttctataagtctatggccagtatgatggtgcaagtctggtttgcttgttataatgggtttacggggcagcctctgtacgaaggatggttcctggctctttttaatctactgtactctactctgcccgtactttatattggcctgttcgagcaggacgtgtcggcagagcagagccttgaaaagcctgagctttacgttgtggggcagaaggatgagctgtttaattattgggtgttcgtgcaggcaatcgcacatggcgtaacaacaagcttggtgaatttctttatgacgttgtggatctccagagacaccgcagggcctgcgagcttcagcgatcatcagagtttcgctgtcgtggtagcgctgtcatgcctgctgtccatcacgatggaggtcatcttaattattaagtattggacagctctttgcgtcgcgactatcctactttctctgggattctacgcgatcatgactacaacaacccagtccttctggctgtttagagtaagtcctactacgttcccctttttgtatgccgacctaagcgtgatgagctccccctctatactgctagtcgtgttacttagcgtgtccatcaacaccttccccgtgttggctctgcgggttatcttccccgcactcaaggaactgcgagccaaagaagaaaaggtggaagagggaccatcagaggagatctttacaatggagcccctcccccatgtgcatagggaaagtcgcgcaaggaggagctcatacgcattttctcacagggaaggatacgcgaatctgatcacccagggtactatcttgcgtagaggaccaggggtttcctccgatatcgcgagcgagagcttggacccctcagacgaagaggcagcatctagcccaaaggagtctcagtag

SEQ ID NO: 179755 - DNA, 3006 bp, Artificial Sequence
  Description of Artificial Sequence: Synthetic coding sequence
atggaggccgcccacgccaagaccaccgaggagtgcctggcctactttggagtgtcggagacaaccggtttaacccctgatcaggtgaagcggaacctcgagaaatacgggctcaacgaactgcccgctgaagaaggaaagaccctatgggagctggtcattgaacagtttgaagatctcctggttaggatcctgctgctggctgcctgcatctccttcgtcctggcttggttcgaggagggcgaagagaccattaccgcgttcgtggaacccttcgtcatactgctgatccttatcgcgaacgcaattgtgggcgtctggcaggagaggaacgctgaaaacgcgattgaagccctcaaggaatatgaaccagaaatgggaaaagtttatagggccgaccggaaatccgttcagagaattaaggcccgcgatattgtgcctggcgatatagtggaggtcgcagtgggagacaaggtacccgccgatatccgcattctggccatcaaatcaactactctcagggtcgaccagtctatcttgaccggtgagtccgtgtctgtgattaaacacacagagcctgttcctgacccgcgggctgtgaaccaggacaaaaaaaacatgctgttttcagggaccaatattgcggccggcaaagccttgggaatagtggccactactggtgtgggcactgaaattggcaaaatccgcgatcaaatggctgcaactgagcaagacaaaactcctctgcagcaaaagttagacgagtttggtgagcagctatccaaagtgatctccctcatctgcgttgctgtgtggctaatcaacattggtcacttcaacgacccggtgcacggcgggagttggttcagaggcgccatctactacttcaaaatagccgtcgccttagcagtcgcagccatacctgaaggactcccggcagtaatcacaacttgtttggcgctgggcactcgaagaatggccaagaaaaatgccattgtccgttctcttccctccgtggagacgctggggtgcacatctgttatttgtagcgacaaaactggaaccctgactaccaaccagatgagcgtatgtaagatgttcattatagacaaggtggatggggacatttgtctcctcaacgagttttctataaccggttctacctatgcaccagagggcgaggttctgaagaacgacaagcccgtccgtcctggtcaatacgacggtctcgttgaattagccaccatctgcgccctgtgtaacgattcctctctggactttaatgaggccaagggagtatatgagaaagttggggaggctaccgaaacagccctcaccacgctggtggagaaaatgaatgtattcaacaccgacgtacgaagcctcagcaaggtagagagagccaacgcctgcaattccgtgataagacagctcatgaaaaaggagttcactctcgagtttagccgggaccggaagagtatgagcgtatattgctcccctgccaaatcttctcgggctgcagtaggcaacaagatgtttgttaaaggtgccccagagggcgtaatcgaccgatgtaactacgtacgcgtgggtacgacaagagtccccctaaccggtcctgtgaaggaaaaaatcatggctgtgatcaaagaatggggaactggacgtgacaccttgcgctgtctggccctggctacaagagacacaccacctaagcgggaggaaatggtactggatgactctgcccgattcttagagtacgagaccgacctgactttcgtaggggtcgttggcatgctggatccgccaagaaaagaagtgacaggctctatacagctttgtagggacgccggtattcgggtaataatgattacaggggataacaaagggaccgcgatcgctatctgcagacgtatcggtatttttggcgaaaatgaagaagtggcggacagagcctatactgggcgggaatttgacgacctgccattggccgagcaacgcgaggcctgcaggagagcttgctgcttcgcgcgagtggaaccctcgcacaagtccaaaatcgtggagtatttacagtcatacgatgaaatcaccgctatgaccggagacggggtgaatgatgcgccggccctcaagaaagccgagatcggaatcgcaatggggtctggcacagccgtcgccaagacagcaagcgagatggtgctcgcggacgacaatttttccaccattgtggctgctgttgaggaaggacgggctatatataacaacatgaaacagttcattcggtacttaattagttcaaacgtgggagaggtcgtgtgtatcttcctgacggcagccctgggcctacctgaagccttaatccctgttcagctgctatgggttaatctggttacggacggcctacccgcgaccgcccttgggttcaacccccctgatctggacatcatggaccggcctccacgcagcccaaaagagcccttaattagcggatggctcttctttaggtatatggcaattggcggatatgtgggcgccgccaccgtcggagctgcggcttggtggtttctgtacgctgaggatgggccccatgttaactacagccagctgacacatttcatgcagtgtaccgaggataacacccactttgagggaattgattgcgaagtgttcgaagctcctgaacccatgacaatggcacttagcgtgctggtcacaattgagatgtgcaatgctctaaatagcctgtcagagaatcagagcctcctacgcatgcctccttgggtcaatatctggctcttaggctctatctgcttgtctatgtcacttcactttctgatcttgtatgtggatcctctcccaatgatctttaaactgcgggcgctggatcttacacagtggctgatggtgctgaaaattagcctacccgttattggactggacgaaattctaaagtttgtcgcccgtaactacctggaagacccagaagacgagcgtagaaagtag

SEQ ID NO: 179756 - DNA, 2535 bp, Artificial Sequence
  Description of Artificial Sequence: Synthetic coding sequence
aagcggcggaaccccggccggcaggccgtgggccacaccgaggaggatcctcctcgggtggggactccgtggaaggagcacaccggtcccggcccacaggagggctccacgatggaagcggcgcacgccaagaccaccgaggaatgcctggcttattttggcgtctccgaaactaccggacttacccccgaccaggttaaacggaacctcgagaaatacggacttaatgaactgcccgccgaagaaggtaagaccctgtgggagctggttatagagcagtttgaggatttgctggtgcgcatcctcctccttgcagcctgtatttcttttgtcctagcgtggttcgaggagggcgaagaaaccatcaccgcctttgtagaaccttttgttattttgttaattctgatagcaaacgccatcgttggcgtatggcaggagcggaacgctgaaaacgcgattgaagccctcaaggagtatgagcctgaaatgggcaaggtctaccgagccgaccgcaagtcggtccagcgtattaaggccagggacattgtgccaggcgatattgttgaagtcgccgttggcgataaggtccccgcagatattcggatcctggctattaagtctactaccttaagggtagatcagagtattttaacaggggaatctgttagcgttattaagcacacagagccagtcccagatccaagggctgtcaatcaagacaaaaaaaatatgctgttctccggcacaaatatcgctgcagggaaagctctgggcatagtggccacgactggagtggggaccgaaataggaaagatcagagatcagatggcagctacggagcaggacaagaccccgctccagcagaaactggacgaattcggggaacaactgtctaaggttatttctctcatctgtgtggcagtgtggctcataaacattggacactttaatgaccctgttcatgggggtagctggttccgaggcgctatctattatttcaaaatcgccgtggcattggccgtcgcagccattcccgaaggcctgcctgctgttatcaccacatgcctggctttgggcactagacggatggccaagaagaatgctatcgtgcgcagcttaccatctgtggaaacattgggttgtacgtctgtgatatgctccgacaagacaggcacgctgacaacaaatcaaatgagtgtctgcaagatgtttatcatcgacaaggtggacggtgatatttgcctgctaaacgaattttcaatcactggctcgacttacgccccagagggcgaggtgctcaaaaacgacaagcccgtgagaccaggacaatacgatgggctggtggagctggcgaccatttgcgccctctgcaacgacagctcactagactttaacgaagcaaaaggcgtttacgagaaagtgggcgaggctacagaaaccgcactgaccactcttgtcgagaagatgaacgttttcaataccgacgttcggtccctttcaaaagtagaacgcgccaacgcctgcaacagcgtgataaggcagcttatgaaaaaggagttcactctggagtttagtcgcgacaggaaaagcatgtctgtgtattgttcccctgccaaaagttcacgtgcagccgtgggcaacaagatgttcgtgaagggggcccctgagggtgtgattgatagatgcaactatgtcagagtgggcactacccgggtgcctctcacgggccctgtgaaagaaaaaataatggcagtgatcaaagagtggggcactggaagggacactctaagatgccttgcacttgccacaagggacactccgcctaaaagagaggaaatggtgttggacgacagtgcacgcttcctcgagtatgagacagacttgacttttgtgggcgtagtcggcatgttggacccaccaaggaaggaagtgactggatccatccagctctgtagagatgctggaattcgggtgatcatgatcacgggcgataacaagggtactgcgatagctatttgtcgaagaattggaatttttggagaaaatgaggaagtggccgatcgggcttacaccggtcgggagttcgacgacctcccccttgccgaacagagggaagcctgtcgccgggcatgctgctttgctcgagtcgaaccctcccacaagtctaaaatagtggagtatttacagtcatacgatgagattaccgccatgaccggcgatggagttaacgacgctcctgccctcaaaaaggctgagatcggcatcgcaatgggatccggtaccgctgtagccaagactgcaagcgagatggtactcgctgacgataactttagtacgatagtggcagccgttgaggagggacgcgccatctataacaacatgaaacagtttattcgatatctgatatcttcgaatgttggggaggttgtatgtatcttcctgactgcagccctggggctccccgaagctcttattcctgtgcagctgctgtgggtaaatctggtgaccgactgtgctgagcttcttatttactag

SEQ ID NO: 179757 - DNA, 2985 bp, Artificial Sequence
  Description of Artificial Sequence: Synthetic coding sequence
atggaggccgcccacgccaagaccaccgaggagtgcctggcctactttggcgtttctgagaccacaggtttgacgccagaccaggttaaacgcaatctggagaagtacgggctgaatgagctgcccgccgaggaaggcaaaactctgtgggaactggtaatcgagcagttcgaggatttattggtgaggatcctgctgctcgccgcttgcatatctttcgttctggcctggtttgaggagggggaagagacgatcactgcattcgtggaaccctttgtaatcctcctcatcctgatcgccaatgcaatcgtgggtgtatggcaggagagaaacgctgaaaacgcaatagaggccctgaaagaatatgagccagagatgggtaaggtgtatcgtgctgaccggaaaagcgtgcagaggattaaggctcgggatattgttcccggagatatagtggaagtcgccgtcggagacaaagtacccgcagatatccgtatcctcgccatcaaatccacaaccctgcgcgtggatcaatcaatcctgacgggcgagtccgtttccgtcatcaaacatacggaacctgtgccggaccctagggcggtgaatcaggacaagaagaatatgctcttttcaggaacaaatatcgccgcaggaaaggcactaggtatcgtggccactacaggagtgggcactgaaattggcaaaattcgggatcaaatggctgctaccgagcaagacaagacgcccttacagcagaaactcgacgaatttggggagcagcttagcaaagttatttctctgatttgcgtcgccgtctggctgattaacatcggacactttaatgatcccgtacacggaggatcctggttccgtggtgctatatactactttaagatcgctgtggcactggccgtagctgctatccccgaaggcctccccgccgtgatcactacatgtctggctttgggcacacgcaggatggcgaaaaaaaacgctatcgtgcgttcactgccaagcgtggagacactggggtgtacctctgtaatttgttccgataagacaggtacccttacgactaaccagatgagcgtctgcaaaatgttcatcatagataaagtggacggcgacatttgtctgctgaatgagttttccatcactggatctacatatgcaccagaaggcgaggtcttaaagaatgataagccagtgaggcctggccagtacgacggcttggtggagctagctacaatctgtgcactgtgtaacgattcttccttggacttcaacgaagctaagggcgtgtatgaaaaggtgggtgaagctaccgaaactgctctgacaacacttgtggaaaaaatgaacgtgtttaatacagatgtgcggtcactgtctaaagtcgagagggccaacgcctgcaacagcgtgattcgacaattgatgaaaaaggagtttacattagaattcagcagggatcggaaatctatgtctgtgtattgtagtccggccaaatcttctagggctgctgtaggcaataaaatgttcgtgaagggcgcacctgaaggggtgattgacaggtgcaactacgtgcgtgtcgggacaactagggtgcccctcactgggcccgtgaaagagaaaattatggctgtaatcaaagagtggggaaccggacgagatacacttaggtgtctggctctggctacgcgcgatacgccccctaagagggaggaaatggtgctcgacgattccgctaggtttctggagtacgagactgacctcacattcgtcggggtggtaggaatgctggaccctccccggaaggaggtcactggatccatccaactgtgtagggatgccggaataagagtcataatgattaccggcgataacaagggtaccgctatcgctatttgtaggaggattggcatctttggcgagaacgaagaggtggcagatcgagcctataccggccgggagtttgacgatttaccattggcagagcaaagagaagcttgccgccgtgcttgctgtttcgctcgagtggagccgagtcataagtcaaagatcgtggaatacctgcagagctacgacgagataaccgccatgaccggtgatggcgtcaatgatgcccccgctttaaagaaggctgagataggtatcgcgatgggtagcgggactgcagtggcgaaaaccgccagcgagatggtgctggctgatgacaactttagtaccatcgtagccgctgttgaggagggacgagcgatctacaataacatgaagcagtttatccgatacctcatcagctccaatgtcggggaagttgtctgtatttttttgactgccgcgcttggtctgcctgaagccctgattccagtgcaactcctttgggtaaatctagtcaccgatggactgcctgcaacagctctgggtttcaatccgccggatctggatattatggacaggcctccaagatccccaaaagaacccctcataagcggctggctctttttccggtatatggccatcggtgggtacgtgggcgcagccaccgtgggggccgcagcttggtggttcctgtatgctgaggatgggcctcacgtgaattactcacagttgacgcatttcatgcagtgcacggaagacaacacccattttgaagggatcgactgcgaagtatttgaggcacccgaaccgatgaccatggctctttcagttctggtgacaatagaaatgtgtaacgccctcaattccctatcagaaaatcaatcactgctgaggatgcctccttgggtaaacatctggcttctcggatccatctgcctgtctatgtcgcttcacttcttgatcctgtatgttgaccctcttcctatgatatttaagctgcgtgccctcgacctcacgcagtggctaatggtgttgaaaatatctctgccagttataggtctggacgagatcctgaaattcgtggctaggaattaccttgaaggttag

SEQ ID NO: 179758 - DNA, 2610 bp, Artificial Sequence
  Description of Artificial Sequence: Synthetic coding sequence
atgggcaaggtgtaccgggccgaccggaagagcgtgcagcggatcaaggcacgtgacattgtccctggcgatattgtggaagtggctgtcggcgacaaagtgcccgccgatatccgaatcctggcaatcaagtccaccacactgagagtcgaccagtccatcctgacgggagaaagtgtatccgtcattaagcacacagagcccgttccagatccccgtgctgttaaccaggataagaaaaacatgctgttctccggtactaacattgctgccggaaaagcccttgggatcgtggcgacgaccggagtcggtacagagattgggaaaataagggatcaaatggccgcaactgagcaggataagacacccctccaacagaagctggatgagttcggtgagcagctctcaaaggtgatctcactgatatgtgtggcagtgtggttaattaatatcggccacttcaacgatcccgtacatgggggtagttggttccgtggggcaatttactattttaaaattgcagtagcacttgctgtggcagccatcccagagggtctgcccgccgtgatcacaacgtgtctggccttgggtacccggagaatggcgaagaagaacgctatcgtgcggagtctgcccagcgtggagaccctaggttgtaccagcgttatttgtagtgacaaaacaggtacactgactacgaaccagatgtcagtctgcaaaatgtttattatcgacaaggtagatggtgatatctgccttctgaacgagttcagcatcaccggatcaacttacgcgcctgagggagaggtcctgaagaacgataagccggtgaggcccgggcagtacgatggattggtagagctggctacaatttgtgccctttgcaacgattcgagtctggatttcaacgaggcgaagggcgtttacgagaaagtgggcgaggccaccgagactgctctgacaacacttgtagaaaagatgaacgtgttcaacactgatgtacgctctctgtccaaagtggagagggcaaatgcgtgtaacagtgttattaggcagctgatgaaaaaggagttcaccctcgagttttctcgagaccggaaaagtatgtcagtgtattgctcaccagcaaaatccagcagggcagccgtcggcaataaaatgtttgttaaaggagccccagaaggagtgatcgacagatgtaattatgtacgggtaggcacgaccagagtgcccctgacgggccctgtgaaagaaaaaatcatggccgtgataaaggagtggggaacgggtagggacacattgaggtgtttagccctagctacaagggacacacctccaaaacgagaggagatggttctcgatgattcagccagatttctcgagtatgagacagacttgactttcgttggcgtcgtcggcatgctggacccgccgcgcaaggaggtgaccggctctatacagctgtgtcgcgacgcgggaattagggttattatgattacaggagataacaaggggacagccatcgcaatctgccgaagaatcggcatctttggggaaaacgaggaagtggcggacagggcgtacaccggcagggaatttgacgaccttccactggccgagcagcgggaggcttgcaggagagcttgttgttttgcgcgagtggagcctagccataagagcaaaatcgtggagtacctccagtcatacgatgaaataacagccatgacgggcgacggtgttaatgatgcgcctgcacttaagaaagctgaaattggcatagcaatgggatcaggaacagctgtcgctaagacagcctctgaaatggtgctggctgacgataatttctctacaatagtggccgccgtcgaagaaggccgggcaatatacaacaacatgaagcaatttattagatatctcatctcatctaacgtgggcgaagtagtgtgtatcttcttgactgctgccctaggattgccagaagcactgatcccagtgcagctcctgtgggtcaacctggtgacagacggcctgccagctacggccctgggattcaacccaccagatctggatatcatggatcggcctccccgctcgcctaaagagcctttgatctcaggatggctattctttagatacatggcaatcgggggatacgtgggtgctgccacggtcggtgccgctgcatggtggttcctgtacgccgaagacggccctcacgtgaactatagccagcttacccacttcatgcagtgtactgaggacaatacgcactttgaaggcatagattgcgaggtcttcgaggcccccgagcctatgactatggccctgtccgtgttggtgactatcgagatgtgcaatgcgctgaatagcctctctgagaatcagagtctgctcaggatgcccccctgggttaacatatggctgctcgggagtatctgtctgtctatgtcccttcactttttgattctttacgtggacccgctgcccatgatcttcaaattgagggctctcgacctaactcagtggcttatggtactcaagatttccctgcccgtaattgggctcgatgaaattctgaagttcgtagcccgaaactacctcgaggggtag

SEQ ID NO: 179759 - DNA, 2994 bp, Artificial Sequence
  Description of Artificial Sequence: Synthetic coding sequence
atggagaacgcccacaccaagaccgtggaggaggtgctgggccacttcggcgtaaacgagtcaaccggcctgagccttgaacaggtgaaaaaacttaaagaacgatggggatccaatgaattgcctgccgaggagggaaaaacacttctagagcttgttatcgagcagtttgaagacctgttggtccggattctcctgctggcggcctgcattagtttcgtgcttgcttggttcgaggaaggcgaagagaccattactgcctttgtggagccgtttgtcatccttctgattctagttgctaacgccatcgtgggggtctggcaagaaaggaatgctgagaatgccattgaagctctgaaggagtacgagcccgaaatgggtaaagtgtacaggcaggaccgaaagtctgtgcagcgcatcaaggctaaagacattgtgccaggtgacatagtcgagatcgcagtcggtgacaaggtaccagcggacatccgccttacgagtatcaaaagtacgaccttgagagtcgatcagtctatcctcacaggagagtcagtaagtgtcatcaagcatacagacccagtgcctgacccaagggcagtcaaccaggataaaaagaacatgctgttttcaggcaccaacattgcagcggggaaggccatgggggtagtcgtggccacaggagtgaacaccgagatcggcaaaatccgcgacgaaatggttgccacagaacaagaacgtacccctctgcagcagaaactggacgagtttggagagcagctttcaaaagtgattagccttatatgcattgctgtgtggattatcaatatcggacattttaatgacccagtgcatggagggtcttggatccgcggggcaatttactactttaagattgcagttgcgttagcagtcgcggcaatacctgaagggctcccggccgttatcacaacttgtctagccttgggcacccgcaggatggctaaaaagaacgccatcgttagatctctgccctcagtggaaaccctcggatgcacctcagtcatatgtagtgataaaactggtactctcactacgaaccagatgtcagtgtgccggatgtttattctggacagggtggaaggcgacacatgttctcttaacgagttcactatcactggctccacttacgccccaatcggggaggtgcataaagatgataaaccagttaattgccaccagtacgatggacttgtggaactagccaccatatgcgcgctttgcaatgatagtgctctcgattacaatgaagctaagggggtgtacgaaaaggtgggggaggctactgaaacagccctgacatgtctggtcgaaaagatgaacgtcttcgacacagaactaaagggcctgtcgaaaatcgagagagctaatgcatgtaattctgtaataaagcagttgatgaaaaaggaattcacactggagttttccagagacaggaagtcaatgtctgtgtactgcacccctaacaagccatccaggacctccatgagcaaaatgttcgttaaaggggcccctgagggcgtgatcgaccgctgcacccatatccgtgtgggctcgactaaggtccctatgacctcaggcgtgaaacagaagattatgagtgtgatcagagaatgggggtccggttctgacactctccgttgtctggccttggcaactcacgataatccccttcggagagaggaaatgcatctggaggatagcgccaattttatcaagtatgaaacgaatctgaccttcgtgggttgcgtgggtatgttggaccctccacggatcgaggtggcctcgagtgtgaagctttgtcgacaggccggaattcgtgtcatcatgataacgggagacaacaaagggacagccgtggctatctgccgtcgcatcggcatcttcgggcaggatgaagatgtgacctccaaggccttcaccggccgagaatttgatgaactcaacccctcagcccaaagggacgcctgcttaaacgccagatgttttgctagagtggagccttctcacaaaagcaagatagtcgaattcctccagtctttcgatgaaatcaccgcaatgacaggggatggtgtcaatgatgcacccgcgctgaaaaaagccgaaatcggaattgccatgggatccggcactgcagtggctaaaacggcgagtgaaatggtgctggctgacgacaacttcagcacgatcgttgctgccgtcgaggagggcagggcaatatataacaatatgaaacagttcatacggtacctgatctcaagcaacgtgggtgaggtggtgtgcatcttcctaaccgctgccctaggcttcccggaagccctgatccctgtgcaactgttatgggtcaaccttgtgactgacgggctccctgccaccgcactcggatttaatcctccagatttggatattatgaacaagcctcctcgaaatcccaaagaacctctgatcagtggctggctgttttttaggtatctcgcaattggatgctacgtgggcgccgccacagtgggcgccgctgcttggtggttcatcgctgctgacggcggccccagggtcagcttctatcagctgtctcattttctgcagtgcaaggaagacaaccccgactttgaaggtgtcgattgtgcaatttttgagtccccctaccctatgacaatggccctatccgtgcttgtgacaatagagatgtgcaatgcactgaattcactctcagagaaccagagtcttctccgaatgcctccctgggaaaatatttggctggtggggtcaatatgcctgtccatgtctcttcacttcctcatcctatacgtcgagccgttgccgcttatctttcagatcacaccactcaacgtaacccagtggttgatggtactgaagatctcgttgccagtaatcctcatggacgagaccttaaaatttgtggctaggaactacctcgagcccgccatcctcgagtag

SEQ ID NO: 179760 - DNA, 3048 bp, Artificial Sequence
  Description of Artificial Sequence: Synthetic coding sequence
atggagaacgcccacaccaagaccgtggaggaggtgctgggccactttggagtgaatgagtccacaggtttatcactggagcaagttaagaagttaaaggaaaggtggggcagtaatgaactcccggcagaggaggggaaaactttgctggagctggtgatcgagcaattcgaagatttgctagtgcgaatcctgctgctggcggcatgcatttctttcgtgctcgcatggtttgaagagggagaggagaccatcacggcatttgtggaaccgttcgtgattttgctcattctggtcgctaacgccatcgtcggcgtgtggcaggaacgcaatgcagagaatgcgatcgaggccctcaaagagtacgagcctgagatggggaaggtgtaccgccaggatcgcaaatctgtacagcgcataaaggccaaagatatcgtacctggggatatcgtggagattgccggtgagagcgtgtccgtaataaaacacaccgacccagtcccggaccctagagcggtaaaccaagataagaagaacatgctgttttcagggaccaatatcgctgccggtaaagcaatgggagttgtggttgccaccggtgtgaacacagagataggtaaaatcagggacgagatggttgcaacggagcaggagcgtaccccccttcagcagaagttagatgagtttggagaacaactgtcaaaggtcatctcattgatatgtattgcagtctggataatcaatattgggcactttaatgaccccgtgcatggcggatcatggatcagaggcgctatctactacttcaagatagctgtcgccctcgccgtcgctgccattccagagggactgcctgcagtcattactacgtgtttggcattaggaacgcggaggatggccaagaagaacgccatcgtcaggagcctgccatctgtggagacgctcggatgtacctctgtgatatgctctgataaaaccggcacccttacaactaatcagatgagcgtatgtcgcatgtttatattggatcgtgtcgagggagacacgtgcagcctgaacgaattcacaattaccggttcaacgtatgcacccattggcgaagttcacaaggatgacaagcctgtgaactgtcatcaatacgatggtctcgtcgaactagctacaatctgtgccctatgtaacgacagtgcgctggactacaatgaagccaagggggtgtacgagaaggtgggcgaggccacggagaccgctctcacttgcttggtcgaaaaaatgaacgtatttgatacagagctgaaaggcttgtccaagatagagcgggcaaatgcttgcaattctgtgatcaagcaactaatgaagaaggagtttactcttgagttttcccgcgacaggaagagcatgtccgtgtactgcactcccaacaagcccagccgaacgtctatgagcaagatgtttgttaaaggcgcgcccgagggtgtaatagaccggtgtactcatatcagggtgggatcaactaaggtgcccatgacatccggcgtgaagcagaagattatgtctgttatacgagaatggggctctggatctgacaccctgaggtgtttggctctggccacgcatgacaatcccctccgcagggaggagatgcatctggaagactcggccaacttcattaaatacgagaccaacttgaccttcgtgggttgtgtcggcatgctggaccctccacgcatagaagtggcgtcctccgtaaaactttgcaggcaggccggcatacgggtcataatgataacgggagataataagggtacagctgtggcgatctgtcgtagaattggcatttttggccaagatgaagacgttaccagcaaggccttcactgggagggaatttgacgagttgaatccgtcagcccagcgggacgcttgcctcaacgcacgatgttttgcacgcgtcgagccctcacacaaaagcaaaatagtagagttcctccaatctttcgatgagatcactgccatgactggcgacggcgtgaatgacgcccctgcattgaagaaggccgaaatcggcattgccatgggctccgggactgccgtggcaaagaccgcaagtgaaatggtgttagcagacgacaacttctcaacaatcgtggcggccgtggaggaggggagggcaatctacaataatatgaaacagtttattcgctatttgatttcatcgaacgtcggtgaggtcgtttgtatttttctaacagccgcccttggattccctgaagctctgatcccagtgcagcttctgtgggtgaacttggttaccgacgggctgcccgcgactgcactcgggtttaatccgcctgacttagatattatgaataaacctcccagaaaccctaaggagcccttaatatccggctggctgttttttaggtacttggctataggctgctatgtgggagctgctaccgtcggggcagccgcctggtggttcatcgccgcggatggtggtccaagagtgtctttttaccagctcagtcacttcctgcagtgcaaggaggataaccctgatttcgagggagttgattgcgctatattcgagtcgccctacccaatgacgatggcactttccgtgctggtgactatcgaaatgtgcaacgcactcaactcactatcggagaaccagtcattactgcgtatgccaccttgggagaacatatggctggttggctcgatttgcctgtccatgtcgctgcattttctgattttgtatgtagagcccctgccattgatcttccagattactcctttaaatgtcacccagtggctaatggtgttgaagataagccttcccgtcatcttaatggacgaaacgttgaagttcgtggccaggaattacttggaacctggaaaggaatgcgtgcagccggctacaaaatcttgctcattctcagcctgtaccgacggaatctcatggccattcgtgctgttgataatgcctctggttatctgggtgtacagcactgataccaatttctctgatatgttttggtcgtag

SEQ ID NO: 179761 - DNA, 3129 bp, Artificial Sequence
  Description of Artificial Sequence: Synthetic coding sequence
atggagaacgcccacaccaagaccgtggaggaggtgctgggccacttcggagtaaacgagtcaacaggactcagcctggagcaagttaagaaactgaaagagcgatggggcagcaatgaattgcctgctgaagagggtaaaactctgttggagctcgtgattgagcagtttgaagatctcctagtgcgaattctgcttctggcagcttgcatttcatttgtgctggcctggttcgaggaaggagaagaaactatcaccgcattcgtggagccgtttgtaatcctcttgatcctggtggctaacgcaatcgtcggggtgtggcaagaaagaaacgctgagaatgcgattgaagctctaaaagaatacgagccagagatgggcaaggtgtatagacaggaccgaaaaagtgtccaacgcattaaagcaaaggacattgtccctggcgacattgtcgagatcgccgtcggcgataaagtgcccgcagatattcggctcacgtctatcaagagcaccacactaagagtggatcaaagtatactcacaggagaaagtgtgtcagtcattaagcatacagatcctgtgcctgaccctagagctgtgaaccaggataagaagaatatgctgttttctgggacgaatattgcggcaggtaaggctatgggagttgtcgttgcaacgggggtgaatactgaaattgggaaaatcagagatgagatggtagccacagagcaagagaggacgcccctccagcagaagctagacgagttcggcgaacagctctccaaggtaatctctttaatctgcatcgcagtctggatcataaatataggccatttcaacgatccagtgcatggaggctcttggattcggggagcgatctattactttaagatcgctgtggccctcgctgtggctgcaattcccgaaggactcccagccgtaattaccacttgcctggctctgggcacgcggcgtatggcgaaaaagaacgcgatagttaggtcgctacctagtgtggaaacattaggctgtacctctgtcatatgcagcgacaaaacaggaactctgactactaatcaaatgtcagtatgccggatgtttatcctcgaccgggttgagggcgatacctgttccctgaatgagttcactatcactgggtcaacatacgcgccaatcggggaggtccataaagatgacaaaccagttaattgccaccagtatgacgggctcgtcgagcttgctacaatttgcgctctgtgtaacgactctgccctggactataacgaagccaaaggagtttatgaaaaagtgggcgaagcaacagagaccgccttgacctgtttggtggaaaagatgaatgtgtttgataccgaattaaaggggctgtcaaagatcgagagggctaatgcatgcaatagtgttatcaagcagctaatgaagaaagagtttactctggaatttagtagggaccgaaagtcgatgtcagtgtactgcacacctaacaaaccatctcggacctcaatgtctaaaatgtttgtaaaaggagctccagaaggcgtaatcgataggtgcacccacattagggtaggttccacaaaggtacccatgactagcggagtcaagcagaaaatcatgagcgtgataagagagtggggttccggaagtgatactctgcgctgtctggcccttgccacacacgataaccctttgagaagagaagaaatgcacctcgaggacagcgctaacttcatcaaatatgagaccaatctcacgttcgtcgggtgcgtaggaatgctagatccaccaaggattgaggtagcctcgagcgttaagctgtgccgccaggctggcatccgagttattatgatcaccggcgacaacaaagggaccgcagttgctatctgccgcaggatcggaatatttggccaggacgaggatgtcacaagcaaggcctttacggggagagagtttgacgagcttaatccctctgcacagcgggatgcatgccttaatgcccgctgttttgcccgcgttgagccttcccacaagagcaaaatcgttgagttccttcagtctttcgacgagattacagcaatgaccggggatggagtgaacgatgctccggctctgaagaaagcagaaatcggaattgccatgggctctgggacagccgtcgccaaaactgcctcggaaatggtcctcgccgatgacaacttcagcactatcgttgccgctgttgaggaagggcgggctatttataacaatatgaagcagtttatcagatatctaattagcagtaacgtgggcgaggttgtatgtatcttcctgacggcagcgcttggctttccggaggccttaataccggtacagctgttgtgggtgaaccttgtgacggatggattacccgccaccgctctgggctttaatcccccagacttggacataatgaataaacctccaaggaacccgaaagaacccctgatcagtggctggctgtttttccggtacctggccatcgggtgctacgtgggcgccgccaccgtcggtgcggcagcctggtggttcatcgccgccgatggcggccctcgtgtgtctttctaccagctttcccactttcttcagtgcaaagaggacaatccagactttgaaggggttgactgcgctatctttgaatccccatatcccatgaccatggcactttcagtcttggtgacaatcgagatgtgtaatgcccttaactctctctccgagaatcagtcacttctgcggatgcctccctgggagaacatttggttggtcggctccatctgcctgtctatgagcctgcatttcctgatcctgtatgtagagccattaccgctgatcttccaaataactcccctgaatgtgactcagtggttgatggttctgaagatctcgctcccagttatattgatggacgaaactttgaaatttgttgctcgaaattatcttgagcctggcaaagagtgtgttcaaccagcgaccaagtcctgcagcttttctgcatgcaccgatggaattagttggcctttcgtgttactgattatgccattggttatctgggtctactctacggatacaaacttctccgacatgttttggagctag

SEQ ID NO: 179762 - DNA, 2802 bp, Artificial Sequence
  Description of Artificial Sequence: Synthetic coding sequence
tgaaccatcaccgccttcgtggagcccttcgtgatcctgctgatcctggttgccaacgccatcgttggcgtctggcaggagcgaaatgccgagaacgcgattgaagccctgaaggagtatgagcccgagatgggcaaggtctatcgacaggaccgcaaaagtgttcaacgtatcaaggcaaaagatatcgtaccaggcgacatagtcgaaatcgcaggtgagtcggtctcggtgattaagcatacagacccagttcccgatccccgcgcagtgaaccaggacaagaagaacatgctcttttccggaacaaacatagccgccggaaaagcaatgggggtggtcgtcgctaccggggtgaacactgagattggcaaaattcgtgacgagatggttgccactgaacaggagagaacccccctgcagcagaagctggacgaatttggagagcagctgtctaaagttattagtctcatctgcattgcggtttggatcatcaatatcggccacttcaacgaccctgttcatggaggctcttggattcgcggcgccatctattacttcaagatcgccgttgcacttgctgtggctgcaatacccgaaggactccctgccgttattaccacctgcctggcattaggaactcgaagaatggctaaaaagaacgctatcgtgagatcacttccctctgtggaaacactgggctgcaccagcgttatctgctccgacaagacgggaacgttgacaactaaccagatgtcagtgtgcaggatgtttattctggatagagtggagggtgacacgtgttctctcaacgagtttaccattactgggtccacttatgcaccaatcggggaggtgcacaaagatgataaaccagtgaattgccaccaatacgatggcttagtggaattggccacaatatgcgccctctgtaatgacagcgccctggactacaatgaagcaaaaggtgtgtacgaaaaagtaggcgaggctacagagacagctctgacatgtcttgtcgagaaaatgaatgtgtttgataccgaactcaaaggcttgtcaaaaatcgagcgggccaatgcttgcaactccgttattaagcagctgatgaaaaaagagtttacactggagtttagtcgtgatagaaagtcaatgagcgtatactgtacccccaataaaccctccaggactagcatgtcaaagatgtttgtaaagggggcaccggaaggagtaattgaccgctgcacacacattcgcgtaggcagcacaaaagtccccatgactagcggcgtgaagcagaagatcatgtccgtgatccgcgagtggggcagtggctctgacactctccggtgcctggccctggctacacacgacaatcccctgaggcgcgaggaaatgcacctcgaagacagcgctaatttcatcaagtacgaaacaaacttaactttcgtgggctgtgtcggcatgctcgacccaccccgtattgaagtggcatctagtgtcaagctgtgtcggcaggcggggattcgcgtaattatgatcacaggcgacaataagggaactgcggttgcgatttgtcgaagaataggaatcttcggccaggatgaagacgtgacctcgaaagcatttacgggccgggagttcgacgaactcaatccctccgcccagagggacgcctgcttaaatgcgaggtgcttcgcgcgcgtagaaccatcccacaagtctaagattgtcgagtttctgcaatcattcgacgagattacggctatgaccggggacggcgtcaacgacgcgcctgctctgaagaaggcagagattggcatcgcgatgggctccggtactgcagtcgccaaaacagcgtccgaaatggtgttagcagacgacaatttttccactattgtggccgccgtggaggaaggtagagccatctataataatatgaagcaatttataagatacctgatttcctccaacgtcggcgaggtggtctgcatcttcctgaccgccgctctggggtttccagaagctctcattcccgtgcagctgctctgggtgaatcttgtcaccgacggtctgcctgccaccgcattgggtttcaatccacccgatctcgatataatgaacaaaccacccagaaatccaaaagaacctctgatcagtggatggctgttttttaggtacttggctattggatgttacgtcggcgctgctacagttggagccgccgcatggtggtttattgcagccgatggcggcccccgtgttagcttctaccagctctcccactttctccagtgtaaggaagataatccagactttgaaggcgtcgactgtgccatcttcgagtccccttatcccatgactatggcgcttagtgtcttggttactatcgagatgtgcaatgctctcaattctctcagcgaaaaccaaagcctgctcaggatgcccccatgggaaaatatctggctggtgggcagcatttgcctgagcatgtcattgcactttctgatcctctatgtggagcctctgcccttaattttccagattacccccctaaacgtcactcaatggcttatggtcctgaaaatttccttacctgttattctgatggacgagacgcttaagtttgttgcgaggaattacttggaaccagggaaggagtgcgttcagcccgctacaaagtcctgttctttctccgcgtgtaccgatggaatatcttggccattcgtactgctgataatgcctttggtcatatgggtgtactccactgacacaaatttttcagacatgttctggagctag

SEQ ID NO: 179763 - DNA, 3663 bp, Artificial Sequence
  Description of Artificial Sequence: Synthetic coding sequence
atgggcgacatggccaacaacagcgtggcctacagcggcgtgaagaactccctcaaagaggccaaccatgacggcgactttggaatcacactggctgagttgcgagcgctgatggagctgcgaagtactgatgcccttcgaaaaatccaagaatcctacggcgatgtctatggaatttgcaccaaactgaagacctcccccaacgagggcctgtctggaaatccagcagatctggaacgcagagaggctgtgtttggaaagaattttatccccccaaaaaaacccaagacctttctgcaactcgtgtgggaagcactgcaggacgtgaccttaatcatcttggaaattgctgccattgtgtccttgggcctttcattttatcagccaccagagggtgataatgccctgtgtggcgaggtgagcgtaggagaggaggagggcgagggggaaaccgggtggatcgagggggctgctatcctgctgtcagtcgtctgtgttgtgcttgtgaccgcctttaacgactggagcaaagaaaaacaatttaggggattgcagtctcgcatcgagcaggagcaaaagtttaccgtgatccgggggggacaagtcattcagatcccagtggccgacatcactgtgggcgatatagcccaggttaagtatggagatctccttcctgccgatggcatactgattcaggggaatgacttgaaaatcgatgaaagtagcctcacaggagagtccgatcacgtcaagaagtcgctggataaagacccactgctcctgtcaggaactcacgttatggaagggagcggtcgaatggtggttactgcagtgggcgtgaacagccagactggcatcatattcactctcctgggcgctggaggggaagaggaggagaagaaggatgaaaagaagaaggaaaaaaagaataagaagcaggatggagcaatcgaaaataggaataaagctaaagcgcaggatggggcagcgatggaaatgcagccgctgaagagtgaagagggcggggatggagacgagaaggataagaagaaggcgaatcttcctaagaaagagaagtctgttctgcaaggcaagctaaccaaactcgccgtccagatcggaaaggccggcctgctaatgtcggccataactgtgatcattttagttctatatttcgttattgacacattctgggttcagaagcgtccatggctcgctgagtgcactcctatttatattcagtactttgttaaattctttattatcggagtgaccgtcctcgtggtggccgtgcccgaaggtttaccactggccgtcaccatatccctggcctacagcgtcaagaaaatgatgaaagacaacaatttagtacggcacctggacgcctgtgaaactatgggaaatgctacagcaatctgttcagataagacgggtacgttgacaatgaatagaatgaccgtggtacaggcttatattaatgagaaacattacaaaaaggtgcctgaacccgaagctatcccccctaacatcctgtcctacctggttactggcattagtgtaaattgcgcgtacacctccaaaatattaccgccagagaaagaaggagggttaccacgccacgttggcaacaagacagagtgcgcccttctggggcttctgttagacctgaagcgagattaccaggacgtgaggaatgaaatccctgaggaggccttgtacaaggtgtatacctttaacagcgtccggaagtctatgtccaccgtactgaagaactcagatggcagttacagaatcttctccaagggagccagcgagataatcttaaagaaatgttttaagatcctgtcagctaacggagaggcaaaggttttccgcccccgggatcgggatgatattgtcaaaacagtgatcgagccaatggcctctgaaggactgcgtactatctgtctggcttttcgtgattttcccgcaggtgagcctgaaccagagtgggacaatgaaaatgacatagttactggtttgacctgcattgctgtggtgggaatagaagatccagtacggcccgaggtgcctgatgccatcaaaaaatgccagagggccggcatcacagtgaggatggtaacaggagataacataaacaccgcccgagccattgcaacaaaatgtggtatactccaccccggagaagattttctttgccttgaagggaaggactttaatagaaggataagaaatgagaagggtgagatcgagcaggagcggatcgataaaatatggccaaaacttagggtcctggccagatcatcccccacagataaacacactctggtgaaaggcattattgatagcaccgtgagcgaccagaggcaggtcgtcgcggtgaccggtgacggaactaacgatggacccgctctgaaaaaggccgatgtgggtttcgccatgggaatcgccggcactgacgtagccaaagaagccagcgacataattctgaccgatgacaactttacatcaatagtcaaagccgttatgtgggggcgaaatgtttacgactcaatatccaagttcctacagtttcagctgacagtgaacgtggtggcagtcattgtggccttcacaggggcgtgtatcacccaggatagccctttaaaagccgtgcagatgttgtgggtcaatctgataatggataccctggccagtctggccctggcaaccgagcctcccaccgagtccctcttgctccgcaaaccatatggaaggaataaaccattgatttcacgcactatgatgaaaaacattctggggcacgcgttctaccagctcgtcgtcgtgttcactttactgttcgcgggggaaaaattttttgacatcgatagtggccgcaatgccccgctgcatgccccgccttcagaacactatactatagtgtttaataccttcgtgttaatgcaactgttcaatgaaattaatgctcgaaaaatccacggggaaaggaacgtgtttgaagggatttttaacaacgccatattctgcactattgtgctggggaccttcgttgtacagattatcatagttcagtttgggggcaagccattctcttgttcagagctgagtatcgaacagtggctttggtccatctttctcgggatgggaactttactatggggacagttgatctcaaccatacccacgagccgccttaagtttttaaaagaggccggccacggaacccagaaggaggagattccagaagaggagctggctgaagacgttgaggaaattgatcatgcagaaagggagctgcgccgagggcagattctatggttcagaggactcaaccgaattcagacccagatcagagttgttaatgcctttagatcgtcactgtacgagggtcttgaaaagcctgagtcccgaagctccatccacaattttatgacacaccctgaattcagaattgaagactccgagcctcatatcccactgatagacgatactgatgcagaagatgacgctccaaccaagagaaactcttcaccccctccatcacccaataaaaacaacaatgccgtcgattctgggattcatctcaccatcgagatgaataaatcggccacgagctccagtcccggctctccactccattccctcgaaacaagtctgtag

SEQ ID NO: 179764 - DNA, 3555 bp, Artificial Sequence
  Description of Artificial Sequence: Synthetic coding sequence
atgggcgacatggccaacaacagcgtggcctacagcggcgtgaagaactcactcaaagaagccaatcatgatggtgacttcggcatcacactggcagagctgagggcattgatggaactcagatccaccgatgccttgaggaaaatacaggagtcctacggagatgtatacgggatttgtactaaactcaagacttcacctaacgagggcctctccggcaaccctgctgaccttgagaggcgagaagctgtgttcgggaagaattttattccccctaaaaagccaaaaacttttcttcagctggtttgggaagctctgcaagatgtcacacttatcattctggaaatcgctgccattgtatcactggggctgagtttttaccagccaccggagggcgacaacgcgttatgcggggaagtgtctgtgggcgaggaggaaggagagggtgagaccgggtggatcgaaggcgccgctattctcctatccgtggtgtgtgttgtactcgtcacggcgtttaatgattggagtaaggaaaaacagttcaggggcctgcagagtcgcattgaacaggagcagaagtttactgttattcgcggtggtcaggtaatccagattcctgtggctgatatcaccgtgggcgacatagcccaagtcaaatacggcgatctactgcctgctgacgggattttaatccaaggaaatgacctcaaaattgatgagtcctctctaactggagagagtgaccatgtcaagaagtcccttgacaaagaccctctgctgttaagcggcacccatgtgatggaaggtagtggaagaatggtggtgaccgcggtcggggttaactctcaaaccgggatcatttttaccctgcttggagcagggggtgaagaggaggagaagaaggacgaaaagaagaaagagaagaaaaacaagaagcaggatggcgcgattgaaaataggaataaggccaaggctcaagacggggccgccatggagatgcaaccattaaaaagcgaggaggggggggatggtgacgagaaggacaagaagaaagccaacttgcctaagaaagagaagagcgtgttgcaaggaaagttaacaaaacttgccgtccagatcggaaaggccggcctgttaatgtctgcaatcaccgtgatcatcctggttttgtattttgtcattgataccttttgggtacagaaacgaccttggctcgctgaatgtactcccatttatatacagtacttcgtgaagtttttcatcatcggagtcacagttctggtggtcgctgtgcccgagggtttaccattggccgtaacaataagcctagcgtacagtgtgaagaagatgatgaaggataacaacctcgtccgacacttggacgcttgcgaaactatgggaaacgcgactgccatatgttcagacaaaacagggacactcaccatgaataggatgacagtggttcaggcctacataaatgaaaagcattataagaaggtgcccgagcccgaggccatacctcctaacattctgtcatatttggtcactggtattagcgtaaactgtgcgtacacttctaagatacttccacctgagaaggagggaggccttccacgccacgtcggcaacaagaccgagtgcgcactcttgggcttactcctggacctgaagcgggattaccaggatgttaggaacgagatcccggaagaagcactgtacaaagtgtacacattcaattccgtgcgaaagtctatgtccacagtcttgaagaacagcgacggatcttaccgtatatttagtaagggggctagcgagatcattctgaaaaagtgttttaaaatcttatctgctaacggcgaggccaaagtcttcaggccacgggatagggacgacattgtgaagaccgtgatagaacccatggctagtgaagggcttcggactatctgcctggcatttcgagatttccctgccggagaacccgaaccagaatgggacaatgaaaatgatatcgtcaccggcctcacttgcattgccgtggtgggcatcgaggaccccgtccgccctgaggtcccagatgctatcaagaagtgtcagcgggcggggattaccgtgcggatggtgaccggcgataatataaacaccgctcgggccatcgcgacaaaatgtggtattttgcatccgggcgaggattttctttgtctagagggaaaggatttcaatcggcgcattaggaatgaaaagggcgagattgaacaggagagaattgataagatttggccgaaacttcgcgtgctggccagaagctcacccacagataagcacacccttgttaaaggcattatcgattccaccgtctcggaccaacgccaggtcgttgccgtgactggagacggcaccaacgacggtccggccctaaagaaggcggacgtcggctttgctatgggaatcgcgggtacagatgtggccaaggaagctagcgatattatactgaccgatgacaacttcacgagcatcgtcaaagcagtcatgtggggtcgcaatgtgtacgactcaatctccaagttcctgcaatttcagctgacagtgaatgttgtggcagtgattgtcgcatttacgggcgcctgcattactcaggattcacccctgaaggccgttcagatgctctgggtaaatcttattatggacacactcgcttcccttgccctggcaaccgaacccccaaccgagtctcttttgctgcgtaagccatatggaaggaataaacctctcatttctcgcacaatgatgaagaatatcctgggccacgcattctaccagttagtcgtggtttttacgctcctttttgctggagagaagttctttgacatcgactccgggagaaacgcgcctctgcacgctcccccctctgagcattacacgatcgtcttcaatacttttgtcctgatgcagctcttcaatgaaatcaatgcacgcaaaattcacggtgagcgcaatgtgttcgaagggatcttcaacaatgctattttttgcaccattgtactagggacttttgtggttcagctgatttctaccattccaacttccaggctgaagtttttaaaggaggcaggtcatggaacacaaaaggaagagattcccgaggaagagcttgccgaagatgtcgaagagatcgatcacgccgagagggagcttcgccgtggtcagatcctgtggttcagggggctcaaccggattcaaacacagataagggtagttaatgctttccggtccagcctgtatgagggccttgagaaaccggagtccagatcttcaatacacaacttcatgacacaccctgagttcaggatagaggatagcgagccacacataccactgattgacgacacagacgccgaagacgatgcaccgaccaaacggaactcatcccctccacctagccccaataaaaataataacgccgtagattctggcattcacctgacaatcgagatgaacaaatccgccacaagcagttctcccgggtctccgctgcactcactggaaactagcctgtag

SEQ ID NO: 179765 - DNA, 3531 bp, Artificial Sequence
  Description of Artificial Sequence: Synthetic coding sequence
atgggcgacatggccaacaacagcgtggcctacagcggcgtgaagaactcgctcaaggaagcgaatcatgacggcgatttcgggataaccctggctgaactaagggctctgatggagctacgttcaaccgacgcactccgtaaaatacaggagtcatacggagatgtgtacggcatatgcacaaaactgaaaacgagcccaaacgagggtctgtccggaaaccccgccgacctcgaacggagggaggccgtgtttggaaaaaacttcatcccacccaaaaaacctaaaaccttccttcagctggtgtgggaagcactgcaggacgtaactctgatcatccttgaaatagccgctattgtctctctggggctgtccttctatcaaccaccagaaggggataacgccctttgtggcgaagtcagcgttggggaagaggaaggcgaaggagagacagggtggatcgaaggcgcggcaatcttgctgtcggtcgtgtgtgtggtgttggtaaccgcatttaatgactggagtaaggagaagcagttcagggggctccagagccgaattgagcaagaacagaaattcactgtcattaggggcggtcaagtaatccagattccagtggccgatatcactgtgggagacattgctcaagtaaagtatggagacctcctccccgcagacggtatccttatccaggggaatgacctgaagatcgacgagtcatctctcactggcgagtccgatcacgtcaaaaaatcactggacaaagaccctctgctgctcagtggcacacacgtgatggaagggtcagggcggatggtggtgacggccgttggtgtaaactcccaaaccggaatcatctttacactgcttggggctggcggagaggaggaagaaaagaaggacgagaaaaagaaagagaagaagaataagaagcaggacggagctattgagaaccgcaacaaggctaaggcacaggatggcgccgctatggaaatgcaacctctcaagagtgaggaggggggggatggggacgaaaaggacaagaaaaaggctaatctcccaaaaaaggagaagtccgtgcttcaagggaagctgaccaagctggccgtacagataggtaaggccgggctgctgatgtccgctatcactgtcatcattctagttctttactttgtcatcgataccttctgggtgcaaaaaagaccgtggctggcggaatgcacacccatttacattcagtatttcgttaaattctttataataggtgtcacggtgctggtcgtagcagtaccagaaggcctccctcttgcagttactatctcccttgcttacagcgtcaagaaaatgatgaaagataataatctggtgaggcacctggacgcgtgcgaaacaatgggtaacgccactgctatctgtagtgataaaacggggacactgaccatgaacagaatgacagtggtgcaagcttacatcaacgagaaacactataagaaagtgccagagcctgaagcaatcccccctaacattctctcatacctcgtgacgggaatatcagtgaattgcgcctatacttcaaagatcttgcctccggaaaaagagggtggactgcctcgccacgtcggtaataaaaccgaatgcgccttgctcggcctgctgctggacctcaaacgagactatcaagatgtaaggaatgaaatcccagaagaggcactgtacaaagtctacaccttcaacagtgtcagaaagtcaatgtctacagtcctgaaaaacagtgacggttcctataggattttctccaaaggagcctcagagatcattctgaagaagtgcttcaaaatcctctccgcaaacggcgaggctaaggtgtttagacctagggatcgcgacgatattgttaagactgtaattgaacccatggcttcggaaggattgaggactatttgccttgctttccgggatttcccagcgggcgagccagaaccggaatgggataatgagaatgatattgtgacaggcctaacctgtattgctgtggtaggtatcgaggacccagtgcgaccagaggtgccagatgctatcaaaaaatgtcagagggcaggaataaccgtgcgtatggtcacgggcgacaacatcaacacagcacgcgccattgctactaaatgcggcattctgcaccctggggaagatttcctttgcctggaggggaaggatttcaatcgccgaatccgcaacgagaagggtgagattgaacaggagaggattgacaaaatttggccgaaactgcgggtgctggctcgatcctctcctacagacaaacatacgttggtgaagggaatcatcgattctactgtttcggatcagaggcaagtcgtagccgtgactggcgacggcactaacgatggacccgctctaaaaaaggccgatgtagggttcgccatgggcatagcgggaaccgatgtggctaaggaggcttcagatattatcctaacagacgataactttacctccattgttaaagccgtgatgtggggccgcaacgtatacgactcaatctcgaagttccttcagttccaactgactgtgaacgtggtagcagtcatcgtggcctttaccggcgcttgcataacccaggactcccctctcaaggccgtgcaaatgctttgggtcaacttaattatggacaccttggcttccctcgccctcgccacagaacctccgacagagtccttgctgctgcggaagccgtatggcaggaacaaaccactgatcagtagaacaatgatgaaaaacatcctcgggcacgccttttaccagctcgtcgtagtgttcacactactgtttgcaggcgagaagttcttcgacatagactcgggacggaatgcccctctacacgctcctccctctgagcattacacaattgtgttcaatacctttgtgcttatgcaactgtttaatgaaatcaatgcccgcaagatccacggggaaagaaacgtctttgagggtattttcaacaatgccatcttttgcaccatcgtcctcggtaccttcgtagtacagattatcattgtccagttcggggggaaaccattttcttgctcggagctgtccatcgagcagtggctctggtcaatcttcctgggaatgggtactttactctggggacagttgatttcaacaatacctacctcacggttgaaatttctcaaagaagccgggcacgggacacagaaagaagagatccccgaagaggagttagctgaagacgtcgaggagatcgatcacgccgagagagagctcaggaggggacagattctatggtttcgggggctgaataggattcaaactcagatggatgtggtcaatgcgttccaaagcggctcaagcattcagggcgctctgcgtcgccagccaagtattgcctcccaacatcacgatgtgacaaatatcagtactcctactcatgtagtgttttcatcctctacagcatcaaccactgttggctattcttccggtgagtgcatctcctag

SEQ ID NO: 179766 - DNA, 2892 bp, Artificial Sequence
  Description of Artificial Sequence: Synthetic coding sequence
atgttcctggtgatcggcacccacgtgatggagggcagcggccggatggtggtaacggcagtgggtgtaaactcccagacagggatcattttcactcttctgggtgctggcggcgaggaggaggagaagaaggacgaaaagaagaaggagaagaaaaacaagaaacaggatggtgccatcgagaataggaacaaggccaaagcccaggatggcgccgctatggagatgcagcctctgaagagcgaagagggaggtgatggagacgagaaggacaaaaagaaggccaatctgccaaagaaggaaaaaagcgtgcttcagggcaagcttacgaaactggccgtccagatcggtaaagcgggtttgctcatgtccgctatcaccgtcataatcctcgttctgtatttcgtcatagatacattttgggtccagaagagaccctggctagctgagtgtacacccatatacatacagtactttgtgaaatttttcatcattggagtgacagtcctcgtggttgccgtgccagaaggccttcctctcgcggttaccatctccctggcctattctgtgaaaaagatgatgaaagacaacaatttagttcggcacctggacgcttgtgagacaatgggaaacgccacagcaatttgtagcgacaagacaggaaccttaacgatgaatcgtatgacagtagtgcaggcctacattaacgaaaaacactacaaaaaggtgcccgaacctgaggccatcccccccaatatactgtcatacctcgtgaccggtatcagtgtgaattgcgcatacacaagcaagatcctaccccccgaaaaggagggcggacttccacgtcatgtcggtaataagaccgagtgcgcattgcttggcctcctccttgatctcaagagggactatcaggacgtacggaatgagattcccgaagaggcgctgtacaaagtctacactttcaactctgttcggaaaagcatgtcaacagtcctgaagaattctgatgggagctacagaatcttttccaaaggagctagcgaaattattcttaaaaaatgtttcaaaattttgagtgctaacggagaggccaaagtgttcaggccacgagatcgagacgatatagtaaaaacggttatagaacctatggctagcgagggccttcgaacgatttgcctagccttccgggacttcccagccggtgagcccgaaccagagtgggataacgaaaacgacattgtgacaggcttaacgtgtatcgccgtagttggaattgaggatcctgtaagacccgaagtgcctgacgcgatcaagaagtgtcagcgggccggcattaccgtgcggatggttaccggcgataatattaacacggctagagcgatagcaactaagtgtggtatcttgcaccctggggaggacttcctttgtttggaggggaaagacttcaacaggcgcatcagaaatgagaagggcgagattgagcaggagcggatcgataagatttggccaaagctgagggtcttagcccgaagttctcctacggataaacacacactggtgaaaggcatcatcgatagcaccgtctctgaccagagacaagtggtcgccgtgacaggcgatggaacgaatgatgggcctgcactcaaaaaggcagacgtaggcttcgcaatggggatagccggcacagatgtcgcaaaagaggcaagcgacattattctgacagacgataacttcacaagcatcgtaaaagctgtcatgtgggggcgaaacgtgtatgatagcatctccaagtttctgcagttccagctgaccgtcaatgtggtggctgtgatcgtggcattcacgggcgcctgtattacccaggatagcccacttaaggcagtgcagatgctctgggttaaccttattatggacaccctggctagcctggccctggccaccgagcccccaaccgaaagtctgctgctgcgcaaaccgtatggacgcaacaagcctttgataagccgaactatgatgaaaaatatcctcggccacgcattctaccagctggtagtggtattcaccctgcttttcgcgggtgaaaagttctttgatatagactcgggacggaatgcacctctgcacgctcctccctctgagcactacaccatagtattcaatacatttgtgctgatgcagctgttcaacgaaatcaacgccaggaaaatccacggagagcgcaacgtcttcgaaggcatattcaataatgcaattttttgtactattgtcctcgggacgttcgtggtgcagattattatcgtacaatttggcggtaagccattttcctgcagcgaactgtctatcgaacagtggctctggagcatctttttgggcatgggtacactgctctgggggcagctgattagcacaatacccacctcccggctgaagttccttaaagaggccgggcatggcacacagaaggaggaaattccagaggaggagctcgccgaggatgtcgaagagattgatcacgctgaacgggagctgcgaagggggcagatcctgtggttccggggattgaatagaattcagacccagatccgagtggtgaatgcctttaggtcttctctttatgaaggactggagaaaccagagtcgaggtcttctattcacaactttatgacccatccggaatttagaatcgaagactctgaaccacatatacccctcattgatgacaccgacgcagaggacgacgccccaacgaaacggaatagctcccctccaccaagcccaaataaaaataataatgctgtggactcaggaatccaccttacaattgagatgaacaagtcggctacctcgtcttcaccgggctcccctctgcattcgctggaaacaagcctctag

SEQ ID NO: 179767 - DNA, 3663 bp, Artificial Sequence
  Description of Artificial Sequence: Synthetic coding sequence
atgggcgacatggccaacaacagcgtggcctacagcggcgtgaagaactctctcaaggaggctaatcacgacggtgacttcggcatcactttggccgagttacgcgccttaatggagctgcgctctacagatgcactgcggaaaattcaggagtcctatggagacgtttacgggatttgtacaaagctcaagactagtcctaacgaaggcctgagtgggaatcccgcggacctggaaagacgcgaagcagtttttggcaagaacttcataccacccaagaaaccgaaaacgtttttgcagctggtgtgggaggctttacaggacgtcacattaataatactcgagatagccgcgatcgtttctctgggcctttcattttaccagccacctgagggggataatgctttgtgcggtgaggtgtccgtgggagaggaagagggagagggagagacggggtggatcgagggtgcggccattctcctgtctgtagtatgtgtggtccttgtgactgcttttaacgattggagtaaggaaaaacaattcagagggctccagagccgaattgaacaagagcagaagttcacggtcatacgtggggggcaggtcatccagatacccgtcgctgacatcacagtaggtgacatagcacaggtcaagtacggtgatttgctgccggctgacggcatcctgatccagggcaacgatcttaagatcgatgagagctccctcacaggggaatccgaccacgtcaagaagtcactggacaaggaccccctgttgctcagcgggactcatgttatggaaggtagcggccgcatggtagtgacagcagtaggtgtgaattcacaaacgggtattatttttacattgctgggtgccgggggtgaagaggaggaaaagaaggatgagaaaaaaaaggagaagaagaacaagaaacaggacggagcgatagagaatcgaaacaaagccaaagcccaagacggcgccgctatggagatgcagcctctgaagagcgaggaagggggggacggggatgagaaagataaaaagaaagcaaacttgcccaaaaaagagaaatcggtactgcaggggaaattaactaagctggctgtgcagattggtaaggctggcctcttgatgtcggccatcacggtgatcatcctggtgttatactttgtcatcgacaccttttgggtccaaaagcgcccgtggctggctgaatgcactcccatctatattcagtattttgttaaattctttatcatcggcgtcacagtgctcgttgtggccgtccccgaaggtctgccattggcagtgacaatatccttagcctactcagtcaagaagatgatgaaagacaacaatttggtaagacacctagatgcatgcgagactatgggaaatgctactgcgatttgctcggacaaaaccggtacgttgacgatgaaccggatgaccgtcgtgcaggcgtacataaatgagaaacactacaagaaggttcctgagccagaggctatacccccaaacatcctctcttatttggttaccggcatctccgtcaattgtgcctacaccagtaaaatcctcccacctgagaaagagggcggactcccccggcatgttgggaataagacagaatgcgcactgttaggtctgcttctcgatctcaaaagagactatcaagatgttcgaaatgaaataccagaagaagctctgtacaaagtgtacactttcaattccgtgaggaaatctatgtccaccgtgttgaaaaacagcgatgggagctatcgaatcttttccaaaggagcttcagagataattctgaaaaagtgtttcaagatcctaagtgccaacggcgaagcaaaggtgttccggccccgtgatcgggacgatatagtaaagacggtcatcgaaccaatggcttcagaaggattaagaactatctgcctagccttccgagatttcccagctggagagcctgagccagagtgggataatgaaaacgatatagtcaccggtctgacttgtatagcagttgtgggcatcgaagacccagtgcggcctgaggtgcccgatgccattaaaaagtgtcagcgcgctggaattaccgtcagaatggttaccggggataacattaatacagctagagccatcgcaacaaagtgcggtattctgcatcccggggaagacttcctgtgcttggaaggcaaggattttaacagaaggatccggaatgaaaagggcgagatagagcaagagcgcattgataaaatctggccaaagcttcgtgtcctagcacgaagctcaccaacagataaacataccctcgtgaagggtatcatagattccacagtttccgaccagaggcaagtcgtggccgttacaggggacggaacgaatgacgggccagccctcaagaaggctgacgtcgggtttgctatgggcatcgcaggaaccgatgttgccaaggaggcgtcagacatcatccttactgacgacaacttcacaagcatcgttaaggctgttatgtggggccggaacgtttatgactcaatttccaagtttctgcaatttcagctgaccgtgaatgtcgtggctgtgatcgttgccttcactggagcgtgcataactcaggacagcccccttaaggctgtgcagatgctctgggtgaacctaatcatggataccctggctagtttggccctagccacggaaccccctacagaaagtctcttacttcgaaagccgtacggtcgaaataaacccctcatatctcgcactatgatgaagaatatactgggacatgcgttctaccagcttgtagtggtgttcacactcctgtttgcaggagaaaaatttttcgacatagactcaggcagaaatgccccactccacgcaccccctagcgaacactacaccatcgtgtttaacacttttgtgcttatgcagctctttaacgagattaacgcaagaaaaatccatggggagcggaatgtgtttgaaggcatctttaataacgctatcttctgcacaattgtactgggaaccttcgtggtacaaattatcatagtacagtttggtggaaaacccttcagctgcagtgagctgtccatcgaacaatggctctggtccatttttctggggatggggacgctcctatggggccaactgattagcacaatccctaccagccgcctgaaatttctgaaagaagccggtcacgggacgcagaaggaagagattcctgaggaagaactcgctgaggatgtggaagagatagatcatgccgagcgggaactccgcagggggcagattctctggtttagggggctaaataggatccagactcaaatcagggtggtgaacgcgttccgatcaagcctctatgagggactcgaaaagccagaatcaagaagcagtatacacaacttcatgacccaccccgagtttaggatcgaagacagcgagcctcacataccactaatagatgacacggacgccgaggatgacgcacccaccaagcggaactcctctcccccgccatcaccgaataaaaacaacaatgcagtggacagtgggattcatcttaccatcgagatgaacaaaagcgccactagctcttccccgggcagccccctccatagtctggaaacaagcctgtag

SEQ ID NO: 179768 - DNA, 306 bp, Artificial Sequence
  Description of Artificial Sequence: Synthetic coding sequence
atgggcgacatggccaacaacagcgtggcctacagcggcgtgaagaatagcctcaaagaagctaatcacgacggcgatttcggcatcaccctagcggaactgcgggctttgatggaactgcgcagtaccgatgcactgaggaagatccaagagagctacggggatgtctacggaatatgcacaaagctgaaaacgtctcccaacgaaggcgaattctattatgcgtgcttctggtttttcgtgcagcgggtgctatatatttggttaatcaatgaacacgcgtacataattctggcgatcgtctag

SEQ ID NO: 179769 - DNA, 3600 bp, Artificial Sequence
  Description of Artificial Sequence: Synthetic coding sequence
atgggcgacatgaccaacagcgacttctacagcaagaaccagcggaatgaatcatcgcacggcggggagttcgggtgcactatggaagagctcagaagcctgatggaattgcgaggtacagaagccgtcgtgaagatcaaagagacctatggggatactgaagctatttgccggcgtctcaaaacgtcacccgttgaggggctccccggaactgctccagatctggagaaaagaaagcaaatttttggccagaacttcattccccccaagaagcccaagaccttccttcagttggtgtgggaagccttgcaggacgtgactctcatcatactggaaattgctgcgatcatttctcttggtctgtctttctatcatcccccaggcgaaggtaacgagggttgcgcaaccgctcagggaggagccgaggacgaaggcgaggctgaggcaggttggatcgagggcgcggccattctgctctctgtgatatgtgtggtgttagtaacagccttcaatgactggagcaaggagaaacagttcagaggcctacagtctaggatagagcaggagcaaaaattcaccgttgttagggccggccaggtcgtgcagatcccagttgccgagattgtggtgggggatatcgctcaggtgaaatatggtgacctgttacctgccgatgggttgttcattcaaggaaatgatttaaagatcgacgaatcctccctgacaggggaaagcgaccaagtgaggaaaagtgtcgacaaagaccctatgctgctctctggcacacacgtgatggagggctctggacggatgctggtcaccgctgtgggggtcaattctcagaccggaatcatatttacgctcttgggcgccggtggagaggaggaggagaagaaggataagaagggggttaagaaaggagacggactgcagttacccgcggccgacggtgccgccgcgagcaatgctgccgactccgccaatgcgtctctggtgaacggcaagatgcaggacgggaatgttgatgccagccagagcaaggccaaacaacaagatggcgccgccgctatggagatgcagccattgaaaagcgcagaggggggcgatgctgacgatcggaaaaaagccagcatgcacaagaaagagaagagtgttttgcaagggaagctaacaaagcttgctgttcagattggcaaagcggggttggttatgtctgctatcactgtcattatactcgtcctttattttaccgttgacaccttcgtcgtcaacaagaagccctggctgcctgagtgcacacccgtctacgttcagtatttcgtgaaatttttcattatcggagtgaccgtgctcgttgtggctgtgcctgaggggctgcccttggccgtgaccatttccctcgcatacagcgtgaaaaagatgatgaaagacaataacctggtaagacacctcgacgcctgcgagacaatggggaatgcgaccgctatttgctctgacaagacaggcactctgactacgaaccgcatgaccgtggtgcaagcttacgtgggtgatgtccactataaagagattccagacccctctagcatcaataccaagacaatggaactactcattaatgctattgccatcaattccgcttacaccacaaagatcttacctccggaaaaagagggcgcgctccctaggcaagtgggcaacaaaaccgaatgcggtttgttggggtttgtgttggatcttaagcaagattatgaacctgtcagatcccagatgcctgaggagaagctatacaaggtctacacctttaacagtgtcaggaaatcaatgagcactgtcatcaaactgcccgatgagtccttcagaatgtatagtaaaggagcctccgagatagtgctaaagaagtgctgcaaaatcctcaatggtgctggcgagcctcgtgtcttcagaccaagagacagggacgagatggtcaaaaaggtcatagaaccaatggcctgtgatggtttgcgcacgatttgtgtggcctatagagatttccccagcagccctgaacccgactgggacaacgagaacgacatcctgaatgaactgacttgcatctgcgtggtgggaattgaagatcccgtacgtccggaagtgcccgaggcaatccggaaatgtcagagggctggcataactgtccgtatggtaaccggcgacaacattaacacagctagggcgatagccatcaagtgtggtatcattcatccaggggaagatttcctgtgtctggaagggaaggaatttaaccgtaggataaggaacgagaaaggcgaaattgaacaggaacgcattgacaaaatttggccgaagctgagagttctggctcgctccagtcccacagacaagcacacgcttgtcaaaggaatcattgactctacccacactgaacagcggcaggtggtggccgtaacgggcgacggcactaatgacggccctgctctaaagaaggccgacgtagggtttgccatgggcattgctggaactgacgttgctaaggaggcatccgacataattctcaccgacgataattttagttcaattgtgaaggctgtgatgtggggccggaacgtgtatgatagcatatcaaaattccttcagtttcagctgaccgtgaacgtcgtggccgttatcgtggcattcaccggcgcctgcataacacaggattccccattaaaagctgttcagatgctttgggtcaatttgattatggatacatttgcctccctggctctggccacagaaccgcccaccgagaccctgttactgagaaagccctacggacggaataaacccctgattagtaggacaatgatgaagaatatcttgggccacgccgtgtaccagttggcactgattttcacacttctgttcgtgggagaaaagatgtttcagatcgactcaggaaggaacgcaccactacacagtccacctagcgaacactacaccattatctttaacaccttcgtgatgatgcagctgtttaacgaaatcaatgccagaaagatccacggggagcgcaatgtcttcgacgggatttttcgaaatcccatcttttgtacaattgtcctggggacatttgctatccaaatagtcattgtgcagttcgggggaaagcccttttcttgtagcccattgcagctggatcagtggatgtggtgtatctttatagggctcggagagttggtctggggtcaggtaatcgcaacaatcccgactagccggttaaagtttctgaaagaggccgggcgactgacacaaaaagaggagatccctgaggaggaactcaacgaggacgtcgaagagatcgaccatgccgagcgcgaactgaggcggggccagatcctgtggtttcgcgggctgaatcggatccagacccagatagaagtggttaatacttttaaatctggagcctctttccagggagccctacgacggcaatccagcgtgacgtcccagtcacaggacgtggcgaacctcagcagccccagccgagtctctttaagtaacgctctcagctccccgacctccttacccccggctgctgcaggccgcgagtag

SEQ ID NO: 179770 - DNA, 3690 bp, Artificial Sequence
  Description of Artificial Sequence: Synthetic coding sequence
atgggcgacatgaccaacagcgacttctacagcaagaaccagcggaatgaaagtagccatggtggtgagttcggctgcactatggaagagctgcgcagcctgatggagttgcgaggaacggaagcggtagtgaagattaaggaaacatacggggacaccgaggccatctgccgcaggctgaagacctcccctgtggaggggctgcccggaacagcccccgacctggagaaaaggaagcagatctttgggcagaatttcataccacccaaaaagccaaagacctttttacagctggtgtgggaagcattacaagacgtgacgctcatcatcctggagatcgcagccatcatctcccttggtttgtctttctatcacccccccggcgaagggaacgagggctgtgctacggcccaaggtggcgcagaagacgagggggaggcagaagcaggatggatcgagggagccgccattctactgtccgtgatctgtgtggtgctggtgaccgcgttcaatgactggtctaaagagaagcaattcaggggtctgcagtccagaattgaacaggagcaaaagtttacggtggttagggctgggcaagtcgtgcagataccagtagcagaaattgtcgttggagacatagctcaagtgaagtacggcgatctcttaccggcagacggactgttcatacagggcaatgatttgaaaattgacgaaagctccctgactggcgaatcagaccaggtgcgaaaatcagtcgacaaggatccaatgttgctttccggcacgcatgttatggaagggtcaggaagaatgcttgtcactgcagtgggtgtgaactcccaaacaggcatcatttttacactgcttggcgcgggtggcgaggaggaggagaaaaaggataaaaagggtgtgaagaaaggcgatggccttcagcttcctgcagctgatggtgcggctgcgagtaacgccgcagactccgcgaacgccagcctcgttaacgcaaaacagcaagatggtgccgccgctatggagatgcaaccattaaaatccgcggaggggggggatgccgatgacaggaagaaagcatccatgcataaaaaggagaagagcgtgttacagggcaagctgaccaagctcgctgtccagatcgggaaggccggccttgtcatgagcgccattacggtcattatcttagtactatacttcaccgtcgacacgtttgtagtcaacaaaaagccatggctcccagagtgcaccccagtatatgtgcagtatttcgtgaaattctttatcattggggtaacggtgctggtggtggctgtgccagaaggcctgccactggcagtcactatctcattggcctactccgttaaaaaaatgatgaaagacaacaatctggtcaggcaccttgatgcatgcgagacaatgggaaatgcaactgccatatgttctgacaagacggggaccttaactactaacagaatgaccgtcgtgcaggcatacgtgggtgatgtgcattacaaggaaatccccgacccttctagcataaacacaaagactatggagctgctcatcaatgccatagccattaactccgcgtacactacaaaaattctgccccctgaaaaggaaggagctttgccacgccaggtgggaaataagaccgaatgtgggttgttgggatttgtcctggatctgaagcaggactatgagcccgtccgaagtcaaatgccagaggagaagctgtataaagtgtatacattcaattccgtcaggaagagtatgagcaccgtgatcaaacttcctgacgaatcgttccgcatgtattctaaaggggcatccgagatcgtgctgaaaaagtgttgtaagatcctgaacggggccggggaacctagggtttttagacccagggacagggacgagatggtcaagaaagtcattgagccaatggcctgcgatgggctgcgcacaatttgtgtggcctacagagattttccttctagccctgaaccggactgggataacgagaatgacattctcaacgagctcacgtgcatctgcgtagtgggaattgaggaccctgttaggccagaagtacccgaagccatacgcaaatgccagagggctgggatcacagtaagaatggtaaccggcgacaatattaataccgcccgggctattgctattaaatgcgggataatccatcccggggaggactttctgtgtctggagggcaaagaattcaacagacgtatccgtaacgagaaaggcgaaatcgagcaggaaaggatcgacaagatttggcctaaactcagagtcctggcaaggtcttctcccacagataaacatacattagtaaagggcataatagattcaactcatacagagcagcgccaggtggtagccgtgaccggcgatggcaccaatgatggtcctgcactcaaaaaggccgacgtaggatttgctatgggcatcgccggaacggacgtggccaaggaagcctctgacattatccttaccgacgacaatttctctagcatcgtcaaggccgtgatgtgggggaggaacgtgtatgattccatctcgaaattcctccagtttcaattaaccgtgaacgttgtggcagtgatcgtggctttcaccggggcatgcataacccaagactctccactcaaagcggtgcaaatgctctgggttaatcttattatggataccttcgcgtctctcgcactcgctactgaaccaccaaccgagacactgctcctgcggaagccttacggtagaaataagccactgatcagtcgtaccatgatgaaaaatatcctgggccatgcagtctaccagctcgctctcatattcacactcctgttcgttggcgaaaaaatgttccagatcgactctggtcggaatgccccccttcactcacctccgtcggaacattacacaataatcttcaacacatttgtcatgatgcaactgtttaacgaaattaatgctcgaaaaatacatggggaacggaatgtgttcgatgggatattccgcaatcctatcttctgtactatagtgttgggtactttcgctattcagatcgtcatagtccagtttgggggtaaacccttttcttgcagtcctttacagctagatcagtggatgtggtgcatcttcatcggcctcggggaacttgtgtgggggcaagtcatcgcaactatccctacgagccggttgaaatttttgaaggaggccggacgcctcactcagaaagaggagataccagaggaagaacttaatgaggatgtggaggaaatcgatcatgcggagagggagctccgcagaggacaaattctctggttccgcggcctcaatcgtattcagacgcagatacgagtggtgaaagcctttagatccagtttgtacgaaggcctagagaagccagagtcccggaccagcattcacaacttcatggcacaccccgaatttcgcatcgaggactcgcagccacacatcccactgatcgacgacacggatctggaggaggacgctgccctgaagcaaaactctagccccccgtcttccttgaacaaaaacaactctgctatagacagcggtatcaatctgaccactgacaccagcaaaagcgctacatcttcctcacccggatctcctatccacagtcttgagacttcactgtag

SEQ ID NO: 179771 - DNA, 3732 bp, Artificial Sequence
  Description of Artificial Sequence: Synthetic coding sequence
atgggcgacatgaccaacagcgacttctacagcaagaaccagcggaatgagtccagccacgggggcgagtttggatgcacaatggaggagttgcggagtcttatggagctgcggggtaccgaggccgtcgtgaaaatcaaggaaacctatggcgatacggaggctatatgccggagactgaaaaccagccccgtggaagggctccccggcaccgcacctgacttggaaaagcgaaaacagatcttcgggcagaattttattccacccaaaaaaccaaagactttcctgcagctcgtgtgggaggccctgcaagatgtgacactgatcattttggagattgctgctatcatctcactggggctgtctttttatcacccccctggcgagggaaatgaggggtgcgcaaccgcccaagggggagctgaggatgaaggtgaagcagaggctggatggatcgagggcgctgctatacttctcagtgtgatttgcgtggtgctcgtgacagcatttaacgactggagcaaagagaaacagtttaggggcctgcagagccggatagaacaggagcagaaattcactgttgtgagagctggacaagtggtacagatccctgtggcagagatagttgttggcgacatcgctcaagtgaagtatggggatctgttgccagcagatggcctgttcatccagggtaatgatcttaaaatcgacgaaagctcattgactggcgaatccgatcaggtcagaaagagcgtcgataaggatccgatgctactgtcaggaacacacgtcatggagggatccggccggatgttagtcaccgccgtaggagtgaacagccagaccggcatcatctttactctcctgggtgcgggcggggaggaggaggagaaaaaagacaaaaaaggggtcaagaaaggcgatggcctgcagctgcctgcagcggacggagccgcggcatctaatgcggctgacagcgctaacgcctctctcgtgaacggcaaaatgcaagacggcaatgtggacgcctctcagagcaaagcgaagcagcaagatggagcggccgccatggaaatgcaacctttgaagtctgcagaaggtggtgacgcggatgaccgcaaaaaggcgtcaatgcataagaaagagaaatcagtgctccagggcaagctcaccaaactggccgtccagatcggaaaagccggcttggtaatgtcggccattaccgttatcatcctggtcctgtattttacagtggacacatttgttgtgaacaagaagccgtggctgcccgagtgcacgcctgtttacgttcagtactttgtgaagttttttatcattggtgtaaccgtcctggtagtggccgttccagaaggacttccgctggccgtcacaatcagcctggcctactcagtgaagaagatgatgaaggacaacaatcttgtgcgccacctggatgcttgtgaaaccatgggaaacgccaccgccatctgctcagacaagactgggacgctcaccaccaaccggatgaccgtcgtccaggcatatgtgggggatgttcattacaaagaaattccggacccaagcagcattaataccaaaacaatggaacttcttattaatgcaatagcaatcaattcggcttacacaacaaagattttgccacctgaaaaagagggcgccctgccacgacaggttgggaataaaacggagtgtggcctgctggggtttgtactcgacctcaagcaggattatgagcccgtcagaagccagatgcctgaagaaaagctctataaagtgtacacctttaatagtgtccggaaatcgatgtcaacagtgataaagctgcctgacgagtcctttcgcatgtatagcaagggcgcctctgaaatcgtcctcaaaaagtgttgtaaaatcctgaatggcgcgggcgagccacgggtgttcagaccaagggacagggatgagatggtgaaaaaggtgattgaacccatggcttgtgatggcctgcggaccatatgcgttgcttacagggatttcccatcttcaccagaacctgattgggataacgagaatgacatcctcaatgaattgacctgcatttgtgttgttggaattgaagatcccgtaagacccgaagtgcccgaggccattaggaagtgtcagcgagctggtatcacggttaggatggtgaccggcgacaatatcaatacggcccgcgctatagccataaagtgcggcataattcaccctggcgaggattttctctgtctggaaggaaaagaatttaaccgtaggatcaggaacgaaaagggggaaatcgaacaagagcgtatcgacaaaatctggccaaaactgcgggtcctagcgcgcagttcgcccaccgataaacacaccttagtgaagggcatcattgatagcacccataccgagcagagacaggtcgtcgccgttacgggagatggtacaaatgacgggcctgcgttaaagaaggccgatgtaggttttgcaatggggattgcgggcaccgatgtcgccaaagaggcttccgatatcattctcacagacgacaactttagttcaatagttaaggcagtgatgtggggaaggaatgtttacgacagtatctctaaattcctgcagttccagttgacagttaatgtggtagccgtgatagtggctttcacaggtgcctgtatcacccaggattccccactcaaggcagtgcaaatgctctgggtgaatttgattatggataccttcgcctctctggccctggcaaccgagccacctaccgaaacactgctgttgcgcaagccctacggccgtaataagcccctgatctcacggaccatgatgaaaaacattctgggacacgcagtgtatcagcttgctttgatcttcacgctgttgttcgttggcgaaaaaatgtttcagatcgactctggccggaacgcccccctgcacagcccgccttccgaacactatactataatttttaataccttcgtgatgatgcagctgtttaatgaaatcaacgccaggaaaattcatggcgagcgtaatgttttcgatgggatttttagaaatcccatcttctgcactatagtcctggggacgttcgccattcagatcgtaatcgtgcaattcgggggtaaaccattttcttgttctccattgcagctggaccagtggatgtggtgtatctttatcgggcttggagagttagtgtggggccaagtaattgctaccatccctacttctagactaaagtttctcaaggaagccggcagattaacccagaaggaggagattcccgaggaggagctcaatgaggatgtggaagagatagatcacgcagaacgcgagctacgccgggggcagattctgtggtttcgcggactgaatagaatccaaacccaaatacgggtggtcaaggctttccggtcaagcctatatgaaggactggagaagccggaatcccggacctctatccataactttatggcacatccagagtttagaatagaagatagtcagccacatattccgctcatcgatgacactgacctggaggaggacgccgctttgaagcaaaattctagtccgccaagttccctgaacaagaataacagcgcaatcgactcagggataaatttgacaactgacacttctaagtctgcaacatcgtcctctccaggatccccaatccactctttagaaaccagcttatag

SEQ ID NO: 179772 - DNA, 3732 bp, Artificial Sequence
  Description of Artificial Sequence: Synthetic coding sequence
atgggcgacatgaccaacagcgacttctacagcaagaaccagcggaatgagagttcccacggcggcgaatttggctgcactatggaggaactgcggtctctgatggagctgcgagggaccgaggccgtggtgaagattaaagagacttacggcgacactgaagccatatgtaggcgtctgaagacctctccggtggaagggctccccgggaccgcacccgatctggagaagcggaaacagatttttggccagaactttattcctccaaaaaagccaaaaacattcctccagctggtgtgggaagcgctccaggacgtgacactgatcatcctcgagatcgctgccataatctctctggggctgtccttttaccaccccccaggagagggaaacgagggatgcgccaccgcgcaagggggagctgaggacgagggagaggcagaagcggggtggatcgagggagccgcaatcttactatcggtgatctgtgttgtcctggtaacagcatttaacgattggagcaaagagaaacaattccgtggattgcagagccgcatcgaacaagagcagaagttcacagttgtccgggcaggccaggtagttcagattccggttgccgagatagtggtgggagacattgcacaggttaagtacggagacctactgcccgccgacgggctctttattcagggaaatgatctgaaaattgacgagtcctcgctcactggagaaagtgaccaggtcagaaagagcgtcgacaaggacccaatgttactcagcggcacacatgtgatggagggctccggtagaatgctggttacagcagtgggggtgaacagccaaaccggtattatttttactttgctaggggccggaggcgaagaggaggagaagaaggacaaaaagggcgtgaaaaagggtgatggcctgcaattacctgcggccgacggagcagcagctagcaacgcagcagactctgccaacgcttcccttgtgaatggcaagatgcaggacggaaacgttgatgcctcccagagtaaagccaagcagcaggacggcgccgccgccatggaaatgcagccactaaagagtgccgagggcggcgatgctgacgatcggaagaaggccagtatgcacaagaaagaaaagagcgtcttacaaggtaagctcacgaagctagccgtgcagattggcaaagcagggcttgtgatgagtgcgattaccgtgatcatccttgtgttgtattttaccgtcgatacatttgtagtaaataaaaagccttggctgcccgagtgcacccctgtttacgtgcaatattttgtaaagtttttcatcattggagtgaccgtcttggtcgttgccgtgcctgagggtttgccgttggctgttacgatcagccttgcatatagtgtcaagaaaatgatgaaagataacaacctcgtgcggcatctggacgcatgcgagactatgggaaacgctacggcgatctgttcagacaagacagggaccttgactaccaatagaatgacagtcgtacaggcctatgtgggagacgtgcattataaagaaatacccgacccttcctccatcaacaccaagacgatggagttattgattaacgctatagccatcaacagtgcctacaccaccaagatattgcctccggaaaaggaaggcgccctaccccggcaagtgggcaataagacagagtgcggacttctcgggttcgtcctggatcttaagcaggactacgaaccagtgagatctcagatgcccgaggagaaactctataaagtgtacacttttaacagcgtgagaaagagcatgtcaaccgtgatcaaattacccgatgaatcattcagaatgtatagcaagggggcttcagagatcgtcctcaaaaagtgttgtaagatattaaatggagctggagagccgcgggttttccggccacgggacagggacgagatggtgaagaaagtaattgagcctatggcatgtgacggcctgcggaccatttgcgttgcatatcgagacttccccagcagccccgagcctgattgggacaatgaaaacgacatactgaatgagctcacatgtatctgtgtggtggggatagaggaccccgtgaggcccgaagttccagaagccattagaaaatgtcagagagccggtataaccgtgagaatggtgactggagacaacatcaacacagcgcgggcaatcgccataaagtgtggcatcattcatccaggggaagattttctttgcctggaaggaaaggagttcaacaggaggatacgcaacgagaagggggaaatcgaacaggagcgaatcgataaaatctggccaaaactcagagtgctggctaggtcatcccctacagataaacatacactcgtcaagggcataattgatagtacccatacagagcagagacaagtggtggccgtaaccggagatggcacaaatgacgggccggccctcaagaaagcggatgtggggtttgctatgggaatcgcaggaacagatgtcgctaaggaggcctccgatattattctgactgacgacaatttctcatccatcgttaaggccgtgatgtggggacggaatgtctatgattctatctctaaatttttgcagttccagctaacagtaaatgtggtggcagtaattgtggccttcacaggggcatgcatcacacaggactctccactgaaagctgtacagatgttatgggttaatctcatcatggacacttttgcaagcttagccttagctactgaaccacccacagagaccttgctcctgcgcaagccatacggtcgaaacaagcccctgatttcccgcactatgatgaaaaatattcttggtcatgctgtgtaccagttggcgttgatattcaccctattgtttgtgggcgaaaaaatgtttcagatcgatagtgggagaaatgcgccactgcactcgccgcccagcgaacattatactatcattttcaacaccttcgtaatgatgcagctgttcaatgagattaacgcaagaaagattcatggtgagcggaatgtcttcgatggcatctttaggaatccaatcttttgtacaattgtccttgggacatttgctattcagattgttattgtacagtttggcggtaaacccttctcctgttccccactccagcttgatcagtggatgtggtgtatcttcattgggttgggtgaactggtgtgggggcaggttatcgcaactattcccactagtaggcttaagtttctgaaggaagcaggtcgactgacccagaaagaagaaattccagaagaggaactgaacgaagacgtggaggaaatcgaccatgcagaacgggagttgcggcgtggtcaaattctgtggttccggggcctgaacagaattcagacacagatcagggtagtgaaggcattccggtcttcattatatgagggccttgaaaaaccagagtctagaacttctattcacaacttcatggctcatcctgagttcaggattgaagattcccaaccacatatacctctgatcgacgatacggacctggaggaagatgccgccctgaaacagaacagctctccgccatcatccttgaacaaaaataattctgctattgattcggggataaatctgactacagatacatcgaaatccgctacctccagctctcccggtagtcctattcactcgctggagacatctttatag

SEQ ID NO: 179773 - DNA, 3597 bp, Artificial Sequence
  Description of Artificial Sequence: Synthetic coding sequence
atgggcgacatgaccaacagcgacttctacagcaagaaccagcggaatgaatctagtcacggcggcgagttcggttgtacgatggaggagcttcggtcacttatggaacttcgcggcaccgaagccgttgtcaagatcaaagagacctacggggacacagaggccatctgtcggcgattgaagaccagccccgtcgagggactgcctggcactgcccctgacctcgaaaagcggaagcagatctttggtcagaacttcatccctccaaaaaaacccaagacatttcttcagttggtctgggaggcactccaggacgtcaccctgataatcctggagattgctgcgattatctctctgggtctaagtttctatcacccacctggggaaggcaacgagggttgtgccaccgctcagggcggcgctgaggacgagggtgaggcggaggccggctggatcgaaggcgccgcaatactgctgagcgtgatttgtgtcgtactagttacagccttcaatgactggtcgaaggagaaacagtttcgggggctacagagtcgcatcgagcaggaacagaagttcacagtcgtgagagccggacaagtagtacagatccctgtcgctgaaatcgtggtgggagatatagcccaagtgaaatatggagatttgttgcctgccgacgggctgttcatccagggcaatgatctgaagatcgatgaatccagcttgacgggagagtcagaccaagtcagaaaatcagttgacaaagatccaatgctcctgtccggcactcacgtgatggaggggtcaggacggatgctcgtcaccgcggtgggtgtgaactcacagactgggattatttttacccttctgggtgcaggaggagaggaagaagaaaagaaggataagaaagcaaagcagcaagacggcgccgcagctatggagatgcagccactaaaatccgccgagggcggagatgccgatgataggaaaaaggccagcatgcataagaaggaaaaatccgtgctacaagggaagctcaccaaactcgctgtccagatcggcaaggctgggctggtcatgtcagccatcacggtcattatattagtgctgtattttacagtggataccttcgtggtaaataaaaagccttggctccccgaatgtactccggtctacgttcagtacttcgtaaagtttttcattatcggagtcacagtgctcgtggtggcggttcctgagggacttccactggcggtgaccatatccctagcatattctgtgaaaaaaatgatgaaggataacaacctcgtgcgccatctcgatgcttgcgagacgatgggcaacgcaacagccatctgctctgacaaaactggaacacttacaacaaatcggatgaccgtcgttcaggcctacgtaggcgatgtccactataaagagattcccgatccttcctctatcaacaccaagaccatggaactcctgattaatgccatagccatcaacagtgcgtacacgacgaaaatcttgccccccgaaaaggagggcgccctgccccgacaggtcgggaacaaaactgaatgtgggctgctaggatttgtcttagacttgaaacaggactacgagcccgttcggagccaaatgcccgaagagaagctgtacaaggtgtataccttcaactcagtacggaaaagcatgtctacggtgatcaagctgcccgatgaatcttttagaatgtactccaaaggcgcatctgagatagtgctgaagaagtgctgtaaaattctcaacggggctggcgagccacgtgtgtttaggccaagggaccgtgatgagatggtgaagaaagtcattgaaccaatggcctgcgacggactgcgcacgatctgcgtagcttaccgtgactttcccagctcccccgagccagattgggacaatgagaatgatattttgaacgagctaacctgtatatgcgtcgtcgggatagaagatccagttcgaccagaggttccggaagccatcagaaaatgccagagggccggcattaccgttcggatggtgaccggggacaacattaatacagcccgagccatcgctattaaatgcggaatcatccaccctggcgaggatttcttgtgcctcgagggaaaagagtttaatagacgcattcgtaacgagaaaggagagatagagcaggaacgtatcgacaagatctggccaaagttacgcgtcctggctcgtagtagccccactgacaaacatacactggtgaaaggaatcatcgatagcacacatacggagcagagacaggtggtggccgtgaccggtgacggtacgaatgatgggcctgcgctcaagaaggctgacgtgggctttgccatgggcattgcaggcaccgatgtagcaaaagaagcatccgacatcattctgacagatgataatttctcatcgattgtaaaggccgtaatgtggggccgaaacgtgtatgactctatttccaagttcctgcagtttcagctgaccgttaatgtcgtggcagtgattgttgctttcaccggggcgtgcatcacccaggatagccccttgaaagcggtgcagatgttatgggtgaatctcatcatggacacgttcgccagcctggccctagcaacggagccacccaccgagacactactgttaagaaagccttatggcagaaacaagcccttgatctccagaacaatgatgaagaatattcttggtcacgcagtttaccaattggctctgatcttcactctactctttgtcggagaaaagatgtttcagattgacagcggtagaaacgctcctctgcattcacccccttctgagcattatactattattttcaacacttttgtgatgatgcagctctttaacgagatcaacgctagaaagattcacggtgagcggaatgtatttgacgggatttttagaaacccaattttctgtactattgttttgggcacatttgcaattcagatcgtgattgtgcaatttggaggtaaacctttttcctgctcacctctccagcttgatcagtggatgtggtgtattttcatcggattgggggaactggtgtggggacaggtgatcgccacgattccaacctcacggctgaagttcctgaaggaggccgggagattaactcagaaggaagagattccagaggaggaactgaacgaagacgtggaggagattgatcatgccgagagagagctccgtcggggccaaatcctgtggttccgaggcctgaaccgtatccagacgcagatccgcgtggtgaaagcgtttaggtctagtctgtatgagggactggagaagcccgaatccagaaccagcatccacaacttcatggctcaccctgagttcaggatcgaagactcacagccccatattccgctgattgatgatactgatctcgaagaggatgccgctctcaagcagaattctagcccccctagttccctgaataaaaacaacagcgccatcgatagtgggatcaatctgacaacagacacgagtaaaagtgcgacatcgtcatcacccggcagccccattcattccttagagacatccctgtag

SEQ ID NO: 179774 - DNA, 3597 bp, Artificial Sequence
  Description of Artificial Sequence: Synthetic coding sequence
atgggcgacatgaccaacagcgacttctacagcaagaaccagcggaatgagtcgtcacatggtggggagttcggatgcaccatggaagagctgcggagcctaatggagctgaggggaacagaagccgtcgttaagataaaagagacctacggcgatacagaagccatatgtagaaggcttaaaacttctcccgtggagggcctgcccggaacagcccctgacttagagaagcgcaagcagatattcggtcaaaacttcatcccaccaaagaagcccaagacttttttgcagttagtgtgggaagccctccaggatgtgacattgattattctggagattgcagcgataatttccctgggcctgtctttttaccacccccctggagaaggcaatgaggggtgcgcaactgcccaaggaggggcggaagatgaaggggaagcggaggctgggtggatagagggcgccgccattctgctgagcgtgatctgtgtggtcctggtcacagctttcaatgactggtctaaggaaaagcagtttcggggcttacagtcccgtatcgaacaggagcagaaatttactgtggtgagagctgggcaggtggtgcaaatccccgtggccgaaattgtggtgggcgacatagcacaggtgaagtacggagacctgctgcccgctgacgggctttttatccagggcaatgacctgaagatagatgaatcctccctcacaggcgagagtgaccaggtccgcaaaagcgtggacaaggatccaatgcttctctctggtacacatgtgatggaaggctccggacggatgttagtgaccgcagtaggggtgaatagtcagactggcatcatcttcactctgctgggtgcaggcggcgaggaagaggaaaagaaggacaaaaaggccaaacaacaggatggggctgccgctatggaaatgcagcctctcaagtcggctgagggaggagacgcggatgaccggaaaaaagctagtatgcataagaaagagaaaagtgtgttgcaaggaaagctaaccaagctggccgtgcagatcggcaaagccggacttgtaatgtctgctattactgtgatcatcctcgtcctttactttacagttgacacttttgtcgttaacaagaagccatggctcccggaatgcaccccagtttacgttcagtacttcgtaaagttttttattattggcgtcacagtcctggtggtagcagtgcccgaggggctgccactggctgtgactatatccctcgcctacagcgttaaaaagatgatgaaggacaacaatctggtacgacacctggacgcatgtgaaaccatgggaaatgcaactgccatctgcagcgataagaccggcaccctcaccactaacagaatgaccgtagttcaggcatacgtcggggacgttcattacaaggagatccccgacccctcatcaataaacacaaaaactatggaattgctgattaacgcaatcgcaattaattccgcctacaccactaaaatactgccaccagagaaagagggtgccctgccacggcaggtgggtaataaaaccgagtgcggcctactggggtttgtcttagacctgaaacaggactacgaaccagttaggtcccaaatgcccgaggagaaactctacaaagtatatacttttaatagcgtgcgtaaaagcatgagcacagtgattaagttacctgacgaatcttttagaatgtattctaagggagctagtgagatagtgctgaaaaagtgctgcaaaatccttaacggggcaggggagccacgagtcttccgccctagggaccgcgatgaaatggtcaagaaggtcatagagcccatggcgtgtgacggactccgtacaatctgtgtcgcctatcgagacttccccagctcaccagagccggattgggataacgaaaatgacatcttgaacgagctgacctgtatctgtgtagtgggcatcgaagatccggtgcggccggaggtgcctgaagccataaggaagtgtcaacgggcaggaattaccgtccgcatggtgacaggggacaacatcaacactgctagggcgatcgcaatcaagtgtggcattattcatcccggtgaggattttttgtgtctggagggtaaagaatttaaccgaaggatccggaacgagaagggagagatcgagcaggaacgaatagacaagatttggccaaagctccgggtgttagctaggtcatccccaactgataagcacacactagtcaaggggatcatcgatagcactcataccgaacagcgccaagtagtcgccgtcactggggatggaaccaatgacggacccgcactgaaaaaagccgatgtgggcttcgctatgggcattgccggaaccgatgtggctaaagaggccagtgacataatcttaacggatgacaacttttcctccatcgtgaaggctgtgatgtggggaaggaatgtgtatgattcaatcagtaagtttctacagttccaactgacggtcaatgtagtggcagttatagttgcgtttactggagcttgtattactcaagactccccattaaaagctgtccaaatgctctgggtgaatttaatcatggatacttttgctagcctcgctctcgccacagagccccccacggaaaccctcttgttgcgcaaaccgtacgggaggaacaaacccctgataagcaggactatgatgaagaatatcctgggccacgcagtgtatcagctggctcttatatttactctgctgttcgtcggggagaaaatgttccagattgatagtggtagaaacgcccctcttcactcacctcccagcgaacattatacaattatcttcaacactttcgtcatgatgcagctcttcaacgaaatcaacgcgcggaagatccacggagagcgaaacgtgttcgacggaattttccgcaacccaatattctgcacaattgtgctggggactttcgccatccaaattgtcatcgtccagttcggtggaaagcccttttcctgcagtccgctgcagctggatcagtggatgtggtgtatttttatcggcttgggggagttggtctgggggcaggttattgccaccataccgacgtcacgcctaaaatttctcaaggaggcagggcgattaacacagaaggaggagatacccgaggaagaactgaatgaagacgtcgaagagatcgaccacgcagaaagggagttgcgaagaggacaaatcctgtggttccgaggcctgaatcgtattcagacacagattcgtgttgttaaggcatttcggtcctccctttatgaggggttagaaaaacctgagtctcgaacttccattcacaattttatggcacaccctgagttccgcatcgaggattcccaacctcacatccctctgatagacgacaccgatctggaggaggacgccgctttaaaacagaactcgtcacccccctcatctctgaataaaaacaactcggcgatcgattccggtatcaacttgacgaccgacacttccaaatcagcgacctctagtagtccagggtcccctatccacagcctggagactagtctgtag

SEQ ID NO: 179775 - DNA, 1299 bp, Artificial Sequence
  Description of Artificial Sequence: Synthetic coding sequence
atgaccgtggtgcaggcctacgtgggcgacgtgcactacaaggagatacctgatccctcatcaatcaacaccaagaccatggagctcctgatcaacgccatcgcgattaactcagcctacacaacaaaaatcttaccaccggaaaaggagggggccctcccaagacaagtaggtaacgtctacgatagcatttcaaaattcttgcagttccagttaaccgtcaacgtcgtcgccgtcattgtggccttcacaggcgcttgtattacccaggacagcccgctcaaagccgtccagatgctatgggttaacttaatcatggacacatttgcttcactcgccctcgccaccgaaccccctactgaaaccctgttactgagaaagccgtacggcagaaacaaacctctcatctctaggacaatgatgaagaacatcctgggccatgctgtctatcagcttgcgctaattttcacgctcttgtttgttggcgaaaagatgtttcagattgactctggacgcaatgcacctctccactcccccccgtcagaacattacactatcatctttaatacatttgtgatgatgcagttgtttaacgaaattaacgctcgcaagattcacggtgagcgaaatgtgttcgacggcatctttcgaaatccaatcttttgcactattgtactgggcacttttgccatccagatcgtgatcgttcagttcgggggcaagccttttagctgcagtcccctgcagctggaccaatggatgtggtgcatattcatcggtcttggtgaactggtttggggacaggttatcgccacaatccctacctcacggctgaaatttctgaaggaagcggggcggctcacccaaaaggaagagatccctgaggaggagctgaacgaagacgttgaggagatagatcacgccgagcgagagctacgcagagggcaaatcttatggtttcggggactgaatcggatacagacgcaaatccgtgtagtcaaagcctttcgttcgtcactgtacgaaggtctggagaaacctgagtccagaaccagcattcacaatttcatggcccatcccgagttcagaatcgaagattctcagccgcacattcccttgattgatgatacggacctcgaagaggacgcagccttgaagcaaaacagttcacctcctagctctctgaacaaaaacaactcagctatcgatagcggaattaatctcactaccgacacatccaagtcagccacctctagctctccgggctcacctatccacagtctcgagacaagcctctag

SEQ ID NO: 179776 - DNA, 3537 bp, Artificial Sequence
  Description of Artificial Sequence: Synthetic coding sequence
atggagctgcggggcaccgaggccgtggtgaagatcaaggagacctacggcgacactgaggccatctgtagacggttaaagacctctcccgtggaagggctcccaggaactgcacctgatctggaaaaacgcaaacagatctttgggcagaatttcattcctcctaaaaaaccaaagactttcctccaactcgtctgggaggctctccaggatgttaccctgatcattctcgagattgctgctataatctcactgggcttgagcttttatcatcccccaggagagggaaacgaagggtgcgccactgcgcaggggggagctgaggacgagggggaggcagaagccggatggattgagggagccgcaatcctgctttcagttatatgtgtggtgttggtgaccgctttcaatgactggagtaaggaaaagcagttcagaggtctccaatcgaggatagagcaagagcagaaatttaccgtcgtacgcgccggtcaggtcgtgcagataccagtggctgagattgtggttggagacatcgctcaagttaagtacggggacctgcttcccgctgatggccttttcatccagggcaatgatctgaaaatcgatgaatcatccctcactggagaatccgatcaggtcagaaaatctgtggataaggaccctatgctcttaagcggaacccatgttatggaaggtagcgggcggatgctggtgacagctgtgggagttaatagccaaaccggtataatttttactctcttgggagccggtggcgaggaagaggaaaagaaagataagaagggcaaaatgcaagacggaaacgtggacgcctctcagtcgaaggctaagcagcaggacggcgcagccgccatggaaatgcagcccctgaagtccgcggaaggcggggatgcagatgatagaaaaaaggcaagcatgcataagaaagagaaatcggttctacagggaaaactgacgaagttggcagtgcaaattggcaaggctggtctcgtgatgagcgcaattacggtcataatcttagtgctgtatttcaccgtcgacacatttgtggtgaataagaagccttggctgccagaatgcacacccgtctatgttcaatactttgttaaattcttcatcattggcgtgaccgttttggttgtcgctgttccagaaggtctgccgttagcagtgactataagccttgcatacagcgttaagaaaatgatgaaggataataacttagtgcgacatctggacgcctgcgagacaatgggaaatgctacagccatttgtagtgacaagacaggtaccctcaccaccaataggatgactgtcgttcaggcctacgtaggcgatgtccattacaaggaaatccccgacccttcatcaatcaatactaaaaccatggagctcttgattaatgccatcgcaataaattcggcttacaccacaaaaatcctccctcccgaaaaggagggcgcacttccccgccaagtgggcaataagaccgagtgtgggcttctcggctttgtcctggatctgaaacaggattacgaacccgtgagatctcagatgcctgaagagaaactgtataaagtgtacacctttaacagcgtccggaaatcaatgtctacagtgataaagctcccagatgagagtttccgaatgtacagcaaaggcgccagcgagatagtgttgaagaaatgctgtaagatactgaatggagctggagagccaagagtgttcaggccccgggacagggatgagatggtgaaaaaggtgatcgaaccaatggcatgtgatgggctgcgcacaatatgcgtggcttatcgtgactttccgtcctcgccggaacccgattgggacaacgaaaatgatattctgaacgaactgacctgcatttgcgttgtggggatcgaggaccccgtccgccctgaagtgcccgaagcaataagaaaatgccagagagcaggaataacggtgcgcatggtgacaggagacaacattaacacagccagagcgatcgccatcaagtgcggcattattcacccaggcgaggacttcttgtgtctcgagggcaaagagttcaataggcgaataaggaacgagaagggagaaattgaacaagagcgaattgataagatttggcctaaactcagggtcttagcccgatcatctcccacagacaagcacaccttagtgaagggcattatcgattccactcacacagaacaacgacaggtggtggccgtgacaggtgacggtaccaatgacgggccagctctcaagaaagccgatgtcgggtttgccatgggaatcgctggtaccgatgtggcgaaggaagcctctgacataatcctgacagacgataatttttcctcgatcgttaaagccgtcatgtgggggcgcaatgtgtatgacagcatatccaagtttctgcagtttcagcttaccgtcaacgtagtggccgtgatcgtcgcctttaccggcgcctgtatcacccaagacagccccctgaaggccgtgcagatgctttgggttaacttgatcatggacacctttgcctctttggcactagctacagagccaccaaccgagaccctgctcctgagaaaaccgtatgggcggaacaagccactgatatccagaactatgatgaaaaacatcctcggacatgctgtgtaccaattagccttaatcttcactctgctttttgtgggcgagaagatgttccagattgactctggaagaaacgccccattgcactcccccccctcagagcactatacaattatctttaatacattcgtaatgatgcagctttttaatgaaatcaacgctcgaaagattcatggcgagagaaacgtttttgatgggattttccgtaatcccatcttctgtacgatagtcctggggacttttgcaatccaaattgtgattgtgcagttcgggggaaaacccttcagttgttcgccgctgcagctggatcagtggatgtggtgtatttttatcggactcggcgaattggtgtgggggcaagtgattgccactattcccacaagcagactgaagttcctaaaagaggccggcaggctgacacagaaggaagagatcccagaggaagaacttaacgaggatgttgaagaaattgatcatgctgagcgagaactgcgtaggggacagatcctttggtttcggggcttgaaccggatccagactcagatccgagtggttaaggcctttcggagttccttatatgaaggcttagaaaagcccgagtctcgcacaagtatccataatttcatggcccatcctgaattccggatagaggattctcaaccacacattccgctgatcgatgataccgacctggaagaggacgccgctctgaaacagaactcctcccctcccagttcgttgaataagaacaatagcgctatcgacagtggcataaatctgaccaccgatacaagtaagtctgccacaagcagctcccccgggagcccgatccatagcttggagacttcactgtag

SEQ ID NO: 179777 - DNA, 3663 bp, Artificial Sequence
  Description of Artificial Sequence: Synthetic coding sequence
atgggcgacatggccaacagcagcatcgagttccaccccaagccccagcagcagcgcgacgtgcctcaggcgggaggttttggctgtactctggcagaattacgaaccctcatggagctcaggggtgccgaagccctgcagaagatcgaagaggcctacggcgatgtcagcggattatgccgacgcctgaagacatcgcctaccgaggggctggctgataacacgaacgatttagagaagcgccgacaaatatacggacagaacttcatccccccaaagcagcccaaaacctttctgcaactcgtgtgggaggccttgcaagatgtcacccttatcatattggaggttgccgctatcgtatctttaggtctgagtttttacgcaccccccggagaggaatcggaggcatgtgggaatgtatctggcggcgccgaagatgaaggagaagccgaagcgggctggatagagggggccgccatcctgctgtcagtcatctgcgtcgtgctggtcaccgcctttaatgattggtcgaaagagaaacaattcaggggccttcagtccaggattgaacaggagcaaaaatttactgtgattcgaaacggccaactgctccaagtcccagtagccgcacttgtcgtgggtgacattgcacaggtcaagtatggggacctgcttcccgccgatggggtgttaatccaggcaaatgacttgaaaatcgacgaatcatccttgacaggcgaaagcgaccatgtgaggaagtcagctgataaggatcccatgctactgtccggaacacacgtgatggaaggcagcgggaggatggttgttacagcagttggcgtgaattcacaaaccggtatcattttcacactccttggggctgggggagaggaggaggagaaaaaggataaaaagggaaaacagcaggatggagcaatggaatcttctcagacaaaggcgaaaaaacaggatggggcggtcgccatggagatgcaacctctgaaaagcgcagaaggaggcgaaatggaggagagggaaaagaagaaggcgaacgctccaaaaaaggagaaaagcgttctccagggaaaactgacaaaactggcagttcagatagggaaggccggcctagtcatgtctgccattacagttatcatcttggtgctgtacttcgtgatcgagacattcgtggtcgagggacgtacttggctcgccgaatgtactccagtgtacgtgcagtactttgtcaagttcttcatcataggagtgactgtgctggttgtggccgtgcccgagggcttgccgctcgccgtcactatttctctcgcatattcagttaaaaagatgatgaaagacaacaacttagtgcgccacctcgatgcttgtgaaaccatgggtaatgcaaccgctatctgtagtgataaaactggcacacttaccacgaataggatgactgtcgttcagagttatctcggtgatacgcattataaagaaattcccgccccctctgcactaacccctaaaatactagatctcttagttcacgctatcagcataaatagcgcgtataccacaaaaatcttgccgcctgaaaaggagggagcacttccaagacaggtaggaaacaaaacagaatgcgcgctccttggctttgtgctcgacttaaagcgtgacttccagccggtgagggaacagataccagaagacaagctctataaagtgtatacttttaatagtgttagaaaatccatgtccaccgttattaggatgcctgacggcggcttcaggctgtttagtaagggagcttcggagatactcctaaaaaagtgcaccaacatcctgaattccaacggtgagttgagaggttttaggcctcgggacagggacgatatggttcgaaaaatcattgaaccgatggcttgcgacggactccggacgatctgcatcgcctatagggacttctctgccggccaggagcccgactgggataatgaaaacgaggttgtgggcgacctgacatgtatagcggtggtgggaatcgaggatcctgttaggccagaagtgccagaggccatcaggaagtgccagagggccggaatcactgtgcgcatggtcaccggagacaatatcaatacagcccgcgcaatcgcggcgaagtgtggaatcattcagcccggcgaggatttcttgtgtctggaaggaaaagagttcaacagaagaattcgtaatgagaagggtgaaatcgagcaggagaggttagacaaggtttggccgaaactccgtgtccttgcacggtcctcacctaccgacaaacacaccctggtcaagggtatcatagattctaccacaggggaacagagacaggttgttgccgtaaccggcgacgggacgaatgacggccctgctttgaaaaaagcagatgtcggattcgcaatggggattgctggtactgacgtggccaaggaagcttccgacatcattctgacggacgacaactttacgtcgatcgtgaaagctgtgatgtggggcagaaatgtttatgattcaatttcgaaattcttgcagttccagctgactgtcaacgtagtggcagttattgtcgcgttcactggtgcatgcatcacccaggacagccctctgaaggcagttcagatgttgtgggtcaaccttatcatggacacctttgcatcattagctcttgccaccgaacccccgaccgagagcctgctcttgcgcaagccctacggccgcgacaagcctctcatcagccgcacgatgatgaaaaatatactggggcatgctgtgtaccagctcgcaataatatttacgctacttttcgtgggcgagctgttcttcgacattgacagcggtcgcaatgcacctctgcactcccccccatccgagcattacaccattattttcaatacattcgttatgatgcagctctttaacgagatcaacgcaaggaaaatccacggcgagcgaaacgtgttcgatggtattttttccaaccccattttttgtaccattgttttgggtaccttcggcattcagatcgtcatcgtgcagttcggcggaaagccgttttcgtgcagccctctatccacggaacagtggctgtggtgcctgtttgtgggggtaggcgaactggtttggggccaagtcattgccactatcccgacaagtcagctgaagtgtctgaaggaagctggccacgggcccgggaaggatgaaatgactgatgaggagctggctgagggtgaggaggagattgaccacgcggaaagggagctcaggcggggacagatactctggtttaggggcctcaatagaatccaaacgcagattcgggtggtgaaggcgtttcgatctagtctgtatgaggggctcgagaaacccgagtcgaagactagcatccataatttcatggccactccagagtttctgattaacgattacacacataatatccctctgatcgacgacacagacgttgatgaaaatgaggaacgcctgcgggcacctccgcccccttcgcctaatcagaataacaatgccatcgattctggcatttatctgacgacacatgtcaccaaaagcgcaactagctcagtgttttcgagctctcctgggagtcctcttcacagcgtggagacaagcttgtag

SEQ ID NO: 179778 - DNA, 3663 bp, Artificial Sequence
  Description of Artificial Sequence: Synthetic coding sequence
atgggcgacatggccaacagcagcatcgagttccaccccaagccccagcagcagcgagatgtgcctcaagctggtggctttgggtgcacactggctgaactgagaacgctaatggagcttcgaggagccgaagctctgcagaagattgaggaggcctatggcgatgtctctgggctttgccggcgcctgaaaacaagtcccaccgagggccttgcggacaatacaaatgacttggagaaacgaagacagatctatggacaaaacttcatacctcctaaacagccaaagaccttcttgcaactggtgtgggaagctctccaagatgtaaccttaattattctggaggtcgccgcaattgtgtccctgggcctctccttctacgctcctcctggcgaagagagtgaagcctgtggcaacgtgagtggcggggctgaagatgaaggtgaggccgaggcagggtggatcgagggggccgcaattctcctgagtgtgatttgcgttgtgctcgttacagccttcaacgactggtccaaggagaagcagtttaggggactgcaatcaagaattgagcaggagcagaagtttacagttattaggaacggccagttgctgcaggtgcccgtggcagctttggtggtgggagacatcgctcaggtcaaatatggcgacctgctgccagccgacggagtgttgatccaggccaacgatcttaaaattgatgaaagttccctgaccggcgagtctgatcacgtgcgtaaatccgctgacaaggaccctatgctcttaagtggcactcacgtcatggagggctctggaagaatggtggttaccgccgttggagtgaactcccagacgggaattatcttcactcttctgggtgctggaggcgaggaggaagaaaagaaagacaaaaagggtaaacagcaggacggggccatggaatctagccagacgaaagccaaaaaacaggacggggctgtggctatggaaatgcagccgctgaagagcgccgagggaggagagatggaggaaagagaaaagaagaaggcaaacgctcccaagaaggaaaaaagcgtcctacagggaaagcttacaaagctggccgttcaaattggaaaggctgggctggtaatgtcagcaatcactgtcattattttggtcctatacttcgttatcgaaacctttgtagtggagggccgtacatggttggccgagtgtacccccgtgtacgtgcagtattttgtgaagttttttatcatcggcgtcacggtgctggtagtcgccgtgccagagggcctccctcttgccgtaaccatttctcttgcatattcggtgaagaagatgatgaaagacaataatttggtccggcacctggacgcatgcgagaccatgggaaatgccaccgctatttgctccgacaaaaccggaacgctgaccaccaataggatgacagttgtccagagttatctgggagatactcactacaaagagatcccagctcccagtgccctgactcctaagatacttgacctgttggtgcacgcgatctctataaactccgcttataccactaaaattctgcctcctgagaaggagggggccttgccacgccaggttggaaataagaccgagtgcgcactgctgggtttcgtactggatttgaaaagagatttccaacctgtcagagaacagattccggaagacaaattgtataaggtgtatacttttaattccgtccgtaagagcatgtccaccgttattcgcatgcccgacgggggctttcgattattctctaaaggcgcctctgaaatcctgctcaaaaagtgtactaacatcctcaattccaacggagagctgaggggcttccggccgcgcgaccgtgacgatatggttcgaaagatcatcgaaccaatggcttgtgacggcctccgtacgatctgcatcgcctacagagacttttctgctggccaggagccagactgggacaatgagaatgaggttgtgggggacctgacatgcattgccgtcgtcgggatagaagacccggttcgccctgaggtccctgaagccattaggaagtgccagcgggctggaattacagtcagaatggtcaccggggataatatcaacaccgctcgagctattgcggccaagtgcggcatcattcaaccaggggaggactttctgtgcctggaagggaaagaatttaaccgcaggataaggaatgagaagggcgagatcgagcaagaaaggctggacaaggtgtggccaaaactgagggtgctggctaggtcatcgccgaccgataagcacactttagtcaaaggcattatagactcaactactggagaacaacggcaggttgtggctgtgacaggtgatggcacgaacgacggacctgccctgaagaaagccgacgtgggctttgcaatgggaatagccggaacagacgttgctaaagaagcctccgacattatattaaccgacgacaatttcactagcatcgtaaaggccgtgatgtgggggagaaatgtgtatgactcaatctctaaattcctgcagttccagttaactgtgaatgttgtcgccgttatcgtcgccttcaccggcgcctgcataacccaggactcacctctaaaggctgtgcagatgctgtgggtgaacctgatcatggacactttcgcctccctggccctcgcaacggaacctccgaccgagtccctgctgctgcggaaaccttatggaagagacaagcctctgatctccaggacaatgatgaagaatatcctcggtcacgcagtgtatcagctcgctatcatcttcacactgctgttcgtgggagagctcttcttcgatattgactcagggagaaatgcccctctgcacagtcctcctagtgagcactacactattatcttcaataccttcgttatgatgcagctcttcaatgagattaatgcaaggaagattcatggcgagcgcaacgtgtttgacgggatattcagtaaccctatcttttgcacaatagtccttggaacgttcgggatccaaatcgtgattgtccagttcggaggaaagccattctcctgctctcctctctctaccgaacagtggctatggtgtctcttcgttggagtgggggagctcgtgtggggtcaggtgatcgccaccattcctaccagccagctgaagtgtctaaaagaagctgggcacggcccagggaaagacgaaatgaccgacgaggaactcgccgagggggaggaggaaatcgatcacgccgagagggaacttcggaggggccagatcctgtggtttagagggctcaaccgaattcaaacacagatcagagtggtcaaagcctttaggagttccctctatgaaggcctggaaaagcccgaaagcaaaacctccatccacaattttatggcgactccagaattcctcatcaacgattacacacacaatataccactcatagacgacactgatgtggacgaaaacgaagaacggctccgggcccctccaccccccagccccaatcagaacaataacgcaatagacagtgggatctatctgacgacacatgtaactaagtcagctacgtcttctgtgttcagttcatctcccggctctcccttacattccgtcgagacatctctgtag

SEQ ID NO: 179779 - DNA, 3522 bp, Artificial Sequence
  Description of Artificial Sequence: Synthetic coding sequence
atgggcgacatggccaacagcagcatcgagttccaccccaagccccagcagcaaagggatgtcccgcaggctggaggctttggctgtaccctcgccgagctccgcacgctcatggaacttaggggcgctgaagctcttcagaagattgaggaggcgtatggtgacgttagtgggttatgccgccggctgaaaacctcaccgactgagggattagccgacaacacaaacgatctagagaagcggagacagatctatggacagaatttcattcctccaaaacagcctaaaacttttttgcagttggtgtgggaagctctgcaggatgtgaccctcatcattctggaggtggcagctatagtgtccctgggcttgagtttttacgcaccccccggtgaggagtccgaggcctgtggtaatgtttcagggggcgccgaggacgaaggcgaagccgaggctggctggatagagggagccgcaatcctcctaagtgtaatttgcgtggttctggtgacagctttcaatgattggtcaaaggaaaaacagttcagagggcttcagagccgaatcgaacaggaacaaaaattcacagtaatacggaacggccagctcctgcaggttcctgtggctgccttggtggtcggggacattgcccaggtaaagtacggagatttgctgccagccgatggggtattgatccaggcaaatgatctcaagatcgatgaatcctccttgaccggtgagagcgatcacgtacgcaagagtgcagacaaggatccaatgcttctgagcggcactcacgtgatggaaggtagcggcagaatggtcgtgactgcagttggcgtaaattcccagacaggcatcatcttcaccttactgggagccggtggagaagaagaggagaaaaaggataaaaagggaaagcagcaggatggcgctatggagtcatctcagactaaggctaagaaacaggatggcgcagttgcaatggagatgcagcctttaaagtctgctgaagggggcgagatggaagaaagagagaagaaaaaagctaacgctccaaagaaggaaaagtctgtgcttcaaggtaaacttacaaagctagcagttcagatcggaaaggccggcttggtgatgtcggccattacggtgattatcttagttctgtacttcgtgattgagactttcgttgtggaagggagaacatggctggcagaatgtacaccggtgtacgtgcagtacttcgtaaagttcttcatcataggcgtgaccgtgttggtggttgctgtgccagaaggcctcccgctggcagtcactatttcattggcttacagcgtcaagaagatgatgaaagataacaatctggtgcggcatcttgacgcttgcgagactatgggaaacgcgaccgccatttgctctgacaagaccgggacactgacaactaatcgcatgaccgtggtccagtcatacttgggggacacacattacaaggagatccctgccccaagtgcccttactcccaagatcctcgatctgttggtgcatgcaattagcataaactctgcatatactacaaaaatcctcccgcccgaaaaagaaggagctttgccaaggcaggttggcaataagacagaatgtgcgctgctggggttcgtgttagacctgaaaagagattttcaacctgtgagggagcagattccagaagataaactttataaagtgtacactttcaatagcgtgaggaaaagcatgtctactgtgatccgtatgcctgacggtggcttccggcttttctctaagggcgcttcagaaattctactgaaaaagtgcacaaacatcttaaactcgaatggcgagctgcgaggatttcgaccacgagatcgtgacgatatggtaaggaaaataattgaaccaatggcctgcgatgggcttaggactatctgcatcgcctacagagatttctctgctgggcaggagcctgactgggataacgagaatgaggtggtgggcgacctgacgtgtatcgcagtcgtcggcatcgaggacccggtgcgccccgaagtccctgaagcgatacgcaagtgccaaagggccggcatcaccgtaagaatggtcacaggggataatatcaataccgccagagctattgccgccaagtgtggcattatccagccaggcgaagatttcctttgccttgaagggaaagagtttaataggaggattcgcaacgagaagggggaaattgaacaggaacgcttggacaaggtgtggccaaaactgcgcgtgctggcccgttctagccctacagacaagcatacattggtgaaaggaataatcgactcaactaccggagagcagcgccaggtggtagcagttacaggggacggcactaacgatggccccgcgcttaaaaaagccgatgtcggatttgcaatgggcattgcaggcacggacgtggccaaggaggcttctgacatcatcttgacagacgataactttacttctatcgttaaagctgtgatgtggggacgaaacgtgtacgacagcatctccaagttcctccagtttcagttaacagttaatgtcgttgcagtgattgttgccttcacaggagcctgtattacccaggattcccctctcaaagccgtccagatgctctgggttaacctgatcatggacacatttgcatccttggccctcgccaccgagccaccaacggaaagcctcctcctcaggaagccgtacgggcgggataaacctctgatcagtaggaccatgatgaaaaatatcctcggacatgcagtgtatcaactcgcgattattttcaccctcctattcgttggtgaattattctttgacatcgactctggaaggaatgctccccttcacagccctccatcagagcattacacaattatcttcaacactttcgtgatgatgcaacttttcaatgaaattaatgccagaaagatccatggtgagcgtaatgtgtttgacggcattttcagcaatcccatattttgtacaattgtgctggggacgtttggaattcagattgttatcgtgcaatttggagggaaacccttcagctgcagtcccctgagcacagaacagtggctatggtgcctcttcgtcggtgtgggcgagttggtttggggccaggtgattgcgactattcccacaagccaactcaagtgcttaaaagaggcaggtcacggccctggcaaggacgagatgacggacgaggagctggctgagggcgaagaagaaatcgaccatgctgaacgagagctgaggaggggacagatcctgtggttccgaggcctcaatcggatccaaacccagatggaagtggtgtccacttttaagaggtctggcagtgttcaaggggctgtcaggagaaggtcttcagtcttgtcccagctgcatgacgtcacgaatctgagtacccccacacatgcaatcctcagcgccgccaaccccacctctgccgcgggaaaccctggcggagagagtgtgccctag

SEQ ID NO: 179780 - DNA, 3480 bp, Artificial Sequence
  Description of Artificial Sequence: Synthetic coding sequence
atgggcgacatggccaacagcagcatcgagttccaccccaagccccaacagcaaagggatgtgccacaggcaggagggtttggatgtactctggccgagcttcggacccttatggagctgaggggcgctgaagccctacagaagattgaagaagcctatggagatgttagcggtttatgccgacgtctcaagacttcaccgacggaaggactcgctgataacaccaacgacttagaaaaaagacggcagatctacggacagaacttcatcccaccaaaacaaccaaagacctttttgcagctggtctgggaggcccttcaggacgtgaccctgattatcctagaggtggcggccatcgtgtctctcggcctgtcattctatgcccctccaggagaggaaagtgaagcttgtggcaacgtaagtggaggagccgaggatgagggcgaggctgaggcaggttggatagaaggagccgctatcttactcagcgttatctgcgtggtgctcgtaacagccttcaatgactggagcaaggaaaagcaatttaggggcctgcaaagccggatcgagcaagagcagaaattcacagtaatccgcaatggccaactcctacaggttccggttgccgctctcgtggtaggggatatcgcccaggtgaagtatggcgacttgctgcccgccgatggagtgttgatacaggctaatgatctgaagatcgacgagtcttcactgactggggagtcagaccacgtccggaagtctgcagataaggatcctatgctgttaagtggtactcacgtcatggagggaagtggccgaatggttgtcacagcggtgggcgtgaacagtcagacggggataatcttcacgctccttggggcagggggagaggaagaggagaaaaaggataagaaggccaagaagcaggatggagcagttgctatggaaatgcaaccattaaaaagtgcagagggcggcgaaatggaagaacgagaaaaaaagaaagctaacgcacccaaaaaagagaagtctgtattgcagggaaaactgacaaaactcgctgtacagataggaaaggctggtctggtaatgtcagctattactgtgatcattctggtcctgtacttcgtaatagagactttcgtcgtggaaggccggacctggctggctgagtgcaccccggtgtatgtacaatattttgtaaaattcttcatcatcggcgtcactgtgctcgtggtggccgtccccgagggccttcccttagcagtgacaataagtctcgcctatagtgtcaagaaaatgatgaaggataacaaccttgtgagacatctcgatgcctgcgaaacaatggggaatgcaaccgctatctgttctgacaagacgggcaccctaaccactaatcgaatgaccgtcgtgcaaagctacctgggcgacacacactacaaagaaatcccggcgccttctgcccttacacccaaaatccttgatctgctggtccatgctatctctatcaactccgcctacaccaccaaaattctgccacccgagaaagaaggagcactgcctcgccaggtgggcaataagacagaatgtgcacttctcgggttcgtcctggacctgaagcgggactttcagcctgtgcgagagcagatacccgaggataaactgtataaagtctatacctttaacagcgtgcgcaagtcaatgtcgacggtcatccgtatgcctgacggaggctttcgcctgtttagcaaaggcgccagtgaaatccttctaaagaagtgcacgaatattttgaactccaatggggagctcagaggctttcgtcctagagatcgcgatgacatggtaagaaaaatcattgaaccaatggcctgtgatgggttaaggaccatatgcattgcttatcgggatttttcggctggtcaggaacccgattgggacaatgaaaatgaggtagttggcgacctcacatgtatagcagtggtggggattgaggacccggttcgtcctgaggttccagaggccatccgcaaatgtcagcgggcaggcataaccgtgagaatggtgactggcgacaacattaacacagctcgggcgattgccgccaagtgcggtatcattcaacccggggaggactttttgtgcctcgagggaaaagagttcaatagaagaatcagaaacgaaaagggcgaaatagaacaggagcgcctagataaagtctggccgaaactgcgagttctcgcacgctcgagccctactgataaacacaccctggtgaagggaattatagatagcacaaccggcgaacagcggcaagtcgtcgccgtcaccggggacggaaccaacgatgggcccgccctcaaaaaagccgacgtcggtttcgcaatgggcattgccgggaccgacgtggcaaaggaagcatccgatataatcttgacggatgacaatttcacttccatcgttaaagccgtgatgtggggacgtaacgtgtacgacagcatctctaagttcctgcaattccaactgactgtaaacgtcgttgctgtgattgtggccttcactggggcctgtatcactcaggactctcccctgaaggccgtccagatgctttgggtgaacttgataatggatacttttgctagcctggcactagcaacagagccaccaactgaaagcctgcttctcagaaagccatacggaagggacaaacctttaatcagcagaaccatgatgaagaatatccttggtcacgccgtgtaccagctggctatcatatttacactgctgtttgtgggcgaactcttcttcgacattgacagtggtcggaacgctccactgcacagtccaccatccgaacactatacaattatctttaacactttcgtgatgatgcaactgttcaacgagatcaatgccagaaagatccacggcgagcggaacgtgtttgacggcattttcagcaaccctatcttttgcacaatcgtcctgggcactttcggcatccagatcgtaattgtccagtttggcggcaaacccttctcatgtagtccactgtcaactgaacagtggttatggtgcctttttgtgggagtgggagagctagtatggggccaggtgattgcaactattccgacttctcagctcaaatgccttaaagaagctggacatggacctggaaaggatgaaatgacggacgaggaactggctgagggggaggaggagatagatcatgccgagcgggaactgcggagaggtcagatcctctggtttcgaggccttaatcgaatccagacgcagatggaagttgttagtacctttaagcggagcggcagcgtccagggcgctgtaagacggaggagtagcgtactgtctcagctacatgacgtgaccaacctctccacgcctacacacgccatcctatccgccgctaacccgacctctgctgccgggaaccctggaggcgagtcggtcccgtag

SEQ ID NO: 179781 - DNA, 3480 bp, Artificial Sequence
  Description of Artificial Sequence: Synthetic coding sequence
atgggcgacatggccaacagcagcatcgagttccaccccaagccccagcagcaacgggatgtgcctcaagccggcggctttgggtgcacactggctgagctgaggaccctaatggaactgaggggtgcagaagctctgcagaagatcgaggaagcctatggtgacgtgtcaggcctctgcaggcgcctgaagacatcccccactgagggtctggctgataacacaaacgacctggaaaagcggcggcagatctacggacagaacttcatcccccctaaacagccaaagactttcctccaactcgtctgggaagcattgcaggacgtcacactaatcatcctagaggtcgcggctatcgtaagtctcggacttagtttttacgctcctccaggtgaggaatctgaggcgtgcgggaacgtttccggtggcgcggaagatgaaggggaggccgaggctggctggatcgaaggcgcagctatcctgttgtccgttatttgtgtggtcctcgttacagcttttaatgactggtccaaggagaagcagtttcgagggctgcaatcacggattgagcaggagcagaagtttaccgtcattcgaaacggtcagctgttgcaggtccccgtggccgcattggtggtgggggacatcgcccaagtgaagtatggcgatctgctccccgctgacggtgtactaatccaggcaaacgacctgaagatcgacgaaagctccctgacaggcgaatcagatcacgtccgcaagtccgccgataaggatccgatgcttctctccggtacacatgtgatggaaggttctggcagaatggtggttactgctgtaggcgtcaacagtcagactggcattattttcacccttctcggtgctggcggggaggaggaggaaaagaaggacaagaaagctaagaaacaggacggggccgtcgccatggagatgcagcccctaaaaagcgctgagggcggggagatggaagagcgcgagaaaaaaaaagccaacgctcctaagaaggagaagagtgtgctgcaaggcaagctgaccaagctggcagtccaaattggaaaagccggactcgtgatgtccgcaattaccgtgatcattttggttctatatttcgttattgagacattcgtcgtggaggggcgcacatggctcgcagaatgcacacccgtgtacgtgcaatactttgtcaaatttttcatcatcggcgtgacagtccttgtggtggcagttcctgagggcctgccgttggccgtaacgatatccctcgcctactctgtcaaaaagatgatgaaagataataacctggtccggcatctggacgcttgtgagaccatgggtaacgccaccgcgatctgttctgacaagacaggcactctaacaacaaacaggatgacagtcgttcagtcataccttggcgatacccactacaaggaaatccctgcccccagtgcactgactcctaagatcctagacctgctggtccacgcaatctccatcaattcagcatatacaacaaagatcctgcctcccgagaaagaaggtgctctccctcgccaggtagggaacaaaaccgaatgcgccctgttgggctttgtacttgatctgaaacgagactttcagcccgtgcgcgaacagatccccgaagacaagctctacaaggtgtataccttcaactctgtcagaaagagtatgtcaacagtcatcaggatgcctgacggggggttccgactgtttagcaaaggtgcctctgaaatcctcttaaaaaaatgtacaaacatacttaacagtaacggcgagctcagagggtttcggccgagagatagggatgatatggtgcggaaaattatcgagcctatggcttgtgatgggcttagaacaatctgcatagcttatcgtgattttagcgccggccaggaaccagactgggataatgaaaacgaagtagtgggcgacctgacttgtattgccgtggtgggcatcgaggatcctgtccggcccgaggtgcccgaagcaatacgtaaatgccagcgcgcagggatcaccgtccgaatggtgaccggcgataatattaacacggcacgggccatagccgcaaaatgcggtatcattcaacctggcgaggactttttgtgtttagagggcaaagagttcaacagaagaatacgcaatgagaagggagaaatcgagcaggagagactcgacaaagtatggccaaagctgagagtgttggcccgctcctcacccacagacaaacacacactggttaagggtatcatcgactctaccacaggggagcagaggcaggtcgttgcggtcacgggagatggcacgaatgacggtccggcactgaagaaggccgacgttgggttcgctatgggaatcgcaggaactgacgtcgccaaggaggcttccgacattattctgacagacgacaacttcacatccattgtaaaagctgtgatgtggggccgcaacgtttacgattccatctcaaaatttcttcaatttcaactgacggttaatgtggttgcagtaatcgtggctttcactggagcctgtattactcaggattctccactgaaggcggtacagatgctttgggttaatcttatcatggatacgttcgctagtttggcactggcaacagaaccgcctaccgaaagtttattgctcagaaagccctatggtagagataagcctctcatttctagaactatgatgaaaaatattctaggacatgccgtgtaccagttagcgatcatttttacacttttgttcgttggtgagttgttctttgatatcgattccgggcgaaacgctccgctgcattcacctccgtctgagcattatactataattttcaacacctttgtgatgatgcaactcttcaacgaaattaacgccaggaagattcacggagagcgcaacgtttttgacgggattttctccaatcccatattctgcaccatcgtcttggggacatttggcatacagatcgtcatcgtgcagttcggcggcaaacctttctcctgttctcccttatccaccgaacagtggctgtggtgtctgtttgtcggtgtgggcgagcttgtttgggggcaggtgatcgctacaatccctacaagtcagctcaaatgtctgaaagaggccggccatggacctggtaaggacgagatgaccgacgaggagctcgcagaaggagaggaagaaatcgaccacgcagagagagagttacggcggggtcagatcctgtggtttagaggattaaacagaattcagacgcaaatggaggtcgtctctacttttaaacggagtggaagtgtgcaaggagccgtgagacgcagaagcagtgtgttatcccaactgcatgacgtcaccaacctgtccactccaacgcacgctattctttctgctgcaaatccgacttccgccgcaggcaacccagggggcgagtcagtgccgtag

SEQ ID NO: 179782 - DNA, 3465 bp, Artificial Sequence
  Description of Artificial Sequence: Synthetic coding sequence
atgggcgacatggccaacagcagcatcgagttccaccccaagccccagcagcagcgggacgtcccacaggccggcggatttggctgtactctggcggaactgcgcaccctcatggagcttcggggcgccgaggcccttcagaagatcgaggaagcctatggcgacgtctccggtctctgtcggaggttaaaaacatcccccacggaggggctggcagataacaccaatgatctcgaaaagcgcagacaaatctacggccaaaactttattccccctaaacagccgaaaacattcctgcagctcgtttgggaggccctgcaagacgtcaccctgatcattcttgaagtggcagcaatcgtttccctgggcctgtccttctatgcccccccaggcgaggagtctgaagcctgcggcaatgtgtctggcggtgcagaggacgagggcgaagccgaggctggttggattgaaggggcggccatcctcctgtcagttatttgcgtggttttggtcaccgccttcaatgattggtctaaggagaagcaatttagaggacttcagtccagaatcgagcaagaacagaaattcaccgtgatccgaaacggccagctgctccaggtgcccgtagccgccctcgtggtgggcgacattgcccaggttaagtacggagatctgttgccagccgatggggtgctgatccaagccaacgatctgaaaatcgatgaatcaagcctgacaggggaaagcgatcacgtgcgcaagagtgccgataaggatcccatgctgctaagcgggacccacgtgatggaggggtcaggaaggatggtggtcacagcggtcggcgtcaattcacagacaggcatcattttcactctgctgggcgccggaggcgaggaggaagagaaaaaagacaaaaaagctaagaagcaggatggcgccgtggccatggagatgcagcctcttaaaagcgccgaaggcggggagatggaagagcgcgagaagaagaaggcaaacgcccctaaaaaagaaaaaagcgtcctacagggaaaacttacaaaactcgctgtacaaattggcaaagctggccttgtgatgagcgctataaccgtaatcatccttgtattgtactttgtgatcgagacatttgtagttgagggccgaacatggctggctgagtgtaccccagtgtatgtgcagtactttgtcaaatttttcatcattggtgtgactgtcctcgtggtcgctgtgcccgaggggctgcctctcgccgtcactataagcttagcatactcagtgaagaaaatgatgaaggataataatttggtaagacacctcgacgcctgtgaaaccatgggcaatgctacggccatctgttcggacaagacaggtacgctgacaaccaaccgtatgacagtcgttcaatcttatctcggagatacccattacaaggagatacctgccccatctgctctgacaccgaagatactggaccttttggtgcatgccattagtatcaactctgcctatacaaccaagatcttacctccagagaaggaaggcgccctcccacgtcaggtaggaaataaaacagagtgtgcgcttctgggtttcgttttggatctgaagagggattttcagcctgtcagggagcagattcctgaggataaactgtacaaggtctacaccttcaactctgtccgaaagtctatgtctacagtcattcgaatgccagacggcggcttcaggttattttccaaaggagcttcagagattcttctcaaaaagtgcactaacatcctgaatagcaacggcgaactgaggggttttcggcctagggatcgtgacgacatggtgcggaaaatcatcgaacccatggcctgtgacggactgcgtacgatttgtatcgcttatcgcgactttagtgctggacaggagcccgactgggataatgagaacgaggtggtgggagacctgacctgcattgccgttgtggggattgaggaccccgtcagacccgaggttcccgaggctattcgcaaatgccaaagggcgggcatcaccgtgcgcatggtgaccggtgataacatcaacacggctcgggctatcgctgctaaatgcggcattatccagcctggtgaggactttctgtgcctcgaagggaaagagttcaacagacgcataaggaatgaaaagggggagatcgaacaggaaaggcttgataaggtgtggccgaagctgcgggttctggcacgatcgagtcccacagataagcacaccctggtaaaggggatcattgacagcaccaccggagagcagcgccaggtagtggcagtgaccggggatggcacaaacgacggccccgccctcaagaaagccgatgtgggctttgcaatggggatagccgggaccgatgtggccaaagaggcctccgacatcatccttacagatgataatttcacgtcgatcgtgaaagctgtcatgtggggccgcaatgtgtacgatagtatcagtaaattcctgcaatttcaactgaccgtgaatgttgtcgcagtaattgtggcgtttactggtgcctgcattacgcaggatagcccgctgaaggccgtgcaaatgctgtgggtcaatctcatcatggacaccttcgctagtctggctttggcaacggagccaccaactgagtccctattgctgcgcaagccatatggacgggataaaccactaataagcaggacgatgatgaagaatatcctcgggcacgccgtgtatcagttggctatcatcttcaccctgctgtttgtgggagagctttttttcgatatagattccggccgaaatgcacccttacatagcccaccatccgagcattacacaattatttttaatacgttcgtcatgatgcagctgttcaacgaaattaatgctcgcaagattcatggtgaacgcaatgtgtttgacggaatcttcagcaatcccattttctgtactattgttctgggtacgtttggcatccagatagtgattgttcaatttggtgggaagcctttttcatgctcacctctgtccactgaacagtggttgtggtgcctctttgtgggtgttggcgagctggtgtgggggcaggtcatagccacaatcccgacgagccagcttaagtgcttgaaggaggcgggccacggcccaggaaaggatgaaatgacggacgaggagctggccgagggcgaggaagagatcgatcatgccgagagggaactgagacggggacagatcctgtggttccggggtctgaatcgtatccagacgcaaatggaggtggtaagtactttcaaacgatccggtagcgtgcagggagctgttcggagacggtcatcagtgttgagccagctccatgatgtaacaaatctgtcgacgcctacccacgccattctctcagccgccaatccaacctccgccgctgggtcagaaagctag

SEQ ID NO: 179783 - DNA, 3513 bp, Artificial Sequence
  Description of Artificial Sequence: Synthetic coding sequence
atgaccaaccccagcgaccgggtgctgcccgccaacagcatggccgagagtcgggagggggactttggttgcacggtgatggagctgcggaagctgatggaacttcgtagccgagacgccctgactcagatcaatgtgcactacgggggcgttcagaatctgtgttctagattaaaaacttcgcccgtggaaggccttagcggcaaccccgccgatctggaaaaacgccgacaggtgttcgggcataacgtgattccccctaaaaagcccaagactttcttggaactggtctgggaggccctccaggacgtaacactaatcatattagaaatcgcagctatcatcagtcttgtgctttctttttatagacccgccggtgaggaaaacgagttgtgcggccaagttgccacaacccctgaagatgagaacgaagctcaagctggttggattgaaggggcagccattctgtttagtgtgattatcgtggtgcttgttactgctttcaacgactggtcaaaagagaaacaattcaggggtttgcagtgtagaatcgagcaggaacaaaagttttcaatcatcaggaacggacagcttatacagttaccagttgctgagattgtggttggtgatatcgcccaggtgaagtacggcgatctgctgcccgccgacggaatcctgatccaaggaaacgacctgaagattgatgagagtagtctgaccggtgaatccgaccatgtcaaaaagtccctcgacaaggatcctatgctgttgtcaggaacacacgtgatggagggctcgggtcggatggttgtaactgcggtgggggtgaattctcagactggtatcatcctcacgcttctcggtgtgaacgaggatgatgagggtgaaaagaaaaagaaaggaaaaaaacagggtgtccctgagaatcgcaataaggccaaaacacaagacggagtcgccttggaaatccagccattgaattcgcaagagggaattgataacgaggagaaggataagaaggcagtgaaagttccaaagaaggaaaaatccgtattacagggtaagctaacacgactcgcagtacagataggaaaagctgggctgctgatgagtgctcttaccgtgtttatcctgatcctgtattttgtcatagataatttcgtcatcaacaggaggccctggctaccggagtgcacccccatttatatccagtacttcgtgaagttttttattataggcataactgttcttgtggtcgctgtgcccgagggcctacctctggctgttacaatctctcttgcctactccgtcaaaaaaatgatgaaggataacaacctggtgcgccacctcgatgcctgtgagaccatgggcaacgcaaccgccatctgcagcgacaaaacaggcacgcttactatgaaccggatgacggtggttcaagcttatattggaggaattcactatcgccaaatccctagtccagatgtgtttctgccgaaggtactggatcttattgttaacggtatctcaatcaactcagcttacacttcaaaaatcctgccccctgagaaagaggggggactcccacgtcaggttggtaataagactgaatgtgccctgcttggcttcgtgacggacctgaagcaggactatcaggcggtccgtaacgaggttcctgaggagaaactttataaagtctatacgtttaattcagttcgaaaatccatgagcacagttattagaaaccccaatggcgggttccgaatgtatagtaagggggcttccgagatcattctgagaaagtgtaacaggatactggatcgcaagggtgaagccgttccatttaagaacaaagacagggatgatatggtcagaaccgttatcgagccaatggcatgcgacgggctgcgcaccatctgcatcgcatatcgcgatttcgacgacacagaaccctcgtgggacaatgagaatgagatcctcacagagctcacttgtatagctgtagtcgggatcgaagatcccgtacggccagaggtccctgacgccatcgccaagtgtaagcaagcaggaatcactgtgcgaatggtaaccggggataacatcaacacggcccgcgccatcgccacaaaatgcggcatcctgactcccggcgacgactttttgtgtctggaaggcaaagaattcaatcgacttattagaaacgagaaaggagaagtggagcaggagaagctggacaagatctggcctaaactaagggtccttgcacggtcgagtcccacggataaacacactctcgtaaaagggatcatagatagcacagttggagagcatcgccaggtggttgctgtcaccggagatggcaccaacgacggccccgccttgaagaaagccgatgtgggattcgccatgggaattgcgggtactgatgttgctaaggaggcaagcgacattattctgactgatgacaacttcacctctatcgtcaaggcagtgatgtggggtcggaacgtttacgattcaataagcaagttccttcagttccagctaacagtcaacgtggtcgcagtgatcgtcgccttcacaggggcttgcatcactcaggattccccactgaaggcggtgcaaatgctatgggtcaatcttattatggatacttttgccagcctcgcattggctaccgagcccccgacggagtctctccttaagcgaagaccctatggtagaaacaagcctctgatctctagaactatgatgaaaaacatactcggtcatgccttttaccagctgatcgttatttttatccttgtgtttgcaggagaaaagttcttcgacatcgacagtgggagaaaagcacctctgcacagcccgccctctcagcactatacaatcgtgtttaacactttcgtgctcatgcagttgttcaacgagatcaacagtagaaaaattcatggagagaagaacgtattctccggaatataccggaacatcattttttgttcagtcgtcctgggcaccttcatctgccaaatctttatagttgaatttgggggcaaacccttttcttgtaccagtctctctctgagtcagtggttatggtgtctgttcatcggtataggtgaactactgtggggtcagtttatcagtgctatccctactcgcagcctgaaattcttgaaagaagcagggcatggaaccacgaaggaggagatcaccaaagatgcggagggcttggacgagatagatcatgccgaaatggagctgcgccgaggccagattctgtggttcagaggactgaataggatccagacgcagattgatgtaattaatactttccagaccggtgccagtttcaaaggagtcctgcgcaggcagaacatgggacagcatctggacgtaaaactcgtgccaagctcaagttatgtggcggtggccccagtaaaatcctcacccactacctctgtgcctgcagtgagttctcctcccatgggcaaccagtccgggcagtcagtgccctag

SEQ ID NO: 179784 - DNA, 390 bp, Artificial Sequence
  Description of Artificial Sequence: Synthetic coding sequence
tgaatcggcgagctgctgtggggccagttcatcagcgccatccccactaggtctctcaagttcttgaaagaagccggtcatggaaccaccaaggaggagattacaaaggatgccgagggtctggacgaaatagaccatgccgagatggagctgaggcgaggacagattctgtggttcagaggactgaataggattcagacccagattgacgtcattaacacctttcagacaggtgcatcttttaagggagttttaagacggcagaacatggggcagcacctggatgtgaagctcgtgccgtctagtagttatgtcgcagtggcacctgttaagtcatctcccactacttccgtgccagccgtgtcgtcccccccaatgggaagcgagtag

SEQ ID NO: 179785 - DNA, 3618 bp, Artificial Sequence
  Description of Artificial Sequence: Synthetic coding sequence
atgaccaaccccagcgaccgggtgctgcccgccaacagcatggccgaaagcagagagggagatttcgggtgcaccgtgatggagctccgcaagctcatggagctccgtagccgtgacgccttaactcaaatcaatgtgcactatggaggcgttcagaatttgtgttcacgcctgaagacttcccctgtagaagggttgtcagggaaccccgctgacctggagaagagacggcaggtcttcggacacaatgtgataccacccaagaagcctaaaacatttctggagcttgtgtgggaagcacttcaagatgtgacactgatcattctagaaatagcggccatcatctctctggttctatcattctatcgcccagcaggcgaagaaaacgaactttgtgggcaagtggcgaccactcccgaggatgaaaatgaggctcaggcaggctggattgaaggggctgccatcctcttttcagttattatcgtagtgctcgttacggctttcaacgattggagcaaagaaaagcagtttagaggccttcagtgcagaattgagcaggagcaaaagttcagtattatccgaaatgggcagctaatccaactcccggttgctgaaattgttgtcggtgatatcgcccaggtgaagtatggagatttattaccagccgacggtatccttattcaaggcaacgaccttaagatcgacgaaagcagcctaacaggcgaatccgaccacgtgaagaagagtttagataaggatccaatgctcctgagcggcacacacgtgatggagggaagcgggagaatggtagttacggccgtcggtgtgaacagccagaccgggattatcctgaccctgctgggggtgaatgaagacgatgaaggtgagaagaagaagaagggaaaaaagcaaggagtgccagagaaccggaacaaggctaaaacacaggacggcgtcgctttggagatccaacccttgaacagtcaggaagggattgacaacgaggagaaggataagaaggccgttaaggtgcctaagaaggagaagtcagtgttgcaggggaagctgaccagactggccgttcagattggcaaagctgggctgctcatgtcagccttaaccgtttttattctcatactgtacttcgtgattgacaatttcgtcatcaatcgacgcccttggttgccagaatgtaccccaatctacattcagtactttgtcaaattcttcatcatcggaattactgtattggtcgtggccgttcccgagggcctccccttggcggtcacaatctccctggcatactctgtgaaaaagatgatgaaagacaataacctcgtcagacacctggatgcctgcgaaactatgggtaacgccacagcaatttgctctgataaaaccggcaccctcaccatgaataggatgaccgtggtgcaggcatatataggcgggatccattatcggcagatccccagtccagatgtgttcctcccgaaggtgctggacctaatcgtgaacggaatttctattaattctgcgtacacgtcaaagatccttccacctgagaaagagggaggcttgcctcgacaggtcggaaataagacagagtgtgcccttctgggttttgtgacagacctcaagcaggattaccaagcggtgcgcaatgaggtgcccgaggagaagctgtataaagtatacacttttaattctgtgcgcaagtctatgtcaactgtgatcagaaatccgaatggtggattcagaatgtattcaaagggcgcctccgagattattctgaggaagtgtaataggatcctagatcgcaagggagaggctgtgccgtttaaaaataaggatagggacgacatggtgagaaccgtgattgagcccatggcttgcgacggcctgaggaccatctgtattgcctacagggacttcgacgacaccgagccatcttgggacaatgaaaacgagattttgactgagctcacttgtattgcagtggtgggtatcgaggatccggtgagacccgaggtcccggacgcaatcgccaagtgtaagcaggccggcattacggtgcggatggttaccggcgacaatatcaataccgcacgcgcaattgctacgaagtgcgggatcctcacacccggggacgactttctatgcctggaaggtaaagaattcaatagactaatccggaatgaaaagggagaggtggagcaggaaaaactggacaagatttggcctaaactgagggtgctcgcgagaagctcccccaccgacaagcacacactggtaaaggggattatcgacagcacagtgggggaacacagacaagtagtggccgtcaccggtgatggcacaaatgacggacccgccctcaagaaagctgatgttgggttcgcaatgggcatcgcggggacagacgtcgctaaagaggcctccgacataatcctgaccgatgacaatttcaccagcatcgtgaaagctgtgatgtggggacgtaatgtctatgactctatcagcaaatttcttcagtttcaactaacggtcaatgttgtagctgtgattgtggccttcactggtgcctgcataactcaggactccccgctcaaagcagtgcagatgctctgggtgaaccttattatggatacattcgcgagcctggccctcgcaactgaaccacccacagagagcttgttgaaaaggcgaccctacggtcgcaacaagcccttgatttcaagaacaatgatgaagaacatactaggacatgctttctatcagttaattgtcatcttcatcctggtgttcgcgggcgagaagttctttgacatcgacagtgggagaaaggcccctctccactctcctccgagccagcactacacaatcgtgttcaacacattcgttttaatgcaactgtttaatgaaatcaactcccgaaagatacatggcgagaaaaacgtgttcagcgggatttaccggaacattatcttctgttccgtggtgctgggcacatttatttgtcagatcttcatcgtggagtttgggggcaagccattcagctgtacttctctctcccttagccagtggctttggtgccttttcattggcattggggaactcctatggggtcaattcatttctgctatacccactcggtctctcaaatttctgaaagaggccgggcacgggaccaccaaggaggagatcacgaaggatgccgagggacttgatgagatcgaccatgcagagatggagctacggagaggccaaatcctttggtttcggggtctgaatcgcattcagacacagatcaaagtggtaaaagccttccatagctcgcttcatgagagtatccaaaaaccctacaatcaaaaaagcattcattcgtttatgacacatcctgagttcgcgatcgaggaggagcttccgagaacacctcttctggatgaagaggaggaggagaacccagacaaagcaagcaagttcgggactagagtccttctcctcgacggagaagtaacaccctatgccaatacaaacaacaatgccgtagactgcaaccaggtccagctgccccagagcgattcaagcctccagagtctggagaccagcgtgtag

SEQ ID NO: 179786 - DNA, 3513 bp, Artificial Sequence
  Description of Artificial Sequence: Synthetic coding sequence
atgaccaaccccagcgaccgggtgctgcccgccaacagcatggccgaaagtcgtgagggggatttcggatgcaccgtcatggaactccgcaaattgatggagcttcggagtcgtgacgcccttacacagattaacgtccattacggaggcgttcagaatctctgtagccgcctgaagacgtctcctgtggagggactaagtgggaaccccgctgatctggaaaagaggagacaggtttttggacacaacgtcatccctccaaagaagccaaagaccttcttagagctggtctgggaggcactccaggatgttacactgattattctggagatcgccgctattatctccttggtgctgagcttctaccggcctgctggagaggaaaacgagctgtgcgggcaggtagctacgactccagaggatgaaaatgaggctcaggctggctggatcgagggagccgctattctctttagcgtgattatcgtcgtgctggtgacagcattcaacgattggtcgaaagaaaaacaattccgcggtctgcagtgccggatcgaacaagagcaaaaattctccattataagaaacggccaactcatccagctaccagtggccgagatagtagtcggcgacatcgcacaggtaaaatacggagacctattacctgcggacggtatattgatacaagggaacgatttgaagatcgacgagtccagtcttactggtgaaagtgatcatgtgaagaaaagtcttgataaggaccctatgcttctctccgggacacacgttatggaaggctccggcagaatggtggtgacagcagtgggagtgaattcacagaccggcattatcctgactctattgggcgtcaacgaagacgatgagggcgagaagaagaagaagggaaagaaacagggggtgccggagaacagaaacaaggctaaaactcaggacggggtggccctggagatccaacctctgaactcacaagagggaattgacaacgaagaaaaggacaagaaggccgtgaaggtgcccaagaaggaaaagtcagtgctccaggggaagttgactaggctagctgttcagatcggaaaagccgggcttttaatgtcggctctgactgtgttcattcttattctctacttcgtgatcgacaatttcgttataaaccggcgcccatggttacccgaatgtactccaatttacattcaatacttcgtcaagtttttcatcatcggaatcacagtgctagtcgtggccgttccggagggcctgcccctggcagtgacaatcagcctggcatacagtgtgaagaaaatgatgaaagataataatctggtgcgccaccttgacgcttgtgaaaccatgggaaacgctactgctatctgttccgataaaacaggcacactcaccatgaaccgcatgacggtggtccaggcctatatcggaggaattcattataggcagattcccagccctgatgtgttccttccaaaggtcttggacctcattgtaaatggaatcagtatcaactccgcatacacatcaaagattctgccacctgagaaggaaggaggcttgccacgacaggttgggaacaaaaccgaatgtgcgctgctgggatttgtcaccgatcttaagcaggactaccaggctgttcgcaatgaagtgccagaggaaaagctgtataaagtgtacacattcaattccgtgcggaagagtatgagtactgtgattcggaacccaaacggaggttttcgaatgtactcaaagggcgcctcggagataatattaaggaagtgcaatcggatcctcgaccgaaagggggaagcagtgccattcaaaaataaagacagagacgatatggttcgcactgtcatcgaaccgatggcgtgtgatggcctgaggactatttgcattgcgtaccgcgactttgacgacacagaaccctcctgggacaacgagaatgaaattttgactgagctcacctgcattgccgtggttggcattgaagaccccgtcaggccggaggtgcctgacgccatcgccaaatgtaaacaagccgggattaccgtgcgtatggtgacaggcgacaatattaatacagctcgggctattgccaccaagtgcggtatcctcacccccggagatgattttctttgcctcgagggcaaagaattcaaccgcctgatcaggaacgagaagggtgaggtggagcaggagaaactcgacaagatttggcccaagctgagggtcctcgccaggagttctccaaccgacaagcataccctcgtgaaagggatcatcgactccacagtcggcgagcataggcaagttgtggccgtgactggcgatgggacaaacgacggccctgcactaaagaaagccgacgtcggattcgcaatgggaatagccggcacggatgtggccaaagaagccagtgatataattctgacggacgataatttcaccagcatcgtgaaggccgtaatgtgggggcggaatgtgtatgactcgatctccaaatttttgcagtttcagctaacagtcaacgtggtcgcagtgatcgtggcctttactggagcttgcataacacaggattcccctctgaaggctgtgcagatgctatgggtgaacctgattatggacacatttgcgagcctagcactcgcaactgagcctcccacagagagccttttaaagcggagaccatacggccggaataaacccctcatatctagaaccatgatgaaaaacatcctaggccacgctttttaccagctgatcgtcattttcatcctagtattcgcgggagaaaaattcttcgacatagacagcgggcgcaaggcgcccctacattcaccaccatctcagcactataccattgtatttaacaccttcgttcttatgcagctgtttaatgagattaactcaaggaaaatccatggtgagaagaacgtgttcagcggaatctacaggaatatcattttttgtagcgtcgtgctggggacgtttatttgtcaaatattcatcgtagagttcggggggaagcctttcagttgcacatccctgagtcttagccagtggctgtggtgcctcttcataggaataggagaactcttgtggggacagttcatcagtgccatacctactcgatcgttaaagtttctcaaagaagctggccacgggaccactaaagaagagatcacgaaggatgctgaaggattggacgaaatcgatcacgcagaaatggagttgcgacgaggtcagatactttggtttcgcggcctgaacaggatccaaactcagattgatgtcatcaacacgttccagaccggcgcctctttcaaaggtgtcctgaggcggcagaatatggggcagcatctggatgtgaagcttgtacccagcagttcgtatgtcgctgttgctccagtgaagtcctcccccaccaccagcgtgcctgcagtgagcagcccccctatggggaaccagtctgggcaatctgtcccatag

SEQ ID NO: 179787 - DNA, 3477 bp, Artificial Sequence
  Description of Artificial Sequence: Synthetic coding sequence
atgaccaaccccagcgaccgggtgctgcccgccaacagcatggccgagtcccgagaaggagatttcgggtgtacagtgatggagctgaggaagttaatggagcttcgtagccgagatgccctgacacagattaatgtccactacggtggagttcagaatctgtgctcccgcctgaagactagccctgtagagggcttgagcggcaaccctgctgacttagaaaagcgaaggcaggtgttcggacataatgtgatcccaccgaagaagccaaaaactttcctagagctggtttgggaagccctccaggacgtaacactcattattctggagatcgcagcgatcatatcattagtcctcagtttctatcgccctgccggtgaagagaacgaattatgcggtcaggtggctactaccccagaagacgaaaacgaagcccaggccggctggatcgagggtgctgccatcctgttctctgtgatcatagtagtgctcgtgacagcctttaacgactggtcaaaagaaaaacagtttcgcggcttgcagtgccgtatagaacaggaacagaaattttcaattattcggaacgggcagcttatccagctgcccgtcgcagagattgtcgtaggggatattgcccaggtcaaatacggcgatctcttgcccgccgatggaatattgatccagggcaatgatttgaaaatagacgagagctcattgacaggagagagcgatcacgttaaaaagagcctagataaggacccaatgctcctgtccggcacccatgtcatggagggctctggtaggatggtagtgaccgccgtgggagttaacagtcagacaggaataatcctcacgttgctcggcgtgaacgaagatgacgagggtgaaaaaaagaagaaggctaagacacaggatggtgtggcgctcgagattcagcctctcaactctcaggagggcattgacaacgaagaaaaggataagaaggcggtgaaagttcccaaaaaggaaaagagcgttttgcaaggaaaattgacccgcctggctgtgcaaatcggcaaagctggactcctaatgtcagccctcactgtgtttatcttgatcctgtactttgttatcgataatttcgttattaataggagaccttggctccctgaatgtacccccatctacatccagtacttcgtgaagtttttcattatcgggattaccgtgctggtggtcgcagttcccgagggtctcccactcgcagttaccatcagccttgcgtactctgtgaaaaagatgatgaaggacaacaacttagtccgccatctggacgcctgcgaaactatggggaacgccacagccatctgctccgacaagacaggcaccctgacgatgaacaggatgaccgtggtacaggcttatatcggtggaatccattaccggcagattccaagccctgatgtgtttctccccaaggtcctcgatctcattgtcaacggaatatccattaacagcgcatatacgagcaagattcttcctcctgagaaagaggggggcctgcccaggcaggtcggaaataaaactgagtgcgcactccttggattcgtgactgatctcaagcaggactatcaggctgttaggaacgaggtacctgaagagaagctgtataaggtgtatacattcaatagcgtgcggaaaagcatgtccacagtgatccgcaacccaaatggcggctttcggatgtactcaaagggggcctctgagatcatcctcaggaaatgcaatcgcatactggaccggaagggcgaggcggtgccttttaaaaataaggaccgcgacgacatggtgcgcaccgtgattgagccaatggcttgcgacggcttacgcaccatatgtatagcctacagagactttgatgacaccgaaccaagctgggacaatgaaaacgagattctaaccgaactgacatgcatagccgtggtaggcatcgaggaccccgtcaggcctgaggtgcctgacgctattgccaaatgtaagcaggctggaataaccgtgagaatggtcaccggtgataatatcaacacggcccgcgcaatcgcaacaaaatgtggaatcttaactcctggagatgactttctatgtctggagggcaaagaattcaaccggttgataagaaacgaaaaaggcgaagtggagcaagagaaactggataagatctggcccaagctccgggtgttggctagatctagccctaccgataagcacaccctggtgaaagggatcatcgactccacagtgggcgagcacaggcaagtggtcgccgtcaccggcgatggaactaacgatggcccagctctgaagaaggcagatgtgggattcgcaatgggaattgcaggaacagatgtagccaaggaagcctcagatatcattctgactgatgataacttcacctcgatcgtgaaggccgttatgtggggcaggaatgtctacgactcaataagcaaattcctgcaatttcagttaacagttaacgtggtcgcagtcatagtcgcctttaccggagcctgtattacccaggacagcccgcttaaagccgttcagatgttgtgggtgaacctcatcatggataccttcgcctctctcgctctagccaccgagcctccaacagagagcctccttaagcgcagaccatacggccggaataagcccctaatctcacgaactatgatgaagaatatccttggccatgccttctatcagctgattgttatcttcatccttgtgttcgcaggcgaaaagtttttcgacatagattccgggcggaaagccccactgcacagccccccgagccagcactataccattgtgtttaatacatttgtactcatgcaactctttaacgagataaactcacggaagattcacggggagaaaaatgtgttcagtggcatctatcgcaatatcattttttgtagcgtggtgctgggcaccttcatctgccagatattcatagtggagtttggtggcaaacctttttcatgtacttctctcagcttaagtcagtggctgtggtgtttatttatcgggattggagaactcctatggggacaattcattagcgccatacctaccaggtccctgaagttccttaaggaggccggccatggaaccacaaaggaagagataacaaaagacgccgaaggactggacgaaatagatcacgcagagatggagcttagacggggccagatcctgtggttccgggggctgaaccgcatccagactcaaatcgacgtgattaacactttccagactggcgcgagttttaagggggtcctgcgccgacagaacatgggccaacacctggatgtaaagcttgtgccaagttcttcctatgtggcagtcgcacccgtgaaaagcagtcctactactagtgtgcccgcagtgagcagcccacccatgggaaatcagagcggccagagtgttccgtag

SEQ ID NO: 179788 - DNA, 3405 bp, Artificial Sequence
  Description of Artificial Sequence: Synthetic coding sequence
atgaccaaccccagcgaccgggtgctgcccgccaacagcatggccgagagccgtgagggtgattttggatgcacagtgatggagctgagaaaattgatggaactgcggtctagggacgctctaacccaaatcaatgtgcactacggcggcgttcagaatctttgttctcgcttgaagacaagcccagttgagggtctgagtgggaaccccgcagacctcgagaaacgccggcaagtcttcggccataatgtgatacctcctaaaaaaccgaaaacctttcttgagctcgtttgggaggccctccaggacgtcaccctgattattcttgagatcgcagctattatttctctggtgctgtctttctatagaccagctggtgaggagaacgaactttgcggccaggtggccactactccagaggacgagaacgaggcccaggcaggatggattgagggagccgccatcctgttcagcgtcattatagttgtcctcgtgaccgcatttaacgattggtctaaggaaaagcagttcagaggcctgcaatgccgcatcgagcaggagcagaaattcagcataattcgtaatgggcaactcatacagcttcccgtggcagagatcgtagtgggagacatcgctcaagtgaaatatggggacttgttacctgccgacggaattttaatccagggaaacgatctcaagattgatgaatcctcgctcactggcgagagcgatcacgtgaaaaagtctctggacaaggaccctatgctgttatcgggaactcatgtgatggagggctcaggtaggatggtggttactgccgtaggagttaacagtcaaaccggtatcatcctcacccttcttggcgtgaacgaggatgatgaaggcgaaaaaaaaaaaaaagggaagaagcagggcgtgccagagaaccgcaacaaggctaagacccaagacggggtggccctagaaatccaacctcttaattcgcaggaaggaatcgataacgaagaaaaagataagaaagccgtaaaggtaccaaagaaggaaaaaagtgtactccagggcaagctcactaggcttgccgttcagattggcaaagcaggtttactcatgtctgctctcaccgtgtttatcctgatcttatactttgtgatagacaattttgttatcaaccggcggccttggctccccgaatgtaccccaatttacatacagtacttcgtgaagttctttatcattggcataaccgtcctggtggtggctgtacccgagggcttgcccctggctgtgacaatctccctggcttattcagtcaagaagatgatgaaggataacaacctggtgcggcacctggatgcctgcgagaccatgggtaatgccacggctatatgcagtgacaaaaccgggacacttacgatgaataggatgaccgttgtgcaggcctacataggtggcatccactacaggcagatcccttctcccgatgtctttctgcctaaagtcctcgatctgattgttaatggcatctcaatcaacagcgcttatacttccaagattctcccacctgagaaagagggaggtttgccacggcaggtaggcaataaaactgaatgcgccctgcttgggttcgtgacagacttaaaacaggattaccaggctgtccgcaatgaagtgcctgaggaaaagctctataaagtatacacattcaacagcgttcgcaaatcaatgagtaccgttatacgtaaccccaatggcgggttccggatgtatagcaaaggtgccagcgagattatcctacgcaaatgtaaccgtattcttgataggaaaggcgaggccgtgccatttaagaataaggatcgagatgacatggtacgtactgtgatcgagccgatggcttgtgacggcctccgtacaatctgtattgcctaccgagacttcgacgataccgagccatcttgggataatgagaatgagatcctgactgagctcacttgtattgcagtggtggggatcgaggatccagtccgccctgaagtaccggatgccattgccaaatgcaagcaggccggcattacagttaggatggtgacaggtgacaacatcaatactgcccgggccattgctacaaaatgtgggattcttacaccaggtgatgattttctttgcctggaaggcaaggaatttaaccggttgatcagaaacgaaaaaggggaagtcgaacaagagaaactcgacaaaatttggcctaaactgcgggtgcttgcccgctcctcaccaactgataaacatactctggtgaaagggatcatcgattccacagtgggagaacacaggcaggtggtcgctgttaccggcgacggaactaacgacgggcccgccctgaagaaagctgacgtgggatttgccatggggatcgccgggactgacgttgcgaaagaggcttccgacataatcctgaccgacgacaattttaccagcatcgtgaaggcagtcatgtgggggcgaaatgtctatgacagtatttcaaagttcctgcaatttcagctgactgtgaacgtcgtggccgtgatcgtggcctttactggggcttgtatcacacaagattctccactgaaagctgtccaaatgttgtgggttaacctcattatggatacttttgcctcccttgcgctcgctactgagccacccactgagtccctattaaaaagaaggccatacggaaggaacaaaccattaatcagtagaaccatgatgaagaatatcctgggccacgccttttaccagctcattgtgattttcatcctggtgttcgccggcgaaaagttctttgatatagatagcggtcggaaggcccccctccatagcccgccatcacagcattacaccatcgtctttaacacctttgtgctcatgcaattattcaatgagatcaacagcaggaagatccacggcgagaaaaatgttttttcagggatttacaggaacataatcttttgctctgtggtcctcgggacatttatttgtcagtttatctccgccatcccaacccgatctctgaagtttttgaaagaagctggtcacggaacaaccaaagaagaaataactaaggatgcagagggtttagacgagatcgatcacgcggaaatggagttaaggcgtggtcagatcctttggttcaggggcctgaatcgaattcaaacacagatcgacgtgatcaacacttttcagactggagcctccttcaagggcgtgctgcgtaggcaaaatatggggcaacacctagacgtcaagctcgtcccatccagtagttatgtggccgtagctccagtgaaaagctctccaactaccagcgtcccggcagtctcctcgcctcccatgggaaatcagtccggacaatccgtcccatag

SEQ ID NO: 179789 - DNA, 354 bp, Artificial Sequence
  Description of Artificial Sequence: Synthetic coding sequence
tgaggcggcaagcccttcagctgcaccagcctgagcctgagccagtggctatggtgcctgttcattggcataggcgaattgctgtggggccagtttatctcagcgatccccactaggagcctcaaatttttaaaggaagccggtcatggcaccacaaaggaggaaattacaaaggacgcagagggcctcgacgagattgaccacgctgaaatggagctgaggcggggacaaatcctgtggtttagaggcctaaaccgcattcagacacagcacttgctacaggacagcgacctgctcccagataaggaagaggccattatctcctcaagtctcttcccttcctgcaacttctag

SEQ ID NO: 179790 - DNA, 2667 bp, Artificial Sequence
  Description of Artificial Sequence: Synthetic coding sequence
atgaaggtggcccggttccagaagatccccaacggcgagaacgagacaatgattccggtattgacgtccaaaaaggccagcgagctgccagtgtccgaggttgcaagcatcttgcaagctgatctccagaacgggctgaacaagtgtgaggtgtctcatcgccgcgctttccacggatggaatgagtttgatatctccgaggacgaaccgctgtggaagaaatatattagccagttcaagaaccctcttatcatgctcttgttggctagtgccgttatcagcgtgctgatgcatcagtttgacgacgccgtgagtattaccgtggctatcctgatcgtggtcaccgtggcctttgttcaagaatacaggagtgagaaatctttagaggagttgagtaagttggtccccccagagtgccactgcgtccgagaaggcaagctagaacatacgttagcaagggatttggttcccggggataccgtctgtctctcggtgggggatagagtccctgctgatctacgactatttgaggccgtcgacctgagcattgatgagtcttctctcaccggagaaaccaccccttgctcaaaggttaccgctcctcaacccgcggcaaccaatggggatttagccagccgctcaaatatagccttcatgggcacactcgttcgatgcgggaaggccaaaggggtggtgatcggtacaggcgaaaacagtgagtttggggaagtgttcaagatgatgcaggccgaagaggccccgaaaactccactacagaagtccatggacctgctaggaaaacagcttagcttttatagcttcggcattattggcataataatgctagtggggtggctgttagggaaagacatactggaaatgttcacaatttccgtttccctcgcagttgctgctatccccgaaggattgcccatcgtggttacggttactcttgcccttggcgtgatgcgcatggtcaagaaaagggccattgtgaagaagctgcctattgtcgagacacttggctgttgcaacgtgatttgcagcgataagaccgggacactgaccaagaacgaaatgactgttactcacatattcacgtcagatggtctgcacgcagaagtaactggtgtggggtataaccagttcggtgaggtcatagtggatggcgacgtggttcatggattctataatccagccgtatcccggatagtagaagcaggatgcgtatgcaacgacgccgtgatccggaataacacacttatgggaaaacccactgagggggcactaatagctctcgcaatgaagatggggctggacgggctccagcaagattatatcagaaaggcagagtaccccttttcctcagaacagaagtggatggcagtcaagtgtgtgcacaggacccaacaagatcgccctgagatctgttttatgaagggcgcctatgagcaggttatcaagtattgcactacttaccagtcaaaggggcagactcttacattgacccagcagcagagagacgtgtaccagcaggagaaagctcggatgggcagcgcggggctgcgggtcttagccctcgcaagcgggcccgagctcggacagctgacttttcttggtttggtgggaattatagacccacccagaacaggagtcaaggaagctgtgaccaccctcatcgctagcggggtctccataaagatgataactggcgattctcaagaaaccgctgtcgccatcgcctctaggttggggctatatagcaaaacttctcagtcagtgagtggcgaggaaattgacgcaatggatgttcagcagttaagtcagattgtgcccaaagtcgccgtgttctaccgggcttccccccgacacaagatgaagataatcaaatctctacaaaaaaacggctctgtcgtcgccatgactggagacggcgttaatgatgctgtcgccctcaaggccgctgatattggcgttgccatggggcagacaggcacagatgtgtgtaaggaagccgccgatatgattctggtagatgatgattttcagaccatcatgagcgcaattgaagagggaaaagggatatacaacaatattaagaattttgtgcgtttccagctgtccacttccattgcagctttgacactcatcagcctggcaactttaatgaacttccccaaccccctaaacgccatgcagatcctgtggataaatattatcatggatggcccgcctgcccagtccctgggcgtcgagccagttgataaggatgttatccgcaaaccacccaggaattggaaggacagtattcttaccaaaaacttgattctgaagatcctggtgtcctccattattatcgtttgtggtacgttgttcgtgttctggcgggagttgagagacaatgtaattaccccccgtgacacaacgatgacttttacatgtttcgtcttttttgacatgtttaacgccctgagttcccggtcgcagacaaaatctgtatttgaaattggattgtgctcaaatagaatgttctgttacgccgttcttggctccataatgggccagcttctcgtgatttactttcctccgctccagaaagtatttcagacagagtcactgagtatcctcggtttggccctgggcgaggaatggaccgctgcaggatag

SEQ ID NO: 179791 - DNA, 2877 bp, Artificial Sequence
  Description of Artificial Sequence: Synthetic coding sequence
aaggtggcccggttccagaagatccccaacggcgagaacgagaccatgatacccgtgctgacctccaaaaaggccagcgaactgccagtgagtgaggtggccagcatcttgcaggcggatttacagaatggactcaacaagtgcgaagttagtcacaggagagcatttcacggttggaatgagtttgatatctccgaggacgagcccttgtggaagaagtacatctcccagtttaagaatccgctcattatgctgctgctcgcatctgctgtaatcagtgtgttgatgcaccagttcgatgacgcagtatccattacagtagctattctcatcgtggtcacagtggcttttgtccaggagtatcgttccgaaaagagcctcgaagaactgtcaaaactcgtgccacctgaatgccattgcgtcagggaaggaaaactggagcataccctggctagagacctcgtacccggagacaccgtttgcctctccgtgggggaccgggtgccagcggatttgcgcctcttcgaagctgttgaccttagtatagatgagtcctctctgaccggagagacaacaccatgctccaaggtcaccgctccacagcccgcagcgaccaacggggacctcgcatccagaagtaacatagcatttatgggtacattagtaagatgcggaaaggcaaagggcgtggtgattgggacgggcgagaattccgagttcggggaagttttcaaaatgatgcaggcagaggaggcacccaagacacccctccagaagtcgatggacctgcttggcaaacagttatccttctactcatttggaataatcggcataataatgctggttggatggcttctgggcaaggatatactcgagatgtttacaattagcgtttcactggctgtcgcggctatccccgaagggctgcctatagtggtgacggtcactttggcgctcggcgtgatgcgcatggtcaagaaacgagcgatcgtgaaaaagcttccgatagtcgagactctggggtgttgtaacgtaatatgttccgataaaacaggaaccctcactaagaacgagatgactgtaacgcacatcttcacgtccgatggtctgcatgccgaagtgactggggtgggatacaatcagttcggagaggtgatagttgacggggacgtagtgcatggattttacaaccctgccgtctctcgaattgtggaggccggctgcgtgtgtaatgacgccgtgattagaaataacactctcatggggaagcctacagaaggcgccttgatagctcttgctatgaagatgggacttgacggtctacagcaagattacattcgcaaggccgagtaccctttctcctcagagcagaaatggatggccgttaagtgcgtgcaccgcactcagcaggaccgccctgaaatctgtttcatgaagggggcctatgaacaagtaatcaaatattgtacgacttaccagtccaaaggccaaactttaactttgacccagcagcagcgcgacgtgtatcaacaggaaaaagctaggatgggttccgcgggactacgggtgcttgccctcgcatcaggacctgaattaggacagttgacattcctgggtctcgtgggaattatagacccgccccgcaccggcgtgaaggaggctgttacgactctcatcgcatccggtgtgtcgattaagatgattaccggggactctcaggaaaccgcagttgcgatcgcgtccagactgggactctactccaagactagccagagcgtctctggggaggaaatcgatgctatggacgtccagcagctatcccagatcgtccctaaagtcgccgtattctaccgggcttcacccagacataagatgaaaattataaagagtctccagaaaaatggcagtgtggtcgcaatgacaggcgatggcgtgaacgacgctgtggccctcaaagccgcagacatcggagttgccatggggcagaccggaaccgacgtatgcaaagaagcagctgatatgatattagtagatgacgactttcaaaccattatgtcagccattgaagagggtaagggaatttataacaacataaaaaacttcgttaggtttcagctgtcaacaagtatagccgccttgaccttgatctccctggcgacgttgatgaatttccctaatcccctcaatgctatgcagatcctttggataaacatcatcatggatggaccacccgctcagagcctgggggtagagcccgtggataaagatgtgataagaaagccccctagaaattggaaggatagcatcctaacgaaaaaccttatcctgaaaatcctagtgtccagtataattatcgtgtgcggcacactatttgtcttttggcgcgaactgcgcgacaacgtgattacaccccgtgatacgacaatgaccttcacctgttttgtattctttgacatgttcaacgctctgtcctctaggtcccaaacaaaaagcgtgttcgagattgggctgtgcagtaataggatgttctgctatgcagtcctgggctccatcatgggccagctgttggtcatctacttcccacccctgcagaaggtgtttcagaccgaaagtctgagcatcctggacttgctgtttcttttggggctgacctcctccgtctgcatcgtggccgaaattattaagaaggtggagcgaagtagagagaagatccaaaaacacgtgtcctcgaccagttcttcatttctggaagtgtccagttcatcgggcaacttcgtggccgtgtggctttgggagcgaagcggacagcagctcgtcgagattcatccccacctggagacaggcctgccgctcacagaagatgtcagctgtgtgtag

SEQ ID NO: 179792 - DNA, 2850 bp, Artificial Sequence
  Description of Artificial Sequence: Synthetic coding sequence
atgaaggtggcccggttccagaagatccccaacggcgagaacgagaccatgattccagtcctgaccagcaagaaagcatctgagcttccagtgagcgaggtggcaagcatcttgcaagcagaccttcagaatggactcaataaatgcgaagtgagccatcgcagagcgtttcacggatggaacgagtttgacatctctgaagatgaaccgctctggaaaaagtacatctcgcagttcaagaatcccctgattatgctcttactggcaagtgcggtcatctctgttctgatgcatcaattcgacgatgctgtgtctattaccgtggcaattttgatagttgtgacggtcgcctttgttcaagagtatagatctgaaaagagtttagaggagctttctaaactagtgccccctgagtgccattgtgtgcgagagggtaaactggaacacaccttagcacgggatttagttcccggcgatacagtgtgtttaagcgtgggcgaccgcgtgccagctgacctcagactcttcgaagccgttgacctttccattgacgaaagctccctaacaggtgagacgaccccttgtagtaaagtgaccgcaccccaacccgccgctactaacggcgacctagcttctaggtctaacatagccttcatgggaactctggtaagatgtggaaaggcaaaaggagtggtcattggaactggcgagaactccgagttcggggaagtcttcaagatgatgcaggccgaggaggcacccaagacgccattacaaaaaagcatggacctcctgggaaaacagctgtccttctattccttcggtattatcggcattatcatgctggtgggctggctgctcgggaaagatattctcgaaatgtttactatctctgtcagtttggccgttgcagcgatacccgaaggcctgccaatcgtggtgactgtgactctagcactaggcgttatgaggatggtcaagaagagagctattgtaaaaaaattgcctatcgttgagaccctcggatgctgtaacgtcatatgctcggataagaccggtactctgaccaagaacgagatgacagtcacgcacatctttaccagtgatgggctgcacgctgaagttactggggtaggctacaaccagttcggcgaggtgatcgtcgacggagatgtggttcatggcttttacaacccagccgtatctaggattgtggaggccggctgcgtatgcaatgatgctgttattcgtaataataccttgatggggaagcctacggagggggccctcatcgctctcgccatgaagatgggcctggacggccttcaacaagactatatccggaaggcagaataccccttttctagtgagcagaagtggatggcggttaagtgcgtgcataggacccaacaggatcggcccgagatctgtttcatgaagggcgcctacgagcaggtgattaaatactgtactacatatcaatccaagggacagacattaacgttgacgcagcagcagcgtgatgtctaccagcaggagaaggcacgtatggggtcggccggcctgcgagtgttggcccttgcttccggtcccgaacttggacagctaacattcctgggcctcgtgggaatcatcgacccgccgcgcaccggcgtaaaagaagcggtaaccaccctgatcgcctctggcgtgagtatcaagatgatcactggggactcacaggaaacggctgtagcaattgcatcacggctaggactgtactctaagactagtcaaagtgtttcaggcgaggaaatcgacgccatggatgtccaacagctgagtcaaattgtaccgaaagtggcagtgttctaccgcgcttcgccccgtcacaagatgaaaatcattaagtcgcttcaaaagaacgggagtgtcgtggccatgacaggagatggcgtgaacgatgcagttgcactcaaagccgccgacattggcgtcgccatgggccagaccgggactgacgtttgtaaggaggcagctgatatgatcctggttgacgacgactttcagacaattatgtctgcgatcgaggaaggcaagggtatatataataacattaagaattttgtcaggtttcagctgtcaacctccattgccgccctcaccctgatctcccttgcaaccctaatgaatttcccgaaccccctgaacgccatgcagatcctgtggatcaatattataatggacggacctcccgcccagagtctcggggtggagccagtagataaggatgtgattcgcaagcccccacggaactggaaggacagcattctgaccaaaaatctgatcctgaaaattctcgtgtcatccatcatcattgtgtgtggaactctgttcgtgttctggcgagaattacgcgataatgtcataactccaagagataccactatgacctttacatgctttgttttcttcgacatgttcaatgcactgtccagtaggtcacagaccaaaagcgtgttcgagatcggcctgtgtagtaatcgaatgttctgctacgctgtgctgggctctattatgggtcagctgctagtgatttattttcccccattgcaaaaggtctttcagaccgaatcgctgtctatattggatctgttattcctcctgggtctcacaagtagtgtgtgtatcgtcgccgagatcataaaaaaggtagagagatcccgcgagaagatccaaaaacacgtcagcagtacctccagttcctttttagaggtttggctgtgggagcgaagcggccagcaactcgtggagatccacccacatctcgagaccggactccctttgacggaggatgtgtcctgcgtgtag

SEQ ID NO: 179793 - DNA, 2922 bp, Artificial Sequence
  Description of Artificial Sequence: Synthetic coding sequence
atggacagcctgctgccccccagccggttcagctacttcaagaagtatcctctccatgctattcggcgctacctcagtacactgagaaaccaacgagccgaggagcaagtagctcggttccaaaagatcccaaacggggaaaacgagaccatgatccccgtactgacttcgaagaaagcgtcggaactgccagtttctgaggtcgccagtatacttcaagcggacctgcagaatgggcttaataaatgtgaagtgagccaccgccgggcattccacggatggaacgaattcgatatctccgaagatgagccattgtggaaaaagtacatttcacagttcaaaaatcccctcatcatgcttctcctcgcctctgccgtgattagcgtgctgatgcaccagtttgatgacgctgtgagcatcacggtggctatcctcatcgttgtcactgtggctttcgtgcaagaataccggtcagaaaagtctctcgaggagttgagtaaactggtgcctccggagtgtcactgtgtccgcgaaggaaagttggagcacaccttggcacgtgatcttgtgccaggagataccgtgtgcctgtcggtgggggacagagtgccagccgacctcaggctgttcgaggcggtcgatctgtccatcgacgagtcttccctgacaggcgagaccaccccttgttcaaaagtgaccgccccacagccggctgccaccaatggagacctggcttctaggtcgaatatcgccttcatgggcaccttagttaggtgcggtaaagctaaaggcgtcgtcatcggaaccggagagaactcagagtttggagaagtctttaagatgatgcaggccgaagaggcccccaaaactcctttacaaaagtcgatggatctgctgggcaagcaactgagcttttatagtttcggtattattggaatcattatgctggtgggttggctattggggaaagatatactggaaatgttcactataagcgtaagcctggccgtcgccgccattcccgaaggtttgcctatcgtagtcaccgtgaccctggcattgggcgtaatgaggatggtgaagaagagagccatcgttaagaaattgccaattgttgaaacattgggctgctgtaacgtgatttgttctgacaagacaggtactttgaccaagaacgaaatgaccgttacacacattttcacttcagacggtctgcacgccgaggttactggcgtcggctacaaccagttcggcgaggtcatcgtagatggggatgtggtgcacggattctataaccccgccgtttctcgcattgtcgaagctgggtgcgtgtgcaatgacgctgtgatcagaaataatacactgatggggaagccgactgaaggagccctgatcgctctggccatgaaaatggggctggatggcctgcagcaggactacatcaggaaagcagagtaccctttctcctccgaacagaagtggatggcggtaaagtgcgtgcatagaactcagcaggaccgtcccgagatctgttttatgaaaggcgcttacgagcaggtgatcaagtactgtactacgtaccagagtaaaggccagaccctgacattgacacaacagcagagggatgtgtaccagcaagagaaggcaagaatgggatctgccgggctccgagtgctggcacttgcctctgggcctgaactcggtcagcttaccttcttaggtctggtgggaattatagacccaccaaggaccggcgtgaaggaagctgttacaactctaattgcaagcggcgtttctataaagatgattacaggcgattcccaggaaactgctgtcgctatagcctctagactgggactgtactcaaaaacatctcagtccgtctccggggaagagatagacgcgatggacgtgcaacagttgagtcagatcgtccctaaagtggcggttttctatcgcgcaagtcctcggcataaaatgaagataattaagtcactgcagaagaacggatcggtggtggctatgactggcgatggtgtgaatgatgccgtcgctctgaaggcagccgatatcggtgtggccatgggacagaccggtaccgacgtgtgtaaggaggcagctgatatgatactcgttgatgacgacttccaaaccataatgagcgccatagaagagggaaagggtatatataacaacattaagaacttcgtcagattccagctgagtacaagtattgcagccctgaccctgatcagcctagccactttaatgaacttcccgaaccccctgaacgctatgcaaatactatggatcaacatcatcatggacggcccaccagcgcagtccctcggggtggaacctgtagacaaggatgtcatcaggaagccaccacgcaattggaaagactccattctgactaaaaacctgatactcaagatattggtgagctcaatcattatagtctgcggcaccctcttcgttttctggcgcgagctaagagacaatgtcattacccctcgggatacaacaatgactttcacatgttttgtgttctttgacatgtttaatgccctcagcagtaggagtcagactaaatctgtgtttgagattggtttgtgctctaatagaatgttttgttatgccgtgctgggcagcataatgggacagctcctggtgatctatttccctcccttgcagaaggtctttcagactgagtctctgtccatccttgatctcctgtttctcctgggcctcacatcatccgtgtgtattgtcgcggagataatcaaaaaagtcgaaaggagccgggagaaaattcagaaacatgtgtggttgtgggagcgctcaggtcaacagctggtggaaattcacccccacctggagacagggctacccctgacggaggacgtgtcatgcgtatag

SEQ ID NO: 179794 - DNA, 2820 bp, Artificial Sequence
  Description of Artificial Sequence: Synthetic coding sequence
atgaaggtggcccggttccagaagatccccaacggcgagaacgagaccatgatacccgtgctgacgtccaaaaaagctagcgagctccccgttagtgaagtcgccagcatcctgcaggccgacctgcagaacggacttaataagtgcgaagtgagtcacaggcgtgctttccatggctggaatgagtttgacatctctgaggatgaaccactgtggaaaaagtacatcagtcaattcaaaaatccgctgatcatgctgctactagcttccgcggtaattagcgtgctgatgcaccagttcgatgacgcagtatcgatcaccgtagccatattgatcgtggtgaccgtggccttcgtgcaagaatatcgcagcgagaaatccctggaagagcttagcaaactcgtccctcctgaatgccactgcgtacgggagggtaagctggagcatactctcgccagagacctggttcctggcgacacagtctgtctctcagtgggggacagagttcccgccgacctccggctgtttgaggcggttgatctcagtatcgatgagagttcactaacaggagaaactactccgtgctcaaaagtgactgcaccacagccagcggctactaacggagacttggcctcacgttcaaacattgcttttatggggaccctggtaaggtgtgggaaagcaaaaggcgtggtcataggtactggagagaacagcgagtttggagaagtcttcaagatgatgcaggcagaggaggcacctaagactcccttgcagaaatctatggacctgctggggaagcagctcagcttttattcattcggaattatcgggatcatcatgctggtgggttggctgctgggtaaggatatacttgaaatgtttaccatcagcgtgagcctcgccgtagcagccattcctgaagggctgcccattgtggtgactgtcaccctggcactgggtgtgatgcgcatggtgaagaaaagggccatagtgaagaaactacctatcgtggaaacattgggatgctgtaatgtgatttgtagcgacaaaaccggaacgctgactaagaatgaaatgacagtaacccacatattcaccagcgatggtctgcacgcagaggtcaccggggtggggtacaatcaattcggcgaagtgatcgtggatggtgatgtggtgcatggcttttacaaccccgctgtctctcgaattgttgaagccggctgcgtttgcaacgacgcggtgatccgcaataacactcttatggggaaacccacggagggtgctctcatcgcactggcgatgaaaatgggcctggacgggttgcaacaagattacattcggaaagctgagtaccctttttccagtgagcagaagtggatggccgttaaatgcgtgcatagaacccagcaggacagaccggagatctgcttcatgaagggggcctacgagcaggttatcaaatactgtacgacataccagtctaaggggcagacgctgaccctgacccagcagcagcgcgacgtttatcagcaggaaaaggcccgtatggggagtgcgggcctgagggtgctggccctggctagtggtcctgagctgggtcagctaacatttctcggcctcgtgggcattatcgatccacccaggactggcgtcaaggaagccgtaacaactctcattgcctctggagtgagtatcaagatgataacgggagattcacaagagaccgcagtggctatcgccagccggctgggcctctatagtaagacaagccaatcagtaagcggcgaggagattgatgcaatggatgtccagcagttatcccagattgtaccgaaagtcgcggtgttctaccgagcgtcaccaaggcataaaatgaagatcattaaatccctccagaagaatggtagtgtagtagctatgaccggcgacggtgtgaacgatgccgtggccctgaaggctgcagatatcggggtggctatggggcaaacgggaacagatgtgtgtaaagaggccgctgatatgattctagttgacgacgattttcagaccataatgagtgctatcgaggagggaaaaggcatttacaacaacattaagaactttgtgagatttcagctcagcaccagcattgccgccctcaccctcatcagcctggcaacgctaatgaactttcccaatcccctgaacgctatgcagattctgtggatcaacatcataatggacggccctccagcacagagccttggcgtggagccggttgataaggatgtgatccggaagcccccaaggaattggaaagactctatcctcacgaagaatcttattcttaagattcttgtgagctcaatcatcatcgtttgcggtaccctgtttgtgttctggcgtgagcttcgtgataacgtcatcacgccccgagacacgacaatgacatttacctgtttcgtcttttttgacatgtttaatgcattgagctcacgcagccaaaccaagtctgtgtttgagattgggctgtgcagcaaccgcatgttttgttatgccgtcctcggcagcattatggggcagcttcttgtgatttatttcccacctttacagaaggttttccagacggagagcttgtccatcctcgacctcctctttcttttgggtttgacgtccagcgtgtgtatcgtggcagagattatcaagaaggtagagaggtcacgtgagaagatccagaaacacgtgtggctgtgggaacgctcaggccagcagcttgtagaaatccacccccacctcgagactggccttcccctcacggaagacgttagctgcgtgtag

SEQ ID NO: 179795 - DNA, 2760 bp, Artificial Sequence
  Description of Artificial Sequence: Synthetic coding sequence
atgaaggtggcccggttccagaagatccccaacggcgagaacgagaccatgattcccgtgctgacgtctaaaaaggcatcagaactgccagtctctgaagtagcgtcaatcttacaggccgacctacagaacggcctcaacaagtgtgaagtgtctcacaggcgggcattccacggttggaacgagttcgacatttcagaggatgagcccctttggaaaaagtatatctcacagtttaagaatccgctcatcatgctgctgctggcctccgcggtaatcagcgtcctgatgcaccagttcgatgacgccgtatctattactgtggccatcctaattgtcgtcacagtcgcgttcgtccaggagtaccgatccgaaaaaagcctagaagagctgagcaaattggtaccacccgaatgtcattgcgtgcgggagggcaaactggagcatacactggcacgtgacctagtacccggcgacacagtctgcctgagtgtcggggatcgggtacccgctgatctgcgactttttgaagccgtggacttgagcattgatgagtccagcctcactggcgagaccaccccatgtagtaaggtaacggccccccagccggctgcgactaacggggatctggcaagccggtccaacattgcctttatgggcaccttggttagatgcgggaaagcaaagggcgtggtgattggtaccggcgaaaattcagagttcggcgaggtttttaagatgatgcaggccgaggaagcccctaaaactccgctgcagaaaagtatggacctgcttgggaagcagctgagcttttacagtttcggcatcatcgggatcattatgctggtggggtggctacttggcaaagacattttagagatgtttacgatcagcgttagtctggcagtcgcagccattcccgaagggctgcctattgttgtcactgtcacacttgctcttggggtcatgaggatggttaagaagagggctattgtcaagaaacttccgattgttgaaaccctcggctgttgcaatgtaatctgctcggataagaccggcactttaacgaaaaacgaaatgacagttacccacattttcactagtgatggcctccacgcggaagttacgggcgtaggatataatcaatttggggaggtgattgtcgatggcgacgtcgtgcacggtttctacaatcccgctgtatctagaattgtggaagcaggctgtgtctgcaatgacgcagtcatccggaataacaccctcatgggaaagccgaccgagggcgccctgatcgcattggccatgaagatgggcctagacggtttacagcaagactacattaggaaggccgagtacccatttagctctgagcagaagtggatggccgtgaaatgcgtacaccgaacacagcaagaccggcccgaaatctgtttcatgaagggtgcatatgaacaggtgatcaaatattgtaccacctatcagtcaaaggggcaaacattgaccctgacccagcaacagagggacgtctatcagcaggagaaagcacggatgggatcagcgggattgagagttcttgccctcgcttcagggcctgaactgggacagttgacttttcttggattggtcggcatcatagatcctcctcgcacgggggtgaaggaggcggttacaactctgatcgcctcgggtgtgtctattaaaatgataaccggcgatagtcaggagacggctgttgccatcgcatcccggctgggcctgtactccaagacctctcagagcgtgagcggagaggaaatcgatgccatggacgttcaacagcttagtcaaatcgtaccaaaagtcgccgtgttctaccgagcctccccaaggcacaagatgaagatcatcaagagtctacaaaaaaacgggtccgtcgtggccatgacaggcgatggcgtcaacgatgccgttgccctgaaggccgctgatataggcgtggccatgggccagaccggaactgacgtctgtaaggaagccgctgatatgattttggtagacgacgacttccagaccatcatgagcgccatagaagaggggaaaggtatttataataacattaagaactttgtccgctttcagcttagcaccagcatcgccgccctgaccctgatttccctggccacactgatgaattttcctaaccccctcaacgcaatgcaaatcctttggataaacatcatcatggacggacctccagcccagtccctcggcgtcgaacccgttgataaggacgtgatcaggaagccaccaagaaactggaaagattctattcttacaaaaaacttaattctcaagattttggtgtcaagtataataatcgtctgcgggacactctttgtcttttggagagagctcagagacaacgtcattacgccaagggacactactatgacctttacttgttttgtgttttttgatatgttcaacgcattatcttcacgatctcagacgaagtcagtctttgagataggtctttgtagtaatagaatgttctgttacgcggtcctgggctcaatcatggggcagctgctcgtgatatactttccccccttacagaaagtgtttcagacagaaagtctgtccattcttgatctgctgtttctcctgggtttaacttcaagcgtttgcatcgttgccgaaatcattaagaaggtcgaacgatctcgcgagaagattcaaaagcatgtgagctccacatcgagctcttttttggaggtttag

SEQ ID NO: 179796 - DNA, 2712 bp, Artificial Sequence
  Description of Artificial Sequence: Synthetic coding sequence
atgatccccgtgctgaccagcaagaaggccagcgagctgcccgtgtccgaagtcgcaagtatcctccaggccgacttgcaaaatggtctgaacaaatgtgaagtgagtcaccgaagagctttccacggctggaacgagtttgacatttcagaggacgagcctttgtggaaaaagtatatcagccagtttaagaatcccctgatcatgctcctcctggcctcagcagtaatcagtgtgctgatgcaccagttcgatgacgcagtgtcaatcacagtggcaatcctaatagtggtgaccgtagcctttgttcaggaatatcggtctgaaaaatctttggaagagttatcaaaactcgtaccacctgagtgccattgtgtgcgagaaggaaaactagagcataccctcgctagggacctagtgccaggtgataccgtgtgtctgtctgtgggtgatagggtcccagccgacctcaggttgtttgaggctgtggaccttagcatcgacgagagttcgctcaccggagagaccactccctgttccaaagtcactgccccacagcctgcggccacaaatggcgatctggccagcagaagtaatattgctttcatggggacgctggttaggtgcggaaaggctaaaggcgtagttatcggtacgggtgaaaacagcgagttcggagaagttttcaagatgatgcaagccgaggaagcccccaaaaccccactacagaagtcaatggacctattaggtaagcagctgtccttctatagcttcggaataattgggattatcatgctggtgggttggctgctcggaaaggacattctagagatgttcaccatcagcgtatcccttgccgttgcagcgattcccgagggtctaccgattgttgttaccgtgaccctggcgctcggagtaatgcggatggtaaaaaagagggcgatcgtgaagaagctgcccatcgtggagaccctgggctgttgcaatgttatttgcagcgataagaccgggacactgacgaaaaacgaaatgaccgtcactcatatctttacaagtgatggcctgcacgcagaggttaccggggtcgggtacaaccagttcggtgaggtgatcgtcgatggtgacgtcgtccatggtttctataatcctgctgtcagtaggatagtcgaagcaggctgcgtctgtaacgacgctgtgattcgcaataatacgctgatgggcaagcctacagaaggagcgcttatagctctggccatgaagatggggcttgatggattacagcaggactacattaggaaggcagagtatccattctcatcagaacagaaatggatggcggtgaaatgcgtccacagaacacagcaggacaggcctgagatttgtttcatgaaaggggcttatgagcaggtgattaagtactgtacgacatatcaatcaaaaggtcagactttaactctcacacagcagcagagggacgtttaccaacaggagaaagccagaatgggatccgctggactgcgagtgctcgccttggctagcggtcccgaactaggtcagctcacattcctcggcttagtgggcatcattgatcccccacggactggcgttaaagaggctgtgactaccctaattgcctcgggggtgtccatcaagatgattactggagactctcaagagactgcagtggccattgcatcaaggctgggcctttatagcaagacaagtcagagtgtatccggcgaggagatcgatgcaatggacgtgcagcagctgagccagattgttccaaaagtggccgtgttctacagagccagcccgcggcacaaaatgaaaatcattaagtccttacaaaagaacggtagtgtggtggccatgactggcgatggagtcaatgacgctgtagctttgaaagctgccgatataggggtggccatgggtcagaccggtactgacgtgtgtaaagaagccgccgacatgatcctagtggacgatgacttccagaccataatgtctgcgattgaggaaggcaagggtatctataataacatcaagaatttcgtcagatttcaattgtcaacatcaattgccgccctgacccttatctcactggccactctgatgaattttcccaaccccctgaatgccatgcagatactatggattaatatcatcatggatggaccgcctgctcagtcccttggtgttgagccagtggacaaagacgtgatccgcaagcccccaaggaattggaaagatagtatcctgaccaagaatcttatactgaaaattctggtgagttccataattatcgtctgtggcaccctttttgtgttctggagagagttgagagacaatgtaataactccacgagatacaacaatgaccttcacatgtttcgtttttttcgacatgtttaacgccctctcatctcgctcccagactaaatctgtttttgagatcggcctatgctctaatcggatgttttgctatgcagttctgggatctattatgggccagctgctcgtgatctactttccgcccctgcagaaagtctttcagacagagtcgctcagcatcctggacctgctctttttattaggcttgacgtcatccgtgtgtatcgtggcagaaatcatcaagaaagtggagcgcagccgtgaaaaaattcagaaacatgtgtcaagtacgagcagctccttcttggaggtctag

SEQ ID NO: 179797 - DNA, 363 bp, Artificial Sequence
  Description of Artificial Sequence: Synthetic coding sequence
atgaaggtggcccggttccagaagatccccaacggcgagaacgagacgatgattccagtactgacctctaaaaaggcctccgagctgcctgtttctgaggtcgctagtatcctccaggctgacctgcagaatggcttgaacaaatgtgaggtgagccacagaagagcctttcatggctggaacgagtttgatataagtgaagacgaacctctgtggaagaagtatatcagtcaattcaagaacccccttatcatgctcctgctcgcctctgccgttattagcgtgctgatgcaccagtttgacgatgcggtcagtattactgtggcaatcctgatcgttgtgaccgtcgcatttgttcagtag

SEQ ID NO: 179798 - DNA, 2712 bp, Artificial Sequence
  Description of Artificial Sequence: Synthetic coding sequence
atgatccccgtgctgaccagcaagaaggccagcgagctgcccgtgtctgaggttgccagcattctccaggccgatctgcagaatgggctgaataagtgcgaggttagccataggcgagcattccacggttggaacgagtttgatatctctgaggatgagccattgtggaaaaagtacatcagtcagttcaaaaaccctctgattatgttgctgctggcgtcagccgtcatcagcgtgctgatgcaccaatttgacgacgccgtgtcaatcactgtggcaattttaatcgtcgtgactgttgcctttgttcaagagtaccggtcagagaaatccctagaagaactgtcaaagttggttcctcccgagtgtcattgcgtaagagaaggcaaactggagcacacactggctcgcgacttggtccctggcgacaccgtgtgtctctctgttggggatcgggtacctgctgacctacgactttttgaagcagttgatttaagtattgacgaaagctcactcacaggcgagactaccccttgtagcaaggttacggccccgcagcccgccgcaacgaatggtgatcttgcaagtagatcaaatatagcctttatgggtaccctcgtgcgctgcggtaaggctaaaggcgtggtgattgggacaggtgaaaacagcgagtttggggaagtatttaaaatgatgcaggctgaggaagcccccaagacacccctccaaaaaagcatggaccttctgggcaagcaactgtccttttactcattcggaatcataggcatcattatgttagtgggatggctgctgggaaaagacatcctcgagatgtttacaattagtgttagtttagcagtggccgccatccctgagggactgcctatcgtggtcaccgttactctggccttgggtgtgatgcggatggtgaaaaagagagctattgtgaagaagctaccaattgtggaaacactgggctgctgtaacgttatttgctcagacaagaccgggactttaacaaaaaatgaaatgacagtgactcacattttcacaagtgacggcttacacgccgaggtcactggtgtgggctataatcaatttggtgaggtgattgtcgacggggatgtagtgcacggtttctacaaccctgcagtgagtaggatagttgaagctggctgcgtctgcaacgacgcagttattcgcaataatacactgatgggtaagccaactgagggtgccctgatcgctttggcgatgaagatgggcctggacggactgcagcaggattatatcaggaaagctgaatacccatttagcagtgagcaaaagtggatggctgtgaaatgcgtgcatagaactcaacaggacagacccgagatctgcttcatgaagggcgcgtacgagcaagtgattaaatactgtaccacctaccagtccaagggacagactctaacactcactcagcaacagagagacgtataccagcaagagaaggcccgcatgggcagcgctggcttgagagtactcgccctggcctcagggccagaactcgggcagcttacctttctggggctggtgggcattatagaccctcctcggactggtgtcaaggaagccgtcaccacacttatcgcttccggcgtctctattaaaatgattacaggggactctcaggagaccgccgtggcaattgcgagcaggctcgggctctactcaaagacatctcaaagcgtgtctggtgaagagattgatgctatggacgtgcagcagctatcacagatcgtgcccaaggtggccgtgttttaccgtgcctctccaagacataagatgaaaatcattaagtccctccagaagaacggctccgtcgtcgccatgaccggggacggcgtgaatgacgctgtggctcttaaggcagcagacatcggcgtcgccatggggcagacagggacagatgtgtgcaaggaggctgctgatatgattctagttgatgacgacttccagacgatcatgagtgcaattgaagagggaaaagggatttacaacaatatcaagaactttgtgcgctttcagctgagtacaagcattgctgccctgactcttatttcccttgctacgttgatgaactttccaaaccccctgaacgccatgcaaattctgtggatcaatatcataatggacggcccccctgcccaatcgctgggcgtggaaccagtcgataaagacgtcatccgaaaacccccccgcaattggaaggattctattcttactaagaatctgatcctgaaaatcctcgtgtcaagtataatcatcgtatgcggcaccctgttcgtcttctggcgggaactgcgcgacaatgtaattacacccagggacaccactatgactttcacctgtttcgttttttttgatatgtttaacgcactttccagtcggtcccagacaaagtcagtgttcgaaatcggcctgtgctctaaccgaatgttctgttatgccgtcctggggtccataatgggccagcttctcgttatttatttcccgcctttgcagaaagtatttcaaactgagagcctgagcattttagatctcctctttcttctgggtctgacctcgtccgtgtgtatagtggccgaaatcataaaaaaggtcgaacgatctcgtgagaagatccagaaacatgtttcctctacatcttcgtcctttctggaggtctag

SEQ ID NO: 179799 - DNA, 2772 bp, Artificial Sequence
  Description of Artificial Sequence: Synthetic coding sequence
atgatccccgtgctgaccagcaagaaggccagcgagctgcccgtgagcgaggtggcttccatccttcaagccgacctgcagaacggtctgaacaagtgcgaggtatcccaccggagggcattccacggctggaatgagtttgatatcagtgaggacgaacccctgtggaaaaagtatatctcccagttcaagaaccctctgattatgctgctcctcgccagcgccgtgatctcagtgttgatgcatcagtttgacgacgctgtaagtattaccgttgccatccttattgtcgtgaccgtggcgttcgttcaagagtatcgcagcgagaaatccttggaagaactcagtaagttggtgcctcccgaatgccactgcgtcagagagggtaagctggagcatacgctggcgagggacctggtacctggcgatacagtctgcctcagtgtaggcgaccgagttcctgctgacttaaggcttttcgaagctgtggacctgagcatcgacgaaagtagtcttacaggcgagacaacaccttgttcgaaagtgactgctccccaaccagccgccactaatggtgatttggcgtcccggagtaatattgctttcatgggcacactggtgcggtgtgggaaggccaagggcgtggtcataggcaccggcgagaactcggagttcggggaggttttcaaaatgatgcaagcagaggaggctcccaaaactcccttgcagaagtcaatggaccttcttgggaagcagctcagcttttacagctttggcataatcggtattattatgctggtgggctggctactggggaaagacatccttgagatgttcacaatttcagtcagccttgcagttgccgccattccagagggcctgccaattgtggtgacggtgacactcgccctgggtgtgatgagaatggtaaaaaagcgcgcaatcgtgaaaaagttaccaattgttgagacattggggtgctgcaacgtgatctgctccgacaagacaggtaccctgacgaagaacgagatgacagtcacccatatttttacctctgacggactacatgccgaggtgaccggagtgggctacaatcaatttggtgaggtgattgtggacggagatgttgtgcacggattttacaatccggccgtctccagaatcgtcgaagcaggatgcgtgtgtaatgacgccgtgattcgtaacaacaccctaatgggaaaaccaaccgagggcgccttgattgctttagcgatgaaaatgggattggatggacttcaacaagactatatcagaaaggcggagtacccattctccagcgagcagaagtggatggcagtcaaatgtgtgcatagaacacagcaggacagacccgagatctgctttatgaaaggcgcatacgagcaagttatcaagtattgtaccacgtatcaaagcaaaggacagactctgaccctgacccagcagcagagggacgtctaccagcaggagaaggcccgaatgggatctgccggcctcagggtacttgccctggccagtggtcccgagctggggcagctcaccttcctcggactagttgggatcatcgatccacctcggactggggttaaggaggctgtgacaacattaatagcttccggagtctccatcaaaatgatcacaggtgactctcaggaaaccgccgtggcgatcgctagtagattgggtctctactccaaaacatcccaatctgtgtccggcgaagagatcgacgccatggacgtgcaacagctttcgcaaatcgtgccaaaagttgctgtgttttaccgggcctcccccaggcacaaaatgaagattattaaatccctccagaagaatgggagcgtggtcgccatgaccggggacggcgtgaatgatgcagtggcactcaaggcggccgatatcggtgtggctatggggcaaaccggaaccgacgtgtgcaaggaggccgcagatatgatactggtggatgatgacttccagaccatcatgagcgccatcgaggaggggaaggggatttacaataacatcaagaactttgttagattccagctgtccacttcgattgctgctctcacccttatcagcctggccacattaatgaacttcccgaatccactgaatgccatgcagattctgtggattaacatcatcatggatggacccccagctcagtccctcggcgttgaaccagtggacaaggatgtcattaggaaaccacctcgaaactggaaggactcaatactaacaaaaaatttgatcctgaaaattctggtctcttccatcatcattgtgtgtggtaccttatttgtcttttggagagagctacgcgataacgtgatcactcctcgggatacaacaatgaccttcacctgttttgtgtttttcgacatgtttaatgccctttcgagcagatctcaaaccaagagcgtgttcgagatcggtctttgttccaatcgcatgttttgttatgccgtgctcggatctatcatggggcagctgctcgtcatctactttccccctttgcagaaagtgttccaaacagaatccttgtcaatcctcgatttgctttttctcctcggccttaccagtagtgtgtgcatcgtcgcagagattataaagaaagtggagaggagccgcgaaaaaatacagaaacatgtatggctgtgggaaaggagcgggcagcagctggtagagatccacccccacctggagaccgggttgcctctgacagaagatgtttcatgcgtgtag

SEQ ID NO: 179800 - DNA, 249 bp, Artificial Sequence
  Description of Artificial Sequence: Synthetic coding sequence
atgatccccgtgctgaccagcaagaaggccagcgagctgcccgtgtccgaggtcgcgtctatacttcaggctgatttacagaatgggttgaataaatgtgaggtctctcaccgaagggcattccatggttggaatgaatttgatataagcgaggatgagccgctctggaaaaaatatatctcccagttcaagaacccactgattatgctcctactggcctcagcagtaataagtgtgctgatgcattag

SEQ ID NO: 179801 - DNA, 2760 bp, Artificial Sequence
  Description of Artificial Sequence: Synthetic coding sequence
atgaaggtggcccggttccagaagatccccaacggcgagaacgagaccatgatcccggtgttgacttctaagaaagctagcgaactgccagtttcagaagtggcgtctattctgcaagcagacctacagaatggattgaacaaatgcgaggtcagccacagacgggctttccatgggtggaacgagttcgacataagcgaagatgagcctctgtggaagaaatacataagccagttcaagaaccccctaataatgttgttgctggccagtgcggtcatttcagttctgatgcaccagttcgacgacgcggtgtcgatcacagtcgcgatcctcattgtagtgactgtcgcattcgtccaggaataccgcagcgaaaagagcctggaggagctctctaagctggtacctccagagtgtcactgcgttcgcgaaggcaagctagagcacaccctcgctcgcgacctagtaccaggcgacaccgtctgcctgagtgtgggcgatcgggtgccagctgaccttaggttgttcgaggctgtcgacctatctattgacgaaagttcactcaccggtgagacaaccccctgtagtaaagtgactgcgccccagccagcagcaacgaatggcgatctggcatctcggtccaacattgcttttatgggaacactcgtgcgatgcggtaaggcaaaaggagtggttattggcacaggtgaaaacagcgagttcggcgaggtgtttaaaatgatgcaagccgaggaagcaccaaagactccccttcagaaaagcatggatctcctcggcaaacagttatcgttctatagttttggtatcattggtattatcatgctcgtgggttggctcctcggaaaggacattctggaaatgtttactatctctgtgtccctggccgtagcggctatccctgaagggttgcctattgtggtgacggttaccctggcgcttggggtgatgaggatggtcaagaagcgagccatcgtgaagaaactgcccatcgtagaaacacttggttgctgcaatgttatctgcagtgacaaaaccggaacactgactaaaaatgaaatgaccgtgactcatattttcacatccgatggcctgcacgctgaggtaacaggcgtgggctataaccagttcggtgaggtcattgtcgacggagacgtcgtgcacggcttttataaccccgccgtaagccgtattgttgaagccggctgtgtctgcaatgatgcagtgattcggaacaatacactcatgggtaagcctacggaaggagcgctgatcgcattagccatgaaaatgggcctggacggcctacaacaggattacattcgcaaggccgaataccctttcagctctgaacagaagtggatggccgtgaagtgcgtccacaggacacagcaggataggccagaaatttgtttcatgaaaggcgcatatgagcaagtcattaaatactgcaccacgtaccagagcaaagggcagacgctgactctgacacagcagcagcgagatgtctatcagcaggaaaaggcaaggatgggatcagccggcttgagggtgctggcgctggcttcaggaccagagttaggacagcttactttcctcggcctagtggggattatagacccaccccgcaccggtgtgaaggaggctgtaaccaccctcatcgcatccggagtgtctattaaaatgattacaggggattcgcaggaaaccgctgttgccatcgcatcccgtctcggcctgtattcaaagacaagtcagtctgtatccggcgaggagattgatgccatggatgtccagcaactatctcagatcgtgccaaaggtggctgtgttttatcgggcttcacctcggcataagatgaagatcattaaaagcctccagaaaaatgggagtgtggtggccatgacaggggacggggtcaacgatgctgtggccttaaaggccgccgacattggcgtagccatgggacaaaccggcactgacgtctgtaaggaggccgctgatatgatactggtcgacgacgattttcagaccataatgtctgccatcgaggagggtaagggcatttacaacaatatcaagaactttgtgcggttccagttgtcaacttctatcgccgctctgacgctcattagcctggccactctgatgaatttcccaaatccactgaatgcaatgcagatcctttggatcaacatcattatggacggaccccctgcccagtcccttggggtggaacctgttgataaggacgtcattaggaagccaccacgcaactggaaagacagcatcttaactaagaatctcatcctgaaaatcttggtgagctcaataatcatagtatgcggcacactcttcgtcttttggagggagctgcgagacaatgttataacccctcgcgatacaacaatgacattcacatgcttcgtgttcttcgatatgttcaatgctctctcctctagatcacaaaccaagtctgtgttcgagattggcctctgttcaaataggatgttctgctacgccgtcttgggttctatcatgggccaattactcgttatatacttccccccgctgcaaaaggtttttcagacggaaagcctgtccattctcgatctgttgttcttattgggcctaaccagctctgtgtgtatagtcgcagagattattaagaaggtcgagcgctcacgagagaaaatccagaaacatgtctcttctacatcctcatccttcctggaagtctag

SEQ ID NO: 179802 - DNA, 309 bp, Artificial Sequence
  Description of Artificial Sequence: Synthetic coding sequence
atgaaggtggcccggttccagaagatccccaacggcgagaacgagacaatgattcctgtcttgaccagcaagaaagcatctgaacttcctgtgtccgaggtggcctccatcctacaagctgacctacagaatggcttaaacaagtgcgaagtgagtcaccggcgggcttttcatggatggaatgaatttgacatcagcgaagatgagccgctatggaagaagtacatctcccagtttaagaacccgttaatcatgctcctcctcgcgtccgccgtgatttccgtactgatgcatcagtttgacgactag

SEQ ID NO: 179803 - DNA, 2760 bp, Artificial Sequence
  Description of Artificial Sequence: Synthetic coding sequence
atgaaggtggcccggttccagaagatccccaacggcgagaacgagaccatgattcccgtcctgacatcaaagaaagcatctgagctgcctgttagcgaagtggcgtccattctacaagcggatctgcagaatggtttgaacaaatgtgaggtttcgcaccgccgcgcatttcacgggtggaacgagttcgacatttccgaggatgaacctttgtggaaaaagtatatctcacagttcaaaaatccactcatcatgctactcctggctagcgccgtgatctctgttctgatgcatcagttcgacgatgcggtgtccattactgtggctatactcattgtggtgacggtcgcctttgtacaggagtatcgctctgagaagtcgctggaagagttaagcaagctcgtaccccccgaatgtcattgcgtccgggagggtaagctagagcacactttggccagagacctcgttcctggcgacaccgtatgcttgtccgtcggtgatcgggtgccggctgatctacgacttttcgaggctgtcgacctcagcatcgatgaatcatctttaactggcgaaacgacaccatgttccaaggtaactgcaccacagccggccgcaactaacggcgacctcgcgagtagaagcaatatcgcgtttatgggcacactggttcggtgcggcaaggcgaagggggtcgtcataggaactggcgagaactcagaatttggggaggtttttaagatgatgcaggccgaggaggcccctaagacccctttgcaaaaaagcatggatcttctaggtaaacagctgtctttttattccttcggcatcattgggatcattatgttggttggctggctgctggggaaggacatcctagagatgttcacaatcagcgtttctctagctgtggcggccatccctgaaggcttgccaatagttgttactgtcactttagctctgggtgttatgaggatggttaaaaagcgcgctatcgtgaagaagctcccgatagtagaaacactcggttgctgtaatgtgatctgtagcgataagactggtacattaaccaaaaatgagatgacggtcacacatatatttacttcggatggccttcatgcagaggtgaccggggtcggctacaatcagttcggtgaggtcatcgttgacggcgatgtcgtccatgggttctacaatccagccgtgtctcgtattgtggaagctggctgtgtgtgcaacgacgcagttatacgtaataacacactgatgggcaagccaaccgagggcgccctcatcgcattagctatgaagatgggtctggacggtctccaacaggactatattcggaaggcggaataccccttcagctccgaacagaagtggatggccgttaaatgcgtgcaccgaacacaacaggacaggccagaaatttgctttatgaagggcgcctatgagcaggtaatcaagtattgcacaacctatcagtccaaagggcagacgctgacactaactcagcaacagcgggatgtttatcaacaggaaaaagctcggatgggttccgccggccttcgggtattagccctcgcctcagggcccgagctcggccagctgactttcctgggcctggtcggaattatcgatccgcccagaaccggagtgaaggaggccgtgaccacccttatcgccagcggagtgtctatcaaaatgattaccggtgacagccaggagaccgcggtcgcgatcgctagccgtctcggtctttactccaagacaagtcaatcggtgagcggagaggaaatagatgcgatggacgtacagcagttgtctcaaatcgtgccgaaagtcgcagttttttaccgcgctagccctaggcacaagatgaagatcattaagagccttcaaaagaatggcagtgtggtcgccatgacaggcgacggcgtaaacgatgccgtggcgctaaaggccgcagatatcggtgtggctatggggcagaccggaaccgatgtgtgcaaagaggcggcagatatgatactggtggacgatgacttccagacaattatgtctgccatcgaggaaggaaaaggaatctacaacaacataaagaatttcgtgcggttccagttaagtacaagcatcgctgctctaacactgatctcgttggcaactctgatgaattttcccaatcctttgaacgccatgcagatactgtggatcaacattatcatggatgggcccccagcgcagagcttgggggtcgaacctgtagacaaggatgtcatccgtaaacctcccaggaattggaaagattcaatcctgaccaagaacctgatcctcaagatcttggtgagctctataatcatagtctgtggtaccctattcgtcttctggagagaactccgggataatgtaatcacccctcgagacaccactatgactttcacttgtttcgttttctttgacatgtttaatgcgctttcaagccgctcccagacgaagtctgtgttcgagatcgggttgtgctcaaatcggatgttttgctatgccgtgctcgggtccattatgggtcagctcctggtgatttattttcctcctctgcaaaaagtgttccagaccgaaagcctttcgatcctcgatctgttattccttttgggtctcacctcctccgtgtgcatcgtggccgaaattatcaaaaaggtggagcgatctcgggaaaaaattcagaagcacgtttcttctaccagcagcagctttctggaagtttag

SEQ ID NO: 179804 - DNA, 2772 bp, Artificial Sequence
  Description of Artificial Sequence: Synthetic coding sequence
atgatccccgtgctgaccagcaagaaggccagcgagctgcccgtgagcgaggtggcttcgatcctccaggcagatctgcagaacggccttaataaatgtgaagtatcacatcgccgggcatttcacggatggaacgagttcgatatttcagaggacgaacccctgtggaaaaagtacatttcccagttcaaaaatcctcttattatgttgttattggcctctgcagtcatttcagtattgatgcaccagttcgatgacgccgtgtcgattactgtggccatccttatagtggtaacggtggccttcgtccaggagtacagaagtgagaagagtctggaggagttatccaagctcgtccctcctgaatgccactgcgtgcgggagggtaagctggagcatactctggctcgtgacttggtgccaggggatacagtttgtttaagcgtcggtgatcgggtgcccgccgatctaagattattcgaggctgtggatctgtcaatcgacgaatccagcctgacgggtgagactaccccttgttccaaggttacagcaccccagccggctgctactaatggagacctggcgtcacgaagcaatatcgcatttatgggaacccttgtgaggtgcggaaaggctaagggtgtagtgataggtacaggggaaaatagcgagtttggggaggtctttaagatgatgcaagccgaggaggctcctaagacacctttgcagaaatccatggaccttcttggcaaacagctctctttttacagttttggaatcatcggaattattatgctggtcggctggcttctggggaaagacatcctggagatgttcactattagcgtgagtttagctgtagcagccattcctgaggggctgccaatcgtggtgactgttacattagctctcggagttatgcggatggtcaagaaacgtgccattgtaaaaaagctcccaattgttgaaaccctgggatgctgtaacgtgatctgcagtgacaagactggaacccttaccaagaacgaaatgacagtcacccatattttcaccagcgatggactacatgcggaggtcacaggagtcgggtacaaccaattcggagaggtcatcgttgatggcgatgtcgtgcacgggttttacaacccagccgtgagcagaatcgttgaggccggctgcgtgtgtaatgatgctgtgatcagaaacaataccctgatgggtaagcctaccgagggcgcactaattgccctggctatgaagatgggactggacggcctgcagcaggactatattaggaaagcagagtatcctttctccagtgaacagaaatggatggcagtcaaatgcgtccacaggacacagcaggatagaccggagatctgcttcatgaaaggcgcttatgagcaggttattaagtattgtaccacatatcaatccaaggggcagacacttacactcactcagcagcagcgggacgtgtaccagcaagaaaaggcacgtatgggctccgccggcttgcgagtgcttgctctagcctcgggtccggagcttggacaattaacttttctcgggctggtggggatcattgaccctccccggactggcgtaaaggaggccgttactactctgatcgcaagcggcgttagcatcaaaatgattaccggcgatagtcaggagaccgccgtggccatagctagtcgcttgggactgtattccaaaaccagccagagtgtgtccggagaagagatcgatgcaatggatgtgcagcagttgtcccagatagtgcccaaggtagctgtgttttatcgcgcttccccacggcacaaaatgaagataatcaagagtctgcagaaaaatggaagtgtcgttgcaatgaccggggacggggttaatgacgccgtggcactcaaggccgccgatataggagtggccatgggccaaactggcactgatgtgtgtaaggaggccgctgacatgatactggtcgatgacgactttcagaccatcatgagcgcaatcgaagaggggaaagggatttataataatatcaagaatttcgtcagatttcagctcagcacatcaattgctgctctgaccctgatcagccttgccaccctgatgaacttccccaatccactcaatgctatgcaaatcttgtggatcaacatcatcatggacggaccccctgctcagagtctgggggtggagcccgtcgacaaggacgtaattagaaaaccacctagaaactggaaggattctatattaactaagaacctgatacttaagatactggtctcttctattatcatcgtgtgcggaaccttgtttgtgttttggcgggagctccgagacaacgttatcactccacgggacacgacaatgacctttacatgcttcgtgtttttcgatatgttcaatgctcttagtagccgcagccagaccaagtccgtcttcgaaattgggctgtgctccaacagaatgttctgctatgccgtgctcggttcaataatgggacagttgcttgtgatctacttccctccactccaaaaggtcttccagactgaatccttgagcatactggacctgcttttccttcttggcttgacttcctccgtgtgcatcgtggcagaaattatcaagaaagttgagcgtagtagagagaaaatccagaaacatgtttggttatgggaaaggtcaggccagcagttggttgaaatacaccctcacctggagacggggctgccattaacggaggacgtgtcatgtgtctag

SEQ ID NO: 179805 - DNA, 2835 bp, Artificial Sequence
  Description of Artificial Sequence: Synthetic coding sequence
atggacagcctgctgccccccagccggttcagctacttcaagaagtaccccctgcacgcaattcgcagatatcttagcacattaagaaaccagagagcggaagagcaggtggctaggttccaaaagatccctaatggtgagaatgagaccatgatcccggtgttgacatctaagaaagcatccgagctaccagtttcagaagtggctagcattctccagtttaagaatccactaatcatgctactgcttgccagtgccgttatctccgtcttaatgcatcagttcgatgatgctgtgtccatcacagtcgccatcctgatcgtcgtaacagtcgcctttgtgcaggaataccggtctgagaagtccctcgaagaactgtcaaaattagtccccccagagtgtcattgtgtgcgagagggaaagttagagcatacgctggcaagggacttggtgcctggtgacacagtttgtctctccgtaggggaccgggttcccgcggatctgcgcttgttcgaggccgtagacctttccattgatgagagcagcctcactggcgagacaaccccatgctctaaagtcaccgcaccgcagccagccgccaccaatggcgatctggcatctaggtctaacattgcttttatggggacattggtgcgctgcggcaaagccaagggagttgttataggcactggcgaaaattcggaattcggggaagtgttcaaaatgatgcaggcagaggaagcaccgaaaacaccactacaaaagagcatggatctacttggaaaacagttgagtttttatagcttcggaatcatcgggataataatgcttgtgggctggctgctcgggaaagatattctcgagatgtttaccatttccgtgtctctggctgtcgcagctatccccgagggccttcccatcgtagtgaccgtgacgctagctctgggggtgatgagaatggtgaagaagagagccattgtgaaaaagcttcctattgtagaaaccctgggatgctgtaacgtcatctgctccgacaagaccgggactttaactaaaaatgagatgactgtgactcatatatttacatccgatgggctccatgctgaagttacaggtgtcggatacaaccagttcggggaagtcattgtggatggtgacgttgttcatggcttctataacccggccgttagtcgcatagtggaggcagggtgtgtgtgcaacgatgctgtgattagaaacaacacacttatgggcaagcctaccgagggagcgctgattgccctggccatgaaaatggggctggatggcctgcagcaagactacattcgcaaggcagaatatccattctcgagcgaacagaagtggatggccgtcaaatgtgttcacagaacccaacaagatcgaccagagatctgttttatgaagggggcctatgaacaggtaatcaagtactgtaccacgtaccagtccaaaggtcaaaccctgacgctgacccaacagcagcgcgacgtgtaccagcaggagaaagcaagaatgggatccgcaggccttcgggtgctggctcttgcctccggccccgagctcggccaactcacttttctcggcctggtcggcatcattgacccacctaggaccggggtgaaagaagcagtgactactctcatcgccagtggcgtgagcatcaagatgatcacaggggacagccaggaaaccgccgtcgctatcgcctctcgactgggactctactctaaaactagtcagtccgtgtcaggagaagagattgacgccatggatgtgcaacagttgtcacagatcgtacccaaggtggccgtgttctacagggcctcccctcggcacaagatgaaaattattaagtctcttcagaagaacggaagtgtggtggctatgaccggcgatggggtgaatgacgcggtggcacttaaggccgccgatattggagtcgctatgggacagactggaaccgatgtatgtaaggaggccgccgatatgatcctggtggatgacgactttcaaacaattatgtccgctatcgaagagggaaagggtatatacaacaacatcaaaaatttcgtgaggttccagctgagtacctccatcgcagctctgacccttatctccctcgctaccctgatgaacttcccaaatccgctaaacgcgatgcagattttgtggattaatatcatcatggatggcccccccgcccagtcactcggggtcgaacccgtggataaggatgtgataaggaagccaccccggaactggaaggatagcattttgaccaaaaacctcatcctcaagatcctggtgagttcaatcattatcgtgtgcgggaccttatttgtgttttggagagagctgcgtgataacgtcatcaccccccgggataccacaatgacattcacatgcttcgtctttttcgacatgttcaatgcccttagttctcgctcccaaactaaaagcgtttttgagattggactctgtagcaatcgcatgttttgctatgccgtgttgggttccatcatgggtcagctgttggtcatctattttccccccctgcaaaaagtatttcagacggagagcttgtcgatactcgacttgctcttcttactgggcttgacctctagcgtctgcattgtggctgagattattaagaaagtagagcgcagtagggaaaagattcaaaagcatgtgagctctacatccagtagcttcctcgaggtgtggctgtgggaaagatcaggacagcaactggtcgagatacatccgcacttggagaccgggctgccattgacagaggacgtctcctgtgtctag

SEQ ID NO: 179806 - DNA, 2841 bp, Artificial Sequence
  Description of Artificial Sequence: Synthetic coding sequence
atggtggagggccgggtgagcgagttcctgaagaagctgggcttctccgggggtggccgccagtatcaggctctcgaaaaagatgaggaggaggcgctcatcgacgagcagagtgagctcaaagccattgaaaaagagaagaaggtaacagccctccctccgaaggaggcctgtaaatgtcaaaaagaagacctggcgcgggcattctgtgtagatctgcatactggattatccgagttttctgttactcagcggaggctcgcccacggctggaatgaatttgtcgccgacaattccgagcctgtttggaagaagtaccttgaccagttcaaaaatccgttaattttgctgctcctgggaagtgccctagtctcagtgctcactaaagagtacgaggatgccgtgagtatcgccaccgctgtgctggtggtggttacggtggcttttattcaggaatacaggtccgaaaagtcactggaggaattaaccaaaatggtgcctcccgagtgcaactgcctgagagagggaaaactgcagcatctcctagctcgtgagcttgtacctggtgacgtagtatctctcagtattggcgacagaattcccgcagatatccggctgacagaggtcaccgatctcctggtggatgaatcctctttcactggtgaagctgaaccctgcagcaagacagactcaccccttacaggggggggagaccttactacattgtcaaacatagtgttcatgggaacactggtgcagtacgggagggggcagggcgtcgtgattggaacaggggaaagcagtcagttcggagaagtgtttaagatgatgcaggccgaggaaactcctaaaacccctcttcagaagagcatggatcggcttggtaagcagctgacactgttctcttttggcatcattggcctcattatgctgataggatggagccagggtaagcagctgctgtctatgttcacgatcggggtgtccctagcagtggccgctatccctgaagggttgcctatcgttgtgatggtgacactagtgctgggagtgctgcgtatggcaaagaaacgcgtgatcgtcaagaaactgcccatagtagaaacactggggtgctgttccgtcctgtgcagcgacaaaaccggcactctgactgctaatgagatgaccgttacccaactagtgacttccgacggcctgcgggcagaggtgtccggcgtgggctacgacggccaggggacggtctgtcttttgccatccaaagaggtaatcaaagagtttagtaacgtgtcagtgggaaaattggtagaagctggctgtgtggccaataacgccgttatacggaaaaatgcagttatggggcagcccactgagggtgctctgatggcactcgcaatgaagatggatttatccgacataaagaatagctatatcagaaaaaaagagataccatttagttccgaacagaagtggatggcagtgaagtgctcgttgaagaccgaagaccaggaggatatctactttatgaaaggagctctcgaagaggttatcaggtactgtactatgtataataatggaggaatccccttgcccctcacaccccagcagcgtagcttctgcttgcaagaggagaaaaggatgggctccctaggactgcgcgttcttgccctggcttccggtcccgagctggggaggcttactttcctggggcttgtggggataatagacccccccagggtgggagtcaaagaagccgtgcaggtgctgtccgaaagtggcgtctcggtgaaaatgatcacaggggatgccctggagactgccctcgctataggtcgcaatatcgggctgtgtaacgggaaactgcaagccatgagtggggaagaagtggatagtgtggaaaaaggtgagctggctgatcgggtggggaaggtgtccgtctttttccgcaccagcccaaaacacaagttaaagattattaaggcactgcaggagagcggcgcgatcgtagccatgaccggggacggcgtcaacgatgctgttgccctgaagtctgctgatattggcattgcaatgggacaaacaggaacagatgtgagcaaggaagccgcaaacatgatcctcgtggacgacgacttcagcgcaatcatgaacgcagttgaggaaggaaaaggaatcttttataatatcaaaaacttcgttaggttccagctctctacttctattagtgccctctcactgataaccttgtcaactgtcttcaatctgccttctcccctgaatgccatgcagatcctgtggattaacatcatcatggatgggccacccgcacaaagtctgggggtagagccagtggataaagacgcattccgacaaccaccgagatcagttcgggacaccatcctatccagggccctcatcctgaaaatattgatgagcgccgcgattattatttctgggacattgtttatattctggaaagaaatgcctgaggatagggctagcaccccgcggactaccacaatgacctttacttgtttcgtcttttttgacctctttaatgccctcacgtgtaggagtcagacaaaactcatctttgaaattggattcttgagaaaccatatgtttctgtacagcgtgctcggcagtattctcggtcagctggcagttatttatattcctcccctgcaacgggtcttccagacagaaaatttgggcgctttggaccttctgttccttacagggttggcttcaagcgtctttatcttatccgaattattgaagctctgtgagaagtattgttgttcccctaagcgcgtccaaatgcatcccgaagacgtgtag

SEQ ID NO: 179807 - DNA, 2928 bp, Artificial Sequence
  Description of Artificial Sequence: Synthetic coding sequence
atggtggagggccgggtgagcgagttcctgaagaagctgggcttcagcggagggggacggcagtatcaggccctcgaaaaggatgaggaagaggcactcatagacgaacagtccgagctaaaggcaatagaaaaagagaagaaggtgactgcactcccacccaaggaagcgtgtaaatgccagaaggaggacctcgctcgtgctttctgcgtggacctccataccggcctgagtgagttctccgttacacagcggaggttggcccacggctggaacgagtttgtcgcagacaatagcgagccggtgtggaagaaatatcttgatcagtttaagaaccctctcattctgctgctcctgggcagcgccctggtgtctgtcctcaccaaggagtatgaagatgcagtctccattgctacagccgtgctcgtggtggtgaccgtagcctttatacaagaatatcgttcagaaaagtcactggaggaattgaccaagatggtcccccccgaatgcaactgtctgcgggagggaaagttgcaacacctactggcacgcgaactcgtccctggtgacgtagtttctctctccattggcgatcgcatccctgctgacattcgcctcacagaagttaccgatctccttgtggatgagtcatcttttactggcgaggcagaaccttgctcgaaaacagattcccctcttacaggaggaggcgacctaacgaccctgagcaatattgtctttatgggcacactcgtgcaatacgggagaggccagggtgtggtgatcgggactggtgagagttctcagttcggcgaggtattcaaaatgatgcaagccgaagagacccccaaaaccccacttcagaagtctatggacagactggggaagcagctgacccttttttcatttgggatcattggcctcataatgctgatagggtggtcacagggaaaacagttattatcaatgttcacgattggggtgtccctcgccgtcgccgccatacccgaagggctccccattgttgtcatggtcacacttgtgcttggtgtgctccgcatggcaaagaagcgcgtgatagtgaagaaattgcctatcgtggaaactttgggctgctgttcagtgctgtgctccgataaaaccggcaccctgacagccaatgagatgactgtgacgcaactggttactagcgatggcttgcgcgctgaggtgtccggggtcggctacgatgggcagggaaccgtctgtctgctgcccagtaaggaagtaatcaaggagttctcgaacgtgtccgttggtaaactcgtggaggcgggctgtgtggcaaataatgccgttattcggaagaatgctgtcatggggcagccgactgagggggctctcatggccttggcaatgaagatggacctgagcgatatcaagaatagctacatccgaaaaaaggagatccctttctcaagcgagcaaaaatggatggctgtgaagtgttcactcaaaactgaggaccaagaggacatatattttatgaagggggccttggaagaggttattaggtactgcacaatgtataataacggtggtataccccttcctcttacccctcaacagaggtctttctgccttcaggaggagaagcgcatgggttcactcggccttcgagttctggccctagcaagcggaccggagctcggtcgactgaccttcttgggtctggtaggcatcatcgatccgcctagagtgggagtgaaagaggcagttcaagtcttgtcagagagtggcgtatccgttaaaatgattactggcgacgcactggagaccgcactcgctatcggccggaatatcggactttgcaatggcaaactgcaagcaatgtccggggaagaagtagatagtgtggagaagggagagctcgcagacagggtgggaaaggtgtcggtgttttttcgaacaagccccaagcataagctcaagatcattaaggcactgcaagaaagcggcgctatcgtggctatgaccggggacggtgtgaatgatgccgtagccctgaaatcagcagatatcgggatcgctatgggccagacgggaacagacgtgtctaaggaagccgccaacatgatactggtggacgatgatttttcagccatcatgaatgcagttgaagaaggaaaaggtatattctataacattaagaacttcgtccggttccagctgtccaccagcattagtgctttgtcattgataaccctgtcaactgtgttcaacttgcccagcccattgaatgccatgcaaatcttgtggattaacattatcatggacggacctccagcgcagcgtagctcgcaaaagacagaggtatgttgcaccgctgttcggctgggggtcgaggggcgtggggaatctacatgggcgggtcgcgccgggctgggggtggaacccgtcgacaaggatgcctttcggcagccacccagaagtgtgcgtgacacaattttaagccgggctctaatcctcaagatccttatgtctgccgctattattatcagcggaacactgttcatattctggaaggagatgccagaggaccgcgcctccaccccgcggacaacgaccatgactttcacatgctttgtgttttttgacttgtttaacgcactcacttgtcggtctcagacaaaactgatcttcgaaattggcttcttgcggaaccatatgttcctatacagcgtgttaggcagcattttgggacaactggcagttatttacatccctccactgcagcgggtgttccagactgagaatttgggtgctcttgacctgctgtttctgaccggattggccagctccgtattcatattatcggagcttctcaaactctgcgaaaaatactgttgtagccccaagagagttcaaatgcatccggaggacgtgtag

SEQ ID NO: 179808 - DNA, 2388 bp, Artificial Sequence
  Description of Artificial Sequence: Synthetic coding sequence
atgcggacccccagcgccagcccccggcagtgcctgagctggagcctgagtccctcctcttccttgcgcgagggcaaactgcagcacctgctggctcgggagctggtgccgggagacgtagttagcctctctattggcgacaggataccagccgacatcagactgacagaggtgaccgacctgctcgttgatgaatccagcttcaccggtgaagctgagccttgtagcaagaccgattcacccctgacgggtgggggcgacctgactactctgagtaacatcgtgttcatgggcacccttgttcaatacggtcgaggacaaggcgtcgtgatcggaaccggtgagagtagccagtttggagaagtgtttaagatgatgcaggccgaagagacaccgaagacaccccttcagaagtcgatggatcggctcggtaaacagttgactctatttagctttgggattattggcctgatcatgctaataggttggtcccaagggaagcagctgctgagtatgttcacgatcggcgtttcactagccgttgccgccatcccagaggggttgccaattgttgtgatggttactctcgtcctgggcgttttgaggatggccaagaagcgcgttatcgtgaagaagctgccaattgtggagacactgggttgctgtagcgttttatgttcggacaagactggcactttaactgcaaacgaaatgacggtgacacagctcgtgacctccgacggtctgagagctgaggtatccggcgtgggttacgatggccagggcactgtctgtctgcttccctccaaggaagtgatcaaagaattcagtaatgtaagtgtcggaaagcttgtggaagctggctgcgtagccaacaatgctgtgatcaggaagaacgccgttatgggccagccaaccgagggggccttgatggcattggccatgaaaatggacctatccgacattaagaattcttacatccgaaagaaggagataccttttagcagcgagcagaagtggatggcagtcaagtgtagcctcaagaccgaagaccaggaagacatttatttcatgaaaggtgcactcgaggaagtgattagatactgtactatgtacaacaatggcggaattcccctgcctctgacaccccagcagaggtcattttgtctccaggaggagaaacgtatgggcagtctgggcctgcgcgtgctggctctggcttccggccctgaactgggaagactaacgtttttgggcctggtaggaataatcgatcccccaagagttggtgtgaaagaggctgttcaagttctctctgagtccggcgtgtcggtaaaaatgatcacaggagacgcgctggaaaccgcactggcaattggtagaaacataggcctgtgtaatgggaagctccaggccatgtctggtgaggaggtagatagcgtggaaaagggggagctcgctgacagggtagggaaggttagcgtttttttccgaacatctccgaagcataagctcaagatcatcaaagccctccaagaatctggtgcgatagtggccatgaccggtgatggcgtgaatgacgcggtggcactgaagtcagctgatatagggatcgccatgggccagaccggcactgacgtatcgaaagaagcggccaacatgatcttagttgacgatgacttcagcgcgattatgaacgcagtggaggaagggaaggggattttttacaacattaagaatttcgtccgcttccagctgtctactagcattagcgcactgtcactgatcacgctaagcaccgtgtttaatctgccttcaccccttaatgccatgcagatattgtggatcaacattatcatggatggtcccccagcacagtccttaggcgtggaacccgtcgacaaagacgcttttcgtcaacccccacgctcagtgagagatactattttaagtagagccctaatattgaagattctgatgtccgctgcgatcatcatctcaggcacacttttcattttctggaaagaaatgccagaagacagggcctccacgccaagaacaacgaccatgacattcacttgctttgttttctttgacctgtttaacgcgttgacatgtcggagccagacgaaactgatctttgagatcgggttccttaggaatcatatgtttctctacagcgtgctaggatccattttaggccaactcgcagtgatctatatccctccgctccagcgagtgtttcagaccgagaatttgggcgcacttgacttactcttcctcactggcctcgctagcagcgtgtttatcttatcagaactgctaaagctttgtgaaaagtactgttgctcaccaaagcgcgtccagatgcacccggaagacgtgtag

SEQ ID NO: 179809 - DNA, 3090 bp, Artificial Sequence
  Description of Artificial Sequence: Synthetic coding sequence
atggaggccgcccacctgctgcccgccgccgacgtgctgcggcacttctcagtgaccgctgagggtggtctaagtccagcccaagtcactggagcgagggagaggtacggcccaaatgagctgccttccgaagaggggaaaagtctgtgggagctggtactcgaacaattcgaggatcttcttgtgagaattctgctcttggcagccctagtctccttcgtgctggcctggtttgaggaaggcgaggagactacgacagcttttgttgagcccctcgttataatgcttatattagtagccaacgcgatcgtgggcgtgtggcaggaacggaatgcagaatccgctattgaagcgcttaaagaatatgaacccgagatgggcaaggtgattaggtctgatcggaagggcgtgcagagaatcagggccagagatattgtgcccggagacattgttgaggtggctgttggggacaaagtgcctgccgatttaagacttattgagatcaagtccaccaccctacgggtggatcagagtatcctgactggcgagtccgtctcagtgactaaacatacagaagcaatcccggacccccgcgcagttaaccaggacaagaagaacatgctttttagcggcaccaacatcacatcagggaaggcggtcggggtagccgtggctactgggctccacacggagctgggtaagattagaagccagatggctgcagtggagccagaacgtactcctctacagcgcaagctcgacgagtttggacggcagctgagccacgctatatccgttatctgtgtggctgtgtgggtcatcaacataggccatttcgcagaccccgcccacggggggagttggctaagaggcgctgtttattactttaagattgcggtcgcactggctgtggccgcaataccagaggggctgcccgcggtgataactacctgccttgccctcgggacgcgtaggatggctcggaagaatgccatcgtcaggtctctgcccagcgtggagacactgggctgcacctcggtgatctgttccgacaaaaccgggacgctcactaccaatcagatgtccgtctgtcgcatgttcgtggttgccgaagctgacgcagggtcgtgtcttctgcacgagtttacaatttctggcacaacctatacccccgagggggaggtgcgccaaggggatcagccagtgaggtgcggacagtttgacggcctggtcgagctggcaaccatctgcgctctgtgcaacgactctgcacttgattataacgaggcaaaaggggtgtacgagaaggtgggcgaagccaccgagactgcattaacctgcctggtagagaaaatgaacgtttttgatacagacctgcaagctctgagtagagtggagcgggctggcgcctgcaataccgtcatcaagcaactgatgcgcaaggagttcaccctggagttttctcgcgacaggaagagcatgtcagtttactgtactccgacacgtccacaccccacaggtcaagggagtaaaatgttcgtcaagggggcgcccgagtccgttatcgagcggtgcagtagtgtgcgtgtgggtagccggaccgctccacttacaccaacttccagagaacagatactcgccaaaatccgcgactggggatctgggtccgatacactccgatgcctcgcactggcaactcgggacgccccacccagaaaagaggatatggagctggatgattgttccaaatttgtccaatatgagacagatctgaccttcgtcggttgtgtagggatgctagatccacctagacccgaagttgcggcctgtatcacccggtgctatcaagccggtattcgggtggtcatgataacgggcgataacaaaggcactgccgtagcaatatgccgccggctgggcatattcggagacacagaggacgtcgctggcaaagcgtatacgggtcgcgagttcgacgacctgagccccgaacaacagagacaggcctgcaggaccgcccgatgcttcgcaagagtcgaacctgcccataaaagtcggatcgtggaaaatctgcagtctttcaacgaaattaccgccatgactggagacggggtaaatgacgccccggccctgaagaaagctgaaattggcatagccatgggttctgggactgccgtcgctaagtccgccgccgagatggtactcagcgatgacaattttgcaagcatcgtcgcagccgtggaagaaggccgggccatttacagcaacatgaagcagtttataagatacctgatttcctctaatgttggggaagtagtttgtatctttcttactgcaattttaggcctgccagaggccctgattcctgttcagctgttatgggttaatctagtgacagacggtctgccagctacagctctcggcttcaacccccccgacttggatatcatggagaaacttccacgcagcccgagggaagccctcattagcgggtggctgttctttcgatacttggccatcggagtctatgtcggtctggctaccgtcgccgccgctacttggtggtttgtgtacgacgctgagggccctcacataaacttctaccagctcaggaatttccttaaatgtagcgaggacaaccctctgtttgcagggatagattgcgaagtttttgagtctagatttccgaccaccatggccctgagtgtgcttgtgaccattgagatgtgcaatgctctgaacagtgttagtgagaatcaaagccttttgcgtatgccaccctggatgaacccttggctactggtggccgtggcaatgagcatggctctgcactttctgattctactagtcccgcctctacctctaatcttccaagtaactccccttagcggccgtcaatgggttgttgttctgcaaataagtctcccggtgattctactggacgaggccctgaaatacctctcaagaaatcatatgcatgcttgcctctaccccggactgctccggaccgtgtctcaagcctggtctcggcagcctctgactacttcctggacccctgatcacaccggattggcttcgctgaagaagtag

SEQ ID NO: 179810 - DNA, 3132 bp, Artificial Sequence
  Description of Artificial Sequence: Synthetic coding sequence
atggaggccgcccacctgctgcccgccgccgacgtgctgcggcacttctcagtgaccgcggaaggaggtcttagccctgcgcaggtgaccggggcacgagaaagatatgggcctaacgaactgccatcagaggaaggaaaaagcctgtgggagctggttctggagcaatttgaggacctgctggtgagaatcctgctgttggccgctcttgtgagctttgtgctcgcttggtttgaagagggcgaggaaacaacaacggccttcgtcgagcctctcgtcataatgttaattctggttgcaaatgcaattgttggcgtatggcaagagagaaatgccgaaagcgccatcgaagctctcaaagaatacgagccagagatgggtaaagtgattagaagtgacagaaagggtgttcagcgaattcgcgcgcgggacattgtgccgggagacatcgttgaggtcgccgttggagacaaagttcctgccgacctgcgcttaatcgaaataaagtcgactaccctgagggtggatcaaagcattctcaccggcgagtctgtgagcgtgactaaacatactgaggcaattcccgacccgcgggccgtgaatcaggacaagaagaatatgctcttcagtggcacgaacattacttccggcaaggccgtgggagtagccgttgcgaccggactgcatacggaactggggaaaatcaggagccagatggcagccgtggaaccagagcgcacccccctccagaggaagctggacgaattcggccggcagctctctcacgcaatttcggtcatttgcgtggcagtttgggttattaatatcggccactttgctgaccccgctcacgggggatcctggctgcggggggccgtgtactatttcaaaatcgccgtggcccttgctgtcgccgcgattcccgagggtctccctgcagtgattactacatgcctggccctgggcacgcgccgcatggccagaaagaacgccatcgtcagatctcttccgtccgtagagacactgggatgtacctcagttatttgttctgacaaaaccggtacactgacaacaaaccagatgtcagtgtgccgaatgttcgtggtggctgaggcagatgccggttcctgcctgcttcacgagtttactatcagcggtaccacatacacacccgagggggaggtgcgacaaggagatcagcccgtacggtgcggtcagtttgacggcctcgtggaactggctaccatttgcgctctgtgcaacgacagtgcccttgattacaatgaggcaaaaggagtttacgagaaagtgggtgaagctaccgagactgcactgacatgcctagtggagaaaatgaacgtgttcgatactgacttacaggccctgtcacgggtggagcgtgccggggcctgtaacaccgtaattaaacagctgatgaggaaggaattcacgcttgaattctctagagaccggaagtctatgtcagtatattgcactcccacgcgacctcaccccactggtcagggctcgaagatgtttgtaaagggggctcccgaaagcgtcatcgaacggtgcagttccgtgcgcgttggcagtagaaccgcccctctgactcccacgtcccgcgaacagatactggccaaaattcgggattggggatctggctccgacactcttcgatgtctggcgttggccacacgtgatgcccctccaagaaaggaagacatggagttggatgattgttccaaattcgttcaatacgagacagatctgaccttcgtgggctgcgtgggaatgctggacccccctagacccgaggtagccgcctgcattacacgctgttaccaagccgggatcagggtggtgatgatcacgggggataacaagggaactgctgttgcgatttgtcggaggctgggaattttcggggatactgaggatgtggccggtaaagcatataccgggcgggagtttgacgatctgtctccagagcagcaacgacaggcttgccgaactgcccggtgtttcgcacgagtggaaccagctcacaagagcagaatcgtagaaaatctgcagagctttaacgagattaccgcaatgactggcgatggtgtcaatgatgcacctgcgctgaagaaggcggaaatcggcatcgcaatgggcagcggaacagccgttgctaaaagcgctgcagaaatggtcctgtctgacgataacttcgcttccatcgtggccgcggtggaggagggcagagccatctacagcaatatgaaacagtttattaggtatctaatttcatctaatgttggggaggttgtatgcattttccttacggccatccttggcctgccagaggctctgattccagtacaactcctgtgggtgaacctggtgacagacggcctgcctgcaactgccttggggtttaatccgcccgacctggatattatggagaaactgccccgttcaccccgcgaagcattgatttccggatggctgttctttcgctatctcgccatcggcgtctatgtcgggctcgctacagtggcagctgcgacttggtggttcgtctacgatgctgagggacctcacataaatttttaccagttgcggaatttcttaaaatgtagtgaggataatccattgtttgccggtattgactgcgaggtgttcgagagcagattcccaaccactatggcactcagcgtcctcgtcacgattgaaatgtgcaatgctctgaactccgtgtccgaaaaccagagccttcttcgcatgcccccttggatgaacccctggttgctggtcgccgtggctatgagcatggctctgcactttctaatccttttagtaccacctctccctcttatctttcaggttacgcccttgtctggtcggcaatgggttgtggtgctgcagatttctctgcccgtaatcttactcgacgaggccctgaaatacctctctagaaaccacatgcatgcttgtttgtatccggggctgctaagaacagtatctcaggcttggagccgtcaacctctgaccacaagctggactccggaccacacagggcgcaacgagcccgaagtgtctgctggaaatcgcgtagagtcaccagtatgtacatcggactag

SEQ ID NO: 179811 - DNA, 3159 bp, Artificial Sequence
  Description of Artificial Sequence: Synthetic coding sequence
atggaggccgcccacctgctgcccgccgccgacgtgctgcggcactttagcgtgacggcagaaggcgggctcagtcccgcccaggtaacgggcgcccgggagcgttatgggcctaacgaactgccttcggaggagggaaaaagcctgtgggagctggttctcgagcagtttgaggacttactggtgaggatattactcctcgccgcgcttgtgtcctttgtcttagcttggttcgaagagggcgaggagacaacgacggcattcgtcgaacccctggttatcatgctcatccttgtagccaacgccattgtcggtgtttggcaggagagaaacgccgagagtgccattgaggctctgaaggagtacgagcctgagatgggcaaggtcataaggtcggatcgtaaaggagttcaacgtatccgggcacgcgacatagtcccaggcgatatcgtggaagtggccgtgggcgataaagtgcctgccgacttgagactgatcgagataaagagcacaacacttcgtgtagatcaatctatactgacaggcgaaagcgtatcagtgacgaaacacacagaggcaattccagaccccagagctgttaatcaggataagaagaacatgctattctccggcaccaatatcacgagcggcaaggcagtcggcgtggcggtggcaaccggcctgcacactgaactcggaaaaatcagatctcagatggccgctgtcgagcccgagcgaacgcccctgcagagaaaactggacgaatttggtcggcaactatctcacgccatcagtgtgatatgtgtcgcggtttgggtgataaacatcggacactttgctgatcccgcccacggtgggtcctggctgcggggagctgtctactatttcaagatcgcggtggccctggcagtagccgcaatccccgaaggattgcccgccgtgataactacttgcctggccctaggaactcggcgcatggctagaaagaatgcaatagtcagaagtctcccatccgtggagaccctgggctgcacctccgtcatatgctctgataagaccggaacattgaccaccaaccagatgtcagtgtgtaggatgtttgtcgtggccgaggctgatgccggaagctgtttgctgcacgaatttactatttccgggactacttacacccctgagggggaagtcaggcagggggaccagccagtgcggtgcggacagtttgacggattggtggagctggctactatctgtgcgttatgtaatgactcagccctggactataatgaagctaaaggggtttacgaaaaggttggtgaagccacggagacagcgttaacttgcctggtcgagaagatgaatgtattcgataccgatctgcaggctttatctagggtggaacgagctggcgcctgcaatacagttatcaagcagctgatgaggaaggagtttacccttgagttttctcgggatcgcaagtcaatgtccgtgtactgcacaccaacaaggcctcatcctaccggtcagggtagcaagatgttcgttaagggcgcccccgagtcagtcattgagcgctgttcgtcagtgcgggtgggatcgaggactgcccccctcacccccacaagtagggagcagatactcgctaaaatcagagattgggggtcgggatctgataccctacgatgtttggctctggcaacccgggatgccccacctcggaaggaagatatggagttagatgattgttctaagttcgtgcagtacgagacagacctcaccttcgtcgggtgtgtaggaatgctcgatccacccagaccagaagtggcagcctgcatcacacgctgctatcaggccggaattcgcgtcgtcatgattaccggggacaataaggggacagcagtggccatctgcaggcgcctcggcattttcggggacaccgaggacgtcgcaggcaaagcctacacaggacgggagttcgatgatctgagcccagagcagcaaagacaggcctgccggacagcaagatgcttcgccagagttgaaccagcccacaaatcgcgcatagtggagaaccttcaaagcttcaatgagataacagcaatgacaggtgatggtgtgaacgacgccccggcactgaagaaagccgagattggtattgccatgggcagcgggacagccgtggccaagtcagcagcagagatggtgctttctgatgataacttcgccagcatagtcgctgcagttgaagagggacgggccatatattctaatatgaaacagtttattcgttacctgatctcctctaatgtgggggaagtcgtgtgcattttcctcacagccatacttggtctcccggaagctctgattccagtgcaactcctgtgggtgaacctcgtgactgacggtctgcctgcaactgctctcggcttcaaccctccagatttagacatcatggagaagctgccccggtcccctcgggaggctctcattagcggatggttattttttcgatatcttgccattggagtctatgtcggtttggccacagtcgccgccgccacctggtggtttgtgtatgacgcggagggtccccacataaacttctatcagctgagaaactttctgaaatgctccgaggataaccccttgtttgcaggcatagactgcgaggtattcgagagcagattccccactactatggccttgtcagtgctcgttacgatcgagatgtgtaacgcgctgaactccgtgtccgaaaatcagagtctgctgcggatgccgccctggatgaatccatggctgctcgtggctgttgccatgagtatggcccttcactttctgatactcctggtcccccccctgcctctgatattccaggtgactcccctttctggtaggcagtgggtggtggtgctgcaaatttcattaccagtgatcctgcttgatgaagcacttaagtacctgagccggaatcatatgcacgcctgtctgtatcccgggctcctgcgcaccgttagtcaggcttggtctcggcaacccctgaccacttcatggactccagatcacacagggctggcctccctcgggcaaggccattctatcgtctccttgagtgaattactccgcgaagggggctcgcgcgaggagatgtctcaaaagtag

SEQ ID NO: 179812 - DNA, 3090 bp, Artificial Sequence
  Description of Artificial Sequence: Synthetic coding sequence
atggaggccgcccacctgctgcccgccgccgacgtgctgcggcacttctccgtgacagcagagggcggcctctcaccagctcaagtaactggcgcccgggaacgctacgggccaaatgagctacccagtgaggaaggaaagagtttgtgggaactcgtcctggagcagtttgaagatcttctcgtccgcatcctcctgctggcagccctggtatcatttgtcctcgcatggtttgaggagggcgaagagacaacaacagctttcgtggagccccttgttatcatgctgatcctggtagctaatgcaatagtcggagtgtggcaggagaggaatgccgagtcagctattgaggccttgaaagagtatgagccagaaatgggtaaggtaatccgatccgacaggaagggtgttcagaggattcgggcccgtgacattgtaccgggggatatcgttgaggtcgccgtaggagacaaggtgccagccgatctccgcttaatcgagataaaatccaccaccctgcgagtggatcagtctatcttaactggtgagtccgtcagtgtcacgaagcatactgaggctattcctgaccctcgtgctgtgaatcaagacaagaaaaatatgctgttttccggaactaatatcaccagtggtaaagcagtgggcgtcgctgtggctacgggccttcacacggaactggggaagatccggagccagatggccgccgtggagcccgagcgtacccccctgcagagaaaacttgatgaattcggtagacagctttcgcacgctatcagcgtcatttgcgttgctgtgtgggtaatcaacattggtcatttcgccgaccctgcccacggcggctcctggctgcggggggccgtgtattactttaagatcgcagtggcgctagccgtcgcggcaatcccagagggactgcctgcagtcatcaccacctgtctggccctgggcacacgacgcatggctcggaagaatgccatcgtacgttctcttccttcagtggaaacactcgggtgcaccagcgtgatttgctcggataaaaccggaacactcacgaccaatcaaatgagcgtatgcaggatgtttgttgtggccgaagctgacgccggatcctgtctcctccacgagtttaccatatctggaaccacttatacacctgagggcgaggttagacaaggagatcaacctgttcgctgcggccaattcgatggactggtcgagctggcaacaatatgcgctctgtgtaatgactcggccctggactataacgaagcaaaaggagtgtacgaaaaggtgggggaagcgacagagaccgctttgacatgtctcgtggaaaaaatgaatgtttttgatacagacctccaggccctgtcacgggtggagcgagcgggcgcctgtaatacggtgattaagcagcttatgcggaaggaatttaccctagaattcagcagggatcgcaagtctatgtccgtgtactgtactcccacaagaccccacccaaccggacagggctccaagatgttcgtgaaaggcgctccggagtccgtgatcgagagatgttcctccgtgagggtgggcagtagaactgcaccactgactccaacatcaagggagcagattttagctaagatacgggattggggaagtggttccgatactctgcgctgtctcgccttagccacacgtgatgccccccctagaaaggaagatatggaattggacgattgctcaaagttcgtgcagtatgagactgacttgaccttcgtgggttgtgtcgggatgttagatccccctaggcccgaagttgccgcgtgtataacccggtgctatcaggcaggcatacgagtcgtcatgatcaccggtgacaacaaaggcaccgccgtcgccatctgccggcgtctggggatctttggcgacaccgaagatgtggccggtaaagcatatacagggagggaattcgatgacctgtctcccgagcagcagagacaggcgtgccgtacagccaggtgtttcgcccgtgtagagcccgctcataagagcaggattgtcgagaatctccagtctttcaacgagattacagctatgaccggagacggagttaacgatgcccccgctctgaagaaagcggagatcggcatagccatgggctcgggaactgctgttgcaaagagcgccgccgagatggtgctgtcagacgacaattttgccagtatcgtcgcggccgtagaggaaggccgcgctatttatagcaatatgaagcagttcattcgctacctgatcagctcgaatgtcggggaggtggtgtgtatttttcttaccgcaatcttggggctgccagaagccctgatccccgtgcagctgctgtgggtcaatttggtgacagatggcctcccagccacagctctcggcttcaacccacctgatctggacatcatggagaaacttcctcgctcacctcgggaagccttgatcagcggatggctctttttcaggtacttggctatcggcgtgtacgtggggctggccactgtggcagccgctacctggtggttcgtctatgatgccgagggaccacacataaacttctatcagttaaggaattttctcaaatgtagcgaagacaaccccctgttcgccggcatagactgcgaagtatttgaatcccgcttccctactactatggcactgagcgtgctcgttactatagagatgtgcaatgcgctcaattctgtgtcagaaaatcagagtctcctgaggatgcccccctggatgaacccgtggctgctggtggcagtcgccatgagcatggcattgcattttctgatccttctggtgccacctctacccctgatctttcaagtcactccgctgtccgggcgccagtgggtggtagttctgcagatcagcttgccagtcatacttctggacgaagccctgaagtatctgagcagaaaccacatgcacgcctgcttataccccggccttctcaggaccgtttcacaggcctggagccggcagccactgacaacctcttggacgccggatcacactggattagcctctcttaagaaatag

SEQ ID NO: 179813 - DNA, 651 bp, Artificial Sequence
  Description of Artificial Sequence: Synthetic coding sequence
atggagaagctgccccggagcccccgggaggccctgatcagcggctggcttttctttcgatacttggccatcggtgtctatgtgggactggctaccgtagccgccgctacctggtggtttgtctatgatgccgagggccctcatattaacttctaccagttacgaaatttcctcaaatgctctgaagacaatcccttatttgccggaatcgattgcgaggtcttcgagtcacggttccccaccacaatggccctctccgttctggtgactattgaaatgtgtaacgcactgaactctgtctccgagaatcaatctttgttgagaatgcctccctggatgaatccgtggctgctggtggctgtagcgatgagcatggcattgcattttctgatactgctggtgcccccccttcccttaatctttcaggtgacccctctgtcgggtaggcagtgggtagtggtgctgcagatcagtttgccggtgattttgctggacgaggcgcttaaatatctctctcggaaccacatgcatggaccaggaacacagcatcggctcgcggtcagagctgctcaacggggtcgcaagcaggggcgaaatgagcccgaggtatcggcagggaatcgagtcgaatctcccggccccggcgggtag

SEQ ID NO: 179814 - DNA, 3000 bp, Artificial Sequence
  Description of Artificial Sequence: Synthetic coding sequence
atggaggccgcccacctgctgcccgccgccgacgtgctgcggcacttttccgtcaccgcggaggggggcttgagccctgcccaggtcactggtgcgcgggaaaggtacgggcccaatgagttaccctctgaagaagggaagagcttgtgggagctagtacttgaacagtttgaagatctgttggtgcggatcttgctcctagctgcgcttgttagctttgtgctcgcctggttcgaggaaggcgaggagacaaccacagcttttgttgaaccactagtgataatgctgattctggtggccaatgctattgttggtgtctggcaggaacgcaacgctgaatcagcaattgaagctctgaaagagtacgagcctgaaatggggaaggtcatccgctcagacaggaagggcgtacaacgcattagagcccgagatatagttcccggagatatcgtcgaggtcgctgtaggcgacaaggtacccgccgatctgagactgattgagattaagagcacaactctccgcgtcgatcagtcaatcttaacaggggagtccgtcagcgtgactaagcacacggaggcaatccccgatcctagggctgtgaatcaggataagaagaatatgctgtttagcggcacaaacattacgtctggcaaggctgtcggagtcgccgtagctacaggcttacacacggagttggggaaaattcggagtcagatggctgccgttgaacctgaacgcacccccctgcagcggaaattggacgagttcggccggcagctttcccacgccatcagtgtcatatgtgtggccgtttgggtcatcaatattgggcatttcgccgacccagcccatggaggaagctggctgaggggcgcagtgtactattttaaaattgctgtggctctggctgttgcagctatccccgagggcctgcctgcagtgatcaccacgtgtctcgctctgggtacacggcgcatggcaaggaaaaatgccatcgttaggtcactccctagtgtcgagaccctcggatgtacctctgttatttgcagcgacaaaaccggcactttaaccaccaatcaaatgagcgtctgtcgcatgtttgtggtcgccgaggccgacgctgggagctgcctgttgcacgaatttactatatccggtacaacgtacacgcctgaaggagaggttcgccagggcgaccagccggtcaggtgcggacagttcgatgggttagttgagctggccaccatctgtgctctttgcaatgatagtgccttagactataacgaggctaagggcgtgtacgagaaggtgggagaggctacggaaacggcactgacttgtctggtggagaagatgaatgtctttgacacagacctccaagcactttcgagggtggaacgggcaggggcctgtaatacagtgatcaaacagctgatgcgcaaggaatttacacttgagttcagccgagataggaagtctatgtccgtttattgcacccctactaggccacacccgactggccagggaagcaagatgtttgtgaagggcgcgcccgaatctgtgattgagcggtgctctagcgttagagtaggcagtcgtaccgctccgctgaccccgacttctagggaacagatccttgcaaagattagagactgggggagtgggagcgatacgctccgatgcctggcgttagctacccgggatgcacctcctcgaaaggaagacatggagctagatgactgctccaaattcgtccaatacgaaaccgaccttacttttgtcgggtgtgttgggatgctcgacccacccaggcccgaagttgctgcctgtataacccgctgctaccaggcaggcattcgggtagtgatgatcactggagataataaaggcacagcggtggccatctgccgcagactgggaatttttggcgacactgaagatgtggccgggaaagcttacaccgggcgagaatttgatgacctaagccctgaacaacagcggcaggcttgtaggactgccagatgttttgcgcgcgtggagccggctcataagtcgcgcattgtagaaaatctgcagtcttttaatgaaataaccgctatgacaggcgacggcgtgaacgatgcacctgctctcaagaaagcagaaatcggtatcgccatgggctccggcactgccgttgctaaaagcgccgcggagatggtccttagcgatgacaactttgcctccatcgttgcagctgtcgaggagggacgggctatctacagcaacatgaagcaattcattcgctacctcattagtagcaacgtcggagaagtcgtatgcatcttcctaacagcaattctggggctccccgaagcgttaatccccgtgcaactactttgggtgaatctggttaccgacggattaccagctactgccctggggttcaacccacctgatctggacattatggaaaaactgccaaggtcaccacgggaggccctcatcagcggatggctgtttttccgctacttggctataggggtgtatgtgggccttgccacagtcgctgccgccacgtggtggtttgtctatgatgcagagggccctcacattaacttctatcaactgaggaattttctgaagtgcagcgaggacaacccactgttcgcaggtatcgattgcgaagtgttcgagtcacgttttcctaccacaatggccctgtcagtcctcgtgaccatcgagatgtgcaacgctctgaacagtgtctctgaaaaccagtctctgcttagaatgcccccctggatgaacccatggctgttggtggctgtggctatgtccatggccctgcacttcctcatccttctcgttccaccgctgcccctgatattccaagtgacaccactcagcggtcggcaatgggtggtggtcctgcagattagcctaccagtcatcctgctcgatgaggctctcaagtatctgtcgcgcaaccatatgcatgaggaaatgtcacaaaaatag

SEQ ID NO: 179815 - DNA, 2997 bp, Artificial Sequence
  Description of Artificial Sequence: Synthetic coding sequence
atggaggccgcccacctgctgcccgccgccgacgtgctgcggcactttagtgtgactgccgaaggggggctgtctcccgcccaggtgacgggagcaagagaacgatatggaccgaatgagttgccatcagaagaggggaaaagcctgtgggaactcgttttggaacagtttgaagatcttctcgttcggattttgctccttgccgccctggtaagctttgtgctggcatggttcgaagagggcgaggaaacaacaaccgctttcgtggaacctttggtcatcatgctcatcctggtggccaatgcaattgtaggagtctggcaggagcgtaacgcagagagcgctattgaagctctgaaagagtatgaacccgaaatgggcaaggtcatcaggagcgaccgaaagggagttcaacgaattcgcgcaagagatatcgttcctggagacattgtggaggtcgccgtcggtgataaggtacccgcggacctccggctgatcgagatcaaatcgaccaccctgcgggtggatcaatctatcctgactggggagagcgtgtctgttactaagcatacagaggctattcccgacccaagggccgtgaaccaagataagaaaaatatgctattctcgggtaccaatataacctctggcaaggcagtcggcgtggctgtagccactggtttgcataccgagctgggtaaaatccgcagccagatggccgctgtagaaccagagcggacacccctacagagaaagttggatgaattcggcagacagctgtctcatgccatttcggtcatctgcgtagcagtctgggtcatcaacatcggtcattttgctgatcctgcccacggaggaagctggcttagaggggcagtgtactattttaaaatcgccgtcgccctggccgtcgccgcaattccagaaggcctccctgcagtgataactacatgcctagccttaggcacaaggagaatggcacggaaaaatgccatcgtccggagcctccccagcgtcgagacccttggttgcaccagcgtgatctgttctgacaaaaccggcaccctcaccaccaatcagatgtcagtctgccgaatgttcgtggtcgccgaagcagacgccggctcatgtttgctccacgaatttaccattagtggtactacatatacccccgagggggaggtcagacagggcgatcaaccagttagatgtggacagttcgacggacttgtcgagcttgccaccatctgtgctctgtgtaatgattctgcactggactacaacgaggctaaaggagtttacgagaaggtaggcgaagcgacagaaaccgccttaacctgcctagtggagaagatgaatgtgttcgacaccgatctgcaggcgctgagtcgcgtcgaaagggccggagcctgtaatactgttattaaacagctgatgcgaaaggagtttaccttggagttttcaagagatagaaagtcgatgagtgtgtattgtacaccaactcggccccacccaacaggccagggaagtaagatgtttgtcaaaggcgcccctgaatcagtgatcgaacgctgtagcagcgtgcgggtcggtagcagaactgcaccactgacacccacaagcagagaacaaatactggcaaagattcgggattgggggtcaggtagcgatacattacggtgtcttgccctcgcaacacgcgacgcaccaccgcgcaaggaagatatggagctcgatgactgctccaaatttgttcaatacgaaacagatctaacctttgtggggtgtgttggaatgttggaccctcccagacctgaggtggctgcctgtatcacacggtgctatcaggccgggattcgagtggttatgatcactggagataataagggtaccgccgtcgccatctgccgcaggctggggatctttggtgatactgaggacgtagctggaaaggcctacacaggaagggaattcgatgacctctctcccgagcagcagcgccaggcctgcagaacggctcgatgcttcgccagagtggaacctgcccacaagtcccggatcgtggagaacttgcagtcctttaacgagattacagccatgactggggacggtgtgaacgatgctccggccctgaagaaggccgaaatcggaattgctatgggatcaggaacggccgtagccaagtctgcagccgagatggttttatcggatgataatttcgctagcattgttgccgctgtcgaggaagggagagcaatctattccaatatgaagcagttcatcaggtacctgatctcaagcaacgtaggggaggttgtttgtatattcttgaccgccattctgggcctgcctgaggcacttatccctgtacaacttctgtgggtgaatttggttactgatggtctgcctgccactgcattaggatttaatccaccagacctagacattatggaaaaactaccaaggagtcctagagaagccctcatatctggctggctctttttcagatacctcgctattggagtgtacgtggggctggccacagtagccgctgcaacatggtggtttgtgtacgacgccgaaggcccacacattaatttctatcagttgagaaacttcctgaagtgttcagaggacaatcctttattcgctggtatagactgcgaagtcttcgagtctcgctttccaacaaccatggcactgagcgtcctagtgacaattgagatgtgcaacgcccttaatagcgtaagtgagaaccagtcacttttacgaatgccaccctggatgaatccgtggctcctcgtagctgttgcgatgagtatggccctgcattttctgattctgctggtgcccccccttccactcatcttccaagttacgccattgagcggaagacagtgggttgtcgtgctacagatctccctgccagtgatcctgttagatgaggccttgaagtacctgagtagaaatcacatgcacggccatacccagtcctag

SEQ ID NO: 179816 - DNA, 2997 bp, Artificial Sequence
  Description of Artificial Sequence: Synthetic coding sequence
atggaggccgcccacctgctgcccgccgccgacgtgctgcggcactttagtgtgacagcggaaggcggactcagtcctgcgcaggtgacgggagcacgagaacggtatggccctaacgagctcccctccgaagagggcaagtccctgtgggagctggtactagaacaattcgaagatctgttggtcagaatactcttactagcagccctggtgagtttcgtccttgcatggttcgaagagggcgaggagacgacgactgcattcgtggagccgctggtcattatgcttattttggtggctaatgcgatcgtgggagtctggcaggagcggaatgctgagtctgctatcgaagctctcaaagagtacgaacccgaaatgggtaaagtgattcggagcgaccgcaagggagtgcagaggatacgcgccagggatatcgttcctggcgatatcgtcgaggtggctgtcggagacaaggtgcccgccgacctcagactaattgaaattaagagcaccaccctgagagtcgatcagtcaatcctcaccggggagtcagtaagcgtgaccaagcataccgaggctattccggacccacgcgcagttaatcaggataagaagaacatgctctttagcggcacaaatatcaccagcggtaaagctgtcggtgtagccgtggccacaggcctacacacagaattagggaagatcaggtcacagatggctgccgtggagcccgagaggacacctctccagaggaagctcgacgaattcggccgccaacttagtcatgctatctccgttatttgtgtggccgtgtgggtgatcaacattggccactttgcagatcccgcccatggcggaagttggctgcgcggtgcggtttactactttaagatcgccgtggctctggctgttgcggctattcctgaaggacttcccgcagtcattactacatgtctcgctttggggacccgccgtatggctagaaagaatgccatcgtgcggtctttgccttccgttgaaactctcgggtgtacttctgttatttgttccgataaaacaggcacgttgaccaccaaccagatgtctgtgtgtcgcatgtttgtagtcgctgaagccgatgctggctcctgtttactacacgagtttacgatcagcggcactacttatacaccagagggagaggttcgacagggcgatcagccagtccgatgcgggcagttcgacgggctggtggagctcgctactatttgtgccctgtgcaacgactctgctctggactacaacgaagctaagggagtgtacgagaaggttggcgaagcaacagagaccgcactgacatgccttgtggaaaagatgaacgtgttcgacacagacctgcaggctctgtcccgcgtggagcgggccggagcttgtaacacagttattaaacagttaatgaggaaagagttcacactggagttttctagggaccgcaagagcatgagtgtctattgcactccaactaggccccaccctaccggccaggggtcgaagatgttcgttaagggggcccccgagagcgtgatcgagaggtgtagtagtgtccgcgtgggcagccggacagctcccctgactccaacttctcgggagcaaattctcgcgaagataagagattggggctctgggagtgataccctgcgatgtctggctctggcaaccagagatgctcctccacgtaaagaggacatggaacttgatgactgttccaagtttgtgcaatatgagaccgaccttacttttgttggctgtgtcggaatgttggatcccccccgaccggaagtcgccgcctgtattaccagatgttaccaggcgggcattagagttgtgatgattactggcgacaataagggaaccgccgtcgccatctgtcgacggcttggtatctttggcgacaccgaggatgtagcggggaaagcatacaccgggcgggagttcgacgatctctctcctgaacagcaaaggcaagcctgtcgtaccgcgcgctgctttgcccgcgtggaacctgcccacaaatctcgaatcgtggagaatctgcaatcctttaacgagatcacagcaatgacaggtgacggcgtcaacgacgcccccgctctcaagaaggcggaaattggtatcgccatgggaagcggcacagcagtagctaagagtgctgccgaaatggtgctctctgatgataatttcgcatccatcgtcgcagccgtagaggaaggacgcgcaatatacagtaacatgaaacagttcataagatacctcatcagctccaatgtcggcgaagttgtatgtatctttctgactgctatcctgggactcccagaggcactgatcccggtgcagcttctgtgggtgaacttggttaccgacggtctgcctgcgactgccctcggttttaaccctcccgacttagacattatggagaagctgccgagaagcccaagagaggctctcatcagtggctggctcttcttccgctacttggccatcggggtctatgtgggactggccacagtagctgctgcaacttggtggttcgtgtacgacgcagagggcccacatatcaacttttaccagcttcggaactttctgaaatgtagcgaggacaatccgttattcgctggaatcgattgcgaggttttcgaatcaaggtttcctacaaccatggctctgtctgtcctggttacaatcgagatgtgcaacgccctgaactcggtgagcgagaaccagtctctcctccggatgcccccctggatgaatccttggctgttggtcgcagtggcaatgagtatggccttacatttccttattctgcttgtgccccctctacctctgattttccaagtgacaccgctttccggccgacagtgggtggttgtgctgcagatcagcctcccggtgattctcctggatgaagctttgaagtatctgtcccgcaatcacatgcatgagatgtcccaaaagtag

SEQ ID NO: 179817 - DNA, 1386 bp, Artificial Sequence
  Description of Artificial Sequence: Synthetic coding sequence
atgaccgtgcccaaggagatgcccgagaagtgggcccgggcccaggccccaccgtcctggtcgcgcaaaaagcctagctggggtacagaggaggagagacgggcccgggctaatgacagagaatataacgaaaaatttcagtatgcctccaactgcatcaaaacctcaaagtacaatattctcacctttctgcctgtaaacctgtttgaacaatttcaagaggtcgccaacacatacttcctcttccttcttatactgcaactgattccgcagattagctctcttagctggtttacgacaatcgtgcccctggtccttgttctgaccatcactgcagtcaaggatgctaccgacgattattttcggcataaatctgataaccaggtaaataatcgccagtcccaggtcctcatcaatggcatcctccagcaggagcagtggatgaacgtgtgcgtgggtgatataattaagctcgaaaacaaccagttcgtggccgcggatctactcctgctgagcagcagtgagccacacggattgtgctacattgagactgctgaactcgacggtgagacgaatatgaaagttaggcaggccattcccgtgacttccgagctgggggacatctctaagctggcaaagttcgacggggaggtaatttgcgagccccctaataacaaacttgacaagttttcgggcaccctgtactggaaggagaacaaattccctctatcaaatcagaacatgctactcagaggctgcgtgctgcggaatacagagtggtgtttcgggttagtaatcttcgcgggccccgacactaagctgatgcagaattctggccgaaccaagttcaaacggactagtattgatagactgatgaatactctggttttatggatctttggctttttagtgtgtatgggtgtaatactcgcaattggcaacgcaatatgggagcatgaagtgggtatgcgcttccaggtctatttgccatgggatgaagcagtcgattccgcattcttctccggcttcctttcgttctggtcttacatcatcatactcaatacagtcgtccccatctccctttatgtttctgtagaagtcatccgcttgggtcattcttacttcatcaactgggataagaagatgttttgtatgaagaaaagaacacctgctgaggcccgtaccactaccctgaacgaagaactgggccaagttgagtatatcttctccgacaaaacaggcacgctaactcagaacattatggttttcaataagtgctccatcaatggccactcttacgtgggctccgagggtcccaggagaaaggggccctcatggcccggtactgtggcccatgcttattctcatagtaccctgggagggtag

SEQ ID NO: 179818 - DNA, 1164 bp, Artificial Sequence
  Description of Artificial Sequence: Synthetic coding sequence
atggccgtgtgcgccaagaagcggccccccgaggaggagcggcgggctcgagctaacgatagggaatacaacgaaaaattccagtacgcttctaattgtattaagaccagcaaatacaatattctcacattcctgcctgtgaacctgttcgagcagttccaggaggtcgccaatacatactttctgtttctgctgattttacaattgattccccagatctcatctctgtcatggttcacaactatcgtccccctcgtgttggttcttaccattacagccgtgaaagatgcaactgatgactacttccgtcacaagagcgacaatcaggttaataacaggcagtcccaggtgttgatcaatggaatcctccagcaagagcaatggatgaatgtctgcgtgggggacatcattaagcttgagaacaatcagttcgtggccgcggacctccttctcttgagctcaagcgaaccccacggcctctgttatatcgagacagccgagttagatggcgaaaccaacatgaaggtgagacaagccattcccgtgacgtccgaactgggcgacatctccaagctggctaagtttgatggagaggtgatttgcgaaccacccaacaacaagctggataagttttcaggtaccctttactggaaggaaaacaaattccctttatccaaccagaatatgctccttagagggtgcgtgcttcgtaacactgagtggtgctttgggctggtcatatttgcaggccccgacactaaacttatgcagaattccggtcgtaccaaatttaagcgcacttctattgataggctaatgaacaccctggttctgtggatttttggattcctggtctgtatgggtgtcatcctggccattgggaatgcgatttgggagcatgaagtaggaatgcggtttcaggtttatctgccctgggatgaagctgttgactcagcctttttctcgggcttccttagtttttggtcctacatcattattctcaacactgtagttccgatatctctgtatgtacggtacgtgccgagcctcacctggggcctgagccgcgaatccggggggcctatcgagctttttttcagtatgaagatgaagagcctgaggtcaaatgaaaagtccagttcctcttgcactgtcaatatctag

SEQ ID NO: 179819 - DNA, 3672 bp, Artificial Sequence
  Description of Artificial Sequence: Synthetic coding sequence
atggacaccctgcgggccgtgcccctgttcagcatcagcggcctgttttccttcccttatagagtttcacacgggatcgctgggattttacttggagaaatggccgtctgcgctaaaaagagaccaccagaggaagaaaggcgcgcacgcgccaacgaccgggaatataatgagaagttccagtatgctagtaactgtatcaagacaagcaaatacaatatcctgactttcttgccagtgaatctgtttgagcagtttcaggaagtggctaacacgtactttctgttcctgctgatacttcaattgattccccaaatttctagcttgtcatggttcacaaccatagtgccgcttgtgctggttctcacaattaccgcggtcaaggatgcaacagatgactatttccgacataagtcagataaccaggtgaataatcgccagtcacaggttcttattaacgggattctccagcaggagcagtggatgaacgtatgcgtgggcgacatcatcaagctcgagaacaatcagtttgtggctgctgacctgcttctactgagcagctctgaaccgcatgggctctgttacatagagactgccgagctggatggggagaccaacatgaaagtaagacaagcaatcccagtgaccagtgagttgggtgatatcagcaagctagctaagttcgacggagaagtcatttgcgagcctccaaacaataaactggacaagttcagcgggactctgtattggaaagagaataagttcccactaagtaaccagaacatgctccttagggggtgcgtgctcaggaacacagagtggtgctttggactagtcattttcgctgggcctgatacaaagctgatgcagaactctggaagaactaagttcaaaaggactagcattgaccggttgatgaacaccttagtgctttggatttttgggtttctcgtgtgcatgggcgtgattctggccattggcaatgcaatctgggaacacgaagtcggcatgcggtttcaagtatacctgccctgggatgaggcggtggactccgccttcttcagtggctttctgtcattctggtcatacatcatcattctgaacacagtcgttccaatttcattgtatgtttctgtagaggtcatccgtctgggccactcatatttcatcaactgggacaaaaaaatgttttgtatgaagaagcgcacacccgctgaggcacggacgacaacattaaatgaggagttaggccaagtggagtacattttcagcgacaagactggcaccctgactcagaatataatggtattcaacaaatgctcgatcaatgggcattcctatggcgacgttttcgacgtgctgggacataaggccgaattaggcgagagaccagaacctgtggacttctcgttcaatcctctcgctgataagaagttcctgttctgggacccttcactgctagaggccgtaaagattggagaccctcacacccatgaattctttaggctgctatctttgtgtcatacagtgatgtcagaggagaaaaacgaaggcgaactctactataaagcgcagagccctgacgagggtgcactggtaactgcggccagaaacttcggatttgtattcagatccaggacacccaaaactatcacagtacacgagatgggaactgctatcacttatcagctgcttgcaattctagacttcaacaatataagaaaaagaatgtccgtaattgtgcggaatcctgaaggcaagatcaggctgtactgcaagggagccgacaccattctgctggatcgcctgcaccactccacacaggaattgctgaacaccacaatggatcacttgaatgaatacgccggggaaggacttcgtactctagtcttagcatataaggacctggatgaagaatactacgaagaatgggccgagcgacggctgcaggcttcgttagctcaggattccagagaggacagactggcctccatatacgaagaggtggagaacaacatgatgcttctcggagctacagccatcgaagacaaactccagcagggggtgcctgaaaccatcgccctcctgaccctggctaacattaagatttgggtgttgacaggcgataaacaggagactgcagttaatatcggttacagttgcaagatgcttactgatgatatgaccgaagtattcatcgtgacagggcacactgttctggaggttagggaggaacttcggaaggcccgagagaagatgatggacagcagtcggtccgttggaaatggttttacataccaggacaagctcagctcctctaaactgacctccgtactggaagccgtggccggcgagtacgccctggttatcaacggccactccctggcccatgctcttgaagcggatatggagttagagtttctggagaccgcatgcgcgtgcaaagcagtgatatgttgtagagtcacacccctccagaaggcccaggtggtcgaactggtgaaaaagtacaagaaggccgtgacattggccatcggggacggggctaacgatgtttcaatgatcaaaactgcacatattggagttggtatttcaggtcaggagggtatccaggcagtacttgcgagtgactacagtttctcccagtttaaatttctgcagcgcctcctgctggtgcacggcagatggtcgtacttgaggatgtgtaaattcctttgttatttcttttacaagaactttgccttcacaatggtccatttttggtttgggttcttctgtggtttttccgcccagaccgtttacgatcaatattttattacactttacaacattgtctatacatctttgccagtacttgctatgggagtttttgatcaggacgtgcctgagcagcgcagcatggagtatccaaagctgtatgagccaggccaacttaatctcctgttcaataaacgcgagttcttcatatgtatcgcccaggggatatacactagcgttttaatgttctttattccctatggagtgttcgcagatgcaacaagagacgacggcacgcagctggcagactaccagagctttgcagtcaccgtggctacatctttagtgatcgtcgtgagcgtacagattggcttggacaccggctattggacagccattaaccactttttcatctggggaagtctcgcagtatactttgctatcctttttgctatgcacagcaatggactcttcgatatgtttccaaatcagttcaggtttgtgggcaatgcccagaataccctggcccagccaaccgtatggctgaccatagttttaacaactgtcgtgtgcatcatgcctgtggtcgcattccgcttccttcgcttgaacctcaagcctgaccttagcgacacagtgagatatactcagttagtacgaaaaaagcaaaaggctcaacaccgttgtatgaggcgggtcggacggacaggtagcagacgcagtggttatgcgttctcccaccaggagggattcggggagttaattatgagcgggaagaatatgaggctctcttctctggcactcagctcctttaccacacgcagtagctctagttggattgagagtcttaggcggaaaaagagcgattccgcatcaagcccgagcggaggcgcagataaaccactcaagggctag

SEQ ID NO: 179820 - DNA, 3444 bp, Artificial Sequence
  Description of Artificial Sequence: Synthetic coding sequence
atggccgaccagatccccctgtaccccgtgcggagcgccgccgccgctgccgccaacagaaagagggccgcatattactcagcagcaggacccagaccaggcgctgaccgccacagtaggtatcaacttgaagatgagtcagctcatctggacgaaatgccactgatgatgtcagaagaagggtttgagaacgaggagagtgattaccacaccctgccccgagcccgaattatgcagcgcaagcgcggtttggaatggtttgtgtgcgacggctggaagttcttatgtacttcctgctgtggatggctgatcaatatttgtcgcagaaagaaagagctgaaggcccgtactgtgtggctgggctgcccagagaagtgcgaggagaaacatccacgaaactcgatcaaaaaccagaagtacaacgtttttacctttattcctggggtcctttatgagcagttcaagtttttcctgaacctgtactttctggttatctcgtgcagccagttcgtgcccgccctaaagattggatacctgtacacatattgggcgcccttgggctttgtgctggcagtgacaatgacaagggaggccatagatgaattcagacggttccagcgggacaaagaggtcaactctcaactttactcaaaactcacagtgcgggggaaagtgcaggttaagagctccgacatccaagtaggcgacctgataattgttgagaagaaccaacgtatcccatcagatatggtcttcctgagaacatcggaaaaggccggaagctgtttcattaggacggaccagctggatggggaaacagattggaaactcaaagttgcagttagctgcacacagcagcttccagccttgggcgatctcttttccatcagcgcttatgtatacgcacagaaacctcagatggacattcattcctttgaaggcacgtttacgcgcgaagattctgatcctccaattcacgaaagcctgagtattgaaaacacgttgtgggcatccaccatcgttgcatctggaaccgtgataggggtcgtaatatacaccggcaaggaaaccagatcggtgatgaatacgtctaatccaaagaacaaagtgggactgctggatctcgagctgaatagactgactaaggccctatttctcgctctcgttgctcttagtatcgttatggtgaccttgcaggggttcgtggggccatggtatcgtaacctgttcagattcttgcttttattttcctatattataccaatcagcctgcgggtgaacttagacatgggcaaggccgtgtacggctggatgatgatgaaggatgaaaacattcccggcacggtggtgcggaccagcacaattcctgaagagctgggccgtcttgtgtacttattgacagataagacaggtaccttgacgcagaacgagatgattttcaagagattgcatctgggtacagtgagttacggagctgacaccatggatgaaatccagtcccatgttcgagatagttactctcagatgcagagccaggcaggggggaataatactgggagcacacccctccgaaaagcccagtcttctgcacccaaagttcggaaatctgtgtcatcccgaattcacgaggcggtgaaggcaattgttttgtgtcacaacgtgactcctgtgtacgagtccagagctggagtgacggaggagaccgagttcgccgaggccgatcaagacttcagtgacgagaatagaacatatcaggctagcagccccgatgaagtagcgttagtccaatggaccgagtctgtgggcctgacgctggttagcagggacctgaccagtatgcaactcaagaccccatctgggcaggttttgtcgttttgtatactgcagctttttccctttacgtcagagagcaaacgcatgggtgtgatagtaagggacgaaagtaccgctgaaattaccttttatatgaaaggagctgatgtcgcgatgagcccgattgtccagtataacgattggctggaggaggaatgcgggaacatggcccgggaaggcctgagaacacttgtggtggcaaaaaaggccctcaccgaagagcagtaccaggacttcgagtcccgatacacacaggctaagttgagtatgcacgatagatcccttaaagtggccgcggtggtcgagtctttggagcgcgagatggagttgctgtgccttaccggtgtcgaagaccagctccaggcggacgtgagacctactttggaaatgcttaggaacgctggcatcaagatctggatgctgacaggcgacaagctggagaccgctacctgcatagcgaaatccagccaccttgtctccagaactcaggacattcatatttttagacaggtgacgtcccggggcgaagcacacttggaactgaatgctttcagaagaaagcacgattgtgccctggtgatcagcggagactccttagaagtgtgtctgaagtactatgaacacgagttcgtggaactggcttgtcagtgccctgccgtcgtgtgctgcagatgcagcccaacacagaaggcacgcatcgtgacattgctgcagcagcatacaggtaggagaacttgcgcgatcggcgacggcggcaatgacgtaagcatgatccaggccgccgattgcggtataggaattgagggcaaagagggtaaacaagcctctctcgctgccgattttagcatcacccagttccgccatatcggtagactgcttatggttcacgggaggaactcatacaaacgttcagctgcattggggcagttcgtaatgcacagagggctcataatctctaccatgcaggcagtgttcagctctgttttctactttgcttcagtgcccctttaccagggcttcctcatggtggggtatgccactatctacaccatgttccccgtcttctccctcgtgctggatcaggatgtcaagcccgaaatggcgatgctgtatcccgaactatacaaggacctcactaagggcaggtcactgtcttttaagactttcttaatctgggtactgataagcatttaccagggaggaatcctcatgtatggtgcattagtgctatttgaatctgagtttgttcatgtcgtggcaatcagttttaccgccctgattctcaccgagttgctcatggtggccctgaccgtaagaacatggcactggttgatggtagtggctgagttcctctccctgggatgctatgttagcagcttagccttcctgaacgaatattttggcatcggtcgggtgagttttggagccttcctggacgtggctttcataactactgtgacctttttgtggaaggtgtccgctattactgtggtgagttgtttgccactgtacgtgttgaaatacttaaggcgtaaattgtccccacctagctattgtaagctggcaagctag

SEQ ID NO: 179821 - DNA, 408 bp, Artificial Sequence
  Description of Artificial Sequence: Synthetic coding sequence
atgcaggccgtgttcagcagcgtgttctacttcgccagcgtgcccttgtaccagggcttcctcatggttggctacgctacgatctataccatgtttcccgttttcagtttagtgctggatcaagatgtcaaacccgagatggcaatgttgtatcctgaactctacaaagaccttacaaaatcccaacaggacggccgatctaaccgtcgacagcacgaaagactcacctctggtacaagcggtcatgtctgggatccagggtcattcttccgaatccgggtttccgggaagggagccagaaatgctggaaagatattagttcttcagaaccttcctcacttgggcttcaataagtacctcccgcggcgtcaccctcacgtgtgggggcctggggcactcagagtctag

SEQ ID NO: 179822 - DNA, 3411 bp, Artificial Sequence
  Description of Artificial Sequence: Synthetic coding sequence
atggccgaccagatccccctgtaccccgtgcggagcgccgccgccgcagcagcaaacaggaagagggccgcctattactcggccgctgggcctcgtcctggcgccgaccgccacagtcgttaccagctggaggacgagagcgcacacttggacgaaatgccacttatgatgagcgaggaaggcttcgagaacgaggagtcggactatcatactctgcccagagcccgtataatgcaacgcaagcgcggcttggagtggtttgtttgtgatgggtggaagttcctgtgcaccagctgctgtgggtggcttataaatatctgccggcggaaaaaagagctcaaagcgcgaacggtgtggttggggtgccccgagaagtgtgaagagaaacaccccagaaatagtattaagaatcagaagtacaatgtcttcacattcatcccaggtgtgctatacgagcagtttaagtttttcctgaatctgtacttcctggtgattagctgtagtcaattcgtgcccgcattgaaaattgggtatctgtacacatattgggcgcctctgggatttgtcctggctgtgaccatgacccgagaggctatcgatgagttccgacgcttccagcgagacaaggaagtcaatagccagctgtactctaagctgactgtacgcggtaaggtccaagtcaagagctctgacattcaggtgggtgacctcattatcgtggaaaaaaaccagcgtattccaagtgacatggtgtttcttaggacatcggagaaggctgggtcatgtttcattaggacagaccagctggacggtgaaactgattggaagttgaaggtagctgtctcatgcacccagcagctgcctgcgctcggcgacctgttcagcatttccgcttatgtttacgcgcaaaaaccccagatggacatacattcattcgaagggacatttacacgggaggatagtgaccccccgattcatgagtcactgtctattgagaatactttatgggcatctacaatcgtggcttccggaacagtgattggagtggtgatctatacaggaaaagaaactcgaagtgtgatgaatacatccaacccaaagaataaagtggggctcttggacctggaactaaatcgcttgacaaaagccctgtttttggccttagtggcgctgtcaatcgtcatggtaaccctgcagggattcgtgggcccatggtatcgtaatttattccgctttctacttttgtttagttacattattcctattagcctccgagtgaacctggatatggggaaagccgtttacggatggatgatgatgaaagatgaaaacatccctgggacagttgtgagaactagtaccatccccgaggaacttggccgtctggtgtacctgctgacggataaaactggcacactaacgcagaacgagatgatattcaagcggctacacctcggtacagttagctacggagctgacactatggatgagatccaatcccacgtgcgcgatagttacagtcagatgcaatcccaggcagggggaaacaacaccggctctacccccttaagaaaagcccagtcttctgctcccaaggtaagaaaatcagtctcgagccgaattcacgaggcggtgaaggcaattgtattatgtcataatgtgacacccgtctatgaaagcagagctggtgtgacagaagagactgagttcgccgaggccgatcaggacttttcggatgaaaaccgcacctaccaggcctcgtctccagatgaagtggccttagtacagtggactgaaagcgtgggtttgaccctggtgtcccgcgatctgacatcaatgcagttgaagaccccatctggacaggtgctaagtttctgtatattacagttgttcccctttaccagtgaatcgaagaggatgggggtgatcgtacgggatgaatcaacggctgagatcactttctacatgaagggggcggacgtcgccatgtcgcctattgtccagtacaacgactggctcgaagaggaatgtgggaacatggcccgcgaaggattgaggacactggtcgtggctaaaaaggcacttacggaggagcaataccaggacttcgaaagccggtacactcaggccaaactgagcatgcatgatcgcagtctgaaggttgcagctgttgttgagagcctagagagggagatggagctgctgtgcctgacgggggtcgaagaccagctgcaagctgacgtgcgtcctacactcgaaatgctgcggaacgcaggaattaaaatttggatgctgaccggagacaaacttgaaacggccacctgcatcgccaaatctagtcacctggtctcccgtacacaggacattcacatttttagacaggtgacctcacgcggggaggctcacctggaattgaatgcatttagacggaaacacgattgcgccctggtcatctccggtgatagcctcgaagtctgccttaaatattacgagcacgagtttgtggaactcgcatgccagtgccccgctgtcgtctgttgcaggtgttcacctacacagaaggccagaatcgtcacgctgcttcagcaacatacgggacgtaggacatgcgctataggggatggggggaatgacgtgtccatgatacaggcagctgattgcggtataggaatcgagggaaaggagggaaagcaggcatctctggctgccgattttagcatcactcagttcagacatatcggacggttactgatggtacacggaagaaatagctataagagaagtgctgccttgggacagttcgtgatgcatcgtgggctgatcatctctacaatgcaggcagttttctcttctgtcttctattttgcttctgttcccctctatcagggttttctaatggtgggttacgcaacaatatatacaatgtttccagtattcagtctggtccttgaccaagacgtgaagcctgagatggccatgctgtacccagaactttacaaggacttaactaagggtcggtctctttcctttaagacctttctgatctgggtgctgattagcatctaccagggggggattcttatgtacggtgctttggttctgtttgagtccgagttcgtccatgtcgtcgccatcagctttacagcactgattctaaccgagctcctgatggttgctttgaccgtgagaacctggcactggctgatggtcgtcgccgagtttttgagcctaggttgctatgtctctagcctcgcctttttgaatgagtactttgatgtggctttcattaccaccgtcacctttttatggaaggtgagtgcaatcacggtcgtttcctgcctgccattgtacgtgttgaaatacctgaggagaaaactgtcaccacctagctactgcaagctcgcttcctag

SEQ ID NO: 179823 - DNA, 411 bp, Artificial Sequence
  Description of Artificial Sequence: Synthetic coding sequence
atgcccctgatgatgagcgaggagggcttcgagaacgaggagagcgattaccacacactgccacgggcacggattatgcagcgaaagaggggcctggagtggttcgtgtgtgatggatggaaattcctttgcacctcatgttgtggttggctgatcaatatctgccggcgtaaaaaagagctgaaggcacgcacggtgtggcttgggtgtcccgaaaagtgtgaggagaaacacccacgaaactctatcaagaaccagaaatataatgtttttactttcatacccggtgttctatacgaacagttcaagttctttctcaacttgtattttctagtgatctcttgctctcagttcgtgcccgcgctgaagataggatatctgtacacttactgggccccactcatgacttag

SEQ ID NO: 179824 - DNA, 609 bp, Artificial Sequence
  Description of Artificial Sequence: Synthetic coding sequence
atgcagcggaagcggggcctggagtggttcgtgtgcgacggctggaagttcctgtgtacctcttgctgtggctggctgattaacatatgtaggcgcaagaaggaacttaaggcaagaacagtctggctcggatgtcccgagaagtgcgaggagaagcatccaagaaattctattaagaaccagaagtacaatgtgtttactttcataccgggtgtgctgtacgagcaattcaagtttttcctaaatctctactttctggtgatctcatgctcccagtttgtccctgccctgaagatcggctatctgtacacatactgggctccactggggtttgttttggccgttaccatgacaagggaagccattgacgagtttcgtcggtttcagcgggacaaagaagtgaatagccagctgtacagcaaactaaccgtgaggggcaaggtccaggtgaaatcatccgacatacaggtcggagacctgattattgttgagaaaaatcagcgcatcccctccgacatggtgtttctcagaacatctgaaaaggcagtcagtaataatctcgactactgtagccatctagtgctttttatcttttgcttcctcaattag

SEQ ID NO: 179825 - DNA, 1374 bp, Artificial Sequence
  Description of Artificial Sequence: Synthetic coding sequence
atggcccgggagggcctgcggaccctggtggtggccaagaaggcccttactgaggaacaataccaggactttgagtctcgctatacccaggcgaagctatcaatgcacgacagaagtctgaaagtagccgcagttgtagaaagccttgagcgcgaaatggagttgctttgtcttacaggtgtcgaagaccagctccaggcagacgtgagaccaactctggaaatgcttcgaaacgctggtatcaagatctggatgctgacgggagataaactcgagacagcaacctgtatagctaaaagcagccacttagtatctcgaacacaagatatccatatcttcaggcaggtgactagccgaggcgaggctcatctcgaactcaatgcgtttagacggaagcatgactgcgccttggtcatttctggcgattcacttgaggtgtgtctgaaatattacgagcatgagttcgtggagctggcgtgccaatgcccagccgtcgtttgctgccgctgctcccctacccagaaagctagaatcgtcactttattgcaacagcacacaggacgcagaacttgtgccattggggacggaggaaacgatgtatccatgatacaagccgcggattgtggcatcggcattgaaggcaaggagggcaagcaggccagcttggctgccgatttcagtatcacccagttcaggcacattggccgcctcttgatggtgcacggtcgtaatagctacaagaggagtgccgccctaggacagttcgtgatgcatcggggactcattatttcaaccatgcaggccgtcttttcatccgttttttacttcgcatcagtccctctgtaccagggctttctcatggtgggctacgctaccatttacactatgtttcccgtattttctctcgtgttagatcaagatgtgaaacccgaaatggctatgctatatccagaattatacaaagacctgacgaagggaagaagcctctcttttaaaacctttcttatctgggtcctgatctctatttaccagggcggtattcttatgtatggagcgttggtgctgtttgagtctgaattcgtccacgtcgttgcaatctcatttaccgctctcatcctaactgagctcctgatggtagcgctgaccgttcgcacgtggcattggttgatggttgtggccgaattcctgagcttgggatgttatgtgtccagcctggcattcctcaacgagtattttgacgtggcctttattaccactgttaccttcctgtggaaggtgagtgccataactgtcgtgtcatgtctgcccttatacgttctgaagtacctgcggcgtaaactttctcccccttcctattgtaagctggcaagttag

SEQ ID NO: 179826 - DNA, 4500 bp, Artificial Sequence
  Description of Artificial Sequence: Synthetic coding sequence
atggagcgggagcccgccggcaccgaggagcccggcccccccggccgtagaagacggcgcgaggggcgtaccagaaccgttagatcaaatctgctcccacctccgggagctgaggatccagctgccggggctgccaaaggggaacgaaggaggcggcgcgggtgtgcccaacacttagccgataatagactgaagacaacaaaatacactcttctttcctttttgcctaaaaacttgttcgaacaattccacagacctgccaacgtgtatttcgtgttcattgcattgcttaatttcgtgcccgcagttaacgcgtttcaaccaggccttgcacttgcaccagtactctttattctggcaattacagccttccgggacctctgggaggattactcccggcacagatcggaccacaaaattaaccacttgggctgtctggtgttcagcagagaggagaagaagtacgtaaatcggttctggaaagagatacacgtcggcgatttcgtgagactccggtgcaacgaaatttttcccgcggacatcctgctgctgtcttcgtctgaccctgatgggctttgccacattgagacagccaacctggacggcgaaaccaacttaaagagaaggcaagtcgtccgtggattttctgagctcgtgtctgaatttaatcccctcactttcacttcggtgattgagtgcgaaaagcctaataatgatttatcccggttccggggctgcatcattcatgacaatgggaagaaagccggtctctacaaggagaaccttctacttcgaggatgtaccctgaggaataccgatgctgtcgtgggcatcgtgatctacgctggtcacgaaactaaagcactgcttaacaacagtgggccccggtacaaacggagcaagctggaaagacagatgaactgtgatgtgctgtggtgcgtgctgctcttggtttgcatgtctctattctcagccgtgggacacggactgtggatttggcgctatcaggaaaagaagagcctgttttacgtccctaaatctgatgggtctagtcttagccctgtcaccgccgccgtgtatagtttcctgacaatgatcattgtccttcaggtcctcatcccgatttctctatacgtgtccatcgagatcgtaaaggcctgtcaagtgtatttcattaatcaggatatgcagctgtacgacgaggaaacagatagccaattgcagtgtcgggcactgaacatcaccgaagatttagggcaaatacagtacatattctccgacaagactggtacacttactgagaataaaatggtctttcgccggtgcacggttagcggagtcgagtatagtcatgatgccaacgcccagcggctggcgcgctatcaggaagctgatagcgaagaggaggaggtcgtgccccgcggaggatctgtgtcccagaggggtagtattgggtctcatcagagcgtgcgcgtcgtacatcggacacaaagtactaaaagccacaggcgcacaggatcccgcgcagaggccaaaagagcttccatgctttctaagcatacagcattctcatctccgatggagaaagacattacgcctgacccaaagcttctggagaaggtcagtgaatgtgacaaatcactggccgtcgcccggcaccaagaacacttgctcgcccacctaagccccgaactcagcgatgtattcgacttttttatcgctctcaccatctgtaacacagtcgttgtcacgagcccggatcagccgagaacaaaagtcagggtgcgatttgagctgaaatcccccgtcaaaactatcgaggacttcctgcggaggttcacgcccagctgtcttaccagtgggtgcagctctattgggtccctagcagctaacaaatcctcccataagttgggcagttcctttccctctactcctagctccgacggaatgcttcttagactcgaagagcggctcgggcaacccactagtgccatcgcgtcgaacgggtactcaagccaggcagacaattgggcatcggagcttgcacaggagcaggagtcagagagagaactgcggtacgaagctgagagtccagacgaggcagctctagtgtacgccgcgagggcatataactgtgtgcttgtcgagagacttcacgatcaggtgtcagtcgaactcccccacctgggcagactgacctttgaactactgcataccctgggatttgattcggtgagaaagagaatgtcagtggtgatacggcaccctttaacagacgaaattaacgtttatactaaaggcgccgactccgtggtgatggacctcttacagccatgtagtagtgtggatgcccgaggacggcaccagaaaaagatcaggtctaagacacaaaactatctcaatgtatacgcagcagagggcttgaggacgttatgcattgctaaaagggtgttgagcaaggaggaatacgcatgttggctgcagtcccacctggaagcagagagctctctcgaaaacagcgaggaacttctctttcagtctgccattcgcctggagactaacctccacctcctcggcgcaacggggatagaagatcgactccaggacggcgtacctgagactataagcaagctgcgccaggccggcctgcagatttgggtgctgacaggcgataagcaagaaacagccgttaatattgcatacgcctgcaaacttcttgaccacgatgaagaagttatcacgctcaacgcgacaagccaggaagcctgtgctgccctcctggatcagtgtctttgctacgtgcagtcaaggggtctccagcgagcccctgaaaagactaagggcaaggtaagcatgcgattctcttcgctttgtcctccctctacgtctaccgccagcgggcgaagacctagtctggtcattgacggacggtcactggcatatgctcttgaaaaaaatctggaagataagtttctattcctggccaaacagtgcaggagtgtgctttgttgccgatctactcccctgcagaagtcaatggtcgtcaagctcgtccgatctaagcttaaagcaatgaccctagctattggcgatggggctaatgacgtttccatgattcaggtcgccgatgttggtgtgggcatatccggacaggaaggaatgcaggccgttatggcctctgacttcgcggtcccaaagtttaggtacctcgagcgcctgctgatattacacgggcattggtgctactcaagattggccaatatggtgctctactttttttacaagaatacgatgttcgtggggcttctgttctggtttcagttcttctgtggatttagtgcttctaccatgatagaccagtggtatctgattttctttaatctcctgttttcatccttgccccccctggttacgggcgtcttggatagagacgtgccggcgaatgtgttgctgacgaacccccagttgtacaagtctggccagaacatggaggaatatcgaccgcgaacgttctggttcaacatggcagacgccgcctttcaatcgttagtatgtttcagcatcccttacttagcttattacgactctaacgtggatctcttcacatgggggacccctatcgtaaccattgcactcttaacctttttactccacctcggaattgaaacgaagacgtggacctggctgaattggatcacctgcgggttctctgtgctactatttttcaccgtggcactgatttataatgcgagttgtgccacctgttacccacccagtaacccttactggacgatgcaggcactgttgggtgatcccgtcttctatttgacttgcctgatgacaccagtggctgctctgctgccccgtttatttttcaggtccctccaaggacgcgtgttccccacacaacttcagctggccagacagctgactcgcaaaagccccagacgatgcagcgcacctaaagagacatttgcccagggacgactgccgaaagactccggcactgagcatagtagtgggcggactgtaaagacctccgtgccactctcccagcccagttggcacacacaacaacctgtttgctccctggaggcgagcggggagccttctaccgttgacatgtccatgccagtacgagagcatactctgctggaaggattaagcgcccccgcccccatgtcttctgcccccggcgaggcagtgcttcgctcgcccggcgggtgcccagaggaaagtaaagttcgagctgccagcacaggtcgcgtcaccccgctgtcctccctgttctctctgcccacctttagccttctgaattggattagctcatggtcactcgtctcgcgtctgggaagcgtgctgcagttctctcggactgaacaactcgctgacgggcaagcagggaggggcctaccagtgcagccacacagcgggcggtccgggctccaaggccccgatcacagacttcttataggcgcctcatcccgcaggtcccagtag

SEQ ID NO: 179827 - DNA, 3405 bp, Artificial Sequence
  Description of Artificial Sequence: Synthetic coding sequence
atggactgcagcctggtgcggaccctggtgcaccggtactgcgccggggaggaaaattgggtggacagcagaactatctatgtggggcacagggagccgccgcctggagctgaggcttacattccccagagataccccgacaatagaattgtctcttctaagtacacgttctggaattttatacccaaaaacctatttgagcagtttagacgggtagctaatttttactttctgattatcttcctggtccaactcatcattgataccccgacctcacctgtcacatcaggactgcccctatttttcgtgatcaccgtgacggcaattaaacaaggctacgaggactggctgagacacaaagctgataacgccatgaaccagtgccctgttcatttcatccagcatggcaagctggtcaggaaacagtcgcggaaacttcgggtgggggatattgtcatggttaaggaggacgaaaccttcccatgtgacctaatttttttaagcagcaatagaggagatggcacttgtcatgtgacaactgccagccttgatggcgagagttctcacaaaacccattatgctgtgcaagacactaaggggtttcatactgaagaggacatcggagggctgcatgcaaccattgagtgtgagcagcctcagccagatctctataagttcgtgggacgaattaatgtatactcggacctgaatgatccagtggttagaccactgggctctgaaaatctgctcctgcgcggggccacactgaagaacaccgagaagatcttcggcgtggcaatatacaccggtatggaaacaaaaatggctttgaattatcaatccaagagccagaagcgctccgccgtggaaaagtccatgaacgcatttcttatagtgtatttatgtatcctcatcagtaaagccctgatcaacacagtactcaagtacatgtggcagtctgaaccatttcgagatgagccctggtacaaccagaagaccgagagtgagcgccagcgcaatctatttctcaaagcatttactgacttcctggcgttcatggtcctgttcaactacataattcccgtcagtatgtacgtaacagtggaaatgcagaaatttttaggatcctattttatcacttgggatgaagacatgtttgacgaggagacaggggaagggccgctggttaatacttccgatcttaatgaggagcttggtcaggtggagtatattttcactgataagaccgggacattgacagagaataacatggagtttaaagaatgctgcatcgaaggacacgtgtacgtaccacatgttatctgcaatgggcaggtgctgcccgagagcagcggcatcgatatgattgactcatctccaagtgtcaatggccgtgaacgggaggagcttttcttcagggcgctgtgtctctgccatacagttcaggtgaaagatgacgactcggttgatgggccccgtaagagccctgatggcggtaaatcttgcgtgtacatttcgtcttcccccgatgaggttgctctcgtggagggggtgcagaggctgggcttcacatatctccgtctgaaggacaattacatggagattcttaatcgtgaaaaccatatcgaaagattcgaactgttagaaattctttctttcgactccgtgcgtcggcgcatgtccgtcattgtgaagtccgctactggggaaatttatctgttctgcaagggtgccgatagtagtatattcccccgcgtgattgagggaaaggtcgatcagatacgtgctcgcgtggagagaaatgctgtcgagggactacgcaccctttgtgtggcctacaagcgcctgatccaggaggaatacgagggaatttgcaaattattacaggccgccaaggtcgcactgcaggacagggagaaaaagctcgcggaagcctacgagcagatcgaaaaggacctgacgctgctgggcgccacagccgtggaagaccgcctgcaggagaaagccgctgacacgattgaggcgctgcagaaagccggcatcaaggtctgggttctaactggggacaaaatggaaacagccgccgctacttgctatgcctgtaagctctttcgaagaaacacccagctgcttgagcttaccactaaacgcattgaggagcagtcacttcatgacgtgctgttcgaactgtccaagactgtactccggcattccggctccctcacccgggacaatttatcaggactcagcgcggatatgcaggactatggactgatcattgacggtgcagcgctgtctctcatcatgaaacctcgggaagacgggtcaagtggcaactatcgggaactgttcctcgagatttgccgaagttgttcggcagtgctatgttgccggatggccccgctccagaaagcacagatcgtgaagctaattaaattctcaaaagaacatcccataacgctcgcaattggggacggtgcaaatgacgtgtctatgatactcgaggctcacgtcggtatcggtgtcatcggcaaggagggacggcaggccgcacggaatagcgattacgccatcccaaaatttaagcaccttaagaaaatgctgctggtgcatggacacttctactatattagaattagtgagctggttcaatacttcttctacaagaatgtgtgttttatttttccccagttcctttatcagttcttttgcgggttcagtcagcagacattatatgacactgcatacttgacattgtacaatatttccttcacttccttgcctatcctcctatattccctgatggagcagcacgtggggattgatgtactcaagcgggatccaacactgtatcgagacgttgccaagaatgctttactgcggtggcgcgttttcatctactggaccctgcttgggctttttgacgccctggtcttcttcttcggggcttattttgtgttcgaaaatacgacggtgacttctaacggtcagatcttcggcaattggaccttcggaactctcgtctttactgtcatggtgtttactgtcacattaaaactggcccttgacacacattattggacgtggataaatcacttcgtaatctggggctcactattgttctacgtcgtattcagtctgctatgggggggagttatttggcccttccttaactatcaaaggatgtattacgtttttattcagatgctctcgagtggcccagcctggctggcgattgtactcctggtcaccatctccctgttacccgacgtgctcaagaaggtgttatgtagacaactgtggcctaccgctaccgagcgcgtccagactaaaagccaatgtcttagtgtagaacagtccacgatttttatgctttcccagacctcctccagcttaagcttctag

SEQ ID NO: 179828 - DNA, 3576 bp, Artificial Sequence
  Description of Artificial Sequence: Synthetic coding sequence
atggactgcagcctggtgcggaccctggtgcaccggtactgcgccggggaagagaattgggtagattccaggacaatttacgtcggacacagggaaccacctcccggcgcagaggcctacattccacagaggtatccagacaatcggatagtgtcctctaaatacacattctggaatttcattcccaagaacctctttgagcagtttcggagagttgccaacttctattttctgattatcttcctggtccaactcattatcgacactccgaccagtcccgtgacctccgggttgcccttattttttgtcatcacagtgacagctataaagcagggctacgaggactggctgagacacaaggctgataacgccatgaaccagtgccccgtgcatttcattcagcatggcaaactggttagaaagcagtcccgcaagctcagagtgggtgatatagtgatggtaaaggaagatgaaacattcccttgtgatcttatcttcctctcctccaatcgtggggatggcacctgtcatgtcaccactgccagccttgatggcgagagttctcacaagacgcactatgccgtgcaggacaccaaggggttccacactgaggaggacattggcggcctccacgcgaccatcgaatgtgagcagccccaaccagacctgtacaaattcgttgggcgcattaatgtgtacagcgatttgaatgatccagttgttaggccactggggagcgagaacctcctcttgagaggcgctactctcaaaaataccgaaaaaatctttggtgttgccatatacacggggatggaaacgaagatggcccttaactaccaaagcaaatcacagaagcggtcagccgtggaaaagtccatgaacgcgtttttgatcgtgtacctctgtatcctgatctcaaaagcactgatcaacacggttctaaaatacatgtggcagagcgagccatttagggacgagccctggtataaccagaagacagaaagcgaaaggcagagaaacctgttcctgaaggctttcactgatttcctggccttcatggtactgtttaattacatcattcccgtgagtatgtatgtcacagtggaaatgcagaaattcctggggtcttactttattacctgggatgaggacatgttcgacgaagagacgggagagggccccttagttaatacctctgatctcaacgaggaacttgggcaggttgagtatatttttaccgataaaacaggtacactgactgaaaacaatatggaattcaaggaatgctgcatcgaagggcatgtgtatgtccctcacgttatctgtaatggccaggttctccctgagagcagcgggattgatatgatagactccagcccttccgtgaatgggcgagaacgcgaggagctattctttcgagccttgtgcttgtgccacactgttcaggtgaaagacgatgatagtgtcgatggaccacgcaaatctcctgacgggggaaaatcgtgcgtttatatttcgagcagtcctgatgaggtagctctggtcgaaggcgtccagaggctgggctttacatacctcagacttaaagataattacatggagattctcaatagggagaaccacattgaaagattcgaattgctcgaaatcctatccttcgacagtgtgaggcgacgcatgagtgttatagtgaaaagtgcgacgggagaaatatacttgttctgcaagggtgccgattcctctattttccctcgcgttattgagggtaaggtggaccaaatcagggctcgggtggaacgaaatgccgttgagggtcttcgaaccttgtgcgttgcttacaaacgcctgatacaagaggagtatgaagggatctgcaagctacttcaggcagctaaggtggcgctgcaggaccgcgagaaaaagctagctgaagcatacgaacagatcgagaaggatctcacccttctgggagcaactgcagtagaggatcggttacaagagaaggcagcagacaccatcgaggctttgcagaaagccggtattaaggtgtgggtgctcactggcgataagatggagactgccgcagcaacctgttatgcctgcaagctgttccgaagaaacacgcagctgctggagttgacgactaaacggatagaagagcagagcctgcatgatgtgctattcgagctgtccaagacggtgctgaggcattccggatccctgactcgggacaacctgagcggactcagcgcagacatgcaagattacggtctcatcattgatggggctgcactgtctctcatcatgaaaccccgtgaagatgggagctctggtaattacagggagttgttcctggagatttgcaggtcatgctctgctgtgttgtgttgcaggatggccccgctgcagaaggcacagattgtgaagctcatcaaatttagcaaagagcatcctattactctcgccattggggatggagctaacgacgttagcatgattctggaagcccatgtaggcatcggggtgatcggaaaggagggcagacaagctgctcgcaattctgactacgccattcccaagttcaaacatcttaagaagatgcttcttgtgcatgggcatttttactacatccgaattagtgagttggtgcaatactttttttataaaaacgtgtgcttcattttccctcagttcctctaccaatttttctgcggcttctcccaacaaacactctatgatactgcgtatcttaccctctataacatttcttttacttccctgcccattctgttgtacagtctgatggagcagcacgtcggtattgacgtattgaaaagagaccctacactgtatcgtgacgtggcaaagaacgcgctgctgcgatggcgcgtgttcatctactggacactgcttggcctgtttgatgcattggtgttcttcttcggagcgtattttgtctttgagaacacaacagtgacaagcaacggccagatcttcggcaattggacctttggcaccctggtgtttaccgttatggtgtttacggtcactctgaaactcgctttagacacccactactggacatggatcaatcacttcgttatatggggatccttactattctatgtcgtgttcagtctcctttgggggggcgtgatttggccttttttgaactaccagcggatgtactacgttttcatccaaatgctgtcatccggaccggcctggctggctattgtgctgctggtgaccatttccctactgcctgatgtgctcaaaaaagtcttatgtaggcagctgtggcccaccgcaaccgaaagggttcagaatgggtgcgctcagccgagagaccgagactccgaattcacaccactggcgtcacttcagagccccggctatcagtcaacctgtccctcagccgcctggtattcctctcattcacaacaggtgacccttgctgcctggaaagaaaaagtgtccacagagccgcctcctatattggggggctctcaccatcattgctcatcaattccgtcccactcttgcccacgatcccgggtcggtatgctagtctag

SEQ ID NO: 179829 - DNA, 3405 bp, Artificial Sequence
  Description of Artificial Sequence: Synthetic coding sequence
atggactgcagcctggtgcggaccctggtgcaccggtactgcgccggtgaggagaattgggtagactctcgcaccatctacgtgggccaccgtgagcctccacctggcgccgaggcatacatcccccagcgctatccagataatcgtatagtctcgagcaaatacactttttggaattttatacctaagaatcttttcgagcaattccgccgcgtggccaatttctatttcctgatcatctttctggtccagctcattatagacacccccacttcgcccgttacaagtggtttaccattgttcttcgtcattacagtcaccgcaattaaacagggatatgaggactggctgagacacaaggccgacaacgctatgaatcagtgccctgtgcatttcatccaacatgggaagctggtgcgaaaacagtcacgcaagctaagggtaggcgacatagttatggttaaggaagacgaaacattcccatgtgaccttatattcctaagcagcaacaggggggacggcacatgccatgtgacaactgcaagcctcgacggcgagagttcccacaaaacacattacgcagttcaggacactaaagggtttcatactgaggaagatattggaggacttcacgctaccattgaatgcgagcagccacagccagacctttacaaattcgtggggagaatcaacgtttacagcgatctgaacgatcccgttgtcagacctctaggtagcgaaaatttattactgcggggagccaccctgaaaaataccgagaagatttttggggtcgccatatacacaggcatggaaactaagatggctctgaattatcaatccaaatctcaaaagaggtccgcagtggagaagtctatgaatgcttttctgatcgtctatctgtgtatcttgattagcaaggcgcttatcaatacggtgcttaaatacatgtggcaatccgagccttttagggatgagccctggtacaaccagaaaaccgaatcagagcgtcagaggaatctatttttgaaagcatttactgattttctggcattcatggtgctcttcaactacattatccccgtctccatgtacgtgactgtggagatgcagaagttcttaggatcatacttcatcacctgggatgaggacatgttcgatgaagaaactggcgaagggccacttgtgaacaccagtgaccttaatgaggagcttgggcaggtcgaatatatctttacagataaaaccggaaccctgaccgaaaataacatggagtttaaggagtgttgcattgagggccatgtgtatgtgccacatgtcatttgcaacggccaagtactcccagagtcaagcggtattgatatgatcgactcttcaccttccgtgaacggccgtgagagagaagagctcttcttccgcgccctgtgtctttgccacacagtgcaggtgaaagatgacgactccgtggacggacccagaaagtcgcctgatggaggcaagtcttgtgtttatatctcatcaagtcctgatgaggtcgctctggttgagggggtgcaaagattaggttttacttacctcagactcaaggacaactacatggagatactgaaccgggagaaccatatcgagagatttgagttattggagattctatccttcgatagtgtgcggaggaggatgtctgtgattgtaaagtctgccaccggcgaaatttatctgttctgcaagggcgccgatagtagcatctttcccagggtcatcgaggggaaggtcgaccagatccgcgcccgggttgaacggaacgccgtcgagggtcttaggacgctgtgcgtggcctacaagcgattgatccaggaagaatacgagggcatctgcaagctgcttcaggccgccaaagttgctcttcaggaccgggaaaagaaactcgcagaggcatatgagcagatcgaaaaggacctgaccctgctcggcgccacggcagtggaagatagactgcaggaaaaagcagctgatacaatcgaggctctgcaaaaggccggcatcaaggtgtgggtactgacaggtgacaagatggaaaccgcggcggccacctgctacgcctgtaagctctttcgcaggaatacacagctcctggagctcaccaccaagagaatcgaagaacagtcattgcacgacgtgctgtttgagctgagtaagactgttctgcgccactctggaagtctgacaagggacaatctctcgggcctgtctgctgacatgcaagattacgggttaattattgacggggctgctttgagccttattatgaagcctcgcgaagatggcagctccgggaactacagggaattattcttagagatttgccgcagttgctctgctgtgctgtgttgcagaatggcccccctccagaaagctcaaattgtgaagctcatcaagttttccaaagaacaccctataactctggctataggagatggagctaacgacgttagtatgatcttggaggcccatgttggcatcggagtgatcgggaaggaaggtagacaggccgcgcgcaatagcgattacgcgatacccaaatttaaacatctgaagaagatgctcctcgtacacgggcacttctattatattaggatatccgaactggttcagtactttttctataagaatgtttgcttcatctttccacagtttctttaccagtttttttgcggattcagccagcagaccctgtacgacacagcttacctcaccttgtataatataagctttactagcctaccaatcctcctctacagcttgatggaacagcatgtgggaattgacgtgctgaagagagaccctactctttatagagatgttgccaaaaatgccctgctgcgttggcgagtgttcatttattggacacttttaggactgttcgatgcactcgtgttttttttcggtgcctatttcgtgttcgagaacacgaccgtcacatctaatggacaaatttttggcaactggacttttggcaccctggtattcaccgttatggttttcacggtaacactgaaattggcacttgatacccactattggacctggatcaatcactttgtaatttgggggtccctcttgttctatgtcgtgttcagcctcctgtggggaggggtcatctggcccttcctgaattaccaaaggatgtactatgtgttcattcagatgctttcaagtggacccgcctggcttgcaatcgtcctgctcgtgaccatctcgctcctgcctgacgtgttgaaaaaggtgctatgccgccagctgtggcccacagctaccgagcgcgttcagactaagtctcagtgcttatcggtggaacaatccactatttttatgctatctcaaacatcctccagccttagcttctag

SEQ ID NO: 179830 - DNA, 2808 bp, Artificial Sequence
  Description of Artificial Sequence: Synthetic coding sequence
tgatacgtgggccaccgggagcccccccccggcgccgaggcctacatccctcaacggtacccagacaaccgcattgtctcaagtaaatacacattttggaactttattcctaaaaacttgttcgagcagtttagacgagtcgccaatttttactttttaatcatcttcctggtgcagctaatcatcgacacaccaaccagtcccgttacatccggattaccactgtttttcgtgatcaccgtgacagccatcaagcaaggctacgaggactggctgcggcacaaagctgataacgcaatgaatcagtgtccagtccattttatacagcacggcaaattggtccgcaagcagagtcgcaagctgagagtcggagacatcgtcatggtgaaggaggatgaaacattcccctgtgacttaatctttttgagcagtaacagaggcgacggcacatgtcatgtaaccactgcctcactcgatggagagtcaagtcacaaaacacattatgccgtgcaggatacaaagggtttccatactgaagaagacattgggggtttacacgcaacgatagagtgtgaacagccacagccagacctctacaaattcgttggtagaattaatgtatacagcgacctcaacgatcccgttgtccgcccactgggtagcgaaaatctgctgctgcgtggcgcgaccctgaagaacactgaaaaaattttcggcgtggcaatctacactggcatggaaacaaaaatggctctcaactatcagtccaagagccagaagagatccgctgtggagaagtcaatgaacgctttcctgatcgtctatttgtgtatcctcatctctaaggctttgatcaacacggtgctaaaatacatgtggcagtccgagccctttcgcgatgagccttggtacaatcagaagaccgagtctgagaggcaaagaaatctcttcctgaaagctttcaccgactttctggcctttatggtgttgttcaactatatcatcccggtcagcatgtacgtgacggttgaaatgcagaagttccttggttcctacttcatcacctgggacgaagacatgtttgacgaggaaaccggggagggcccactggtgaatacttctgacctgaacgaagagttgggccaggtggagtacatttttactgataaaaccgggaccttgacagaaaataatatggagtttaaggagtgctgcatcgagggtcacgtgtacgtccctcacgtgatttgcaatgggcaggtgctgcccgagagctctggaatagatatgattgattccagcccatccgtcaatggaagggaacgtgaagagctctttttcagagcgctgtgtctgtgtcacacggtgcaagtgaaagacgacgactcagtggacggccccaggaagtctccagatggtgggaagtcttgcgtatacatctcgtcctcccctgacgaagttgcactggtggaaggcgtgcagagactggggttcacttacttgcgcttaaaagataattacatggagatcctgaatcgagaaaatcacatcgagcgtttcgagcttctggaaatccttagctttgattcagtcaggcgccggatgagcgtcatagtgaagtctgccacaggggagatctatctcttctgtaaaggcgccgactcaagcatttttccccgggtgatcgagggcaaagtggaccaaattcgggcgagggtggagagaaacgccgtcgaaggcttgagaactttgtgcgtggcctataaaagattgattcaagaagaatacgaaggcatctgcaaactcctgcaagccgcaaaggtcgcattacaggatcgcgagaaaaagctcgctgaagcttatgagcagatcgagaaggatctcaccctcttgggcgctactgcagttgaagatcgactgcaagaaaaagctgcggacaccattgaagcgttacaaaaggctggaataaaggtgtgggtccttacgggggataaaatggagaccgccgctgccacttgttacgcctgcaaactgtttagacgaaatactcagctactggagctgaccacaaagaggattgaagagcagtccctgcacgacgtgttgtttgaactatccaagacagtcttacggcactctgggtctctgacccgtgacaacttgtccggattgagcgccgatatgcaagactacggccttattatcgatggggcagcgttatctctgattatgaagccacgtgaagacgggtcttctggcaattatcgggaactgttcctggagatatgcaggagctgctctgccgtattgtgttgtagaatggcaccgctgcagaaggcgcagattgtgaagctgatcaaattctccaaggaacacccaatcaccctagcaatcggtgatggcgcaaatgatgtgagcatgattcttgaggcacatgtgggcataggagtgataggcaaagagggtcgccaagcagcccggaatagcgattatgccattcctaagtttaagcacctgaagaagatgctcctggtgcacggacacttctactacatcaggattagtgaactggtgcaatatttcttctataaaaacgtgtgcttcatcttcccccagttcctttaccagtttttctgcggcttcagtcagcaaaccctgtacgacacagcttacctcaccctctacaatatcagcttcacttcacttcccattctcctgtatagtctgatggagcagcacgtcggtatcgacgttctgaagcgtgaccctacactgtaccggtatcatcctcccaattccctgtcatag

SEQ ID NO: 179831 - DNA, 1119 bp, Artificial Sequence
  Description of Artificial Sequence: Synthetic coding sequence
atgagcgtgatcgtgaagagcgccaccggcgagatctacctgttctgcaaaggggcagacagttccatctttcccagggtaattgaagggaaggtagaccagattagggctcgcgtggagaggaatgccgtcgagggtttacgcacactctgtgtagcttacaagcgccttatccaagaagaatacgagggcatttgcaaactccttcaggccgccaaggtcgccctccaagaccgcgagaaaaaactggcagaagcgtatgaacagattgaaaaagatctcacactgctcggcgctactgcagtcgaggatcggttgcaggagaaggctgccgacacaatcgaagctctgcagaaggcagggatcaaagtgtgggttctgacaggggacaagatggagactgccgctgcaacatgttatgcatgtaaactgttccgacgcaatactcaattgttggagcttacaaccaagcgcatcgaagagcaaagtcttcatgacgtactctttgaactgtctaagacggtcctccggcactcaggatccttaactcgggacaacctgtcagggttgtccgctgacatgcaggactacgggcttatcatcgatggtgcggccctttcactgattatgaagcctcgagaggacggcagcagtggcaattaccgagaactctttctggaaatctgccggtcctgcagtgccgtcctttgctgtagaatggcaccactgcagaaagcgcagatagtcaagctgataaagttctcaaaggaacatccaataaccctcgctatcggggatggcgctaatgacgtgagcatgatcttggaggcccatgtaggtattggagttatcggcaaagaggggcgtcaggctgcgcgcaattctgactacgccatccccaagttcaaacatcttaagaaaatgttgctggtgcatggacacttctactacattagaatatccgaattggtccaatatttcttttacaaaaatgtgtgcttcatctttccacaattcctgtatcagtttttctgcggattctcgcagcagggacgccgccaggagtgtcctgctgctctggcgagggtccaccttctcgacgcacctggcaccgtttag

SEQ ID NO: 179832 - DNA, 1059 bp, Artificial Sequence
  Description of Artificial Sequence: Synthetic coding sequence
tgaagcatcttcccccgggtgatcgagggcaaggtggaccagatcagagccagggtggaaagaaatgctgttgaaggactcaggacattatgtgttgcatacaagaggttaattcaagaggaatacgagggaatttgcaagctgctccaggccgctaaagtggctctgcaggatcgcgaaaaaaaacttgcagaagcgtatgaacagattgagaaagatctcacactgctgggggccaccgccgtggaagatagactccaggaaaaagccgcggacacaattgaggccctgcagaaggcaggcataaaggtttgggtgctcacaggtgacaagatggaaaccgctgcagctacctgttacgcctgcaagttgtttaggagaaacacccagctgcttgagcttaccaccaagcgaattgaggaacagtcccttcacgacgttctttttgaactgtctaagactgtgctgcggcacagcggatccctgacccgcgacaatctgtctgggttgtcggccgatatgcaggactacggcctcatcatagacggcgccgccctgtcattaatcatgaagcccagagaagacgggtcatccggtaattacagggaactgttcctggaaatctgtaggagctgcagtgctgtactgtgctgtagaatggctccactacagaaggcacagattgtgaagctcattaaattctctaaggagcatccaatcactctcgctattggggacggcgcgaacgatgtgtctatgatcctggaagcccatgtgggtattggagttatcgggaaagagggaaggcaggctgccaggaactcagattatgcaatccccaaatttaaacatcttaagaagatgctgttggtccatggccatttttattacattagaatatctgagctggtgcagtattttttttacaaaaacgtgtgttttatctttcctcagtttctttaccagttcttctgtgggttctcacaacagggccggagacaggaatgcccagctgccctggccagggttcatctgctcgatgcccccggaacagtctag

SEQ ID NO: 179833 - DNA, 3405 bp, Artificial Sequence
  Description of Artificial Sequence: Synthetic coding sequence
atggactgcagcctggtgcggaccctggtgcaccggtactgcgccggagaggaaaactgggtagactcgcgtaccatctatgtgggtcatagggaaccaccacctggtgcagaggcttacatcccgcagcgctaccctgataatcgcatcgtgtcctccaagtacacattctggaacttcatccctaaaaaccttttcgagcagttcaggcgcgtcgcaaacttctacttcctgatcatctttctggttcagcttataatagacactcctacttcccccgttacctcaggactccccctcttctttgtcatcacagtgactgccataaagcagggctacgaggactggttgcggcataaggcggataatgcaatgaaccagtgccctgtgcacttcattcagcacggaaagttggttcggaaacagagccgcaagctgcgcgtgggtgacattgtgatggtaaaggaggatgaaaccttcccttgtgatctcatatttttgtcctctaataggggagacggcacatgccacgtgactactgcaagcctggacggtgagtcttcgcataaaacccactacgcggtgcaggacaccaaagggtttcacacagaggaggatataggcggtctgcatgcgaccattgaatgcgagcagccacagccagatctctataagttcgtgggaagaatcaatgtctactcagatctgaatgaccctgttgtgagacctttaggttctgagaatctgcttctcaggggcgcgacactgaagaacacagagaaaatcttcggcgtagcaatttataccggaatggagaccaagatggctttgaattatcagtcaaagagccagaagcgatccgctgtggagaagagcatgaatgccttcttaatcgtctatctgtgcatcctaattagcaaagctcttataaacactgttctaaagtacatgtggcagtcagagccttttcgcgatgaaccttggtacaaccaaaagacagaatctgaacgccagcggaatcttttccttaaagcattcaccgacttcctggcatttatggtactcttcaactacataattccagtgtcaatgtacgtgacggttgagatgcaaaagttcctgggttcttatttcatcacctgggacgaagatatgttcgacgaggaaacgggggaagggccactggtgaatactagtgatctgaatgaggagctcgggcaagtcgaatacatctttactgataagactggtacccttactgaaaacaacatggaatttaaagagtgttgtatagaaggccatgtttacgtgccccatgtgatctgtaacggacaggtgctaccagagagctcgggtatcgatatgattgactcatctcctagcgtcaacggccgagaacgtgaggagctgttcttcagagctctttgcctgtgtcacacagtacaggttaaggatgatgacagcgttgacggcccaaggaaatccccggacgggggcaagtcttgcgtctacatttcaagtagtccggatgaggtagccctggtcgaaggcgtccagcgcctggggtttacttacctgcggcttaaagacaattatatggagatcctgaacagagaaaaccacatcgaacgcttcgaactgttagaaatactctcattcgattccgtgagacgtcgcatgagcgtaatcgtaaaatccgctacgggtgagatttacctgttttgtaagggcgccgattcctcaatttttccacgtgtgattgagggtaaagtggaccagatcagggcccgtgtcgagcgtaacgccgtagaaggcctacgaactctatgcgtagcgtacaagcgccttatccaggaggaatacgagggcatctgcaagctgctgcaggccgcaaaagttgccctgcaggacagggagaagaaattggccgaggcatacgagcaaattgaaaaggatcttactctattgggagcaacggctgtagaagacaggttacaagaaaaggcagctgacacgatagaagccctgcagaaagccggaatcaaggtctgggtgctgactggcgacaagatggagacagccgctgccacctgctatgcctgtaaattatttaggcggaacactcaactgttggagttgactacaaagagaatcgaggaacagagcctgcatgacgtgttgttcgagttgagcaagaccgtcctcaggcattcaggcagcttaacaagggacaacctcagtgggctgtccgcggatatgcaggattacggcttgataatagatggggccgcactttctcttatcatgaaaccgcgcgaagacggtagcagcgggaattatcgagagctgtttttggagatatgcagaagctgtagcgcagttctatgctgccgcatggcccccctgcagaaagctcagattgttaaattgataaaatttagcaaagagcaccccatcacactggccattggggacggcgccaatgacgtgagcatgattctggaagcccacgtaggtattggtgtgataggcaaagagggccgacaagccgcccggaacagcgactacgccattcccaagtttaaacatctaaaaaagatgctgcttgtgcacggccatttctattacatacggatctctgagctagtacagtattttttctacaagaatgtgtgctttatctttccccaatttctctatcagtttttttgtggtttttcccagcagactttgtatgacacagcttacttaacactgtacaatatcagcttcacaagcctcccgattctgctgtactccctgatggaacaacatgtgggtattgatgtgctgaagagggacccaactctgtaccgggacgttgctaagaacgcactcctgaggtggagggtgttcatctactggaccctactgggactctttgatgccttggtgtttttcttcggcgcatactttgtgtttgagaacaccaccgttacatcaaatggccagatttttgggaactggacattcggcactctggtgttcacggtcatggtcttcactgtaacactgaaactggctctggatactcattattggacctggattaaccactttgtcatctggggatccctcctattttacgtagtgttttccctgctgtggggtggcgtcatttggccattcctgaactatcaacggatgtactacgtttttattcagatgctgagctccgggcctgcatggctcgctattgtactactcgtgaccatttcccttcttccggacgtattaaagaaagtcctctgtcggcagctgtggcctactgccaccgaacgagtgcagaccaaaagtcagtgcttaagtgtagagcagtctaccattttcatgctgtcccagacaagcagcagcctgagtttctag

SEQ ID NO: 179834 - DNA, 3534 bp, Artificial Sequence
  Description of Artificial Sequence: Synthetic coding sequence
atgtggcggtggatccggcagcagctgggcttcgaccccccccaccaatccgacacgagaaccatctacgtggccaataggtttccccagaatgggctctacactccccagaaatttatagataataggattatatcatctaagtacaccgtctggaactttgtcccaaaaaacttattcgagcagtttagacgcgtcgctaacttctactttctcatcatcttcctggtgcagctgatgatcgacacaccaacttcacctgtgacatccggactgcctcttttttttgttataaccgtgactgctattaagcagggctacgaggactggctgaggcacaactccgacaatgaagtcaacggagcacccgtctatgttgtgaggagcgggggcctcgtgaagacaaggtcaaagaacattagagtgggcgacatcgttcgcatcgccaaggacgagatcttccccgcagacctcgtccttctgtcctccgaccgcctggatggttcttgtcatgtcaccaccgccagccttgacggtgaaaccaatctgaagacgcatgtcgcggttccggaaacggccctattacaaactgtcgccaacctcgacaccctggtggccgtcattgaatgtcagcagccagaagccgatctatacaggttcatggggagaatgattataacgcagcaaatggaggagattgtgcggccactggggcccgaatcactgttgctaaggggagctcgcttgaagaatacaaaggaaatcttcggggtcgccgtttacactggcatggagaccaagatggctctgaactacaagagcaagagtcagaagcgttctgctgtggagaagtcaatgaacacttttttgatcatctacctggtgatcttgatctccgaggcagtgatttccacaatcctgaagtacacgtggcaggcagaagaaaagtgggacgaaccctggtataatcagaagactgagcatcaacggaatagtagtaagatcctgcggttcatctccgattttctcgccttcctggtgctctataatttcatcatcccaatctcgctgtacgtgacagtggagatgcagaagtttcttggatccttcttcatcggctgggatcttgacctgtatcatgaggagtccgaccagaaggcacaggtgaatacttcagacctgaacgaagaattaggccaagtggagtacgtttttacggacaaaacagggaccctgactgagaacgaaatgcagtttagggaatgcagtatcaatggaatgaaataccaagaaatcaacgggagactcgtgccagagggccctactcccgactcgtcggagggcaacttatcgtatttgtctagtctctctcatctaaacaacttgtcccaccttacgacttcctcctcctttcgcacctccccagagaacgagactgaacttatcaaggagcacgaccttttctttaaggcggtgtcgctgtgtcatacggttcaaatttccaacgtgcaaaccgactgtactggcgatggcccatggcaatcaaatctggcgccctctcagctggaatactacgcgtccagtccagacgaaaaagcccttgtggaagccgctgcacgaatcggcattgtcttcattggaaactcggaagaaactatggaggttaaaaccctaggcaagctcgaacgctacaaacttttacatattctcgagttcgactctgacagaaggagaatgtctgtgatagtgcaggccccttcaggtgagaaactgctgtttgcaaaaggcgctgaatcctctattttgcctaagtgcatcggaggcgagatcgaaaaaacccggattcacgtcgatgagttcgctctgaagggactgaggaccctctgtatcgcgtacagaaagttcaccagcaaagagtacgaggagatagacaaaagaatctttgaggcacgtacggctttacagcagcgagaagagaagctggccgccgtctttcagtttatagagaaggacctgatcctcctgggcgccactgccgtggaggatcgactccaggataaggtacgggaaactatcgaggccttgcgtatggctggcatcaaggtgtgggtgttaaccggcgacaagcatgagacagccgtcagcgtgtccctgtcttgcgggcacttccatcgaaccatgaatattcttgagctgataaaccaaaagagcgattcagaatgcgctgagcagctgaggcagctggcccgccgtattacagaggaccacgtaatccaacacggccttgtcgtggacggtacgtccctgtccttggcgctgcgggagcacgagaagctcttcatggaggtgtgcagaaactgctccgcagtcctgtgctgccggatggctccgttgcagaaagcaaaggttatcagactgatcaagatcagccctgaaaagcccatcaccctagctgtgggcgatggggctaatgacgtcagcatgattcaggaggcccacgtcggcatcggaattatgggaaaggagggcagacaggctgccaggaactccgactacgccatcgcccgctttaagttccttagtaaactgttatttgtgcacgggcacttttattatatccgcattgccaccctggttcagtatttcttttacaagaacgtgtgtttcataaccccccagtttctttaccagttctattgcctgttctcacagcagacattgtatgactccgtgtatctgacactgtacaatatttgcttcacatcgctaccaatactgatttatagcctcttagagcagcatgtggaccctcacgtactccagaacaagcctactctgtatagagacatctccaagaaccggctgctgtccatcaagacgtttctgtactggaccattttgggcttttcccatgcctttatttttttcttcggtagctatctgcttataggcaaagacacaagcctgttgggaaacggccagatgttcggaaactggaccttcgggactttggtgttcacagtcatggtcattacagtaactgtgaagatggcgctcgagacccacttctggacctggatcaatcatctcgtgacctggggatctattatcttttatttcgtctttagcctcttctacgggggtatcttatggccattcttaggctctcaaaacatgtattttgtgttcatccaactgctcagttccggttccgcctggttcgcaatcatattaatggtggtaacctgtctgtttttggatatcatcaaaaaagtgtttgacagacacctgcatcctacaagcaccgagaaagctcagctaacggaaacgaatgccggaatcaagtgtttggacagtatgtgttgcttccctgagggtgaggcagcctgtgcctctgtcggacgtatgctggagcgggtcatcggccgatgttctcccactcatatctcacgtagttggtccgcatcagacccattctacacgaatgatcgaagcatcctaaccctgtcgacaatggattctagcacctgctag

SEQ ID NO: 179835 - DNA, 315 bp, Artificial Sequence
  Description of Artificial Sequence: Synthetic coding sequence
atgtacttcgtgttcatccagctgctgagcagcggcagcgcctggttcgctataattctgatggtggttacgtgcctgttcctagacatcatcaagaaggtctttgatcgccatttacatcctacgtctacggagaaagcccaaatgtattcaaataccgtggccttgtcagacgaattcatcgcattgcaacccttgagcagagctcgcaatcagctgagcaagttgagatggaaaaagatccgcgtgcagagcgctcagcacatgaacctgctcaaggccagcactgagggccgcacagttggaacttgctag

SEQ ID NO: 179836 - DNA, 4503 bp, Artificial Sequence
  Description of Artificial Sequence: Synthetic coding sequence
atggaccccagcatgggcgtgaacagcgtgaccatcagcgtggaggggatgacttgcaattcatgtgtgtggaccatcgaacagcagatagggaaggtcaatggtgtacaccacattaaggtgagtctggaagagaagaacgccaccattatctatgatcctaaattacagacacctaaaacactacaggaggccatcgacgatatgggattcgacgccgtaattcataatcccgatcccttaccggtactgacagataccttatttctgaccgtgacagcgtccctcaccctgccgtgggatcatatccagtccacactacttaagactaagggcgtgactgacatcaagatctacccacagaagcgcactgtggccgtaacaatcataccaagcatcgtgaacgcgaatcagatcaaggaactagttcctgaattatccttggatactggcactcttgaaaagaaaagcggggcatgcgaagaccactcaatggcacaggccggggaagtcgtcctgaaaatgaaagtggagggcatgacttgtcattcttgcacctccactatcgaaggcaaaatcggtaagctgcagggtgtgcagaggattaaggtgtcacttgataaccaggaagccacgattgtatatcagcctcatctgattagcgtggaggaaatgaagaagcagatcgaagccatgggcttccccgcctttgtcaaaaagcagccaaaatacctgaagctgggggccattgacgtcgaaaggctcaagaatacgcccgtgaagagcagtgagggaagccagcagcgtagccccagctacactaacgactctacggctacctttatcatagacggcatgcattgtaaaagctgtgtgagtaatatcgagagcactctgtccgcgctgcagtatgtgagttcaatagtcgtgtcactggaaaacagatctgccattgtgaagtacaacgcgagctcggttacacccgagagtctgcggaaagctattgaggccgtgagcccggggctgtatagggtcagcataacatcagaggtggagagcacgagcaacagtccttccagttcatcactgcagaagatccccttgaatgtcgtctcccagccgctcacacaagagaccgttatcaacatagatggcatgacgtgtaactcctgcgtacagtctattgagggcgtcatctccaagaagccgggagtcaagagcattagagtctcccttgcaaactccaatgggaccgtggaatatgatcccttgctcacttctcccgagacacttagaggcgccattgaggacatgggatttgatgccaccctatctgacaccaatgagcccctggtcgtaatcgcccagcccagcagcgaaatgcctctactgacctctaccaatgaattttataccaagggcatgacaccagtgcaagacaaagaggaaggcaaaaactcatccaagtgctacatacaggttaccggaatgacctgcgctagttgcgtcgctaacattgaacgcaacctccgccgtgaagaggggatctacagtattctcgttgcgctaatggcaggcaaagctgaagtgcgatacaaccctgccgtgatccagcctcccatgatagccgagttcatcagagagctgggctttggggccaccgtcatcgaaaacgctgacgagggggatggcgttctggagctggtggtacgaggcatgacctgcgccagctgcgtgcacaagatcgagtctagcctcaccaagcacaggggcattctgtattgctcagtggcactcgccacaaataaggcccacatcaagtacgatcccgagattattggccctcgtgacatcattcataccattgaaagcctcgggtttgaggcaagcctcgtcaagaaagatagatccgcatcacacctggaccacaaacgggaaattcgccaatggcggcgatctttcctggtatctctgttcttttgcatccccgtcatgggtttgatgatctacatgatggttatggatcaccattttgcaaccctgcaccacaaccagaatatgtccaaagaggagatgattaacctgcatagcagcatgtttcttgagcgccagattctgcccggactctccgtgatgaacctgcttagctttctgttgtgtgtgcctgtgcaattctttggaggatggtatttctatattcaggcgtataaggccctgaaacacaagactgcaaacatggatgtgttgatcgttcttgctaccaccatcgccttcgcatatagcttgataattttgcttgtagcaatgtatgaacgggcgaaagttaatcctattacgttctttgacactcccccaatgttgtttgtctttatcgccctggggagatggttagagcacatcgccaagggtaagaccagtgaggctctggcaaagctcatctcactccaagctaccgaagccactattgtgacccttgactccgacaacattctcttaagtgaagagcaggtagacgtggagttagtgcagaggggggacataattaaggtagttcccggcggcaaatttcccgtcgacggcagagttatcgagggacattccatggtggatgagtctctcatcaccggtgaagccatgccggtggcgaaaaaacccggatcgaccgtaattgctggttcgattaatcaaaacgggtctctgctgatctgtgcaactcatgttggcgctgatacaaccctgtcacaaattgtaaaattagtcgaggaggcccagacatccaaggcccccattcagcagttcgccgataaactcagcggctactttgtgccattcattgtcttcgtgtccattgctacccttctcgtgtggattgtcattggcttcctgaatttcgagatagtggaaacttacttccctggatacaaccgaagcatttcgagaaccgagactattatcaggttcgcatttcaggcttccattacagtcctctgtatcgcttgtccatgttctctgggactggcgacaccaacagcagtgatggtcggaacaggtgtgggtgcacagaatggaatcctcatcaaaggaggcgagcctctggagatggcacacaaagttaaagtggtcgtgtttgataagacgggcacaattactcacgggacacccgtggtcaatcaagtgaaagtgctgactgagtcaaataggatttcacaccacaaaattctggctatcgtcgggaccgctgaatcaaatagtgagcaccccctgggaaccgcgattaccaaatactgcaagcaagagctggatactgaaaccctcggaacatgcatcgactttcaagttgtacctggttgtggcatcagttgcaaggttacaaatatcgaagggctgctgcacaaaaacaattggaacattgaggacaacaacatcaaaaacgcaagcctggtgcagattgacgcctcgaatgagcagagctcaaccagctctagcatgatcattgacgcgcaaatctcgaacgccctgaatgcacagcagtacaaggttctgatcggaaacagagagtggatgatccgcaatggacttgtgatcaacaacgatgtcaatgactttatgacagaacatgagaggaagggaaggaccgccgtcctggtggcagtggacgacgagttgtgcggactaattgccattgcagataccgttaagccggaagctgagctggcaattcatattttgaagtcaatgggccttgaagtagtcctaatgactggggacaactctaagaccgccagatccattgcctcccaggtgggaatcactaaggtcttcgctgaggttctgcccagtcataaggtcgcaaaggtgaaacaattacaggaggaggggaaaagggtcgctatggtgggcgatggcataaatgattcccccgccttggcaatggccaatgtcgggattgctattggcaccggaaccgatgttgctatcgaggccgccgatgtggtgctcatccgaaatgacctgctagacgtggtggcttctatagatttgagccgcgagaccgtcaaaagaatccgtattaacttcgtgtttgctctcatttacaacctcgtcggtatccccatagcagcaggagtcttcatgcccatcggtctggtgctgcagccgtggatggggtctgcagcgatggccgcgtcttcggtcagcgtcgtgctatcaagcttatttctgaagctgtaccgcaagcccacctatgagtcatacgagctgcccgctcgcagccagatcggacagaagagtcctagcgagatctcagtccacgtggggatcgacgacacaagtcgcaatagccctaaactagggttgcttgaccgcattgtgaattactcaagagcgagtatcaatagcctgttgtctgataagagatctctcaactctgtggtcacctctgaacccgacaagcactcgctcctcgtgggggattttcgggaagatgatgacaccgcattgtag

SEQ ID NO: 179837 - DNA, 4269 bp, Artificial Sequence
  Description of Artificial Sequence: Synthetic coding sequence
atggaccccagcatgggcgtgaacagcgtgaccatcagcgtggagggaatgacctgtaattcatgtgtgtggacaatcgagcagcaaataggcaaagtcaatggtgtccatcatatcaaagtgtctctggaagagaagaacgccaccattatttacgaccctaaactgcagacccctaagacattgcaggaagctattgacgatatgggattcgacgctgtgatacacaaccccgatccactgcccgtgctcactgatacattgttcctcaccgtcaccgcatctctgaccctgccttgggatcacatccagagcacgctgttgaagaccaagggtgttaccgacatcaagatatatccacagaagcgaactgtggcggtcacaattatccctagcatcgtgaatgcaaatcagataaaagaactcgtgccagaattgagcctcgataccgggaccctagagaaaaagtcaggggcatgcgaagaccacagcatggcccaggccggcgaagtggttctgaaaatgaaggtggagggtatgacctgccactcatgcacctccactattgagggcaaaattgggaagctgcaaggagtgcagagaataaaggtctcattggataatcaggaggccacaatcgtctatcagcctcatttgataagcgttgaggagatgaagaagcagatcgaagccatgggatttcccgcttttgtgaaaaagcagcccaaatatctgaaactgggcgctattgatgtcgagcgtcttaagaataccccagtcaagtcaagtgagggtagtcagcagcgctccccctcttacacgaatgactcaacagctacgttcatcatcgacggtatgcactgcaaatcctgcgtgagcaacattgagtccaccctgagtgcattgcagtatgttagctcaattgtggtgtccctcgaaaaccggtccgccatcgtgaaatacaatgcttcaagcgtcactccagagagtctgcgtaaagccattgaggctgtcagccctggcctgtaccgggtcagtatcacgtcggaagtggagtccacaagcaatagcccttcttcttcctctcttcagaaaatcccactgaacgtggtgtcccaaccccttacacaggagacagtgattaatatcgatggcatgacctgtaacagttgcgttcagtcaattgaaggcgtgattagcaagaagccaggagtcaagtcgattagggtatcactggcaaactctaatgggaccgtcgaatacgatccactcctcacttcccctgaaacacttcggggggcaattgaggatatgggtttcgatgcgactctttccgatacaaacgagccactggttgtgatcgcccaaccttcatctgaaatgcccctcctcaccagcacaaacgagttttatactaagggaatgaccccggtccaggacaaagaggaagggaagaattctagcaagtgttatatccaggtgacaggcatgacctgtgcctcatgcgtggcgaatattgaacgcaatttgcggagggaagaaggtatttattctatcctggtggccctgatggcgggcaaggcagaagtgagatacaaccctgcagtaatacagccgcctatgattgccgagttcatccgggaactgggtttcggcgccactgttatcgagaacgccgacgagggggacggtgtgctggagcttgttgtgcggggaatgacttgcgcctcctgcgtgcataagatcgagtcgagcctgaccaaacaccggggaattttatattgttcggtcgctcttgctacaaataaagcacacattaagtatgatcccgagatcatcgggcccagagacataatccacaccatagagtctctcggatttgaagccagcctggtgaagaaggataggtcagccagccatctggaccacaaacgcgagatccgacagtggcgccgcagtttcctggtgagccttttcttttgtatcccagtgatggggctgatgatctatatgatggtcatggaccaccatttcgccacgctccatcataatcagaacatgtcgaaagaggagatgatcaacctccacagttctatgtttctggaaaggcagatccttcctggcctgtccgtgatgaacctgctttctttcttgttatgtgtgcctgtccaaggaaaaactagtgaagctcttgcaaaactcatttcattacaggccactgaagctaccatcgtgaccctggactctgacaacattctcctgagcgaggaacaggtggatgtggaactggtgcagcggggcgacattatcaaggtggtgccaggcggaaaattccctgtggatggccgcgtgatcgaaggccattctatggtggatgagtctctcatcaccggcgaagcaatgcctgttgccaagaagcctggctcaacagtcattgcaggatccattaaccagaacggctcactcctgatttgcgcaacccacgttggcgcggacaccacactgtctcagattgtcaaactcgtcgaagaggcgcagaccagtaaagcccccattcagcagttcgcagataaactgtccggctacttcgtccccttcatcgtttttgtgagtatagcgaccctcctcgtctggattgtaattgggttcctcaactttgagatagttgaaacctatttccccgggtataatcgatcgatttcccgtacggagactatcatccggtttgcattccaggcgtctattacagtgctctgtattgcatgtccctgttctctgggattggcaactccaactgctgtgatggtggggaccggcgtgggagctcaaaatgggattttgatcaaagggggcgaaccactggagatggcccacaaagtgaaggtagtcgtgttcgacaaaactgggacgattacacacggcactcctgttgtgaaccaggtgaaggtgctcacggagagcaacagaattagccatcacaaaatcctggccatcgtgggcacagctgagtcaaatagcgagcatcccctgggcactgcaattactaagtattgcaagcaggagcttgacaccgagacactcggcacctgcattgactttcaggtggtccccgggtgtggaatatcttgtaaagtgactaacatcgaagggctgttgcacaaaaacaactggaatatcgaggataataacattaagaacgcaagcctggtgcaaatcgacgcctctaatgagcagagctccacttcaagctcaatgatcatcgacgcccagattagtaacgccttgaatgctcagcaatacaaagtgctgatagggaatcgcgaatggatgatcaggaatggattggtcatcaataacgacgtcaatgacttcatgactgaacatgaacggaaggggagaacagctgttctggtggcggtagacgatgagctgtgtggccttatcgctattgcagatacagttaaaccagaagcagaacttgccatccatatccttaaatccatgggtctggaggtcgtgcttatgactggggacaactcaaaaacggcaagatccattgcatctcaggtgggaatcacaaaagtcttcgctgaagtgctcccgagccacaaggttgctaaggtcaagcagctgcaagaagagggtaaacgggtggccatggttggggatggcatcaatgatagtccggccctggccatggccaacgtcggaatcgccattggtacagggacggatgtggccatcgaagcagctgacgttgtcctcatcaggaacgaccttctcgacgtagtggctagcattgacttaagtagggaaactgtgaagcgtatccgaatcaactttgtattcgctttgatatataacctcgtgggtatccccattgccgcgggggtgttcatgccaatcggcctggtgttgcaaccctggatgggcagtgcagccatggccgcttcatctgtaagtgtcgttctttcctcgctgtttctgaagctgtacagaaaaccaacgtacgaatcttacgagctcccagcgagatcgcagattgggcagaaatctccttcagagattagcgtgcacgtaggtatcgatgataccagcagaaatagccccaagcttggcttgcttgacagaatcgtgaactattccagggccagtataaattcactgcttagtgataaaagaagtctaaactccgtagtgacatcggagcctgacaaacattcactcctagtgggcgattttcgtgaagatgatgacacggcactgtag

SEQ ID NO: 179838 - DNA, 264 bp, Artificial Sequence
  Description of Artificial Sequence: Synthetic coding sequence
gagtgcaacgaggagatcaagatggaccccagcatgggcgtgaacagcgttactatttctgtggagggaatgacatgtaattcatgcgtgtggaccatcgagcagcagattggaaaagttaacggagtgcatcatatcaaggtgagcttggaggagaaaaacgctacaattatcttctacgcacattggttcggcttcgctgcacttgatgggatatgttccaatgggtgctttatctgcttctgtagcactttcttctcttag

SEQ ID NO: 179839 - DNA, 1512 bp, Artificial Sequence
  Description of Artificial Sequence: Synthetic coding sequence
atggaccccagcatgggcgtgaacagcgtgaccatcagcgtggagggcatgacctgcaacagctgcgtgtggacaattgaacagcagatcggaaaggtcaatggagtgcatcatattaaggtaaaagtggtggttttcgacaaaacggggaccatcacccatggcacaccagtggtgaaccaagttaaggtgcttaccgaatccaaccgtattagccaccacaaaatattggctatcgtgggtaccgctgaaagcaactctgagcaccccctcggtactgccattaccaaatattgcaagcaggaattagacacagaaacattgggcacctgcatcgattttcaagtagtgccaggctgcggcatttcatgcaaggtcacgaacattgaaggactcctccacaaaaataattggaacatcgaggataataatataaagaacgcatccctcgtgcagattgacgcatcaaacgagcaatcctccaccagcagctcaatgattatcgatgcccagatttcaaatgctctgaacgcccagcagtacaaggtactaataggtaaccgagaatggatgatacgcaatgggttggtgattaataatgatgtcaatgattttatgaccgagcatgagcgaaaagggcgtaccgctgtgctggtcgccgtggatgacgagctgtgtgggctcattgctatcgctgacacagtgaagcccgaggctgagctcgccatccacatcttgaagtcgatgggcttggaggtcgttctgatgactggagataactctaagacagcacggtccatcgctagccaggtaggaatcaccaaagtctttgctgaagtgcttccaagccataaagtggccaaagtcaagcagttacaggaggagggcaaaagggtggcaatggtcggggacggtatcaacgactcacccgcactcgcaatggccaatgttggcatcgcgatcggaacaggcactgacgtggccatcgaagccgctgacgttgtactgatcaggaatgatctgttagacgttgtggctagtatagatctgagtcgcgaaaccgttaaacgaatccggatcaacttcgtgttcgcccttatctacaaccttgtaggaatacccatcgctgcaggagtctttatgccaatcggtctcgtgctgcagccctggatgggatcagccgctatggctgcctcttccgtgtcagtggtgctatcctctctcttcctgaaattatatagaaagcctacttacgaatcatatgagctgcccgctagatctcagatcgggcagaagtcacccagcgaaatctcagtgcatgtaggcatagatgatacatcccgcaactctcctaagttgggcttactcgatcgcatcgtgaactattcccgggccagtattaattcacttctgagcgataaaagatctcttaactctgtggttacgagcgagcctgacaaacattctctattggtgggagattttcgggaggatgacgataccgcgctctag

SEQ ID NO: 179840 - DNA, 2049 bp, Artificial Sequence
  Description of Artificial Sequence: Synthetic coding sequence
cggaaccaggagtgcaacgaggagatcaagatggaccccagcatgggtgtgaattccgttaccatcagcgtcgagggtatgacatgtaactcttgcgtttggacgatagaacagcagataggcaaagtcaatggcgtccaccacatcaaggtcagtctggaggagaagaatgcaactatcatttacgatccaaagttgcagacacctaagaccctacaggaagcaattgatgacatgggatttgatgccgtaatacataacccagatcccctgcctgtgctcaccgatactctttttttgaccgtgacagcatcactgacgctcccctgggaccacattcagtcaacactgctgaagaccaaaggggtaacagatatcaaaatctacccccagaagaggacagtggctgtcactatcatcccctccatcgtaaatgccaatcagataaaggaactggtgccagagctgtccctggacactggaactttagagaagaagtcaggggcttgtgaggatcacagcatggctcaggccggtgaggtggttctcaagatgaaggtagagggaatgacatgccacagttgcacatccacaattgaagggaaaattggaaaacttcagggcgtccaacgcataaaggtttctctcgacaatcaagaagccactatcgtctatcaaccgcacttaataagcgtcgaggagatgaagaaacagatagaggccatggggttccccgcgtttgttaaaaaacaacccaaatacctaaaattgggggcaatcgacgtggagaggttaaagaatactcccgtgaaaagctccgaaggaagccaacagcgctccccaagctacaccaacgattccactgccacattcataatcgatggcatgcactgtaagagttgtgtgtctaacatcgaaagcacccttagtgctttacagtatgtaagcagtatcgtcgtgtcccttgaaaacaggtctgcaatcgttaaatacaacgccagttcagtgacaccggaatcccttagaaaagcaatcgaagcagtatctcctggtttgtacagagtttccattacgagtgaggtggaaagcacctctaacagtccaagttctagcagtctgcaaaaaatccctcttaacgttgtgtctcaacctcttacacaagagaccgtcattaatatcgacgggatgacctgtaactcttgtgtgcaatccatcgaaggcgttatctccaaaaagccaggagttaaaagcatccgcgtgtcgcttgcaaattccaacggtaccgtcgaatacgatcctctcctcacatctcctgagacactccggggggccatcgaagacatggggtttgatgcaacattgtctgatacaaatgaaccgctggtcgtgatcgcacagccttccagcgaaatgcccctgttaacgagcactaatgagttctatacgaaaggaatgacaccagtgcaagacaaggaagaaggcaagaactcctctaagtgctatatccaggttaccggaatgacttgtgcaagctgcgtcgccaacatcgagcgtaatctcaggcgagaggaaggtatttactccatcctggtagcactcatggcaggtaaagccgaggtgcggtacaaccctgctgtcatccagccacccatgatcgctgaatttatcagggagctcggctttggggccactgtgatcgaaaacgcggatgaaggagatggggtgctggaattagtcgtacggggcatgacctgtgcatcgtgcgtccacaagattgagtctagtctgacgaaacacagaggcatcctgtactgttcagtcgcccttgctaccaacaaagcgcacatcaaatacgatccagagattatcggaccccgcgatattatccacaccattgaagtcagtgcaaaaaacttgtgcttctgtgtgttgacatacctcatttcaaccccagtcaatcacttctggtttgcatccgatcggggcaatgagaaaaaatctaatagcttcgaacatttcaagcaggatctttcccaaaacctgatgtag

SEQ ID NO: 179841 - DNA, 825 bp, Artificial Sequence
  Description of Artificial Sequence: Synthetic coding sequence
atggaccccagcatgggcgtgaacagcgtgaccatcagcgtggaggggatgacctgtaacagctgcgtttggactatcgaacagcaaattggcaaggtgaacggcgtacatcacattaaagtgagcctggaagagaagaacgccactattatttacgatcctaaactccagaccccaaaaactcttcaagaagccatcgatgacatgggattcgacgctgttatccacaatcccgatcctctgcctgtcctgacagacaccctattccttaccgtcaccgctagtttgaccctgccatgggatcatatacagtccaccctgcttaaaacgaaaggcgtgacagacattaagatctatcctcagaaaagaactgtcgcggttacaattatcccctcgatcgttaacgccaaccagataaaagagctggtgcccgaactatcgctcgatacgggcacacttgaaaagaaaagcggcgcatgtgaagaccactccatggcccaggctggcgaggtggtcctcaaaatgaaggtggagggaatgacctgccatagttgcacctcaaccatcgaaggaaagatcgggaaactgcagggggtgcagcggatcaaggtcagtctggataatcaggaggcgacaatagtatatcagcctcatctgatttcggtggaggagatgaagaaacagattgaggctatgggctttcctgcatttgtgaaaaagcagcccaagtatctcaagctgggtgcaatcgatgtggagaggctgaaaaacaccccagtcaagtcatctgagggcagtcagcagcggtctcccagttaccagtag

SEQ ID NO: 179842 - DNA, 546 bp, Artificial Sequence
  Description of Artificial Sequence: Synthetic coding sequence
atgcggcccagcggcacctgcgccagctgcggcagcgaccccccccctcctacccaagttccctctagccgcaacgattgtggctcaaccgtgcccgacaatccttttgtacgcaccttacctcatacaactatgtctggccaccaactgcctcctgccggaacccagcgacccggacccgccgcctgcctggtccccggtagcttaccaagcttaccttcccagcctggcccttggggggctctcggtacagccgccgccgaaggaatgtcttgctccaatacaagaaccgcactcgaatttgctcttttccccaaggaaatgctgttggggtcctggtatggatggggactgagcctgtatcgaagagggaggtgccaggattccgctcaccctgaggaagacacttgcccacacggagagggcgccccagcccaagccggggaaagtgtgccctcacagcagttgtgtcaccatcccgccggtaactggggcggactgtactgggtgattggcaaagcttttagtctggcttggaactgttag

SEQ ID NO: 179843 - DNA, 642 bp, Artificial Sequence
  Description of Artificial Sequence: Synthetic coding sequence
atgcgggtgcggggccccgcccggctgatcgccagcggcgcccggctgcttctccgcatgctgagtgcactgccaggatggggacctgctcaccttcaaaggccgctattggggccggctagttgtctgggtatcttacgaccagccatgactgcccactcgttcgcactgcctgtgatcatctttaccactttctggggtttggtgggcattgctggtccgtggtttgtgcctaagggaccaaaccgcggggtcataataaccatgctcgtcgccacagctgtgtgttgttatctgttgtgtcctgcactcgggatgactgtcgctcccctgagcctgaccacaccgtcctccggtccgtcccctacacagctgtgtctcgtgacatcctccctgctactggcacctcgagatccggatccacaaggcctccctggctcttggaagtcaagccagagctctcagccagcacgggccctgggcagcccaggccacagcagtggccgtggagatgttttgctacagtacccccactgcagcggtgtttgtcccctgtctcagggggatgctgctggcgagctggtatgggtggggtcttttcctctgcaaactggacagatgccaggactgtcgcccagctag

SEQ ID NO: 179844 - DNA, 495 bp, Artificial Sequence
  Description of Artificial Sequence: Synthetic coding sequence
atgaccgcccacagcttcgccctgcccgtgatcatcttcaccaccttctggggcttggtgggcatcgcaggcccctggttcgtgcctaaaggtccaaacaggggagtaattatcactatgctggtagctaccgcagtgtgctgttatctcctgtgtcccgccctaggtatgactgtggcccccctgtccttaaccactccctctagtggcccgagccccacccagttgtgcctcgtgacttcaagtctgctgttggctcccagggaccctgatccacagggcctgcccggcagctggaagagctcccagtcttcacaacctgctagagccctgggtagcccaggacattcttccggcaggggggatgtgctgctgcagtacccacactgctctggggtatgcccattgtctcagggagatgccgccggcgagcttgtctgggttgggtcttttcctctgcagaccgggcagatgcctggcctgtcccctagctag

SEQ ID NO: 179845 - DNA, 393 bp, Artificial Sequence
  Description of Artificial Sequence: Synthetic coding sequence
atgcgggtgcggggccccgcccggctgatcgccagcggcgcccggctgctcctgaggatgctgtccgctctccccgggtggggtcctgcacacctgcaaagacctctgcttgggcccgcctcctgtctgggcatcctgaggcctgctatgactgcccactcatttgctctgccagtgatcatctttacaacattttgggggctcgtgggcattgcaggcccatggtttgtccctaagggacccaatcggggtgtgatcatcactatgctagtggcaacagctgtttgttgctatcttttttggctgatcgccatcttggcacagctgaatcccctattcggcccccagctgaagaacgagactatttggtatgtgaggttcctttgggaatag

SEQ ID NO: 179846 - DNA, 246 bp, Artificial Sequence
  Description of Artificial Sequence: Synthetic coding sequence
atgaccgcccacagcttcgccctgcccgtgatcatcttcaccaccttctggggtttggttggcatcgccggaccctggttcgtgccaaagggccccaaccgaggtgttatcatcactatgctggtcgccacagccgtttgctgttatttgttttggctgattgctatcttagctcagttaaacccattgttcgggccacagttaaagaacgagacaatatggtacgtccgctttctttgggagtag

SEQ ID NO: 179847 - DNA, 564 bp, Artificial Sequence
  Description of Artificial Sequence: Synthetic coding sequence
atgaccgcccacagcttcgccctgcccgtgatcatcttcaccaccttctggggcctggttggtatcgccgggccttggtttgtgccgaagggtcccaacagaggcgtgattatcactatgttagtcgcgaccgctgtgtgttgctatctgttttggctcatagccatactggctcaactgaatccactttttggcccgcaactgaaaaacgagactatctggtgccctgcattggggatgactgtggcccccctttctttgaccacaccttcttcaggacccagccctactcaactctgtcttgtcacctcaagcttactgctggcccctcgggaccctgatcctcagggcctgcctggatcttggaagagtagccaatctagtcaaccagcccgcgcactgggctcacccggtcactcaagcggtcgaggggacgttctgttgcagtatcctcattgtagtggtgtttgtcccctgagccagggagacgcggcgggcgaattagtatgggtcggcagctttccgctgcagaccggacagatgcccggtctcagcccatcatag

SEQ ID NO: 179848 - DNA, 357 bp, Artificial Sequence
  Description of Artificial Sequence: Synthetic coding sequence
atggccagccagagccagggcatccagcagctgctgcaggccgagaaacgtgcagctgagaaagtgtcagaggcccgaaaaagaaagaatcgcagactaaagcaggccaaagaagaggcgcaagccgaaatcgagcaatatcggctgcagagagagaaggaatttaaagctaaagaagctgccgcgctgggaagccgagggtcttgtagtaccgaggtcgaaaaagagacacaggagaaaatgacaatactacagacatacttccgacagaatcgcgacgaagttctggacaatctgctcgcttttgtgtgtgatatcagacctgagattcacgaaaattatcgcatcaacggatag

SEQ ID NO: 179849 - DNA, 357 bp, Artificial Sequence
  Description of Artificial Sequence: Synthetic coding sequence
atggccagccagagccagggcatccagcagctgctgcaggccgagaaacgagcagccgaaaaggtggccgatgctaggaagcgcaaagctaggcggctcaaacaggcaaaggaagaggcccagatggaagttgagcagtaccgtagggaaagggagcacgagttccaatccaaacagcaggccgctatgggaagccagggcaatttatccgcggaagtggaacaggcgacccggcgccaggtccaagggatgcaaagttctcagcaacgcaatagggaaagagtgctcgctcagttactgggaatggtctgcgatgttagacctcaggtccatccaaactacagaatcagtgcttag

SEQ ID NO: 179850 - DNA, 237 bp, Artificial Sequence
  Description of Artificial Sequence: Synthetic coding sequence
atggccagccagagccagggcatccagcagctgctgcaggccgagaagagagctgctgaaaaggttgcagatgcacggaagcggaaagctaggcggcttaagcaggcgactaggagacaagttcagggaatgcagagcagccagcagcgaaatcgcgagcgcgtgctagcccaattgctggggatggtttgcgatgtgcggccccaggtgcatcccaattaccggatatcagcatag

SEQ ID NO: 179851 - DNA, 357 bp, Artificial Sequence
  Description of Artificial Sequence: Synthetic coding sequence
atggccagccagagccagggcatccagcagctgctgcaggccgagaaacgggctgctgaaaaggtcgccgacgctaggaagcgcaaggctagaagattgaaacaagccaaggaggaggcgcagatggaggtagagcaataccgacgggagagagagcacgagtttcaaagcaaacagcaggcggcaatgggcagccaaggcaacctttctgccgaggttgagcaggctaccagaagacaggtgcaggggatgcagagttcgcagcagcggaaccgtgaaagagtcctagcccagctcctgggaatggtgtgtgacgtccggccccaagtgcatccaaactatagaattagtgcgtag

SEQ ID NO: 179852 - DNA, 477 bp, Artificial Sequence
  Description of Artificial Sequence: Synthetic coding sequence
ggcggccagcagcacgccgtgccctgcccccacggcggccccggcggccaggggcagccgagggccgaagctgctggcacaggacagggccaccgcgggggtcacagacccggtgccgtggtcggggctgctcagcatttgcacagaggcttaggggtagccggcgggggcccagggcccggcccagctgtgctgcagactagaaaagcccgaaggcttaagcaggccaaggaggaagctcagatggaagtagaacagtatcgacgggagcgagagcacgagtttcagtcaaaacagcaagctgcgatggggagtcaggggaacctgtcagccgaagtcgaacaggctacacgtcgccaggtgcaaggcatgcaaagcagtcaacagagaaatcgggagcgcgtattagcgcagctgcttgggatggtgtgtgatgtgagaccccaggtccaccccaattaccggatctccgcgtag

SEQ ID NO: 179853 - DNA, 237 bp, Artificial Sequence
  Description of Artificial Sequence: Synthetic coding sequence
atggccagccagagccagggcatccagcagctgctgcaggccgagaagcgggcagccgagaaggtcgcggacgcccgaaaaagaaaggcacgcaggctgaagcaggccaccagacgacaagtccagggcatgcagagcagccaacagagaaaccgggaaagggttctcgcccagctcctgggtatggtatgtgacgtgcggcctcaggtccatcccaactacaggatcagcgcgtag

SEQ ID NO: 179854 - DNA, 237 bp, Artificial Sequence
  Description of Artificial Sequence: Synthetic coding sequence
atggccagccagagccagggcatccagcagctgctgcaggccgagaaacgcgctgcagaaaaggtcgcggatgctcggaaacggaaggctcgacgacttaagcaggctacccgaagacaggtccaggggatgcagtcctcccagcagagaaaccgggagagggtcctggcccaactgttgggaatggtgtgtgacgtcaggccacaggtacatccaaactatcggatatccgcctag

SEQ ID NO: 179855 - DNA, 357 bp, Artificial Sequence
  Description of Artificial Sequence: Synthetic coding sequence
atggccagccagagccagggcatccagcagctgctgcaggccgagaaaagagcagcagaaaaggtagccgacgcccgcaagcgcaaagctcgacgtctcaagcaggccaaggaggaagcccagatggaagtggaacagtataggcgggaaagagaacacgaattccagtcaaaacagcaagccgctatgggttcacagggaaatttgtccgctgaggtcgagcaggcaacacgacggcaggttcagggaatgcagtcatcacagcagaggaaccgggagagggtccttgctcagctcttggggatggtgtgcgatgtgcgtccacaggtgcatcccaattaccggatctcagcctag

SEQ ID NO: 179856 - DNA, 237 bp, Artificial Sequence
  Description of Artificial Sequence: Synthetic coding sequence
atggccagccagagccagggcatccagcagctgctgcaggccgagaaacgtgcagccgaaaaggtggcagatgctagaaagagaaaagccagacgtctaaaacaggcaacaaggcgtcaggtccagggaatgcaaagctcccagcagcgcaaccgggagcgggttctggctcaattgctcgggatggtttgtgacgtgaggcctcaagtgcaccctaattaccgaatctctgcatag

SEQ ID NO: 179857 - DNA, 357 bp, Artificial Sequence
  Description of Artificial Sequence: Synthetic coding sequence
atggccagccagagccagggcatccagcagctgctgcaggccgagaaaagggcagcggagaaagtggctgacgcccgcaaacggaaggctcgcaggctaaagcaagccaaggaggaggcccaaatggaggtggaacagtaccggagagaacgggaacacgaattccagtctaaacagcaggcagccatgggcagccagggtaacctgagtgcagaagtcgaacaggctacgaggcgacaggttcagggtatgcagagtagccagcagagaaatcgggagcgtgtcctagcccaactactcgggatggtatgcgatgtgcggcctcaagtccacccaaattacaggatatcagcttag

SEQ ID NO: 179858 - DNA, 237 bp, Artificial Sequence
  Description of Artificial Sequence: Synthetic coding sequence
atggccagccagagccagggcatccagcagctgctgcaggccgagaagcgggccgcggaaaaggttgcagacgctcggaaacgcaaggcgcgacgcctgaagcaggccacgaggcgacaagtccaagggatgcaatcatctcagcagcggaatagggagcgggtgctcgctcagctgctgggaatggtctgcgacgtgcggccgcaagtacatcccaattacagaattagcgcctag

SEQ ID NO: 179859 - DNA, 237 bp, Artificial Sequence
  Description of Artificial Sequence: Synthetic coding sequence
atggccagccagagccagggcatccagcagctgctgcaggccgagaagcgcgctgccgaaaaggtagccgacgcccgcaaacgcaaggcgcggagacttaagcaggcaaccagaaggcaggtgcaaggtatgcaatcaagccagcagagaaaccgggaacgtgtgctggcacagcttctgggtatggtgtgcgatgttaggccacaagttcaccccaactatcgtatcagcgcctag

SEQ ID NO: 179860 - DNA, 357 bp, Artificial Sequence
  Description of Artificial Sequence: Synthetic coding sequence
atggccagccagagccagggcatccagcagctgctgcaggccgagaaaagggccgccgagaaagtagctgatgctcgaaagagaaaagcccgacggctgaagcaggccaaagaagaggcccagatggaggtggagcagtatagacgcgagcgggagcatgaatttcagagtaagcagcaggcggctatgggctctcagggaaacctgagcgcagaagtggagcaggccacccgacgacaagttcagggtatgcagtcatctcagcagcgaaatcgtgagcgcgtcttagcacaactgctgggcatggtctgcgacgtgcgtcctcaagtacacccaaactataggataagtgcctag

SEQ ID NO: 179861 - DNA, 237 bp, Artificial Sequence
  Description of Artificial Sequence: Synthetic coding sequence
atggccagccagagccagggcatccagcagctgctgcaggccgagaaacgcgcagccgaaaaagtggccgatgcaagaaaacgtaaggcccgacggctgaaacaggcaaccaggcgccaggtccaggggatgcagagctcccaacagcgcaatagagagagagtgctagcccagctccttggtatggtctgtgacgtgcggccacaggttcaccccaactatcggatcagcgcctag

SEQ ID NO: 179862 - DNA, 357 bp, Artificial Sequence
  Description of Artificial Sequence: Synthetic coding sequence
atggccagccagagccagggcatccagcagctgctgcaggccgagaagagagctgctgagaaggtcgctgatgcaaggaaacggaaggcacgcagactgaagcaagcaaaggaggaagcacagatggaagtcgagcagtatcgaagggagagggagcacgaatttcagtctaagcaacaagctgctatggggagccagggtaacctgagtgcagaagtagaacaggcaaccaggcggcaggtccagggcatgcaatccagccagcagcggaatagggagcgggtgctggcccagctgcttggaatggtttgtgatgtgaggcctcaggtgcatccaaactaccgaatttccgcttag

SEQ ID NO: 179863 - DNA, 357 bp, Artificial Sequence
  Description of Artificial Sequence: Synthetic coding sequence
atggccagccagagccagggcatccagcagctgctgcaggccgagaagcgagcggctgagaaggtggcggacgcccgtaagcgaaaggctaggaggctgaagcaggccaaggaggaagcacagatggaagtcgagcagtaccggagagagagagagcatgagtttcagagcaagcagcaggcagccatgggctcccagggcaacctgtccgcagaggttgaacaggctactagacgacaggtacaggggatgcagagctcgcagcaacgtaaccgggagcgggtgttggcacagttgttagggatggtctgtgacgtccgcccccaggtacatcctaactatcggatttccgcatag

SEQ ID NO: 179864 - DNA, 234 bp, Artificial Sequence
  Description of Artificial Sequence: Synthetic coding sequence
atggaggtggagcagtaccggcgggagcgggagcacgagttccagtctaaacaacaagccgcaatggggtctcaaggcaatttgagcgccgaagtcgaacaggccactagacggcaagtccaaggcatgcagagtagtcagcaacgcaaccgggagagagtgcttgctcaacttttaggtatggtgtgcgacgtgagacctcaggtgcatcccaactatagaatctctgcctag

SEQ ID NO: 179865 - DNA, 348 bp, Artificial Sequence
  Description of Artificial Sequence: Synthetic coding sequence
gtggagcccggcatccagcagctgctgcaggccgagaagcgggccgcagaaaaggtggcggacgctagaaagaggaaagcccgccggctgaaacaggcaaaggaagaggcccagatggaggtcgagcagtatcgccgcgagcgtgagcatgaatttcaatccaagcagcaagctgctatgggatcacagggaaacctgagcgccgaagttgagcaggccacgcgccgtcaggtccaggggatgcagagtagccagcagagaaatagagagagagtactggcacaattgttgggcatggtttgcgatgtgaggccccaggtgcaccccaactatcggatctctgcctag

SEQ ID NO: 179866 - DNA, 468 bp, Artificial Sequence
  Description of Artificial Sequence: Synthetic coding sequence
atgagcgagagcaagagcggccccgagtacgccagcttcttcgccgttatgggggcctctgcagcaatggtgtttagcgcactcggggcagcttacggaacagccaagtcaggtacaggcatagcagccatgtccgtaatgcgccctgaacagatcatgaaatctataataccggtggtgatggccggaattatagcaatatacggcctggtcgtagccgtgctcatcgccaactcgttgaacgacgacatctcactctacaagtcctttcttcagctgggggccggccttagtgttgggctatccggtttggccgctggattcgcgatcggaattgttggagacgccggagtgaggggcacagcgcagcagccaagactgttcgtaggcatgattctgatcctcatctttgcagaggtcctggggctgtatggcctaatcgtcgcccttattctgtccacaaaatag

SEQ ID NO: 179867 - DNA, 477 bp, Artificial Sequence
  Description of Artificial Sequence: Synthetic coding sequence
atgtggagcaacctgggcatcggcctggccatcagcctgagcgtggtaggagcagcgtggggcatctatattactggcagttctatcatcgggggaggggtcaaggctcccaggatcaaaaccaagaatctggtgtccatcatcttctgtgaagctgtggcgatctacggaatcattatggctatcgtgatctctaatatggccgagcctttttccgctacagatccgaaggctatcggccatcgtaattaccatgctggatactccatgttcggcgcaggccttaccgtgggactctcaaacttgttttgtggagtgtgcgtcggaattgtgggttctggagcagccctggcggacgcccagaacccatccctgttcgtcaaaatactcatcgtcgagattttcgggtcagctataggtttgtttggggtcatcgtcgccatcctacagacctcacgcgtgaagatgggcgactag

SEQ ID NO: 179868 - DNA, 129 bp, Artificial Sequence
  Description of Artificial Sequence: Synthetic coding sequence
gtgggcagcggcgccgccctggccgacgcccagaaccccagcctgttcgttaaaatcctgatcgtcgaaatcttcggtagcctggcttccctgggcagctccagtcaattcttcaggccccctgaatag

SEQ ID NO: 179869 - DNA, 759 bp, Artificial Sequence
  Description of Artificial Sequence: Synthetic coding sequence
atgaccggcctggccctgctgtacagcggcgtgttcgtggccttctgggcttgcgcactagctgttggagaagccggttcatggagagcaggagccgctagccgcccatcctggcccggcaggaacagtgcaggtaagtggcccgcaggcaacacagggccacctcgcgcgcttcaccccagactctggggtttagcccccgcccgagcaagcgactctgataaaggtgatcctgactttcagctgctcgaggaggggtttttaactgaaacaagtccgtttatgtggtcaaatcttggaatcggactggcgatttctctgtccgtggtcggcgccgcctggggaatttacattacaggctcatccatcattggtgggggagtgaaagctccacgcatcaaaactaaaaatctagtgagcattatattctgtgaggctgtcgcaatctatggcatcattatggccattgtgatctcaaatatggccgagcccttttccgcaaccgacccgaaagcaatagggcatcgtaattatcacgcgggctactcgatgttcggagctggtcttacggttggattatcgaatctgttttgcggagtttgcgtgggtattgtaggctcaggcgccgccctcgctgatgcacagaatccatctctctttgtgaagattttgatcgtggaaatcttcggatcagccatcggactgtttggcgtcatcgtggccattttgcagacctccagggtcaagatgggcgattag

SEQ ID NO: 179870 - DNA, 618 bp, Artificial Sequence
  Description of Artificial Sequence: Synthetic coding sequence
atgaccggcctggccctgctgtacagcggcgtgttcgtggccttctgggcttgcgcactggccgtcggagtgtgctatacaattttcgacctgggatttaggttcgacgtggcatggtttttgaccgagacctccccattcatgtggtcaaacctgggaatcggactcgcgatatcacttagcgtggtgggcgcagcttggggaatctatatcacaggcagctctattatcgggggtggggtcaaagcccccagaatcaagacaaagaatctcgtgagtataattttctgtgaggccgtggcgatttacggcatcatcatggccatcgtgatcagcaatatggccgagcccttctcggccacagaccctaaagctatcggccaccgcaattatcacgctggctactccatgtttggcgctgggttaaccgtcggcctttcgaatctgttctgtggcgtgtgcgtgggcatagtcggaagcggcgccgcactcgccgatgcccaaaacccctcattatttgtgaaaatcctaatcgttgagatcttcggaagtgccatcggcctattcggagtaattgtggccatactgcagacaagtcgggtgaagatgggtgattag

SEQ ID NO: 179871 - DNA, 261 bp, Artificial Sequence
  Description of Artificial Sequence: Synthetic coding sequence
atgtggagcaacctgggcatcggcctggccatcagcctgagcgtggttggggcagcttggggtatctatattacaggttcctccatcataggcggtggcgtgaaagccccccggataaaaaccaagaaccttgtgtctatcatcttctgcgaagcagttgccatctacggtattataatggcgattgtgatttctaatatggctgaaccatttagcgccaccgaccctaaagcaattggacacagaaactaccacgcatag

SEQ ID NO: 179872 - DNA, 477 bp, Artificial Sequence
  Description of Artificial Sequence: Synthetic coding sequence
atgtggagcaacctgggcatcggcctggccatcagcctgagcgtggtgggcgcggcctggggcatttacataacaggctcatctatcattggagggggcgtaaaagccccaagaattaagactaagaacttagtgagtatcatattctgcgaggcggtcgccatctacggaattattatggccattgtgatctctaatatggctgagccgttctccgcgactgatccaaaggccattggccaccgaaattaccacgctggctacagcatgttcggggccggccttacagtcggacttagtaatctgttttgtggagtttgtgtgggcatcgtcgggtctggcgccgcgctcgctgatgcccagaatccttcactgtttgtaaaaatcctcattgtggaaatctttggctctgcaattggtctgtttggcgtgatagtggccatcttacagacctcacgcgtcaaaatgggtgattag

SEQ ID NO: 179873 - DNA, 786 bp, Artificial Sequence
  Description of Artificial Sequence: Synthetic coding sequence
atgaccggcctggccctgctgtacagcggcgtgttcgtggccttctgggcttgcgctttagctgtcggagtttgttacaccatattcgatctggggttccggttcgatgtggcttggttcttgacagaaacctctccgtttatgtggagcaacctgggaatcgggctcgcaatctcgctgagtgtcgtgggagctgcatggggcatttatattacggggtccagcattataggtggtggagtgaaggccccccgaatcaaaactaaaaatttggtttctatcatcttctgtgaagcagttgctatttacggcattattatggctattgtaatcagcaatatggccgaaccattttccgccactgaccccaaagccatcggccaccgcaattatcacgccggctacagtatgtttggagctggacttactgtgggcttgagcaacctgttttgtggagtctgcgtcggcattgttgggtctggcgctgctttagccgatgcccaaaatccatctctgttcgtcaagatcctaatcgtggagattttcggcagtgccataggcctctttggagtaatagtcgctattttgcaggtgatgaatcccctcggcaaaccactctgtccttgccctcagccgtccctgacgctgttactagagaaactcaaatgttctccatcattacctatcacgattgattcgcctaaacagctgccgccccctcactttcacctcctggttttttcctacaggggctcgttattcttgagtctgatctggtgccattag

SEQ ID NO: 179874 - DNA, 681 bp, Artificial Sequence
  Description of Artificial Sequence: Synthetic coding sequence
atggccctgagcgacgccgacgtgcagaagcagatcaagcacatgatggcctttattgagcaggaagccaacgagaaggctgaagagattgatgctaaagccgaagaggaatttaatatcgaaaaggggcgccttgttcaaacccagcggctgaagataatggagtactacgagaaaaaggagaaacaaattgagcagcagaaaaagatccagatgagcaatctaatgaatcaagcccgactaaaggttctccgggcacgggatgatctgattaccgacctcttgaacgaggctaagcaaagactgagcaaagttgtgaaggatactaccaggtatcaggtgttgcttgacggcctggtactgcagggcttgtatcaattacttgaaccgcgcatgatagtgcgttgcaggaaacaggattttccgttagtcaaggccgcagtgcagaaggcgatcccgatgtataaaatcgccaccaaaaatgacgttgacgtacaaatcgaccaggagtcgtatctgccggaggatattgcagggggcgttgagatctataacggcgatagaaagattaaggtgtcgaacacgttagaaagtaggctcgatctcatcgcgcagcagatgatgcccgaagtgagaggggcattgtttggtgctaacgccaaccgcaagtttttggattag

SEQ ID NO: 179875 - DNA, 591 bp, Artificial Sequence
  Description of Artificial Sequence: Synthetic coding sequence
atggccctgagcgacgccgacgtgcagaagcagatcaagcacatgatggctttcattgaacaggaagctaatgagaaggccgaagaaattgacgccaaagctgaggaggaatttaatattgaaaaggggagactggtgcagacccagcgtttgaaaataatggaatattatgagaagaaggagaaacagattgagcagcaaaagaagattcagatgtccaatttaatgaaccaagccaggcttaaagtactgagggcacgcgatgatctcataacaggcctgtaccagctcttggaacctcggatgatcgtgaggtgccgcaaacaggattttcctcttgtaaaggccgctgtacagaaggccatcccaatgtacaagatagccactaagaacgacgtcgatgtgcagattgaccaggaatcatatctccccgaagatatcgccgggggagttgagatctacaacggcgaccggaagattaaggtatcaaatactcttgagtctcggttggacctcatcgctcaacaaatgatgcccgaagtgcgcggagctctctttggcgctaacgccaaccgcaaatttctcgattag

SEQ ID NO: 179876 - DNA, 615 bp, Artificial Sequence
  Description of Artificial Sequence: Synthetic coding sequence
atggccctgagcgacgccgacgtgcagaagcaggccgaggaggagttcaacatcgagaaagggagactcgttcaaacacaacgactgaaaattatggagtattacgagaaaaaggaaaagcaaatcgagcagcagaagaagattcagatgtctaatctgatgaatcaggcccgcctgaaggtgctaagggcgagggatgacttaatcacggacctgctgaacgaggccaaacagcgtctttccaaggtagtaaaggacacaacccgctaccaggtcctactggacggcctcgttctgcaggggctgtatcagctcctggagcctagaatgatagtgcggtgtagaaagcaggacttccccttggtcaaggctgcggtgcaaaaggcaatccccatgtataagatcgctactaagaatgatgtggacgtccagatcgaccaggagagctacttacctgaagatatcgccggcggcgtagagatatacaacggcgaccgcaagattaaggttagtaacaccctggaaagccggttagacttgattgcacaacagatgatgccagaggtgaggggagcactgttcggcgcaaatgccaataggaaatttcttgactag

SEQ ID NO: 179877 - DNA, 1056 bp, Artificial Sequence
  Description of Artificial Sequence: Synthetic coding sequence
atgagcttcttccccgagctgtacttcaacgtggacaacggctacctggagggtttagtgcggggcctcaaagccggggttttatctcaggcggattacctcaacttggtgcagtgtgaaactctcgaagatctgaaactgcatctgcaatcgaccgattatggaaactttttggccaacgaggcgagcccgcttacagtcagcgtaatcgacgacagactgaaagagaagatggtggtcgaattccggcacatgcggaaccacgcttacgaacctttagcgtcttttctcgacttcatcacgtactcttatatgattgataatgtcatcctgctgatcacagggacattacatcagagaagtattgccgaactggttccaaagtgccaccccctgggctctttcgaacaaatggaagcagtgaatatcgctcagacacccgccgaactttataatgccattctggtcgacactccactcgcagccttttttcaggactgtatatcggaacaggacctggatgaaatgaacatcgagataatccggaacaccctctacaaggcatacctcgaatcattctacaaattctgtacacttctggggggaacaaccgcagatgcaatgtgtcctatccttgagttcgaggccgacagaagagcattcatcattacaattaattctttcggaaccgaacttagcaaagaagatagagcaaaactattcccccattgtggcagattgtaccccgagggccttgctcagctcgctcgagccgatgactatgaacaagttaagaacgtggccgactactacccagaatacaagctgcttttcgagggagccgggtccaaccctggggataaaaccctggaagatcggttcttcgagcacgaggtgaagttaaacaaacttgcatttctgaaccaattccatttcggcgttttctatgcttttgtgaagctgaaggagcaggaatgccgcaacattgtttggatcgccgaatgcattgcccagagacatagggccaagattgacaattacattcccatattctag

SEQ ID NO: 179878 - DNA, 825 bp, Artificial Sequence
  Description of Artificial Sequence: Synthetic coding sequence
atggtggtggagttccggcacatgcggaaccacgcctacgagcccctggccagttttttggattttattacatatagctacatgatcgataacgtgattctcctgattactgggacgctgcatcaaaggtcaatcgccgagctggtgccaaagtgccacccactgggatccttcgaacagatggaagctgttaacattgctcagaccccggctgagttgtacaacgcaatcctggtggacacccccctggctgcattcttccaagactgcatttcagagcaagacctcgacgagatgaatattgagattatcaggaatactctgtacaaggcttacctagagtccttctacaagttctgcactcttctgggaggcaccacagctgatgccatgtgtccaatcctcgagttcgaagcagaccgacgagcattcatcatcacgataaactcctttgggactgaactgtctaaggaagatcgcgctaaactgtttcctcattgtggaaggctttatccagaagggctggcgcaactagcccgcgctgatgattatgaacaggtgaaaaatgtggcagattattatcccgagtataagctactgttcgagggcgccggaagtaacccgggagacaagacgctggaagaccggttttttgaacatgaagttaaactaaacaaactggcttttttgaatcagtttcatttcggcgtcttctacgcttttgtgaagctgaaagagcaggagtgtcgcaatattgtatggattgccgagtgtatcgcccagcgtcaccgtgctaagatcgataattacatccccattttctag

SEQ ID NO: 179879 - DNA, 1179 bp, Artificial Sequence
  Description of Artificial Sequence: Synthetic coding sequence
atgagcttcttccccgagctgtacttcaacgtggacaacggctaccttgagggcttggtccgtgggctgaaggccggcgtgctatctcaggcggattatcttaacctggttcaatgtgaaacactggaggatctcaagctgcacctgcagtcgacagactacgggaactttctcgctaatgaagcaagtcccctgactgtcagcgtcatagatgacagattgaaggagaaaatggtggtggagttccgccatatgcggaatcacgcctacgaaccactggcctctttcctcgatttcatcacacaggagtctgaggcaggcacacccgaagggccaggaaacatgcctaagttggggtctcgcccatcaccggggcatcggcccccttttctcagagtatctcttctcccttggccaccctcatcgtacagctatatgatcgataacgtcattctgctcattactgggacattgcaccagcggagcatcgccgaactcgtgcctaaatgtcacccactcgggtctttcgaacagatggaggcagttaacatcgcacagaccccagccgagttgtacaacgctatcttagtcgacacacccctggcggcgttcttccaagattgcatctccgaacaggatctggatgagatgaatattgaaattatacggaacaccctttataaggcgtatctggagagtttctacaagttctgcactttactgggcggcacaaccgccgatgccatgtgccccatcctcgaatttgaagccgataggcgggctttcattattacgataaatagcttcggaacggaactctcaaaagaagaccgagccaaactattccctcactgcggtcggctctatcccgaagggttggctcagttggctagagctgacgattatgagcaggtcaaaaatgttgccgactattaccctgagtacaaattgctttttgaaggagctgggtcaaacccaggcgacaaaacattggaagatcggttctttgagcacgaggtgaagctcaacaaacttgcctttttgaatcagtttcattttggagtattctacgctttcgttaagttgaaagagcaagagtgcaggaatatcgtatggatcgctgagtgtattgcacagcgccaccgggccaagatcgacaactatatccccatattctag

SEQ ID NO: 179880 - DNA, 1149 bp, Artificial Sequence
  Description of Artificial Sequence: Synthetic coding sequence
atgaccgagttctggctgatcagcgcccccggcgagaagacctgccaacaaacatgggagaagctccatgcagctacatccaaaaataacaacctggccgtgacctctaagttcaatattcccgacctcaaagtcggtacactcgacgtgttagtgggtctgtcggatgagctggccaagctggacgcgtttgtcgagggagtggtcaagaaggtggcccaatatatggcagatgtactggaggatagtaaggataaggtgcaagaaaatcttctggcgaacggagtggatctggtgacttatatcacacggttccaatgggacatggccaagtacccaatcaaacagagcctgaaaaatatttcagaaataatagccaagggtgtcacccagatcgacaatgatctcaagagtagagccagcgcctacaataatctaaagggaaatttacagaatctcgaacgcaaaaatgctggatcactcttgacaaggtctcttgcggaaatcgtaaagaaggacgattttgtgctggacagcgagtacctggtgacactactggttgtggttccgaagctcaatcataacgactggatcaagcagtatgagacactcgcggagatggtggtcccccggtcaagtaatgtcctgtcagaggatcaggattcttacctgtgtaatgtcacccttttccgcaaggccgtggatgattttaggcacaaggcccgcgaaaataaattcattgtgcgcgacttccagtacaacgaagaagagatgaaggccgacaaagaggagatgaatcgcctctccacagataagaaaaagcaatttgggccgctggtgaggtggctgaaagtgaacttcagtgaggctttcatagcgtggatccatgtgaaagccctccgagtgttcgtcgaatccgttcttcgctatggtctgccagttaattttcaggccatgctcttgcagccaaacaaaaaaaccttgaaaaaactgagagaagttctacatgaattgtacaaacacttggatagtagtgctgctgctatcattgacgctccgatggatatccccggtttaaatctcagtcaacaggagtattacccatacgtttactacaagatcgactgcaacctgctagagtttaagtag

SEQ ID NO: 179881 - DNA, 1149 bp, Artificial Sequence
  Description of Artificial Sequence: Synthetic coding sequence
atgaccgagttctggctgatcagcgcccccggcgagaagacctgccaacagacctgggaaaaactgcacgcagccaccagcaaaaacaacaacctggccgttacctcaaaattcaacatacccgacctgaaggtgggcacccttgatgtcctcgtcggactgtctgatgagctggcgaagctagatgctttcgtcgagggagtggtgaagaaggttgcccagtacatggcagacgtactcgaagattccaaagacaaagttcaagaaaaccttctggctaatggggtcgacttggtaacttacataactcggttccagtgggatatggcaaagtaccctataaagcagagcctgaaaaatatttccgaaattattgccaaaggcgttacgcagatcgacaatgatctgaaaagccgcgccagcgcctacaacaatctcaagggaaatctgcagaaccttgagcgaaaaaacgcaggttctctgctgacaaggtcccttgctgaaattgtgaaaaaggatgacttcgttctggacagcgagtacctggtgacactgttagtggtggtgcctaagctcaatcacaatgattggattaagcagtacgagacactggcagagatggtggtccccagatccagtaacgtcctctccgaggatcaggactcttacctttgcaatgtgaccttattccgtaaagccgtcgacgatttcaggcataaagccagagagaataaattcattgtacgagatttccagtataacgaagaggagatgaaggcagataaagaagaaatgaaccggttgtcaaccgacaagaagaagcagttcgggccactcgtcagatggctcaaggtcaactttagcgaagcttttatagcttggatacacgtgaaagctctgcgcgtgttcgtggagagcgtcctgagatacggcttacctgtcaattttcaggctatgctgctccaaccaaacaagaaaactctgaagaagctgcgggaggtgctccatgaactatacaagcacttagatagttcggcggctgccattatcgatgcaccgatggatattccaggactcaacctgtctcagcaggagtattacccatacgtctactataagattgattgcaacctcctggagttcaaatag

SEQ ID NO: 179882 - DNA, 1053 bp, Artificial Sequence
  Description of Artificial Sequence: Synthetic coding sequence
atggccgtgttcgtggtgctgctggccctggtggccggcgtgctgggaaatgagttttctattctgaagtcacccggttccgtggtgttccgaaatgggaattggcccatccctggcgagaggattccagacgtagctgctctttctatgggattctcagtgaaggaagacttatcatggcctgggctggccgtggggaacctgttccatcgccctcgggccaccgttatggtgatggtgaaaggtgtgaacaagctcgccttgccccccggaagcgtgataagctatcctttagagaatgccgtgcctttctctctggatagcgttgccaattcaatccatagtttattctcggaggagacaccagtcgtactccagttagccccaagcgaagagcgcgtatatatggtcgggaaggcgaatagtgttttcgaagacctctctgttaccttgcgccaactgagaaaccgactcttccaggaaaattccgtacttagttccctccctttaaattcattgagccggaataacgaagtcgacttactgtttttgtccgagctgcaggtactgcatgacatatcttctctgctaagccgccacaagcatctggccaaggatcattctccagatctgtacagcctggagctggccgggcttgacgagattgggaaaagatatggtgaggactctgagcagttccgagacgctagtaaaattttggtcgacgctctccagaaattcgccgatgatatgtattccctttacggcggcaacgctgtggtcgaattggtgaccgtcaagagcttcgacacttctctcataaggaagacccgtaccatcctggaggcgaagcaagcgaaaaaccctgccagtccctacaacttggcctacaaatataatttcgaatactcagtggtttttaatatggtgctgtggattatgattgctcttgcccttgctgtgatcataacctcgtacaatatatggaatatggatcctgggtacgattccattatatacagaatgaccaaccaaaaaattaggatggactag

SEQ ID NO: 179883 - DNA, 732 bp, Artificial Sequence
  Description of Artificial Sequence: Synthetic coding sequence
tgatgccccgccggccccttccgggtggccccccagtgctgcggccgtcgggggacaatggccgtattcgtagtgctgttagcgcttgtggccggtgtcctcgggaacgaattcagcatcctgaagtcacctgggtcagtcgtgtttcgtaatggcaattggcctatcccaggggaaagaatacccgacgtcgccgcccttagtatgggattttctgttaaggaggacctcagctggccaggtctggccgtagggaacctgttccaccggccgcgagcgactgtcatggtcatggttaagggagtgaataaactggctttgcctcccggctctgtcatttcttatccattagagaatgtcgacctactattccttagcgagctgcaagtcctgcacgacatcagctccctgttaagccgacacaaacacctcgccaaggaccactcccctgatctgtactcactggaactggctggacttgacgaaattggaaagaggtacggagaagactcagagcagtttagagatgcctccaagattctggtggacgcactacagaagtttgcagatgatatgtactcactctatggagggaacgcggtcgttgaactcgtcaccgtcaagtcttttgacacatccctgattagaaagacaagaacgattttagaagccaagcaggccaaaaacccagcgagcccttacaatctggcttacaagtacaatttcgaatag

SEQ ID NO: 179884 - DNA, 612 bp, Artificial Sequence
  Description of Artificial Sequence: Synthetic coding sequence
gagagcgagcgggtgaccagcagccggtgcggctgccggccctgccctgccggcccctttcgtgtggcgccccagtgttgcggcaggcgtgggaccatggccgtgtttgtagtgctgctagccctcgtggcgggcgtgttagggaacgagttctcaatcctgaaaagccccggctctgtggtcttccgcaacggaaactggccaatccccggggagcggattcctgatgtggccgccttgagcatgggctttagcgtgaaagaagacctgtcctggcctggcctggccgtcggcaatctgtttcataggcccagagctacagttatggttatggttaagggagtgaacaaactggcccttccgccgggttctgtcattagctatcccctggagaacagagtgtatatggttggcaaagctaatagcgtgtttgaggacttgtcggtaacactgagacaactgcggaacaggttgttccaggaaaattccgtgctctcatccttaccattgaacagcctcagccgcaataacgaggtggaccttcttttcctaagcgagctccaggtcctgcacgacatctcatccttgctttcgcgtcataaacatctgtag

SEQ ID NO: 179885 - DNA, 780 bp, Artificial Sequence
  Description of Artificial Sequence: Synthetic coding sequence
tgagtgccccccgcccggagcgtgagcccccggagcgccgccgccgccgctgctccatggctgtgtctgtcttgctcctggagatggtggcgcgacctgagctggcctggcctcgcagtgggtaacctgtttcaccggccccgggccactgtaatggtgatggtcaagggagtgaacaaacttgcgttgccaccagggtccgtgatctcctacccactagagaacgcggtgcctttctcgctggactccgtggcaaactctatccactccctttttagcgaggagacacctgttgtgctgcagctggcccctagtgaggagagagtttacatggtgggaaaggcaaacagtgtcttcgaagacctgtccgtgacccttcggcagctgaggaacaggctgttccaggaaaactccgtgttatcgtcactaccactgaactcactttctcggaacaatgaggtcgatctgctgttcctctccgaacttcaggtcctgcacgatatatccagtctgctctccagacacaagcacctggctaaagatcacagccctgacctctacagcctagagctggccgggctggacgagatcggaaagagatatggagaggactccgaacagtttcgcgacgcctctaagatcctggtcgacgccttgcaaaagttcgcggatgacatgtactctctgtatggtgggaacgccgtcgttgagctcgtgaccgtgaaatcgtttgacacgagcctcatccggaagacccgcacgattctggaggctaaatag

SEQ ID NO: 179886 - DNA, 957 bp, Artificial Sequence
  Description of Artificial Sequence: Synthetic coding sequence
atggccgtgttcgtggtgctgctggccctggtggccggcgtgctgggcaacgagttcagcatcctcaagtcgcccggaagcgttgtctttagaaatgggaactggccaattccaggagaacggatacccgatgtagcggcattaagcatgggatttagtgtcaaggaggatttgtcatggcctggcctggcagtcggcaatctctttcaccggccgcgtgcgactgtcatggtgatggtgaaaggagtgaacaagttagccctgccaccgggtagtgtgatatcgtatccgctcgagaatagagtttacatggtcgggaaagctaatagcgtctttgaggatctttcagtgacactgagacagctccgaaaccgcttgtttcaggagaattccgtgttaagcagcctgccactcaattcccttagccggaacaatgaagtggacctactattcttgtccgaactgcaggtgctgcacgacattagcagcttgctgagtaggcataagcacctggccaaggatcactcccctgacttatattcgctggagctggctggcctagatgagattggaaagcggtacggcgaggattccgaacagttccgcgacgcaagcaagattctcgtggatgcattgcagaaatttgcggatgatatgtactccctttacgggggcaacgcagtcgtggaactggtcacagtgaaaagcttcgacacgtctctgatacgcaaaaccagaacaatccttgaagctaagcaggccaaaaatccggcttccccttataacctggcgtataaatataattttgaatacagtgttgtgttcaatatggtcttatggataatgatagcgctggccctagccgtcatcataacttcttacaacatctggaacatggaccctggatatgacagtatcatttatcgaatgacgaatcagaagattcgtatggactag

SEQ ID NO: 179887 - DNA, 819 bp, Artificial Sequence
  Description of Artificial Sequence: Synthetic coding sequence
atggccgtgttcgtggtgctgctggccctggtggccggcgtgctgggaaacgaattctctatcttgaaatcacccggatcagttgtgttcaggaacggcaattggcccatccccggggagaggattcctgatgtggcagccctgtctatgggctttagcgtcaaagaagacttgagctggcccggactcgcagttggcaacttgtttcaccggcccagagccacagtgatggttatggtcaagggagtcaacaaactcgctctgcccccaggcagcgtgatttcatatcctctggagaacgtcgacttgctcttcctctcagaactgcaggtgctgcatgatatctcaagcttattgagtcgccacaaacatctggcgaaggaccactcgcctgatctgtactcgcttgagctggccggattggacgaaatcggaaagcgatatggagaggattccgagcagttccgcgatgcatccaagattctggtggacgctcttcagaaatttgccgacgacatgtacagtctctacgggggcaatgctgtggtggagctggtgaccgttaagtcgtttgatacttctctgatccgaaagacccggaccattttagaagctaagcaggccaaaaaccccgcgtctccctacaatctggcctataaatacaattttgagtactccgtggtgttcaacatggtgttatggattatgatcgccttggctctagcagtcataattacctcatacaatatctggaatatggacccaggctatgactcaattatttaccgaatgacaaaccagaaaattcgcatggattag

SEQ ID NO: 179888 - DNA, 498 bp, Artificial Sequence
  Description of Artificial Sequence: Synthetic coding sequence
atggccgtgttcgtggtgctgctggccctggtggccggcgtgctgggtaacgagttttctatcctcaagtcacctgggagtgtcgtgttcagaaacggcaattggccaattccaggcgaaaggatcccggatgtggccgcactgagcatggggttctctgtgaaggaagatctgtcttggcctgggctggctgtcggcaatctgtttcaccgacccagggctacagttatggttatggtgaagggcgtaaacaagctggcccttccccctgggtccgtgatctcctacccgctcgaaaatgctgtgccttttagcctcgattcagtggcaaattcaatccacagtctgttttctgaagagacccccgtcgttttacagctggccccttccgaagaaagggtctacatggtgggtaccatgaagctaacctgctcctttttcttaaattgtaagtgttacatgatcttccaagcctgttgtctcgtgataagtatttag

SEQ ID NO: 179889 - DNA, 825 bp, Artificial Sequence
  Description of Artificial Sequence: Synthetic coding sequence
atggtgatggtgaagggcgtgaacaagctggccctgccccccggcagtgtaatcagttatccgttggagaacgccgtcccatttagccttgatagcgtggcaaactcaatccactccctgttttccgaggagactcccgttgtgctccagctggcaccttctgaagaacgcgtgtatatggttggcaaggccaatagcgtgtttgaggacctctctgtaacactgaggcagttgcgcaacaggctctttcaagagaacagcgtgctgtcatctctccctctgaactccctgagccgaaataatgaggtggacctgctgttcctatccgaactgcaggttctgcacgatatctcatccctgctgagcaggcataagcatcttgccaaggaccattcccctgacctttattccctagagctggcaggcttggacgagattggcaagcggtacggagaggatagcgagcagtttagggacgcctctaagatactagtggacgcattgcagaaattcgcagatgacatgtatagcttatatggggggaatgcagtggtggagctggtaaccgttaagagctttgacaccagtctcattaggaagacacggacaattttggaggccaagcaggcaaaaaaccccgcatccccctataatcttgcatacaagtataactttgagtactcagtcgtgtttaatatggtcctgtggatcatgattgctctcgcgctcgcggtcattataacatcatataacatttggaacatggacccgggttatgactctataatttacagaatgaccaatcaaaagatcagaatggactag

SEQ ID NO: 179890 - DNA, 2517 bp, Artificial Sequence
  Description of Artificial Sequence: Synthetic coding sequence
atgggcgagctgttccggagcgaggagatgaccctggcccagctgttcctgcagtcagaggctgcatactgctgcgtgagcgaattgggcgagctgggtaaagtgcagttcagggatctgaaccccgacgtaaatgtgttccagaggaagtttgtgaatgaggtgaggcggtgtgaagaaatggatcgcaaacttcgctttgtagagaaggaaattagaaaagccaacatccccattatggacaccggtgagaatccggaagtcccgtttccacgggatatgatagatttggaggccaattttgaaaagattgagaatgaactcaaggaaatcaacactaatcaagaggccctgaagcgcaatttcctagagttaaccgaactcaagttcatacttcgcaagactcagcagttcttcgatgaggctgaacttcaccatcaacaaatggcagacccagatctcttggaagagtcttcatcactgctcgagccctctgagatgggcaggggcaccccgcttagacttgggtttgtggccggcgttataaatcgggaaaggatccctacattcgaaagaatgttgtggagggtgtgcagagggaatgttttcctgagacaggcagagatagagaatccacttgaggacccagtgacgggggattacgtccacaagtcggtgttcattattttttttcaaggcgaccagctgaagaaccgcgtgaagaaaatctgcgaagggttccgtgcttctttgtacccttgccctgagacaccccaggagaggaaggaaatggcctcgggagtcaacacgcggatcgatgatctgcagatggtcttaaaccagaccgaggatcatcggcaaagggttctgcaggccgcagccaagaacattagagtgtggttcataaaggtcagaaagatgaaggctatctaccatactctaaatttatgtaatattgatgttacccaaaaatgtctgattgctgaagtctggtgtcctgtgacagatctcgattcgatccaattcgctcttcgacgaggcaccgagcacagcggaagcactgtgccatcgatcctgaatagaatgcagacgaaccaaactccgccaacgtacaataaaaccaataagtttacgtacggatttcagaatatcgtggacgcctacgggatcggaacctaccgggaaatcaatccagctccgtatactattatcacctttcctttcctatttgctgttatgttcggagacttcggtcacggtatattaatgacgctctttgcagtgtggatggtacttcgcgagagcagaattctcagccagaagaatgagaatgaaatgttctcaaccgtgttcagtggaagatacattatcctccttatgggagtctttagcatgtataccggattgatatacaatgactgcttctcaaaaagccttaatattttcggctcgagctggtctgtcaggccgatgttcacctataattggactgaggaaaccttaagaggaaatccggtgcttcaattgaatccagctctacccggcgtgtttggtggaccttacccttttgggattgatcctatatggaacatcgctactaacaaactgacttttttgaacagcttcaaaatgaagatgtctgtcattctgggaattattcacatgctgttcggtgtcagcctgagtctgttcaatcacatttactttaagaagcccctgaatatctactttgggttcattcctgagatcattttcatgacaagcctctttggctatctggttatccttatattttacaaatggacggcctatgatgcacacacaagcgagaacgctcccagtttactaatccattttatcaatatgttcttgttctcctacccagagagcggatactccatgctctattcagggcagaaaggaatacaatgctttctagtagttgtggccctgctgtgtgtgccatggatgttgctgtttaaacctctggtcctgcggcggcagtacctgcgacggaaacatcttggaacattgaatttcgggggaatcagagtgggaaatggccctactgaggaggacgccgagatcatccagcacgaccagttgtctactcattcagaggacgcagacgagtttgactttggcgataccatggttcatcaagctatccacacaatcgagtactgcttaggctgcatcagtaataccgccagctatctccgtttgtgggccctctctctggcacacgcacagctgtctgaagttctttggacgatggtaattcacatcggcctctcagtgaaaagcctcgctggcggcctggtactatttttctttttcacagcctttgcaacacttaccgtcgccattctcttgatcatggagggcctcagtgcttttttacatgctctccgacttcattgggtcgagttccagaataagttctactccggcacaggttttaaatttctgcctttcagcttcgagcacatccgcgaggggaagtttgaggagtag

SEQ ID NO: 179891 - DNA, 2514 bp, Artificial Sequence
  Description of Artificial Sequence: Synthetic coding sequence
atgggcgagctgttccggagcgaggagatgaccctggcccagctgttcttgcagtccgaggctgcctactgttgtgtatccgagcttggagagctcggtaaagtacagttcagagatctaaatcccgacgtgaacgtgtttcagcggaagtttgtgaatgaggtccgtcggtgcgaggagatggaccgaaagctgcgcttcgtggagaaggagatcagaaaggcaaatatcccgattatggacaccggcgagaacccggaagtcccgtttccgcgagacatgatcgatctcgaggctaactttgaaaagatcgaaaatgaacttaaggaaattaacacaaatcaagaagcgctgaagcgaaactttctagaactcacagagttgaagttcattctgaggaaaacccagcagttctttgatgagatggctgacccagatctccttgaggagagctctagtcttctcgagccctccgaaatgggtagaggaacgcctttgaggcttgggttcgtggccggagtgattaatagggagcgaataccaacatttgagcggatgttgtggcgcgtttgtcggggcaacgtcttcctgaggcaggctgagatagagaacccactcgaggacccagtaaccggtgattacgtgcacaagtcagtgtttatcatattctttcagggggaccagcttaagaatcgcgtcaagaaaatatgcgaaggatttagagcatcgctgtacccatgtcccgagacgcctcaggagagaaaggaaatggcaagcggcgtaaacactaggattgatgacctccaaatggtcctgaatcagacagaagaccatagacaacgagttctccaggccgccgccaagaatatcagggtgtggttcattaaggttcgcaagatgaaagctatctaccataccctgaatctttgcaatatcgatgttacccaaaagtgcctgattgcagaagtctggtgtcctgtgacagatctggattctattcaattcgctctcaggagggggacagagcacagtggatctacagttccatctattttgaacaggatgcagacaaatcaaacaccaccgacatacaataagacaaataaatttacatatggattccagaatatagtcgatgcatacggtattggaacttaccgcgagattaatccagccccttatacaatcattacctttccctttttattcgccgtcatgttcggcgattttgggcacggtatacttatgaccttgttcgcggtctggatggtgcttcgtgagtccagaatcctgtcccagaagaacgagaatgagatgttctcaactgtcttctccggaagatatattatcttgttgatgggcgtcttttcaatgtatacagggttaatatataacgactgcttttcaaagagtctgaatatcttcggttcatcgtggagcgtgcgtccaatgtttacgtacaattggaccgaggagacactgagagggaaccccgtgctgcaattgaacccagctctacccggggtcttcgggggcccttatcccttcggaatagacccgatttggaacatcgctacaaacaaactgactttcctgaatagttttaagatgaagatgagcgtgattttaggtatcattcacatgctattcggcgtgtctctcagtctcttcaatcacatctattttaagaagccccttaatatctattttggcttcatcccggaaatcatattcatgacatcactcttcggatacctagtgatcttgattttttacaagtggacagcgtacgatgcacatacttccgagaatgccccttctctgctgatccactttattaatatgttcctgttctcctacccggaaagcggatatagtatgctgtattcagggcagaaggggatccagtgtttccttgtagtggtggccctcctgtgtgtgccctggatgctgcttttcaagcccctggtgctccgacgacaatacttgcgtcgcaaacatctcgggacgctgaattttggaggcatccgcgtcggaaacggacctactgaggaagatgctgagattatccagcatgaccagttaagcacccacagcgaagacgctgacgagccttctgaagacgaagtctttgattttggcgacacaatggtccatcaggcaatccacaccattgagtactgtctcggctgcatctctaacaccgcatcatacttaagattgtgggccctgagcttagcccatgcacagctgagcgaggtgctgtggactatggtgatacatatcggcttgagcgtgaaatccctggctggggggttggtcttattctttttcttcacggctttcgctactctcacagtggccatcctgcttattatggagggattaagtgcctttctgcacgctctacgcctgcactgggtcgagttccaaaacaaattctactctggcacaggttttaagttcctgcccttctcttttgagcatatcagggagggcaaatttgaggagtag

SEQ ID NO: 179892 - DNA, 2496 bp, Artificial Sequence
  Description of Artificial Sequence: Synthetic coding sequence
atgggcgagctgttccggagcgaggagatgaccctggcccagctgttcctccaaagtgaagccgcatactgctgtgtttctgagcttggagaactgggaaaagttcaatttagagatctgaatcccgatgtcaatgtatttcagcggaaattcgtgaatgaagtgcgaaggtgcgaagaaatggatcgaaagctgaggttcgtcgagaaggagattcggaaagccaacattcctataatggacacaggggaaaaccccgaagtgccttttccaagggatatgattgaccttgaggctaactttgaaaaaatagagaacgagttgaaggaaattaacactaaccaggaggcactcaaaagaaacttcctggaactgacagaactaaagtttatcctgcggaagactcagcaattctttgatgagatggccgaccccgatcttttggaggaaagcagctcgctgctcgaaccctctgagatgggacggggaacaccactgaggctgggattcgtggcgggcgtgattaatcgcgagaggatccccaccttcgagagaatgctgtggagggtgtgccggggtaacgtgtttctcaggcaggctgagattgagaaccctctcgaagaccctgtgacaggagactatgtgcataaatccgtttttatcattttttttcagggtgatcagctaaaaaaccgtgtcaagaaaatctgtgagggatttcgagcatccctctacccttgtcccgaaactccccaagaacgcaaggaaatggcctccggcgttaatacacgaatcgacgatttgcaaatggttttaaatcagaccgaggaccacagacaaagagtccttcaagcagccgccaaaaatatccgtgtatggttcatcaaagtgcgtaaaatgaaggcaatataccacacccttaatctgtgcaatatagatgttacacagaagtgtctgattgccgaagtatggtgtcccgtcactgaccttgacagcattcaatttgcgctgcggcgggggacagaacattccggcagcacggtgccctcaatcctgaacaggatgcagacaaaccagacccctcctacttacaacaagaccaacaagttcacgtacggcttccagaatattgtggacgcttatgggattggtacatatcgcgagatcaatcccgccccatacacaatcatcactttccccttccttttcgcagtgatgttcggcgactttgggcacggaattcttatgaccttgttcgccgtgtggatggtccttagagagtcccgcattctttcccaaaagaacgagaatgagatgttctccaccgttttctcagggagatatattattctgctaatgggagtctttagcatgtatacaggcctgatttacaacgactgttttagtaagagccttaatatcttcggttcatcttggtccgtacgacccatgttcacctacaactggactgaggagacactgagaggcaatccagtgctgcagcttaaccctgccctgccaggagtctttggaggcccttacccgttcggcattgaccccatctggaatatagcaactaataagcttacattcctcaacagcttcaagatgaagatgtcagtgattttaggaattatccatatgttatttggcgtttcgttgtccctttttaatcatatctacttcaagaaacccctgaacatctacttcggcttcattcccgaaattatttttatgacatccctgtttgggtatctggtgatcctcatattctataaatggactgcctacgacgcccacacttctgagaatgcaccctctctgctaatccatttcatcaacatgttcttattctcttaccctgaatctgggtatagtatgctgtattccggacaaaagggaattcagtgcttcctggtcgtggtcgccctgttatgcgtgccctggatgctcctgtttaagcctctggttttacggagacagtacctgaggcggaaacacctgggaacactgaatttcggaggcatccgcgttggcaacgggccgacagaggaggacgctgaaataatacagcacgatcaactgagtacccacagcgaggatgctgatgaattcgacttcggggacactatggttcaccaagctatacataccatcgaatactgcctgggctgtatatcgaacaccgccagttatcttagactctgggccctgtctctggcacatgcccagctgagtgaagtgttatggactatggtgattcacatcgggctgtccgtgaagtccctggcaggcggcctcgtgttatttttcttcttcacagcattcgctactctaaccgtggctatcctgctgataatggagggactgagcgccttcctgcacgctctgagattgcattgggtagagttccaaaataaattttatagcggaactgggtttaagtttctcccctttagctttgaacacattagagaaggcaaattcgaggaatag

SEQ ID NO: 179893 - DNA, 2367 bp, Artificial Sequence
  Description of Artificial Sequence: Synthetic coding sequence
atgggcgagctgttccggagcgaggagatgaccctggcccagctgttcctgcagtcagaggccgcttactgctgcgtgagtgaattaggcgaactgggcaaggtccagtttagggacttaaacccagatgtcaacgttttccaacggaagtttgtgaatgaggtgaggaggtgcgaagaaatggatcgcaagctgcggttcgtcgaaaaagagatacgtaaagccaatatcccaatcatggataccggtgagaatccggaagtgccatttcctagagacatgatcgacctggagatggcagacccagacctgcttgaggaatcaagcagcctgttggaacctagtgaaatggggcggggaactccactgaggctggggtttgtcgccggggtcatcaacagagagcgcatccccacctttgagcgaatgctatggcgcgtttgccgcggcaatgtgttcctgcgccaagctgagattgaaaatcctctcgaagatcctgtcacaggagactatgtgcataagagtgtgtttatcatctttttccaaggagatcaactcaagaaccgggtcaaaaaaatctgcgaggggttccgcgccagtctctacccctgtccagagacgccacaagagcgaaaggaaatggcctcaggagtgaacaccaggattgatgatcttcagatggttctgaaccagacagaggaccacagacagcgtgttcttcaggcggccgccaagaacatccgcgtatggtttattaaggttcgaaaaatgaaagccatttaccacacactcaatctgtgtaatattgacgtgacacagaagtgcttgattgccgaagtgtggtgccctgtgaccgacttggattcaatacagtttgcactcaggcgaggtaccgagcacagcgggagtactgtgccttcaatccttaaccgaatgcagactaaccagactcctcctacttataataaaactaataagttcacctatggcttccaaaacatcgtggatgcctacgggatcggcacctaccgggaaatcaacccagcgccctataccatcattacttttccatttttgttcgccgtgatgtttggcgacttcgggcatggtattttgatgaccctgttcgcggtctggatggtattacgtgaatcaagaatcctgagccagaagaacgaaaacgagatgttctcgacagtgttctctggccggtacatcatcctgctaatgggcgtattttctatgtatactggactgatttataacgattgcttttcaaagtcgctgaacatctttggtagtagctggtcagtccgccccatgtttacttataactggacggaagagaccctgagaggcaatccagtcttacagctgaatccagcactccctggtgtgtttggcggcccttacccctttggtatagatcctatttggaatatcgcgactaataagttgactttcttaaattccttcaaaatgaagatgtcggttattcttggaataatccacatgctgtttggtgttagccttagcctttttaaccacatttattttaaaaagccccttaatatctattttggcttcatccccgagataatcttcatgacatccctttttgggtacctggttattctcattttctataaatggacagcctatgacgctcacacatctgagaacgcccctagcctgctcattcacttcattaatatgttcttgttcagctatccagaatctggctactccatgctgtacagcggccagaagggcatccagtgtttcctcgtggtggtggctctgctgtgcgtgccctggatgctgctcttcaagcctctggtgttgaggaggcagtatcttaggaggaaacacctcgggacactgaactttggaggcatcagagtgggaaacggccccaccgaggaagacgcagagattatccagcatgaccagctgtccacccactccgaagacgctgatgagtttgatttcggcgatacgatggtccatcaggctattcacaccatcgaatattgccttgggtgtatttccaacactgcctcttacctgcggctgtgggcgctgagtcttgcccacgcacaattgagcgaagtgctttggacgatggtgatccacatcggtttgagcgtgaagtccctggccggagggctggttctgttcttcttttttacagctttcgctactctcaccgtggcgatcctgctgattatggagggccttagcgccttcttgcatgcccttagactccattgggtcgagttccagaataagttctattcagggaccggattcaaatttttacccttctctttcgaacacatacgcgaaggtaagtttgaagagtag

SEQ ID NO: 179894 - DNA, 1452 bp, Artificial Sequence
  Description of Artificial Sequence: Synthetic coding sequence
atgcagaccaaccagaccccccccacctacaacaagaccaacaagttcacatatgggttccagaatattgtggatgcctatggtattggaacttatcgcgagataaaccccgctccatacaccattataacatttccctttctattcgctgtgatgttcggggatttcggacatggcatcctaatgaccctgttcgctgtttggatggtgttgcgagaaagccgtattttgagtcagaaaaacgaaaatgagatgttttcaaccgtgttttctgggaggtacataattctgctgatgggcgtcttttcgatgtacactggcctcatttacaacgattgcttctcgaagtcacttaatatctttggcagttcctggtcagtgcgacctatgtttacatacaactggacggaagagacgctcagaggaaatcccgtactgcagctcaacccggccttgccaggagttttcggcgggccatacccctttggaatcgatcctatctggaacatcgcaacgaataagcttacctttcttaacagcttcaaaatgaagatgtccgtgattctgggcatcattcatatgctttttggcgtgtcacttagtctttttaatcatatatacttcaagaagccgctaaatatctattttggcttcataccagagattatcttcatgacgagcttattcggctacctggtgatcctcatcttctacaagtggacagcgtacgacgcccatacatccgagaatgcaccgtccttgctgattcattttataaatatgttcctgttcagctatccggaaagcgggtattctatgctctacagtgggcagaaagggatccagtgcttccttgtcgttgtggcattgctttgcgtgccttggatgctgctgtttaaaccactggttctgcgacgccaataccttcggcgaaagcatctgggaacgctcaacttcgggggtattcgggtgggaaatggcccgacagaagaagatgccgagatcatccaacacgatcaactgtccacccatagcgaagacgcagacgaaccctctgaggacgaagtctttgacttcggcgacacgatggtccaccaggcaatccacactattgagtactgcctcggatgcatctccaatactgcatcatacttgcgactctgggccctcagcctggcacacgctcagttgagcgaggttttgtggactatggtgatccacataggattatctgtcaagtccctcgccggcggactggtgctctttttcttttttactgctttcgcaactctgaccgtggcaatactgttgattatggagggcttgtccgcctttctgcacgccttgcgactccactgggttgagtttcagaacaaattctacagtgggaccgggttcaagttcctgccttttagtttcgaacacatccgagagggaaagttcgaagaatag

SEQ ID NO: 179895 - DNA, 2514 bp, Artificial Sequence
  Description of Artificial Sequence: Synthetic coding sequence
atgggcgagctgttccggagcgaggagatgaccctggcccagctgttcctgcaatctgaagcagcttattgctgcgtttcggaacttggtgagctggggaaggtgcagttccgcgatttaaatcccgacgttaacgtcttccagcgtaaattcgttaatgaggttaggagatgcgaagaaatggacaggaaactgcgatttgtggaaaaggaaatccgaaaagcgaacatacctatcatggatacaggagagaatcctgaagtacctttccctcgagacatgattgatttagaagctaattttgaaaagattgaaaacgagctaaaagagatcaatactaatcaggaggcgttgaagcgaaactttctcgagctgaccgagctaaagtttattctgaggaagacgcagcaattcttcgacgaaatggctgaccctgacttactcgaagagagcagtagtcttttggagccatcagagatgggccgaggtacaccccttcggctcgggtttgtcgccggcgttattaatagggaacgaattcccacttttgagaggatgctctggcgcgtatgtaggggaaatgtgttcctccgccaggccgagattgagaatccactggaggaccccgttacaggagactatgtccacaaatctgtgttcattatattttttcagggtgatcagcttaaaaatcgggtgaagaaaatctgcgagggctttagggccagtctctatccgtgtcccgaaactccccaggagcgcaaagaaatggcctcaggggtcaacactaggattgatgacctgcagatggtgctgaatcaaactgaggatcacaggcaaagggtactgcaggccgccgcgaaaaacattagagtgtggttcataaaggtcaggaaaatgaaagccatctaccacacactgaacttgtgtaacattgatgtgacccagaaatgtttgatagcggaggtgtggtgtcccgtgacggatctggactcaattcaattcgcgctgcgcagaggcaccgaacactcgggctctacagttcccagcatacttaaccgaatgcagactaatcaaacacctcctacctataacaaaacaaacaaattcacctatggcttccagaacatcgtggacgcatacgggattggtacatacagagaaattaacccggctccatacaccatcattaccttcccctttctattcgctgttatgttcggagatttcgggcatggcatactgatgaccctgttcgccgtctggatggtgctgcgggaatcgcggattctcagtcagaaaaatgaaaacgaaatgttctctactgttttctccggcaggtatattatcttattgatgggggtgtttagcatgtatacaggcttaatctacaacgattgtttctctaagtctctaaacatttttggaagctcatggtctgtgagacctatgttcacttacaattggacagaagagactttaaggggtaaccccgtgctgcaactgaatcctgcactgcctggcgtgtttggaggaccatacccctttgggatcgatcccatttggaacatcgcaacgaataagctgacttttcttaattcattcaagatgaagatgagtgtgatactgggtattatccatatgttgttcggagttagccttagcctgttcaatcacatctactttaaaaaacctttaaacatctatttcggcttcatccctgagatcatttttatgacttccctcttcgggtacctcgtaattctgatcttttacaaatggacagcctacgatgcccatacttctgagaacgcccctagcctcctaatccacttcattaacatgttcctgttttcttacccggagtccggatattctatgctctactccggacagaaagggatccaatgtttcctggtggtcgtggccctgctgtgcgtcccctggatgctgctattcaaacctttagtgctgcgaaggcaatatttgcgccggaagcacctgggtaccctgaacttcggcggcattagggttggtaacggccctaccgaggaagacgctgagataatccagcatgatcagctaagtacccacagtgaagatgctgatgagccctccacctccggtcagtttgactttggcgacactatggttcatcaagcgatccatacgatcgaatattgtctgggttgcatttcaaataccgcaagttatcttcgcttatgggcgctcagcttagcccacgcccagttgtctgaggtgttgtggaccatggtgatccatattggtctgtcggtgaaaagcctggcaggaggccttgtcctgttcttcttttttacggcatttgccacactgacagtggctatcctgctcatcatggaggggctctctgccttcctgcatgccctgaggctccattgggtggaattccagaataagttctacagcggtaccgggtttaaattccttccattttcatttgaacatatacgagagggcaagttcgaggaatag

SEQ ID NO: 179896 - DNA, 2571 bp, Artificial Sequence
  Description of Artificial Sequence: Synthetic coding sequence
atgggcagcctgttccggagcgagaccatgtgcctggcccagctgttcttgcaatctggtacagcttatgagtgtttgtctgccttgggtgagaaaggcctggtgcagttccgtgatttgaatcagaatgtttcatccttccagaggaaatttgttggggaggtcaagcggtgcgaagagttggaaaggatattggtgtacctcgtgcaggaaatcaatcgtgctgacatacctctgccagaaggagaggcctccccaccagcccccccccttaagcaagtgctggagatgcaggagcaattgcagaaacttgaggtggaactcagagaggtgacaaaaaataaggaaaaactccggaaaaaccttcttgaactcatcgagtatacccatatgctgagggtcactaagaccttcgtgaaacgaaacgtcgaatttgagccaacctacgaagagtttccctcactggagtccgatagcctgttggattacagctgtatgcagaggctgggcgctaagttaggattcgtgtccgggctgataaatcaaggcaaggtggaggcattcgagaaaatgctgtggcgtgtatgcaagggatacactatcgtgtcctacgctgagctcgacgagagtctggaggaccctgagacgggggaggtcataaagtggtacgtattcctgatctccttctggggggaacaaatcggacataaggtcaagaagatctgcgactgctaccattgtcacgtttatccatatcccaatactgctgaagagcggagggagatccaggagggattaaatactaggatccaggatctgtacaccgtcctgcacaaaactgaggactacctgagacaagtgctttgtaaagccgcagagagcgtctacagcagggtaatccaggtcaaaaaaatgaaagccatctaccacatgctgaatatgtgttcgttcgacgtcacgaacaagtgtctcatcgccgaagtctggtgtcccgaggccgacctacaggacttacggcgggctcttgaggagggcagtcgggagagcggggccacaataccatcctttatgaatataattcccacgaaggagaccccacctacaaggattagaacgaataaattcaccgaagggtttcagaatatcgttgacgcttacggagtgggctcctatcgcgaagttaaccccgcactgttcactatcatcacctttccctttctctttgccgtgatgtttggtgacttcggccatggcttcgtgatgtttttatttgcgctgctgctggttcttaatgaaaaccaccctcgactgaaccaatctcaggagattatgagaatgtttttcaatggacgctatattctcctgctgatgggcttgttcagtgtctacacaggcctgatatataatgactgcttcagtaagagcgtgaacctctttggttcaggctggaacgtgagcgccatgtattcctcatctcatcctcctgctgagcataagaagatggtgttatggaatgattccgtcgtacgccataactccatactccagctggatccctctattcctggcgtgtttcgaggaccatatcctcttggaatagacccaatctggaacctggccacaaatagactgacctttctgaacagcttcaagatgaagatgagcgtcattctggggatcattcatatgaccttcggcgttatattaggaatctttaatcacctgcactttaggaaaaagtttaacatctacctggtttctattcctgaattactgtttatgttatgcatctttggatatctcattttcatgattttttataaatggctggtttttagtgcggagacgagccgcgtggcaccttccattctcattgagtttataaacatgtttctattcccagcatctaaaacatctgggctctataccgggcaggaatacgtgcaacgcgttcttctggtggtgactgcgctaagcgtgccagtgctatttctggggaaaccactgtttctgttgtggctccacaacggtcgcagctgcttcggggtcaatcggtccggctacaccttgatcaggaaagacagtgaagaagaggtgtcactgctcggaagccaagacatagaagaaggcaaccatcaggtggaggacggctgccgggaaatggcatgcgaagagttcaatttcggcgaaattctcatgacccaggtgatccactcaattgaatactgcctgggatgcatcagcaatacagctagttacctgaggctgtgggccctgtcattggcacacgctcaactgtccgacgtgctttgggctatgctgatgagggttggccttcgcgttgacactacctacggcgttttgctcttgttaccagttatcgctctgtttgctgttcttactattttcattctactgattatggagggcctctcggcctttctgcatgcgatccgactccactgggtggaattccagaacaaattttacgtcggcgcaggtaccaaattcgtgcccttttctttcagcctgctgagttcaaaatttaataatgacgattcagtggcatag

SEQ ID NO: 179897 - DNA, 1119 bp, Artificial Sequence
  Description of Artificial Sequence: Synthetic coding sequence
atgggcagcctgttccggagcgagaccatgtgcctggcccagctgttcctgcaatccggcactgcgtacgagtgtttgtccgccctgggcgagaaaggcctggtgcagttccgggatctgaaccagaacgtgtctagctttcaaaggaagttcgtcggtgaagtcaagcggtgtgaggaactggaaaggatattggtgtaccttgtgcaggagatcaacagagctgatatacctcttcctgagggcgaagccagtccccctgccccaccactaaaacaagttctcgagatgcaagaacaattacagaagctggaggtcgaattaagggaggttaccaagaataaagaaaagcttcgaaaaaatctgcttgagctgatcgaatacacccacatgctaagagtcaccaagacctttgtgaaacggaatgtggaattcgaacctacttacgaggaattcccatcacttgagtcagacagtctcttggattacagctgcatgcaacgcctgggcgccaagctcggcttcgtctccggactgatcaaccaagggaaggttgaggctttcgagaaaatgctgtggagagtttgtaaggggtacacaatcgtgtcttacgccgaactggacgagtctctggaagatcccgagaccggtgaagttatcaaatggtatgtctttctgatctcattttggggcgaacaaatcggccataaagtgaaaaaaatatgtgattgctatcactgccatgtttacccttatccgaatactgccgaagaacgccgtgaaattcaggaagggctaaacacccgtatccaggacttgtacacagtgttgcacaagaccgaagactatctgcgtcaggtcctgtgcaaagccgccgaaagcgtgtactctcgggtcattcaggtcaaaaaaatgaaagccatctatcacatgctgaatatgtgttccttcgatgtaacaaacaagtgcttgattgcagaagtctggtgtcctgaggccgatttacaggatttgaggcgcgctctggaggaggggagcgtgagattgccatctagccctctgccaggcactgaagaaaggctgatggagctcattaactcggagaagaagcgcaagtag

SEQ ID NO: 179898 - DNA, 2523 bp, Artificial Sequence
  Description of Artificial Sequence: Synthetic coding sequence
atggtgagcgtgttccggagcgaggagatgtgcctgagccagctgtttctgcaggttgaggctgcttactgttgtgtcgcagagctgggagagctggggcttgtacagttcaaggacctgaacatgaatgtcaatagtttccagagaaagttcgtaaatgaagttcggaggtgtgaatctctagagaggatcctgcgcttcctggaggacgaaatgcagaacgaaattgtggtgcaactgctcgagaagagccctttgacgcccctgccacgggaaatgatcacactggagaccgtgttagaaaagctggagggcgagttgcaggaggcaaatcagaatcaacaggctctcaagcagtcctttctggagttgacagagttgaagtacctgttgaagaagacccaggactttttcgaaactgaaacaaacctagcagatgacttctttaccgaggataccagcggactacttgaactgaaggctgtccccgcttacatgaccggcaaactgggcttcatcgccggggtaattaaccgggagcggatggcatccttcgagagactcctttggcggatctgtcgaggcaacgtatacttgaaattttccgaaatggacgctccattggaagatccagtcaccaaagaggaaatccaaaagaatatattcataatcttctatcagggagagcaactcagacaaaaaattaagaaaatctgcgacggtttccgcgccaccgtatacccatgtccagagccagctgtggaacgacgggaaatgctggagagcgtcaatgttcggctggaagacctgattacagtaattactcagacagagtcacatagacaacgacttctgcaagaagctgctgctaattggcacagctggctgataaaagtgcaaaagatgaaagccgtttatcatatcctcaacatgtgcaatattgacgtcacccagcagtgcgtcattgcggagatctggttcccagtcgccgacgccacgagaataaagagagccctggaacaagggatggagctgagtggctccagtatggcgccaattatgacaacggtccagagtaaaacagcccccccgactttcaacaggaccaataaattcacagctgggtttcagaacatagtggacgcctacggtgttggatcttaccgtgaaatcaatccagcaccatacactattattacgttcccgtttctgttcgcggttatgttcggcgattgcggccacggcactgtcatgctgcttgctgcactctggatgatcctgaacgagcgccgactgctgtctcaaaagacggataatgagatctggaataccttcttccacggacgctacctaatccttttgatgggcatcttcagcatctacaccggactcatctataatgactgcttcagcaaaagcttgaacatttttggctccagctggtcggtgcagcccatgttccgaaacggcacatggaatacccacgtcatggaggagtctctctacctgcaactagacccagctataccaggggtatatttcggcaatccatatccctttggcatagatccgatatggaacctggcaagcaataagttaaccttcctaaattcatacaaaatgaaaatgtccgtgattttgggcatcgtgcaaatggtattcggcgttattctgagtctcttcaaccatatttacttccggaggacactgaatatcatacttcagtttatccccgagatgatctttatcctctgcctgtttggttacctggtatttatgataattttcaaatggtgctgctttgatgtacatgtgagccagcatgccccttcgatcctgattcacttcattaacatgttcctcttcaactattccgatagcagtaacgcccctctctacaaacatcagcaggaagttcagtccttctttgtagtaatggccctaatctcagttccttggatgctgctcataaagccattcatactacgcgctagccaccgtaagtcccagctgcaagccagtaggatacaggaagacgccaccgagaacatagagggagattcttctagtccatcaagtaggtctgggcaacgcacttcagccgacacacacggggctttagacgatcacggcgaagaatttaattttggcgatgtgtttgtgcaccaggctattcacacaatagaatactgcctgggatgtatctccaacacagccagttatctgagactatgggcactgagtctggcccacgcccaactcagtgaggtgctttggacaatggtaatgaactctggtctgcaaaccagaggatgggggggaatcgtgggagtgtttatcatctttgctgtatttgcagttcttacagtcgctatactcctcattatggagggactttctgcctttctgcacgccctgcggctgcattgggtagaattccagaacaaattctatgttggcgatggctataagttctctccttttagcttcaagcacattcttgatggaacagccgaagagtag

SEQ ID NO: 179899 - DNA, 2523 bp, Artificial Sequence
  Description of Artificial Sequence: Synthetic coding sequence
atggtgagcgtgttccggagcgaggagatgtgcctgagccagctgtttttgcaggtggaagcagcctactgttgtgtggccgaactcggcgagctaggcctggttcagttcaaagatttaaatatgaatgtgaattccttccagcggaagttcgtgaatgaagtgcgcaggtgcgagtcactcgagaggatcctgcgcttccttgaggacgagatgcaaaatgagattgttgtgcagctcctagaaaagtctcccctgactccactgccacgagagatgattactctggaaactgttctcgagaagctcgagggagaattacaggaggcgaatcagaatcagcaggctctgaagcagtcttttctggagctgacagaattaaaatacttattgaagaaaacacaagacttttttgaaactgaaaccaatctcgctgatgatttttttacagaagacactagtggccttcttgagttgaaggccgtcccggcttatatgaccggaaaactcgggttcatcgctggggtcattaatcgggaaaggatggccagctttgaacgattattatggagaatctgccgaggcaatgtctacttgaaatttagtgaaatggatgcgccattagaagaccctgtgaccaaggaagagatccagaagaacattttcataatcttctaccagggggaacaactgcgacagaagattaagaagatatgtgatggctttagagctaccgtgtacccctgtccagagcccgcggtggaaaggagggaaatgctggaatctgtgaatgtacggctggaggatttaataaccgtaattacccagactgagtcccatcgtcagagactgctgcaggaagccgccgccaattggcacagttggctgatcaaggttcagaaaatgaaagctgtctaccatatcctgaatatgtgcaacatcgacgtcacccagcaatgtgtgatcgcagagatctggtttcccgtggccgacgctactaggatcaaacgcgctctagagcaggggatggagctgtcgggctcctctatggcacctatcatgaccactgttcagagcaaaactgccccacccacatttaaccggacaaacaagtttaccgcaggcttccagaatattgtggacgcttacggagtcgggtcctaccgtgagatcaacccagccccctacaccattatcacttttccgtttcttttcgcagtgatgttcggagactgcggccacggaacggtaatgttgctcgcggctctgtggatgatcctcaatgagcgccgcctactatcccagaagaccgataatgaaatttggaatacgttttttcatggcaggtatctgatattattaatgggtatattctccatatacacaggcctgatttataatgactgtttcagtaagtctttgaacatcttcgggtctagctggtcagtacaacctatgttccggaatggcacgtggaacacacacgtgatggaggagtcactatacctccagctcgatccagcaatccctggggtgtactttgggaatccctatcctttcggcatcgaccctatctggaacctggccagcaacaagttaacatttctcaattcttacaagatgaagatgtctgtgatcctggggatagtccaaatggtgttcggggtcatcctgtctttgttcaaccacatctactttaggaggactctgaacatcattctccagtttattccggagatgatattcatcctgtgtcttttcgggtacttagtctttatgataatctttaagtggtgttgctttgacgtgcatgtttcacaacatgctccctcgattctgatccacttcattaacatgttcctgtttaattacagtgattcctccaacgccccactgtacaaacaccagcaggaggtccagagcttcttcgtggtcatggccctgatcagcgtgccctggatgctcttaattaagccattcattctcagggccagccacaggaaaagccagcttcaggcctcacggattcaagaggatgctacagagaacatcgagggagattcaagttctcctagcagcaggagcggtcagaggacatccgccgatacacacggggctctagatgatcacggagaggagtttaacttcggagacgtcttcgtgcatcaggctatccatactatcgagtattgcctaggctgcatttctaacactgcctcatatttgcgcttgtgggccctgtccctggcacacgcccagctgtctgaagtgttatggaccatggtaatgaactctggcctgcagacccggggctggggcggcattgtgggtgtgttcatcatcttcgcagttttcgctgtgctcaccgtggcgatcctcttaatcatggaaggactgtctgcctttctgcacgcactgcgtctccactgggtcgaattccagaacaagttctatgtaggggacgggtataagttctcccccttttcctttaagcacatcctggacgggacagccgaagaatag

SEQ ID NO: 179900 - DNA, 2523 bp, Artificial Sequence
  Description of Artificial Sequence: Synthetic coding sequence
atggtgagcgtgttccggagcgaggagatgtgcctgagccagctgttcctgcaggtggaggccgcctattgctgcgtagccgaactgggtgagctcggactggttcagtttaaggatctgaatatgaatgtaaatagctttcagaggaaatttgttaatgaagtccgtcgctgtgagtcattggaacgcatccttcggttcttggaagatgaaatgcagaatgagatcgttgtgcagttgcttgaaaaatcccccctcacacctctcccccgtgaaatgattaccttagaaactgtgctcgagaagctggaaggcgaactacaggaagccaaccagaaccagcaggcactcaagcagtcttttctggagctgaccgagcttaagtacctgctgaaaaagactcaggacttttttgagaccgaaaccaatttagccgatgatttcttcacagaagataccagtggcctccttgaactgaaagccgttccagcttacatgactgggaaactcggattcattgccggcgtgataaatagggagaggatggcttctttcgaaaggctgctttggcgcatttgcagagggaacgtctaccttaagttctccgagatggatgcaccactcgaggatccagtgacaaaggaagaaatacagaagaacattttcatcattttctatcaaggagagcagctcagacaaaagattaagaagatatgcgatggctttcgcgctaccgtctatccctgccccgaacccgccgtggagcggcgagaaatgctcgagtcagtgaatgtgagactagaagacttgataacagttataacgcagacagagtctcacagacagagactcctgcaggaagcagctgccaattggcattcttggctgatcaaggtccagaaaatgaaggccgtctatcatattctaaatatgtgtaatatcgacgtgacacagcagtgtgtgatagcagaaatttggttcccagtggctgacgctacgagaattaaacgggcattggagcaggggatggagctgtctggcagttctatggcccccatcatgactactgtgcagagtaagaccgctccaccgaccttcaaccgtacaaacaagttcacagctggattccagaatatcgttgatgcttacggtgttggatcctaccgggaaataaaccccgccccctatacgatcatcacttttcctttcctttttgccgtgatgttcggcgactgtgggcacggtactgttatgttgttggccgctctgtggatgattctgaacgagagacggctcttatcccagaagacagataatgagatctggaatacattcttccacggacgttatctaatcctgttgatggggatattcagtatttacaccgggctgatatataatgactgtttcagcaaatcccttaacatttttggtagtagttggtctgttcagcccatgtttcgaaatggaacttggaatactcacgtcatggaggaatcgttgtatctccaacttgacccagcgataccgggcgtgtatttcggaaatccctatccattcggaatcgatccgatttggaacctggcgagcaataaactaacatttctgaattcttataagatgaaaatgtctgtcattctgggcatcgtccagatggtgttcggcgtaatcttgagcttgttcaatcatatttatttccgtcggaccctgaacatcattttgcagttcatcccagagatgatctttattctttgtttgttcgggtacctggtgtttatgataatctttaaatggtgttgctttgatgtccatgttagccagcacgccccctcaattctcattcacttcataaatatgttcctgtttaactactctgacagctccaacgccccattgtataagcatcagcaggaagttcagtctttctttgttgtaatggccctgatctcagtgccgtggatgcttcttatcaagccgttcatactccgggctagtcaccgtaagagtcagctgcaagcctcccgcatccaggaagatgccactgaaaatatagaaggagacagttcctcacccagttccagaagcggacagcgcacaagcgcagacacacacggcgccctcgatgaccacggagaagaattcaattttggagacgtgtttgtgcatcaggcaatccacaccatcgagtactgtctggggtgcatcagcaataccgcatcctacttgaggctctgggcgttgagtctagcccatgctcaactgtcggaggtgctctggactatggtgatgaactctggtcttcagactagaggttggggcggtatcgtgggcgtctttataattttcgccgtttttgcagtgctgaccgtagctatcttacttatcatggagggcttatcggcctttctgcatgctctgcgcctgcattgggtagagtttcaaaataaattctatgtcggggacggctacaagttctcacccttcagctttaaacatatcctggatggtactgcagaagaatag

SEQ ID NO: 179901 - DNA, 3108 bp, Artificial Sequence
  Description of Artificial Sequence: Synthetic coding sequence
atgggcaaggccgagaactacgagctgtacagcgtggagctgggccctggcccagggggagatatggccgctaagatgtcaaagaaaaagaaagctggcggtggggggggcaagaggaaagaaaagctggaaaatatgaaaaaggagatggagattaatgaccatcagctcagcgttgcagagctcgaacagaagtaccagacatcagctaccaaaggacttagcgcctccctggccgccgaactcttactgagagatggaccaaatgccctgcggccccctcgtgggacaccagaatacgtgaagttcgcccgacagcttgccggtggtcttcaatgtctgatgtgggtggctgccgccatctgccttatcgcattcgctatccaggctagtgaaggagatctgaccaccgacgataatctctatctggcgattgccttgatagctgtcgttgtggtgacaggatgttttggttactatcaggaatttaagagcacgaatatcatcgcctcctttaaaaatctagtacctcaacaggcaacagtcatacgagacggagataaatttcagatcaatgccgaccagctcgttgtaggggacctagtagaaatgaaaggcggtgaccgggtaccggcagatattagaatcttggccgcgcagggatgcaaagtcgataattcaagtctaacaggcgaatccgagccacagactcgatctcctgagtgtacccacgagagccccctcgaaacacgtaacatcgcctttttctctacaatgtgcctggaaggcacagttcagggactagtagtgaacacgggggaccggactataataggacggatcgcatctcttgcctctggggtagagaacgagaagactcccatagccatcgaaatcgaacattttgtggatatcattgcaggtttggctatactgtttggcgctacattctttatcgtcgcaatgtgcatagggtatacgttcctccgggctatggtgtttttcatggcaattgttgtagcttacgtcccggagggactccttgctacagtgacggtatgtctctccctcactgccaagagattggcatctaagaattgcgtcgtgaagaatctagaagctgtggagactctgggaagtacctctgtaatatgttcagataaaacaggcactctgacccaaaacagaatgactgtatcccacctgtggtttgacaatcatatacacacagctgacactaccgaggatcagagcgggcagactttcgaccagagtagcgaaacctggcgggctctgtgtcgcgtgctgactttgtgtaatagggccgccttcaagagtgggcaggacgccgtgccagttcccaaaaggatagtaattggcgatgcctctgaaacagccttgcttaagttcagcgaactgacactgggcaacgcaatgggatacagagatcggtttccgaaggtctgtgagattcccttcaacagtactaacaagtttcagctctcaatccataccctggaagatccacgggatcctcgacacctcctggtgatgaaaggagcacccgaacgggtcctggaacgctgcagcagcattctgatcaagggacaagaactgcctctggatgaacagtggagagaggcgtttcaaaccgcctacttgagcctgggggggcttggcgagagagtattgggtttttgtcaactttacttgaacgagaaagattacccgcccggctacgcctttgatgttgaagctatgaacttcccctcctctggcctttgtttcgcgggactggtttctatgattgatcctccccgggctactgtccccgatgccgtgttgaaatgccggacagccggaattcgggtaattatggtgacaggcgaccacccaatcaccgccaaggctatcgctgcctctgtgggcattatctccgaagggtccgaaaccgtggaggacattgccgcccggttacgcgtgcccgttgaccaggtgaacaggaaagacgcccgggcatgtgttatcaatgggatgcagttgaaggacatggacccttctgagctggttgaggctcttcggacccaccctgaaatggtcttcgcacgcacctcccctcagcaaaaactggttatcgtcgaatcctgccaaagactcggcgctatcgtggctgtgactggggacggggtgaacgatagtccagcccttaagaaagccgacattggggtcgccatgggcatcgcgggcagcgacgctgctaaaaatgcagcagatatgattctcctcgatgacaacttcgcctccattgtcactggggtcgagcagggcaggctgatctttgacaacctgaagaaatctatcgcctacacgttaaccaagaacatcccagagctgaccccgtacctgatttacataactgtttcggtccctctacccctgggctgtataaccatcttattcatagagttatgcaccgacatcttcccgtctgtctcactggcttacgaaaaagcagaaagcgatatcatgcatctcaggccccggaacccaaaaagagacaggctggttaacgagccgctagctgcctactcctattttcagataggcgcaatccagagcttcgccgggttcaccgactactttaccgctatggctcaagaaggatggttccccctgctgtgcgttggacttagagcacagtgggaagaccatcacttgcaggacctccaggattcttatggacaagaatggacattcggccagaggctctaccaacagtatacatgctacacagtcttctttatctcaattgaagtttgtcagatcgccgatgtactcattagaaaaactagaaggctgtccgccttccagcaaggatttttccgtaacaagatcctggtgatcgctatcgtgtttcaggtatgcattggttgctttttgtgctactgccccggaatgcccaatatctttaacttcatgccgatcagattccaatggtggctggttccactgccctacggtatcttgatcttcgtgtatgacgaaattcggaaattgggagtccggtgctgtcccggatcttggtgggatcaggaactgtattactag

SEQ ID NO: 179902 - DNA, 876 bp, Artificial Sequence
  Description of Artificial Sequence: Synthetic coding sequence
atggccgccctgcaggagaagaagacctgcggccagcggatggaggagtttcagcgctattgctggaacccagacacaggtcagatgctggggaggactctgtccagatgggtgtggatatccttatactatgtcgccttctatgtggtgatgacaggtttgtttgccctgtgcctgtacgtcttgatgcagaccgtggacccatacacccccgactatcaggaccaactgcgatcccctggggtgaccctcagacctgatgtttacggcgagaagggcttggagatcgtctataacgtctccgataacaggacctgggcagacctgacccagaccctccacgcgtttctggccgggtattcaccggctgcccaggaggattctattaattgtacttcagaacaatatttctttcaagaaagtttcagagcacctaaccacacaaagttcagttgcaagtttaccgccgatatgctgcagaattgtagcggtctggctgatcctaatttcggattcgaagaaggcaagccatgtttcattattaagatgaatagaatcgtgaaatttctgccgtccaatggcagcgcaccacgggtggactgtgcattcctggaccagcccagggagctcgggcaacccctccaagtgaaatattaccctccgaatggcactttctcgctgcattatttcccatactacggaaagaaagcccagccacactactctaaccctctggtggccgctaaacttctcaacatcccacgcaacgcagaggtggccattgtatgcaaagtcatggccgagcatgtgacgttcaataatccgcatgatccttatgaggggaaggtcgagttcaagctgaagatcgagaagtag

SEQ ID NO: 179903 - DNA, 1290 bp, Artificial Sequence
  Description of Artificial Sequence: Synthetic coding sequence
atgcagctgcggaaccccgagctgcacctgggctgcgccctggccttgaggtttctcgccctggtgtcctgggatatcccaggggcccgggcattagataatggcctcgcacggactcctactatggggtggctgcattgggagcgctttatgtgtaatctagactgccaggaagaacctgattcttgcatttcagagaaactatttatggagatggctgaactgatggtatctgagggatggaaggacgcaggctatgaatatctgtgtatcgatgactgttggatggctcctcagagagatagcgaaggaaggctgcaagccgatccacagagattcccgcatggcattcgtcagctggcaaattacgtacactccaaagggctgaaactcggtatttatgcagacgtgggcaacaaaacatgtgcgggttttcccggatcgtttggctactatgacatcgacgcccaaacgttcgctgactggggcgtggatctgctgaaattcgacggctgttattgtgattctctagagaatctggctgatgggtacaaacatatgtcacttgctcttaaccggacaggacgctctatcgtttactcatgtgaatggccattgtatatgtggcccttccaaaaaccgaattataccgaaatcaggcagtattgcaaccattggaggaatttcgctgatatagacgactcctggaaatctattaaaagtatactggactggacttctttcaaccaggaacgtatcgtcgatgtagcaggacctggcggttggaacgatcccgacatgctagtgatcggaaatttcggtctttcatggaaccagcaagttacacagatggcgctgtgggccatcatggccgcacccttatttatgtcaaacgatctcagacacatatcacctcaagccaaggcgctgcttcaagacaaagacgtaatcgccatcaaccaggacccattggggaagcagggttaccagctcaggcagggcgacaacttcgaggtttgggagcgtcctttgagtggacttgcctgggccgtcgctatgatcaatcgccaggaaattggtggccctagatcatacacaatcgccgttgcttccctcgggaagggcgtggcctgtaatcctgcgtgctttataacgcagctgctccccgtcaagcggaaactgggcttctatgaatggacctcgaggctacgaagtcacatcaaccctacgggaacagttctgctgcagctcgaaaatactatgcagatgtccctcaaagacctgctgtag

SEQ ID NO: 179904 - DNA, 3120 bp, Artificial Sequence
  Description of Artificial Sequence: Synthetic coding sequence
atgcaccagaagacccccgagatctacagcgtggagctgagcggcaccaaggacatcgttaagactgacaagggggacgggaaggagaagtacagaggactcaaaaataactgccttgagttaaaaaaaaaaaaccacaaagaggagtttcaaaaggagctgcacctcgatgaccataagctgagtaatcgggagctggaggagaaatacggcactgacataattatggggctcagtagcactcgggcagccgagctacttgcccgggacggccctaacagtcttaccccgccaaagcagacccctgagatcgtgaaatttcttaagcagatggtcggcgggtttagtatcctgctatgggtcggcgcatttctgtgctggatcgcttacggaatccagtatagctcagacaaatccgcctcgcttaataatgtttacctgggatgtgttctcggactcgtcgtgatcctgacaggcatattcgcctactatcaggaagcgaaatcaactaacattatgtcttcattcaacaaaatgatccctcaacaggcactggtgatacgggactctgaaaagaagactatacctagtgagcagctggtggtgggggatattgtcgaagtgaaggggggcgaccaaatcccggccgatatcagagtgttgtccagccaaggctgcagggtggataactcctccctgacaggtgagtcggagccccagccccgttcttccgaattcacccacgaaaacccacttgaaaccaagaacatttgtttctattccacaacatgcttggaggggaccgtaaccggtatggttatcaacaccggagacagaaccattatcgggcacatagcttcgctcgcttctggcgttggtaatgaaaagacccctattgcgattgagatcgagcattttgtgcacatagtagcaggcgtagccgtgagcatcggaatcctcttcttcatcatcgcagtgtctttgaagtaccaggtcttagacagcatcatctttttaatcgggatcatcgtggcaaatgtgcctgaaggccttctcgccaccgtcaccgttacactgtccctaaccgcaaagaggatggccaagaaaaattgtttggtgaagaatctcgaggctgttgaaacgttaggttcgacaagtatcatctgtagtgacaaaaccggcaccctcacgcaaaataggatgacagttgcccacttgtggtttgacaaccagatcttcgtcgcggataccagtgaggaccacagcaatcaggtcttcgatcagagtagccggacctgggccagcctgagtaagatcattacgctctgcaatagagccgaatttaagcccgggcaggagaacgtgccaatcatgaaaaaggccgtgatcggagatgcgtcagagacagcgctgctgaagtttagtgaagtcattctcggcgatgtgatggagataaggaagcggaatcgcaaggtcgctgagattcccttcaatagcacgaataagttccagttaagtattcacgagatggatgatccacacggcaaacggttcctcatggtgatgaaaggagcccctgagagaatcctcgagaagtgtagtaccataatgataaacggggaggaacacccactggacaagtccacagcaaaaaccttccataccgcctacatggagcttggaggactaggcgagagggtgctgggattttgtcacctatatctgcctgcagatgagttcccggagacttattcctttgacatagacgcaatgaacttcccaacaagtaatctgtgctttgtgggcctattgagcatgattgaccccccaagaagtaccgtgccagacgccgtgactaagtgtagaagcgcgggcattaaagtcataatggtaactggcgatcacccaattacagccaaagccatcgccaagagtgtaggcataattagcgctaatagtgaaactgtcgaggatatagctcatcggcttaatatcgctgttgagcaggtgaacaagcgcgatgcgaaggccgcagtggtcactggcatggaattgaaggacatgtcatctgagcagctggatgagattctagccaactaccaggaaatagtgttcgcgcgcacttctcctcagcaaaagctcatcatcgtcgaaggatgccagaggcaagatgccgtcgtcgcggtaaccggcgatggtgtgaacgattctcccgccctgaaaaaggctgacatcgggattgctatgggtatcgctggctctgacgccgctaaaaacgcagctgatatggtcctgttggatgacaacttcgcctcgatcgttaccggcgtcgaggaaggtcgcctgatttttgacaatctcaaaaaaacaattgcttactccttgactaaaaacatcgcggagttatgcccattcctcatatatataatcgtgggcctaccactgcccatcggcacaatcacaatattgttcatagacctcggaactgacattattccgagtatagcgctagcgtacgagaaagcagagtccgacatcatgaatagaaagccgcggcataagaacaaggaccgcctggtgaatcaaccacttgctgtttacagctatttgcacattgggttaatgcaggctttaggggcttttctggtttattttaccgtctacgcacaggaggggttccttcccaggactctgattaacctgcgggtggagtgggagaaagactacgttaacgaccttaaagattcttatggccaggaatggacacgatatcaacgcgaatacctcgaatggacggggtatacagcattttttgtaggtattcttgttcagcagattgctgatctcatcatacgcaagactcgaaggaactctatttttcagcagggcctcttccgaaataaagtgatctgggtcgggatcacgtcgcagattattatagggctcattctctcctatggcctcggaagtgtcacagccctatcttttacaatgctgagggcgcagtactggttcgtagctgtgccacacgccatcctgatttgggtatacgatgaggtgaggaagctgttcataaggctgtatcccgggtcgtggtgggacaagaatatgtactattag

SEQ ID NO: 179905 - DNA, 3072 bp, Artificial Sequence
  Description of Artificial Sequence: Synthetic coding sequence
atgggcaagggcgtgggccgggacaagtacgagcccgccgccgtgtccgaacagggcgacaaaaaaggcaagaagggaaaaaaagatagagacatggacgagctgaaaaaagaagtttctatggacgatcacaagctgtctctggatgaactgcacagaaaatacgggaccgacctgagccggggactgacaagcgcccgcgccgcagagattctcgcgagagatggacctaacgctctgacgccacctcccactacaccagaatggataaagttctgcagacagctgttcggaggttttagcatgctcctgtggattggggccatactgtgttttctggcctacagcatacaggccgcgactgaggaggaaccccagaatgataacctgtacttaggcgtagtcttgtccgccgtagtcatcattacaggatgcttctcgtattaccaggaagccaagagcagtaagattatggaaagtttcaaaaatatggtgccacagcaggcactggtgatacgcaatggtgaaaagatgagcattaatgccgaagaagttgtggtcggagatctcgtcgaggttaagggcggcgacaggatcccggctgatcttaggattatcagtgcaaatggctgtaaagtagacaactcctccttgacaggggaatccgagccccaaaccaggagtccagatttcacgaatgaaaatcctctcgagacaagaaacattgcctttttcagtaccaactgtgtggagggaacagcaaggggcattgtggtctacacaggcgacaggaccgtgatgggccgcattgctaccctggcctcgggacttgaagggggccaaacccccattgctgccgagattgagcactttattcatattatcactggggtggctgtatttctgggagtgagtttcttcatccttagcctgatattggaatacacctggctggaagcagtgatatttcttatcggcatcatcgtggccaatgtacccgagggtctgctggccaccgtcaccgtgtgcctgacactgactgctaagcgcatggcccgtaaaaattgcctggtgaagaacttggaagcggtcgaaacccttggctcaacttctacgatttgttctgataagactggaactctgacccagaacagaatgactgtcgcccacatgtggttcgacaaccagattcatgaagcagataccaccgaaaatcagtcaggcgtcagttttgataagaccagcgccacatggttggctctgagtaggattgccggcctttgtaatagagccgttttccaggcaaaccaggagaacctccccatcctcaaaagagccgtggccggagatgccagcgaatcagctcttcttaagtgtatcgaactttgttgcggctccgtgaaggagatgagagagagatacgccaaaattgtggagattccttttaacagcaccaataaataccagctctctatccacaagaatcccaatacctctgagccacaacatcttttagtcatgaagggcgccccagaacgtattctcgaccgttgctcaagcatactactgcacggaaaggagcagccactagatgaagagcttaaggacgcattccagaacgcctatcttgaactgggaggtctgggggaaagagtcctgggtttctgccacctgtttctgcccgacgaacaattccccgagggatttcagttcgataccgatgacgtgaattttcccattgacaacctgtgtttcgttggactgatctctatgatcgatccaccaagggccgccgtacccgatgcagtggggaagtgtaggtccgccggtattaaagtcattatggtcactggcgatcacccgattacagccaaggccattgctaaaggcgttggaatcatctctgaggggaatgagaccgtggaggatatcgccgcaaggttgaacatccccgtaagccaggtcaatcctcgagacgccaaagcttgcgtcgttcacggctcagatctgaaagacatgacgagtgagcaactcgatgatatactgaaatatcacacggaaatcgtattcgcccgcacctcgccacagcagaagcttattatagtggagggttgccagcgtcagggggccatcgtagcggtgaccggcgacggcgtgaacgatagtccagctctgaagaaagctgatattggcgtagccatggggatagcagggtccgatgtctccaagcaggccgccgatatgattctactcgatgacaactttgcttctatcgtaacgggggtcgaagaaggccgcctcatctttgacaatctgaagaaatctatcgcctacactctgacgtctaatataccagagatcactccttttttaatttttatcattgccaatattccgctcccactcggaaccgtgactatcctgtgcattgacctcggcacagacatggttcctgcgatctccctggcgtacgaacaggccgagagcgatatcatgaaaaggcagccccggaaccctaagacggataagctggtgaacgaacgcttaatttccatggcttatggacagattggcatgattcaggcactgggagggttttttacgtattttgtgatactggcagagaatgggtttttgcccatccacctgttgggtttgcgagtggattgggatgatcgatggattaacgatgttgaggactcatatggacagcagtggacgtacgagcagcggaaaattgtggaattcacttgccatactgcattctttgtgtctattgtggttgtgcagtgggctgacttagtcatttgtaagaccaggcgcaactccgtgtttcagcaggggatgaaaaacaagatcctcatttttgggttatttgaggaaaccgctcttgccgcctttttgagctactgtccgggtatgggcgtggccctgaggatgtatcccctcaaacccacttggtggttttgtgcatttccctatagtctgctgatttttgtgtacgatgaggtccgcaaactcatcatccgcaggcgccctggcggctgggtggagaaggagacatattactag

SEQ ID NO: 179906 - DNA, 2043 bp, Artificial Sequence
  Description of Artificial Sequence: Synthetic coding sequence
ggcaaggaggtgggccgggacaagtacgagcccgccgccgtgagcgagcaaggagacaagaaaggaaagaaagggaagaaagatagagatatggatgaactcaagaaggaggtgtctatggacgatcacaagctgtccctcgacgagctgcacagaaaatacggcacagatctgtccagggggctgacatctgcccgggcagctgagattctagcccgtgacggacccaatgccttgacacccccacctactacacctgaatggatcaaattctgcagacaacttttcggtgggttcagtatgcttctttggatcggcgccatcctctgcttcctggcatactccatccaggcagccactgaggaggaaccacagaatgacaacctctaccttggagtggtgctgtctgcggtggttatcataacggggtgcttttcatattaccaggaagccaagtcgtccaaaatcatggagtcgtttaagaacatggtgccccagcaggccctggttattagaaatggggaaaagatgagtataaacgccgaagaagtggtagtgggagatctcgtggaggtgaagggtggggatcggattcccgccgatctcaggatcatcagtgcgaatggatgtaaggtcgacaatagcagcctgacgggggagagcgaacctcaaacaagatctcccgatttcaccaacgaaaaccccctcgaaacacgcaatatcgcattcttcagcaccaattgtgtggaaggcactgcgaggggcatcgtggtttacactggagaccgaactgtgatggggcgcatcgctactctggcctctggcttagaagggggacaaactccaatcgccgccgagattgagcactttatacacatcattacaggagttgcggttttccttggggtgagcttctttatattgtccctgatcctggagtatacctggctggaggccgtgatttttttgatagggattatcgtggcaaatgttcccgaaggccttcttgcaaccgtgacggtttgtctgacccttactgccaagcggatggccaggaaaaactgcctggtcaaaaacctcgaggcagtcgagacactcggaagtacctcgactatttgtagcgataagaccggtaccctcacccaaaaccgtatgaccgtggcccatatgtggtttgataatcagattcatgaagcagataccacagagaaccagtcaggggtgagcttcgacaagacttccgctacctggttggcactgtctaggatagcaggcctgtgcaatcgggctgtatttcaagctaaccaggaaaatctgccaatcctaaagagggctgtcgccggagatgcttccgaatccgctcttttgaaatgtattgagttgtgttgcggttcagtcaaggagatgagagaacggtatgcaaagatcgtggagattccctttaattccaccaataaataccagttgtcaattcacaagaatcctaacacgtctgaacctcaacatctactcgtgatgaaaggtgctcccgagcgcattctcgatcgatgctcttctattctcttgcacgggaaagagcaacctttagacgaagagttgaaggatgcgttccagaacgcctacttggagttgggcgggctcggagagagggtccttggtttttgtcatctctttctacctgatgaacagttccctgaagggtttcagtttgataccgatgacgttaactttcccattgacaacctgtgcttcgttggtttgatttctatgatcgaccctccccgggccgctgtgcccgatgccgtcggaaagtgccgcagtgctggcattaaagtaatcatggttaccggtgaccacccaataactgcgaaagcaatcgccaagggggtgggaataatctccgagggcaatgaaccaatgtcccgcggaaagtcttggtcttcgccagcaacccaaccaagcagctcagtgtcatggtggtgctccggccctacttggagctcagtgagacctggtgggatcaggagctcatctcgaggatag

SEQ ID NO: 179907 - DNA, 435 bp, Artificial Sequence
  Description of Artificial Sequence: Synthetic coding sequence
atggacgagctgaagaaggaggtgagcatggacgaccacaagctgtcccttgacgagctacacaggaagtacggaactgacctgagtcgcggtctgacttctgctcgcgcggctgagattctggcccgcgacggtcctaatgccctaacaccacctccaacgactccagagtggattaagttttgtagacaactcttcggcggcttctcaatgctgttatggatcggtgccatcttatgtttcctcgcctattcaatccaggcagccacagaagaggaaccccagaatgacaatttgtacctcggcgtcgtcttgagcgccgtagtgataattacggggtgttttagttactaccaggaggcgaaatctagtaagatcatggagtcttttaagaacatggtcccacaacaggcgctggtgatcagaaatggatag

SEQ ID NO: 179908 - DNA, 2979 bp, Artificial Sequence
  Description of Artificial Sequence: Synthetic coding sequence
atggacgagctgaagaaggaggtgagcatggacgaccacaagctgtcactggacgagcttcatagaaagtatggcacagatctttcgcgtggactaacttccgcccgagccgcagaaattctcgctcgcgacggccctaatgctctgactccaccgcccactactccagaatggattaagttctgtagacagttgttcggtggcttctccatgcttctgtggataggtgccattctttgtttcctggcatacagcatccaggctgccacggaagaagaacctcaaaatgacaacttgtatctcggtgtcgtgctgtccgctgtcgtaattataacaggttgcttctcctactatcaggaggccaagtcttcaaagattatggaatcattcaagaatatggtgccacagcaggccctggtgattcgcaacggagaaaagatgtccattaacgcagaggaggttgtggtgggggatctcgtggaggtgaagggcggggatcggatccctgctgatctgcggattatcagtgctaacggctgcaaggtcgataactctagccttaccggtgaatcagaacctcaaacacgttctccagatttcaccaatgaaaatcctctggaaacaagaaatatcgcgttcttctctaccaactgtgttgagggcacagcccggggcattgttgtgtacactggcgaccgcactgtcatgggtcggatcgcaaccctggccagcgggctggaaggtggacagacccccatcgctgccgaaatcgagcactttatccatatcataaccggggtggccgtgtttctgggcgtgagtttcttcattttgagtctcattctcgaatacacttggcttgaggctgtcatcttcttgatcggaattatcgtggccaatgtgcccgaggggctcctggccactgttacagtctgtctgaccttgaccgcaaagcgcatggcccgcaagaactgcctagtgaagaatcttgaagcagtggagactttggggtccacaagtaccatttgctcagataaaacgggaacactgacccagaacaggatgactgttgcccacatgtggttcgataatcagatacacgaggcggacacaactgagaaccagagcggagtctcctttgataaaactagcgctacttggctcgctctgagcaggattgctgggctctgtaacagagctgtttttcaagccaaccaggaaaacctgccaattctgaagagggccgtggctggtgacgccagcgagtcggcccttctgaagtgtatcgagctgtgctgcggctccgtcaaggagatgagggagagatatgccaagatcgtggagattccttttaatagcactaacaagtaccaactcagtatacacaaaaaccctaacacctccgagccccagcatctgttggtcatgaaaggagctcccgaaaggatattggatcgatgttcctctatcctcttacatggtaaagagcaacccttagacgaagagctgaaagacgccttccagaatgcgtacttggagttgggcgggcttggcgaaagagtgttgggcttttgccatctgtttctgccagacgagcagttcccggaaggattccagttcgatacagatgacgtgaactttcccatcgataacctgtgcttcgtcggtctcatttcaatgatcgacccaccaagagccgcagtccccgatgccgtagggaagtgccgatccgcaggaattaaagtcataatggtgaccggggaccaccctatcactgcgaaggctattgcaaagggcgtgggaatcatcagcgaaggaaatgagactgttgaggatatcgctgccaggctcaacattcctgtgagtcaagtgaaccccagggacgcaaaagcttgcgttgttcacggttccgatctgaaagacatgacatcagagcagctggacgatattctgaagtaccacacagaaatcgtttttgctagaacctccccgcagcagaagctgatcattgtcgaaggatgccaaagacagggagctatcgtagcggtgacaggcgatggagttaacgattcgcctgcactgaagaaggcagatatcggcgttgcaatgggcattgctggatccgacgtatcgaagcaggcggccgatatgatcttattggacgacaactttgcctcaatcgtcaccggcgtggaggagggacggctgattttcgataacctgaaaaaaagcatagcctacaccctaaccagcaatatccccgagatcacaccatttctgatctttatcatagccaacattccactgcccctgggcacagtcactatcctatgtatcgatttaggcacagatatggtgcccgccataagcctagcatacgaacaagcagagtccgacatcatgaagagacaaccgagaaatcctaaaaccgataagttggttaatgagaggctgatctctatggcatatgggcagattggcatgatccaagctctcgggggcttctttacatacttcgtaatactcgcagaaaacggttttctacccattcatctcctaggcttgagggtcgattgggatgaccggtggattaacgacgtggaggactcatatggacaacagtggacctatgagcagaggaagatagtggagttcacctgccacaccgctttcttcgtgtcaattgtcgtggtccagtgggccgacctcgtcatttgcaagacacggagaaatagtgtgtttcaacaaggaatgaagaacaagatccttattttcggtttgttcgaggagaccgccctggctgccttcctcagctactgccctgggatgggcgtcgctctgaggatgtatcccctgaaacctacctggtggttctgcgctttcccatactccctactgatcttcgtgtatgacgaagtgaggaagctgattatccgcagacgtcccggggggtgggtcgaaaaggaaacgtactactag

SEQ ID NO: 179909 - DNA, 321 bp, Artificial Sequence
  Description of Artificial Sequence: Synthetic coding sequence
atggacgagctgaagaaggaggtgagcatggacgaccacaagctgtctttggacgaactgcaccgaaagtacggcaccgatttgagtcgcggattgacgagcgcgcgggcggctgagatactggctagagatggacctaatgcactgactccgccaccaaccaccccggaatggatcaagttctgccggcagctttttggtggcttctcaatgctgctgtggatcggggccattctgtgtttcctagcctattctattcaagccgcgacagaagaggaaccacagaatgacaacctatacctgggggtggtgttaagctag

SEQ ID NO: 179910 - DNA, 474 bp, Artificial Sequence
  Description of Artificial Sequence: Synthetic coding sequence
cggcagccccggaaccccaagaccgacaagctggtgaacgagcggttaatatccatggcatacggccaaatcggcatgatccaggccttgggtgggttctttacctatttcgtgattctggcagaaaacgggtttctcccaatccacctgctgggacttcgagtggattgggatgatcgctggataaacgatgtggaagattcttatgggcaacagtggacatatgaacaaaggaagattgtggagtttacttgtcatacagccttcttcgtgagcattgttgtagtccagtgggctgacctggtgatatgcaagacgagacggaattccgtattccaacagggcatgaagaacaaaatcctgatctttggtctttttgaggagaccgcactggctgcattcctctcttactgtcctggcatgggcgtggctctgcggatgtatccgctgaaaacactgactcagtacagttag

SEQ ID NO: 179911 - DNA, 480 bp, Artificial Sequence
  Description of Artificial Sequence: Synthetic coding sequence
atgaagcggcagccccggaaccccaagaccgacaagctggtgaacgagcgtttaatcagtatggcttatggacagatcggtatgattcaggctctaggcggcttctttacgtactttgtaatcttagcggaaaacggctttctccctatacatttgctaggccttcgcgtcgactgggacgatcggtggattaatgacgtagaggatagctatggtcaacagtggacctacgagcaacggaagatcgtagaattcacctgccatacggcattcttcgtgtctatcgtggtggtacagtgggcggatctggtgatatgtaagaccagaaggaatagcgttttccagcagggcatgaagaataaaatattaatcttcggactgttcgaagagaccgcccttgccgcgttcctgtcgtattgtcccggcatgggagtggcgttgcggatgtacccgctcaagactctcacccagtacagctag

SEQ ID NO: 179912 - DNA, 3072 bp, Artificial Sequence
  Description of Artificial Sequence: Synthetic coding sequence
atggccttcaaggtgggccgggacaagtacgagcccgccgccgtgtccgagcagggtgacaaaaaggggaagaagggaaagaaggacagagacatggatgagttgaagaaagaggtgtctatggatgaccataagttgtctttagacgagctgcatcggaagtatgggacagacctgagcagagggctgacaagcgccagagcggctgagatactcgcgcgagacggaccaaatgcactcacaccacctcccacaacccctgaatggattaagttttgtcgacaactgttcggcgggttcagcatgctgctgtggatcggagctattctgtgctttttggcgtactccattcaggccgccacagaagaagaaccccagaacgataatttatatttgggcgtcgtcttaagcgcagtggtgatcattactggctgcttcagctattatcaggaggctaaatccagcaaaatcatggagagtttcaagaacatggtaccgcagcaagcgctcgtgattcgcaatggtgagaagatgtctatcaacgcagaggaggtagtcgtgggagatctcgtggaggtgaagggcggcgaccggatacctgccgacctgcggatcatttccgctaatgggtgtaaggtggacaactcaagtctcaccggggaatccgaaccacaaacacgatctccagattttaccaacgagaaccctctggagacaagaaatatcgcctttttcagtacaaattgcgtggaagggaccgcccgcggcatagttgtgtacaccggggatcgaacagtcatgggtcggatagcgactctcgcatcaggactagaaggaggccagacccctatcgctgcagaaatcgaacatttcatacatataatcaccggggtcgcagttttcttgggggtgagtttttttattctgtccctcatcctggagtatacttggctggaagcggttatctttctcatcggcattattgtggccaacgtccctgagggcttgcttgctacagttaccgtttgcctgacactgacggccaagcgaatggctagaaaaaattgtctcgtgaagaatctagaggccgtggaaacgctggggtctacaagtactatctgctcagacaaaaccgggacactgacacagaaccgaatgacagtggcccacatgtggttcgacaaccaaatccacgaggccgataccactgagaatcaatccggcgtaagtttcgataagacctcagccacatggctcgccttatcacggattgctggcctctgtaaccgggctgtgtttcaggctaatcaggagaatctccctattctgaagcgcgccgtcgctggagatgctagcgagtctgctctcctgaagtgcatcgagctgtgctgcggttctgttaaggaaatgcgggaaagatatgctaagatcgtggagatcccatttaattccacaaataaatatcagttgagtatacacaagaatcctaacacgtcagaaccacagcacctactggtcatgaaaggggcgccagagaggattctagatagatgttcttctatcctcctgcacgggaaggaacagcctttggacgaagagctaaaggatgcatttcagaacgcttatctcgaactgggcggattaggggaacgggtgctggggttttgccacctgtttctacccgatgaacagtttccggaagggttccagtttgacacagatgatgtgaacttcccaattgataatctctgtttcgtggggttgatctcaatgatcgacccgccgcgagctgcagtgcctgatgcagtagggaaatgcagatctgccggcattaaggtgatcatggtaaccggagaccaccctattactgcaaaggccattgcaaaaggcgtggggatcatctccgagggaaatgagaccgtcgaggatatagcggcaaggctgaatattcccgtgtcacaagtgaatccccgtgatgcaaaggcctgcgtcgtccacggatcggatctcaaagacatgacgtcagagcagctggacgatatcttgaaatatcatactgagatagtgttcgccagaacttctccccagcagaaattgatcattgttgagggctgtcagaggcagggcgctatcgtggcagtgactggtgatggggtaaatgactctccggccctgaagaaggccgacatcggagtggcgatgggtatcgccggctctgatgttagtaagcaagccgccgatatgattctacttgacgacaatttcgccagcattgtgaccggagtcgaggagggacgcctgatctttgataacctgaagaagtcgatcgcctacacccttacatcgaatattccagagatcactccctttctgatttttattatcgccaatataccccttccattaggcacagtgaccatactgtgtatcgatcttggtaccgatatggtaccagccatctctctcgcctacgagcaggccgaatccgacatcatgaagaggcagccacggaatccgaagaccgataaactggtaaatgaaaggcttatcagcatggcatacgggcagattggcatgatccaggcgctgggcggtttttttacatattttgttatcctggccgaaaatggctttctgcctatccacttgctggggctgcgagtggactgggatgacagatggatcaacgatgtggaggattcttatgggcagcagtggacatacgaacagcgaaaaatagtcgagttcacatgtcataccgcattcttcgtaagtatcgtggtggtacaatgggctgacctggtgatatgcaaaaccagacgcaacagtgtttttcagcaaggcatgaaaaacaaaatcttaatcttcggtctgttcgaggaaaccgccctggcagccttcctgtcatactgcccgggcatgggggtggctctgagaatgtatcccctgaaacccacgtggtggttttgcgccttcccttactcattgttgatattcgtatacgatgaggtaagaaaattaattatcagaaggcgacctggaggatgggtggaaaaggaaacatactactag

SEQ ID NO: 179913 - DNA, 3063 bp, Artificial Sequence
  Description of Artificial Sequence: Synthetic coding sequence
atgggccggggcgccggccgggagtacagccccgccgccaccaccgctgagaacggcggcgggaagaaaaagcagaaagagaaggagctggatgagctcaagaaggaagtggctatggacgaccacaagctctccttagacgaattaggccgcaaataccaggttgacctcagcaaagggctaaccaatcagagggcacaggacgtgctagcaagggatggtccaaacgcactcacacctccgcccacgactcccgagtgggtgaagttctgtcggcaactgtttggcggattttccatcctgctatggatcggcgctattctctgctttctggcctacgggattcaggcagccatggaagatgagccatcaaacgacaatctctacctgggcgtcgtcctggccgcggtcgtcattgtcactggctgtttcagctactaccaggaagctaagtcttccaaaataatggacagcttcaagaatatggtaccccagcaggccctcgttatccgggagggggagaaaatgcaaattaatgccgaagaagtcgtggtgggcgacctggtggaagtgaagggaggtgacagagtgcccgctgacctgcggatcatatcctcacatgggtgtaaagtggacaactcttccttgactggagaaagtgagccgcaaactaggagcccagaatttacacacgagaaccccttagaaacccggaatatctgttttttcagcaccaattgcgttgagggcactgcaaggggtatagtgatcgcaaccggcgatagaacggtcatgggtcgtattgccacactcgctagcggtctggaggtcggacggactcctatcgctatggagatcgagcacttcattcaactgatcacgggcgtagccgtgtttctgggtgtgtcgttttttgtcctgagtctgattctaggatactcctggctggaagccgtgatcttcctgattggaataatcgtggccaacgtgcccgaaggtcttctcgccacagtgaccgtgtgcctaacactgacagctaaacgaatggcaaggaaaaactgccttgtgaagaatcttgaagcagtagaaaccctcgggtctacctccaccatttgttccgataaaaccggcacgttgactcagaataggatgacggtggctcatatgtggttcgacaatcagatccatgaggcagatactaccgaagaccagtccggggctacatttgacaaaaggtcccctacctggacagcactttcaaggatagcagggctctgtaaccgggccgtttttaaggctgggcaagagaatatttccgtgtctaagcgggacaccgccggggacgcgtccgaaagtgccctgttaaagtgtatcgagctgtcctgtggctctgtgcgaaagatgcgcgaccggaatcctaaggtcgcggagattccgtttaacagtaccaacaagtatcaacttagcattcatgaacgggaggactctccccaaagtcacgtgctggttatgaagggagcaccggaaagaattctcgataggtgcagcaccatactggtccaggggaaagagatacccttggataaggaaatgcaggacgctttccagaacgcctatatggagcttggtggtctgggagagcgtgtgttaggcttttgccagctgaacttgcccagtggcaagttccctcgcggctttaaatttgatacagatgaacttaacttcccaactgagaagctttgcttcgtcggcctgatgtccatgattgatcccccccgagccgctgtgccagatgcagtgggcaaatgcagaagcgcggggattaaggtcatcatggtgactggcgaccacccgatcaccgcaaaagctattgcaaaaggagtcggcattatatcagagggcaatgagacagttgaagacatcgccgcccggctgaatatccctatgagccaggttaaccctcgtgaagccaaagcttgtgtagttcacggatccgatctgaaagacatgacatcggagcaattggacgagatcctcaagaaccacaccgagatcgtcttcgcccgaactagtccgcaacagaaactcattatcgtcgaaggctgtcagcggcagggcgccatcgtggctgtgacaggcgacggggtgaacgacagccccgcactcaaaaaggccgatatcggtatcgccatggggatttctggttccgacgtgtcaaagcaggcagccgacatgattctgctcgatgacaatttcgcaagtattgtcactggcgtcgaagagggaagactaatattcgataacctgaaaaaaagtatagcatacaccttgacctcaaacatccccgagattacacctttcttgttgttcatcatagctaatattcccctgcctttaggaacagtcacgatactgtgtattgacctggggaccgacatggtcccggcgatatcattagcatatgaggcggcagagagcgacattatgaagagacagccccgcaattctcagacagacaagctcgtcaacgaacggctcatctctatggcttacggacagattggaatgatccaggcgcttggggggttcttcacgtatttcgtgattctagctgagaacgggttcctcccaagtaggctattgggtatacggctggactgggatgaccgtacgatgaacgatctggaggactcctacggccaggagtggacctatgagcaacgcaaggtggtcgaattcacctgccataccgcgtttttcgcgtccatagttgtggtacagtgggcggacttgatcatatgtaaaacacggcgcaactccgtttttcaacagggaatgaaaaataaaatcctgatattcggattactggaggagacggctttggccgcttttctcagctattgcccgggcatgggagtcgccttgcgcatgtacccattgaaggtgacgtggtggttttgcgcttttccttacagtcttctcatcttcatttatgatgaggtgcgtaagctgattcttaggcgctaccccggcgggtgggtggaaaaggagacctactactag

SEQ ID NO: 179914 - DNA, 3030 bp, Artificial Sequence
  Description of Artificial Sequence: Synthetic coding sequence
atgggccggggcgccggccgggagtacagccccgccgccaccaccgcggaaaatggaggagggaaaaaaaagcaaaaagagaaagaattagatgaactgaaaaaggaggtcgcaatggacgaccataaactatctttggatgagttgggaagaaagtatcaagttgaccttagcaaggggttaaccaaccagcgcgcccaggatgtgctggctcgggatggaccgaacgccttaacacccccccctacaacccctgaatgggtgaagttctgtaggcagttatttggcggcttctctatcctgctatggatcggagccatcctttgtttcctcgcctacgggattcaggctgctatggaagatgagccaagtaatgataacctgtatctcggagttgttttagccgccgtggtgatagtcaccggctgctttagctattatcaggaggcaaagtcatctaagattatggactcattcaaaaacatggtcccccagcaggcgctggttatacgagagggcgagaagatgcagattaatgctgaagaagttgttgttggagacttggtcgaagtaaagggcggtgatcgggtccctgctgacttgaggattatatcctcccatggatgcaaggtggacaacagcagcttgacaggggagtcggaaccccagacgcgcagccccgagttcactcacgaaaaccctctggagaccagaaacatctgctttttctccactaattgcgttgaaggaaccgcccgggggatagtgatcgcaactggcgataggaccgtgatgggacggattgcaactctggcatccggcctggaagtgggcaggactcccatcgccatggagatagagcatttcatccagcttatcaccggggtggccgtctttctcggagtgtccttcttcgtgttgtctcttattctgggctacagttggttggaggccgtgattttcctgattggaataatcgtggctaacgtgcccgagggcctactcgccacagtgaccgtatgtcttacattgactgctaagcggatggcccggaagaattgtctggtgaaaaacctcgaggctgtggagactttgggctctacatccactatttgcagtgacaagacaggaacactgactcaaaacagaatgactgtcgctcacatgtggtttgacaaccagatacacgaagccgatacaacagaagatcaatcaggcgccacctttgacaagcgctcccccacgtggaccgctctctcacgcatcgctggcctatgtaacagggccgtatttaaagcaggacaggagaacatttccgtgagcaagcgcgataccgctggcgacgctagtgagtcggctctgctgaagtgcatcgaactatcctgcggcagtgtgagaaagatgagagaccgtaatccaaaagtagctgagattcccttcaattcgacaaacaaatatcagttgagtatccacgagcgagaagacagtccccagtctcatgtcctggtgatgaagggcgcccccgagcgaatcctggacaggtgctcaacaatactggtgcaggggaaggaaatcccactcgataaggaaatgcaagacgcattccagaatgcatacatggaactcggtggtcttggagaaagagtgctcgggttttgccagctgaatctcccctcagggaagttcccacgcggttttaaatttgacaccgacgaattgaacttccccaccgaaaagctgtgtttcgtcggtttgatgtccatgatcgacccaccacgcgccgccgtgcctgacgccgttgggaaatgtcgctccgctggtatcaaggtgattatggtaaccggcgaccaccccatcaccgccaaagccatcgcaaagggcgtgggtattatttccgaaggtaacgaaacagtcgaggacattgcggcgcggctcaatatccctatgtcccaggtcaatcccagggaggccaaggcctgcgtggtacatgggtccgatctaaaggatatgacaagcgagcagctggatgagattctgaaaaaccacaccgagatcgtgtttgccaggacaagcccacagcagaagctcatcatcgttgagggatgccaaagacagggcgcaattgtggccgtcaccggggatggcgtgaacgattccccagcattgaaaaaggcagatatcggcattgcgatgggaatctccggcagtgacgtgtccaagcaggctgccgatatgattctgttggacgacaatttcgcctcaatagtaaccggcgtcgaagaagggcgtctgatatttgataatcttaaaaagtccatcgcgtacacattaacctcgaacattcccgagataacacctttcctcttgtttatcattgcaaacatccccctccccctcggtaccgtgactattctctgtatcgacttggggacggacatggtacctgctatcagcctggcgtatgaagccgccgaatccgatattatgaaacgccaaccccgcaacagtcagacagataaactcgtcaatgaaagactcattagcatggcctatggtcagatcggcatgattcaggcccttggggggttttttacatacttcgtgattctcgctgagaatggcttcttgcctagcagactgctgggaatcaggcttgactgggatgacagaacaatgaacgatttggaggattcatacgggcaagagtggacctacgagcagcggaaggtggtcgaattcacttgtcacaccgccttctttgccagcatcgtggtggtccagtgggctgaccttatcatttgtaaaactagacgcaactctgtgttccaacaaggcatgaaaaataagattctgatcttcggattactagaggaaacagctttggccgcattcctgagctattgccctggtatgggtgtcgccctgcgcatgtatcctctgaacctgctgattttcatctacgacgaggtgagaaaactcattttgagacgctatcccggtgggtgggtggagaaagagacgtactactag

SEQ ID NO: 179915 - DNA, 2172 bp, Artificial Sequence
  Description of Artificial Sequence: Synthetic coding sequence
atgctgagcagcgccctggccctgagcggcgccctggtgaagcggctaaagccacccaacggacattttatcctcaccgatactcatgatcttaacacgtccaaaattgaacattcactctttaccgtctgcctgactttgacagccaagaggatggctcggaaaaattgtcttgttaagaacctggaggcagtcgaaacgctaggttcaactagcaccatctgtagcgacaagacaggaaccctcacgcaaaaccgcatgacagtggcccacatgtggtttgataaccaaatccatgaggccgacacaacagaggaccaatccggtgccacctttgataaacgatctcctacctggacggcactgtcacgtattgcgggcctatgcaacagggctgtatttaaggccgggcaagagaacatttctgtttcaaaacgggataccgctggcgacgcctcagagtctgcgctgctgaaatgcatcgagctgtcatgtggttcagtgagaaagatgagggatcgaaaccctaaggtggccgagatccctttcaacagtacgaataagtaccagctgtctatccacgagcgtgaagactcaccccagtcccatgtcttggtgatgaaaggtgcgcctgaacgaatactcgataggtgttccactattctcgtacaggggaaggagattcccctagataaggagatgcaagacgccttccaaaacgcatatatggagttgggtgggcttggggagcgcgttctcggcttttgtcagctcaatctcccttcagggaagtttccaaggggcttcaagttcgacacggatgaattgaatttccccactgaaaaactttgtttcgtcgggttgatgtctatgatagatccgcccagagccgctgtgcctgatgccgtaggaaagtgcaggagtgctggtataaaggtgataatggttaccggggaccaccccattacagctaaggcaattgccaagggtgtgggcatcatttctgaaggaaacgagacggtcgaggacattgccgcacgcctgaatatccccatgtcacaggtgaatcccagagaagctaaggcgtgtgtggtacatgggagcgacttaaaggacatgacaagtgagcagctcgacgaaatcttaaagaatcacaccgagatagtgttcgcgcgcacatcgcctcaacaaaagctgataatcgtcgaaggctgccaaagacaaggcgccattgtggccgtgaccggcgacggcgttaatgactcaccagctctcaagaaggccgatatcggtatagcaatgggtatcagtgggtctgatgtctcaaaacaggcagccgacatgatcctgctcgacgataatttcgcttccattgtgacaggcgtggaggaaggtcgcctgatctttgacaaccttaagaagagcattgcatatactttgacaagtaacatccctgagattacacctttcctgctctttatcatcgccaatattccactacccctaggcacagtgactatcctgtgcatcgacctgggcaccgatatggtcccagctatcagtctggcttacgaagcagccgagagcgacattatgaaaagacagccacgtaattcacagacggacaagctggtcaatgagcggctcatctcaatggcctacgggcaaattggcatgatccaggcactcggcggcttcttcacttatttcgttattttggcggagaacggttttctgccctcccggcttttaggtataaggctcgattgggacgacaggaccatgaacgatctggaagactcgtatggtcaggagtggacttatgagcaaagaaaggtggtggaattcacctgccacactgctttcttcgccagcatcgtcgtagttcaatgggccgaccttatcatatgcaagacgaggagaaattctgtctttcagcaggggatgaagaataagatcttaattttcggcttacttgaggagacagcacttgcagccttcctgtcatactgccccggcatgggtgtcgctttgagaatgtacccgctaaaggtcacctggtggttctgtgcctttccatattcgctgctcatctttatctacgatgaagttcgaaaactgatcctgagaagataccctggaggttgggtggagaaggaaacatactattag

SEQ ID NO: 179916 - DNA, 2145 bp, Artificial Sequence
  Description of Artificial Sequence: Synthetic coding sequence
tgacagctgatcaccggcgtggccgtgttcctgggcgtgagcttcttcgtcttatcacttatccttggctattcctggctggaagcggtgatcttcctgattggaatcattgtcgctaacgtgcccgagggtctgctggccaccgtaacagtatgcctgacgctcaccgccaagcgaatggcccgcaaaaactgtttggtaaagaatctcgaagcggtggagacactgggcagcacatccacaatctgttcagataagacgggtaccctcacacagaatcggatgactgtggcccacatgtggttcgataaccaaattcacgaagccgataccactgaggatcagtccggagctacatttgataaacggagcccaacatggaccgccctcagtagaatcgccgggctgtgcaaccgtgcagttttcaaagcggggcaggagaatatctccgtatcaaaacgagatacagccggcgatgcgtccgagtccgcactgctgaaatgtatagaactgtcctgtggctcagtgaggaagatgagagacagaaatccgaaggttgccgagattccatttaactcaactaataagtatcagctcagcattcatgaaagagaagacagtccccagtcacacgtcctggtaatgaagggagctcctgagcgcattttagaccgatgcagtacaatactggttcaggggaaggaaattcctctggacaaggagatgcaggacgcatttcaaaatgcatacatggaactcggtggccttggagagcgtgtgcttggtttctgccagctgaacttgccatctggaaaatttcccaggggcttcaaatttgacactgacgagctgaacttcccgacagaaaaattgtgttttgtcggactgatgtctatgattgatccaccaagagcagccgtgccagatgctgttggaaagtgcagaagcgcaggtattaaagtgattatggtgacaggagaccaccccattaccgccaaagctattgccaagggagtcggcatcatttcggaggggaacgaaaccgttgaagatattgccgccaggctcaatatccctatgtctcaagtgaatccacgcgaagcaaaggcatgcgtagtgcatggttccgacttgaaggatatgactagcgagcaactggatgagatcctcaagaaccacaccgagattgtgttcgcccggaccagtcctcagcagaagcttatcattgtggaggggtgccagaggcagggcgccatcgtggctgttaccggcgatggagtgaatgattcccctgccctcaaaaaggctgatatagggatcgctatggggatctctgggagtgacgtgtccaaacaagctgccgatatgattctactggacgacaactttgccagtattgttacaggcgtggaggaaggtaggcttatttttgataaccttaagaagagcattgcctatacactaaccagcaacattccagaaatcaccccctttcttctgtttatcatcgctaacatccctctgcctttgggaacggtgaccatcctttgcatcgacctaggaactgacatggtgcctgccatctccctagcgtacgaggccgcagagtccgacataatgaagcgacagccgcgtaattcccagaccgacaaactggtaaatgagcggctcatatcaatggcttacggacagatagagaatggcttcctcccaagccggctgttgggcatacgactcgattgggatgacagaaccatgaatgacctggaggattcctacggccaggagtggacttacgaacagcgcaaggtggtggaatttacatgccataccgccttttttgcctctattgtcgtggtgcaatgggcagatttgattatctgtaaaacgaggcgaaatagtgttttccagcagggtatgaaaaacaaaatcctgatctttggcctactggaagaaaccgcgcttgcagctttcctgtcttattgcccagggatgggagtggcattgcgtatgtatcctctgaaagtgacttggtggttctgcgcctttccatactccctcttaatttttatctatgatgaagtgaggaagctcattctgcggagatatccaggaggctgggttgaaaaagaaacttactactag

SEQ ID NO: 179917 - DNA, 819 bp, Artificial Sequence
  Description of Artificial Sequence: Synthetic coding sequence
atggacagcttcaagaacatggtgccccagcaggccctggtgatccgcgaaggagagaagatgcagatcaacgccgaagaggtggtggttggagacctcgtggaggtcaaaggcggtgaccgcgtgcctgccgacctgaggatcataagttctcacggctgcaaagtagataacagcagcttgacaggcgagagtgagcctcagacaagaagccctgagtttacacatgaaaatccattagagactagaaacatttgctttttttccacgaattgtgtggaaggcacagcgaggggtattgtaatcgctacaggcgaccgtactgtgatgggtcgaattgccacgcttgcatcaggcctggaggtgggcaggacaccaatcgctatggagatcgaacatttcatacaactgattacaggagtcgctgtgttcttgggagtctcgttctttgtactctctctcattctgggctacagctggctggaagccgtcatctttctgatagggattatcgtggcaaatgtgcctgaaggtcttctcgcaaccgtgactgtgtgcctgactttgaccgccaagcggatggcccgtaaaaactgcctcgtgaaaaatctcgaagctgttgaaacactggggagtaccagcaccatctgctccgacaaaacagggaccctcacccagaaccggatgactgtggcccacatgtggtttgataatcagattcatgaagccgatacgaccgaggatcagtctggagactgggttctccagcggggctggataggtcttgaagaggccgagggctccggcgtcgtgggctag

SEQ ID NO: 179918 - DNA, 3042 bp, Artificial Sequence
  Description of Artificial Sequence: Synthetic coding sequence
atgggcgacaagaaggacgacaaggacagccccaagaagaacaaggggaaggaacgtcgcgaccttgatgatctgaagaaagaagttgcaatgactgagcacaaaatgtcagttgaggaagtctgtcgaaagtacaatacggactgtgtccaggggctcacccactcaaaagcccaggagatcctagcccgggacgggccaaatgccttgacgccacctcctaccacgccagagtgggtgaaattctgccgacaactatttggtggattcagtatattactgtggattggagccatcctctgctttctggcctatggaattcaggccggaaccgaagacgatcccagcggtgacaatctgtacctcgggatcgtgttggcagcagtagtaattatcaccggttgcttcagttactatcaggaagctaagagtagtaaaatcatggagagcttcaagaatatggtcccccaacaggcgctagtgattagagaaggggaaaaaatgcaagtaaatgccgaagaggtggtggtgggcgacctggtggaaataaaaggcggtgacagagtgcccgctgacctccggatcatttcagcccatggctgcaaggtggataattcatctctaaccggcgagtctgaaccacagacccggagccccgactgtacccatgacaatcccctcgaaactcggaacattactttcttcagtacaaactgcgtggaaggcacggccagaggggtcgttgtcgctacaggagaccgaactgttatgggaagaatcgctacactagcgtcagggctggaggtcggaaagactcccatcgccatcgagattgaacatttcatacagctaattactggcgttgccgtcttcctgggcgtctccttcttcatcctttccttgattctgggttacacctggcttgaggccgttatctttctgatcggcatcatagtcgcaaacgtgcccgaaggtttgcttgctacagtcaccgtctgccttactctgacagctaagcgaatggctagaaagaattgtttagtgaagaacctcgaggcggtcgagaccctaggcagcacaagcaccatctgtagcgataagacggggaccctgacgcaaaatagaatgaccgtcgcgcacatgtggttcgataaccagattcatgaggccgataccaccgaggatcagagtggtacctcctttgataaatcttcccatacctgggtagcactgagccacatcgcagggttgtgcaacagggctgtcttcaagggcggccaggataacattccagtgcttaagcgcgatgtggctggggacgcttccgaatctgcgctgttaaagtgtattgaattgtctagtggcagtgtgaagctaatgagggagcgcaataaaaaagtggccgagattccatttaacagtacgaataaataccagctgagtatacacgagaccgaggacccgaatgataaccgatatcttctggtgatgaaaggcgctccagagcgaattttagaccggtgcagtaccatcttgcttcaagggaaggagcaacccctggatgaagaaatgaaggaagcattccagaacgcttacctcgaattgggaggccttggtgagcgggtgcttggcttttgccattattacctccctgaagaacaatttcctaaaggattcgcctttgactgcgacgacgtcaattttactacggataatttgtgtttcgtcggtttaatgtcaatgatcgaccctcctcgagctgctgtaccggacgcagtggggaagtgcaggtctgctggaattaaggtcattatggtgacaggcgatcacccaataacggcaaaggcgatcgccaagggagtgggtattatcagtgaaggaaacgagactgtggaagatattgccgctagacttaacatccctgtgagtcaggttaatccccgggatgccaaagcttgcgtgattcacggaactgacttgaaagatttcacctcggaacagatcgacgaaatcttgcagaaccacaccgaaatcgttttcgctagaacctcaccccagcaaaagctgatcattgttgaaggttgccagagacagggcgccattgttgcagtgaccggggacggagtaaatgattccccggccctcaaaaaagccgatatcggcgtagcgatggggatcgctggatcagatgtgtccaagcaggctgccgacatgattctgctggatgacaacttcgcgtcgatagtgacaggagtggaagaaggtcgtctgatattcgacaacttaaaaaaaagtatcgcatacaccctgacctcgaacatcccagagatcaccccatttctgttatttatcatggccaacatcccacttcctctgggtacgattactatcctttgtatcgacctggggacggacatggttcccgcaatctcccttgcctacgaggccgcagagtcagacattatgaagcggcagccaagaaaccctcgtaccgataagttggtaaatgaacgccttatctccatggcctacggacaaattgggatgatacaggcgttgggggggttcttcagctatttcgtgatactcgctgagaacggcttcttacccggcaacttggtagggatccgtcttaattgggatgacaggactgtcaatgacttggaagacagttatgggcaacagtggacctacgaacagaggaaggttgtggaatttacatgtcacaccgccttctttgtctccatcgtagtggtccaatgggctgatctcatcatctgtaagacaaggcggaatagtgtctttcagcaggggatgaagaataagatacttatctttgggctttttgaggagacagcactggctgcatttttgagttattgccccggaatggatgtggcactcagaatgtaccccctgaaaccatcttggtggttctgtgccttcccttactcattcctcattttcgtctatgatgagattcgcaaactgatattgcgaaggaaccctggcggctgggtggagaaggagacctattactag

SEQ ID NO: 179919 - DNA, 2952 bp, Artificial Sequence
  Description of Artificial Sequence: Synthetic coding sequence
atgaccgagcacaagatgagcgtggaggaggtgtgccggaagtacaatacagactgcgttcagggacttacccactctaaagcccaagagattcttgcccgcgacgggcctaatgccctcacaccaccacctacaacacccgagtgggttaagttttgccgccagctgttcggcgggttcagcattcttctctggattggtgccatcctgtgtttcctcgcatatgggatccaggctggtacagaagacgatccttccggggacaacctatatcttggaatagttctggcggctgttgtgataatcactggttgcttttcttattaccaggaagctaaatcgtcgaaaatcatggagagctttaagaacatggttccccagcaggctttagtgattagggagggggagaagatgcaagtgaacgcggaggaagtcgtggttggtgatctggttgaaattaagggtggtgacagagtgccagccgatctccgtatcattagcgcgcatgggtgcaaggtggacaactctagcctgacaggagagtccgagccccagacgcgctcacctgactgtacccacgataatcctctggaaacaaggaatattacgtttttcagcacaaactgtgtcgaaggaaccgcccgcggcgttgtggtagccacaggcgaccggaccgtgatggggagaattgccacactggcctcaggcctggaggtcggcaagacaccgattgccatcgagattgaacattttatccaattaataactggagtggcagtcttcctgggcgtgagtttttttatcctatcactcattcttggctacacctggctcgaagccgtgattttcttaattggcatcatagtggctaatgtaccagagggcctgctggccactgtcaccgtgtgcctgacgctcaccgcaaagcggatggctcgaaagaactgcctggtcaagaacctggaggctgttgagactctgggctcaaccagcacaatctgctcggacaagactggaaccctgacccagaatcggatgacggtagctcatatgtggtttgataatcagatccacgaagccgacaccacagaagatcaatcagggacatcattcgacaaaagtagtcacacctgggttgcccttagtcatatcgctggcctttgtaaccgcgccgtgtttaagggcggccaggacaatataccagttttgaagcgtgatgttgctggggacgcaagcgagtctgctttgcttaagtgcattgaactgagcagcggcagcgtgaagctgatgcgggagcgcaacaaaaaagttgcagaaattccattcaattcaaccaacaagtaccaactgagcattcacgaaaccgaggaccccaacgacaaccggtacctgctcgtcatgaagggggctccagaacggattctcgatagatgctccaccattcttcttcaggggaaggagcagccactggacgaggaaatgaaggaggccttccagaacgcttatctggagctcggtggacttggggagcgggtgctggggttctgtcattattatctgcccgaggagcagttccccaagggttttgcctttgattgcgatgatgttaatttcaccaccgacaatttatgcttcgtgggactaatgagtatgattgaccctcctagagccgccgtccccgacgcagtgggcaagtgccgttccgctggtattaaggtgattatggtcacaggtgaccatccaatcacggccaaagcaattgctaaaggagtgggcattatctcagaggggaacgaaactgtggaagacattgccgccaggttaaatatccctgtcagtcaggttaacccacgtgacgccaaggcatgtgtcattcacggtacggatctaaaagactttacatcagaacagatagatgaaattctgcagaatcacactgaaatcgtgttcgctcgaactagcccgcagcagaaattgattatagtcgaaggttgtcagcgtcagggagccattgtggccgtgacaggcgacggtgtgaacgactcaccggcccttaaaaaagccgacatcggcgtcgccatgggtatagccggcagcgacgtcagcaagcaagccgcagatatgatcttgctagatgacaattttgcttccatagtcaccggcgttgaggaaggccggctgatctttgataatctgaagaaaagcatcgcatataccctaaccagtaacatccctgagatcaccccattcttattattcataatggcgaacatccctctgcccttgggcactatcacaattctgtgcatagacctgggcactgatatggttcctgccatttccctcgcctacgaggccgctgagagcgatattatgaagagacagccaagaaacccaagaacagataagctggtgaatgaaagattgatctcaatggcgtatggtcagatcggaatgatccaagccttgggcggctttttttcttacttcgttatacttgccgaaaacggcttcctccctggcaatctcgtcggcatcagactaaactgggatgacaggaccgttaacgatctcgaagatagttatggacagcagtggacgtatgagcaaaggaaagtggtggaatttacttgccacacggcgtttttcgtgtccattgtcgtggtgcagtgggcagacttgattatatgtaagactaggaggaacagcgtcttccagcaagggatgaagaataagatcctcattttcggactgttcgaggaaaccgccctcgcggcttttctctcatattgccccggcatggacgttgccctgaggatgtatccgcttaaacccagctggtggttttgcgcttttccttacagtttccttatcttcgtttatgatgagatcaggaagctcatcctgaggaggaatccaggggggtgggtagagaaggaaacctactactag

SEQ ID NO: 179920 - DNA, 3681 bp, Artificial Sequence
  Description of Artificial Sequence: Synthetic coding sequence
atgggcgacaagaaggacgacaaggacagccccaagaagaacaagggaaaggagcgccgagaccttgacgatctgaagaaggaagtagccatgacggagcacaaaatgagcgttgaggaggtgtgccgcaagtacaataccgattgtgtgcagggtttgacacactcaaaggcccaagaaatactcgccagagacgggcccaatgccctcacccctccacccaccactcccgagtgggtgaagttctgtaggcagctgttcggcggtttcagtatactgctgtggatcggggccattttgtgcttccttgcttatggcatccaggcaggaactgaggatgaccctagtggggacaacctgtacctcggtatcgttctggcagcagtggtgatcatcactggatgcttctcttattatcaggaagctaaatctagcaaaatcatggagtcttttaaaaatatggtgccccagcaggccctcgtcatccgtgagggcgaaaaaatgcaggtaaacgccgaggaggtcgtcgtgggagacctagtggagataaaggggggcgacagagtaccagccgacctccgtattatatccgcacatggatgcaaggtggacaattccagcctgaccggcgagagtgagccacagacacggagtcccgactgtacccatgataacccgcttgaaaccagaaacatcacctttttctccaccaactgcgtagaagggacagcacgtggcgtggtcgttgctacaggggatcgaacagtgatgggccggatcgctacactagcatccggactcgaggtgggaaagactcccatcgcgatcgaaatcgagcactttatacagttgattactggggtggcagtatttctgggtgtcagtttcttcatcctgagtctgatcctcggttacacctggctggaggctgtgatcttcctgatcggaatcatagtcgccaacgtgcccgaaggactgcttgctaccgtaaccgtgtgcttgaccctcacggccaagaggatggcccgcaagaattgcctcgtgaagaacttggaagccgtcgaaacgctgggctccacctccactatttgcagcgacaagaccggcacgttgacacagaacaggatgacagtcgcacacatgtggtttgacaaccagattcacgaggccgatactaccgaggaccagagcggcacaagcttcgataagagcagtcatacgtgggtcgcactttcccacattgcaggactgtgtaatagggcagtgtttaaaggcggacaggacaatataccagtgttgaagcgggatgtggccggggacgctagcgaaagcgcactactgaaatgtatagagctttctagcggctcggtgaaacttatgagagagaggaataagaaagtcgccgagattcctttcaattccactaacaagtaccagctctcaattcatgaaacagaggaccctaatgacaaccggtacctcttggtgatgaagggcgcccccgagcgtattctggaccgctgttcgactattctcctacaagggaaagaacagcctcttgacgaagaaatgaaagaggccttccagaacgcctatcttgaactaggtggacttggcgagagagtgctaggtttctgtcattattatcttccagaagaacagttccctaaaggcttcgccttcgactgcgatgatgttaacttcactactgataacctatgttttgttggactgatgtcgatgatcgaccccccccgggccgcggtcccagatgccgttggtaagtgccgtagcgccggcatcaaagtgatcatggtcacaggtgatcaccctattacagctaaggctatagccaagggcgtggggataatctccgaaggcaatgagaccgtggaagacatcgctgcccggctcaatatccccgtgtcccaagtcaacccgcgggacgccaaagcgtgcgtaatacacggaactgatctgaaggattttacttcagaacaaattgatgaaatacttcagaatcataccgaaatagtgttcgcgcgaacctcaccgcagcaaaaactaatcattgtggaggggtgccagagacaaggggccattgtggccgttacaggggacggggtcaacgatagtcccgctctgaagaaagccgacatcggggtggccatgggaattgctggcagcgatgtgagtaagcaggccgctgacatgatcctcttggacgacaactttgcgtccattgtcacaggcgtcgaggaaggacgactgatttttgataacctcaagaaatcaattgcatatacgcttacgtcgaacatacctgagataacaccatttctgctgtttattatggcaaatatccctttgcccctcggcacaattacaatcttgtgcatcgacttggggactgatatggtgccggcaatatctctggcttatgaggccgccgagagtgatattatgaaaaggcagcctaggaatcccagaacggacaaacttgtgaacgagcgcctgatctcaatggcctatggccagatagggatgatccaggccctgggcgggttcttttcatactttgtaatcctcgcagagaatgggttcctgccaggcaacctcgttggcatccgcctaaattgggacgacaggactgtgaacgacctagaagattcatatggtcagcagtggacctatgaacagcgtaaggtggtggagtttacctgtcacactgctttctttgtttctatcgtggtagtccagtgggcagaccttattatctgtaagactagaaggaattcagtgtttcagcaagggatgaaaaacaaaatcctaatcttcgggctgtttgaggaaactgccctcgcagccttcctcagttactgcccgggaatggacgtggccctgaggatgtaccctttgaagccctcttggtggttctgcgcattcccatactctttcttaatcttcgtgtacgacgaaatacgcaaactaatcttgcgcagaaaccctggcggagagggtgctcggcagggctccagagggggccggggagctgccggatcccaggccgccggacctcgtttaccttctccttgctggatggcacttccccctggcagccactccagcttgagttcacatctgagcgggcatcctctttgtctattaaccggcctgtgcctctgtgggttcctggtgtctctgccactgtgcccaagcctttgttgggccgcccgactcgcttgtttgtcaccctcactgactctgagcctttcttttctgctgtgtctcagccgacttggcggggagggcaatctgctgctcaccagtgcccctcctcaccgcccgtcactcccacgtcctcctggtcctgggcctcccctttccgtgcccccgatcttgtactcagggggccgctccccgttgttcctttggccacacctcggcccccaccccctgcactacttgctgcccccacccttgtggctagcaagcctaccttgcccaaagcctctgtcgagtctgttctccgtctcagtaagcttgccacttttaacccccctgtcaattccaccagctcccgccacttccttgggatctttcctgttacctttctccccccccgcagacgccatttctggaagcgggcaactgtctaacatctccgtcggacgggagtag

SEQ ID NO: 179921 - DNA, 444 bp, Artificial Sequence
  Description of Artificial Sequence: Synthetic coding sequence
atgggcagcggcggcagcgacagctaccggatcgccaccagccaggacaagaaggatgacaaggactcaccgaagaagaacaagggtaaagagcgacgcgatctggacgatcttaagaaggaggtggctatgactgaacacaagatgtctgtggaagaggtttgcagaaagtataatacagactgcgtgcagggcttgacacactccaaggcccaggaaatactggctcgagatggccccaatgctttgacaccccctcccacaacccctgagtgggttaagttttgcaggcaactgttcgggggattttctatcctactgtggatcggggccattttgtgctttctggcttacgggatccaggcaggaaccgaagacgaccctagtggggacaatttgtacctgggaattgtgctggcggcggttgtgattataaccgggtag

SEQ ID NO: 179922 - DNA, 2049 bp, Artificial Sequence
  Description of Artificial Sequence: Synthetic coding sequence
atgggccggatcgccaccctggccagcggcctggaggtgggcaagaccccaattgccattgagattgagcattttattcagctgattaccggcgtggctgtcttcctcggagtgtcctttttcattctctccctcatcctgggttacacctggcttgaggcagttatcttcctgattggaattatagttgccaacgtgcccgagggcctgctcgccacggtcacagtgtgcctgacccttactgctaagcgcatggcacgaaaaaactgcctcgttaaaaacctggaggccgtagagaccctcggatcaacctccaccatctgtagtgacaagacggggaccctgactcagaacaggatgaccgttgcgcacatgtggttcgacaatcagatccacgaagcggacactacagaggatcagtctggcacaagcttcgataaaagttctcatacctgggtcgctctaagtcatatcgccggtctgtgtaaccgtgctgtgttcaagggaggccaagacaatattccggttctgaagcgcgacgtcgccggggacgcatcagagagtgccctcctgaaatgtatagaattaagcagcgggagtgtcaaattaatgcgagagaggaacaaaaaggttgcggaaatcccctttaactccaccaacaagtatcagctgtcaatacacgaaactgaagatccaaatgacaacaggtatctccttgtgatgaaaggcgccccagagcgcattctcgacagatgctcaaccatacttctccaaggcaaggaacagcctctggatgaggaaatgaaggaggcctttcagaacgcctacctcgagttaggtggactgggcgagagggtcttaggcttctgccattactacctaccggaagaacagttcccaaaagggtttgcgtttgattgtgatgacgttaattttacgactgataacctttgctttgtcgggctgatgtctatgatagacccgccccgagccgccgtgcccgatgccgttggaaagtgtcggtctgccgggattaaggtgattatggtgaccggcgatcaccctattacagctaaagccattgccaaaggcgtggggatcatctcagaaggcaatgagacagttgaagatattgcagctcgactgaacattcccgtttcacaagtgaaccctagggacgctaaggcctgcgtcattcatgggacggatttgaaggacttcacatccgaacagatagatgaaattctgcagaatcataccgaaatcgtgttcgctaggacgtcaccccagcagaagctcatcattgtcgaagggtgccagcgacagggcgccatcgtcgctgtgacaggcgacggagtgaatgattcaccagcgttaaaaaaggcggacattggcgtcgctatgggtatagctgggtccgatgtgtccaagcaagctgctgatatgattctgctggatgataatttcgccagtatcgttactggcgtggaagagggacgcctcattttcgacaacctgaagaaaagtattgcatacactcttaccagtaatatacccgagatcacgccatttctccttttcatcatggcaaacatccccttgccactgggcacaataaccatactctgtatcgatttgggtacagacatggtaccagcgatctccctggcctacgaggctgctgaaagtgacataatgaagagacagccgagaaaccctaggaccgataagctcgtgaacgaacgactcatatctatggcttacggccagatcggcatgatccaggctctcggaggatttttctcatacttcgtgatcctcgcagagaacggattcttgcctggaaacctggtgggcatacgcctaaactgggatgatcgcactgtcaacgacctcgaagacagctatggtcaacaatggacatacgaacagcggaaagtcgtggagtttacttgccatactgccttctttgtatctatagtcgtggtgcagtgggccgatttgattatctgtaagactaggcggactcgctcttcatcccgggcatag

SEQ ID NO: 179923 - DNA, 3075 bp, Artificial Sequence
  Description of Artificial Sequence: Synthetic coding sequence
atgggcggctgggaggaggagcggaaccggcgggccaccgacaagaaggacgacaaagattcccccaaaaaaaataaaggaaaggagaggcgcgacttagacgacctcaaaaaggaggtggcaatgactgaacacaaaatgtcagtggaggaggtgtgcagaaagtataataccgactgcgtccaagggttaacccactcaaaagcacaggaaatcttggcccgtgatgggccaaacgcactcaccccccccccaacaacacccgagtgggtgaaattctgccgccaactgtttggtggcttctctatattgctgtggataggtgccatactctgtttcttagcttacggaatccaggcggggaccgaggacgatccatctggcgataatctttaccttggcatagtgttagccgcggtggtgatcataacagggtgtttctcttattatcaggaagccaagagttccaagattatggaatcctttaagaacatggttcctcagcaggccctcgtgattagagaaggcgagaagatgcaagtgaatgctgaggaggttgttgtaggggacctggtggagatcaaaggcggcgacagagtgccagcggacctgagaataatcagcgcacacggctgcaaggttgacaattcttcactgactggcgagagcgaacctcaaaccagaagcccagactgcacccacgataatcccctggaaactcgcaacattactttcttttccaccaactgtgtagagggaactgcccgcggcgtggtggtagcgacaggtgaccgaaccgtcatggggcgcattgctacactcgcatccggccttgaagtggggaaaactcctatcgctatcgagatcgaacacttcattcagttaattactggcgtcgcggtttttctgggcgtttcattttttattcttagtcttatactggggtatacctggttggaagccgtgatttttctgatcggaatcattgtcgcaaacgtgcctgaaggactgctggcgactgtaacagtctgcctcacgctcacggccaagagaatggcccgcaagaattgcctggtcaagaatctggaggctgttgagacactaggttccacctcaacaatttgtagcgacaaaactggtactctcacgcagaatagaatgacagtggcccacatgtggttcgataatcaaatccatgaagctgacaccaccgaggaccagagcggaacgagttttgataaaagctcccatacctgggttgctctcagccacatagcgggtctctgcaatcgggccgtgttcaaaggaggtcaggacaacatccctgtcctgaagcgcgacgtcgcaggcgatgcatccgagtcggcccttctgaaatgtatcgaactctccagcggaagcgtgaagctgatgagagagagaaataagaaggtggcagagatcccttttaacagcaccaacaagtaccaactgtcaatccacgaaaccgaagatccgaatgacaaccgatatctcctggtgatgaaaggagctcctgaaagaatcctggaccgttgctcaaccattctgcttcagggcaaagaacagcctcttgatgaagagatgaaggaggcttttcaaaacgcctatctggaacttggaggacttggtgaacgcgtcttgggtttctgccactattacctacccgaagaacagttccctaaagggtttgcgttcgattgtgatgatgtgaattttacaacggacaacctctgctttgtaggattgatgagcatgatcgaccctcctagagcagctgtgcctgacgctgttggcaaatgtcggtcagccggtatcaaggtcatcatggttactggggaccacccaatcacagcaaaggcaattgccaaaggggtgggcatcatctcagaagggaatgagaccgtggaggacatagccgcgcggctgaatatacccgtatctcaggtcaaccctagggacgccaaggcttgtgtgattcacggtacagatttgaaggactttacctcggaacagatcgatgaaattttgcagaaccacactgaaattgtgttcgccagaacatctccccagcagaagttgatcattgttgaaggatgtcagcgacagggggcgattgtggctgtcaccggagacggtgtcaacgattcacccgccctcaaaaaagctgatattggagtggcaatgggcatagcgggatcagacgtaagtaaacaggctgcggatatgattttgttggatgacaacttcgcatctatcgtgacgggagtggaggagggaagactgatattcgacaacctgaagaaatcaatcgcatatacgctgacatctaacattcccgaaataacccctttcctgttatttattatggccaacatcccactgccactgggaactattactattttatgcatagatctgggaacagatatggtccccgccatcagcctcgcttatgaggcggccgagagcgatataatgaaacggcagcccaggaatccccggacggataagttggtgaacgagcgtctgattagtatggcctacggccaaatcggcatgatacaggcgctcggggggttcttctcatattttgtcattttggcggagaacggctttctgcctggcaatcttgtgggtatccgcttgaattgggatgatagaaccgtcaacgacttagaagattcttatggccagcagtggacatacgaacagagaaaagtggtggagtttacttgccacactgcgttcttcgtttcaattgtggtcgtccaatgggctgacttgataatctgtaagaccagacgtaactcagtgttccagcagggcatgaagaataagatcctcatttttgggctcttcgaggaaacagcccttgcggcatttctcagctactgcccagggatggacgttgccctccggatgtatcccttgaagcctagctggtggttctgtgcctttccgtattccttcctgattttcgtatatgacgagattagaaagctgatcctcaggaggaatcctggaggttgggttgagaaggaaacctactattag

SEQ ID NO: 179924 - DNA, 3081 bp, Artificial Sequence
  Description of Artificial Sequence: Synthetic coding sequence
atgggcagcggcggcagcgacagctaccggatcgccaccagccaggataagaaggatgacaaagattctccaaagaaaaacaaaggcaaagagcgacgggatctcgacgacctcaagaaagaagttgccatgaccgaacataagatgagtgttgaagaggtgtgtaggaagtacaatacagactgtgttcagggcctcacacacagcaaggcacaggaaatcctggcgcgcgacggcccaaatgctttaactcctccccctaccacgccagagtgggtgaaattttgccggcagctgttcggaggattcagtattcttctgtggattggcgcaatcctgtgcttcttggcctacgggatccaagctggtaccgaggatgatccatcaggggataatctgtatctgggcattgtgcttgctgcagtggtaattatcaccggctgtttttcctactaccaggaggcaaagtcatccaaaataatggagtcctttaagaacatggttccgcaacaggctttagtgatccgtgagggagaaaagatgcaggtgaatgctgaagaggtcgtggttggagatctggtggagattaaaggaggcgaccgcgtgccagcggaccttaggatcatctcagcccacggctgtaaggttgacaatagtagcctgaccggggagtcagaaccgcagaccaggagccccgactgcacccacgacaaccctctggaaacccgcaacattaccttctttagcacgaattgcgtagagggaacagcccgcggcgtagtggtagcaactggtgatagaacagtcatgggaagaatcgctactctggcatccggcctcgaggtcgggaagacgcctattgcaatagaaattgaacattttattcagctgatcaccggggtcgccgtgttcctgggagtgtccttctttattttgagcctcatcttggggtacacttggctggaggctgttatctttctgattggcatcatcgtagcaaatgtacccgagggactgttggctactgttaccgtctgtttgactctgacggctaaacggatggcaaggaaaaattgcctggtgaaaaatcttgaggcagtcgaaaccctaggcagcaccagcacaatatgctccgataagacgggcactctgacccagaaccggatgactgtggcccacatgtggtttgacaatcagatccacgaagcagacactactgaagatcagtccggtacttcgttcgataagtctagtcatacctgggtcgccctttcccacattgccggtttgtgtaaccgtgctgtttttaagggaggccaagacaacatccccgtgctcaagagggatgtggccggcgatgcaagcgagtcagcactgctcaaatgtatcgaactctcatctggctcagtcaaactgatgagagagcgcaacaaaaaggtcgccgaaatacctttcaactccaccaataagtaccagctgagcatccacgagactgaggaccccaatgacaataggtaccttttagtgatgaagggcgctccagaaaggatcctagatagatgctctaccattttactacagggtaaggagcagcctctcgatgaggaaatgaaagaggccttccagaatgcttatttagaactgggaggacttggggaacgtgtcttgggtttttgtcactattatctgcctgaggagcagttcccaaaaggttttgccttcgactgcgatgatgtgaactttaccactgacaacttgtgtttcgttggcctcatgagtatgatcgacccgcctcgcgctgccgtcccggatgctgtgggcaagtgccgctcagctggcatcaaggtgattatggtgaccggggatcatccaatcaccgctaaggctatcgcaaagggcgtagggataataagtgaaggaaacgaaactgtggaggacattgcagcacgactaaatattcccgtgagccaggtcaaccctcgtgacgccaaggcttgcgtgattcatggcaccgatctcaaagatttcacgtccgagcagatcgacgaaatactgcagaaccacacagagatcgtgttcgcacgaaccagcccacagcagaagctcatcatcgttgagggctgtcagaggcagggcgctattgttgcagttaccggcgatggcgtcaatgactccccagccctcaaaaaggctgacattggggtagcgatgggtattgcagggtctgatgtaagtaaacaggctgctgacatgatccttctcgacgacaatttcgcctccatcgttactggagtggaggagggacgtctgatctttgacaatctgaaaaagagcattgcctacaccttgacttcgaatatacctgagattacaccattcctacttttcatcatggccaatataccactgccactgggcacaataacgattctttgtatcgatctgggaactgacatggttccggctatctcactcgcctacgaagctgccgagtccgatattatgaaacgccagccccggaaccctagaaccgacaagctggtgaatgaacggctcattagcatggcctatggacagattggcatgatccaggccctaggggggttcttctcttactttgtaatactagcagaaaatggctttctgcccggcaatctggtggggattcgcctgaattgggatgatagaactgttaatgacctcgaagattcctacggccagcagtggacctacgaacaacgcaaagtggtggaatttacatgtcatacagctttttttgtctccatagtagtggttcaatgggctgacctgatcatatgcaaaacaagacgaaacagtgtgtttcagcaggggatgaaaaacaagatactcatattcggattgttcgaagagaccgcactggccgccttcttgtcatattgtccagggatggacgtggctctacgaatgtatccccttaaaccttcctggtggttctgcgcatttccttactctttcctcatattcgtgtatgacgaaatcagaaagttgatcctgcgcaggaatcccggaggctgggtggagaaggaaacctattattag

SEQ ID NO: 179925 - DNA, 3090 bp, Artificial Sequence
  Description of Artificial Sequence: Synthetic coding sequence
atgggcctgtggggcaagaagggcaccgtggccccccacgaccagtcacctcgacggcgccctaagaagggtctcatcaagaaaaagatggtgaagcgagaaaaacagaagaggaatatggaggaactgaaaaaagaggtggtaatggatgaccataagctcacgctcgaagagctcagcacgaagtattctgtggatctgacaaaaggacattcacatcaaagagccaaagagattttaacaagaggaggccccaatactgtgacccctcccccaactactcccgagtgggtgaagttttgtaagcaactgtttggcggattcagtttgttactctggacgggagccattctctgcttcgtggcatactctattcaaatttacttcaatgaggagcctactaaggataacttgtacttgtctatagtgctcagcgttgtcgtgatcgtgactgggtgcttctcatactatcaagaggccaagtctagcaaaatcatggaaagtttcaagaacatggtgcctcagcaggccctggtaatccggggtggcgaaaaaatgcagatcaatgttcaggaggtcgtactgggcgacctcgtggagattaaaggaggcgaccgagtgccagcagatttacggctcatttccgctcaaggctgcaaggtggacaatagctccttgactggtgagtccgaaccccagagccgcagccccgactttacacatgagaaccctctggagacccgaaacatatgtttcttctcaacaaattgtgtggaaggcacagcccgtgggatcgttattgccactggagactccacagtcatgggcaggatagcctctctgacaagcggattggccgtcggccagacacccatcgcggcagagattgagcattttatccacctgattacggtggtagccgtgttcctcggggtgacattttttgccctgagccttttacttggctacggctggttggaagccatcatcttcctaattgggattatcgtcgccaatgtgccagagggattgctcgcaacagttactgtttgcctgactctgacagctaaaaggatggccaggaaaaattgtttggtaaagaatctggaagccgtggaaacgcttggctcgacatcaacaatttgctcagacaagaccgggacactcacgcaaaaccgcatgacagtggcacacatgtggttcgacatgacagtgtacgaggcagacaccacagaagagcagacaggcaaaaccttcacaaaatcgtctgacacgtggttcatgctcgcccgaatagccggcctgtgtaaccgcgccgacttcaaggctaatcaggaaatcctacctatcgcaaaacgcgctaccaccggtgacgcgtctgaaagcgcactcctgaagttcatcgagcaaagttattcctccgtggcagagatgcgcgaaaaaaatccaaaagtggcggaaattccttttaacagcaccaacaagtatcagatgagcatacacctacgtgaggattcatcccagactcacgttttaatgatgaagggtgcccctgagaggatcctcgagttttgtagcactttccttcttaacggacaggaatacagcatgaatgatgaaatgaaggaggcctttcagaacgcttacttggaactggggggcctgggagagagggtacttggtttttgttttttgaatctgccttccagtttcagtaagggcttcccgttcaatactgacgaaattaactttccaatggacaacctgtgttttgtcggactgattagcatgatagatcccccacgtgcagccgtgcctgacgcagtaagcaagtgccgcagtgccggaattaaagtgatcatggtgacgggtgaccaccccatcacggctaaggctattgcgaagggggtgggcatcatctctgaaggcactgagacagctgaggaagtggccgcccggctcaaaatccctatatctaaggtcgatgcgtccgccgcaaaagccatcgtcgtccacggtgctgagctcaaagatatccaaagcaaacagctggaccagattttgcagaatcaccccgaaattgttttcgcgcgcacaagtcctcagcagaagctgattatcgtcgaagggtgtcagcggttaggagccgtcgtggccgtgactggtgatggggtgaacgattctccagccctcaaaaaggccgacattgggatcgccatgggaattagcgggtccgacgtctctaagcaggctgcagacatgatactgttagatgataacttcgcttctattgtgacgggcgtggaagagggacgcctcattttcgataatttgaaaaaatccatcatgtacaccctaacgagcaacattccagagattactccttttttgatgtttataatccttggcatccctctccctctgggcaccatcacgatcttatgtatcgacttgggaacagacatggtgccagctatcagtctagcatacgaatctgccgaaagcgacattatgaaacgtctgccccgcaatccaaagacggataacctggttaatcacagactaattgggatggcctatggacaaataggcatgatacaagccctggcaggattcttcacatatttcgtgatactagcggagaacggattccgcccagtagacctgctgggaatccgtctgcactgggaggacaagtacctcaacgacctggaggactcgtatggccaacagtggacatacgagcagcgtaaagtcgttgaatttacatgccagaccgctttttttgtaactattgtggtggttcagtgggcagacctaataatctctaaaacacggcggaatagcttgtttcagcaaggtatgaggaacaaggttctaatctttggcatactggaggagacgctcttagcagcctttctctcctacacccccggaatggatgtagccctgcgcatgtacccattgaaaatcacatggtggttgtgtgctattccatactcaatcctcatttttgtctatgacgaaatcagaaaactgcttatacgtcagcatcctgacggctgggtggagcgcgagacgtattattag

SEQ ID NO: 179926 - DNA, 498 bp, Artificial Sequence
  Description of Artificial Sequence: Synthetic coding sequence
atgatccaggccctggccggcttcttcacctacttcgtgatcctggcagaaaacggatttcgacctgtcgacctgctggggatccgcttgcattgggaggacaaatacctcaacgacctggaagacagctacggacagcagtggacatatgaacaacgcaaggttgtggaattcacatgccagacagccttcttcgtgaccatcgtggtagtgcaatgggccgacctgatcattagcaaaactcggcggaacagtctgttccaacaaggtatgaggaacaaagtactgatttttggaattttagaagagacgcttctcgccgctttcttaagctacaccccagggatggatgtggccctgcgcatgtatcccctcaaaattacctggtggctatgtgccatcccttacagcatcctcatcttcgtgtatgatgagattagaaaattattaattcgacagcatcctgatgggtgggtggaaagggagacctattattag

SEQ ID NO: 179927 - DNA, 888 bp, Artificial Sequence
  Description of Artificial Sequence: Synthetic coding sequence
atgggcaagcggaagtgcagccccgccagccagagcctgttcctgttccagttccagaagatggagctcaagtttaaaatactcctgttttacgtcattttctacggttgtctggccgggattttcatcgggactattcaggttatgctgctcaccatctccgagttcaagcccacttatcaagatcgtgttgcacctccagggctgacccagatcccacagatccagaagaccgaaattagcttccgacccaacgatccgaagagttacgaagcctatgtgttaaacattgtccgcttcttggagaagtacaaagactcagcccaacgcgatgacatgatcttcgaggattgcggggacgtaccatccgaacccaaggagcgcggagactttaatcacgagcgtggagaaagaaaagtgtgtcggtttaagctggagtggctgggcaattgctcaggcttgaacgacgaaacttacgggtacaaagagggcaagccctgtatcatcatcaagttgaaccgggtgctcggctttaagcccaagcctcctaagaatgaaagcctggaaacctatcctgtcatgaaatataatcccaacgtcttgcccgtccaatgtaccgggaaacgcgacgaagacaaggacaaggtaggtaacgtggaatacttcgggctgggtaattccccaggctttcccctgcagtactatccttattacggtaaactgctgcagcctaagtatttgcaaccgttgctcgccgtccagtttacaaacctcactatggacaccgaaattcggattgaatgcaaagcctatggcgagaatattggttattccgaaaaagatcgcttccagggccgattcgacgttaaaatagaagtgaaaagctag

SEQ ID NO: 179928 - DNA, 912 bp, Artificial Sequence
  Description of Artificial Sequence: Synthetic coding sequence
atggcccggggcaaggccaaggaggagggcagctggaagaagttcatctggaatagcgagaaaaaggagttcctcgggcgcacagggggcagttggtttaagatactcctgttctacgtgattttctacggttgccttgcaggcatctttatcgggacaatccaagtcatgttattaaccatcagcgaattcaaacctacgtaccaagacagagtcgcaccccccggcctgacccagattccgcaaatccagaaaactgaaattagtttccggcctaacgacccaaaaagctatgaagcatacgtgctcaacatcgtgcgctttcttgaaaagtataaagactcagcgcagagggatgatatgatatttgaggattgtggggatgtccctagtgagcctaaagagcgcggcgattttaatcacgaacgcggagaaagaaaggtatgtcgttttaaactggagtggctgggcaactgttcaggactgaacgacgagacatacggctacaaggagggaaaaccctgcattatcatcaaactaaaccgtgtccttggttttaaacccaagccaccgaagaacgaaagccttgaaacttacccagtcatgaaatataaccccaacgtgcttccagtccaatgtaccggcaagcgagatgaggacaaagataaagtagggaacgttgagtattttgggcttggcaacagcccaggctttccactgcagtactacccttactacggtaagctgctgcagccaaaatacttgcaaccattgctggcagtccagttcactaatcttactatggacaccgagatccggatcgagtgcaaagcttatggcgagaatatcgggtacagcgaaaaagaccgctttcaaggcagattcgacgtgaagattgaagttaagagctag

SEQ ID NO: 179929 - DNA, 912 bp, Artificial Sequence
  Description of Artificial Sequence: Synthetic coding sequence
atggcccggggcaaggccaaggaggagggcagctggaagaagttcatttggaactcagagaagaaggaattcctgggcagaaccgggggatcttggttcaagattcttctcttctatgtgattttctacggctgcctcgccggtatctttattggtactatccaagtcatgctcctcaccatttcggagttcaaacctacataccaggaccgggttgctccccccggactcacccagatacctcaaattcagaaaactgagatctccttccggcctaatgatcctaagagctatgaagcatatgtccttaatattgtgaggttcctggagaaatataaggacagcgcgcagcgagacgatatgatcttcgaggattgcggcgacgtacccagcgaacccaaggaacgaggcgactttaatcacgagagaggggagcggaaagtctgccggttcaaactcgaatggctcggaaattgttcaggcctcaacgacgagacatacggctataaggagggcaaaccatgtatcattataaagctgaacagggtgctcggatttaagcctaaacctccaaaaaacgaaagtttggagacataccctgtgatgaagtacaacccgaatgtccttccagtccaatgcacaggcaagcgggatgaggacaaagataaggttggcaacgttgaatactttggccttggaaattccccaggatttcctctacagtattacccttactacggcaaactgctgcaaccgaaatatctgcagccgttgctggccgttcagtttaccaacctaaccatggatactgaaatccgtatcgagtgcaaggcttacggggagaacatcggctactctgagaaagataggtttcaaggccgcttcgatgtcaagattgaggtcaagtcttag

SEQ ID NO: 179930 - DNA, 744 bp, Artificial Sequence
  Description of Artificial Sequence: Synthetic coding sequence
atgctgctgaccatcagcgagttcaagcccacctaccaggaccgggtcgccccacctggactcacacaaatcccccagatccagaagaccgagattagcttccgccccaacgaccctaagagctacgaagcctatgtactaaacatcgtccgttttctcgagaaatataaggattctgcgcagcgagacgatatgatttttgaggactgtggagacgtgccttccgagcccaaggaacggggtgatttcaaccacgagcgcggagagcgtaaggtatgtaggttcaagctggagtggctcggaaactgttctgggctgaatgatgagacctacggctacaaggaggggaaaccatgcattattatcaaactcaaccgggtcctgggctttaaaccgaaacctcccaagaacgaaagcctggagacctacccagtaatgaaatataatccgaacgtgctgccggttcaatgcacaggtaagagagacgaagataaggacaaggtcgggaatgtggaatatttcgggttaggaaacagccccgggtttccactgcagtactatccttactacggtaaacttctacagccgaaatacctgcaacccttgctggccgtccagttcactaacctgacgatggacaccgagattcgtattgagtgcaaagcatatggcgagaacatcggctattccgaaaaggatagattccaggggaggttcgacgtaaagatagaggtcaagagctag

SEQ ID NO: 179931 - DNA, 873 bp, Artificial Sequence
  Description of Artificial Sequence: Synthetic coding sequence
atggtgatccagaaggagaagaagagctgcggccaggtggtggaggaatggaaggaatttgtgtggaatccccgcacacatcaattcatgggtcggaccgggacaagctgggcgttcatcttgctcttttacttggtattttacggctttctgactgccatgttcacactgactatgtgggtgatgcttcagactgtgtcagatcacacccctaaataccaggatcgactggcaactcccggactcatgatccggccaaagaccgagaacctagatgtcattgtgaatgtgtccgacaccgaatcttgggaccaacacgtccagaagctgaataagttccttgagccgtataacgatagcatccaagctcagaagaacgatgtgtgtagacctggccggtattacgagcagcctgataatggcgtactgaattatcccaagcgagcttgccagttcaatcgaacacaattgggaaactgttccggaatcggtgatagcacccactatgggtactctaccgggcagccatgcgttttcattaagatgaacagagtcatcaatttctacgctggagcaaaccaaagcatgaatgttacatgcgccgggaagagagacgaagacgccgagaacctgggcaatttcgtcatgtttccagccaatggaaacatagacctcatgtattttccgtactacggtaaaaagtttcacgtaaattatacacagccccttgtggcagtgaagtttcttaatgtcacccctaacgttgaggtgaacgtggagtgtagaatcaacgcagcaaacattgccaccgatgatgagagggataagttcgccggcagggtcgctttcaaactgcggattaataaaacgtag

SEQ ID NO: 179932 - DNA, 840 bp, Artificial Sequence
  Description of Artificial Sequence: Synthetic coding sequence
atgaccaagaacgagaagaagagcctgaaccagagcctggccgagtggaagttgttcatctacaaccccactactggggaattcctaggccgcactgcaaaatcttggggactgatcctgttgttttatctagtgttttacgggttcttggcagcactgttctcttttactatgtgggtgatgttgcagacactaaacgatgaagtgcctaaatatcgtgaccagatcccatctcccggccttatggtatttccaaagcccgtgactgcccttgaatacacatttagtcgctcagatcctacatcctatgctggctacatcgaagacctgaaaaagttcctcaagccgtatactctggaggagcagaagaacctgacagtgtgtcctgatggcgcactctttgagcagaaggggccggtctacgtcgcttgccagtttccaatttccctgcttcaggcatgctccggtatgaatgaccctgatttcgggtactctcagggtaatccatgcatcttagtgaaaatgaaccgcatcatagggcttaagccggaaggcgtgcctaggattgactgcgtgtccaagaacgaagacatccccaatgtggcagtgtacccccacaatggaatgatcgacttaaagtacttcccgtactacgggaaaaaattgcacgttggttaccttcagcccctggtggcagtgcaggtatcatttgcacctaataatactggtaaagaagtgactgtggaatgcaagattgacgggagcgcaaacttaaagtcacaggatgatcgtgacaaatttttgggcagggttatgttcaagattactgcacgggcatag

SEQ ID NO: 179933 - DNA, 582 bp, Artificial Sequence
  Description of Artificial Sequence: Synthetic coding sequence
atgctgagcgagggcgacatcctgttcagcagcctgctgagcagcccgagcctgttttggccgcccggcttaattttactgttttatctggtgttttatggcttcttggccgccctgttcagcttcaccatgtgggtgatgctccaaacactaaacgacgaagtcccaaagtatcgcgatcagattccctcccctggactgatggtgtttcccaagccagtgactgccctggaatacactttctcaagaagcgacccaacttcttatgctgggtacatcgaggatctgaaaaagttcctcaaaccgtatacccttgaagagcagaaaaacttaacagtttgcccagatggggccttgtttgaacagaaggggccggtgtatgtggcttgtcagtttcctatcagtttgcttcaagcgtgcagtggcatgaatgatcccgatttcgggtactctcaagggaatccctgcattctggtaaagatgaataggataatcggccttaaacccgagggggtcccacggatcgactgcgtctccaaaaccaataacgttaaggacggaatgaaaatttatcagatgtag

SEQ ID NO: 179934 - DNA, 2139 bp, Artificial Sequence
  Description of Artificial Sequence: Synthetic coding sequence
atggccctgctggccatgcacagctggcggtgggccgccgccgccgccgcctttgagaagaggaggcactctgctatactcatccgcccacttgtgtcagtttccggatctggtccccagtggcgaccccaccagctaggcgccctgggaaccgcgcgggcctatcaaatacccgagagcctcaaatcaattacatggcagaggctgggtaaaggcaactctggacagttcctggacgctgcgaaagcgcttcaggtttggcccctcatcgaaaagaggacttgctggcatggccatgctggaggaggcctgcacacagacccaaaagagggggctatgaacattgtggtccccttcatgtttaagtatgcagtcgattctctaaaccaaatgagcggcaacatgctgaacttatccgatgcccccaacacagtggccaccatggcaacagccgtcttgatcgggtacggcgtttccagagccggtgccgccttcttcaatgaagtcagaaacgcagtttttgggaaagtggctcagaacagtattaggaggattgccaagaatgtgttccttcatttacataatctggacctgggcttccacctgtccaggcagaccggggccctaagcaaagctattgatcgtgggacccggggtatatcttttgtgctgtcagcccttgtatttaatctgctgccaattatgtttgaagtgatgcttgtgagcggtgttctgtattataaatgcggggcccagttcgcacttgtcaccctgggcaccctgggcacctacactgcctttaccgtcgccgtgacgaggtggcggactcggttcaggatcgaaatgaacaaggctgataatgacgccggcaacgcggccatcgactccctgctgaactacgagacagtcaagtatttcaataacgaaaggtatgaagctcaaagatacgacgggttcctcaagacatacgagaccgcctccctgaagagcacgtccaccttggcaatgcttaatttcggccagtctgcgatatttagcgtgggcctgactgctattatggttctggccagccaagggattgtcgccggtactctgaccgtgggggatcttgtgatggtcaatggccttctgttccagctgtctctgcctctgaatttcctgggcaccgtttatagagaaactagacaagctttaatcgacatgaatacattgtttacccttctgaaagtggatactcagataaaagacaaggtgatggcaagccctctccagataacaccccaaactgccactgtggccttcgacaacgtgcacttcgagtatatagagggccagaaggttttgtccggaatttcctttgaagtgccggcaggcaaaaaggtggccattgtcgggggctctgggtcaggaaagagtacaattgtgagattgttatttcgtttctatgagccacaaaagggatccatctaccttgctgggcagaatatccaagacgtgtcactcgagagtctgaggcgagctgtgggtgttgtgccacaggatgccgtgctgtttcacaataccatctactacaacttactgtatggaaatatatccgcttcacccgaggaggtctatgccgtggccaagctggccggactgcacgacgccattttaagaatgcctcacggatacgacacccaagtcggtgaacgcggcctgaagctgtctggcggcgagaaacaacgcgtggccattgcaagagccattttgaaagaccctcctgtaatcctgtacgacgaggccacttcttctctggattctatcaccgaggagaccattctcggcgcaatgaaggacgtggtcaaacacagaacttctatcttcattgcccatagactctctaccgttgtggatgcggatgaaattattgtccttgaccaggggaaagtagccgaacgtggaacccaccacggtctgttggctaatcctcactcaatctattcggagatgtggcacacccagagctctcgtgtacaaaatcacgataatccaaaatgggaggctaagaaggagaacatttccaaagaagaagagcgaaaaaagctccaggaggagatcgtgaatagcgttaagggctgtggcaactgttcctgctag

SEQ ID NO: 179935 - DNA, 2046 bp, Artificial Sequence
  Description of Artificial Sequence: Synthetic coding sequence
atgcggctgtggaaggccgtggtggtgaccctggccttcatgagcgtcgacatctgtgtaaccaccgctatatacgttttttcgcacctggatcgcagcctgctggaagacattcgtcatttcaatatcttcgactcagtattagacctgtgggccgcctgtctttaccgaagttgcctgctcctgggcgcgaccataggtgtcgccaagaattccgctctggggccccgacggttgagagcatcatggctggtgatcaccctggtatgcctgtttgtgggtatttatgcgatggttaagctgctgctattctccgaagtgcgtcggcccattcgagatccgtggttttgggctctctttgtatggacatacatatccctgggagcttcctttcttctgtggtggttgctgagcaccgtcaggcccgggacacaggcccttgagccaggtgcagccacagaggctgaagggttccctggctcaggccggccaccccctgagcaggctagtggcgcaactcttcaaaagctgctgagttacactaagcctgacgttgcgttcctggtggccgctagttttttcctgatcgtggctgcactgggggagacttttcttccatattacaccggacgcgctatcgacggaattgtcattcagaaatcaatggatcagttcagcaccgccgtggtgatcgtgtgcctgctggctattggctcttcattcgcagcaggcatccgggggggcatctttactctgatctttgcccggctgaacatcagactgagaaattgtcttttcaggtcgctggtttctcaagagacttccttcttcgacgaaaacaggacgggagatctaatcagcaggttgaccagcgacactacaatggtgtcagatctggtgtcccagaatataaacgttttcctgagaaatacagtaaaggtgactggagtggtggttttcatgttctcgcttagctggcagctgtccctcgttacattcatgggcttcccaatcatcatgatggtctccaacatatacgggaaatactacaagaggctgtccaaggaggtgcagaacgccctggctcgcgcttccaacacagcggaggaaactatctcagctatgaagacagtcagaagcttcgcgaacgaggaggaggaggccgaagtttacttgagaaaattgcagcaggtgtataagctgaaccgtaaagaggctgctgcatacatgtattatgtatggggcagtggcttgacattgcttgtggtgcaggtgtccatcttgtattacggcgggcaccttgttatttcagggcagatgacttccggcaacctcattgctttcatcatctatgaattcgtgttgggagattgcatggaaagcgtgggatcagtgtactcaggtcttatgcagggcgttggagctgcggagaaggtgtttgaattcatcgataggcagcctacaatggttcacgatggctcccttgccccagaccacctggagggccgcgtggactttgaaaacgtaacatttacctatcgcacacggccgcatacccaggtgctgcagaatgtgagcttttcactttctcctggtaaagttacggctctagttggccccagtgggtcaggcaaaagtagctgtgtgaatattctcgagaatttctaccctcttgaagggggacgtgtgcttctggatggcaagcccatcagcgcatatgatcataaatacctgcaccgagtcatctctttagtgagtcaagagccagttctgttcgccagatccatcaccgataatatttcatatggactgccaacggtgccttttgaaatggtcgtggaagctgctcagaaggccaacgcgcatggcttcattatggagcttcaggacggatactcaacagagacaggtgaaaaaggagcgcaacttagcgggggtcagaagcagcgcgtggctatggcccgggcactggtaagaaacccacccgttttaatcctagatgaagccacatccgcgctggatgcagagtccgagtacctgatttag

SEQ ID NO: 179936 - DNA, 2052 bp, Artificial Sequence
  Description of Artificial Sequence: Synthetic coding sequence
atgcggctgtggaaggccgtggtggtgaccctggccttcatgagcgtggacatctgtgtgaccaccgccatctacgtgttctctcacctcgatcggtcactgctggaagacatacgccacttcaacatctttgacagtgttcttgacctgtgggctgcatgtttatacaggagctgcctgcttctcggtgccaccatcggcgtggctaagaacagcgcactgggtcctcgccgcttgcgcgcctcatggttggtgatcactctggtgtgcctctttgtcgggatttacgccatggtcaagttattgctgttctctgaagtgcggagacccatccgtgacccctggttctgggctctgtttgtttggacttacatcagcctcggggccagctttctgctttggtggctcctcagtacagtccgcccgggtacacaggctctggagcccggcgccgcgacagaggcggaagggtttcctgggagcggtaggcccccgccagagcaggcctctggggctacgctccagaaactgctgagttatactaagccggatgtggcctttctggtggcggcaagttttttcttgatagtcgccgcacttggagagaccttcctcccatactacactggccgcgcgatcgatggaattgtgatacagaagtcgatggatcaattctccacagcggtggttatcgtgtgtttgctggcaatcggtagctcttttgcggcaggcatcagaggtggcatcttcaccctgatcttcgcacgactgaacattaggctgcgtaattgtctctttaggagcctggtgagccaggagactagctttttcgacgaaaaccgtactggggatttaattagtcgtttgaccagtgatactaccatggtctctgatctcgtgagccaaaatataaacgtattcctgaggaacaccgtcaaagttaccggggttgtggttttcatgttcagcttatcctggcagttaagtttggtcacatttatgggatttcccatcattatgatggtatcaaacatctacggaaagtattacaaacgtcttagtaaggaagtgcagaatgctcttgccagagccagtaatactgctgaggaaaccatatccgcgatgaagacagtgcggtctttcgcaaatgaagaggaggaagcagaagtttatcttcgcaaactgcaacaggtgtacaaattgaaccgtaaggaggctgccgcttacatgtattacgtgtggggcagtggcctcacactgctggtggttcaggtgtcaatcctgtattacggtggccacctagtgatctctggtcaaatgacaagcggcaatctcattgcattcatcatatacgaatttgttctgggagactgtatggagtcggtcggctctgtttattcaggcctaatgcaaggcgttggcgccgccgaaaaagtgttcgagtttatcgatcggcaacctactatggtccatgatggtagtttggccccggaccacctggaagggagggtggactttgaaaatgttacattcacctataggacacgcccacacactcaagtgctccaaaatgtgagtttctcgttatctcctggtaaggtgactgctctggttggcccttctggaagtggtaagtcttcctgcgtcaacattctggagaacttctacccgctcgagggcggccgagttctgctcgatggaaaacctatcagtgcctatgatcacaagtacctgcatagagtgatctcgctcgtgagccaggaaccagtgctcttcgccagatctataactgataacattagctacggccttccaacagtgcctttcgagatggtagttgaagctgctcagaaagccaatgcccatgggttcattatggagctgcaggacggctatagtactgagacgggggaaaagggcgcccagcttagcggcggacagaagcaaagagtggctatggctcgcgctctggttaggaatccccccgtgctgattctggatgaagccacatcagcgcttgatgccgaatccgaatacctttgtgcaggctag

SEQ ID NO: 179937 - DNA, 300 bp, Artificial Sequence
  Description of Artificial Sequence: Synthetic coding sequence
atggccgcccccgccgagccctgcgccggccagggcgtgtggaaccaaacagaacctgagccggccgctacgtctttgctgagcctctgcttcctgcggacagccggggtgtgggtcccccccatgtacctgtgggtgctaggtcccatctacctactgttcatccatcaccacggcaggggttacttgcggatgtctcccctgtttaaagccaaaatggtagctgccattccaggctccctggaaccagggaatgtcagaggcaggcaaggcactggctggaacttagtaaaaagctag

SEQ ID NO: 179938 - DNA, 372 bp, Artificial Sequence
  Description of Artificial Sequence: Synthetic coding sequence
atgcccagcgccggcaccctgccctgggtgcagggcatcatctgcaacgcaaacaacccatgctttagatatcctaccccaggtgaagcccccggggtggtgggcaatttcaataagtccattgttgctcggttgttcagtgatgccaggcgccttttactgtatagtcagaaggacacctcaatgaaggatatgagaaaggtgctcagaacactccaacagattaagaaaagctcaagcaacttgaagttgcaagatttcctggtggacaacgaaacattctcaggattcctgtaccataatctctcattaccgaagtccacggtcgataagatgcttagagccgatgtgattctgcataaggtgtcttag

SEQ ID NO: 179939 - DNA, 6786 bp, Artificial Sequence
  Description of Artificial Sequence: Synthetic coding sequence
atggcctgctggccccagctgcggctgctgctgtggaagaacctgacctttcggcgccggcagacctgtcagctgttgctggaggtggcttggcctctttttatttttttgattctaatttcagtgaggctcagctatcccccttatgagcaacatgaatgccattttcctaacaaagctatgcccagcgccgggaccctgccctgggtgcaggggatcatctgtaatgccaacaatccttgttttcgctaccccacccccggtgaggctccgggtgtcgtcggtaatttcaataagtccatcgttgcccggctgttctctgatgcccggagactgctgctgtatagtcagaaagacacatcaatgaaggacatgaggaaagtactgcggaccctccagcagattaagaaatcttcttctaacctcaaactgcaggatttcttggtggataacgaaacattttccggctttctctatcataatctctcattgcctaaaagtactgtggataagatgctgagggcagatgtgattctgcacaaagtgttcctccagggttaccagctccacctaacctcattgtgtaatggatctaaatctgaagaaatgatccagctgggagaccaggaggtgtcagaactttgtgggctgccccgtgagaaactggccgcggctgagagagtgctgaggagcaatatggatatactaaaacctatacttcgaactctgaactccacatcacctttcccatcaaaagaattggccgaagctacgaaaacattactccattcactggggaccttggcacaggagttattctcaatgcgctcttggagtgatatgagacaggaagtcatgttcctcactaacgtaaattcatctagttcttccacccaaatctatcaggcagtgtcccgcatagtgtgcgggcatccagagggcggaggcctcaagattaagtctctgaactggtatgaggacaacaattacaaggccctgttcgggggaaacggcacggaggaggatgcagaaaccttctatgataactccactaccccctactgtaatgaccttatgaaaaacctggagtcctcgcccctttcacggattatttggaaggccctgaagccgcttctggtcggaaaaatcctctatacgccggatacacccgcaactcggcaagtcatggccgaggtgaacaaaacatttcaggagctggccgtgttccatgatctcgaagggatgtgggaggagctaagtccaaagatttggacttttatggagaactctcaggagatggatttggtgcggatgctgctcgattcgagggacaacgaccatttctgggagcagcagctcgatggactcgactggacagcccaggacattgtggctttcctggccaagcatccagaagacgtccagtccagtaacgggtccgtgtatacctggagggaggcttttaatgaaaccaatcaggctataaggacaatttcccgcttcatggagtgcgtgaatctgaataagctcgaacctatagctacagaggtgtggttgatcaacaaaagtatggagctgctggacgaacggaagttttgggccgggattgtattcactggcatcacccctggatcaatcgagttacctcaccatgtgaaatataagattaggatggacattgacaacgttgaacgtacgaacaagataaaagatggctactgggatcccggcccaagggctgatcccttcgaagacatgagatacgtgtggggtggctttgcctatctgcaggatgtcgttgaacaggctatcattagagttctgactggaaccgagaagaagaccggcgtgtacatgcagcaaatgccatatccttgctacgtcgacgacattttcctgcgggtgatgtcccgcagcatgccgttattcatgaccttggcatggatctattctgttgctgttatcattaagggtatcgtgtacgagaaagaagctaggctaaaggagaccatgagaattatgggactggacaacagcattctttggttttcttggtttatatcatcactaataccgctgttggtgtctgccggcctgttagtggtgatcctgaaactgggtaacttgcttccctatagtgatccatcagtggtgttcgtgtttctaagtgttttcgctgtggtgacaatcctgcagtgttttttgatctctacccttttttctagagccaatctcgcggccgcatgtggggggatcatatactttacattgtacctgccatacgtgctgtgcgttgcttggcaggattacgtcggatttaccctcaagatcttcgcctctcttctctcccctgtggcttttggctttggatgtgaatacttcgctctgttcgaagagcaaggcatcggagtgcagtgggacaacctgttcgagagtcctgtagaggaggatggctttaaccttaccaccagtgtctccatgatgcttttcgatacgttcttgtatggagtgatgacttggtatattgaggcagtgttcccagggcagtatggtattcctagaccttggtatttcccctgcactaaatcttattggtttggcgaagagtccgatgagaagtcacatccaggatcaaatcagaagcggatctccgagatctgcatggaggaagaacccactcacctgaaactgggagtctccattcagaacttggtgaaagtgtatcgggatggtatgaaagtggccgtagacggacttgcactgaatttctacgaaggacagataacttcatttttgggacataacggagccggaaaaaccaccactatgagcatcctcacgggactgtttccgccaacctctggaacggcctacatcctgggaaaggacatcagatccgagatgagtaccatacggcagaaccttggggtgtgtcctcagcataatgtcttattcgatatgctcacagtagaggaacatatctggttctatgccagactcaaaggcctctcggaaaaacatgtaaaagccgagatggagcagatggcattggacgtcggcctgcccagctctaaattgaagtctaaaacctcccagctgagcggtggtatgcaaaggaaactgagcgtggccttagcatttgtcggaggctccaaagtggtcatcctagatgagccaacagctggcgtcgacccttactccagaaggggcatatgggaactgctactcaaatatagacaggggcgcacaatcatcctgtccacccaccatatggacgaagccgatgtgctgggcgacagaatagctatcatatcacatggcaagctttgctgcgtggggagcagcttgttcctaaaaaaccagctgggcaccggttattacctgacactcgtaaagaaggatgtcgagagtagcctgagtagctgcagaaatagtagctctaccgtgagctatctaaagaaagaagacagcgtgtcacagtcaagttctgacgccgggttgggcagcgatcatgagtcagacaccctgactattgacgtgtctgccatctccaatctgattcgaaaacacgtgagtgaagcccgcctcgtggaagatattgggcatgaactgacctacgttctcccctatgaggccgcaaaagaaggcgcttttgttgaactcttccatgagattgatgataggctgtcagatttggggatctcatcctatggcatttcagaaacaacactagaagaaattttcctcaaagttgccgaagagtccggggtcgacgcagaaacatctgacgggactctgcccgcccgcaggaatcggcgggccttcggcgacaagcaaagctgtcttagacccttcaccgaggatgatgcagccgaccctaacgacagtgatattgacccagaaagccgtgagacggacctgttaagtggtatggacggaaaggggtcttaccaggtgaaggggtggaagttaactcagcagcagttcgttgccctcctctggaaacggctgctcattgcccgaaggagccgaaaagggtttttcgcccagattgtactgccagccgtatttgtgtgtatcgctctggtgttttcacttatcgtgcccccatttgggaagtacccaagccttgagctgcaaccctggatgtacaacgagcaatacacattcgtgtctaacgatgctcccgaagacaccgggacccttgaactgcttaacgcgttgaccaaggatccaggatttggcacccgatgtatggagggcaaccccatccctgatactccgtgtcaagccggagaggaagagtggacaactgcccccgtcccacagacaatcatggatctctttcagaatggaaattggaccatgcaaaaccccagccctgcttgccagtgtagctccgataagataaaaaaaatgttgccggtttgtccgcccggggccggcggcctgcccccaccgcagcgcaaacagaacacagcagatattttacaagacctcactggcagaaatatctccgactatttggttaaaacctatgttcagataatcgccaaaagtctgaaaaacaagatttgggttaacgaatttaggtacggcggattctctttaggcgtgtccaacacccaagcccttcctccgtcgcaagaggtcaacgatgcaattaagcagatgaaaaagcacttgaagctagccaaagattcttctgcagatcgctttctcaatagcttggggagattcatgacggggctggataccaaaaataacgtgaaagtgtggttcaacaataagggatggcacgccataagcagcttcctgaatgtgattaataatgccatccttagggctaatctgcaaaagggggaaaatccatcccactacggaattaccgctttcaaccatcccctcaatcttaccaagcagcagctctcagaagtggccctgatgaccacatcagttgatgtgctggtgagcatttgcgtgatctttgcgatgagctttgtacctgcgtcttttgttgtgtttctgatccaagaacgtgtctccaaagcaaaacacctgcagttcatcagcggggttaaacctgtcatttactggctcagcaatttcgtgtgggatatgtgtaattatgtcgtcccagccactctcgtgatcattatatttatctgtttccaacagaagtcctacgtgtcatctactaacctccctgtgctcgctctattgctcttgctgtacggctggagtatcacaccacttatgtaccccgctagttttgtcttcaaaatcccctcgaccgcttacgtcgtgctgacaagtgtcaacctattcatcggcataaatggatcagttgccacattcgtgcttgagctcttcacagataacaagctgaacaatatcaacgatatattgaagagcgtcttcttgatctttccgcacttttgccttgggagaggcttgattgatatggtgaagaatcaggcgatggcggacgccctggagagattcggggaaaatcgattcgtatcccccctttcttgggatctggtgggacgcaatctcttcgctatggctgtggagggggtagttttcttcttaatcaccgtgctgatacagtaccgcttcttcattcgccctcgccctgtcaacgccaagctgagtccattaaatgacgaggatgaagatgtacggagagaacgccagcgcatcctcgatggaggcgggcagaatgatattctggagatcaaagagctcacgaaaatttatcgcaggaagcgaaagccagccgtggatagaatttgtgtgggaatccctcccggcgaatgtttcgggctgcttggggtgaacggagcaggtaagagcagtacctttaaaatgctcacgggagacacaaccgttactcgaggggacgccttcctcaacaagaattctatactatccaatattcacgaggttcaccagaacatgggctattgtcctcaatttgatgctattaccgagctactgactgggagagaacatgtggaatttttcgccctgctccggggagtccctgagaaggaggtcggtaaggtgggagaatgggcgatcaggaaactagggctcgtcaagtatggcgagaagtacgctgggaactattccggcggaaataagcgcaaactttccaccgcaatggcactcattggcggtcctcccgtggtgtttctggatgaacctactaccggaatggacccaaaggcaaggagattcctctggaactgcgctttgagcgtcgttaaggaggggcgatccgtggtgttaacatctcattctatggaggaatgcgaggcactgtgtaccagaatggcgatcatggtgaacgggcgcttccggtgtctgggcagtgtacagcacctaaagaacagatttggggacggatacaccatcgtcgtgcgaattgcaggaagtaaccccgacctcaagcccgttcaagattttttcggcctagctttccccggctctgtgctcaaagaaaagcacagaaatatgctgcagtatcaattgccaagtagcctgtcaagcctggctagaatcttttccattctatcccaatcgaaaaaaagactgcacatcgaagactattccgtgagccagactactcttgaccaggtgttcgttaattttgcaaaggatcagtctgacgacgatcatttgaaggacctctccttacataaaaatcagaccgtggtggatgtggccgtactcactagtttcttgcaagatgaaaaggtgaaggagtcttacgtgtag

SEQ ID NO: 179940 - DNA, 1092 bp, Artificial Sequence
  Description of Artificial Sequence: Synthetic coding sequence
atggcctgctggccccagctgcggctgctgctgtggaagaacctgactttcaggcgccgacagacgtgtcagctgttactcgaagtggcatggccactcttcatcttcctcattctgatctctgtgcggctttcttaccctccctacgagcagcacgagtgccattttcctaacaaggcaatgccgagcgccggtacactcccttgggtgcagggtatcatttgtaatgccaataacccatgctttagataccccaccccaggggaagccccaggggtcgtggggaatttcaataagagtatcgtcgcaaggctcttcagcgatgcgagaagactgttgctgtattctcaaaaggatacctccatgaaagatatgcgcaaagttctcaggaccctccaacagatcaaaaagtcatcgtccaatttaaagctgcaggacttcttggtcgataacgaaacattttccggattcttgtaccacaatctgtctctccccaagtcgactgtggacaagatgttgcgcgctgacgtaattctccacaaggtctttctgcaggggtaccagctgcacctgacatccttatgtaacggctctaaaagcgaggagatgattcagttgggagatcaggaagtgtcggagctgtgtggactcccaagagaaaagctggccgccgctgaacgggtcctccggtccaatatggacatcctgaagcctatcctcatggatgttacttgcgatgacatagcccatggacaactcactgtcccacgctccgctgcagtggcggccacgggcgacgccaaacctaacatgatgggacgggaaactttactgagcatttgcgcgtcggtgcccaaggtggagtttcacgagcgacacattctcaagcattttagcttttgtgtgtgcgtctctgtgagcctgttcccagcaaagggcatcgtctccttctcttgggcatcctttcggatctgggtattgtggaaagccgtcttttggcaacacggggagagcatggctgtctgggaggggcagctggggttaggcctgaacatagcatttgaatatttcacctccatcgacgtgggttag

SEQ ID NO: 179941 - DNA, 4632 bp, Artificial Sequence
  Description of Artificial Sequence: Synthetic coding sequence
atgaacaagatggccctggccagcttcatgaagggccggaccgtgataggtacacctgatgaagaaactatggatattgagttacctaaaaagtaccacgagatggtgggggtcatatttagcgatacgttctcctatcgattgaagtttaattggggctaccggatcccggttatcaaggaacatagcgagtacaccgaacactgttgggctatgcacggggaaatcttctgctacctggctaaatattggctgaaggggtttgtcgcctttcaggctgccattaatgcggccatcatcgaagtgaccacgaatcacagtgtgatggaggagctgacatccgtgattgggattaatatgaaaatacctccattcatatccaaaggagaaataatgaatgaatggttccacttcacttgtctggtctccttctcatctttcatctattttgcttctttgaatgtcgcccgcgagcggggaaagttcaagaaactgatgacagtgatgggactccgcgagtccgccttctggctctcttggggcttgacctatatctgcttcatctttatcatgtcaattttcatggctctggttatcaccagcatcccaatcgtcttccacactggctttatggtgattttcactttgtattctctttatggactgagccttattgcacttgccttcttgatgtccgtcctgatccgtaagccaatgctagccggtctggccggattcctgttcaccgtcttttggggatgtctgggcttcactgtgctatacaggcagctgccattgagcctcggatgggtgctaagccttttgtctccttttgcgttcaccgccggaatggcccagattactcatctcgacaactatcttagcggcgtgattttccccgatcccagcggcgacagctacaagatgatcgccactttcttcatcctggcattcgacacccttttttatctgatttttacactttacttcgagagagtgctgccagacaaggacggacatggcgactcacccctgttttttcttaagtcctccttttggtcaaagcatcaaaatacgcaccatgagatcttcgagaacgagattaatcccgagcatagttcagacgatagctttgaaccggtgtctcccgagtttcacgggaaagaagccatccgaatccgcaatgtaattaaggaatacaacggcaaaactggcaaagtggaggctctccagggaatttttttcgacatatatgaggggcaaataactgccatcttggggcataatggtgcaggcaagagtaccctcttgaatattctcagcggcctctcagtctctacagaaggtagtgccaccatatacaacacccagctgtcagagatcacagatatggaggaaattcgcaagaatatcggtttctgcccacagtttaactttcagtttgattttttaacagtgcgcgagaacttgcgcgtctttgccaagattaaaggcattcagccgaaggaggtggaacaggaggtgaagagaatcataatggagctggatatgcaaagtatacaggatatcatcgcgaagaaactctccggggggcagaaacggaagctcacgctagggatcgctattctgggagatccccaggtgttactgttggacgagccgacagctggacttgacccttttagcagacatcgggtgtggagcttgttaaaagagcacaaagtggatagattgattctatttagtacccagtttatggatgaggccgacatactggctgacagaaaagttttcctcagcaacggaaagctgaagtgcgcaggctccagtctcttcctgaagcgaaagtgggggattggataccacctgtctctccacaggaacgaaatgtgtgacacagagaaaataacctcccttattaaacagcatattcccgatgctaagctgacgaccgaaagcgaagagaagctggtttatagcttgcccctagagaaaaccaataaatttcctgatctgtacagcgacctggacaaatgttccgatcagggcatccgaaattacgccgtctccgtgacaagccttaacgaggtatttttgaacctggagggaaagtccgctatcgatgagcccgacttcgacattggaaagcaagaaaagatccacgtcactcgtaataccggtgatgagagtgagatggagcaagtactgtgttctctcccagagacccggaaggcagtgtcgtcggcggcgctatggaggaggcaaatttacgccgtggcgactctgcggttcctgaaattgaggcgcgaacggagggctttgctttgtctgcttttggtattaggcatcgcgttcataccgattatattggaaaagattatgtacaaagtcacaagagaaacgcactgttgggagttttcacctagcatgtactttctgtccctggaacagatccccaagacgcctttgaccagcttactcatagtgaataatactggctcgaatatagaggacctcgtccactcacttaagtgccaggatatcgtgcttgagatcgatgattttaggaaccgcaacggcagtgacgaccccagctacaatggcgcaattattgtgagcggcgatcagaaggactacaggtttagtgtagcctgtaataccaaaaagctgaattgtttcccggttctgatggggatagtgagcaatgcactgatgggcatctttaactttacggagctgatccaaatggaatcaacttccttttcacgagacgacatagtgcttgacctcggtttcattgacggctcaatttttctcttgcttatcacaaactgtgtcagtcccttcatcggaatgtccagcatcagtgattacaaaaaaaatgtgcagagtcaactatggatctctggcctgtggccctcagcttattggtgtggccaggcactcgtcgatatacctctttacttcctgatcctgttctctatccacttgatttattactttatcttcctaggatttcagcttagttgggaacttatgttcgttctggtcgtgtgtatcattggatgtgccgtttcccttatttttttgacctatgttctctccttcatcttcaggaagtggcggaagaataacggattttggtcattcggcttctttatcatcttgatctgcgttagtactatcatggtgagcacccaatatgaaaagttgaacttgattctatgcatgatatttatcccttcttttactctgttagggtatgtgatgctgctcatccagttggattttatgagaaatctcgattctctggacaacagaatcaatgaagtgaataagacaattctgttgaccactctcataccctatctgcagtccgtcatatttctctttgtgatcaggtgcttggaaatgaaatatgggaatgagattatgaacaaagatccagtcttccggatatcccccagaagtagggaaactcatcctaatcccgaagagcctgaggaggaggacgaggatgtgcaagcggaaagagttcaagctgctaacgccttgaccgcgccaaatcttgaggaggagccagtgattaccgcatcctgtctacacaaagagtattacgagaccaagaagtcttgtttctcaacccgcaagaagaaaattgctattcgcaatgtctcattttgtgtgaaaaaaggagaggtgttggggttacttggtcataatggcgctgggaagtctacttccataaagatgattacaggctgcacaaagccaacagcaggcgtcgttgttctacagggctctagggcctcggtgcggcaacaacacgataatagtctcaaatttttgggatactgccctcaggagaactctttgtggcccaaactcaccatgaaggagcatcttgaactgtacgccgccgtgaagggactcggcaaagaggatgccgccctcagtatatcgcgcttagttgaagctctgaaactccaggagcaacttaaggccccggtgaagaccctgagcgaaggaattaagagaaagctttgcttcgtcctgtctatcctgggaaacccaagcgtggtgctgcttgacgagccatttacagggatggaccccgaaggacagcagcaaatgtggcagatcctgcaggccacagtgaagaataaggagcgcggaacacttctgacaactcactacatgagtgaagccgaggccgtgtgcgatcggatggctatgatggtctctgggactctgaggtgcattggatctatccagcatttaaaaaataaatttggacgggattacctgttggaaattaagatgaaggagcccacccaggttgaagcgctacacaccgaaatcctgaagcttttcccacaggctgcgtggcaggagcggtactcgtcccttatggcttacaaactacctgtagaagacgttcacccactgagccgtgctttcttcaagctggaggcaatgaaacagacattcaacctggaagagtactctctgagccaggccacactggaacaggtattcctggaattgtgtaaagagcaagaactgggtaacgtagatgataaaatcgacaccactgtggagtggaagctgcttccgcaggaagatccatag

SEQ ID NO: 179942 - DNA, 1401 bp, Artificial Sequence
  Description of Artificial Sequence: Synthetic coding sequence
atgaacaagatggccctggccagcttcatgaagggccggaccgtgatcggaacaccagacgaagaaactatggatatcgagctccccaaaaagtaccatgaaatggtgggcgttatcttctccgatacattttcataccgtctaaagttcaattggggttataggattccggtcattaaggagcattcggagtatactgagcactgttgggctatgcacggggagattttctgttatctcgcgaagtattggctgaagggcttcgttgcgttccaggcggcaatcaatgctgccattatcgaggtgacaacgaatcatagcgtaatggaggagctaaccagcgtcatcggaataaacatgaagatacctccttttatttccaagggtgagatcatgaacgaatggttccatttcacctgcttagtgtccttctccagcttcatatatttcgcatctctcaacgtggcccgcgaacgaggtaaattcaagaagttgatgaccgtcatgggccttcgcgagagtgcgttttggctgtcatggggactaacctatatatgctttatttttataatgagcatcttcatggcgttagtcattacttcgatcccgatcgtgtttcacacaggattcatggtgatctttaccctttacagtttgtatggattgtcactaattgcccttgcctttctgatgtcggtgctgattcgcaaacccatgttggcaggactcgccgggtttcttttcaccgttttttgggggtgccttggctttacggtcctctaccgccagctgccactatctctcggttgggtcctctcgcttttaagcccatttgcgttcaccgcgggcatggcccagattactcacctagacaattacctcagcggcgtcatcttccctgatccctccggcgattcttacaagatgatagccacgtttttcattcttgcctttgatacgctgttctacctcatcttcacactatatttcgaacgcgtgctgcctgacaaagatggccacggagatagtcctcttttttttctgaagagcagcttttggagcaaacaccaaaatactcatcacgagatattcgaaaatgagataaaccctgaacactcctcagatgactcatttgagccagtgtcccctgaatttcatggtaaggaagccatccgcattcgaaacgtgattaaggaatacaacggtaagacaggcaaggtggaagccttgcaggggatcttctttgatatctacgagggacaaattacagccattcttgggcacaatggagcaggtaagtctacgctcctgaacatcctgtcaggtctgtcggtaagcactgagggcaaaaaaaactacaacgggatcagacacgccaaacactcaagacactattgctag

SEQ ID NO: 179943 - DNA, 279 bp, Artificial Sequence
  Description of Artificial Sequence: Synthetic coding sequence
atgaacaagatggccctggccagcttcatgaagggccggaccgtgattggaacccccgacgaagagacaatggatatagaacttccaaaaaagtaccacgagatggtcggcgtgatatttagcgacacgttctcttatcgccttaaattcaattggggatataggattccagtgattaaggagcactccgagtacacagggcacaataagtccttctgcaacgggggtgtggatatctcctactggaacaagtatgaggataccacctttcatttttag

SEQ ID NO: 179944 - DNA, 1359 bp, Artificial Sequence
  Description of Artificial Sequence: Synthetic coding sequence
atgaacaagatggccctggccagcttcatgaagggccggaccgtgatcggaacacctgatgaggagaccatggacattgaactgccgaaaaaataccatgaaatggtgggcgttatattctcggacaccttttcttatcggctgaagttcaactggggctaccgaatccccgtaattaaggaacacagtgagtataccgaacactgctgggctatgcacggtgaaattttctgttacttggctaagtactggctcaaagggtttgtcgcctttcaggctgcaataaatgctgcaataatcgaggtgacaactaatcattctgtcatggaggagttgacttccgttatcgggattaatatgaaaattcctccattcatctcaaaaggggagattatgaatgagtggtttcactttacatgtctggtttcgtttagctcattcatttatttcgcaagccttaatgtggccagagagagaggcaagtttaaaaaacttatgaccgttatggggctgcgcgaatctgctttctggctgtcatggggacttacatatatttgctttatatttatcatgtccatctttatggccctggtgatcacatcgatcccgattgtgttccacacaggctttatggtgatctttactttatatagtctctacgggctgagcctgatcgcgctagcttttctcatgagcgtcctgatcaggaaaccaatgctcgctggtcttgccggatttttgttcacagttttttggggttgcctgggattcacggtattgtaccggcaactacccttgtccctcggttgggttctgtctctattaagcccattcgccttcaccgctgggatggcccagataacccatttggataattacctcagtggggtgatatttcctgaccctagtggcgattcatataaaatgatcgcaaccttttttatactggccttcgacacgctgttttacctcatcttcacactgtactttgaacgcgtgctccctgataaggacggccatggagatagtccacttttttttctgaagtcatccttctggtcgaagcatcaaaatacgcaccacgagatttttgagaatgagatcaacccagaacattcttctgacgactccttcgaaccagtgagcccagagtttcatggaaaggaggctattaggattaggaatgttatcaaggagtataatgggaaaactgggaaggtggaagctctgcaggggtccgaggaacgcctctgtcctgccgctcatagactgaggtgtggcgagcgactgtgtcccgcagcacaccatcttggttgcgaagagagaccatgccctgctgcaaccccttcaggaaattag

SEQ ID NO: 179945 - DNA, 7788 bp, Artificial Sequence
  Description of Artificial Sequence: Synthetic coding sequence
atggccagcctgttccaccagctgcagatcctggtgtggaagaactggctcggcgtcaaacggcagccactgtggactctggtgctaattctttggcccgtgatcatctttattattttggcgattacgcgaaccaagtttccccctacagcaaaaccaacttgttaccttgctcctcggaatctgccaagcaccggcttttttcccttcctgcagacactcttatgtgatactgactcaaagtgtaaggatactccatacggccctcaggacctcctgcgccgcaagggcatcgatgacgcactatttaaggacagtgaaatcttgcgcaaaagctccaacctggataaggactctagcctgagctttcagagtacccaagtgccagagagaagacacgcctccctcgctaccgtgttcccctctccatcatcagatctggaaatcccgggcacctatacctttaatggcagtcaggttctggcaagaatcttaggcctagagaagttgctgaaacagaatagtaccagcgaagatatccggagggagctgtgcgattcttatagtggttacattgtggacgatgccttctcctggacctttctggggcgcaatgtgttcaataagttttgcttgagtaacatgacgctgttggaaagcagccttcaggagctcaataagcagttttctcagctgtcaagcgacccaaataatcagaaaattgtattccaggagatcgtgagaatgctcagtttcttttcccaagtgcaggaacagaaggccgtatggcagctgttgagctccttcccgaatgtctttcagaatgatacctcattgtcaaatctgttcgacgttctgaggaaagccaactctgtgcttctcgttgtgcagaaagtttaccccagatttgcaacaaacgaggggtttagaactctgcaaaagtctgtgaagcacctgctgtacacgctcgatagccccgcacaaggtgactcggataacataactcatgtgtggaacgaagatgacgggcagactctaagcccaagttcattggcagcacagctcctgattttggagaatttcgaggatgctttgctgaacataagtgccaatagtccttacataccatacctggcatgcgtgaggaacgttaccgacagcttggcaagaggaagtccagagaacctccggctgctccagtcgactatccgcttcaaaaagtccttcctgcgcaacggcagctacgaagattatttcccgcctgtacccgaggtcctgaagagtaagctatctcaactacgaaacctgacagagctcctgtgcgagtccgaaacatttagcctgattgaaaaaagctgtcaactcagtgacatgagctttggaagtctgtgtgaggagagcgaattcgacctgcaactgttggaagctgcggaacttggaaccgagatcgctgccagcctgctgtatcacgataatgttatctccaagaaggtgcgggatctcttgacaggagatcccagcaagattaacctgaatatggaccaattcctcgagcaggctcttcagatgaattacctcgaaaatattacccagctgatcccgattattgaggctatgttgcatgtgaacaatagtgccgacgctagtgagaagcccggccaactgctcgaaatgttcaaaaatgtggaagagctgaaagaggacctgaggcggacaactggaatgagtaaccgcacaattgacaagttattggctatacccataccagacaatcgcgcagaaattatttcccaagttttctggctgcattcctgcgatacaaacataaccacccctaagttagaagatgccatgaaggaattctgcaacttatcccttagcgagaggtccaggcaaagttatctaattgggctgaccctcctacattacctcaatatctacaattttacatacaaggtcttcttcccgcggaaagatcagaagccggtggagaaaatgatggagctgttcatcaggctcaaggagatcttgaatcagatggccagcgggactcatcctctgctggacaagatgcgctccctcaaacagatgcacctgcccaggagcgtgcccctgacccaggcaatgtacaggagcaaccggatgaacacgccacaaggttccttctctaccatcagccaagctctctgcagccaaggtattaccactgagtacttgacggcaatgcttccttcatcacagcgccctaaaggcaaccataccaaggactttctgacctataaactgaccaaggagcagattgctagcaagtatggcattcccatcaactccacacccttctgcttctccctgtataaggatatcataaacatgcctgctggcccggtgatctgggcattcttgaagccaatgctgctcggaaggattctgtatgccccttataatccagtgacaaaggctattatggagaagagtaatgttaccctgcgccagctcgcagagctgcgagaaaagagtcaggagtggatggacaagtcccccctgttcatgaattcctttcatctgcttaaccaagcgatccccatgctccagaacacactccgaaatccctttgtccaggtgttcgtgaagttctccgtcggtctggatgccgtggaattacttaaacagatcgatgagttggacatcttgagactcaagctggaaaacaacattgacataatcgaccagctgaacacactcagctcactgacggtgaatattagcagctgcgttctgtacgaccgcatacaggcggctaaaactatcgacgagatggaacgggaggccaaacgactgtataagtcaaatgagctgttcggcagcgtaatcttcaaactaccttccaatcgctcctggcatcgggggtacgatagtggcaatgttttcctcccccccgtgatcaagtacacaatccgcatgtccctgaagaccgcccagaccaccagaagtttaagaaccaagatttgggcacctggtcctcacaactccccaagccataatcaaatctatgggcgcgcattcatctacctgcaggacagtatcgaacgggcaattattgagctccagacagggaggaacagccaggaaatagctgtgcaagtacaggcaattccatatccctgcttcatgaaagacaatttcctcacgagcgtgtcgtacagtctgcctatcgtgcttatggtcgcctgggttgtgtttatagcggcttttgtgaaaaagcttgtgtacgaaaaggatttgaggttacacgagtacatgaagatgatgggtgtgaacagctgttcacatttttttgcctggctgatcgagtccgtaggtttcctacttgtgaccattgtgattctcatcattatccttaagtttggtaacatccttccgaaaacgaacggctttatccttttcctgtacttttccgactattccttcagcgtgatcgctatgagctacttgatctctgtgtttttcaataacactaatatcgccgcgcttatcggttccctgatttacatcatcgcattttttccttttattgtactcgtgacagtcgagaacgaactctcttatgtccttaaagtttttatgagcctcctgtcgcccacagctttctcatacgcctcacaatatatcgctagatatgaagagcaggggatagggttacagtgggagaatatgtacaccagcccagttcaggatgacacaacatccttcgggtggctgtgctgtcttatccttgctgacagctttatatatttcttgatcgcctggtatgtgcggaacgtcttccctggcacctacggcatggccgcgccctggtactttccgatcctgccaagttattggaaggagaggtttggatgtgcagaagtgaaacctgaaaaaagtaatggtctcatgtttactaatatcatgatgcagaatacaaacccatctgccagccctgagtacatgttctcctctaatattgaacccgagcccaaggatttgacggtcggagtagccttacatggcgtcacaaagatatacggaagtaaagtcgctgtggacaatctaaacctgaatttctacgaggggcatatcacttctctactggggcctaacggggcaggaaagacaactaccattagcatgctcactggactgtttggtgcaagcgccggaacaatctttgtgtacgggaaggacattaagacagatttacacactgtcagaaagaatatgggtgtttgtatgcagcacgatgtcctattctcttatctgacaactaaagaacacctgctactctatggctctataaaggtgccgcactggactaagaaacaactgcacgaggaagtaaagcgtaccctaaaagataccgggctgtattctcatcggcataaacgggtcggcactcttagcggaggtatgaaacggaagctgtctatctccattgctctcatcggcggtagtagggtcgtgatactcgacgagcctagtaccggggtggacccctgttccagacgttcgatctgggacgtaatctctaaaaataaaactgcccgcactataattctgagtacccaccacctcgatgaggccgaggttctctccgaccggatcgctttcctcgaacagggcggccttcggtgttgtggaagccccttttaccttaaagaagccttcggcgacgggtatcacctcacattgacaaaaaagaaatctccgaacctgaacgcaaacgccgtttgcgacaccatggcggtgaccgctatgatccagagtcacctgccggaggcatacctaaaggaagacatagggggggagcttgtgtatgtactgccccctttctccaccaaggtgtccggagcctacctcagtctccttcgagcattggacaatggcatgggagaccttaacattggctgttacggtatatccgacaccaccgtggaggaggtttttttgaaccttaccaaggaatctcagaagaactccgccatgagtctcgaacacctgactcagaagaaaatcggcaattctaatgccaacggaatttctacacccgatgatttgagcgtttcatcctctaatttcaccgatagagacgataaaatattgactcggggagaaagactcgacggcttcgggttattgcttaagaaaattatggcaatcctgataaagagatttcaccatacccgcagaaattggaaaggtctcattgctcaggtgatccttcccatagtgttcgttacaacagcaatgggactgggtacccttcgaaacagcagtaactcgtaccccgaaatacagatttcacctagcctctacggaacttccgagcaaactgctttttatgcaaactatcacccatcaactgaagccctggtcagtgcaatgtgggacttccctggcatcgacaacatgtgtctcaacacatcagacttgcagtgtctgaataaagattccctggagaaatggaatacttccggagaacctataactaacttcggggtgtgctcctgcagcgagaacgtacaagagtgccccaaattcaattattcgccaccacaccggcggacttattcctctcaagtaatctataatttgactggccaaagagtcgagaactaccttatctccaccgcaaatgaattcgtacaaaagcggtacggagggtggagcttcggtcttcctctcacaaaggatcttcgcttcgatataacaggtgtgccggctaaccgcacgttggccaaagtatggtatgatccagaggggtaccattcacttcccgcatacctcaattccttaaacaatttcctgctcagagtgaacatgagcaagtatgacgctgcgaggcacggtatcattatgtattcacatccttaccctggcgtacaggatcaggagcaggccactatatcaagcctcattgacattctggtggccctctccatcctgatgggctatagtgtgacgaccgccagttttgtaacatacgtggtgagggaacatcagaccaaagcaaagcagctacaacacatctcagggatcggcgttacttgctactgggtaacgaatttcatctacgacatggttttttacctggtacctgtcgccttttctattgggatcattgccatttttaagctgcctgccttttacagtgagaataatcttggtgctgttagtctgctcctgttgctcttcgggtacgccaccttcagctggatgtatttgctggctgggcttttccacgagacaggaatggcctttatcacatatgtctgtgtaaatctcttttttggtatcaactccatcgtaagcctgtccgtggtgtacttcctatccaaggaaaaaccaaacgacccaactttagagctgattagcgagacccttaagcgcatctttctgatctttcctcagttctgtttcggctacgggttgatagaactttcacagcagcagagtgtgctggattttctcaaggcttacggcgtggagtatcccaatgaaacatttgaaatgaataagctgggggccatgttcgtggccctggtgtcccagggcacgatgtttttctcactcaggcttctcatcaacgaatccctcattaagaagttgaggctattctttcgcaaattcaactcttcccacgtgagagagacaattgatgaggatgaggacgtcagggccgagagactgcgagtcgagagcggcgccgccgagttcgacctggtgcaactttactgcctcaccaagacgtaccagcttatccacaaaaagatcattgccgtcaacaatatttcaattggaataccagcgggggaatgcttcggtctcctgggggtgaacggggcaggcaagactactattttcaagatgctgacgggcgatataatcccctcgtcaggaaacattttgatccggaataagacggggagtttgggccacgttgatagtcacagctcgttggttggttactgcccacaggaggatgccctggacgatctcgtgacagttgaggagcacctgtatttttatgctagggtgcatggcatccccgaaaaggatatcaaggagaccgtccacaagttgttacgtaggctccacctcatgcctttcaaagaccgcgcaacctccatgtgcagctacgggacaaaacggaagctgtctacagctttagctctgattggcaaacctagcatcctgcttctggacgagccgtccagcggaatggaccccaaatcaaagcggcatctttggaagatcatatccgaggaggtgcagaataagtgtagcgtgatcctgacctcacacagtatggaggagtgtgaagcgttatgtaccagactggcaataatggtcaacggaaagtttcaatgtattggctctttgcaacatattaagtccaggttcgggcggggcttcacggtgaaggtacaccttaaaaataataaggtgacaatggaaacacttaccaaattcatgcagctccactttccaaagacttacctgaaggatcaacacctgtcaatgctcgagtaccacgtgccggtcacagctggaggcgttgcaaacatcttcgacttgttagagaccaataaaactgcacttaacattacaaacttcctcgttagtcagaccaccctagaggaggtgtttattaattttgctaaagaccagaaaagctacgagactgcagatacttccagccaggggtccacaatttccgtagactcgcaagatgaccagatggagtcatag

SEQ ID NO: 179946 - DNA, 6834 bp, Artificial Sequence
  Description of Artificial Sequence: Synthetic coding sequence
atgttcacctacatcaagatcatcaccagcggcgacagcgacaacatcacccatgtctggaatgaagacgacggacagactctgagtccctccagccttgctgcgcagctgctgatcctggaaaattttgaggatgccttactcaacatatctgccaacagcccttatatcccgtaccttgcatgcgttaggaatgtcaccgattccctggctcgaggcagccccgagaatctgcggctgctgcaatcaaccattaggttcaaaaagagctttctgagaaacggatcctacgaagactacttccctccggtgccggaggtgcttaaaagtaagttgtctcagttaaggaatcttacagaattgctttgcgagtctgagacatttagcctgattgaaaaatcttgtcagttgagcgacatgtcgtttgggtcactgtgcgaggagagtgaatttgacttgcagctcctggaggcagctgaactcgggaccgagattgccgcctccctcctttatcacgataatgtcatttccaaaaaagtacgggacctgctaactggtgacccatccaagattaatttgaatatggatcagtttctggagcaggctctccaaatgaactatctcgagaacatcacccaattgatacctatcattgaagccatgctgcacgttaacaactcagccgacgcaagcgagaagcccggtcagctccttgagatgtttaagaacgtagaggaactgaaggaggatctcaggcggacaacagggatgagcaaccgaacgattgacaagttactggccattccaattccagacaaccgggcagagatcatatcccaagtgttttggctgcactcttgcgacacaaatattacaacacccaagctggaggacgcaatgaaggaattttgcaacctttctctgtctgaaaggtccaggcagagctatcttattggcctgacactcctgcattacttgaatatctataactttacctataaggttttctttccgcgcaaggatcagaaacccgtggagaagatgatggaactttttattcgcctcaaagagatcctgaaccagatggcgagcgggacccatccactgctcgacaaaatgcgctccttaaaacaaatgcacttaccacggtcagtcccccttacacaagccatgtacagatccaatagaatgaataccccgcagggatccttctcaacaatcagccaggctctctgttcacagggaatcacaaccgagtatctcaccgcgatgttgcccagttcccagaggccgaagggcaaccatacaaaagacttccttacatacaagttgaccaaagaacaaattgccagtaagtatgggattccaatcaacagcactccgttttgcttcagcctgtacaaagatatcatcaatatgccagcgggccctgtcatttgggcatttctgaaacccatgcttttggggaggattctttatgctccctataatcccgtaaccaaggccattatggaaaagtccaacgttacactacgacaactggccgaactgcgagagaagagccaggagtggatggataagtctccactgttcatgaactcatttcatcttctgaaccaggccatccccatgctgcagaataccttacgaaaccctttcgtgcaggtattcgtcaaattcagtgtgggattggatgcagtggaactgctcaaacagatagatgagctggatatcctgaggctgaagctagagaacaacatcgacattatcgatcagttaaacactttgagttcactaacagtcaacatcagcagctgcgtgttgtacgatcgtatccaggcggccaagactattgacgagatggagagagaagcaaagaggctgtacaaatctaacgagctgttcggaagcgtgatcttcaagctaccttcaaaccgctcatggcacaggggctatgactccggcaacgtcttcctgccccctgtcatcaaatacaccatcaggatgtccttgaagaccgcccaaacaacgaggtcgctaaggacaaagatctgggcccccggtccacacaatagcccttctcataaccaaatttatggacgggccttcatctacctgcaagatagcatcgaaagagctattatcgagttacagacagggcgtaacagccaggagatcgccgtgcaggtccaggccattccttatccctgctttatgaaagacaacttcctgactagcgtttcttattccctgccaatcgtactgatggtggcatgggtcgtattcattgcggctttcgtgaagaaactcgtctacgagaaggacctgaggctgcatgagtatatgaagatgatgggcgtcaattcttgctctcacttcttcgcctggctgatcgaatctgtgggtttcctattggtcaccattgtcatactcataatcatcctgaagtttggcaatatccttcctaaaaccaatggcttcattctgtttctttatttctcagactattctttcagcgtgatcgctatgagttaccttattagcgtcttcttcaataacacaaatatcgccgccctgatcggcagcttgatctacataattgctttcttccctttcattgtgttagtcacggtggagaatgagttgtcatacgtactcaaggtttttatgagcctattgagtcctacagcctttagctatgcttctcaatatatagctaggtacgaagagcaaggcatcggattacagtgggaaaacatgtacactagcccagtccaggatgataccactagctttggctggctgtgctgcctaattctcgccgacagctttatatatttcctgattgcttggtatgtgcgaaacgtgtttcccgggacttacgggatggctgccccatggtattttccaatcctgcccagctattggaaagaaagattcggttgcgccgaagtgaagccagaaaagagcaacgggcttatgtttacaaatatcatgatgcagaacacaaaccccagtgcatcacctgagtacatgttttctagcaatatcgaacctgaacccaaggacctgactgtgggcgtggccctgcatggcgttactaagatctacggcagcaaggttgctgtcgacaatctgaatttaaatttttacgagggccacatcacctctcttctcgggcccaacggggcaggaaaaaccactacaatctccatgctcaccggactcttcggcgcctccgcgggcaccatttttgtttacggcaaagatatcaagacagatctgcacacagtgcgtaagaatatgggcgtctgcatgcaacacgatgtgttgtttagctatctcacaaccaaggagcatctgttgctttacgggtcaattaaggtcccacactggaccaagaagcagctgcacgaagaagtgaagaggacattaaaagacactggcctgtacagtcataggcacaaaagggtggggaccctctcaggtggcatgaagcggaaactgagcatctccatcgccctcattggtggctcacgtgtcgtcattctggatgagccttcaaccggcgtcgatccatgctcacggcggtccatttgggatgtcatctccaagaataagacagccagaacgatcatcttgagcacacaccacttggatgaagccgaagtactctcagatagaattgcatttctcgaacagggtggtctgcgctgctgcggttcccctttctacctcaaggaagctttcggcgatggctatcacttgactctcaccaaaaagaaatcccccaatctgaacgccaacgcagtctgcgacaccatggcagtgaccgcgatgatccagagccacctgccagaggcctatctaaaggaggacatcggaggagaactggtctacgtgctcccacccttcagtacaaaggtttctggagcttatctgtcactcctccgggctcttgataatgggatgggggatttgaatatcggatgttacggtatctctgatacaacagtcgaggaggtgtttttgaacctcacgaaggagtctcagaagaactctgccatgagcctcgagcatcttactcagaaaaaaattggaaactccaatgctaacggcatcagcactcccgatgacttgtctgtttccagctccaattttaccgatagggacgataaaatcctgacaagaggagagaggctcgacggttttggcctcttattaaagaagatcatggccatcctcattaaaagattccatcacaccagacgtaattggaagggtctcattgcccaggtgatcctgccaattgtgttcgtgactacggcaatggggctgggtaccctgagaaactcaagcaatagctatcccgagatccagatctcccccagcctgtatggcacaagtgagcagacagcattttatgcaaactaccacccttctaccgaggcgttagtgagcgctatgtgggattttcctggaattgataatatgtgtctgaacactagcgacctgcaatgtcttaataaagacagtttggagaagtggaacacttctggagagccgattaccaatttcggggtgtgcagttgctctgaaaatgtccaggaatgtcccaaattcaattatagccctcctcataggcggacatattctagccaggtgatctataaccttacaggccagcgagtggaaaattacctgatttcaaccgcaaatgaattcgtgcagaaacgatatggaggctggtcttttggtctacctttgactaaggacttgaggttcgatataaccggcgtccctgccaaccgcactcttgcgaaggtgtggtatgacccggaggggtaccactctctgccagcatacctcaactcgctgaataactttttgcttcgagtcaatatgtcaaagtacgatgccgcccggcatggtattattatgtactcacatccataccctggcgtccaagaccaggaacaggcaacgatctctagcctcattgatatcttggtggctctcagcatcctgatggggtattcggtcacaacagcttcgttcgtgacgtatgtggtgagggagcatcagaccaaggctaaacaattacaacacatcagcggcatcggcgtaacatgctattgggttaccaactttatctatgatatggtattttacctggtgcccgttgcattttctatcggcatcatcgctatcttcaaactccccgcgttttattctgaaaataacctgggagccgtgtcgctgctgctgttgttgttcggatacgctacattttcatggatgtacttgctggcagggctgttccatgaaacaggtatggcgtttattacgtatgtatgcgttaaccttttttttggcataaactcgatagtctcgctatccgtggtgtacttcttgtctaaagaaaagcctaacgatccaacgctggaacttattagtgagaccctgaagagaatattcttgatcttccctcagttttgcttcggatatggattgattgaactaagccagcagcagtcggtcctcgactttctcaaggcatatggagtggagtatcctaatgagacctttgaaatgaacaagctcggtgcaatgttcgtggcactggtcagccagggaactatgttcttctctcttcggctgctgatcaacgagagcctgataaagaaacttcgactgttctttcggaagttcaacagtagccacgtacgggagaccatcgatgaagatgaggacgtcagagcggaaagattgcgagtagaaagtggggcggctgagttcgacttggtccagctttattgcctcacaaagacctaccagttaatccacaagaaaatcattgctgtgaacaacattagcatcggaattcctgcaggggaatgcttcgggctgctaggtgtcaacggtgcagggaagactaccattttcaaaatgttgaccggcgacatcatcccgagcagcgggaatatcctgatccggaataagaccggtagcctggggcacgtagacagccattcctctctggttggctactgccctcaggaggacgctttggatgacctcgtgacagtcgaggaacacctatatttctatgctagagttcatggcatcccagagaaggacatcaaggaaactgtgcataaactgctgaggcgcctgcatttaatgcccttcaaagatcgcgcaacgagtatgtgcagctacggcactaaaagaaagttgtcgaccgccctggctctgatcggaaagccatctatcttacttttggatgagccatcaagcggtatggacccaaagtcaaaaaggcacctgtggaagattatttctgaagaagtgcaaaacaaatgctctgtgattctcacatcacattcgatggaagaatgtgaggccctttgtactagacttgcaattatggtgaatggcaagttccagtgcataggctccctacaacatattaagagccgcttcgggaggggctttacagtgaaggttcaccttaagaataataaggtcactatggaaaccctgaccaagtttatgcaactgcacttccccaagacctatctcaaggatcaacacctgtctatgctggagtaccatgttccagtcacagctggaggtgtcgcaaatatttttgatcttctggaaacaaacaaaactgctttgaacatcacaaactttctagtcagtcaaacaaccctcgaggaagtcttcatcaattttgctaaggatcagaaatcttatgagactgcagatacttcctcccagggatctacaatttcagtggactcccaggacgaccagatggaaagctag

SEQ ID NO: 179947 - DNA, 15177 bp, Artificial Sequence
  Description of Artificial Sequence: Synthetic coding sequence
atgggccacgccggctgccagttcaaggccctgctgtggaagaactggttgtgccgcctaaggaaccccgttctttttttggccgagttcttctggccatgtattctgttcgtcattctaactgtcttacggtttcaggagcccccgagataccgggatatctgctatctccagcctagagatctgccaagctgcggtgtcataccctttgtgcagtctttactctgcaatactggttctagatgtcgcaacttctcttatgagggatctatggaacatcattttagactttcccgtttccaaaccgctgccgacccaaagaaggtcaataatctcgcctttctcaaggagatccaagatctagcggaggaaattcacggcatgatggacaaggctaagaatctgaaaagactgtgggtcgagcgctccaacacccctgacagcagctatggcagctctttcttcaccatggacctgaataaaaccgaagaggtgattctgaaactcgaatctctccatcaacagccacatatttgggactttttgttgctacttccgaggctgcatacaagccatgaccacgtggaagatggcatggatgtcgccgtgaatttgctgcagacgatcctgaactctctcatttcgttggaagacctagattggcttcctttgaaccagacgttttcccaggtctccgagctggtgttaaatgtgaccatctcgaccttgactttcctgcaacaacatggcgttgcggtgacggagccagtttaccaccttagcatgcagaacatcgtctgggatcctcagaaggtccagtacgatctgaagtcccagttcgggttcgatgatcttcacaccgagcagatactgaattcttccgccgagttgaaggaaatcccgaccgatacctctttagagaagatggtgtgctccgtcctctcatctaccagcgaagacgaagccgaaaagtggggtcatgtcgggggatgccatcctaaatggagtgaggccaaaaactaccttgtgcacgcagtcagttggctccgggtttaccagcaggtctttgtgcagtggcaacagggctcactccttcagaaaactctgacaggtatggggcactctcttgaggcactccgcaaccagttcgaggaagagtccaaaccttggaaggtggtggaggctctgcacaccgctctgctgctactgaacgacagtttgagcgccgacggaccaaaggataaccacacctttcccaagattctgcaacatctctggaaattgcagtctcttctccagaacctccctcaatggccggcactgaaaaggtttctgcagttggacggagccctgcgcaacgctatcgcccaaaacctgcactttgtacaggaagtcctcatttgtctcgagactagtgcaaacgacttcaaatggttcgaattgaatcagctcaagctggagaaggatgtcttcttctgggagctgaaacaaatgctagcaaaaaacgcagtgtgccccaacggccgatttagcgagaaagaagtcttcctcccgcctggaaacagctccatctggggcggactacaagggctgctgtgctattgtaattcttcggagacttctgtgctgaataagttactcggctccgttgaagacgccgacaggatcctgcaggaagttatcacctggcacaaaaatatgtccgtgctaatccctgaggagtatctggactggcaagagctggaaatgcagctgagtgaggcctcgctgagctgtacacgcttattcctattgctgggagccgacccaagcccagagaacgatgtcttttcctcagactgtaaacaccagctcgtgtcaaccgttatattccacacccttgaaaagacacaatttttcctggagcaggcttactactggaaggcctttaagaaattcatccggaagacctgcgaggtcgcacagtacgtcaacatgcaggagagcttccagaataggctcttagccttccccgaagaatccccctgttttgaagaaaacatggattggaagatgatctctgacaattactttcagttccttaacaacttattaaagtcaccaacggcctcaattagcagggctcttaatttcacaaaacacctgcttatgatggaaaaaaaactccacacccttgaggatgagcagatgaactttctgctttcctttgttgagttcttcgaaaagctgctcctacctaacctctttgactcttccatcgttccaagctttcattccttgccatccctaaccgaggatatcttgaacatcagcagcctgtggacaaatcacctgaaatctcttaaacgcgatcccagcgccaccgatgcccagaaactgcttgagttcggcaacgaagtgatttggaagatgcagacattagggtcccactggatcaggaaggaacctaagaacttactgcggttcatagagctgatactgtttgaaattaatcctaaactgcttgagctgtgggcctacgggatttctaagggaaaaagagccaaactcgaaaacttcttcactcttctaaattttagtgtgccagagaacgagatcctgagtacaagcttcaactttagccagctcttccactcagactggccaaaaagtccggccatgaatatcgacttcgtgcgacttagtgaggccattattaccagcttacatgaatttgggttcctcgaacaggagcagatttctgaggctctgaacaccgtgtacgcaattcgaaacgcttcagacctgttctctgcgctctcggagcctcagaagcaggaggtggacaaaatcttgacccacattcacttgaacgttttccaagataaagactccgcactcctcctgcaaatttattcgagcttttataggtacatttacgaactgttgaatatccagtccaggggcagtagtctgacatttctgacgcagatttcaaagcacatcctggacataataaagcaattcaattttcaaaatatctcaaaggcttttgccttcctgttcaaaaccgctgaagtcctgggggggatcagcaacgtatcatactgtcagcagctgctaagcatctttaacttcctagaactgcaagctcagagtttcatgagcactgaaggccaagagctcgaggtaatccataccaccctgactgggctcaagcagctcttgatcatcgatgaggactttagaatctctctgtttcagtacatgtcacaatttttcaactctagcgtggaagatctccttgacaataaatgtcttatcagcgacaacaagcacatcagtagcgtgaattattcaacaagcgaggaatcttcctttgtttttccattggctcagatctttagcaatcttagcgccaatgtttccgtgttcaacaagtttatgtcaatccactgcactgtctcctggttacaaatgtggaccgaaatctgggagaccatctcccaattgtttaaattcgacatgaatgttttcacttccctgcaccatggctttacacaactgctggacgagctcgaagacgacgttaaggtaagcaaaagttgccagggaattcttcccactcataatgtagctagactcatcttaaatttgtttaaaaacgttactcaggccaacgattttcacaactgggaggattttcttgatctgcgagattttctggttgccttgggtaacgcgctggtttcagttaagaaactgaacctggaacaggtcgaaaagagcctgtttaccatggaggccgcgctgcatcagctgaaaaccttcccttttaacgagtctacctctagggaattcttgaatagcctgctggaggtcttcatcgagttcagtagcacatccgaatacatagtccggaatcttgactcaattaacgatttcctcagcaacaatctaactaactatggtgaaaagtttgaaaacattataacagagttgcgcgaagcaatcgtttttctccgcaatgtgtcacatgacagagatcttttttcgtgtgctgatatctttcagaatgtcacggagtgtatcctagaagacggatttctgtatgttaatacgagccagaggatgttgcgcatactggatacactcaattctacctttagctcagaaaacacaatcagctctttgaagggatgcattgtgtggcttgatgtgattaatcacctatatcttctgtcaaactcttctttctcccaagggcacctccagaacattctgggaaattttcgcgacatcgagaataaaatgaactctattctcaagatcgtaacatgggtgcttaacataaagaaacccctctgctcatcgaacggttctcatattaattgcgtgaatatttatctcaaagatgtgactgacttcctgaatatcgttttgactactgtcttcgaaaaggagaagaagccaaagtttgagatcctccttgctctgcttaacgactccaccaagcaggtccggatgtctatcaataacctgactacagacttcgactttgcgtctcagtccaactggcggtactttacagagctgatattacgacctatcgagatgtctgatgagattcctaatcaatttcagaacatttggttacatctgataacactggggaaggaatttcagaaactagtaaagggcatttactttaatattctcgagaacaattccagctcgaagacggaaaatctactgaatatcttcgctacgtcccctaaggaaaaagacgtcaattcggtcggaaacagcatctatcacctcgcatcctacctggcattttccctgtcacacgatctgcaaaatagtccaaaaatcatcatctctcccgagattatgaaagccactggccttggaattcagctcatccgggacgtgtttaactctttgatgccagtggtccaccacacgtccccacagaacgctggctacatgcaagcactcaagaaagtgacatctgttatgagaactctgaagaaagcagatatcgacctgcttgtggatcagcttgaacaagtctccgtcaacctcatggacttctttaagaacatcagcagcgtcggcacgggtaatctggtggtcaaccttctcgtgggccttatggaaaagttcgcggactcctctcattcttggaacgtgaatcaccttctgcagcttagccgtctcttccctaaagacgtcgtggatgctgtgatcgacgtgtactacgtactcccccacgccgttagattactgcagggggttcctggcaaaaatatcacggagggtctgaaagatgtgtatagtttcaccctgttgcacggtatcacaatcagtaacatcaccaaagaagacttcgctatagttataaagatcctgcttgacactattgagttagtgtctgacaaaccggacattatttctgaggcactcgcttgtttccctgtcgtgtggtgctggaaccatactaatagcggatttagacaaaactctaagatagacccgtgtaatgtccatggactgatgtcttcgtcattttatggaaaggtggcatcaatcttagaccacttccacttgtccccccagggtgaggattctccctgttcaaatgagtccagtcgcatggagatcactaggaaagtcgtgtgtatcattcatgagttggtagactggaacagcatcctcttagagctctcagaagtgtttcacgtgaacatctcgttggttaaaaccgtgcagaagttttggcacaaaattctcccatttgtaccgccctctattaaccagaccagagactctatttccgagctctgcccgtccggtagcatcaaacaggttgctctgcaaataatcgagaaactaaagaatgtgaacttcacgaaagtcacaagtggtgagaatatcctcgataaacttagctccttgaacaaaattctgaatattaatgaagataccgagaccagtgtgcaaaatatcatttctagcaacctcgaacggaccgtccaattaatctccgaagactggagtctggagaaatccactcataacctgctgtctctctttatgatgctgcaaaatgcgaacgtgactgggagcagtctggaagcactatctagcttcatcgagaagtctgaaaccccctacaacttcgaagagctttggcccaagtttcaacagataatgaaggatctcactcaggacttccgcattcgacatctgctgtcagagatgaataagggcattaagtccatcaactccatggccttacaaaaaattacgttgcagttcgcccactttctcgaaattttggacagcccctccctgaagaccctcgaaatcatcgaggactttctgcttgtcacaaaaaactggcttcaggagtatgccaatgaggactattcccgcatgatcgagactttgtttatccccgtgacaaacgaatcttccacagaggatattgccctattagctaaagccatcgctaccttctggggctctctgaagaatatatcccgtgcaggaaactttgatgtagctttcctgactcacctgctgaaccaagaacagttgaccaacttctctgtggtccagctgctcttcgagaatatcctgattaacttaataaacaatctggcgggtaattcacaagaggccgcatggaatctgaacgacaccgatctgcagatcatgaattttatcaatctcattctaaaccacatgcaatctgagaccagccggaaaaccgtcctaagcctgcgaagtatcgtggatttcactgaacagttcctgaaaacgttcttcagtttgtttctgaaggaagactcggagaataagatctccctgctgcttaaatactttcacaaggacgtcatagccgagatgagcttcgtgcctaaggacaaaatcttggaaatcctgaagctggatcagtttctcacactcatgattcaggataggctgatgaacatcttctcttctttgaaggagactatttaccatctaatgaaatcttcctttattctggacaacggggaattttattttgacacccatcaggggctgaagttcatgcaggatctctttaatgccctgttgcgcgaaacctcaatgaagaacaagactgagaacaatatcgatttttttaccgttgtgtcacagctgtttttccacgtgaacaagagcgaagatcttttcaagttgaaccaggatctggggagcgcgcttcacctggttcgcgagtgttctaccgagatggcgagactgctcgatacaatattgcacagccccaataaagacttctatgcactgtaccctactctgcaggaggttattctggccaacttaacagacctcttgttcttcataaataattcgtttccccttaggaatagagcgaccctggagatcaccaagcgactggtgggggcaattagccgtgcctccgaggagtctcacgtcctgaagcctttgttggagatgagtgggacactggttatgctcttaaacgatagtgctgatctacgggatttagccacatcaatggattccatagtgaaattactaaagctggtcaaaaaagtcagcggcaagatgagtactgtgtttaagacacacttcattagtaacacaaaagatagcgttaaattcttcgatacactatacagcatcatgcagcagtctgtacaaaacttagtaaaagagatcgctactctcaagaagattgatcactttacttttgagaaaattaatgatctactagtcccatttctggatttagcttttgagatgatcggcgtcgaaccttacatcagtagtaacagcgacatcttcagtatgtcaccctcgattctgagttatatgaatcagtccaaagacttctcagatatcctggaggagatcgcagagtttcttacatcggtcaaaatgaaccttgaggacatgaggagcctcgctgtggcttttaacaatgagacgcagaccttctctatggatagtgtgaatttgagagaagagattctcgggtgcctggtacccattaacaacataacaaaccaaatggactttctgtacccgaacccaataagcacccacagcgggccacaggacataaagtgggagatcatccacgaggttatccccttccttgataaaatcttgagccaaaactcgacggaaatcggctccttcttgaagatggtaatatgcctcacattagaggcgctctggaaaaatctcaagaaggataactggaatgtgtccaatgtgctcatgacctttacacagcatccaaacaacttactgaaaacgatcgaaacagtcttggaagcctccagcggtatcaagtctgactatgaaggcgacctcaacaaaagcctgtactttgacactccactctcccaaaatattacacaccaccagttggagaaagcgatccataacgtgctcagccggattgctttgtggagaaaaggcttgctgtttaataattcggaatggatcacctcaacccgcactctgttccagcctctctttgagatattcatcaaagccaccacaggaaagaatgtgacctcagaaaaagaggagcgcaccaagaaagaaatgatagactttccgtacagctttaagccattcttctgcctcgaaaaatatctgggggggctctttgtgctgaccaaatactggcaacaaatccccctgaccgaccagagcgtggtcgagatttgcgaggtcttccagcagactgtgaagccatctgaggcaatggaaatgttgcagaaggttaaaatgatggtggtccgcgtgctgacaattgtggctgagaatccatcatggacgaaggatatcctgtgtgctacattgtcttgtaaacagaatgggatcaggcacctgatcctctccgcaattcagggagtgacattagcacaggatcatttccaggaaatcgagaaaatctggtcaagtcctaatcagttaaattgtgagtctttgtcaaaaaacttaagtagcactcttgagtctttcaagtcctctttggagaacgccacagggcaggactgtaccagccagccccgcctggaaacagtgcagcagcacctctatatgttggctaagagcctggaagaaacctggagctccgggaatcccattatgacatttttgtctaattttacggtcacggaggatgtcaaaattaaggaccttatgaaaaacattaccaagttgaccgaggagctgaggagctccatacagataagtaacgagactatacactctattctggaagcaaatatcagtcactcaaaggtgttattcagcgcattgacagtcgcgctatctggaaaatgtgaccaggaaattctccatctgctgttaacgttccccaaaggagagaagtcttggattgctgctgaggagctttgctcattaccgggctctaaagtgtatagcctcatcgtccttttgtctcggaacttggatgtgcgcgcattcatctacaagaccttgatgccctcagaggcaaatgggctgctcaattcgttgctcgacatagtctctagcctgagcgctctgctggctaaggctcagcacgtttttgagtacttacctgagtttctccatacatttaaaatcaccgctctgctggagaccctggacttccagcaggtctcccaaaacgtgcaggcacgttcgtcagcttttggctcttttcaatttgtaatgaagatggtatgtaaggaccaggcttcctttctctccgactctaacatgtttataaatttgccaagggtgaaggaacttctcgaagacgataaggaaaaatttaacatccctgaagactctacccctttttgtctgaaactttatcaggagatcttgcaactcccaaatggagctctggtgtggacatttctcaagccaattttacacggaaagatcctgtatacccccaacacgcccgaaatcaacaaggtaatccagaaagccaactatactttctacattgttgacaaattgaagactctctctgagacgttattggagatgtcctcactgtttcagagaagcggctcgggccagatgttcaaccagctccaggaggccctgagaaataaatttgtgagaaatttcgtcgagaaccaactgcacatagatgtggacaagctgactgagaaactgcagacctacggaggtcttctcgacgagatgttcaaccacgctggcgcgggccgcttcaggtttctcggcagcatcctcgtcaatctgtcaagttgtgtggcactgaaccgctttcaagcactgcagtctgtcgacatcctggagactaaagctcacgagctgctacagcagaactcttttctggcatccattatattttctaactccttgtttgataaaaactttcgtagcgaatctgttaagttgccgcctcatgtatcctatacaattaggaccaacgtgctctattcagttcgaactgatgtggtgaagaacccgtcttggaagttccacccacagaatctgccagcagatggcttcaaatacaactacgtgtttgcacctctgcaggacatgatcgaacgggcaatcattctagtgcaaacaggacaagaggcactggaacctgcagcccagacccaagccgctccatatccctgccacacatcagaccttttccttaacaacgtggggtttttttttccactgattatgatgcttacgtggatggttagtgttgcaagcatggtcagaaaacttgtttatgaacaggagatccaaatcgaggagtacatgagaatgatgggggtccaccccgtgattcactttttggcctggtttcttgagaatatggcagttctcactatatcaagtgccactctcgctattgtcctgaaaacgtccggcatcttcgctcacagtaacacctttatcgtcttcttatttttattagactttggcatgtcagtggtgatgttgagctatctgctgagcgcctttttctcccaggccaatactgcagctctctgcacctccttagtgtacatgatcagcttcctgccatacatcgtgctcctcgtcttgcataatcagctgtccttcgtgaatcagaccttcctgtgcctgttatccactactgcattcggccagggcgtgtttttcatcacattcctggagggacaagagaccggtatccagtggaacaacatgtatcaagccctggaacaaggcggcatgacattcgggtgggtttgctggatgatcctctttgactcaagtctgtactttctatgcggctggtatctgtccaacctaatacctggcacctttggcttgaggaaaccatggtactttccttttactgcaagttactggaaatctgttgggttcctggtggaaaaaaggcaatactttctcagcagctccctgttctttttcaacgagaacttcgacaataaaggaagctccctgcaaaatagggagggagaactggagggttccgcacccggcgtcacactggtgagcgtcaccaaagagtatgagggccacaaggccgttgtgcaagacctatccctgacattttatcgagaccagattaccgcattgctgggaacgaatggcgcaggcaagactacgattattagcatgctgaccggattgcaccccccaaccagtggtactattatcatcaacggaaaaaacctccagacagacctgtcgcgcgtgcgcatggaactaggagtatgtccccagcaggacattttacttgacaatctgactgtgagagaacaccttttattgtttgcctccattaaagctcctcagtggacaaagaaggagctccaccagcaggtgaaccagaccctgcaggatgtggacctgacccaacaccagcacaaacagacccgcgccctgtccggtggactgaagcgtaagctgagcctgggtatcgcctttatgggtatgtcgagaacagtggtattggatgagccaacctcgggcgtcgacccttgttcaaggcacagcctgtgggacatattgctaaaataccgagagggccgtactattattttcaccacccatcatctcgacgaggctgaggccctctctgatagagtagcagtgttacagcacggcaggctacgctgttgtgggcccccattctgtctcaaggaggcttatgggcaggggctgcggctgaccctcactcgtcagccctccgttctggaggcccacgacttgaaggacatggcctgcgttaccagcctgatcaagatttatatcccgcaggcttttctgaaggacagcagcggttctgagctcacctataccatcccaaaggacacagacaaggcctgtctcaagggattattccaggctctagacgaaaacctgcaccaactgcatctcactgggtatgggatatcagacacgacattggaggaagtgttcttgatgctgctgcaggatagcaataagaaatcccacatcgccctgggtaccgaatctgagctgcagaaccacaggcccacaggacacctatcaggctattgtggcagtttggcgcgacccgcgacagtccagggagtgcagttactcagggcccaggtggctgcaatacttgctagacggcttagacgaacacttagagcgggcaaaagtacactagctgacctcttactccctgtgttatttgttgccctggctatgggcctcttcatggtcaggcctcttgccacagaatacccacccctccggcttacccccgggcactaccagagagcggaaacttacttcttttccagcggcggtgacaatctagatttgacgcgggtactgctccgcaagttccgtgaccaggatctgccttgtgccgacctgaaccctcgacagaaaaattcttcctgttggcggacggacccattttctcacccagagtttcaggacagttgcggttgcctaaagtgtcccaataggtcagctagcgctccatatttgaccaatcatctcggccacaccctgctcaacctttcagggttcaacatggaggagtacctcctcgctcctagcgaaaagcctcgtctcggaggctggtcctttgggcttaagattccttctgaggccggcggggcaaatggaaacatatcaaaacccccaacactggcaaaagtttggtataatcagaagggatttcattccctgcctagttatttaaatcatttgaacaaccttatcctgtggcagcatcttcccccaaccgtcgattggcggcagtatggcataacactgtacagtcacccatacgggggagctttgctgaacaaggataagatattagaaagcatacgacagtgcggcgtggctctgtgcatagtattgggtttcagcattctgagtgcaagcattgggagcagtgtagtgcgagatcgggtgatcggggcaaagcggctccaacatattagtgggttgggttacagaatgtattggtttaccaacttcttatacgacatgcttttctacctcgtgtctgtgtgtctatgtgtggctgttattgtcgcttttcagctgacggcttttacatttcgaaagaatttggctgccacagctctgctgttgtctctgttcggctatgccacgttgccatggatgtatcttatgtcgaggattttcagcagctcagacgtagcctttatttcttacgtgagcctaaattttatttttggcctgtgcacaatgttgatcactattatgccacgactgctggccataatcagcaaagcaaaaaacttacaaaacatctacgacgtgctgaagtgggtgttcacgatctttccacagttttgtttgggccagggcctggtggaattatgctataatcagatcaagtatgacctgacccacaacttcggcatcgacagctatgtcagcccattcgagatgaatttccttgggtggatctttgttcaactcgcctcacagggcacagtcctgctgcttcttcgcgtcctattgcactgggatttgctgaggtggccacgcggacattcaacactgcagggcactgtgaagtcttctaaggacacagatgtggaaaaggaggagaagcgggtgttcgagggacgaaccaatggcgatattctggttctttataatctttcaaagcactacaggcgattttttcagaatataatcgcggtgcaggatattagtctgggcattcctaaaggggagtgctttgggctcctaggggtgaatggcgccggcaaatctactacttttaagatgctaaacggagaggtgtccctgaccagcggccatgccatcattaggacgcctatgggcgacgcggtggatttgagtagtgccggcactgcaggagtattgataggctactgcccacagcaggacgcactggacgagcttctgacgggctgggaacacctctattactactgctcacttcgggggatccctagacaatgtatccctgaagtggctggcgaccttatacgtcgactgcatctcgaggcacatgcagataaacctgttgcgacctactccggcgggaccaaacgcaagctgtccacagctctcgcactggtaggcaaaccggatattctgttgctggacgagcccagtagcggcatggacccttgttctaaacggtacctgtggcagactatcatgaaagaagtcagggagggatgtgcggccgtgcttacctcccatagcatggaagagtgtgaggcgttgtgtacccggctcgctattatggtgaatgggtcgtttaagtgcctcggtagtcctcaacacataaaaaatcgcttcggggatggctacacggtgaaggtgtggctttgcaaggaagcaaaccagcactgtaccgtctctgatcacctgaagctctacttcccaggaattcaattcaaggggcaacatctgaacctgctggaataccacgtgcccaaacgttggggttgtttagctgacttgttcaaggtcatcgagaataacaagacatttttgaacatcaagcactattctattaaccagacaacactggaacaggttttcattaacttcgcctccgaacagcagcagaccctgcagtctaccctcgatccatccacggactcccatcacacgcatcaccttccaatatag

SEQ ID NO: 179948 - DNA, 2367 bp, Artificial Sequence
  Description of Artificial Sequence: Synthetic coding sequence
atgggcctgttcatggtgcggcccctggccaccgagtacccccccctgcggctgacacccggtcactatcagagagccgagacatatttcttccggaagaattcaagttgctggcgcactgatcctttctctcaccctgagttccaggatagttgcggctgcctgaaatgtcccaaccgatcggcctcagctccatacctcaccaatcacctaggccataccttgttgaacctgtccggcttcaacatggaggaatatctcctggcccccagtgagaagccccgactcgggggatggagtttcgggctaaagatcccttccgaggctggcggtgctaatggaaatatcagtaaacctccaaccctagcgaaagtgtggtataatcagaaggggttccattctctgccttcttatttaaatcatctcaataacctgatcctctggcagcacctcccccctaccgtcgactggcgccaatatggcattacattgtacagtcatccttacgggggagcgttattaaacaaggataaaattttggagtctattcgacagtgtggagttgctctgtgtattgtgttgggatttagcatcttatccgcctcaattggttccagtgtcgttagagacagagtgattggagccaagaggctgcagcacatttctggactggggtacaggatgtactggtttacaaatttcctctatgatatgctgttttacctggtgtcagtgtgcctgtgcgtcgcagtcattgtagcattccagctcaccgctttcacctttcggaaaaacctcgccgccacagccttgctcctttctcttttcggctacgcaaccctgccatggatgtaccttatgagccgcatctttagttcctccgacgtcgcctttatatcctacgtgagtttaaatttcatatttggcctgtgtacaatgttaataaccatcatgcctcgtctactggccataatttctaaagcaaagaaccttcagaacatttacgatgtcttaaaatgggtatttactatcttccctcaattttgcctgggtcagggcctggtggagctctgttataaccagataaagtacgatttaacacataactttgggatagattcgtacgtgtccccatttgaaatgaactttctgggatggatcttcgtccagctcgcctcacagggtacagtcttgctgctgctgcgtgttctcctccattgggacctgctccgatggcccagagggcatagtactctgcagggaactgtcaagagcagtaaagataccgacgtggagaaggaggagaaacgggtgtttgaggggaggacaaatggggatatcctggtgctgtacaatctgtcaaaacactaccgaaggttctttcaaaacatcattgcggttcaggacatctcactcggcatccccaagggtgaatgttttggacttctcggagtgaatggcgctgggaaatctacaacatttaagatgcttaacggtgaagtatcactaacatctggacacgccatcattaggacccccatgggtgacgccgttgacctgtcctctgcaggcaccgctggagttctgattggatattgcccacaacaggacgctttagatgagttgctgacagggtgggaacatctgtactactactgctctttaagaggaatcccccgacaatgtatacctgaagtggcgggagacttgattcgccggttgcatttggaagcacatgccgacaaaccggtcgcgacctactccgggggaacaaaaaggaagttatccacagccctggctctagtgggaaagccagacattctgctcctggacgaaccttcctcagggatggacccctgttcaaagcggtacttgtggcagaccatcatgaaggaggtgcgcgaaggttgtgccgctgtgctaacttctcactccatggaggaatgtgaagcattgtgtacccgccttgcgattatggtgaacggttctttcaagtgcttaggctcaccccagcacatcaagaacaggttcggcgacggatacacagttaaggtgtggctatgcaaagaggccaatcagcactgtacggtatccgatcacttgaagctctacttcccagggatacagttcaagggccaacacctgaatctgctggagtatcatgtgccgaagcgctggggctgccttgctgatctgtttaaagtaatcgaaaacaataagacattccttaacatcaagcattactccataaatcagaccaccctcgagcaggtgttcattaactttgcaagcgagcaacagcaaactttgcagagtacactggaccctagcacagactcacatcatacgcatcacctcccgatctag

SEQ ID NO: 179949 - DNA, 7311 bp, Artificial Sequence
  Description of Artificial Sequence: Synthetic coding sequence
atgggcttcctgcaccagctgcagctgctgctgtggaagaacgtgactttgaaacggaggtcaccttgggtgctggcctttgagatttttattcccttggtgctgtttttcatcctgctgggcctgaggcagaagaaacccaccattagcgtaaaggaagtcgccttctatacagcagcccccctgacctccgcagggatacttccggtaatgcaaagtctgtgcccggacggccagcgggatgagtttgggttcctgcagtacgccaacagcacagttacccagttgctggagaggctcgatagagttgtggaggaagggaacctatttgatcccgcaaggccttccctgggctccgagttggaagctctgagacagcacctcgaagccctatccgccggtcccggcacgtcaggaagtcatttggacaggtctaccgtgtcctccttttccctggatagcgtagctaggaacccccaggagctgtggagattcttgacccagaatctcagccttccaaactcgacggcccaggccctgctggccgccagagtggatcccccagaggtataccacctgcttttcgggcctagctctgcactagatagccagtctggactgcataagggccaagagccttggtcacggcttgggggcaaccctctgtttcgtatggaagaactgctgctcgcccccgccttacttgaacagttaacgtgtacacccggctccggagagcttggcaggatactcaccgtccccgaatcccagaagggcgcgctgcagggatatcgggatgccgtgtgttctgggcaggctgctgcacgcgcccggaggtttagcggccttagcgcagagctccggaatcagctggatgtggctaaagtctctcaacaactggggctggatgcccctaatggctccgactctagccctcaggccccgcctccaagacgtttgcaggccctacttggcgacctcttggatgcgcagaaggttttgcaggatgtagatgttctgagcgcattggctctgctgctgcctcagggagcatgtactggacggacacctggtccccctgcctctggggccggtggcgccgccaacggcactggcgctggcgccgtcatgggccctaacgcgactgcggaagagggggccccgtctgctgccgcactggctaccccagacacccttcagggccagtgctcagcgttcgtgcaattgtgggcagggctacagccaatcctctgtggaaataataggaccatagagcccgaagctcttagaagggggaacatgagcagtctgggctttactagcaaagagcagaggaatctaggattgctcgtgcacctgatgaccagcaacccgaagatactgtatgcacccgccggctccgaggttgaccgggtcatactgaaggcaaatgaaacatttgcctttgtggggaacgtgacgcattacgctcaggtttggttaaatatttctgcagagattcgctctttcttggaacagggccgtttgcagcagcatcttagatggcttcagcagtacgtcgccgagctgcgtctgcatcctgaagcactaaatctcagcttagacgaattgccccctgctctgcgccaggacaatttttccctcccctccggaatggcactgttacagcagctggacactatagataatgcggcgtgtgggtggatacagtttatgagtaaggtttctgttgatatattcaagggctttcacgatgaggagtctattgtcaactatacattgaaccaggcctatcaagacaacgtcacggttttcgcttccgtcatcttccagactcgcaaagatgggtcgttgcccccacacgtgcattacaaaatccgtcagaactcatccttcacggaaaagactaacgaaataaggagggcctactggaggcctggtcccaacactggaggacggttctactttctgtatgggtttgtgtggattcaggacatgatggaaagggctatcattgatacatttgtaggtcacgacgtggtagagccaggatcctatgtccagatgtttccctatccctgctacacgcgtgatgattttcttttcgtaatcgagcatatgatgccgctgtgcatggtcatatcttgggtgtacagcgtggcgatgaccattcagcatattgtcgctgagaaggaacaccgactaaaagaagtgatgaaaactatggggttaaacaacgctgtgcattgggtggcgtggtttatcaccgggtttgtacagctcagtattagtgttaccgccctgaccgccatcctcaagtatggacaggtgctgatgcattcccacgtcgtaataatttggctgttccttgccgtgtatgcagtagctactattatgttctgctttctagtctctgttctctactctaaggccaaactagccagcgcatgtggaggcattatttactttctctcatatgttccatacatgtacgtagccatcagggaggaggtggcccatgacaagattactgcctttgagaaatgcatcgctagtctgatgtcaacgactgccttcgggctgggctctaaatacttcgctctatacgaggtggctggtgtgggcatccagtggcacaccttctcccagtcacccgtagaaggcgacgactttaatttgttgctggcagtgacaatgttgatggtcgatgctgtggtttatgggattctaacctggtatatcgaggccgtccaccctggcatgtacgggctgcctcgcccatggtacttcccgcttcagaaaagctactggttaggatctgggagaaccgaagcctgggaatggtcttggccttgggcaaggacgcccaggctgagcgtaatggaggaggaccaagcgtgtgcaatggagagcaggaggttcgaagagactcgaggtatggaggaagagccaacgcatcttcccctcgtggtttgtgtcgataaactgactaaagtttacaaggatgacaaaaagctggctctcaacaagctctccttgaacctttatgagaatcaagtggtaagtttcttaggccacaacggcgccggtaagactactacaatgtcaatcctaacaggtctctttcctcccacatcaggttccgccacaatatatgggcatgatatccggacggaaatggatgagatcaggaagaatctggggatgtgccctcagcacaatgttctgtttgatcgcctaacagtggaagaacatttgtggttctactcccggttgaagtctatggcccaggaggagatccgccgcgagatggacaagatgatcgaagatctggagctgtctaataagcgccacagcctggtgcagacactgagtgggggcatgaaaagaaaattatcggtggccatcgcttttgtcggaggcagccgcgctatcatactcgatgaacccaccgcgggcgtcgacccttacgccaggcgcgcaatctgggacttaatactcaagtataagcctgggagaaccattctgttatcaactcatcatatggatgaggccgacctgctcggcgaccggatcgccatcatttcccatggcaaactaaagtgttgtgggtctccactgtttctaaagggtacatatggggatggctacagactgaccttggtcaagcgacccgccgaacccggagggccacaggagccaggcctggcatccagtccgccaggtcgagctccactttccagttgttccgagctgcaagtctctcagttcattcggaaacatgtggcaagctgtctgctcgtttccgataccagcaccgagctcagctacatcctgccaagcgaggccgcaaaaaaaggagcatttgaaaggctgttccagcatttggaacgctccttggacgccttacacctgtccagctttggtctgatggataccacactggaggaggttttccttaaggtctccgaagaggatcaatccctggagaattcagaggccgacgtgaaagaatctcgcaaagacgtgttgcccggtgccgagggccccgcttccggagaagggcatgctggaaatttagctcggtgctccgagctgactcagagtcaagccagcctgcagagcgcgagttcggtgggatcagctagaggcgatgagggcgcagggtacactgacgtgtatggggactatagaccactgtttgacaatcctcaagacccagacaatgtatcactgcaggaagtggaggcagaggcattatcacgggttggacaggggagcaggaaattggacggtggatggctaaaggtcagacaatttcatggcctcctggttaagaggtttcattgcgctcgcaggaattcaaaggccctgttttcccaaatcctgctaccagccttctttgtgtgtgtggccatgacagtagcactttccgtccctgaaattggggacctgcctcctctggtgctcagcccgtctcaatatcacaattatactcaacctcgtggcaattttataccctacgccaatgaggaacgacgggaatataggttgaggttaagccccgatgcttctccccagcagctggtgtcgacattcagactgccatccggagtaggggccacctgcgttctgaaaagccctgcgaatggttccctggggccaaccttgaacttgtcctctggagagtcaagacttctcgcggctcgcttttttgattccatgtgcttagaaagctttacacagggcctgcctttgagtaactttgtgcctccccctcctagtccagcacctagcgactcacccgcatccccagatgaagatctccaggcctggaacgtcagccttcctcctaccgcagggcccgaaatgtggacctccgcccctagcctgcccagattagtgcgcgagcctgttaggtgcacatgctccgctcagggcactggctttagctgccctagcagcgtcgggggccatccgccccagatgcgggtcgtgactggggatatcctgaccgacatcaccggacataacgtgagcgagtatttgcttttcacttctgatcgcttcagacttcaccggtatggagccatcaccttcggcaacgtgctaaagtctattccagcaagctttggcacgcgcgccccccccatggttcggaagattgccgtgaggagagcagcacaagtcttctataataataagggataccatagcatgcctacctacctaaattctctgaataatgctatcctcagagccaacctacctaagagcaaggggaaccctgccgcttatggaataacagtgacaaaccatcctatgaataaaacatccgcttctctgtcgctggactacctgctccagggaactgatgtcgttatcgctatctttataatagtggcaatgtcctttgtcccagcaagcttcgtggtattcctggtggcggaaaaaagtaccaaggccaagcatctgcagttcgtgagcggatgtaatccaattatctactggttagctaactacgtttgggacatgctgaactacttggtgcccgctacatgctgtgtgatcatcttatttgtgttcgacctacctgcgtatacatcacccacgaacttcccggccgtcctgtctctctttctcctgtacggatggagcatcacacccattatgtatcctgccagtttctggtttgaggtaccctctagcgcgtatgtgtttctgatcgtaattaatttatttattggaataacagccactgtcgcgacattcttactgcagctgttcgagcatgacaaagacctcaaggtggtgaacagttatctcaagagctgtttccttatttttccaaactacaacctgggccacggattgatggagatggcatataatgaatatattaacgaatactatgcaaagatcgggcaattcgacaaaatgaaaagtccttttgagtgggatatagtgacccgcggcctcgtggcgatggccgtggagggcgttgttggattcttattgactattatgtgtcagtacaattttctccggcgccctcagcggatgcccgtctcgactaaaccagtagaggatgatgtggatgtagcttctgaaagacaaagagtgctgagaggcgacgccgacaatgacatggtgaaaatagagaaccttactaaagtttacaagtcaagaaagattggtcggatcctggcggtggaccgcctttgcctgggtgtacgccctggtgaatgtttcggtctgttgggagttaatggtgccggcaagacatctacgttcaagatgctgacaggggacgagtctactactggcggggaggcatttgtaaacggccactctgttttaaaggagctgttgcaagtgcagcagtctttggggtactgcccccagtgcgatgccctttttgacgagctaacagctagagagcatctgcagctatacactcggctgagggggatctcatggaaggatgaggcccgagtggtgaaatgggccttggagaagctggaactgacaaagtacgctgacaagccagccggcacctacagcggtgggaataagagaaaattgagtactgcaattgcactgattggttacccggcatttatcttcctcgacgaaccaacaacaggaatggacccgaaagctcgacgtttcctctggaatctgatactggacttaatcaagaccggacggagcgtagtgctcacctcgcattctatggaggagtgtgaagctctatgcacccgcctggccatcatggttaatggtagactgcgctgtttgggaagcatacagcatctgaaaaacaggttcggagatgggtacatgattaccgtccgaaccaaatcctcccagagtgttaaagacgtggttaggtttttcaacagaaattttcctgaggcaatgctaaaagagaggcatcacacaaaagtgcaataccagctaaagagcgagcacatttcgctggcacaagtcttctctaagatggaacaggtatccggcgtgctgggtatcgaagactattcggtgagccagaccaccctagataacgtctttgtgaacttcgctaaaaaacagtcagacaacttggaacagcaggagaccgagcccccatccgccctgcagtcccctctaggctgtttactgtcactcctgcggccaaggagcgctcctacagagctccgggcacttgttgccgacgaacccgaggatctggacacagaagatgagggcctcatatcgttcgaagaagagcgagcccagctttcattcaacacagacacactgtgttag

SEQ ID NO: 179950 - DNA, 7311 bp, Artificial Sequence
  Description of Artificial Sequence: Synthetic coding sequence
atgggcttcctgcaccagctgcagctgctgctgtggaagaacgtgacactcaagaggcggagtccttgggtccttgcctttgagatttttatcccgctggtactgttttttatcctgctggggctacgccagaagaagcccacaataagcgttaaggaagtaagtttctacaccgccgctccgctgacctctgcagggatactgcccgtgatgcagagcctgtgcccagacggccagcgagatgaatttgggttcctacagtatgccaactctacagtcactcaactgctggaaagactcgaccgcgttgtggaagaggggaacttatttgacccagctcggccttccctggggtcggagctggaggcactacgtcagcatcttgaagctctgagcgcgggaccagggacatctggcagtcatctagaccggagtactgttagctcctttagtctagatagtgtcgcgcgaaacccacaagagctgtggagattcttaacacagaacctgtcccttcccaattcaaccgcccaggctttgctcgccgcaagggttgatccacccgaagtttaccacctgctcttcgggcccagctccgctctcgactcgcagtccggacttcataagggtcaggagccatggtcgagattagggggcaaccctctattccggatggaggaactcctattagcccctgccctccttgagcaacttacttgcacaccaggctctggcgagctgggacggatacttacagtacctgagtcccagaagggggccctacaaggatacagagacgcagtttgcagcggtcaggcagcagcccgtgctaggcgattctctggcttaagcgccgagctaaggaatcaactcgacgttgcaaaggtcagtcagcaacttggtcttgatgccccaaacgggagtgactcttccccccaggcccctcctccccgacgactgcaagccttactgggggacctgctggatgcccaaaaagttctccaggacgtggacgtcctgtccgctcttgctctgctgctcccgcagggggcatgtaccgggcggacccctggcccacccgccagcggagccggtggggccgccaatggcacgggagccggtgcggtcatgggccccaacgccaccgccgaagaaggagccccttccgccgccgctctggcgacaccagatactctacagggacagtgttctgcttttgtccagttatgggcgggtctgcagcccatcctgtgtggcaacaaccgcactattgagcctgaagccttgagacgtggcaacatgtccagcctcggatttacctctaaggagcagcgtaatctcggactcctcgtccatcttatgacctctaacccaaaaattttgtacgcacctgccggctcagaagttgaccgcgtgatcctgaaggccaatgagaccttcgctttcgtagggaacgtcacacattatgcccaagtttggctgaacattagcgctgagattagatcctttttggaacagggaagacttcagcagcatctacgctggctgcagcagtatgttgctgagctccgcctgcatccggaggccctcaacctttctctggatgagctgccacctgccttgcgacaggacaactttagtctgccttcagggatggccttgctacaacagctcgacactatcgataatgccgcttgcggttggattcaattcatgagtaaggtgagcgtagacatcttcaagggatttcacgacgaggagtcaattgtgaattacacgctaaatcaggcctaccaggataacgtcaccgtcttcgcttccgttattttccagactagaaaggacggatcattacccccgcatgttcattacaagataaggcaaaactcttccttcaccgagaagactaatgagatccgcagggcctattggcgtcctggcccaaacactggaggtcgcttctactttctatacgggtttgtgtggatacaggacatgatggaaagagccatcatcgatacatttgtgggacacgacgtcgtcgagcccgggtcatacgtgcagatgtttccctatccatgttacactcgggatgatttcctgtttgtcatcgaacacatgatgcctctttgtatggtgatttcctgggtgtatagtgtcgcgatgacaatccagcatatcgtggccgaaaaagagcaccgcctgaaagaggtcatgaagactatgggactgaataatgcggtgcactgggtggcttggtttattaccggcttcgtccagttgagcatttctgtcacagctcttaccgcaatcctgaaatacgggcaagttctgatgcatagccatgttgtgataatctggctgttcttggctgtgtatgccgtggcgactatcatgttctgcttcctggtctccgtgctctatagcaaggccaaattggcctccgcctgcggaggtatcatttactttctctcttatgtaccttacatgtatgtggcaattcgagaggaggttgcccatgataagatcacagctttcgagaagtgcattgcaagtctcatgtctactaccgcttttggcttgggaagtaagtacttcgcactttacgaggtggctggcgtggggattcagtggcatactttctctcagagtcctgtcgaaggcgacgacttcaatctattgctggccgtgactatgctgatggtggatgctgtcgtgtacggtatacttacatggtacatcgaagccgtccatccgggtatgtacgggctgccccgtccatggtatttccccctgcagaaatcttattggctgggcagtgggcgtaccgaggcttgggaatggtcatggccatgggctcgcaccccccgcctgtcggtgatggaggaagaccaagcttgcgcgatggaatcaaggcggtttgaagagacacgtggcatggaggaggagcctactcaccttcccctcgtggtgtgcgtagacaagctgacaaaagtctataaagacgataaaaaactggcccttaataaactgtctcttaatctctatgagaaccaggtagtctcatttctgggccacaatggcgctggcaagaccaccaccatgagcatcttgaccggtctcttccctcccacatctggatccgccaccatttatggtcacgacattcgcaccgagatggacgaaattcgcaagaacttgggaatgtgtcctcagcacaacgtcctttttgaccgattgaccgtggaggagcacctgtggttctactcccggctgaagagcatggctcaagaggagatacgcagggagatggataaaatgattgaggatctcgaattatcaaacaaaaggcactcattggtgcaaacactgtcaggaggaatgaagaggaagctgtccgtggcgatagcgttcgtcggagggagcagggctattatcctggacgaaccaacagctggggtggacccctatgcccgacgcgctatctgggatctgattctgaagtacaagcccggcagaacaatattgctatcaacccaccacatggatgaggccgacctccttggcgatagaattgccatcatttctcatggaaagttgaagtgctgtggttctcctctatttctgaaaggcacatacggggatggatatcggctgacactcgtaaaacgtccagccgaacctgggggaccccaagaacccggtttagccagcagtccccccggtcgtgcacctctcagctcatgtagcgaattgcaagtttcccagttcattcggaagcacgtcgccagctgtcttcttgtatctgatacatctactgagttgtcatacatactcccatccgaggccgccaaaaagggtgctttcgagaggctttttcagcacctcgaacgaagtctcgacgctttacatctctcatccttcggtctcatggatacaactttggaagaagtctttcttaaagtctccgaagaagaccagtctctggaaaactcggaggcagatgttaaggagtcacggaaggacgtcctgcctggcgcagaaggaccggcatctggcgaggggcacgctggcaatctggcgcgttgctctgagctgacgcagagccaggcgtctttacagtccgcttcctctgtcggctctgctaggggtgatgagggggctggatatactgacgtgtatggagattaccggccattgttcgacaacccacaggaccccgacaacgtgtcactccaagaggttgaggccgaggcactctcccgggtcggccaaggaagtagaaagctggatggggggtggctgaaagtgcggcagtttcatggattactggtgaagagattccattgtgcccggcgcaactctaaagcacttttctcccagatccttcttcccgcattctttgtgtgcgtggcaatgaccgtggccctcagtgtgccagagattggtgatctgccacccctggtcctcagtccaagccagtatcataactacacccagccccgtgggaattttattccctacgcaaacgaggaacgccgggaatatcgtctgagattgagccctgacgcctcgccgcagcagctggtcagcacctttcgactgcccagcggggtcggcgcaacgtgcgtgctcaaatcccctgcgaatggctccttgggaccgaccttgaatctgtcatccggcgagagcaggctgctcgctgcgcgcttctttgatagtatgtgtctcgaatcatttacacaaggcctcccactcagcaattttgtgccgcctcccccctcccccgcaccaagtgacagccctgcttcacctgacgaggacctgcaggcatggaatgtgtctttaccacctaccgccggcccagaaatgtggacttccgccccttccctgcctcgattagtgcgtgaacctgtgcgctgtacttgcagcgcccagggcaccggatttagctgcccatcttccgtcggtggtcaccctccacagatgagagtagtgacaggcgatattttaacagatatcaccggacacaatgtctctgaatatctgctcttcacctctgacagattccgcctgcaccgatacggtgctattacatttggtaatgtcctgaagagcatacctgcctcattcggcacccgtgcacctcctatggttagaaagatcgcggtcaggagggccgcacaggttttctataacaataaaggttaccactcgatgccaacctatttaaacagcttgaataacgcaatactcagggctaatcttcctaagtctaagggcaatccggcagcatatggcattaccgttaccaaccaccctatgaacaaaacctctgcttccctcagtctcgactatctactacaggggactgacgttgttattgctattttcataatcgttgctatgtcttttgtaccggccagcttcgtcgtgttcctcgtggccgaaaagtccaccaaggccaagcacctacagttcgtatccgggtgcaatccaattatttattggctggcaaactacgtgtgggacatgttgaactacctggttcctgccacatgttgtgtcatcatacttttcgtcttcgatcttccagcttatacttctccgactaattttccggctgttctatcacttttcctcctttacggatggagcatcacacccatcatgtatcccgcctctttctggttcgaggtgcccagttccgcctatgtgtttctgattgtgattaatctcttcatcgggataacagcgacagttgctacttttttgttacagctgttcgagcatgacaaagacctgaaagtggttaattcttatctcaagtcatgctttctaattttccctaactacaacctgggtcatggcctaatggagatggcatacaacgaatacataaacgagtattatgcgaaaataggacaattcgataaaatgaagtcccccttcgaatgggacatcgtcactcgaggccttgtcgccatggcggtggagggcgtggtgggcttcctgctaaccatcatgtgccagtacaattttcttcgcaggccacagcgaatgcctgttagcacgaaacccgttgaagacgatgtggacgtggcatcggagcgtcagagggtgctgcgcggtgacgcagacaacgacatggtcaagattgagaatcttactaaagtctataagagtaggaaaatagggcggattctggcagtagacagactgtgcctcggagttaggcctggggaatgtttcggcttactcggggtgaacggggctggaaagacgagcacgttcaaaatgctgactggggatgagtcgacaacgggaggtgaggctttcgtgaatggacacagcgtactcaaagagctgcttcaggttcagcagtccctgggatactgtccacagtgtgacgccctattcgatgaactcacagctcgggagcacctgcaactatacacacgcctgcgtggaatctcttggaaggatgaggccagagtcgttaagtgggcactagaaaagctggaactgacaaaatatgcagacaagcctgcaggtacgtattctggaggcaataagcggaagctgtcaactgccattgcactcattgggtatcccgccttcatcttccttgacgagccaacgaccggcatggatcctaaggcccgcaggtttctttggaacttgatcctcgacctgattaaaacaggccggtccgttgttttgaccagtcatagcatggaggagtgcgaggcactgtgtacaagactagctatcatggttaacggcaggttacgctgtttaggcagtattcagcacctgaagaaccggtttggtgacggctacatgatcaccgttcggactaagtcgtcccagtctgtcaaggatgtcgtgcgtttctttaaccgaaacttcccagaagcaatgctcaaagaacgtcatcacactaaggtgcagtaccagctcaagtccgagcatatatccctcgctcaagttttctccaagatggagcaggtgagtggcgtgcttggcatcgaggattactccgtttcccagacaacacttgataatgtattcgttaattttgcaaagaagcaatcagataatctcgagcaacaggagaccgagcccccttccgctcttcaatcacctttgggatgcctcctcagtctattgcggccgcgttccgccccaactgagctgcgagcccttgttgcagatgagccagaggatctcgatacggaggatgaggggcttatcagcttcgaagaggaacgggctcagcttagttttaatactgatactttgtgttag

SEQ ID NO: 179951 - DNA, 7401 bp, Artificial Sequence
  Description of Artificial Sequence: Synthetic coding sequence
atgggccggaagaccagccgggtgcagcagggccccccccggagcccagcctgttccgcccatggagaaaggtcttgggggctagagtttccaccgttccggtggctcctgggcatcgcagggaggacacacctcgcagcactgccacccttccagtgggtcttggctttcgaaatcttcattcctctcgtgctgtttttcattctgttaggtctgaggcagaagaagcctactatctctgtaaaagaggttgcattctacaccgcagcccccttgacctcagcagggatcctgcctgtgatgcagagtctgtgccccgacgggcagcgggacgagttcgggttccttcagtatgccaactctactgttacccaattgctggagcgactggacagagttgtcgaagaaggcaatttgtttgatccagctcgaccttctttgggttccgagctggaagcactgaggcagcatctcgaggcgctgtcagcaggccccggaactagtggatctcatctggacaggagtactgtgtcgtccttcagtctggactccgtggcaagaaacccccaagaactctggcgtttcctgacacagaatctgtctctgcctaacagtaccgcccaagccctattagctgcccgggtggatccacctgaggtataccacctcctgtttggtcccagttccgcactggacagtcagtcaggccttcacaaagggcaggaaccctggagtcgcctgggtggcaatccactgttccggatggaagagctgctgctcgcaccagccctgctggaacagcttacttgtacccccgggtctggtgagctaggtcggatactgactgttcccgaatctcagaaaggcgcactccaaggttatcgggatgccgtgtgctcaggccaggcagccgcaagggcacggaggttcagtggattgagcgcagagctgcgtaatcagctcgacgtggctaaggtttcccaacagctgggactcgatgcccctaacgggtcagatagcagtccacaagctccacccccacggaggcttcaggccctcttgggagatctcctggacgcgcagaaggtgctgcaagacgtcgacgttctgagcgccctggccttgctgctgccccagggggcctgtacaggacggacccccggccccccagcttccggtgccggaggagcagccaacggaactggggccggggccgtcatggggcctaatgccactgcagaggagggcgctcccagcgcagccgcgctggctactcccgacacactgcagggccagtgctccgccttcgtgcagttatgggcgggccttcagcccattctgtgcgggaataaccgcaccatcgaaccagaagcccttcgaaggggcaacatgtcatcgctggggtttacatctaaagagcagcgcaacctgggactcctggtccatttgatgacctcaaacccaaaaatattatacgctccggccggaagcgaagtggatcgcgtaatcctgaaagccaatgaaacttttgcgtttgtggggaacgtaacgcactacgctcaagtttggcttaacattagcgcagaaattaggagtttcttggagcaaggtagattgcaacagcatctacgctggctccagcaatacgtggctgaactgcggcttcacccagaggccttgaatctctctcttgacgaacttccccctgctctgcgacaggacaacttcagcttaccatcaggaatggcgctgctccagcagttagacaccattgataatgctgcttgcggctggattcaattcatgagcaaagtctctgtggacatcttcaagggctttcatgacgaggaaagcattgtaaattatactttaaaccaggcgtaccaagataatgttacagtattcgcatcagtgatttttcagaccagaaaggacgggtctctgcctccccacgtgcattataagatccggcagaacagctcgtttactgaaaagacaaatgaaattaggagagcgtattggcggccggggcccaataccggcggcaggttttacttcctgtacggcttcgtgtggattcaggacatgatggaacgtgccatcatcgatacatttgtgggccacgacgttgtggagcctggctcctatgtacagatgttcccctacccttgttacacccgtgacgatttcctgttcgtaattgaacatatgatgccactgtgcatggtaatctcgtgggtgtacagtgtggctatgacgatccagcacatcgtagcagaaaaggaacaccgtctcaaagaggtgatgaaaactatgggtttgaacaatgctgtccactgggtcgcatggtttatcaccgggttcgtgcagttgtctatttccgtcacagcgttgaccgccatcctaaagtacggccaggtgctcatgcacagccacgtggtcatcatatggctttttctggcagtctacgccgttgccacaatcatgttctgcttcttggttagtgtgctgtactcaaaggctaagctcgcttctgcttgtggtggcataatatacttcctatcttacgtgccgtacatgtacgtggccatcagagaggaggtcgctcacgataaaatcacagcatttgaaaaatgtattgcttccctgatgtctaccacagcatttgggctgggttccaaatattttgctttatacgaggtcgccggtgtcggcattcagtggcatacattctcacagagtccagtcgagggcgacgacttcaaccttctcctcgcggttactatgctgatggtcgatgctgttgtttatggaattctgacttggtatattgaagcagttcaccccggtatgtacggcctccctagaccgtggtactttcccctccagaagtcgtattggcttggttctggacgcaccgaagcttgggaatggtcttggccttgggcccgcacaccccggctgtcagtgatggaggaggatcaagcctgcgccatggaatcacgccgcttcgaggagaccagaggaatggaagaggagcccacacacctgcccctcgtagtgtgtgtcgacaagttaactaaggtgtataaagatgataaaaagctcgcgctgaacaagctttctctcaacctctatgaaaatcaagtagtgtcatttctggggcataatggggctggcaagaccaccactatgtccattctgacgggcttgttccctcctacctccggctcggctacaatctacggccacgacattaggacagagatggatgagataagaaaaaacctcggaatgtgcccacagcataatgtgctttttgacagactcactgtggaagagcatttatggttctactctaggctaaagagcatggcccaggaggaaattcggcgagagatggacaagatgatcgaagatctggaactttctaataagaggcattcattagtccaaacactgagtggagggatgaagcgtaagttgtctgtagctatcgcctttgtgggaggaagcagggccattatcctcgatgaacctaccgctggagtggacccatatgcacgcagagctatctgggatctcatcctgaaatataaacctggccgtactattctcctaagcactcatcacatggacgaggctgacctattgggcgacaggattgcgatcatttcccacggtaaacttaagtgctgcgggtcccctctgttcttgaagggcacatatggtgatgggtaccggctcacgttggtgaagagaccagcagagccaggaggaccccaagagccagggctcgctagttccccaccggggagagcgcccctaagctcttgctccgaattgcaagtgtcacagtttatcaggaaacacgtcgcaagttgtttgttagtctctgatacatcgaccgaactcagctatattcttcctagcgaagccgccaaaaaaggcgctttcgagcgcctattccagcacctcgaaagatccctggatgcccttcacctgagctcctttggcctgatggacaccactttggaagaggtctttcttaaggtatcagaggaggaccaatccctggaaaatagcgaggccgatgtgaaggaaagccggaaggacgtcctcccaggtgctgaggggcccgccagtggggaaggccatgcaggaaacttagcaagatgcagtgagctcacgcagtcacaagccagtttacaaagcgcctctagtgttggatcggcgcgcggagatgagggggccggatataccgatgtttatggagattacaggcccctgttcgacaaccctcaggatcccgacaacgtgtcactgcaagaagttgaggcggaggccttgtcccgggttggtcaggggtcccgaaagctcgatggagggtggttgaaagtacggcagttccatggcctattggtgaagcgcttccactgtgccaggcgcaactctaaggcacttttctcccaaattctgctgcccgcattttttgtttgcgtggccatgaccgtagcactgtccgtgcccgagatcggcgatctgccgcctctcgttctatctccatcccagtaccataactatactcagcctagaggtaatttcattccctatgctaacgaagagaggagggaatacagattgcgcctgtctccggatgctagtcctcagcagctagtgagtacatttaggcttccttccggagtaggtgccacatgcgtcctgaaatctccggcaaacggtagcctcggaccaaccctcaatctgtcaagcggtgagagcagattgctcgcagctaggtttttcgactcaatgtgcttggagagtttcacacagggattacctctgtcgaacttcgtaccgcccccaccgagccccgctccttctgattcccccgctagtccagatgaagatctgcaagcctggaacgtgtctctcccaccaactgccggccccgagatgtggacctctgcccctagccttcctcggttggtgagggagcccgtgcgctgcacctgttccgctcaaggaaccggattttcctgcccctccagcgttggcgggcacccccctcaaatgcgcgtggttactggtgacatactgacagatataacaggtcataacgtgtccgagtatctgctgtttacatccgatcgctttagattacacaggtacggcgctataaccttcggcaatgtactgaagtctatcccagcaagtttcggcacccgggccccccccatggtgcgtaagattgctgtcagaagggcggcacaggtgttctataacaacaaaggttaccactcaatgccgacatacctgaattccttaaataacgctatactaagggcaaaccttccaaagagcaagggtaatcctgccgcttacggaatcactgtaactaaccatccgatgaacaagacctcagcgagcctgagtctggactacttattacagggaacagatgttgtcatcgctattttcatcatagtcgcgatgtcttttgtgccagcctctttcgtcgtgttcctggtcgctgaaaagagtacaaaggccaaacacttgcagtttgtttcgggctgcaatccaataatttactggctcgccaactacgtgtgggatatgttgaattatttggttcccgccacatgctgtgtaattatcctgttcgtgttcgacctccccgcttacacaagtcccacaaacttccctgctgtgttatctctgttcttactctatggatggagcatcacccccataatgtaccctgcgagcttttggtttgaagtgccgtcctctgcttatgtttttctgattgtcatcaacctgtttataggcattactgcaaccgtagctactttcctccttcagctgtttgagcacgacaaggatctgaaagtcgtcaatagttatcttaaatcctgctttctcatctttccaaattataatcttggccacgggttaatggagatggcttacaacgaatatattaacgagtattacgctaagattggtcaatttgacaagatgaaaagccccttcgaatgggacatcgtcacccgcggactggtggccatggcagtagagggcgttgtggggtttctattaaccattatgtgccagtataacttcctacggcgcccccaacgaatgccagtcagcactaaacccgtggaggacgatgtggatgtcgcgtccgaaagacagcgcgttctcaggggggacgcggacaacgatatggtgaaaatcgagaatctcactaaagtatataagagccggaaaattgggcggattctggcggtggacaggttgtgcctgggtgtgaggcctggagagtgctttgggctcctgggggtaaatggggccggcaagacctctacgtttaaaatgctcactggcgatgagtctaccacggggggagaggcctttgtgaatggccactcggtcctcaaagagctattacaggtgcagcagtccctgggatactgtcctcagtgtgacgcgcttttcgatgaactcacagccagagaacacctccaactctacactagattgagaggcatttcttggaaagacgaggcacgtgtcgtgaagtgggctctcgagaaactggagctgaccaaatatgccgataaaccggcaggaacctactcagggggaaacaagaggaaactgagtacagctatcgccctgattggctacccagccttcatctttcttgacgagcctactaccggaatggatcccaaagcaagacgatttttgtggaacctgatactagacctcatcaaaaccggtaggtccgtggtgttgaccagtcatagcatggaggagtgcgaagctctgtgtaccagattagccattatggtcaatggccgactgagatgtcttggatcaattcagcacctgaagaaccgctttggcgacggttatatgattactgttaggactaagtcctcacagtctgtcaaggatgtggtcaggttttttaaccgcaactttcctgaggccatgcttaaagaaaggcaccataccaaggtgcagtaccagcttaaatccgaacatattagtctggcccaagtgttctccaagatggagcaggtgagcggggtgctgggtatcgaggattacagtgtgagtcagaccaccttggacaacgtttttgtcaactttgctaagaaacaaagcgacaacttagagcagcaagagacagaaccgccctccgctctacagtcccctcttggctgccttttgagccttctgcggcctcgatctgctcctactgaactgcgagccctagtggcagatgagccagaagatctggacactgaggacgaggggcttatctccttcgaggaggagagagcccagctcagcttcaataccgataccctctgttag

SEQ ID NO: 179952 - DNA, 7308 bp, Artificial Sequence
  Description of Artificial Sequence: Synthetic coding sequence
atgggcttcctgcaccagctgcagctgctgctgtggaagaacgtgacactgaaacgaaggtccccgtgggtgctggccttcgagatttttatcccactggtccttttcttcatcctactcggactgaggcaaaaaaagccaacaatttctgtgaaggaggccttttacacagccgccccactgacttctgccggaatactgccggtgatgcagtccctttgtccagacggtcagcgggacgagttcggatttctccagtacgctaatagtactgttacacagctcctggaacggctggaccgcgtggttgaagaaggaaatttattcgatcccgcaagaccatctctgggcagcgagctagaggcactgcgacagcacctggaagcgctgtccgccggtcctggcaccagcgggtcacacttagatagatccaccgtgagttccttttcactcgattctgttgcaagaaacccacaagagctttggcggttcctcacccagaacctctcactgcctaattctaccgctcaggccctactggccgctagagtggacccccctgaggtgtatcatttactgttcggcccaagtagcgccctagacagccagtcagggctgcacaagggccaggagccatggtctaggcttggtggcaaccctttattcaggatggaggagctcctgcttgccccagctttactggagcagcttacctgcacccctgggtctggggagttgggccggatactgactgtgcccgagtctcagaagggggctttgcagggctaccgcgacgcggtgtgttccggccaggctgcagcgcgcgcgcgacgattcagcggattaagtgcggagctgcgaaaccaactcgacgtcgcaaaagtgtcccagcagctggggctcgatgcccctaacggctccgactcctccccccaggcgcctccccctcgcaggctgcaggctctattgggtgacctgttggatgcccagaaggtgctccaggacgttgacgttctatccgcactggctttgttgctgccgcagggcgcctgcaccgggcgcacaccgggcccacccgcgtccggtgccggcggagcagccaacgggactggtgctggggctgtgatgggccctaacgctactgctgaagaaggggccccatctgccgcagcacttgcgacccccgacaccctgcaggggcaatgcagcgcttttgttcagttgtgggctggactgcagccaatcttgtgtggcaacaataggaccatagaacctgaggctctccggcggggcaacatgagcagcctgggatttacctcaaaagagcagcggaacttgggactgctggttcacttgatgacatcaaatcccaagatcttgtatgcccctgccgggagtgaagtggatagggttatcttgaaggccaatgaaacttttgcgttcgtggggaacgtgactcactatgcccaggtatggcttaacatttcagctgagatacgatcatttctcgagcaggggaggcttcagcagcatctgagatggttgcaacagtacgtcgctgaattacgcctacaccccgaagcgctgaacctgtctctggatgaacttcctccagccttacggcaggacaacttttccctcccgagtgggatggcactgctgcagcagctggacacaatcgacaacgctgcttgtgggtggatacaattcatgagcaaagtgagtgttgacatttttaagggatttcacgatgaagaatccatcgtgaattatacactcaaccaagcttaccaggataatgttacagtctttgccagcgtgatattccagaccaggaaggatgggagcctcccccctcatgtgcactataaaatcagacagaactcttctttcaccgagaagaccaacgagattcggagagcttattggagacccggacccaataccggagggcgtttctacttcctctacggatttgtatggatccaggacatgatggagcgggccatcatcgataccttcgtggggcacgacgtcgtggaaccagggtcgtatgtccagatgttcccctacccctgttatacgcgggacgatttcctgttcgttattgagcacatgatgcctctgtgtatggtgattagctgggtgtattcagtcgccatgaccattcagcacatagtggcagagaaagagcataggctcaaggaggtgatgaaaacgatgggtctgaataacgctgtacactgggtcgcctggttcattacaggcttcgtgcaacttagtatcagtgtcacagctcttacagcgattctcaagtatggacaagtcttgatgcacagccacgtagtgatcatttggttgttcctggctgtgtacgccgtcgccacaatcatgttctgtttcctcgtgagtgtgctgtattccaaagcaaaactggcttccgcctgcggaggaatcatttattttctgagctacgtaccttatatgtacgtagccattcgggaggaagtcgctcacgacaagatcacggcttttgaaaagtgtatcgcatccttgatgtcgacgacggctttcggactcggctccaaatacttcgctctatacgaagttgctggagttggcattcagtggcatacgtttagtcagtctcccgtggaaggcgatgactttaacttactgctggccgtgacaatgttgatggtcgacgcagtggtttacggcatcttgacctggtatatcgaagccgtgcacccagggatgtacggcctgcctcgcccatggtactttcctctccagaagtcctattggctcgggagcgggcgcacggaagcatgggaatggagttggccatgggcccggacacctcggctgtcggtgatggaagaagaccaggcatgcgcaatggaatcacgcagatttgaagaaaccagagggatggaggaagaacccacgcaccttccactggttgtatgtgtggataaactcactaaggtttataaagatgataagaaactcgcactcaacaaactcagtctcaatctttatgaaaatcaagtagtgtctttccttggacataatggcgcaggcaagacaactactatgtcgattcttacaggtctttttcctccaaccagcgggtctgccaccatatacggacacgatatcagaaccgagatggatgaaatccgcaagaacctgggaatgtgcccccagcacaacgtcttgtttgacaggctgacagtggaggagcacctgtggttctattctcgtttgaagtcaatggctcaggaggagatccggcgggaaatggacaagatgattgaagatctcgaactgtctaacaagcggcattccctcgtgcagactctgtcggggggtatgaaaagaaagctcagtgttgcaatagcctttgtaggtggctcccgggcaatcatactggacgaaccgactgcaggagtggacccgtatgcgagacgtgccatatgggaccttattctgaaatacaagcctggtaggaccattcttcttagcactcatcatatggacgaagctgatctgctcggcgacaggattgctatcatctcacacgggaagttgaagtgctgcggtagccctctgttcctgaagggaacgtatggagatggataccgactcaccctagtaaaacgacctgcggagcctgggggcccccaggagcccggcctcgcaagctcccctcccggccgggccccactgagctcttgttctgaactgcaagttagccaattcatcagaaagcatgtggcttcatgtctgcttgtatccgacacctcaaccgaattgtcttacatcctgccaagcgaagctgccaagaaaggggcttttgagaggttgtttcaacacctggaacggtcactcgatgctcttcatctatcatcatttgggctgatggataccaccttagaggaggttttcttaaaggtctcggaagaggatcaaagcttggaaaatagcgaagccgatgttaaagagagccggaaggacgttcttcccggggcagagggtccagcatctggtgaaggccacgccgggaacctggccaggtgtagcgagcttacccagagccaggccagcctgcagtcggcctctagtgtgggcagtgcgaggggcgacgagggcgctgggtacacggatgtctatggggactatcgccccttgtttgataaccctcaggatccagataacgttagtctccaagaagtcgaagccgaggccctttccagagtcggccagggctcaagaaaattggacggcggttggttaaaagtgcggcagttccatgggctgcttgtgaagagattccactgtgccaggagaaactccaaagctcttttttctcaaatactactgcccgctttttttgtatgtgtagccatgacagtggccctatctgtgcctgagattggcgacctgccaccgctagtcctttcaccctctcagtaccataattatacacagccacgcgggaattttatcccatatgccaacgaggaacggcgtgagtatcgactgcgcctctctccagacgcctccccacagcagttagtctccacatttcgccttccatctggagtgggggccacatgtgtgcttaaatcgccagccaatgggtcactgggacctactttgaacctaagcagtggagaatctagactcctggccgctcgattttttgatagcatgtgcctcgagagcttcacccagggcctcccattgtccaatttcgttcccccgccacccagcccagcacccagcgatagccctgcttcaccagacgaggatctgcaggcttggaacgtgtcgttaccaccaacagctggccctgaaatgtggactagtgccccgagcctgccacgactggtcagggagcctgttcggtgtacctgctccgctcaggggacaggattctcatgtccatcaagcgttggtggccaccctccccagatgcgcgttgtcacaggagatattcttaccgacatcactggccacaatgtatctgagtatctgctttttacgtccgatcgattcagactgcaccgttacggagccatcacttttggcaacgtgttgaaatctatccctgcatcttttgggactcgcgcgccgccgatggtgcggaagatcgctgttaggagagcagcccaggtcttctataacaataaggggtaccacagtatgccgacttatctaaactctctcaacaacgccatcctgcgagccaatctaccaaaatctaagggaaatccagcagcctatggcattaccgttactaaccatccaatgaacaagacatccgccagcctctctctcgattaccttcttcaagggacagatgtcgtcattgccatctttattatcgtggcaatgagcttcgttccggcgtcattcgtcgtgttcctggtggccgaaaaaagcacaaaagcgaaacatctacagtttgtgtcaggttgtaaccccatcatctactggcttgcgaactacgtgtgggatatgcttaattacctggtgccagctacctgctgtgttattatcctgttcgtctttgacctcccagcttatacatctcctactaatttccctgccgttctgtcccttttcctgctgtacgggtggtccataacacctattatgtatccagcttcgttttggttcgaagtccctagttcagcctatgtcttccttatcgtcatcaatctcttcatcggtatcaccgctaccgtagcgacatttttgttgcagctgtttgaacatgataaggacttgaaggtcgtcaactcatacctgaagtcttgttttctgatcttcccaaattataacctaggccatggactcatggagatggcatataatgaatacatcaacgagtattatgctaagatcggtcagtttgataagatgaaaagcccctttgagtgggacattgtgacgcggggcttggtggcgatggctgtggagggagtggttggattcctgcttacaatcatgtgtcagtacaacttcctgaggaggcctcagcgcatgcctgtgagtaccaaaccggtggaggatgacgtagacgttgcctctgaaaggcagcgcgtccttaggggcgatgcagataacgatatggttaaaatcgaaaatctgactaaggtgtacaagtccagaaaaattggccggattcttgcagtggaccgtctctgtctaggtgtacggccaggcgaatgcttcggactgctcggagtgaatggggccggcaaaactagcaccttcaaaatgctcaccggcgacgagtccactacgggtggagaggcctttgtgaatggacactccgtgttaaaggaacttctgcaggttcaacagagcctcggctactgcccacagtgcgatgccttgtttgacgagcttacagctagggaacacctgcaattgtacacgagattacggggcatctcttggaaagatgaagcaagggtcgtcaaatgggctctggagaaactggaacttactaagtacgcagataaaccggctggaacctactccggagggaacaaacgtaagctgtccacagccattgctttaattggctatcccgcattcatattcctggatgaacctaccactggcatggaccccaaagcccgcaggtttctatggaatttaatcctggatcttattaaaaccgggaggtcagtggttctgacatctcattcgatggaggaatgtgaagccctctgtactagactggccatcatggtgaacggtcggttaagatgcctaggaagcatacaacacctgaagaataggtttggcgacggctacatgatcaccgtgaggacaaaatcctcccagtccgtcaaggatgtggtgcggttctttaatcgaaatttcccagaggctatgctgaaagagaggcatcatactaaggttcaatatcagctgaagtctgagcatatcagcctcgcccaggtgttctccaagatggaacaggtgtctggggtcttagggatcgaagattatagtgtttcacagacaacactcgacaacgttttcgtcaacttcgctaaaaagcaaagcgacaacctcgagcaacaggagacagaacctcctagtgcactacagtctcccctggggtgccttttgagcctgctcaggcctcggagtgctccaacagaattacgggcgttggtggcagacgagcctgaagacctagataccgaggatgaggggctgatatcatttgaggaagagcgcgcccaattgtctttcaacacagatacgctgtgttag

SEQ ID NO: 179953 - DNA, 591 bp, Artificial Sequence
  Description of Artificial Sequence: Synthetic coding sequence
atgctgaccggcgacgagagcaccaccggcggcgaggccttcgtgaacggacactccgtgctaaaggaacttctgcaggtgcagcagagcctggggtactgcccccagtgcgacgccttgttcgatgaactgaccgctagggagcatttacagctctacactcggttgcggggaatctcctggaaggatgaagctcgggtggtgaagtgggcactggaaaagctcgagttaactaaatatgccgacaagcctgctggaacttactctgggggaaataaacgaaaattgagtactgccattgcactcattggctatcctgctttcattttccttgatgagcccaccaccggtatggaccctaaagcacgccgtttcctgtggaacttaattctggacctgatcaaaaccggtaggagcgtcgtcctgacctctcacagtatggaagaatgtgaagcactgtgcactaggctggctattatggaacgatcccctgcagtgccgggtcagcaccccgctcctgaggagcccgtgtggcgttggctacatgatcatggtgcagatcaggagcagcccgaatgtgaaggacgctag

SEQ ID NO: 179954 - DNA, 5115 bp, Artificial Sequence
  Description of Artificial Sequence: Synthetic coding sequence
atggccgtgctgcggcagctggccctgctgctgtggaagaactacacactacagaagaggaaggtgcttgtcacagtgttggaacttttcttgcccctcttgttttctgggattttaatctggctccgattgaagatccagagcgagaatgtgccgaacgccacaatttaccctggccagagcatccaagaactacccctatttttcacatttccccccccaggcgacacatgggaactggcatatatccccagccactcggatgcagccaagactgtcacagagacagttcgaagggcgttggtgataaacatgagagtgagaggattccccagcgagaaagacttcgaagactacattcgatacgataactgctcttccagcgtactcgcagcagtggtgttcgagcatcctttcaaccacagtaaggaaccactgcccttggcggtcaaataccacctgcgcttcagttacacaaggagaaactacatgtggacgcagactgggtcattctttctcaaggaaacagagggatggcatacaaccagcttatttcctctatttccgaacccaggtcctagggaacctactagcccagatggaggcgaacctggctatatcagggagggcttcctggcagtgcagcacgcagtggatagagccattatggaatatcatgcggatgcagccacgaggcagctgtttcaacgacttacagttacaatcaagcgctttccatatccccccttcatcgctgaccccttcctagtggcaattcagtaccagctgcccttactgctgctgctttcattcacttatacagccttaactatcgcacgcgctgtggtccaggaaaaggagaggcgtttaaaggaatacatgaggatgatgggtttgtcaagctggctgcactggtcagcatggttcctcctctttttcctgtttctgctgattgcagctagctttatgactctgctgttctgtgtcaaggtaaaacccaacgtagctgtcttgtcccgcagtgacccaagccttgtgttggccttcctgctgtgcttcgctatcagtactatctctttttcttttatggtatcaacctttttttcaaaggcaaacatggccgctgcattcggggggtttttgtatttctttacatacattccctatttctttgtcgctccacggtataattggatgacattgagtcagaaattgtgttcctgcttactatctaacgtggcaatggctatgggggcccaacttattggaaaatttgaggctaagggtatgggtatccagtggcgcgacctgctctcgcctgtgaatgtggacgacgacttctgtttcggccaggtcttggggatgctacttctggattccgttctatacggcctggtcacgtggtatatggaggcggtattcccaggtcaatttggcgttccgcaaccctggtacttttttatcatgccgtcctactggtgcggaaagccaagggcggtagccggaaaggaggaggaggattctgacccggaaaaggctttaagaaatgaatacttcgaggccgaaccagaggatctggtggccggcatcaaaattaaacatttgtcgaaagtgtttagagtgggcaataaggatagagcagcagttcgggacctgaatctgaacctgtatgagggccaaattactgttttgttgggacacaatggcgcagggaagactaccacgttgagcatgctgactggactttttcctcctacttccggccgtgcctatataagtggatatgaaattagccaggacatggttcagatcaggaaaagtctcggattgtgtccccaacacgacatcctgttcgacaacctaactgtggcggagcacctgtacttctatgctcagcttaagggtctctcaagacaaaagtgcccggaagaggtcaaacagatgctccacattatcggactggaggacaagtggaacagcaggagtcgatttctgagcggtgggatgagacgtaagctctctattgggatcgctttgatagccggtagcaaagtgctcattttggacgagccaacctccggcatggatgccatttctaggcgcgccatctgggacctcctgcagagacaaaagtccgatcggactatcgtgctcaccacacacttcatggacgaggccgacttgctcggggacagaatcgctataatggctaaaggggagctgcagtgctgtgggtcttcactcttcctgaagcagaaatacggagctggatatcacatgactctcgttaaagagccgcactgtaatcccgaggacatctcacagctggtgcatcaccatgtgcctaacgctactctcgagagctctgccggcgcagaactgtcatttatactccctcgcgaatcaactcaccggttcgagggcttattcgcaaagttggagaagaagcagaaggagctaggaatcgcatctttcggtgcaagcatcactacaatggaagaagttttcctaagggtcggcaaactggttgactcctccatggacatccaggctatacagttacctgccctgcaataccagcacgagcggagagcctccgactgggcagtggattccaatctatgcggcgccatggacccgagcgatggaattggtgcactaatcgaggaggagagaacagctgtgaaactgaatacgggactggccctacactgccaacagttttgggccatgttcctgaaaaaggcagcatactcctggcgcgagtggaagatggtggcggcacaggtcctggtaccacttacgtgcgtgacactggctctgctggcgatcaactattcttcggagctgttcgacgatcccatgctacgattaacgctaggcgaatatgggagaacagtggtcccttttagtgtgcctggaacatcgcagttgggtcagcagctttctgaacatcttaaagatgctctgcaagccgaggggcaggagccaagggaggtgttgggagatctggaggagttcctcatttttagagccagtgtggagggtgggggattcaatgagaggtgtctggtggccgcatctttccgcgacgtgggagaacgaaccgtggtaaacgctctgttcaacaatcaggcctaccactctcccgccacagcactggccgtcgtagacaacctattgtttaagcttctgtgtgggcctcatgcctctatagttgttagcaatttccctcagccccggagtgcattacaagccgctaaggatcaatttaacgagggtagaaaaggcttcgacatagccctcaacctgttatttgcaatggcctttctggcaagtaccttcagcattctcgctgtcagtgaacgagcagtccaggcaaaacacgttcaattcgttagtggcgtgcacgtggctagtttttggctctctgcacttctgtgggacctgatctcctttctgataccgagcctgttgctgttggtggtcttcaaagcattcgacgttagagccttcactcgcgacggtcatatggctgatactctgctgctcctcctgctgtatgggtgggcaataattcctctgatgtatctgatgaactttttcttcctgggcgctgcaacggcttatacccgcctcaccatattcaatattctctccggcatcgctacctttctgatggtgaccatcatgcgcatcccggcagtgaaactggaagagctgagtaagacactggaccacgtgtttctggtgttgcccaaccattgtctgggaatggccgtgtccagtttctacgaaaattacgagacccgacgatattgcaccagtagcgaagtagctgctcactactgtaagaagtataacatccagtaccaggagaatttttacgcctggtccgctccaggcgtgggtcggtttgttgcaagtatggcagcatcaggctgcgcatacctgattcttctgtttttaatagaaactaacttactacagaggctcagaggcatattgtgtgcccttcgaaggaggaggaccctcaccgaactctatacgagaatgccggtactgcctgaggaccaagatgtagcagacgagagaacccggatcctcgctccgagcccggatagcctgctccataccccactgataataaaggaattgagcaaggtgtatgagcaaagagtgcctctcctcgcagtggataggcttagcctcgccgtccagaaaggcgaatgttttggactcttagggttcaatggcgccggtaagacgacgacgttcaagatgctgactggtgaggagtctctcacttcaggcgacgccttcgttggaggacaccggatcagtagcgacgttggaaaggtgcgacagagaatcggctattgtcctcaatttgatgccttgctagaccatatgaccggccgggaaatgctcgtaatgtacgctcggttgcgcgggattcccgaacggcatatcggtgcatgtgtcgagaacacactaagggggctgctcctggagccacacgccaacaaacttgtgcgcacatacagcggcggtaataagcggaagttaagcactggcattgccctgatcggcgaaccggccgtgatttttctcgatgaaccttccacgggcatggaccccgtcgcacggagactgctgtgggatacagtggcacgggcccgcgagagcggaaaagcaattataataacctcccactcaatggaagagtgcgaggctctgtgtacccggttggctatcatggtccagggtcagtttaagtgcctgggcagtcctcagcatttaaaatcaaagttcgggtcaggttattctttgcgagctaaagttcagtcagagggacagcaggaggctctggaagagtttaaggcgtttgtcgacctgaccttcccaggaagcgtgctggaagatgaacatcagggtatggtgcattatcatcttccaggccgtgatctctcttgggcaaaagtcttcgggatcctcgagaaagccaaggaaaagtatggcgtagatgattattctgtgtcccagatctctttggaacaggtcttcttgagttttgcacaccttcagcccccgaccgcagaggaaggtagatag

SEQ ID NO: 179955 - DNA, 5127 bp, Artificial Sequence
  Description of Artificial Sequence: Synthetic coding sequence
accgcccccccccccagccccagcctgcccctgcaggaccgggccgctactagcgcccacctcgccctctttaccctgtcctttcagagcacgttcttgctgtttcccgctggatgctcagcatatctgaatttgttacgcccaccaacttctctggccgccctaggcgtacccttttcaaagacaatggccgtgttacggcagctcgcacttctgttatggaaaaactacacactgcagaagcgtaaggtccttgtgacagtgcttgaactatttcttcctctcctcttttctggtattctaatctggctgcggctcaagatacaatccgagaatgtgcccaacgccaccatctaccccggccaatctattcaagaacttcccctcttttttacattcccaccacccggcgacacctgggaacttgcctacatcccatctcactctgatgccgcgaagaccgtgactgagaccgtacgcagggccttggtcatcaacatgcgtgttaggggattcccgagtgagaaggactttgaagattatattcggtacgataattgtagctcatctgtgttggccgccgttgttttcgagcaccccttcaaccatagcaaagagcccttgcctctcgccgtcaaataccacttgagattcagctatacaaggaggaattatatgtggacccaaaccggaagtttctttctgaaggagacagagggctggcatacgacctccttatttcctctttttcctaaccctgggcctcgggagcccactagtcccgacggcggagagccggggtatatcagagaggggttcctggccgtgcagcacgctgtggatcgtgccatcatggaatatcatgccgatgcagctactcgtcagctgtttcaacggctcactgtaacaataaagcgctttccttatccccccttcatcgcggatccattcctcgtcgccatccagtatcagctgcctctcctgcttcttttaagttttacttacaccgccctgaccattgcaagggcagtggtgcaagaaaaggagcgccgattaaaggagtatatgaggatgatgggcctgagctcgtggctccactggagcgcttggttcctcttatttttcctttttctgctgatcgcagcctcattcatgacgctcctcttctgtgtcaaggtcaaacccaatgttgctgtgctgtccaggtccgacccctcccttgtcttggccttcctcctgtgctttgccatatctactatttccttttccttcatggtcagcacatttttttccaagggcatggggattcagtggagagatctgctatcacctgtcaatgttgatgatgacttctgctttgggcaggtcctgggtatgctactgttggatagcgtcctgtacggactggtcacatggtacatggaagcagtctttcctggtcaattcggcgtgccgcagccttggtatttcttcatcatgccatcctactggtgcggcaagcctcgggccgttgcaggcaaggaggaggaggatagtgatccagaaaaagcactaaggaacgaatatttcgaagccgagcctgaagacttggtggcggggattaagatcaaacacttatccaaggtgtttagagtgggcaataaggaccgcgccgccgtccgcgatctgaaccttaacctgtatgagggtcagatcacagttctcctgggccacaatggagctgggaaaaccacaactctgtccatgctgaccggactgtttcccccgacctccggacgtgcgtacatctccggctacgaaattagccaggacatggtgcagatccgtaaatccctcgggctttgtccacagcatgacatcctctttgataatttaaccgtagctgagcatctgtacttttatgcacagctaaagggcttgagcagacagaaatgccccgaagaggtcaaacagatgctccatatcatcggactggaggataaatggaatagtaggagtagatttttatctggcgggatgcggcgcaaattatcgataggtattgctctgatcgcaggaagcaaagttctcattctagatgaaccaacttccggcatggatgccatcagcagaagggcaatttgggatttgctgcagcggcaaaagagtgatcgcaccattgtcctgaccacacacttcatggacgaagcagacctgctgggcgaccggatcgcaatcatggctaaaggtgaacttcagtgttgtgggagttccctattcctgaagcaaaagtacggggctggctatcacatgactctggttaaggaacctcactgcaaccccgaagacatcagtcagcttgtgcaccaccatgtccctaatgccaccctggaatcttccgccggtgccgagctctctttcatcctcccccgggagtcaactcaccgctttgagggacttttcgctaaactagagaaaaaacagaaggaattaggtattgccagtttcggagcaagtattactacgatggaggaggttttccttagagtggggaagctagtagactcgtcaatggacatccaagctatccagttaccggcactgcagtaccagcacgagcgtcgggctagcgattgggctgttgatagcaacctgtgtggagccatggacccctctgacggtataggggctcttatcgaggaggaaagaaccgcagtcaagttaaacactggcctcgcattacactgtcaacagttttgggcaatgtttctgaagaaggccgcctatagctggcgcgaatggaagatggtggccgctcaggtgctagtaccattgacttgcgtcacactggcactcttagctattaactacagttctgagctgttcgatgatcccatgctgcgcctgaccttaggagagtatggacggaccgtggtgccttttagcgtgccaggaacatctcagttgggtcagcaactgtccgagcacctgaaggacgcactgcaggcagaaggacaggaaccccgggaagtgctgggggatctcgaagagttcctgatcttccgggccagtgtagaaggaggcggatttaacgagcgatgcctagtggccgctagctttagggatgtaggagaacgtactgtggtgaacgccctgttcaataatcaggcataccactctcccgccaccgctttagcggtggtggataacctgctgtttaaactgctgtgtgggccacacgctagtatcgtggttagcaacttccctcagccaagatcagcactgcaggccgcaaaggaccaattcaacgagggtcgcaaaggattcgatattgccctcaatcttctgttcgcaatggcgtttctggcaagcacctttagcatcttggccgtcagcgagagggcagtgcaagcaaagcacgtccagttcgtatctggggttcatgtagcaagcttctggctgtcagctctactttgggatctcatatccttcctaattccgtccctgctgctgctggtcgtctttaaggcgttcgacgtgcgagccttcacgcgggatggtcatatggccgatacactgctgttacttctgctttatggatgggccatcataccactgatgtacctcatgaacttcttttttctgggcgccgccactgcatatactcgcctgacaatctttaacatactcagcgggatcgccactttcctcatggtgactatcatgaggatccctgcggtaaagctggaggaactctcgaaaactttggaccacgtcttcttggttctacctaaccactgtcttggtatggcagtaagctctttttatgaaaactatgagacacggcggtattgtacttcctcagaagttgctgctcattactgtaaaaaatataacattcaatatcaggaaaacttctatgcctggagcgctcccggggtgggtcggtttgttgctagtatggcagcatctggttgcgcttacctcatccttttatttctcatcgagacaaacttgttgcagaggctgcgaggaattctctgtgccctgaggcgccggcggactctgactgaactgtatacccggatgccagtactgccagaagaccaggatgtggcagacgagcgaactcgtatcctcgctccatcaccagactcactcctccacacaccactgattatcaaggagctgagcaaggtgtacgaacagcgcgtgccccttctcgccgtcgatcgtctctctctggcagtgcagaagggcgagtgctttggccttctaggattcaacggcgcggggaaaactactacattcaagatgctgacaggcgaggaatctctgacttccggggatgcctttgttggagggcacagaatttcatcggacgtcggtaaggtgcggcagcggattggatactgtccacagttcgacgccctgctcgatcatatgacaggacgggagatgctcgtaatgtacgctaggctgcggggcattcccgagcggcatattggagcatgcgtcgagaacactctcaggggcttgctcctcgagccacacgctaacaagctcgtacggacatattcaggcgggaacaagaggaaactgtccacagggatcgcactgatcggagagcccgcagtgatcttcctggatgagccctcaacaggaatggatcccgtcgcccgcagactcctgtgggacacagtggctcgggcccgcgaaagcggaaaggcaataatcatcacaagccacagcatggaagagtgcgaagctttgtgcacacgtctggcaataatggtgcagggccagttcaagtgcttgggatcccctcagcatctgaagagtaaatttggatccggatactctctgcgggcgaaggtgcagtcagaagggcagcaggaggccttggaggaattcaaggccttcgtggatctcacctttccgggctcagtgctggaagacgaacaccaggggatggtacactatcacctgcccggacgggacctctcctgggccaaagtgttcggaatccttgaaaaagctaaggagaagtatggagttgacgactactcagtgtcgcagatctcccttgagcaagtatttctgtcgtttgcccacctccagcctcccaccgctgaagaaggccgctag

SEQ ID NO: 179956 - DNA, 6822 bp, Artificial Sequence
  Description of Artificial Sequence: Synthetic coding sequence
atgggcttcgtgcggcagatccagctgctgctgtggaagaactggactctgcggaagaggcagaaaatccggttcgtcgtagagcttgtgtggccgctgtcactcttcttagttctgatttggctcaggaatgccaatcctctgtatagtcaccatgagtgccatttcccgaacaaggcaatgccatctgctggtatgttgccgtggctgcaggggattttctgcaatgtgaacaatccctgctttcagagccccacacctggcgaatccccaggcattgtgagtaattataataacagtattctggctagagtgtaccgcgatttccaagaattgctcatgaacgcacccgagagtcagcaccttgggaggatatggaccgagttgcatatactctctcagttcatggataccctgcgaacgcaccccgagagaatcgccggacgaggaataagaataagagatattctgaaagatgaggagacactaactctgttccttatcaaaaacatcggtctaagcgatagtgttgtttaccttctgattaatagccaggtcagacccgagcagttcgctcacggtgtgccagacctggccctgaaggacatcgcttgcagcgaggctttactcgaacgcttcattattttctcacaaaggagaggcgccaagacggtgagatacgccctttgcagcctgagccagggcacacttcagtggattgaggacacattatatgcaaacgtggacttctttaagctgtttcgcgtgctgccaactttactggactctagatctcagggcattaacctgcggtcctgggggggcattctctccgatatgtcccctagaattcaggaatttattcaccgcccttcgatgcaggatctgctgtgggtgacccgcccactgatgcagaacggcggtcccgagacatttaccaaactgatgggcattctgtctgacctgctgtgcgggtacccagaagggggaggatcacgggtccttagctttaactggtacgaggacaacaattataaagcatttctgggaatagacagcaccagaaaagacccgatttatagttacgacaggaggactacctctttctgcaatgctctaatacagagtttggagagcaacccacttacaaaaatagcatggcgggcggctaagccacttctgatggggaaaatcctgtatactccagactcgcccgctgcacggcgtattttgaaaaacgccaactccacattcgaagagctggagcatgttcgaaaattagtgaaagcctgggaggaggttggacctcagatttggtatttcttcgataactccacccaaatgaatatgattcgtgatactctgggtaatcccactgtaaaggattttctgaatagacaactgggggaggagggtatcacggctgaagcaatcctgaatttcctgtataagggtcctcgcgaatcgcaggccgatgacatggcgaactttgattggcgggacattttcaacataaccgaccgcacccttcgtctggtgaaccagtacctcgaatgcctggtgctagacaagtttgagagctacaatgatgagacccagctcacccagcgcgcactctccctgctggaggaaaatatgttctgggctggggtggtgttcccagatatgtacccttggaccagcagcttgccaccacatgtaaagtacaaaatccgcatggatattgacgtggtggaaaaaaccaataagatcaaagatagatactgggactccggaccaagggccgatcccgtggaagactttaggtacatctggggagggtttgcttaccttcaggacatggtagagcagggtattacgcgcagccaagtgcaggccgaagctcctgtcggaatttatctacagcaaatgccttatccatgtttcgtagacgatagttttatgatcattctgaacaggtgttttccaatttttatggtcttggcctggatctattctgtctccatgactgtaaagtcaatagtcctcgaaaaagagttaaggctgaaagaaacactgaagaaccagggcgtctccaacgccgtgatatggtgtacctggtttctggacagctttagtattatgagcatgtcaatttttctcctaaccattttcatcatgcatggccgtattctccactactccgatccatttatccttttcctgttcctgttggccttctctaccgctaccatcatgctgtgctttctgctttcgaccttcttctccaaggcatcccttgctgccgcatgttctggggtgatatacttcacactctatcttccccatattctttgcttcgcctggcaagatcggatgacagccgaactgaagaaagcggtgtcactgttgtctcccgtggcctttggatttggcactgagtatctcgtaagattcgaggaacaggggctgggacttcagtggagtaatattggcaatagtcctacggaaggcgatgaattttccttccttctgtctatgcagatgatgctcctcgacgccgcagtgtacggcctgcttgcatggtatcttgatcaagtcttccctggcgactatggcaccccactcccatggtatttccttttgcaagaatcctactggcttggaggggagggttgtagcaccagggaggagcgcgccttggaaaagacagaaccgctcacagaagagacagaggacccagagcacccagaaggcatacacgattctttttttgagcgagagcatcctggttgggttcctggagtgtgcgtcaagaatctcgtgaaaatattcgaaccctgcggacgcccagccgttgataggctgaacatcactttctatgagaatcagattaccgcctttttgggacacaacggagctggcaagacaacaaccttatctatcctcactggcctcttacccccaacaagcggcaccgttttggtggggggccgagacatagaaacatcgctggatgccgtccgacagtctctgggcatgtgcccacagcacaatatccttttccaccatctgactgtggcagagcacatgctcttttacgcgcagcttaaaggaaagagccaggaggaagcccagctggaaatggaggccatgctggaggacacaggactccatcacaagcgcaatgaggaagcgcaagaccttagtggaggaatgcaaaggaaactgagcgtagctatcgcatttgtgggagacgcaaaagtggttattctggacgagcccactagcggcgtggacccgtattcccgtcgcagtatatgggatctattgctgaaatatagatcaggcagaacaattattatgagcacccaccacatggacgaggccgatctactgggcgataggattgcgataatcgcacaggggaggctttactgctcgggcacaccactctttctgaaaaactgctttggaaccggactctacctgacattagtcaggaaaatgaagaacatacaatctcaacggaaaggaagcgaaggaacgtgtagctgtagttcgaagggattttctacaacctgtcccgctcacgtcgatgatcttaccccggagcaggtgctcgatggcgatgtaaacgagctcatggatgtagttctgcatcatgtgcctgaggcgaagctggttgagtgcatcggtcaggaattaatattcttgcttcctaacaagaacttcaaacaccgggcgtatgccagcctgtttagggagctggaagaaacactcgctgatttgggcctgtcttcctttgggatctccgacacaccactcgaggaaattttcctcaaggtgacagaggacagtgatagtggccccctcttcgccggcggggcccagcagaaacgagagaatgtgaatccgcgccatccttgtctcggcccacgagagaaggctggtcagacacctcaggactctaacgtttgttccccaggtgctcccgccgcacatcctgaaggccaaccgcctcctgagcctgagtgtccagggccacagctaaacacaggcacacagctggtgctgcaacacgttcaggcattgctcgtgaaacgtttccagcataccattcggagccacaaagactttctcgctcaaatcgtactgcccgctacctttgtgtttctagctctaatgttatccattgtcattccaccatttggagagtatccagccttgaccttacatccgtggatctacggacagcagtatacttttttcagcatggacgagccgggatccgaacagttcacggtgctggccgacgtacttttgaataagccaggcttcgggaaccgctgtctgaaagaaggttggctgcccgagtatccatgtgggaatagcaccccctggaagaccccatccgtgtctccaaatatcacacaactctttcagaagcagaagtggactcaagtcaatccaagtccctcctgccgatgctcaacacgagagaagctgaccatgctgccagaatgcccagagggggcaggaggccttcctccacctcaacgaacacaacgctcaacagaaatcttgcaggacctcacagaccgaaacattagtgactttctggtgaaaacatatccggctttgatcaggtcctccttgaagagcaagttttgggtcaatgaacagcgctacggtggtatctcaattggtggcaagttgccagtggtgccaattaccggggaggcccttgtgggtttcctatccgacttggggcgcattatgaacgtgagcggagggcccataacgcgggaggcttctaaggaaatacctgacttcttaaaacacctggagacagaagacaatattaaagtttggtttaacaataaaggatggcatgccctcgtgtccttcctcaatgttgctcataacgccatactgagggcgtccctccctaaggatcgaagcccagaggaatatggaatcactgtcatctcacaacctctaaatctgacaaaagagcaactttctgaaatcaccgtgctgaccacatctgtggacgctgtcgtggccatttgcgtaatcttcagtatgagcttcgtgcctgcctcatttgtcctgtatctaatacaggaaagagtcaacaagtcaaagcacctccagttcatctcaggagtgagccccactacatactgggtgactaatttcttgtgggacattatgaactatagcgtgtctgctggcctggtggtcggaatctttattggcttccagaaaaaagcttacacatcacctgaaaatctgcctgctttagtagcattactcctcctttatggatgggccgttattcccatgatgtaccctgcatctttcctgttcgacgtaccaagcaccgcctatgtcgcgctgagctgtgccaatctcttcataggtatcaacagttcagctatcacattcatccttgagctgtttgaaaataataggaccctgctgaggtttaatgcggtccttcggaagctcttgatcgtgttcccccatttttgtctgggcagagggttgatcgatctcgcgctgagtcaagccgtcacagacgtgtacgcccgtttcggagaagaacactctgctaatccgtttcactgggatctgattggcaagaatctgttcgccatggttgtggaaggagtggtgtacttcttgctgaccctcctggtgcagaggcatttctttctttctcagtggattgctgaaccgacgaaagaacctatcgttgacgaggacgatgacgtggccgaagaacgtcagcggattattactggcggaaataaaactgacattttgaggcttcacgagctcaccaaaatataccctggaacgtcgtccccagccgttgacaggctctgcgtgggagtgcgccccggagagtgctttggtttgctaggcgtgaatggagccgggaagaccactactttcaaaatgcttacgggtgataccaccgttacctctggtgacgccactgtcgctggcaagagcatcctcactaatatatccgaggtgcaccagaatatgggatattgtcctcagtttgacgccattgacgaactgctgaccggtcgggaacacctgtatctatatgctagactgaggggggtgcctgcagaggaaattgaaaaagtggctaattggagcataaagagtctgggcctcacagtctatgccgattgtctggcaggcacatattcaggaggaaacaaacggaagctgtccaccgccattgccctcatcggatgcccacccttagtcttactggacgagcccaccaccggcatggatccacaggcccggcggatgttgtggaacgtgatagtcagcattattcgggagggccgggcagtggtcctgacgagccattccatggaagaatgcgaagccttgtgtacacggctcgcaattatggttaaaggagcgtttcggtgcatggggacaattcagcacctgaagtctaagtttggagatggctacatcgtcactatgaaaatcaagagtcctaaagacgacctcttgccagatcttaaccctgtggagcagttttttcagggcaacttcccagggtccgtacagagggaacgacactacaacatgctgcaatttcaggtgagtagcagctcccttgcaaggatctttcaactgctcctctcccataaggattccctgcttatcgaagagtacagcgtgacacaaactacgctggatcaggtgttcgtgaactttgccaaacagcagacagagagtcatgaccttccactccatcccagagccgccggtgcctccaggcaggctcaggattag

SEQ ID NO: 179957 - DNA, 2940 bp, Artificial Sequence
  Description of Artificial Sequence: Synthetic coding sequence
atgggcttcgtgcggcagatccagctgctgctgtggaagaactggacattgagaaaaagacagaagatcaggttcgtggtagagctcgtatggccactgtcattgtttctggtactcatctggttgcgcaatgccaaccctctctattctcatcacgagtgtcattttccaaataaagccatgcccagtgccggaatgctgccttggcttcagggtatcttctgcaatgtgaataacccttgctttcagtcacccacgcctggcgaaagtcccgggatcgtcagcaattacaataatagcatcctagcaagggtgtatagggactttcaagaattactcatgaacgcgccagaatcacagcacttgggccgcatctggaccgagctccatatcctgagtcagtttatggacaccttgcgcactcaccctgagaggatcgctggccgtggcatccggatccgggacattctgaaagacgaagaaacattgactctcttcctcatcaagaacattggtctttctgactccgtagtgtatctcctgattaacagccaagttaggcctgagcagtttgctcacggagtacccgatctggccctcaaagacattgcgtgtagcgaggccttactggaacgtttcattattttcagccagcgaaggggagccaagactgttcgctacgccctgtgttcactcagccaggggactttgcagtggatcgaagacacattatatgctaacgtggacttttttaaactcttccgcgtgctgcccactctgctggattctcgttcccagggtatcaacctgagatcctgggggggaatcttgtcagacatgtcacctcgtattcaggaatttatccatcgaccctctatgcaagacttactgtgggtgacacgaccgctcatgcagaacggtggtccggaaacatttacaaagctgatggggatactcagcgacctcttgtgcgggtatcctgagggcggcggctctagagtgctgtctttcaactggtatgaagacaacaactacaaagcgtttctggggatcgacagcacaagaaaagaccctatatacagttacgaccgtagaaccacatctttctgtaacgcgttaattcaaagtctagaaagtaatcccctcacaaaaatcgcctggagagctgcgaagccacttcttatgggaaaaatcctgtatacacccgactctcccgcagcacgccgaatactgaaaaatgcaaattcaactttcgaggaattggagcacgtgcggaagctcgttaaggcttgggaagaagtcggcccgcagatctggtactttttcgataatagcacacagatgaatatgatccgtgatactctcggtaatcccaccgtaaaagatttcctgaatagacagctcggagaagagggcattaccgcagaagcgatcctgaactttctttacaagggacctcgggaatcccaagctgatgacatggctaactttgactggcgcgatattttcaacatcaccgatcggactctaagactggttaaccagtatttagagtgtctagttctggacaagttcgaaagctataacgatgagacacagctaactcagcgcgcactatctctgctggaggaaaacatgttttgggcgggcgttgtttttcccgatatgtacccttggactagttcacttccaccacacgtcaaatacaaaattcgcatggatatagacgttgtggagaagacgaataagatcaaggacaggtactgggacagtggtccccgagccgatccagtcgaggacttcagatacatttggggtggatttgcatacctgcaggatatggtggagcaaggcattactcggagccaggtgcaggctgaagccccggttgggatctatctgcaacagatgccgtacccatgctttgtagacgattctttcatgataatcctgaacaggtgttttcccattttcatggtattggcatggatttatagtgtgagcatgaccgtcaagagcatcgtcctggaaaaggagctccgactcaaggaaacattgaagaatcagggggtgtcaaacgccgtcatctggtgcacctggtttttggacagcttcagtattatgtctatgagcatcttcctgctcacaatcttcattatgtccttactgtctcctgtcgcatttggctttgggacagaatatcttgtgcgcttcgaggaacaaggtctcggcctgcagtggtctaatattgggaactcaccgacagaaggtgatgagtttagtttcctgcttagtatgcagatgatgcttttggacgctgctgtatatggtcttcttgcctggtaccttgaccaggtattccctggggactacgggacccccctgccttggtactttttgctgcaggaatcttattggttgggcggggagggatgttcgacacgggaagagcgcgcgctcgaaaaaaccgagcctttaaccgaggaaacagaggaccctgagcacccggaaggcatacatgattctttcttcgaaagggagcaccctggctgggttccaggcgtgtgtgttaagaacctggttaaaatctttgagccttgcgggcggccagccgtagaccggctcaacattacattctatgagaaccagatcaccgccttcctaggtcataatggtgcaggaaagacaacaacgttttccgcaggagctccactgtcctccaaaggtccagagaggcacttattacgaggcgagcatgggccaccgtggttcccaaaggagcaacagactcgcacatcacagggggccgcgaacccaagagacaccgtctttaaatctttcggcgagccacaggaggggactaccgcttgtacgccttgtgatgggatgtttagtcgggcagtacaatgcgagtggaacgttggacccgtccccttttag

SEQ ID NO: 179958 - DNA, 1179 bp, Artificial Sequence
  Description of Artificial Sequence: Synthetic coding sequence
atggtggtggagggcgtggtgtacttcctgctgaccctgctggtgcaacgccactttttcttatcacagtggatcgccgaaccaacaaaggaaccaattgttgatgaggacgatgatgtggccgaggaacgccagagaataattacggggggcaataaaactgatattttaaggctgcacgagctgactaaaatctaccctggcacctcatctcccgcagtggatcgtctgtgcgtgggcgtgcgtcccggcgagtgtttcggactgctcggagttaacggtgccggcaagaccacaacctttaagatgctcaccggggatacaaccgttacttccggggatgctactgtggctggcaaaagtatactcaccaacatatcagaggttcatcagaatatgggctactgcccacagtttgacgccatagacgagttgctgaccggtagggaacatctgtatctctacgcacgcctgaggggggtaccagccgaagaaatagaaaaggtggccaactggtccatcaagtcactgggcctgaccgtgtacgcagactgcctggcggggacctatagcgggggcaacaagcgcaagctcagtactgccatcgctttaattggatgccccccattggttcttctggatgaaccgacaactgggatggaccctcaggcacggcggatgctttggaatgtgattgttagcattattagggaggggcgtgccgtggtcctgacctcacactctatggaagagtgtgaggccctgtgcacaagactcgctataatggtgaagggcgctttccgatgcatgggcacgatccaacatctcaagtccaaattcggagacgggtatatcgtgactatgaagataaagtccccaaaggatgacttgttgcccgatctgaatcccgttgaacagttttttcaggggaacttcccaggttccgtccaaagggagcggcactataatatgctccagtttcaagtgtcatcgtcttccctcgcacggatctttcagttgctgctgtcacacaaagacagcttgctgatcgaggagtactccgtcacccaaaccaccttggatcaagtcttcgtgaactttgccaagcagcagacagagagtcatgatttacctctccatcctagggccgcaggggcttcaagacaggctcaagactag

SEQ ID NO: 179959 - DNA, 1632 bp, Artificial Sequence
  Description of Artificial Sequence: Synthetic coding sequence
atgatgatgaactacagcgtgagcgccggcctggtggtgggcatcttcattggctttcagaagaaggcatacacgagcccggaaaacttgcccgcccttgtggcgctgctcctgctctatggttgggcagtgataccaatgatgtatcctgcttcttttttattcgacgtgccatcaacagcctatgttgccctgagttgtgctaacttgttcatcggcattaacagtagcgcaattacgtttatcctggaactttttgaaaataaccgaactctcctcagattcaatgcagtacttcgaaaacttctgattgtgttcccccacttttgtttgggtcggggcctgatcgaccttgcgctctcccaggcagttacagacgtctacgcaaggtttggtgaagagcactcagctaacccttttcactgggatctgatcgggaagaatctgtttgccatggtggtcgaaggagtcgtctactttctgttaaccctgctggttcagcgccactttttcctgagtcaatggatagccgaacctacgaaagagccaattgtggatgaagacgacgacgtagccgaggaaagacagcgcataataacgggcggaaacaagaccgacatccttagattgcacgagctgaccaaaatttatccgggaacttccagcccagccgtggacaggctctgcgtcggggtgcgacctggggagtgcttcggccttctgggggtgaacggggctggaaagaccacaaccttcaaaatgctgactggcgatactactgtaactagtggagacgccactgttgcaggaaaaagcatcctgacaaacatctctgaggttcatcagaacatggggtactgcccacaattcgacgcaatcgatgaattattgactggaagagagcatctgtacctctacgcccgcctgcgtggggtgcctgcagaggagattgaaaaggttgcaaactggtccatcaagtcactgggcttgacagtgtatgccgattgcctagctggcacttacagcgggggcaacaaacgcaagctgtctaccgctatagctctaataggatgccccccactggtactgctggacgagccaacaaccggcatggaccctcaagctagaagaatgttgtggaacgtgatcgtctcaatcatccgagagggcagggccgtcgttcttacttcccacagtatggaggaatgcgaggcattatgtactcggctggccatcatggtcaaaggcgccttcagatgtatgggtacaatccagcacctgaaatctaagtttggggatggatacatcgtcaccatgaagatcaagagccccaaggacgaccttctgccagatctgaatcccgtagagcagttcttccagggcaacttccccgggagcgtacaaagagaacgacactataatatgttacagtttcaggtctcgtcatcatccttagctaggatcttccagctcctgttgtcccataaagacagcctcctaattgaggagtattctgtgacccagacaactttggaccaggttttcgtcaactttgccaaacaacagacggaatcccacgacctccctttacatccaagagccgctggtgcctctaggcaggcccaggattag

SEQ ID NO: 179960 - DNA, 3198 bp, Artificial Sequence
  Description of Artificial Sequence: Synthetic coding sequence
atggacgtggtgctgcaccacgtgcccgaggccaagctggtggagtgtataggacaggagctgatctttttactgccgaataaaaacttcaagcaccgagcctatgcctccttgtttcgggagctggaggaaaccctggctgaccttggcctctccagcttcggtatctctgacacaccactggaggaaatctttctgaaggtgacagaggattccgactcagggcctctctttgctggaggcgctcaacagaagcgggaaaacgtcaaccccaggcacccttgccttggaccgagagagaaagcagggcagaccccccaagattccaacgtctgcagcccgggggcccctgcagctcaccctgaaggacagccaccacccgagcctgaatgtccgggccctcagttgaacacaggtacgcagttggtgcttcagcacgttcaggctctcctggttaagcggttccagcacacaattaggtcccacaaggatttcttggcacagatcgtccttccagcaactttcgtgttcttggctctgatgctgagtatcgtcattccacctttcggggagtacccagccctcacgctgcacccctggatctacggccagcagtatacctttttttcaatggatgaaccgggatctgaacagtttaccgttctggccgacgtgttgctgaacaaaccggggttcggcaaccgttgcctcaaagagggctggctgccagagtacccctgtggcaactcaacgccttggaagactccctcagtgtctccgaatattacacagttattccagaaacagaagtggacccaagtcaatccgagccctagctgtcgatgctccacacgggagaagctcactatgcttccagagtgtcctgaaggcgccggaggcctccccccccctcagaggacacagcgaagcacagagatactgcaagaccttaccgatcgaaatattagcgacttcctcgtgaagacttacccagctctcatccggtcttcactgaagtctaagttctgggtgaatgagcagaggtacggaggtatcagcatcggaggcaagctccccgtggtcccaattaccggtgaggccctagtgggcttcctgagcgacctgggcagaattatgaacgtaagtggtggacccatcacacgggaggcaagtaaagagatccctgatttcctgaaacatctggaaaccgaagataatattaaagtgtggtttaacaataaagggtggcacgcactggtctcattcctgaacgtggctcataatgccatccttcgcgcatccttaccaaaagatcggagtcccgaagaatatggcataactgtgatatcccagcctttgaatctgacaaaagagcagttatccgaaataaccgtacttacaaccagtgtcgacgccgtcgttgccatttgcgtgatcttttctatgagcttcgtcccagcttccttcgtcctgtaccttattcaagaacgcgtgaacaagtctaagcatctgcagttcatttctggcgtttctccaacaacctactgggtcacgaacttcctttgggacatcatgaactactccgtgagtgctggactggtggtaggcatatttattggctttcagaaaaaggcatacacttctccggagaacctgcctgccctcgtagcgttacttctactctacgggtgggcagtgatacccatgatgtacccagcttctttcctgttcgatgtgcctagtactgcatacgtggctctgtcttgtgccaatctctttatcggaattaacagtagcgcaatcactttcattctggagctgttcgagaacaatcgaactctgctgagatttaatgcagtcctccgcaaattacttattgtgtttccccatttttgcctcggaagaggccttattgatctcgctttgagtcaggctgtgactgatgtttacgcccgctttggggaagaacacagcgccaaccctttccactgggacttgatcggcaaaaacctttttgcgatggtggtggaaggcgtggtatattttctgctcactctgcttgttcagcgacatttcttcctttctcaatggattgctgagcctacaaaggaacctattgttgacgaagatgacgacgtggccgaggagagacagcggatcatcacaggtggaaataaaaccgatattcttaggttacatgagttgacaaaaatctatccgggtacatcatcaccggctgtagacagattatgtgtgggagtcaggccgggggaatgttttgggctgcttggcgtcaacggcgcaggcaaaacaactacatttaaaatgctgactggggatacgaccgtaacttctggcgacgctactgttgccggtaagagcatccttaccaatatatctgaggtgcatcaaaatatgggatattgtccgcaattcgacgcgattgacgaactgctgacaggacgagaacacctctacttatacgccaggctccgtggcgttccggccgaggaaatcgaaaaggtggcgaattggagcataaaatcgttaggcctgacggtgtacgccgattgtcttgcgggaacctattccggtggcaacaaacggaagttgtcaacagccatcgctctcatcggctgcccccccctggttctactggatgagcctaccacaggcatggatccacaggcccggaggatgctgtggaacgtgatagtgtcaatcataagggagggcagagccgtggtgctgacgtcccactccatggaggagtgcgaagccctctgtacacgcctcgcgatcatggtgaaaggtgcattccgctgtatgggcacaatccagcatctgaaatctaagttcggtgatgggtacatcgtgaccatgaagatcaagagtccaaaagatgatcttctcccagatttgaaccccgtagagcagttcttccagggaaatttccctgggagtgtccaaagggagcggcattacaacatgcttcaatttcaggtgtcttcgtcttccctggcccggatcttccagctgttactaagccacaaagactctctcctgatcgaagaatactcagttacacaaacaaccttagatcaggtgttcgttaacttcgctaagcagcagacagagagccatgacctcccactgcatccaagggccgccggtgcatctaggcaggcccaagattag

SEQ ID NO: 179961 - DNA, 4929 bp, Artificial Sequence
  Description of Artificial Sequence: Synthetic coding sequence
atgagcaccgccatccgggaggtgggcgtgtggcggcagacccggaccttactgctgaagaattatctgatcaaatgtcggacaaagaagagttccgtccaggaaattctctttcctctgttcttcttgttctggttgatcctgatatcaatgatgcatcctaataaaaagtacgaggaagtaccaaatatagaactcaatcccatggacaagttcacactctcaaatctcatcctcggctataccccagttactaatattacatcttctatcatgcagaaggtctctaccgaccacttgcctgacgtcatcatcacagaggagtacacaaatgagaaagagatgctcacaagctctctctctaaacccagcaacttcgtgggcgtagtgttcaaggatagcatgagctacgaactgcgtttcttcccggatatgattcctgtgtcatctatttatatggattctcgcgcaggatgttccaagtcatgcgaggctgctcagtactggagcagcggctttacagtgctgcaggcctctatcgatgcagccattatccagttgaaaacaaacgtcagcctttggaaggagctggaatcgacaaaagcggtgatcatgggagaaactgctgtggtggaaattgatacctttccacgaggcgtcattctgatataccttgttattgcttttagcccgtttggctatttcctggccatccatatcgtcgccgagaaagagaaaaagatcaaggagttcctcaaaatcatgggcctgcatgatacagccttttggctcagctgggttttgctctacacctcactgatcttcctgatgtctttgctaatggcagtcattgctactgcctctctgctttttccccagagcagctctattgtcatatttcttttattcttcctgtacgggctgtcgtcagtgtttttcgctctgatgctcacacctctcttcaaaaagagtaagcacgtgggcattgtggagttctttgtgactgttgccttcgggttcattggtctgatgattatcctgattgagtcctttccgaaatccttggtgtggctgttttcgcctttctgccactgcaccttcgttatcggcatagcccaggtgatgcacttagaggacttcaatgaaggtgctagtttctccaacctgactgccggaccttaccccttgataatcaccatcattatgcttaccctgaactccatattttacgtcttgctcgcagtctatcttgatcaagtcatacccggagaattcggactgcggagatcaagcctgtatttcctcaagcccagttattggtctaagtccaaacgaaattacgaggagctatccgaaggaaacgtcaatggcaatatcagtttctccgagatcatcgaaccagtgtcaagcgaatttgtgggcaaggaggcgatccggatctcgggaatccagaagacgtatcgtaaaaagggggagaatgtagaggcccttagaaacttgtctttcgatatctacgagggccagattaccgctcttctgggacatagcggtactggcaaatcaactctgatgaatatattatgcgggctttgcccaccttctgacggttttgcgtccatttacgggcatcgagtgtccgagatagacgaaatgttcgaagctcgcaaaatgatcggcatctgtccgcaactcgacatccactttgacgtgctcacagtcgaggaaaatcttagcatcctcgcctctatcaagggcataccagccaataatatcatacaggaagtgcagaaggttcttctggacctggacatgcagactattaaggataatcaagcaaagaaactgtctggcgggcagaaaagaaaactcagtctgggaattgccgtgcttggcaatcccaagatcctcctactggatgaaccaacagccgggatggacccgtgttcacggcacatcgtttggaacctgctgaaatatagaaaggctaaccgggtcaccgtattcagtacccacttcatggacgaggcagacatattggcagatcgcaaagccgtgatcagccaggggatgctgaaatgtgtggggtcatcaatgtttctgaagtcaaagtggggtattggttacaggttgtcaatgtatatcgacaagtattgcgcaacggaaagcctgtcaagcctggtgaaacagcatataccaggagctactctgcttcagcagaatgatcagcaactggtgtatagcctgccgtttaaggatatggacaagttttctggactcttttctgccttagatagtcattctaacttgggggttatcagctacggggttagcatgaccacattggaggacgtattccttaagctggaggtagaggccgaaatcgaccaggccgactactctgtgtttacacagcagcctctggaggaagaaatggatagtaaatcctttgatgagatggaacagtccctgttaatcctgtccgaaaccaaggctgccctagtgagcactatgagcctgtggaaacagcagatgtataccatcgctaagtttcatttttttacattaaaaagggagtctaaaagtgtgcgaagcgtgctcctgctgctcttgattttttttactgtgcagatatttatgttcttggtccaccacagcttcaaaaatgccgtcgtaccaattaaactggtgcctgatctatattttctgaaacctggagataagcctcacaaatacaagacctcacttcttttacagaactcggcagactccgacatcagcgatctcatcagtttctttacctctcagaatatcatggtcacaatgattaacgatagtgactacgtcagcgtggcacctcactcagccgccctgaacgtgatgcactctgaaaaagattatgttttcgcggccgtattcaattcgacaatggtgtatagcctgcctatcctcgtcaatatcatctccaactattatctataccatctaaatgtgaccgaaacaatccagatttggtctaccccgttctttcaggaaatcacagacatagtttttaagatcgaactttactttcaggctgctttgctggggattatcgttaccgcaatgcccccgtacttcgcaatggagaatgcggaaaatcataaaattaaggcttatactcaactgaaactgagtggcctactcccttcggcttactggataggacaggccgtggttgatatcccactgtttttcattatcctgattcttatgctgggctctctgctggcattccactatggattatacttctacacagtaaagttcctggccgtggtgttctgcctcataggctatgttccctctgtgatcctctttacttatatcgccagcttcacttttaagaaaattttaaataccaaagaattttggtcgttcatctacagcgtcgcagccctggcgtgcattgccattacagagattaccttttttatgggttacaccattgctactattcttcattatgccttctgtatcatcatccctatctaccccctattgggatgtctaatatccttcatcaagatttcttggaaaaacgtgcgcaagaacgtcgacacctataacccttgggatcgtctgtctgtggcagtgatcagtccttacctccagtgcgtattgtggatatttttgctccagtattacgaaaaaaaatacggcgggcggagtatacgcaaagaccccttttttagaaacctaagcaccaagtcgaagaatagaaagctcccagagccccccgataacgaggatgaagatgaggacgtcaaagccgaaagacttaaagtcaaagagctgatggggtgtcaatgctgtgaagagaagccctccattatggtcagtaatctgcacaaagagtacgatgacaagaaagacttccttctgagcagaaaggtgaagaaagtggcaacaaagtatatcagcttctgcgtgaagaagggcgaaatcctgggcttgcttgggccaaatggggcgggcaagagcactattattaacattttggtcggcgacatcgaacctacatcaggccaggtgttcctcggggactactcatccgaaacctccgaggacgatgactccctgaaatgcatgggctactgcccccaaatcaaccccctgtggcctgatactactttgcaagagcactttgagatttacggggctgtgaaaggcatgagcgccagtgacatgaaagaagtgatctctagaatcacccacgcactggatctcaaagagcatttgcaaaagacagtgaaaaaactgccggccggtatcaagagaaagctgtgttttgccctgagtatgctgggcaatccacaaatcacgctcctggacgagcccagtacaggtatggatcctaaagctaagcaacatatgtggagagcaatccgcacagcgtttaaaaacagaaagcgcgccgccattctgacgacacactatatggaggaagcggaagccgtgtgtgatcgcgtggctattatggtctccggtcagctgcgatgtataggaacggtgcagcacctaaaatctaagtttggcaagggatatttcctggagattaaactaaaggattggatagagaaccttgaagttgatcggctgcagagggaaatccagtacattttcccgaatgcatcgcgtcaggagagcttttccagcattctggcttacaaaatccccaaggaggatgtccagtccctgtctcaatcctttttcaagctcgaagaggcgaaacacgcatttgccatcgaggagtactctttcagccaggccacactggagcaggtgtttgtggagctgaccaaggaacaggaggaggaggacaattcatgtggtactctgaatagcacactttggtgggaacgaactcaggaggatagggtggtcttttag

SEQ ID NO: 179962 - DNA, 4932 bp, Artificial Sequence
  Description of Artificial Sequence: Synthetic coding sequence
atgagcaccgccatccgggaggtgggcgtgtggcggcagacccggaccctgttactgaagaactatctcattaaatgccgcacaaaaaaaagttcagtgcaagaaattttgttcccgctgttcttcctcttttggctgatcctgatctcgatgatgcaccccaataaaaagtatgaagaggtgcccaatattgaactgaacccaatggacaagtttacattaagcaatctgatcctgggatacacccctgtcaccaatattacttcttcgataatgcaaaaggtgtctaccgaccacctccctgatgttattataactgaggaatatactaacgagaaagagatgcttacttctagcctgtccaaaccttccaatttcgtgggggtggtcttcaaggattccatgtcctatgagctacgctttttcccggacatgatccctgttagttccatatacatggattccagagccggctgttctaaatcatgcgaggcggcacagtactggtcttcaggctttacggttctgcaggctagcattgatgccgctatcatccaactaaagacaaatgtcagcctctggaaggaattggagtcaactaaggcggtgataatgggtgagacagctgtggtggagatcgatacatttccccgcggagtgatcctaatttacttggtgatagcttttagcccattcgggtacttcttggccattcacattgttgcagagaaggaaaaaaaaatcaaggagtttctgaaaatcatgggcctccatgacacggctttctggttatcttgggtgctactctatacatcattgatcttcctgatgtctctcctaatggccgtgattgctacggccagtctgctgttcccacaatcatcatccatcgttatcttcctgttgttctttctgtatggactcagttcagtcttttttgctctgatgttgacacccttatttaagaagagcaagcatgtggggatcgtggagttcttcgtcaccgttgcattcggatttattggattgatgatcatactgattgagagcttcccaaaatcgctggtttggctgttctcacccttttgccactgcacatttgtgattggcatcgcccaggtgatgcacctggaggacttcaacgaaggagcctcattctcgaacttgactgcaggcccgtacccactaatcataaccatcatcatgctgaccctcaactctatattttacgtgctgttagcagtctacctggaccaggtcatccccggagagttcggattaaggaggagctccctctatttcctcaagccatcatattggtccaaaagtaaacgcaattatgaggaactgagcgaaggtaatgtaaacggaaacataagcttctccgaaatcatcgaacctgtgagctccgaattcgtcggcaaagaagccattcggattagcggcatacaaaaaacttataggaaaaagggggagaacgtggaagccttgagaaacctgtcgttcgacatctacgagggccagataaccgcattgttaggccattcgggcacaggtaagagcaccctgatgaatatcctgtgtggtttatgccctccttctgacgggtttgctagtatctacggccaccgggtgtcagaaatagatgaaatgttcgaggcacgcaaaatgatcgggatttgtccacaactggacatccacttcgacgtgttaacggtggaggagaacctgtcaatcctcgcaagtattaaagggatccctgctaacaatattattcaggaggttcagaaagtacttttggatctagacatgcagaccataaaggacaaccaagccaagaagttgagcgggggccagaagcggaagctgtcactcggaatcgcagtgctggggaacccaaagattcttcttttagacgaaccaacggcaggtatggatccctgctcccgtcacatcgtttggaacctccttaagtataggaaggcaaaccgagtgacagtgttctcgacccattttatggacgaggccgatatcctcgccgatagaaaagccgtcatttcacagggtatgttgaagtgtgtagggagcagcatgtttctcaagagcaaatggggaatcgggtatagattgagcatgtatattgataaatattgcgccactgaaagcctttcctcattagtcaagcagcacattccaggcgccacgcttctccagcagaacgatcagcagctggtgtacagcctgcctttcaaggatatggataagttcagcgggctttttagcgctttggatagtcattccaaccttggagtgattagctacggggtctctatgacaactctagaggacgtttttctgaagctggaggtcgaggctgagatcgaccaggctgactactctgtgttcacacagcaacccttagaagaggagatggattctaagtccttcgatgagatggaacagtcattacttattctgtccgagacaaaagctgcgctggtttccaccatgtccctctggaagcagcagatgtatactatcgcaaagtttcattttttcacactcaagcgtgagtctaagtctgtgcgatcagtgctcctactgctgctgatcttttttaccgtgcagatcttcatgttcctggtacaccactctttcaaaaacgctgttgtgcccatcaaactggttccagatttatacttcttgaagcctggagataagccccacaaatacaaaaccagtcttctgctgcagaactccgctgccgacagtgatattagcgatcttatctctttctttactagccaaaatataatggttaccatgatcaatgacagcgattacgtgagcgtcgccccccatagcgcggcactgaacgtcatgcacagcgagaaggactacgtctttgccgcagtctttaactcaactatggtgtacagccttccaattctagtgaacataatctcgaattattacctgtaccacctcaacgtaacagagaccattcagatctggtcaacccctttctttcaagagatcactgatattgtatttaaaatagagctttacttccaagccgcgctcctcggaattatcgttaccgccatgcctccatactttgccatggaaaatgctgaaaaccacaaaattaaagcctacacacagctgaagctcagtggccttctaccaagcgcctattggatcgggcaggctgttgttgatatccctctgttcttcattatcttaatacttatgctcgggtcgctgctggcgtttcactatggactctatttctacacagtcaagtttcttgcagtagtgttttgtttgatcggttatgttccaagcgtgatcctgtttacatatatcgctagctttacatttaagaaaatattgaatactaaagagttctggtcattcatctactccgtggctgcactggcatgtattgccataaccgaaattaccttttttatggggtacactatcgccaccatactccactacgctttttgtatcattatccccatctacccccttcttgggtgtctcatatcattcatcaaaatttcctggaaaaacgtcagaaagaatgtcgacacctacaatccttgggacaggctcagcgtggcagtcatcagtccttacctccagtgcgttctttggatttttttgctgcagtattatgagaaaaagtacggcggacgtagtatcaggaaagacccgtttttcaggaatctaagcaccaagagtaagaaccggaagctccccgagccgccagacaatgaagacgaggatgaggacgttaaggccgagcggctaaaagtaaaggagcttatgggctgtcaatgttgcgaggagaagccatcaatcatggtatcgaacctccataaggaatatgacgacaagaaagatttcctgctcagcaggaaggttaaaaaagtggccacaaagtacatttctttttgtgttaaaaagggagaaatcctgggactgctgggacccaacggtgcaggtaagtccacaatcataaacattctggtcggtgacattgaaccaacgtctggacaggtgtttcttggggattattcctcagagacctctgaagacgacgacagcctgaaatgcatgggatattgcccacagattaaccccttatggcccgatactacacttcaggaacattttgagatctacggcgccgttaaaggcatgagcgccagtgatatgaaagaggtaattagcaggatcacccacgctctcgatctgaaagaacacttacagaaaacggtcaagaagctgcccgctgggattaagcggaaactatgcttcgccctgtccatgttgggcaacccccaaattacgctgctggatgagcctagtacaggaatggatcctaaagcaaagcagcatatgtggagagctatccggaccgcattcaagaaccgtaagagagctgcaatccttacaactcactatatggaagaggcagaggcggtttgcgatcgtgttgctattatggtgagcgggcaattgcggtgcattgggaccgttcagcacctgaaatccaaattcggaaaagggtacttcctggaaattaagctgaaggactggatcgagaatctagaggtggatagactgcagagagagatccaatatatcttccctaacgcctcccgccaggaatccttttccagtatcctggcctataaaatcccaaaggaagatgtgcaaagcctgagtcagtcgtttttcaaactggaggaggctaagcatgcttttgccatagaggagtattccttcagtcaggccaccctggagcaagtattcgtcgagttgactaaagaacaagaggaggaggacaactcctgtgggacgctaaatagtaccttgtggtgggaaagaacacaggaggatcgggtcgtattttag

SEQ ID NO: 179963 - DNA, 4854 bp, Artificial Sequence
  Description of Artificial Sequence: Synthetic coding sequence
atgaacatgaagcagaagagcgtgtaccagcagaccaaggccctgctttgcaaaaactttctgaagaagtggagaatgaagagagagtccctgctcgaatggggcctaagcatccttctgggcctctgtattgctctgttcagctcctctatgaggaacgttcagttccctggcatggccccccagaatctcggcagagttgataagttcaacagtagcagcttgatggtagtatacactccgatcagcaatttgacccagcagataatgaacaaaacagcgctagcacccttgctgaaagggacaagcgtcatcggggccccgaacaagactcatatggacgagatcctgcttgaaaatcttccctatgcaatggggattatcttcaatgaaaccttttcctacaaactgatcttctttcaggggtacaattctcccttgtggaaagaagacttcagcgcccattgctgggatggctatggtgaattcagctgtaccttgacaaagtactggaacaggggattcgttgccctgcagacagctatcaatacagccatcatcgagatcaccacaaaccacccagtcatggaagagcttatgtccgtcactgctataactatgaagactttgccttttattacaaagaatcttctgcacaatgagatgttcattctgttcttcctcctgcacttctctcctcttgtatatttcatttcgctcaacgtgaccaaggaaagaaagaaaagcaagaatctgatgaagatgatgggattgcaggatagtgccttttggttgtcctgggggctgatctatgccggctttattttcatcatttctatctttgtgacgatcattatcacatttacacagataatcgtcatgacaggatttatggtgattttcatcctgttctttttatatggactgtctctcgtggccttggtctttcttatgtctgtcctgctaaagaaggcagtccttacaaacctggtggttttccttcttacgctcttctggggctgtctaggattcaccgtgttctacgaacagttgccttcttctttggaatggattctgaacatctgctcacctttcgctttcactacaggaatgatacaaatcataaagctggattataacttgaatggggtgattttccccgacccctctggagattcttacaccatgatcgcgaccttttcaatgctcctgctcgatggcctcatatatttactgctcgctctgtattttgacaaaatcctcccatacggggatgagagacactatagcccattgttctttcttaacagctcaagctgcttccagcatcagcgcaccaacgctaaagttatagagaaagaaatcgacgcagagcacccttcagatgattatttcgagccagttgcaccagaatttcagggtaaagaggcgatccgcatccgcaacgttaaaaaggaatacaaaggtaagagcgggaaagttgaggctctcaaggggctgctgttcgatatctatgagggccagattacagctatcttgggccacagcggagcaggcaaatcctcccttttgaatattctgaacggactgagcgtgccaacggaggggagtgtgaccatttacaataaaaacctgtccgagatgcaggatctggaagagatcagaaagatcacaggggtctgcccccagtttaacgtacagttcgacattctcactgtcaaggagaacctgtccttatttgcgaagattaaagggatccacctgaaggaggtggagcaggaggtgcagcggattttactagagctggatatgcaaaacatccaggacaatcttgcaaaacatctttccgagggacagaaacgtaagcttacctttgggatcacaatattgggcgatccccaaatcctgctgctggatgaaccaacgaccgggctcgacccgttctcacgcgatcaggtgtggtctcttctgcgcgagagacgggcagaccacgttattttgttctcaactcagtccatggacgaggccgacatcctcgctgatcgaaaggtgattatgtccaacggccgcctcaagtgcgcagggagctcaatgttcctgaaaagaagatggggactcgggtaccacttatcactgcacagaaatgagatttgtaaccccgaacagatcacgtcctttattacacaccatatacccgatgctaagttgaagactgagaataaagagaaactcgtctacacccttccactcgagaggactaacacctttccggacttgttctctgacctggacaagtgcagtgaccagggggtgaccgggtacgatatctccatgtctactctaaacgaagtattcatgaaattggaggggcagagcaccatcgagcaggactttgaacaagtcgaaatgatacgagatagcgaaagcctgaacgagatggagctagcccactcctccttctcagagatgcagaccgccgtcagtgatatgggattgtggagaatgcaggttttcgccatggccagactcagatttctgaaattgaagcgccaaactaaggtactcctgactcttctcctggtattcggaattgctatttttccattgattgtggagaatatcatgtacgccatgttgaacgagaaaatagattgggagttcaaaaacgaactgtacttccttagtcccgggcagctcccacaggagccacgaacctcactgctgataatcaataatacggagtccaatattgaagatttcatcaagagtctgaaacaccagaatatattactggaggttgatgattttgaaaaccggaatggaacagacggtctgagttataatggggcaataatcgtatcaggtaagcagaaggactatagattcagcgttgtctgtaatactaaacggttgcactgcttccctatcttaatgaacatcatcagcaatggcctcctgcagatgttcaaccacacacagcacattcggattgaatcgtcaccattcccactaagccatattgggctctggacagggttgcccgacggctcattcttcctgttcctcgtgctgtgctctatctctccctacattactatgggaagtattagtgactacaagaaaaacgctaagagtcagctgtggatctctgggctctatacctctgcctattggtgcggccaggcactggtggatgtgagcttctttattctgatactcttattaatgtacctgattttctatatagagaatatgcagtatctgctgataacaagccagatagtgtttgctcttgtgattgttacccccggctacgccgcaagcctggtattttttatatatatgatttccttcatttttaggaaacgacgcaagaactccgggctctggagcttctactttttcttcgcatccactattatgtttagcatcaccctgatcaaccactttgatctgtccattctcattaccacaatggtgttggtgccgagctacaccctgctgggcttcaaaacgttcttagaggttagagaccaagagcactatagagaatttcccgaagccaatttcgaactgagcgctaccgatttcctggtgtgctttatcccatactttcagacactgctgttcgtctttgttctcaggtgcatggagctgaaatgcggaaagaagcgcatgcgcaaggacccggtctttagaatctcgccccagtcgagggacgccaagcctaaccctgaagaacccattgatgaagacgaggacatccaaactgaacgtatcaggacagcaacagccctaacgacttcaatccttgatgagaaaccagtcattattgccagttgtctccacaaggagtacgcaggccagaaaaaatcatgcttctcaaaaagaaaaaagaagatagcggctagaaatatttcgttttgtgtacaagagggagaaatccttgggctcctcggacccaatggggcgggtaaaagcagtagcattaggatgatctccggtatcacaaaacccaccgctggggaagtggagttgaaagggtgctcctcagtcctcggacatttgggctattgtccacaggaaaatgtgctatggcccatgctgaccctgcgtgaacatctcgaggtgtatgctgccgtgaaaggactgcgaaaggctgatgcccggctggccatagcgagactagtctcggcctttaagctccacgagcagctcaatgttccagtgcagaaacttaccgctggaattacaaggaaattgtgcttcgtgctgtctctcctgggcaattcccccgtcttgctgctggatgagcctagtacaggaatcgatcctaccggtcagcagcagatgtggcaagctattcaggctgttgttaagaacaccgagagaggcgttttactgaccacacataacttggccgaagctgaagctctgtgtgacagagtcgctataatggtgagtgggagattacgttgcataggttcgattcagcacctgaaaaacaaacttggcaaggattatatcttggaactgaaagtcaaggagacgagtcaagtgacactggtacacacggaaattctcaagttattcccacaggctgccgggcaggagcgctatagctcactcctcacttataaactgccagtcgccgatgtgtaccccctgtcgcaaaccttccataagctggaggccgtcaagcacaatttcaacctggaggagtattcactgtcacagtgcaccctcgaaaaggtattcctggagttgtcaaaggagcaggaagtgggcaatttcgatgaggagatcgataccaccatgcgatggaaacttttgccacatagtgatgaaccttag

SEQ ID NO: 179964 - DNA, 1434 bp, Artificial Sequence
  Description of Artificial Sequence: Synthetic coding sequence
atgttcagcatcaccctgatcaaccacttcgacctgagcatcctgatcacgactatggtgttggtgccaagttataccctgctgggcttcaagacattcctggaggtacgagaccaggagcattacagagaattcccagaggcaaacttcgagctgagcgccacggactttctggtttgcttcatcccctactttcagactctgttgtttgtgttcgtactacggtgcatggagctcaagtgcggcaaaaagaggatgcgcaaggatcctgtgtttaggatcagtccacaaagtcgcgacgctaagcccaacccagaagagcctatcgacgaggacgaagatattcaaacggagagaattcggaccgctacagccctgacaaccagtatccttgacgagaaacctgttataatcgcctcttgcttgcataaagagtatgcagggcaaaaaaaatcatgtttcagcaaacggaagaagaaaatcgcagccaggaacatcagtttttgcgttcaggaaggagaaatactgggactgctgggtcctaatggagcggggaaatcctcctctattagaatgatttctggcattacaaaacctaccgccggggaagttgaactgaaaggatgcagtagtgtgctgggccacctgggctactgcccacaggagaacgtgttgtggccaatgctgaccttaagggagcaccttgaggtgtacgccgcggttaagggactgagaaaggctgatgcaagactggccattgccaggttagtttctgcattcaagctacatgaacagctaaatgtaccggttcaaaagctcacagccggaattacccgcaagctgtgtttcgtcctcagcctgttgggaaatagccctgtattactccttgacgaaccctctaccgggatcgaccccactggccagcagcagatgtggcaggcaatacaggcagtggttaagaacaccgagaggggggtcctgctaacaacccataacctcgcagaggcggaggcactgtgcgatcgggtggccatcatggtttctggtcgcctgcgctgcatcggatccatccagcacctcaagaacaaattggggaaggactatatacttgagctcaaggtcaaagaaacaagtcaggtcactctcgtccacaccgagattctgaagttgttcccgcaggccgcaggtcaggaaaggtatagttcgttgctgacctacaagctccctgtggcggatgtgtatcccttatctcaaacatttcataagctagaggctgtcaaacacaacttcaacctggaagaatactccctaagccaatgcacattggagaaagtgttcctggaactctctaaggagcaagaggttggaaattttgacgaggagatcgacacaacaatgcgctggaagttgcttccacatagcgatgaaccgtag

SEQ ID NO: 179965 - DNA, 6441 bp, Artificial Sequence
  Description of Artificial Sequence: Synthetic coding sequence
atggccttctggacccagctgatgctgctgctgtggaagaacttcatgtacaggcgccgccaacctgtgcaattgttggtggaactgttgtggcctctgttcctctttttcattcttgtggcagtgcgacatagccatcccccccttgaacatcacgagtgccactttcccaacaagccgctgccttcagctggaacagtgccatggctccaggggttgatctgcaacgtcaataatacatgctttccccaactgactccgggggaagagccaggtcggctttcaaatttcaatgattctcttgttagccggctgctggccgatgctagaaccgtgctcgggggggcttctgcccatcgcacacttgcgggactgggcaaactgattgcgaccctgagagcagcacggtcgactgcccagcctcagcctacaaagcagagtcctctggagcccccaatgctcgatgttgctgaactcctgacctccttactccgcaccgaatccctcgggctggctttgggacaggcgcaagagcctctccacagcctgttggaggccgctgaggaccttgcgcaagagctgttggccctgcggtctctcgtggagctgagggccctcttacagagaccacgggggacatctggccccctggagctcctgtcagaagctctgtgtagtgtgagagggccttccagcaccgttggcccttcccttaattggtatgaggcctcagaccttatggagctggtgggacaggaacccgagtccgctctaccagacagtagcctatcacccgcgtgctcagagctcatcggcgctttggacagtcatcctcttagcaggttgttatggaggaggctgaagcccttaatcttggggaagttactgttcgccccagacactccattcactcgtaaacttatggcccaggtgaatcgcacattcgaagagctgactctcctgcgggacgtccgagaggtgtgggagatgctcgggccacgtatctttacattcatgaacgacagctccaacgtggccatgctgcaaaggctactacaaatgcaggatgaaggcagaagacagccacggcctgggggccgcgatcatatggaagctctgaggagcttcctggaccccggcagcgggggctattcatggcaggatgcacatgctgacgttggtcacttagtcggtaccctggggagagtaacagagtgcctgtcccttgataagctcgaggctgcccctagcgaggccgcccttgttagcagagctctgcaacttctggcggagcacaggttttgggcaggcgtcgtttttttaggaccagaggactccagcgatcccactgaacacccgacaccagacctcgggccaggccacgtgcggatcaagatacgcatggacatagatgttgtgacccggacaaataaaatcagagatcgattctgggaccctgggcccgcagctgacccacttaccgacctcagatatgtctggggaggttttgtttacttgcaggacctggtggagagggccgcggtgagagtcttgagcggggctaatcccagggcaggcctgtacctccaacagatgccgtacccttgttatgtggatgatgtttttctcagagtgcttagccggtctttgccactgtttcttacactggcttggatatattccgtgaccttaacggttaaagctgttgtcagggagaaagagacccgactcagggacacgatgagagcaatgggtctctcccgcgcggtactgtggctcggatggtttctctcctgtctgggcccatttctgctgtctgcagcgctgcttgtgctagtgcttaaactgggcgatattctgccctacagccaccccggagtggtgtttctcttcttggccgcgttcgcggtggctactgttacacagagctttcttctaagcgcctttttttcccgggccaatttggccgccgcctgcggcgggttagcctacttctcgctctatctcccgtatgtcctatgtgtggcttggcgggacaggttgccggccggcggtcgggtcgctgctagcctgctgtcaccggtggcgtttgggttcgggtgtgagtcactggccttgctggaagagcagggagagggggcccagtggcataatgtagggacaagacctacagccgatgtgttcagcctggcccaggtgtcaggcctcttactgctggacgctgccctgtatggactcgccacatggtatttggaggctgtttgccctgggcaatacggaatacctgaaccatggaactttccgtttaggcgaagttattggtgtggaccacggcctcccaagtctcccgccccatgcccaactcctctcgatccaaaagtgttggttgaggaagcccccccaggcctgagccccggggttagcgtgagaagtctggagaaaaggttcccggggtctccgcaaccagcattgagggggctgagtctggacttttatcagggtcatatcacagccttcctgggtcataatggtgcagggaaaacaactacgctttccatcctctccggactgtttccgcccagcgggggaagcgccttcatcctgggtcatgatgtaaggtcatccatggccgccattaggcctcaccttggcgtgtgccctcaatacaacgtattattcgacatgctaacagtggacgagcatgtctggttttacggacgccttaaaggattaagcgccgcggttgtggggcctgaacaggatagactgttacaggatgtggggctcgtgtctaaacagtccgtgcaaacgagacacctgagcggtggcatgcagagaaagctgagtgtggcgatcgcattcgtcgggggatctcaggtcgtaattcttgatgagccaaccgccggcgtggaccctgcctccaggcgtggaatttgggaactgctgctgaagtacagggagggacgtacactgatcctgagtacccaccaccttgatgaagctgagctattgggagaccgagtcgcagtggtagccggcggccgcctttgctgttgcggcagcccactgtttttgagacgacacctgggttccggttactaccttaccctcgtgaaggccagactgccacttacaactaatgagaaagccgacacagacatggaaggctctgtggacacccgacaggagaaaaaaaatggatcgcagggcagtcgtgtgggtactccacagttattagctctggtgcagcactgggttccgggcgcccgactcgtggaggagttgccccacgaactggtactcgttctcccatacaccggggcacatgatgggagcttcgccacacttttccgtgaactcgacacccggcttgccgaactacggcttacaggatatgggatctcggatacgagcctggaagagatctttctgaaagtggttgaggaatgcgctgccgacacggatatggaagatggctcttgcggacagcatctgtgcaccgggatcgcagggctggatgtaacattgcgattgaaaatgccgccccaagagacagccttagagaacggggaacctgctgggtctgccccagagacagatcaaggcagcgggcctgatgctgtcggacgcgtgcaggggtgggctctgactaggcagcagttacaagccctgttgctcaaaagatttctcctggcgcgccgctcccggcggggcctgttcgcccagatcgtgctgccagccctgtttgtcggcctcgccctggtgttctctctgattgttcccccatttggccactatcccgctcttcgactcagcccaacaatgtacggcgcccaagttagctttttttcagaggatgcacctggggatcccggaagggcccgcttgctcgaagccttactccaagaagctgggctggaggaaccgcccgtccagcactctagtcaccggttcagcgcacctgaagtgcccgccgaggttgcaaaagtgctggcctcgggcaactggacacctgaatcaccgagccccgcatgtcaatgtagtaggccaggagccaggcggctgttgcccgactgcccagcagccgccggcggtccaccgccccctcaggctgtgacaggcagtggcgaggttgtgcagaacctgacaggtcggaatctaagcgattttttggtaaagacctatccacgactggtccggcagggactgaaaaccaaaaagtgggtgaatgaggtccgatacggggggttcagcctaggagggcgcgatcctggactgccttctggtcaggagctcggccggagcgtggaagagctgtgggctctgcttagccccctgcccggcggtgcactggatagagtacttaagaatctgacagcctgggctcacagtctggacgcccaagattccctgaaaatctggttcaataacaagggttggcattctatggtggccttcgtaaaccgggcatccaacgccatcctgagggcacacctgcctcctggtcctgcacggcatgctcactccatcactacactcaatcaccctctaaacttaacaaaggagcagctgtcggagggagccctgatggccagcagcgttgatgtcctcgtaagcatatgcgtggtgtttgctatgtctttcgtgccagctagttttacactcgttctcatcgaggaacgggtgacacgcgccaaacacctgcagttaatgggtgggctgagcccaaccctctattggttaggcaatttcctctgggatatgtgtaattacctcgtgcccgcttgtatcgtggtcctcatcttcctggcttttcagcagcgagcctacgttgcaccagctaacctgccagcccttctgctgcttttactgctgtacggatggtcgatcacccctctaatgtaccccgccagctttttcttttcagtcccttccacagcatacgtcgtgctcacctgcatcaacctgttcatcgggatcaacggatccatggccacatttgtgctggagcttttctccgatcagaaactccaggaggtctctcggatcctcaaacaggtttttcttattttcccccacttctgcctcggcagggggttgatagacatggtgagaaatcaggctatggcagacgccttcgagcgtttgggtgatagacaattccagtcacctctgcgatgggaggtggtgggaaagaatttactggccatggtcatacaagggcccttattcctcctttttactctgttactgcagcaccgatcccagctgttgccacagcctcgggtgcggagcctgccactcctgggggaggaggatgaggatgtcgctagggaaagggagagagtcgtccagggtgctacccagggggatgtgctggtgctgcgcaatctcacaaaggtgtatcggggtcaaagaatgcccgccgtagataggctctgccttggaataccccctggggagtgctttggccttctgggggtgaatggggctgggaagaccagcacttttcgcatggttactggggatacactagccagccggggagaagcagtgctcgcggggcattcggtggctcgagaaccatcagctgcccacctcagcatggggtactgtccccagagcgacgcaatttttgagctgctaaccgggcgggagcatttggaacttctcgcccgcctgcggggggtaccggaggcacaagtggcgcaaacagccggaagcggcttggcccgcctcgggttgagctggtatgctgatagacctgcgggtacctactcaggaggaaataaacgcaagctcgccaccgcactcgccctggtgggggatcccgccgtagtcttcttggacgaaccaacaacgggaatggaccctagtgcaagaaggttcctgtggaattcactgctggccgtcgtcagggaagggcgatcagtgatgctgactagccatagcatggaggagtgtgaggctctttgttctcgtctagctatcatggtgaatggcaggttcagatgtctgggtagtcctcagcatttaaaaggacgattcgccgcgggacatacgctgaccctgagggtgcctgcagccaggtctcaacctgccgctgccttcgttgccgccgagttcccaggggctgaactgcgggaagcgcacggcggtagacttaggtttcagttgccccccggtggcagatgcgctctcgcccgggtgttcggcgagctcgccgtgcacggtgcggagcacggcgtggaagacttctcagtcagccagaccatgctggaagaggtttttctgtatttctctaaggaccagggtaaagatgaagacactgaggagcagaaggaggctggggttggggtggaccccgctcccggtctgcagcaccccaagagagtcagccagttcctggatgacccatcaactgcggaaactgtcctttag

SEQ ID NO: 179966 - DNA, 6441 bp, Artificial Sequence
  Description of Artificial Sequence: Synthetic coding sequence
atggccttctggacccagctgatgctgctgctgtggaagaacttcatgtatcgcaggcgccagccggtccagcttctggtggagctgctctggcctttgttcttatttttcatcctggtcgctgtgcggcactcacacccacccctcgaacaccacgaatgtcattttcctaataagcctttgccctcagcaggcacagtgccttggcttcaaggtctgatatgcaatgtgaataacacctgctttccgcagctgactcctggcgaagagccaggtcgcctgagtaacttcaacgattccctggtgtcgcggctactggccgatgccagaaccgttctgggcggagctagtgcacaccgtactctcgcaggactgggaaaactgatcgccacactgcgggcagcgcgcagtaccgcgcagccacaacccacaaaacagtcaccacttgagccccctatgctcgatgtcgcagagctgcttacaagtctgttgagaactgagagcctcggtttggccctggggcaagcccaagaacccctacatagcctgctggaggccgcagaagatttagcccaggagcttcttgccctgcggtccctcgtggaattgagagccctgctgcagcggccgcgggggactagtggcccccttgagctgctgtcagaggccctgtgctctgttcgggggccctcttcaaccgtgggaccatctctgaattggtacgaggcttccgatttgatggaactggttggccaggaacccgaaagcgcattgcctgatagctccctaagccctgcatgcagcgaactgatcggagcattggacagtcacccgctgtcgagactgctctggcggcggttgaaacctcttatattgggcaagctcctgttcgcccccgatacaccattcacacgtaagctgatggcacaggtaaatagaacattcgaggagctgaccttgctccgggatgtgagggaggtctgggagatgctcggaccgcgcatattcacattcatgaacgattcttcaaacgtcgcaatgctccagcgactacttcagatgcaagatgaagggaggagacagcccagaccaggcgggagggaccatatggaagcacttagaagctttctcgaccccggcagcggaggatattcttggcaggatgcccacgccgatgtgggccatcttgtgggaaccctcgggcgtgtgacagaatgtctatccctggataaacttgaggcggcaccctccgaagctgcactggtgtccagagccctgcagctgctggccgagcatcgcttttgggcaggagtggtattcctcggtcctgaagattcctcagatcccactgagcatcccacacctgaccttgggcctggccacgtgcgcatcaagatccgcatggacattgatgtggtcactaggacgaataaaatccgggaccgcttctgggatcccggacccgctgctgaccctttaactgatctccgatatgtgtggggagggtttgtttacctccaggacctggtagagagagccgctgtgcgagtgctcagcggagctaaccctagggcaggcctatatctgcagcagatgccttacccatgttacgtggatgacgtctttctccgcgtgctgagcaggagtcttcctctgtttcttacactcgcgtggatttatagtgtgactctgacagtgaaagctgtcgtcagagagaaggaaacccgtctgcgggatacgatgcgagccatggggcttagccgagccgtcctctggcttgggtggttcctatcctgtctgggccccttcctcttaagtgcagctcttctggtcttagtcctgaagttgggagacatcctgccttattcccacccaggagtcgtctttctgttcttggccgccttcgctgtggcaacagttactcagagttttctcctaagcgcgttcttcagccgagccaaccttgccgcggcctgcggtggacttgcatatttctcactgtacctcccatacgtgctctgcgtcgcctggagggatcgacttcctgccggaggacgtgtcgcagcctctctcctgtcgccggtcgcgtttgggtttggctgtgagtccctggcgctgctcgaggaacaaggcgagggggcacagtggcacaatgtcggcactcgcccgactgccgacgtctttagtctagcgcaggtgtccgggctcctgctcctggatgcagccctgtacggattggcgacctggtacctggaagcggtgtgtcctggtcaatacggtatcccagagccttggaatttccctttccgtcggtcatactggtgcggaccacgacccccgaagagcccagccccctgtcccacccctttggatcctaaagttctggtggaagaggccccccccgggctttccccaggggtttctgttcgcagtctagagaagcgctttcctggcagtcctcaacctgcactgcgtgggctaagcttagacttctaccagggccacattactgcattccttgggcataatggcgctgggaagacaaccactctatctattctgagcggcctgttccccccctccggaggatccgccttcatattgggccacgatgttagatcctccatggccgccatcagaccgcatctgggggtctgcccccagtataacgtgctgtttgatatgcttaccgtcgacgaacatgtgtggttttacgggcgactaaagggcctatcagctgcagtcgtagggcccgagcaggacagacttcttcaggatgtcggactcgtgagtaaacagagcgtgcaaacacggcacctgtctgggggaatgcagagaaagctgtcagttgccatcgcattcgttggcggcagccaggtggtaattctagacgagcctacagccggagtggaccctgctagtcggcgaggcatttgggagcttctgcttaaataccgagagggacgaacgcttatcctgtcaactcatcatcttgacgaagctgagctgcttggtgatcgggttgcagttgtcgcgggcggcagactttgttgctgcggatctcccttatttctccggcgccacttaggctccggatattacctcactctggttaaagcgagactccctctgaccacaaacgaaaaagccgataccgatatggaaggatcagtggatactcggcaagaaaagaaaaacgggtctcagggcagccgcgtggggaccccccagctcttagctctggtccagcattgggtcccaggggcccgcctggtcgaggagctgcctcacgagttggttctcgtcctcccctatactggggcccatgatggctcgttcgcaacactgtttcgggagttagacacccgcctggccgagctacgtctgaccggatacgggatatctgacacatcactggaggaaatcttcctgaaagtggttgaggaatgtgcagccgatacagatatggaggatggttcctgcggccagcacctgtgtacaggaattgccgggctggatgtgacactccgccttaaaatgcccccacaagagacggctttggaaaatggggaaccagcgggctccgcccccgagaccgaccaggggagtggccccgacgccgtgggaagggtgcaaggatgggcgcttacccgacagcagctacaagcgctactgttgaagagattcctgctggctcgcagatcccgcagggggctttttgcccagattgtgctgccagccctgttcgttggattagctctggtgttttcacttatcgtgccgcctttcggccactaccctgctcttcgtctcagtccaacaatgtatggtgcccaggtttcatttttcagcgaggacgctccaggcgacccaggtcgagcccgcctgttagaagctttgctgcaggaagccggactggaggagccacctgttcagcactcatcacacagattctcagcacccgaagtcccagcagaggtcgccaaagtgctggcctcaggcaattggacgcccgagagtccctctccagcttgtcagtgctctagacccggggccagacgactcttacccgactgcccggccgctgcaggtggtccacctccgccccaagcggtgaccgggagcggcgaggtagtccagaaccttaccgggaggaatcttagtgattttctggtgaaaacctatccccgcctcgtgagacagggccttaaaactaaaaagtgggtgaacgaagttagatacggtggctttagccttggaggaagagaccctggcctgccgtccggacaggagctgggaaggtctgtggaggaattgtgggccctcctatcacctttgccgggaggcgccctcgatagggtcctgaaaaatctgacggcatgggctcatagcctggacgcacaggatagcctgaagatttggttcaacaataagggatggcactccatggtcgcgttcgtgaatcgagcctccaacgccatacttcgcgctcatcttccaccaggacctgccagacacgctcattcaattacgaccctgaaccaccccttaaacctgaccaaggaacagctgtcagagggggctctgatggcctcatccgtggacgtactggtgagcatctgtgtggtgttcgctatgagtttcgtgccggccagcttcactctcgtgctaatcgaggagcgggttacacgggcaaaacatctccagctcatgggagggcttagcccaacactttactggctagggaattttttatgggacatgtgcaattatctggtcccagcctgcatagtggtactgatttttttggcctttcagcaaagagcctatgttgcccctgcaaatctgccagcgctcctgctgctgctcctcttgtatggatggtctatcacccccctcatgtacccagcctctttttttttcagcgtgccttcaacggcttacgtggtgctcacatgtatcaatctgtttattgggattaatgggagtatggccactttcgtgctggagctgttttccgatcagaagttacaggaagttagcaggatcctgaagcaggtcttccttatctttccgcatttttgtctgggacggggattaatcgacatggttaggaaccaggccatggcagatgccttcgagcgcctaggggaccggcagttccagtctcccttacgctgggaagtcgtggggaaaaatttgctggcgatggtcatacagggacctttgtttctgcttttcactctgctcttgcaacatcggagccagcttcttccccagccccgggtccggagtttaccgctcctgggcgaggaagatgaagacgttgctcgggaaagagaacgcgtagtccagggcgctacccagggagacgtattagtactgagaaacctcaccaaagtataccgtggacagcggatgcctgctgtcgataggctgtgtttgggaattccccccggtgagtgctttggcttactgggggtgaatggagcaggcaaaacgagcacttttagaatggtgaccggcgacacactcgcgtcgcgcggggaggcggtacttgcaggccactccgttgctcgggaacctagcgccgcccatttgagcatgggttactgcccccagtcagacgccatcttcgagctcctgaccgggagggagcacctggaactactggcccgacttaggggagtccctgaagcccaggtagcccaaaccgcgggatctggtcttgccagactaggtttgtcgtggtatgccgatagacctgcaggaacctatagcggagggaacaagcgaaagctggctaccgcgctggccctggtaggggatcctgccgtggtgtttttggatgagcccacaactgggatggacccttctgcgagacgcttcctgtggaattccctgttggcagtggtgagggaagggagatctgtcatgctcacgtcacacagcatggaggagtgcgaggcattgtgctcacgactggcaattatggtgaacggaagattccgttgcctaggttctccacagcacttgaagggccggttcgcagcaggtcataccctgacattacgtgtgccagccgcccgcagtcagcctgccgccgcgttcgtagccgccgagtttcccggagcagagcttagagaagcccacggagggagactcagattccagctcccgccgggcggacgctgtgctctcgccagagtgttcggggagcttgcggtgcacggggcagaacacggagtcgaagacttttcggtctcccaaaccatgctggaggaggtctttctgtatttctcaaaggaccaggggaaggacgaagacactgaagagcagaaggaagccggcgtgggagtggatccggctcctgggttacagcaccctaagagagtaagccaattcctcgacgatcctagtactgcagagactgtgttatag

SEQ ID NO: 179967 - DNA, 495 bp, Artificial Sequence
  Description of Artificial Sequence: Synthetic coding sequence
atggccttctggacccagctgatgctgctgctgtggaagaacttcatgtatcggagaagacagccagtccagctgctggttgagctactgtggccacttttcctgttctttatattggtggcggtaaggcatagccaccctcccctggaacatcatgaatgtcatttccccaataagccccttccctccgctggcaccgtcccttggctgcagggcctcatttgcaacgtgaacaacacttgtttccctcaactcacacccggcgaggagccaggacgtctgtccaacttcaatgattccctggtgtcacgcttactcgccgacgcgagaacggtcctggggggggccagtgctcaccggaccctggccgggttgggtaaactgatcgctaccttgcgagccgctagatctaccgcccagcctcaacccacaaagcagtcgccccttgagccacccatgctcgacgttgcggaactgctcacatcactgctgtag

SEQ ID NO: 179968 - DNA, 4746 bp, Artificial Sequence
  Description of Artificial Sequence: Synthetic coding sequence
atgcggaagcggaagatcagcgtgtgccagcagacctgggccctgctgtgtaagaacttccttaagaaatggcggatgaaacgcgaatcactgatggaatggctgaattccctgttgctgctgctatgtctgtatatttacccgcacagtcatcaggtcaacgactttagctccctactgacaatggaccttggacgagtggatacgtttaacgagtccagattttccgtcgtgtatactccagtgactaatacaacccagcagatcatgaataaggtagcttccactcccttcttggctggcaaggaagtcttgggattgccggacgaggagtcaatcaaggagtttaccgctaattaccccgaagagatcgtacgggtgacctttacaaacacatactcttaccatctgaagtttttgctggggcacggtatgccggccaagaaagagcataaagaccacaccgcccactgctatgaaacgaacgaggacgtgtattgcgaagtgtccgtcttttggaaggagggcttcgtcgccctgcaggcagccatcaatgcggccatcatagaaatcactaccaaccactcagtaatggaggaactcatgtccgttacgggaaagaatatgaagatgcacagcttcatcggccagagcggagtgatcacagatctgtacctgttcagctgtataataagtttctcctcattcatttattacgccagcgtcaacgtgactagagaacggaagcgcatgaaagcgctcatgacaatgatgggtcttcgagattctgctttttggctgtcttggggactcttgtatgcgggtttcatttttataatggccctgtttttagcactggtcatcaggagcacgcagtttatcatactgagtggcttcatggtagtattctccttgttcttgctttatggcttaagcttggttgccctggcgtttctgatgtccatcctagtgaaaaaatctttccttacgggtttggtcgtatttctgcttaccgtcttctggggctgtttaggcttcacctcactttaccgtcatcttcctgctagtctggagtggattttgtctctcctctccccgttcgcatttatgctgggcatggcacagcttctccacctagattacgaccttaatagtaacgctttcccccatcccagcgacgggtctaatctcatcgttgctaccaactttatgctggccttcgacacctgcctttatctggcacttgctatctattttgagaagatactgcccaacgagtacggtcatagacgaccaccgttattctttctgaagtcaagcttttggagtcagacccagaaaactgatcacgtcgccctggaggatgagatggatgcagatcctagttttcacgatagcttcgaacaggcccctccagagtttcagggcaaagaggctatcaggatacgtaacgtgacaaaggaatataaggggaaacccgacaaaattgaagctttgaaagacttggtctttgacatctacgaaggccagatcactgcgatactcggtcacagcggagcaggcaagtctaccctgcttaacatcctgtccggcctgtccgtgcctacaaaaggcagcgtaacgatctacaacaacaagctttctgaaatggcagatctggaaaacctgtccaaattgaccggcgtttgcccccaatctaacgttcagtttgactttctgacagtgcgggaaaatctcagactttttgctaaaattaaaggaatcttgccccaggaggtggacaaggaaatcttcctgctggatgagcctaccgcagggctcgacccctttagcagacatcaggtttggaatctgctgaaggaacgtaagaccgacagggtgatacttttctccacccagttcatggacgaggcggacatattggcggaccggaaggtttttctaagtcaggggaagctgaaatgcgctgggtcatccctctttttgaagaagaagtggggcatcggctaccacctgtccctgcagctgaacgagatctgcgtcgaggagaatatcacctctcttgtgaaacagcatatcccggatgctaaattgtctgccaaatccgaaggaaagctgatttacacacttcctctggagcgcaccaacaaattccctgaactctacaaggatctagatagctatcccgatctgggaatcgagaattacggcgtgagcatgacaactttgaatgaagtcttcctgaaattggaagggaagtcaacaatcaacgagagcgacatcgctattctgggggaagtccaagccgaaaaagccgatgataccgagcggctggtcgaaatggaacaggttttaagcagtcttaataaaatgcgcaagaccatcgggggcgtggccctgtggcggcagcagatttgtgcaattgcacgggttcgactgctgaagctaaaacatgagaggaaggctttgttagccctcctcctgatcctaatggctggcttttgtcccctgctggtggagtacaccatggtcaaaatttaccagaatagttatacttgggaactgagtcctcatctatatttcctggcccctgggcagcagccccatgacccgcttacccagctgctgatcattaacaaaactggtgcaagtatcgacgacttcattcagtccgtggaacatcagaacattgctttggaggtggatgccttcggtacgcgcaacggcaccgatgatccatcgtacaatggggccatcactgtttgttgcaatgagaagaattacagcttcagcctcgcttgtaacgctaagcggctaaactgtttccccgtgttgatggatatcgtgtccaatggacttctcggcatggtcaaaccctcagtccacattcggaccgaacggagcactttcctcgaaaacggtcaagacaaccctataggtttcttggcttacataatgttttggctggtcctcacgagctcctgtcctccctacatcgccatgtcctccatcgacgattataaaaacagagcaagatctcagttaaggatttcagggctcagtccttccgcctattggttcggacaagccctcgtcgacgtctcactctacttcctggtcttcgtgttcatttatctgatgagttatatatccaacttcgaggatatgctcctaacaatcatccatatcatacaaattccttgtgccgtcggatattctttctccctcattttcatgacctatgtgatcagtttcatttttcgtaaaggtcgcaaaaattcagggatctggtctttttgtttttacgtggtgacagtctttagcgtggccggctttgcattctccatttttgaaagtgatattccattcatcttcactttcttgatccccccagccacaatgatcgggtgcctcttcctgagttcacatctgctgttttcctccctgtttagcgaggaacggatggatgtgcagccctttctcgtttttctaatccccttcctgcacttcataatttttctcttcacactgcgctgtctggaatggaagtttggaaagaagtctatgagaaaggacccctttttccggattagtccccgcagctcggacgtgtgtcaaaatcctgaggaacctgagggagaagatgaggatgtccagatggaaagagttcgcaccgcaaatgcattaaactcaaccaactttgatgagaagcctgtgattatcgcctcgtgcctccgaaaggagtatgcaggaaaaaggaaaggctgcttttcgaaacgcaaaaacaaaatcgcaacaaggaatgtttctttctgtgtccggaagggagaggtgttagggctgctgggccacaacggagccggcaaatccacctctatcaaggtaatcaccggggacaccaaaccaactgcgggtcaggttctgctcaaagggtctggtggcggcgatgctttagagttcctgggttactgtccacaggagaacgccttgtggccaaacctcactgttcgccagcatctggaagtgtatgcagctgtaaaagggctacgtaaaggcgatgccgaagtggcaatcacgcgtctcgtggacgccctgaagctgcaggatcaacttaaatccccggttaagacactaagcgagggcattaagcgaaagctgtgcttcgtactatcaatcctaggcaatccaagcgtcgtgttgttagacgagccttccacaggaatggaccctgaaggtcagcagcagatgtggcaggctatcagagcaacttttagaaatacagagcgaggggcgcttctgaccacacactacatggctgaggccgaagcagtgtgcgacagagtggccataatggtgagtggacgactgcgctgcatcgggtccatccaacacctgaagagtaagttcgggaaggactacctgctggagatgaaagtgaaaaatttggcccaggtggagccattacatgccgaaatattgaggctcttcccacaagcagctagacaggagcgatactccagcctaatggtctacaagttgcctgttgaggatgtgcagcctttagcccaggctttctttaaactggagaaagtgaaacaatcattcgacctggaagaatactccctcagtcaatcaaccctggagcaggtcttcttggagcttagcaaggagcaggagctaggtgatttcgaagaggactttgatccttccgtcaaatggaagctcctgccccaggaggagccttag

SEQ ID NO: 179969 - DNA, 801 bp, Artificial Sequence
  Description of Artificial Sequence: Synthetic coding sequence
atgcggaagcggaagatcagcgtgtgccagcagacctgggccctgttgtgcaagaactttttaaaaaaatggcggatgaaaagagagtctcttatggagtggctgaatagcctattactcttgttgtgcctttatatttatccgcactcccatcaggtgaacgattttagctcactcctcacaatggacttgggacgcgtcgacactttcaatgagagcagattttccgtggtctacactccagtgaccaatacaacgcagcaaattatgaataaggtggccagcactccatttctggccggcaaggaagtgttgggcctcccagatgaggaatctattaaggagtttaccgccaactatccagaggagatagttagggtcacctttacgaacacatatagctaccatctgaagttcctccttgggcatggaatgcccgccaaaaaagaacacaaagaccacactgcccactgctatgagaccaacgaagacgtttattgcgaagtaagtgttttctggaaggagggattcgtggccctgcaagcggccataaacgctgccattattgagattacaaccaatcactcggttatggaggaactgatgtcggttactggcaagaacatgaaaatgcacagcttcatcggacagtctggggtcatcacggatctatacctgttttcttgtattatatccttctcttcttttatttactacgccagtgtaaacgtcacaagagagcgtaagcgtatgaaggcgttgatgacgatgatggggctcagagactctgctttctggtag

SEQ ID NO: 179970 - DNA, 4866 bp, Artificial Sequence
  Description of Artificial Sequence: Synthetic coding sequence
atgcggaagcggaagatcagcgtgtgccagcagacctgggccctgctctgcaagaactttctgaagaaatggcgcatgaagagagagtcactaatggaatggttgaattccttacttctgttgctttgtctttatatctaccctcattcccatcaggttaatgatttttccagcctcttaacaatggacttggggcgcgtggataccttcaacgagtccagattcagcgtagtctacaccccagttacaaacacaacacagcagattatgaataaagtggcatctactcccttcctcgccggcaaagaggtgctcgggctgcctgacgaggagtcaatcaaagagtttaccgccaactacccagaagagattgtccgagtgacctttacgaatacgtatagttaccatcttaagtttttactggggcatggtatgccagcaaagaaggagcacaaagatcacaccgcccactgctatgagacaaatgaggacgtttattgcgaggtcagcgtcttctggaaagaaggctttgtagcacttcaagcagccataaacgcagccattatcgagatcaccacgaatcacagcgtcatggaagagttgatgtccgtcacaggaaaaaacatgaagatgcatagctttattgggcaatctggcgtcatcactgacctgtacttatttagttgcatcatctccttcagctccttcatctattacgcaagcgttaatgtgactcgggagagaaaacgcatgaaagctctcatgactatgatgggcctcagagactccgcgttctggctttcatgggggctcctctacgcaggatttatctttataatggctcttttcctggcactcgttatccggtctacacagtttattatccttagcggctttatggtggtctttagcctgttcctgctttacggcttgagcttggtagcccttgcctttctgatgtccatcctggtcaagaaatcatttctgaccggccttgtggttttcctgctgaccgtgttttgggggtgcctaggatttacgtctctgtaccggcatctgccagcctcactagagtggattttaagtttgctttcaccatttgcctttatgctcggtatggcccagctcttgcaccttgactatgatcttaattccaatgcttttccgcatccctctgacggttccaatttgatcgtggccacaaactttatgcttgcgttcgacacctgtctctatttggccttggcaatctactttgagaaaatcttgccaaatgagtatggccacaggcggccaccacttttctttctgaagtcatccttctggtctcagacacagaagacagatcacgtggcccttgaagatgagatggatgccgacccatctttccatgactcattcgagcaagcaccacccgagttccagggcaaggaggccattcgtattcgcaatgtgaccaaagagtataaaggtaaacctgataaaatagaggccttaaaagacttggtgttcgatatttacgagggacagatcaccgccatattaggtcatagcggagccggtaagtccacccttctcaatattcttagcggtctcagtgtacccacgaaaggttctgtgactatctataacaacaagctgagcgagatggctgatctggagaaccttagcaagctcacgggggtatgcccgcagtctaatgtgcaattcgattttctgacagtccgcgaaaacctcaggctttttgccaaaatcaaggggatcctgccccaagaggtcgataaagaaatccagcgagtcctgttagagctagagatgaaaaacatccaggacgttctagcccagaacctcagcggagggcagaagaggaagcttacattcgggatagctattctgggtgaccctcagatttttctgcttgatgagccgacagcaggattggatccatttagcaggcatcaggtatggaacctactaaaagaacgcaaaacggatcgtgtcatcctgtttagtacccagttcatggacgaggccgacattctggcggataggaaggtgtttctgagccagggcaaacttaagtgtgctggatcctctctctttctgaagaagaagtggggcatcggctaccatctgagcctgcaactgaatgaaatctgtgtcgaggaaaatattacatctctagttaaacagcacatcccagacgctaagctatctgctaaatccgaaggcaagttgatctacactcttccattagagagaaccaacaagttccctgagctctataaggacctggactcctaccccgacctggggattgagaactatggagtgagtatgacaaccctgaatgaggtatttctgaaactggagggaaagtctaccatcaacgaaagcgacatcgccatccttggtgaggtccaagcagaaaaggccgatgacacggaacgactggtagaaatggaacaggtgctttcctccttaaacaaaatgagaaaaacaatcggaggtgtggctctgtggcggcaacaaatatgcgccatagcgagggtgagattactcaaactgaagcatgagcggaaagctctgctcgccctgcttctaatacttatggctggattttgcccattgttggtcgagtacacaatggtgaagatctaccagaactcttatacatgggagctatctccccacctgtactttctggccccaggtcagcagccacacgacccactgactcagctgcttattataaataagaccggtgcttccatcgatgacttcatccagtccgtggaacatcagaatattgctttggaggtcgatgccttcggcacaagaaatggtaccgatgatccctcttacaacggcgcaattactgtgtgctgcaacgagaaaaactacagttttagtctggcatgcaacgccaagcgtctgaactgctttcccgtcctcatggatatcgtgtccaacgggcttctgggcatggttaagccaagtgtgcacattagaacggagcggagtaccttcctcgagaacgggcaggataatccaattggttttctggcttacataatgttctggctggtgctcacgagtagctgcccaccttacatagctatgtcgtcaattgacgactacaaaaatcgggctaggagccagcttaggatctcgggcctctcaccctccgcctattggttcgggcaggccctagtggatgttagcctctacttcctggtgttcgtgttcatttacctgatgtcctacattagtaattttgaagacatgctcctcaccatcatccatataatccagattccctgcgcagtgggttatagtttttccctaatatttatgacgtatgttatttcctttatctttaggaaaggcagaaaaaactccggtatttggtccttttgtttctacgtggtgaccgtgttctctgtggccggcttcgccttctctatcttcgaaagcgatataccgttcatattcacgttcctcatccccccagcaacaatgattggttgtcttttcctgtcctcccatctgcttttcagtagcctgttcagcgaggagcgtatggacgtgcagccattcctggtgtttctcattccattccttcactttatcatttttctgtttacactacgttgtctggaatggaagttcgggaagaagtcaatgaggaaggatccattttttcgtatttcccctagatcttccgatgtgtgccagaacccagaagagcctgagggcgaagatgaagatgtgcagatggaaagagtcagaaccgccaatgctctaaattctactaacttcgatgaaaagccagttattattgcttcgtgtctgaggaaagagtatgcgggaaaacgaaaagggtgcttctccaagcggaagaacaagatcgctactcgtaacgtcagcttctgtgtgcggaagggcgaggtgcttgggctattaggacacaatggtgcgggaaaatctactagtatcaaggtgattactggggacactaaacccaccgcaggacaggtgctactgaagggatctggtgggggagatgcgctagagttcttgggctattgtccacaagagaatgcactctggcccaatctgacagttcggcaacacctggaggtgtacgccgctgtgaaagggctcagaaagggcgatgcagaggtggctatcactagactcgttgatgcactaaagttacaggaccagttgaagagtcccgtaaagactctttctgagggaatcaaacgcaagctgtgtttcgttctctcaattctcgggaatcccagcgttgtgctgctggatgaacccagtaccggaatggatccagaagggcaacagcagatgtggcaggccatccgtgccacattccgcaacacagagcggggtgccctgctaacgacccattatatggccgaggccgaggccgtgtgcgatagggtggcaatcatggtgagcggaagactaagatgtatcgggtcaatacagcatttgaagagcaaatttgggaaggactacctgttagagatgaaggtgaagaacctggcgcaggtcgagcctctccatgccgagattttgcgcctttttcctcaagctgcaagacaagagcggtactcgtctcttatggtctataaattgcccgtagaggacgtgcagccgttagcgcaggcttttttcaagctggaaaaggtgaaacaaagctttgacctggaggagtactctttgagccagtccacattagaacaagtcttcttagagttgtctaaagaacaggagctgggggactttgaggaggatttcgacccctccgttaaatggaaactgttgccgcaagaagagccgtag

SEQ ID NO: 179971 - DNA, 3312 bp, Artificial Sequence
  Description of Artificial Sequence: Synthetic coding sequence
atggacctgggccgggtggacaccttcaacgagagccggttcagcgtggtttacactcccgtgacgaatactacacaacagattatgaataaagtagcctccactcctttcctcgcaggcaaagaggttctcggactgccagatgaggaatccattaaggaattcactgccaactatccagaagaaatcgtcagggtcaccttcacaaatacctactcctatcacctgaaatttctgttgggccatgggatgcccgcgaagaaagaacacaaggaccacaccgctcattgctacgagactaatgaagatgtctactgtgaagtgtccgtgttttggaaggaaggcttcgtggcccttcaggcagctataaacgccgctattattgagataaccaccaatcactccgtgatggaggagctcatgtctgtaactggtaaaaatatgaagatgcactccttcattggccagagcggcgtgattaccgacctgtatctttttagctgtataatcagtttttccagctttatctactacgcttcagtcaacgtaactcgtgagcgcaagaggatgaaggcgctgatgactatgatgggcctgagagattctgccttttggctgagctgggggctgctctatgcaggtttcatctttatcatggcgctgttcctcgcactggtcataagaagcacacagttcataatcctctcaggttttatggttgtgttttctctatttctgttgtatggactatccctggtggcactggcatttctaatgtccatactagttaagaagtccttccttacaggactcgttgtgttcttgctaaccgtgttctggggatgtctaggctttacatccctgtacaggcacctgccggctagcctggagtggattctgtctctgctttcacctttcgccttcatgcttggaatggcgcagctcctgcatctggattacgacctcaactccaacgcatttcctcacccatcggacggctctaatctgatagtcgcaacaaatttcatgctggccttcgatacttgtctgtatctggccctggctatctactttgaaaaaatattgccaaatgagtatgggcacagaaggcccccattgtttttcttgaagagttctttttggtcccagacacagaagacggatcatgtggccctcgaggacgagatggacgcggaccccagtttccacgactcttttgagcaggccccaccggaatttcagggtaaagaggcaataaggatccgaaatgtgacgaaagagtacaaaggcaagcccgacaaaatcgaggcgctgaaagacttggtattcgacatttacgaggggcagataacagcaatcctggggcactctggtgctggcaaatctacattgcttaacatcctctctggcttaagcgtgccaacaaagggctcagtcacaatctataataataaattgagcgagatggctgatcttgaaaatctgagtaaactgacaggcgtatgtccacagagcaacgtacagttcgactttcttacagtgcgggagaacctccgcctctttgccaagataaagggtatcttgccccaagaggttgacaaggaaatccagcgggttctgcttgaattggagatgaagaacattcaggatgtcctggctcaaaatctcagcgggggccagaagaggaagttgacattcggcattgcaattctgggtgacccccagattttcctgctggatgagccaacagctggcctagatccattcagtagacatcaggtttggaatctccttaaggaaagaaaaactgatcgcgtaattctgttttccacccagtttatggatgaagccgatattctagcggatagaaaggtgttcctgtcgcaggggaaacttaagtgcgcagggtctagtttgttcctcaagaagaagtggggaatcgggtaccacctgagtctacagctcaatgagatttgcgttgaggagaacataaccagcctagtcaagcagcacattcccgacgccaaactctctgccaaatctgagggaaagctcatatacactctgcccctcgagcgtactaataagttccctgaattgtataaagacctggacagttacccagaccttggtatagagaattacggcgtcagcatgactactcttaacgaagtcttcttgaagctcgagggaaaatcaaccattaatgagtcagatatcgccattcttggagaggtgcaagctgaaaaagcagacgatactgagcgactcgtcgaaatggaacaggtgctgtccagcctaaacaagatgcgaaaaacaatcggaggcgtggccctgtggagacagcagatctgtgcaatcgcacgcgtgcgtctgctgaagctgaaacacgaacggaaggcactgctggcactgctactcatccttatggctgggttctgtccgctcctcgtcgaatataccatggttaagatctaccagaacagttacacatgggagctgagtccccatctgtacttcctagcgcccgggcaacaaccacacgaccctctgactcaacttcttatcataaacaagacgggtgctagcatagacgacttcatccagtccgtggagcaccagaacattgccctcgaggtggatgcctttggaacaaggaatgggacagacgacccgtcctacaatggagccatcaccgtctgctgcaatgagaagaactacagctttagtttggcatgtaacgctaagagattgaattgctttcccgtgcttatggacatcgtgagcaatggcttgctcggcatggttaagccgtctgtgcacattcggacagaaagatccacatttctggaaaacggacaggacaacccaattggctttctggcgtacataatgttctggctcgtccttactagttcttgcccgccttatatcgccatgtcatctatcgatgattacaaaaatcgtgccaggtctcagctcagaatctccggactgtccccgtccgcctactggttcggacaggcgctagtagatgtgtcgctatatttcctagtcttcgtcttcatttacctgatgtcctacatatctaactttgaagacatgcttctgactataatacatatcatacaaatcccatgcgcagtgggctatagcttttcactaatcttcatgacatatgtgatctcgtttatattccggaaaggacggaaaaacagcggaatctggagcttctgcttttacgtcgttagcattttcctggtcgatgtgtactgcatatacctgatctacaattcagaattaattctctag

SEQ ID NO: 179972 - DNA, 471 bp, Artificial Sequence
  Description of Artificial Sequence: Synthetic coding sequence
atgctgggcatggcccagctgctgcacctggactacgacctgaactctaacgcctttccacatcctagtgatggctctaatttaatagtggcgactaattttatgttggccttcgatacttgtttgtacttggctctggcgatctactttgagaagatcctgcctaatgaatacgggcatagaagacctcctctcttctttctgaagagcagcttctggtcccagacccagaagacggaccatgttgctctagaggacgaaatggacgccgatcctagcttccacgactcattcgagcaggcccccccagaattccaaggcaaggaagccattaggatccgaaatgtgacaaaggaatacaagggcaaacccgacaagatagaagcacttaaagatttagtgttcgatatttatgaaggtcagatcacggccatcctcgtgacggtggaactcgaatcccaacattgttag

SEQ ID NO: 179973 - DNA, 4875 bp, Artificial Sequence
  Description of Artificial Sequence: Synthetic coding sequence
atgagcaagcggcggatgagcgtgggccagcagacctgggccctgctgtgtaagaattgcctcaagaaatggcgcatgaaaagacagaccctcctcgagtggctcttcagctttttattagtgctctttctgtacctcttcttctctaacttacatcaggtccacgacactccgcagatgtctagcatggatctggggcgggtagatagctttaacgataccaactatgtgatcgcctttgcaccagagagcaagacaacgcaggaaataatgaataaggtcgcttcagcccctttcctcaaaggcagaaccataatgggatggcctgacgagaagtcaatggacgaactggacttgaattacagtattgacgctgttcgggtgatttttaccgatactttttcctaccatttgaagttttcctggggtcaccgtatccccatgatgaaggagcaccgggatcactctgcccactgtcaagccgtcaatgaaaaaatgaaatgcgagggcagcgaattctgggagaaaggcttcgtcgcctttcaggctgcaattaatgccgccattatcgaaatagcaaccaaccacagcgtgatggagcaacttatgtctgtgactggcgtccatatgaagatccttccctttgtggcacagggcggcgtggctactgacttctttatttttttctgcatcatttctttctcaacttttatctattatgtgagcgtcaatgttacccaggaacgtcagtacatcaccagtttaatgacgatgatggggctgcgtgagagcgctttctggcttagctggggcttaatgtacgccgggttcattctcatcatggctaccctcatggcattgatcgtgaaatcagcccagatagtggtgcttaccgggtttgtgatggtgttcacactgttcctgctgtacgggctttcactgatcactctggctttcctgatgagtgtattgatcaagaaaccttttctgaccggcctggttgtgtttctgttgatcgtcttttggggcatcttagggtttcccgcactgtacacccggctgccagccttcctggagtggaccctctgtcttctctcccccttcgcctttactgtgggcatggctcagttgatccatctcgactatgatgtcaattccaatgcacatttggacagctcacagaacccttatctgataatcgcgacactcttcatgcttgtgtttgataccctcctctatcttgtgctgaccctttattttgacaaaattttacccgcggagtatggtcacaggtgcagtccattgttcttcctgaagtcctgcttctggtttcagcacggccgggcaaatcacgtggttctggaaaacgagaccgatagcgatccaactccaaatgattgcttcgaacctgtgtctccagagttttgtggcaaagaggctatccgaatcaaaaatttgaaaaaggagtatgccggcaaatgcgaacgcgtggaggctcttaagggcgtggtcttcgatatatatgaagggcagattactgcccttctgggacactccggggcgggcaaaacaactttgctgaatatactttcaggactctctgtgcccacgtcagggtcggtcactgtctataaccacactctgagcagaatggctgatatcgagaacattagtaaattcactgggttctgcccacaatctaacgtccagttcgggttcttaaccgttaaggagaacctccggttgttcgctaagattaagggaattctgccacacgaagttgagaaagaggtgcagcgggtggttcaggaattagagatggagaatattcaggatattttggctcagaacctgtcaggaggccaaaatcggaaactcaccttcgggatcgcaatcctgggtgaccctcaggttctcctgttagatgagccaaccgctggactggatcccctgagccggcacaggatttggaatctgttgaaagaaggcaaaagcgaccgcgtgattttgttcagtacccagtttattgatgaggcggatatcctggccgaccgcaaagtctttatcagcaacggcaaacttaaatgtgccggctcaagcttattcctgaagaaaaagtggggaattggataccatttgtcattgcaccttaacgaacggtgcgatccagagagcattacttcactggtgaaacagcacatctcagacgccaaacttacggcacagtctgaggagaagctggtgtatatccttccccttgagcggactaataaattccccgagctgtaccgggatctggatcgctgctccaatcagggcatcgaggattatggcgtgtcgattacgaccttaaacgaagtatttctgaagctcgaagggaagagcactattgacgagtccgatattggaatttggggccagctgcagaccgatggggccaaggatatcggaagcttagtggaattggagcaagtactgtcctccttccacgaaacccggaaaactatcagcggagtggccctatggagacaacaggtttgcgctatcgctaaagtgcgttttctcaagttaaaaaaggagaggaaatctctttggacaatcctgctactatttggcatcagcttcatcccacagctgttggagcatctgttctatgagagctaccagaagagctacccgtgggagcttagccccaatacctactttctgagtcctggacagcagccccaagaccctctgacgcacctgctggtcatcaataagacgggttcgaccatcgacaatttcttgcactcgctccgtagacaaaatatcgctatcgaagtggacgcgtttggaactagaaatggcacagacgatccgtcctataatggtgccattattgtatccggcgatgagaaggatcaccgcttcagcattgcatgtaataccaagcggctgaattgtttccctgtgctcctggacgtaatttccaatggactcctcggtatctttaatagctccgaacacatccagactgaccggagtaccttctttgaggagcacatggattacgaatatggttatagatcgaatacatttttctggattccaatggccgcatcctttactccttacattgctatgtcaagtatcggcgactataaaaagaaggcgcactcccagctcagaatctccggcctgtacccgagtgcctactggtttgggcaggccttggttgacgtgagtttgtattttctgattctactgctcatgcagatcatggattacatcttcagccccgaggagattatttttatcatccagaatctgctcatccagattctgtgctccatcggctacgtcagttccttggtctttcttacctatgtgatctccttcatatttcggaacggaagaaaaaattctggtatttggtccttcttttttttgatcgtggtcatcttctccattgtagccacagaccttaatgaatacggttttctgggcttattctttggcaccatgctcatcccccctttcacgctcatagggagccttttcatcttcagcgaaatcagccctgacagcatggactacctaggggcctcagaatctgaaatcgtatacctggctctgctaattccgtacctccattttctcatcttcttgttcatcctgaggtgtctggagatgaactgtcggaagaagctcatgaggaaggatccagtctttaggataagcccccgatcgaacgctattttcccaaatcccgaggagccagagggcgaagaggaggatattcaaatggagaggatgcgtacggtcaatgctatggctgtgcgcgatttcgacgaaacacccgtgattatagcctcatgcctgagaaaggaatatgcaggaaagaagaaaaattgtttttctaaacggaagaagaaaatcgcaactagaaatgtctccttctgtgtaaagaagggggaagtgattggcctactgggacacaacggtgcaggaaagtcaacaactatcaagatgatcaccggggatacaaagccaaccgcgggccaagtcattctcaagggaagcggcggcggggaaccattgggttttctcggatactgtcctcaggaaaatgccctctggccaaacctaaccgtgaggcagcacctggaggtttatgctgctgtgaagggactccgtaaaggcgatgccatgatcgccatcacacggctggtggatgcgctgaaactccaagaccagctcaaagctcccgtgaaaaccctctccgagggtattaagcggaagctctgctttgtgctgagcatcctgggcaatccgtccgtcgtgcttttggacgagccttctacaggcatggatccggaaggccagcagcagatgtggcaggtaatcagagcaactttccgaaataccgagcgcggcgccctcctcactacccactacatggccgaagcggaggccgtatgtgaccgggtagctatcatggtgtccgggcggcttcgttgtatcggaagtattcagcacttgaagtcaaagtttggtaaggattatctgcttgagatgaaactaaagaacctggctcaaatggagcccctgcacgcagaaatccttcgactctttccacaggcggctcagcaggagcgcttttcttccctgatggtttataaactgccagttgaggacgtcagaccattgtcacaagcgttcttcaagctggaaatcgtgaagcagtcctttgacctggaggaatactcactgtcacaaagcactctggaacaggtgtttttagagttaagtaaggagcaggaactgggcgatctggaagaagatttcgacccaagtgtcaagtggaagctgctactgcaggaagaaccctag

SEQ ID NO: 179974 - DNA, 4308 bp, Artificial Sequence
  Description of Artificial Sequence: Synthetic coding sequence
atgagcaagcggcggatgagcgtgggccagcagacctgggccctgctctgcaaaaactgtttaaagaaatggcggatgaaacgacaaaccttactggagtggctctttagcttccttctggtgcttttcctctatctcttttttagcaaccttcatcaggtgcatgacaccccccagatgtcaagcatggacctaggcagggtggacagtttcaatgatactaattacgtgattgcttttgcccctgagtcgaagacaacacaagagatcatgaataaagtggcgtccgccccgttcttaaaaggcaggaccattatgggctggcccgacgagaaaagtatggatgagcttgacctgaactacagcatcgacgccgtaagagtcatctttacagacaccttttcttatcacctgaagttttcttgggggcaccgcattccgatgatgaaagagcatagagaccattcagcccactgccaggctgtgaatgagaagatgaagtgcgagggatcagaattctgggagaaaggctttgtcgcattccaggccgccattaacgctgcaatcatagagatagccaccaaccactcagtaatggaacagctgatgagtgttaccggcgtgcatatgaagattttgccctttgtggctcagggcggagttgcaactgatttcttcatcttcttctgtattatctctttctccacttttatttactacgtctcagttaatgtgacacaagaacggcagtatattaccagtctgatgaccatgatggggctgcgggagtctgcattttggctctcatggggactgatgtatgccggctttatcctcataatggctacattgatggccttgattgtgaaatccgcgcaaatcgtcgtcttgacaggcttcgtgatggtttttacattgttcctgttgtatgggctatccttaatcactctggcttttctcatgtccgtactgattaagaagcctttcttgaccgggttggtagtattcctgctaatcgttttttggggtatcctgggttttcctgccctgtacacaagactgcctgcctttttggagtggacactgtgtctgctatcaccctttgcgttcaccgtcggaatggctcaattgattcatctggattatgatgtcaattcaaacgcacatctggactcgtcacagaacccatatcttatcatcgcaactttgttcatgttggtgtttgacacattactctatctagtgttaacactctattttgacaagattctaccagctgaatacggccatcgatgttctccactcttctttcttaagagctgtttctggttccagcacggcagggctaatcatgtggttcttgaaaacgaaaccgactcggaccccacacccaacgactgcttcgaacctgtctcacctgaattctgcggtaaagaggcaatccggataaagaatctgaaaaaggagtacgccgggaaatgcgagcgcgtggaggcactcaaaggggtggtgttcgacatttacgagggtcagatcaccgctttgctaggacatagcggcgccgggaagactaccctactaaatatcctctcaggtctgagcgtgcccacctctgggagcgttactgtatataaccacactctgtcaaggatggcagatattgaaaacatctcaaaattcaccggattttgcccacagtccaatgtccagtttggattcttgaccgtcaaggaaaaccttcgtctcttcgccaagatcaagggaattctgcctcacgaagtcgagaaagaagtacagagagtcgtgcaggagttggagatggagaacatccaggatattctcgcgcagaatttaagtggtggacagaatcgcaaactcacgtttggcattgccatcctcggggatccccaggtgttgctgttggacgagccaactgctggccttgacccgctgtcccgccatcggatatggaacctgttaaaggaaggtaagtcagacagggtcattctattctcgactcagtttatcgacgaagctgacatcctagcagacaggaaagtcttcatcagtaacggcaagctgaaatgtgccggaagctccctgtttctgaagaagaaatggggcatcgggtaccatctttcactgcacctcaacgaacgatgtgaccccgaatctatcactagcctcgttaaacagcacatctcagacgcaaagctcactgcccagtctgaggaaaagctcgtatacattcttccccttgagagaaccaacaagttccctgaactctatagggatctggaccgatgctccaatcaaggcattgaggactatggagtctccatcaccactctgaatgaagtattcctgaaattggagggaaaaagtacaattgacgagtccgatattggaatttggggtcagctacagacagatggggcaaaggacattggaagcctggtggagttagagcaggttttaagctcattccacgaaacccggaagactatcagcggcgtggcattatggaggcagcaggtttgtgccattgctaaagtgagatttctgaagctcaaaaaggagagaaagagcctgtggacgatcctgctactctttggcataagcttcatcccacagctactcgagcatctcttctatgaatcatatcaaaaatcatatccatgggagctcagccccaacacatacttcctcagtcccggacaacaaccccaagaccccttaacgcacctgctagttatcaataagaccggaagtacaatagacaattttctccacagtttgcgcaggcagaatatcgcaatcgaggtcgatgcatttgggactcgcaacggcaccgatgacccttcttacaatggagccatcattgtttctggagatgagaaggatcaccgctttagcatagcatgtaatacgaagaggttgaattgttttcctgttctgttagacgtcattagcaacggcctgctgggaatttttaattcctccgaacacatccaaaccgacagatccacatttttcgaggagcatatggactatgaatatgggtatagatcgaatacattcttttggattccaatggcagcttcttttaccccatatattgccatgtcctcaattggcgattataaaaaaaaggcacactctcagctgcgcatttctggactctatccaagcgcatactggttcggtcaggccttagtggacgtttctctatactttctgatcttactgcttatgcaaattatggactatatattcagtcctgaggagattattttcattatccaaaacttgctgatacagattctgtgctccattggttacgttagctctctagttttcttgacatatgtcatctcctttatcttcaggaacggaagaaagaatagcggcatatggtcctttttcttccttatagtggtgatcttttctattgttgcgacagatttaaacgagtatggctttctcggcctgttctttgggactatgctaatccccccctttaccctgatcggcagtttatttattttcagcgagatatcccccgactcgatggactatctgggcgcctcggaaagcgagattgtgtatctggctctgctgatcccctacctgcactttctgatattcctcttcatactcagatgtctcgagatgaactgtcgcaaaaagctaatgagaaaggatcctgtgttcagaatcagccctagatccaacgccatttttcctaaccctgaggagcctgagggcgaagaagaagatatccagatggagcggatgcggaccgttaatgccatggcggtccgggattttgatgaaacgcccgtcatcattgcctcttgcctaaggaaagagtacgctggtaaaaagaaaaattgcttctcaaaacggaagaaaaagattgctaccaggaatgtatcattttgcgtgaaaaagggcgaagtcattggtctcctcgggcataacggcgcaggcaagagcaccacaatcaaaatgatcacgggagacacaaaacccactgccggacaagtgatccttaaggggtccggaggaggtgaacccctgggattccttggctattgcccacaagaaaacgcgctctggccaaatctgactgtgcgccagcacttggaagtgtatgcggccgtaaaaggtttaaggaagggtgacgcaatgatcgctatcacacgcctcgtcgatgccctaaagctacaggaccagctgaaggccccggtgaaaacactgtctgaaggcattaagaggaaagccggtgacagcgggcatttgtag

SEQ ID NO: 179975 - DNA, 3423 bp, Artificial Sequence
  Description of Artificial Sequence: Synthetic coding sequence
atgagcgtgggccagcagacctgggccctgctgtgcaagaactgcctaaaaaaatggcgaatgaagcggcagacactgctagaatggcttttttcttttcttctcgtgctcttcctgtatcttttcttctccaacctccaccaagtgcacgatacgcctcagatgtcgtctatggatttggggagggtcgatagcttcaacgacaccaactacgtcatagcctttgcccccgagtcaaaaactacgcaggaaattatgaacaaggtggctagcgcaccgtttcttaagggtcgaaccataatgggatggccagatgaaaagagcatggatgagctggatctcaactattcaatcgacgccgttcgagtcatttttaccgatacattctcctatcacttgaagttctcgtggggtcacagaatccccatgatgaaagagcaccgagatcactcagctcactgccaggccgtcaacgagaagatgaagtgtgaagggtcagaattctgggaaaaggggtttgtggcattccaggccgcaattaatgcggccatcatcgagattgccactaaccattccgttatggagcagctaatgtcagtgaccggggtccacatgaaaatcctgccatttgtggctcagggcggggtggccaccgacttcttcatcttcttttgcatcatcagcttttctacatttatttactatgtgtcagtcaatgttacgcaagaacgacagtacatcacttcactaatgaccatgatggggctgagggagagcgccttctggctttcttggggtctgatgtacgccgggtttatcctgatcatggcaacattgatggcgctgattgttaagagcgctcagattgtcgtccttacaggatttgtaatggtgttcaccctatttctactttatggactgtcactgataacactggcttttctcatgagcgtgctgatcaaaaagccattcctgactggcctggtggtcttcctcctgatcgttttttggggcattttagggttccccgccctgtatacaagactgcccgctttcctcgaatggacactctgcctcctgtccccttttgcatttactgtgggcatggcacagttgatacatttagactatgatgtgaacagcaacgcacacttggactccagccaaaacccatacctgattattgccaccttgtttatgcttgtgtttgacacactactttaccttgtgctcacactctattttgacaaaattttgccagccgagtatgggcacaggtgctcccctctcttcttcctgaaatcttgtttttggttccagcatggaagagcaaaccatgtcgtactggagaatgaaactgacagtgatccaactccgaatgattgttttgagcccgtgtcaccagaattctgcggtaaggaagcgatcaggatcaaaaacctcaaaaaagaatatgccggcaagtgtgagagggtggaggctttaaagggtgtagtattcgatatatacgaaggtcagatcaccgctttgcttggccattctggtgctggaaagactacactcttgaacatactatcaggtctgagcgtccccacatccggtagtgtcaccgtgtacaatcatacattgtcccgaatggccgatatcgaaaatattagtaaatttaccgggttttgtccacagtccaacgttcagtttgggttcctcactgtgaaggaaaacttacgccttttcgctaagattaaaggaatcctgccccatgaggtcgagaaagaggtgcagagagtagttcaggagctagagatggaaaacattcaggacatcctagcacagaacctgagcggcggccaaaatcggaagctgacttttggcatcgcaatcctgggggaccctcaagtgcttctactcgatgagccaaccgctggcttggaccctctaagccgacacagaatctggaatcttctgaaggagggtaagtccgacagagtgatactgttctccacgcaatttatcgatgaggcagatatcctggccgatcggaaggtttttatttccaatggcaagctcaagtgcgccggctcatccctatttctgaagaagaaatgggggattgggtaccacttatccttgcacctcaatgaacgttgcgacccggagagcattacctccttagtaaagcaacacatctcagatgctaagcttacagcccagtccgaggagaagctggtgtacatcctgccgcttgaacgtacaaacaaatttccagagctgtacagggatctggacagatgctccaaccagggcattgaggactacggtgtgtcgatcactactctgaatgaggtgtttctcaaactggaggggaagtcaactatcgacgagtcagacattggcatttggggtcagctgcaaacagatggcgccaaggacataggttctcttgtggagctggagcaggtcctgtccagctttcatgaaacccgcaagaccataagtggcgtggctttgtggcgtcagcaggtctgcgcaattgccaaagtcaggttcttaaagctgaagaaagaaaggaaatccctgtggacgattctgctgctgttcggaattagctttatccctcagctgctagaacacctgttctacgaatcgtaccagaaatcatacccctgggagctcagtccgaatacctacttcctgtctccaggtcaacagccacaggatcctctgacacatcttctcgtgatcaataagaccggatcaactattgacaattttctccattcattaagacgacaaaatattgccattgaggtggacgccttcggaacccgaaatggcactgacgatcctagctataatggtgcaatcattgtctctggagatgaaaaggatcaccgcttctccatcgcatgcaatactaaacgcctgaattgcttcccggtgttgttggacgttatctcaaacggactgctagggattttcaatagcagcgagcatatccagacagacagaagcacattcttcgaagagcacatggattacgaatatggatatcgctccaatacttttttttggattccgatggcggcgtcctttaccccatacattgcgatgagtagtatcggcgattacaagaagaaggctcatagccaattgcgtatcagtggcctgtatccatccgcctattggttcggccaggccctggtcgatgtctctctttattttcttatcctcctgttgatgcagattatggattatatcttctccccggaagaaattatattcattatccagaatctgctaatccaggtggtcatcttctccatagttgccaccgacttgaatgagtatggattcttaggcctgttctggcatcacgtgaataccagcttgcatattgactggctcagcatccattttttttag

SEQ ID NO: 179976 - DNA, 2217 bp, Artificial Sequence
  Description of Artificial Sequence: Synthetic coding sequence
atgcggggcccccccgcctggcccctgcggctgctggagcccccctcgcctgcggagccaggtcgactattgcccgttgcctgcgtttgggccgctgcctcaagggtgccaggctctctgtcacccttcaccggcctcaggccagctaggctgtggggagcaggtcccgcattgctttggggagtgggagccgctagacgatggcggtctggatgtcggggcgggggacctggcgcttctaggggcgtgcttggattagcaagattgctgggcctgtgggcccgtggccccggctcctgtagatgtggcgctttcgccgggcctggcgctccacgccttccccgcgcccgttttccaggaggtcccgctgctgccgcatgggcgggcgacgaagcctggaggaggggacctgccgctccccccggggacaaagggcgactcagacctgcagccgctggtctgccagaggcccggaaactgctgggcctggcctatcctgagagacggcggttggccgcggctgttgggtttcttaccatgagtagtgttatttccatgtccgccccgttctttctcgggaaaatcatcgacgtgatctatactaatccaacagtggactactctgacaacttaactagactttgtctgggactgagtgcagtctttctctgcggagcggcggctaatgctatcagggtgtatctgatgcagacctctgggcagcgtattgtcaaccgacttagaacttccttattcagctcaatactgcgacaggaagtagccttctttgacaaaactagaaccggagaactaatcaacagactatcatccgacacagcgctgctgggacgatccgtcaccgagaatctctcagacggtctccgagcaggtgcccaggcaagtgtcgggatcagtatgatgttctttgtttcacctaatctagccacattcgtgctgagcgttgtgccccccgtctccataatcgccgtaatctatggccggtatttgcgaaagctgacaaaagtgactcaggactccctggcccaggcaacacagctggcagaggagaggattggcaacgttagaacagttagagccttcggcaaggagatgaccgagatagagaagtacgcttccaaagtggatcacgtaatgcagctggcccggaaggaagcttttgctcgagccggatttttcggggccacaggactgtctgggaacttgatagtgttgtctgtgctgtacaagggcggcctgctcatgggttctgcacacatgaccgttggagaactctccagcttcctgatgtacgccttctgggtggggatttctatcggcggactgtccagtttctatagcgagctgatgaaaggattgggagctggaggccgcctttgggagctgttggagcgcgagccgaaactccctttcaacgagggagtgattttaaatgagaagtcttttcagggcgccttagaatttaaaaacgtgcacttcgcatatcccgcccggccggaggtgcccatctttcaggacttttcgctgtcgattccctccggaagcgtcacggcccttgtcggaccctcaggtagtggtaagagcaccgtgttgtcgttgctgctgaggctgtatgacccagcttctggcactatatctctcgacgggcacgatattcggcagttgaaccccgtgtggctgaggagtaagatcgggaccgtctcccaggaacccatcctgttctcctgcagtatcgcagaaaatatagcgtacggggccgacgatcctagctcagttactgcagaagagatccagagagtcgcggaagtcgccaatgcagtggcttttattcgaaacttcccgcagggatttaacaccgtagtcggagagaaaggcgttctgttgtcaggaggtcagaagcagaggattgcaattgctcgagcgctcctgaagaatccaaagatcctgctattagatgaggctacaagtgccctggacgccgaaaatgaatatctggttcaggaggctctggatcggttaatggatggccggaccgtacttgtcatagctcacagactgagtacaatcaagaacgctaacatggtcgctgttttggaccaggggaaaataactgaatacgggaagcacgaggaattgctgtcaaagccaaatggcatctacagaaagttaatgaataaacagtcttttatctcggcctag

SEQ ID NO: 179977 - DNA, 2529 bp, Artificial Sequence
  Description of Artificial Sequence: Synthetic coding sequence
atggtgaccgtgggcaactactgcgaggccgagggccccgtgggcccagcttggatgcaagatggcctcagcccatgctttttcttcacacttgtgcctagcacaaggatggcacttggtacactcgccttggtactcgcccttccttgcaggaggcgtgaaaggccagccggcgccgacagcttgtcatggggtgcaggacctagaatcagcccatacgtgcttcagctcctcttagctacactgcaggcagcgctgccattggctggtctggctgggagagtggggaccgcccggggagcacccttgccctcttacctgcttttagcctccgtcttggaatctcttgctggtgcatgcggactgtggctgctggttgtcgagcggtcccaggcacgacagaggctcgccatgggaatctggatcaaattccgtcactctcccggacttctgctcttgtggacagtggcttttgctgcggaaaatctggccctagtcagctggaactctcctcagtggtggtgggctcgcgcagacctcggacagcaggttcagttttctctatgggttttgcgctacgtcgtgtcaggggggcttttcgtgcttggcctatgggcaccaggcttacggccacaaagctatacactgcaggtgcacgaggaggatcaggatgttgagcgcagtcaagtacgttccgccgcacagcagtcaacttggcgagattttggacgcaagctgcgtttactcagcgggtatctgtggccccgcggtagccccgccctgcagttggtggtgctgatctgtttagggctcatgggcctagaaagggccctcaatgttctggttcccattttctatcggaacattgtgaatctgctaacggagaaggctccatggaattcgctcgcctggaccgtgacctcctacgtgttcctgaagttcttgcagggtggcggtaccggctctacggggtttgtaagtaacctgagaaccttcctttggatccgggtgcagcagtttacttcaaggagagttgaattacttatattctctcatctccatgagctgtcactgcggtggcatctgggacggagaacaggcgaagtcctgagaatagccgacaggggcacctctagcgtgaccggattgctgtcctacctggtgtttaatgtcatcccaactttggctgacatcatcatcggaatcatctacttctccatgtttttcaatgcctggttcggcctcatagtgttcctgtgtatgagcttgtatctgacgctaaccatagtggtgacagagtggaggactaaatttagaagggctatgaatacccaggagaacgccaccagagctcgggcagtggacagtctattaaactttgaaaccgtaaagtactacaatgccgagagctacgaagtggaacgatatcgggaggcaatcatcaaatatcagggcctggagtggaaaagcagcgcctctttagtactcctgaaccagacccagaacttggtgattgggctcggactgctggccgggtcgctgctgtgcgcatattttgtgacggagcagaaactgcaggtgggcgactacgtgctgttcggtacctacatcattcagctgtatatgcccctcaactggtttggaacctattacagaatgatacagacaaacttcatcgatatggaaaatatgttcgacctcctcaaagaggaaacagaagtaaaggacttgcccggggctggccctttaagatttcaaaaaggacgaattgagtttgaaaacgtccatttcagctatgccgacgggcgcgagactttacaggatgtctcattcacagtgatgcctggtcaaacactggcactcgttggccccagcggagcaggtaagagcaccatcctgcgactcttgttccggttctacgatatctccagcgggtgcatccgcatcgacggacaagacatcagtcaggtgactcaagcctccctgcgctctcatatcggggtggtcccccaggacacagtcctattcaatgataccatcgcagataatatacggtatggtagagtcacagccggcaacgacgaggtggaggctgccgcccaagctgcagggattcatgacgccatcatggcttttcccgaaggataccgcacacaagtcggagagcgcggactcaagttatcaggaggagaaaaacagcgtgttgcaatcgccaggaccatcctgaaagccccaggcatcatactgctggacgaggccacaagcgcattggacacctccaatgagcgcgctatacaagcctctctcgctaaagtctgcgccaacaggacgactattgtggtcgctcatagactctctacagtggtgaatgccgaccagatcctggtcatcaaggacgggtgtattgtagagcgcggccgacacgaggcccttctgtcccgaggaggagtgtatgctgacatgtggcagctgcagcagggacaggaggagacctctgaagataccaagccccagacaatggaacggtag

SEQ ID NO: 179978 - DNA, 636 bp, Artificial Sequence
  Description of Artificial Sequence: Synthetic coding sequence
atggtgaccgtgggcaactactgcgaggccgagggccccgtgggccccgcttggatgcaggacggcctttctccctgttttttctttactcttgtgccatccacccgcatggccctgggaactctcgctctggtgctcgcattaccgtgccggcgaagagagcgcccagccggggccgacagcctctcgtggggcgccggccctcgcatctccccctacgccctcccaggcggaccccattgtcaagctatctacttctggcctccctgttggcgcgtctggcccgcaccggttgcatgtgggtgtctctcttggagcggcgccagacacggctcggtctggcagtgggcaagtggatcctcctctgggaccgcgctggttagttgttcatcgggcctgtggcgcctccagttgagaacttggccctggtgcctggggactgcccactcaggagggggacagggccagacttgggcttcccgattttccctggcgtgcggatgctgcggcatgtggtctctagaggggtgcctctcttgggtgtctgggccattggactttgtgccgtcacccatccactgtcgattcatgaaacggactaaaatgtggaagggagcttctgagctggcggactag

SEQ ID NO: 179979 - DNA, 2391 bp, Artificial Sequence
  Description of Artificial Sequence: Synthetic coding sequence
atggtgaccgtgggcaactactgcgaggccgagggccccgtgggcccagcctggatgcaggatggactgtctccatgctttttttttaccctcgttccttccacccgcatggccttaggcaccttggccttggtacttgccttgccttgtaggcggcgagagcggcccgccggagctgactccctgagttggggcgctgggcctcgcatttccccatacgtgttgcaacttttactggcaacgctgcaggccgccttacctctggccggactggcaggtcgggtcggtacagctaggggcgcacccctgccatcatacctgctgctcgcctctgtgctggagagtcttgccggcgcctgcggtctttggctgttggtagttgagcgctcacaagccagacagaggttggccatggggatctggattaaattcaggcactcacccggactgctactgctgtggaccgttgccttcgcggcagaaaatctcgccctggttagctggaacagtccacagtggtggtgggcgagggcagatctaggacaacaggtgaggagcgctgcccaacagtcaacatggagagatttcgggcggaagttacgccttctgtcgggctatctctggccacgcggatcgccggccctgcagttagtggtcttgatctgcttgggtttgatgggtctggagagggctctaaatgttttggtgcctattttctaccgaaatatcgtgaatctcctcacggagaaggccccctggaacagcctggcatggactgtgacaagttatgtgttcctcaagttcctgcagggaggcggcaccggatctaccggatttgtgagcaatctgaggacatttctttggatcagggtccagcagttcacctcccggagggtcgagttgctgatcttcagccatcttcacgaactgagtcttcgatggcatctgggtcgtcggactggggaggtgctcagaatcgcggatcggggcacttctagcgtgacaggacttttgagctatcttgtgtttaatgtcataccaacattagccgacatcatcattggcattatctactttagcatgttctttaacgcttggttcggcttaatcgtgtttctgtgtatgtccctgtatctcacgctgactattgttgttaccgagtggcgtactaagttccgcagggccatgaatacacaggaaaatgctaccagggcaagggccgtagattctctgctgaatttcgaaacagtgaagtattataatgcagagtcctatgaagtggaaagatatagggaggccatcataaaataccagggcctggaatggaaatctagcgcttctcttgtcttgctgaatcagacacagaatctcgtcatcgggctcggcttactcgcaggtagtctactatgcgcctattttgtgactgaacaaaagctccaagtcggagactacgtcttgttcgggacctacatcatccagctttacatgccattgaattggttcgggacgtactatagaatgatccaaacaaatttcatcgacatggagaatatgtttgacctgctgaaggaagaaaccgaggtcaaagacctgccaggagccggtcctctccggttccagaagggcagaattgagtttgaaaatgttcactttagctatgccgacgggcgtgaaaccctgcaggatgtcagttttaccgtgatgcccgggcagaccctggcacttgtgggccccagcggggccggaaaatccacgatcctaagactgttatttcgcttctatgatatcagtagtggctgcatccgcatcgacggacaggacatatctcaagtcacacaggctagtcttcggagtcacatcggggtggtgccccaagatactgtgctcttcaacgacaccattgccgacaatatcagatacggcagagtcaccgcgggcaacgatgaagtcgaggccgcagcccaggcagcaggcattcatgacgcaatcatggcgtttcccgagggttacagaacccaggtgggtgaaagaggacttaaattgtcaggtggcgagaaacaacgagtagcgatcgccaggactattttgaaagctccggggatcatactcctagacgaggctacctctgccctcgacacatccaatgagagggctatacaggcctcactagccaaagtctgcgctaaccggaccaccatcgtagttgcacaccgactgtcaacggtcgtgaatgcagaccaaatcctggtgatcaaagacggttgtatcgtggagcgtggccgccatgaggccctgctctcaagaggaggcgtgtatgccgatatgtggcaactgcagcagggccaggaggagaccagtgaggacaccaaaccccagaccatggaaagatag

SEQ ID NO: 179980 - DNA, 2262 bp, Artificial Sequence
  Description of Artificial Sequence: Synthetic coding sequence
atggccctgctggccatgcacagctggcggtgggccgccgccgccgccgcatttgaaaaacgtagacatagcgcaattctgattagacccttggtcagtgtatccggcagtgggccccagtggcggccacatcaactgggggccctcggaacggcacgggcctatcagcagatcccagaatcgctgaaatccattacatggcagcgccttggcaaggggaatagcgggcagtttctggacgccgctaaggccttgcaggtttggcctctgatcgagaagcgtacctgttggcatggccacgcaggcggcggactgcacactgaccctaaagagggactgaaagatgtggacactcgaaaaatcatcaaagcgatgttgtcgtacgtatggcccaaggatcggcccgatcttagagccagggtggccatctcgctgggctttctgggtggcgccaaggccatgaacatcgtggtcccatttatgttcaaatacgccgtcgattctctgaaccagatgagcggtaacatgctgaacctgagtgatgctccaaacacagtcgccactatggctaccgcagtgcttataggctacggagtgagccgcgccggcgccgcttttttcaacgaggtcagaaatgcagtctttggcaaggtcgcacagaactccatccgtcgaatcgcgaagaatgtgttcctccacctgcacaacctagacttaggattccatctaagcaggcagacaggagcattaagcaaggccattgataggggtacccgtggcatttcttttgtactaagcgccctcgtctttaatctacttcctatcatgtttgaagtgatgctggtgtccggcgtactgtattataagtgcggcgcccagtttgctcttgtgactcttggaaccctggggacctacactgcttttacggtcgcagtgacccggtggcgcacccgttttcgaattgagatgaacaaggccgacaacgacgctggcaatgccgctatagatagcctgcttaactacgagaccgtgaagtatttcaacaacgagcgctacgaagcacagaggtacgacggctttctcaaaacttacgagacagcctcccttaagtccacgtcgactctggccatgctcaactttggccagagtgcaattttcagcgtgggcctgacagcaatcatggtcctggcttctcaggggattgtcgccggaactctgacagttggcgacctggtgatggtgaatggtcttctgtttcagttgtccctgcctctgaatttccttggcaccgtgtatcgcgaaacacgccaggccctgattgacatgaacacgttattcacgctgttgaaagtggacacgcagatcaaagataaggtcatggctagcccacttcaaatcaccccccaaacagcaaccgttgcatttgataatgtacacttcgaatacatagaaggccagaaagttttaagtggcatttctttcgaggtcccagctggcaagaaagtggctatcgttggtggatcggggtcagggaagagtaccatcgtgcgcctgctgttcagattttatgagccacagaagggctccatttacctggccggacagaacattcaggacgtgagcctggaatccctgagaagggctgtgggcgtagtccctcaggacgctgttctgttccacaacacaatctactacaatctgctttacgggaatatcagtgcctcgcctgaagaagtatacgccgtagcaaaattagctgggctgcatgacgcaatcttgagaatgccccatgggtatgacacccaggtgggggagcgcggtctgaaactgagtggaggagaaaagcagagggtggccattgccagggccattcttaaagatccccccgtgattctttatgacgaggctacctctagcctggacagtattacagaggagacaatactcggggctatgaaagacgtggttaagcatcggacaagtatcttcattgcacaccgcctgtcgacagtagttgatgcggacgagataattgtgttggaccaaggcaaggtcgccgaaagaggaacacaccacggactgctggcaaatccccactctatatattccgaaatgtggcacactcagagcagcagagtgcagaaccacgacaatccaaaatgggaggcaaagaaagagaacatatcaaaggaagaagaaagaaaaaagctccaggaggaaattgtcaattctgtcaagggttgcggtaactgctcatgctag

SEQ ID NO: 179981 - DNA, 2259 bp, Artificial Sequence
  Description of Artificial Sequence: Synthetic coding sequence
atggccctgctggccatgcacagctggcggtgggccgccgccgccgcggcatttgaaaagagaaggcactccgccattctcattaggcccctggtgtcagtgtcagggagtggtcctcagtggcggccgcatcaactgggtgctctgggcacagcccgcgcgtaccagatacccgaaagccttaagagcattacatggcagcggctgggaaaaggcaactctggtcagtttctggatgctgccaaggccctgcaggtatggccgcttatcgaaaagagaacatgctggcacggacatgccggcggggggcttcacaccgacccaaaggaaggtctgaaagacgttgatacccgaaagatcattaaggccatgctcagctacgtctggcctaaggacaggcccgatctgagggctagggttgctatttcgcttgggttccttgggggtgctaaggccatgaatatcgtcgtcccatttatgttcaagtatgccgttgactctttaaaccaaatgtctggcaatatgctgaatctttccgacgctcctaatacagttgctacaatggctacagcggtgttgatcggctacggggtcagtagagctggagcagccttctttaacgaagtgaggaacgctgtctttggtaaggtcgcccagaatagtatccggcggattgccaagaacgtatttctacatctgcacaatctggatttagggtttcatctatcccggcaaaccggagcgcttagcaaggcaattgacaggggtactcggggtattagctttgtgctttcagcgttggtattcaacttactccccataatgtttgaagtgatgctcgtgagcggggtcctttattataaatgcggagcgcagttcgcgctcgttacgttggggaccttaggcacttacaccgcattcacagttgctgtgacacgctggagaactagatttcggatcgagatgaataaggcggataatgacgctggtaatgccgccatagattccctgctgaactatgagacagtaaaatattttaataatgaacgatatgaggcgcagcgatacgacggatttctcaagacttatgagactgccagtctaaagtcaaccagcaccctggcgatgctgaactttggacaaagtgccatcttcagcgttggtttgactgcaattatggtcctagctagccagggcattgtcgcgggaactctcacggtgggagatcttgtgatggtcaatgggctgctgtttcagctgagccttcccttgaatttcttgggaacagtgtaccgggaaaccagacaggcactgattgatatgaacacattatttacactcctgaaggtcgacactcagattaaagacaaagttatggccagtccgttacagattacgccacagaccgccaccgtcgcgttcgacaacgtgcatttcgaatatatcgagggtcagaaagtgctctctggcatttcctttgaggtccccgccggcaaaaaagtggctatagtgggcggctccggctccggaaaatctacaatcgtgagactccttttccggttttacgaaccccagaaagggtcaatatatctggccgggcaaaacatccaggatgtttccttggagtcactgcgacgtgccgttggggtcgttcctcaagatgcagtgctgttccacaacacgatttattacaatctcctgtacgggaatatctccgcctcacccgaagaagtctacgccgtggcaaagctggccggcttgcacgatgctatattacgcatgccccacggctacgacacacaggtgggagagcggggcctgaagctgtctggtggtgaaaaacaacgcgttgccatcgccagagccatactgaaggatccacctgttattctgtacgatgaagcaacaagtagcctggatagcataaccgaggaaaccattttgggcgctatgaaggacgtcgtgaaacacagaacttccatttttatcgcacatcggctgtcgacagtcgtggacgctgatgaaatcattgtcttggaccagggtaaggtggctgagcgcgggacccatcatggtctgttagctaacccgcattctatttactctgaaatgtggcatacgcaaagcagccgagttcagaaccatgataacccaaaatgggaggccaagaaggaaaacattagcaaagaagaggagaggaaaaagctgcaggaggagatcgtgaatagtgtgaaaggatgtggcaattgttcgtgctag

SEQ ID NO: 179982 - DNA, 2109 bp, Artificial Sequence
  Description of Artificial Sequence: Synthetic coding sequence
atggccctgctggccatgcacagctggcggtgggccgccgccgccgccgccttcgagaagaggcgccactcagccattctgatccgcccacttgttagtgtatccgggtcaggccctcagtggcgcccacaccagctgggggccttgggcacggctcgggcgtaccaggccctgcaggtgtggcccctcattgagaaacggacctgttggcatggacatgcaggcggcggactgcacactgaccctaaagagggactgaaagatgtggatacgcgaaagatcattaaggccatgctaagttatgtgtggccaaaagatcggcctgacctgcgagcaagggtggcgatttccctcgggtttcttggtggcgcgaaagctatgaacatcgttgtgccatttatgttcaagtacgccgtggactctctgaaccagatgtccgggaacatgttgaacctatccgacgccccaaatacggtggccactatggccactgctgtgctcatcggttatggggtgtcacgagcaggagccgcattttttaatgaagtccggaacgccgtgttcggtaaggtcgcgcagaactctatccgaagaatcgccaaaaacgtgtttcttcatcttcacaacctggatctggggttccatttgagcagacagacaggagcgctctcaaaagcaattgataggggaacaagaggtatcagcttcgttttgtcggccctggttttcaacctgctgcccattatgtttgaagtgatgcttgtgagtggagtgctgtactacaagtgcggggctcagttcgcattagtgactctgggtactctcggaacatatacggcctttacagtggccgtgaccagatggagaacccggttccgcatcgaaatgaacaaagcagataacgacgccggaaatgctgccattgactctctcctgaattacgagaccgtcaaatacttcaataacgaaaggtatgaggcccagcgttatgacggatttctgaagacttacgagactgcatctctcaagtcgacctccacattagcgatgcttaactttggtcaatccgcaatcttttcggttggactcacggccataatggtactcgccagccagggtattgtagctgggacgctgaccgtaggcgatttagtgatggtcaacggccttctgtttcaactcagtctgcccctgaacttcttgggtacggtctacagggaaacgcgccaggccttaattgatatgaacaccttatttacgcttctaaaagtggacactcagatcaaggacaaagtgatggcaagtccgctccagatcactcctcagacagcgacggtggcattcgataatgtccacttcgagtacatcgaagggcagaaggtgctgtctggaatctcctttgaggtaccggccggcaaaaaggtggcgatcgttgggggatcagggtcaggaaaatctaccattgtcaggctacttttccgcttctacgaaccccagaagggaagcatctaccttgctggccagaatattcaggacgtctccctcgaatctctgcggcgtgccgtcggtgtcgtgccacaggatgctgtgttgtttcataatacgatctactacaaccttctgtacgggaatatctccgctagtcctgaagaggtttacgccgtggcgaaattagccggcctccatgatgcaatcttgaggatgcctcacggctacgatacccaggtaggcgaacgcggactcaagctatcaggcggcgagaaacagagagtcgcgattgcccgggcgatcctgaaagaccctcctgtgatattgtacgatgaagccacttccagtctcgattctattacagaagaaactattcttggcgccatgaaggacgtggtgaagcaccggacctccatcttcattgcccaccgcttgtcgacagttgtggatgccgacgagatcattgtgctggatcaggggaaagtggccgagcggggcacccatcacgggctactcgcaaacccacactctatttattcagaaatgtggcacacacaatcttctagggttcagaaccatgacaatccaaagtgggaagccaaaaaggagaatatttcatag

SEQ ID NO: 179983 - DNA, 2181 bp, Artificial Sequence
  Description of Artificial Sequence: Synthetic coding sequence
atggccctgctggccatgcacagctggcggtgggccgccgccgccgccgcctttgagaagcggcgacatagtgccatcttgataagaccattggtgtccgtgagcggaagcggcccccagtggagaccccatcagttgggcgccctcggtaccgctcgcgcttaccaggctctgcaggtgtggccgttgatcgaaaaaaggacatgttggcacggtcatgctggaggcggccttcacactgatcccaaggagggactcaaggatgtggatacccggaaaatcattaaggcaatgctttcttacgtgtggcccaaggatcgccctgatttaagagctcgcgtggcaattagtctgggcttcttaggcggcgcaaaggctatgaacatcgtggttcccttcatgtttaaatatgccgtggacagcttaaatcagatgagcggcaatatgcttaacctgtccgacgctcctaataccgtggcaactatggctaccgccgtgctgatcggctatggagttagtcgtgctggtgctgcttttttcaatgaagtccgtaacgccgtgttcgggaaggtcgcacaaaacagcattcgtagaatcgctaaaaatgtgttcctccatcttcacaatttagacctgggttttcacctgtctagacaaactggcgccctgagtaaggccatcgataggggaactcgtggcatatcattcgtgctgtcagcattggtatttaacctactcccaattatgttcgaggtgatgctcgtgtccggagtgctatattacaaatgcggcgctcagttcgccctggttactctcgggacactaggcacatacaccgcctttactgtcgccgtgactcgttggcggacacgctttcggattgagatgaataaagccgacaacgatgcggggaacgccgccatagattctttgttgaactatgaaactgttaagtacttcaacaacgagcgatatgaggcacagagatacgacggctttctgaaaacctacgagaccgccagtctgaaatctacttctacgttagctatgctgaacttcggccagagcgctatattctccgtgggcctgaccgccattatggtgctggcatcccagggcatagtcgctggaactctgacagttggcgatctcgtcatggtcaatggcttactgtttcagctcagtctccctctgaattttctcggtactgtctaccgcgaaacccggcaggctctaattgatatgaatacactatttactcttctcaaagtcgatacacagataaaagacaaagtcatggctagccccctccaaattaccccccaaacagccaccgtcgcattcgacaacgtgcacttcgaatacattgaaggccagaaggtcctgtctgggatctcattcgaagtccctgctgggaaaaaggtagccatagtaggtggttctgggagcggtaaatcaaccatcgtgagacttctgttccgcttctatgagccacaaaaagggtccatttatttggctggccagaacatccaggatgtgtccctagaaagtctacggcgagccgtgggtgtggtacctcaggatgccgtgctgttccacaacactatttattataatttactgtatggcaacatcagtgccagtccggaggaggtgtacgccgtggcgaagctggctggactccacgacgccatcctgcgaatgccccacgggtatgatacccaggtgggagagcgaggacttaagctgtcaggtggggagaagcagagagtcgcaatcgccagagccatcttaaaggacccccccgtgatcctgtatgatgaggccaccagcagcctcgactcgattaccgaggaaaccatcttgggagcaatgaaagacgtggtcaagcaccggacatccattttcattgcacataggctgagcactgtagtagacgccgatgagattattgtgttggatcagggaaaggtggccgaacgtggcactcaccacggccttctggcaaatccccatagtatctattccgagatgtggcacacccagagcagtcgggtacagaatcacgataatccaaaatgggaagcaaaaaaggaaaatatcagtaaggaggaagaacgtaagaagctccaggaggagatcgtgaactcagtgaaaggttgtggcaactgctcatgttag

SEQ ID NO: 179984 - DNA, 2208 bp, Artificial Sequence
  Description of Artificial Sequence: Synthetic coding sequence
atgctggtgcacctgttccgggtgggcatccggggcggccccttccctggtcggctcctccctccacttagattccagaccttcagcgccgtgagaaatacctggagaaatggaaagaccggtcagctgcacaaggctgagggggagtattccgacggctatagatcaagctcgcttttacgcgcagtcgctcatctccgcagtcagctgtgggctcacttacctcgggctccgctcgcccctcgttggagtccaagtgcttggtgctgggtcgggggtgctctcctaggccccatggttttgtcaaaacacccacatctttgcctcgtcgctttatgcgaggcagaggaggccccgccagcttcatcaacaccccatgtcgttggcagccggtttaactggaagctcttctggcagttcctacatccgcatctgttggtgctgggtgtcgccgtcgtgctcgccctgggcgcagcactcgtgaacgtccagatcccactgctcctcggtcagctggtagaagtcgttgccaagtatacacgcgatcacgttggcagttttatgaccgagtctcagaacttatcaacacacttgctgattctctacggtgtccaaggccttcttacgttcgggtacctggtgttgctctctcatgtaggggaacggatggcagtggatatgaggagagcactgttttcatctctactgcgacaggacatcacattctttgatgccaacaaaacaggccaactcgtgagccgtctgacgactgacgtccaagaattcaaatcttctttcaaactagtaattagccagggtctacgaagctgcacccaggttgccggttgtttggtcagcctctcaatgttatctacgaggctgaccttacttctgatggtggcaacccctgctttaatgggcgtggggacactgatggggtccggacttagaaagctgtcaagacagtgccaagaacagatcgccagggctatgggggttgctgacgaggcgctcggcaacgtgcggacagttagggcattcgctatggaacagcgtgaggaagagagatacggcgccgaattggaggcatgcagatgcagagctgaggaacttggtcggggcatcgcattattccaaggactgagcaatatagcgtttaattgtatggtactcggcacactctttatcggggggagtctcgtggccggacaacagctgactgggggagacctcatgagctttttggtagcctcccagaccgtgcagcgctcgatggccaacctatcagtcctgttcggccaggtggtccggggtctttcggccggggcccgcgtgtttgagtacatggccctcaatccatgtatccctctgtccgggggatgctgcgttccaaaggaacagttaagaggcagcgttactttccagaacgtgtgcttttcgtacccctgtcgccctgggtttgaagtgctgaaggacttcacactcacgctgccccctggcaagatcgttgctctggttggccagagtgggggagggaagaccaccgtggcctccctgctggaaaggttttatgatcctacggcaggagtcgtgatgctggacggccgagatctgcgcactctggaccctagctggctgcgtgggcaggtcgtgggattcatatctcaggaaccagttctgtttggaactaccattatggagaacatccgttttgggaagcttgaagccagcgacgaggaggtgtacaccgctgcccgggaggcaaatgcccacgaatttatcacctccttcccagagggatataacactgtggtgggagaaagagggactaccctgtcagggggccagaaacaaaggttggctattgcaagagcgctcataaaacagcctacggtgctcatcctagacgaagctacctcagctctcgacgcggagagcgaaagggtagtgcaggaggctttagaccgcgcgtcagcaggaagaaccgtcctcgtgatcgctcacagactgtcgaccgttcgcggcgcacattgtatcgttgtaatggccgatggtcgggtatgggaagcagggacccacgaggagttgctgaagaagggcggtctatacgccgagctcattagacgacaagcgcttgatgcacctcgcaccgccgcgcccccccccaagaaaccagagggccctcgatcacatcaacacaagagttag

SEQ ID NO: 179985 - DNA, 1404 bp, Artificial Sequence
  Description of Artificial Sequence: Synthetic coding sequence
atgctggtgcacctgttccgggtgggcatccggggcggccccttccccggcaggttgctccccccgctaagatttcagacatttagtgccgtcaggagactcctacgcctgcagcccagggtgagtcagaaagaaggaacactgggggtgtcggatcacgcccaatccgcactgccaactggtggacccttgagctggccctggcgatatagtgacggctaccgctctagttccttgctgagggccgtcgcccacctgcgttcacagctctgggctcacctgccgagagcccctcttgctcccagatggagccccagtgcatggtgctgggtcggtggcgccttgctgggaccgatggtgctctccaagcatcctcacctgtgtttggtggcattatgtgaggccgaggaagcaccaccagcatcttccacgcctcatgtggtcgggagcaggtttaattggaaacttttctggcaattccttcaccctcacttgcttgtgctgggagtcgccgtggtcctggcactaggagcagcactggtgaacgtgcagattcccctcctcctgggccagcttgtcgaggtggttgctaagtatacccgggaccatgttggatcattcatgactgagtctcagaacttgtctacacacctgctgatcctttacggcgtccaaggactgttaaccttcggatatcttgtactgctgtcccatgtgggagagcgcatggcagtggatatgaggcgggctcttttttcatcactcctccgacaggacatcaccttcttcgatgccaacaagactggtcagctggtcagtcgactgacaacggatgtccaggaattcaagtctagcttcaagctagtcatatcacaaggacttagaagctgcacacaggttgcaggctgtctagtctctctttcgatgctctctacacgactgacactattattgatggttgcaactccggcgcttatgggggtgggcactctcatgggctccggcctgcgcaagctttctcggcagtgccaggaacagatcgctcgtgcaatgggggtcgcagacgaagcattgggaaatgtgagaactgtgcgggctttcgccatggaacagcgggaggaagagcggtacggcgctgagctagaggcctgccgctgccgagccgaagaattggggcggggcatcgctttgtttcaaggcctgagcaatatcgcttttaactgcatggtcctgggaaccctttttattggagggagcctggttgcggggcaacagctgaccggcggggatcttatgagtttcctcgtcgcctctcagacagttcagaggcaggtccatggccaacccctgtgtcccgtgtgggcaggcggacccggggctgaatgcaggtgtccaggtctgtag

SEQ ID NO: 179986 - DNA, 2157 bp, Artificial Sequence
  Description of Artificial Sequence: Synthetic coding sequence
atgctggtgcacctgttccgggtgggcatccggggcggccccttccctgggaggctgcttccaccactgcgattccagaccttctcagccgttcggtatagtgacgggtatcgcagtagttccctcctgagggccgtcgcgcatctgagatctcagctctgggcccatctaccccgagcacctcttgcgccacggtggtccccgtctgcatggtgttgggtcgggggcgctctgcttggtcccatggtgttatccaagcacccccacctctgtcttgtggcactttgcgaggctgaagaggccccaccggcttcttccacaccccacgtggtgggttctcggtttaactggaagttgttctggcagtttctccatccacaccttctggttttaggggtggctgtcgtcctggctcttggggccgcattagtaaacgttcaaattcctctgctgctgggccagttggtggaggtagtcgcaaaatacacgagagaccatgtgggcagcttcatgactgaatctcaaaacctgagcactcacctgttaattttgtatggtgttcagggactgttgacatttggctatctggtcttgctctcacatgtcggagagcgcatggccgtagatatgcgtagggccctgttttctagccttctacggcaggacatcaccttttttgatgcaaacaagaccggacagttagtctctcgactgacgaccgacgtgcaggagttcaaaagcagtttcaagcttgttatctcacaagggttaaggtcctgcactcaggttgccggttgcctggtgtctctgtctatgctcagcaccaggctgacattgcttcttatggtggcaactccagcactcatgggggtgggaacactaatgggatcgggactacgcaagctgtcccgccagtgtcaggagcagatcgctcgtgctatgggtgtcgcggatgaggccctggggaacgtgcggaccgtgcgggcattcgccatggagcagagagaggaagaaaggtatggggccgagctcgaggcatgcaggtgtcgggccgaggagcttggcagagggattgcactgttccaaggtctgagcaatatcgcctttaactgtatggttctgggtaccctgttcatcggtggctcgcttgtggcaggccagcagctgactggtggcgatctgatgagcttcctggtggcaagtcagacggtgcaacggagcatggcaaacctatctgtgctctttggccaggtcgtcaggggcctgagcgctggagctcgggtgtttgagtacatggccctcaacccttgcattcccctgtcgggcggctgctgcgttccgaaagaacaactgcggggtagcgtaacatttcaaaatgtgtgcttctcatatccctgcaggccagggttcgaagtcctgaaagatttcacattaaccctacctcctggcaaaatagttgctttagtgggtcaaagcggggggggcaaaacgaccgtcgcttctcttttggagagattttatgacccaaccgctggagtcgtgatgctcgacgggcgcgacctgaggacactggacccatcctggttgcgtggacaggtagttggcttcatttctcaggaacccgtcttattcggcactacaattatggaaaacatcaggtttggtaaactggaggcaagcgacgaggaggtttacaccgcagccagggaggccaatgcccacgagtttattacatccttcccagaagggtacaatacggtagtgggggagagagggaccacactttcaggagggcaaaagcagcggctggcaatcgcgcgagctcttattaagcaaccaactgtattgatcctagacgaggctacctccgcactcgatgcagaaagcgaacgggtggtgcaagaagctctggatcgtgcctctgcaggccggacagtcctggtgattgctcacagactcagcaccgtccggggggcccactgtatcgtggtgatggcggacgggagagtgtgggaggctggaacacatgaagaactcctcaagaagggcgggctctatgcggagttaatccggaggcaggcactcgatgcgccccgcactgccgccccgccaccaaagaagcccgagggcccccgtagccatcagcataaatcttag

SEQ ID NO: 179987 - DNA, 2106 bp, Artificial Sequence
  Description of Artificial Sequence: Synthetic coding sequence
atgctggtgcacctgttccgggtgggcatccggggcggccccttcccaggacgactgctgcctccactcagattccagactttttctgctgtgagatatagcgatgggtataggtcaagttctctgttgcgcgctgttgctcacctccggtcacaattatgggcccacctccctcgtgcgttgctgggacctatggtcctgagcaagcacccccatctgtgtctcgtggctttatgtgaagctgaagaggctcctcccgctagtagtacacctcatgtagttggaagccggtttaactggaaactcttctggcagtttctgcaccctcacctgctggtcctcggtgtggccgtggtgctagccttaggggcagcgctcgtcaacgtgcagattcctctcctattgggccagctggtggaagtggtggccaagtatacacgagatcatgtggggtcattcatgacagaatcacagaacctaagtactcacctcctcatcctgtatggggtccagggcctgttaacatttggatatctcgtcctgcttagccacgtgggtgagcggatggctgtggacatgcgtagagctctgttcagctccctcttgaggcaggatatcactttcttcgacgctaataaaaccggacaactcgttagtcggttgactaccgatgttcaggaatttaagtcctccttcaaattggtgatttctcagggtctgcgctcctgtacgcaggtcgcgggatgcttagtgtctctttccatgttgagcactcggctgacgcttctgttaatggtagcaactccagccctaatgggagtggggactttaatgggttcagggttacgaaagctgtctaggcaatgccaggagcaaattgcccgagctatgggggtagcagacgaggctttagggaacgtcagaacagtcagagcattcgcgatggagcaaagggaggaggagcgatacggggccgagcttgaagcttgccggtgtcgggccgaggagctaggccgcgggatagctcttttccagggactctcaaatatcgcatttaactgtatggtactgggcaccttgtttattggtggctccttggtagccggtcagcaactcactgggggcgacctcatgtcgttccttgtcgctagccagaccgtccaaaggtctatggccaacctgagtgtcctgtttggccaggtcgtgaggggcctgtctgctggcgcacgagtctttgagtatatggctctgaacccctgtattccgctgtctggcgggtgttgcgttccaaaggagcagctcagggggtcagtcacttttcaaaacgtttgctttagttacccttgcagacccgggttcgaggtgttaaaagacttcactttaaccctcccacccggtaagattgtggccctggtcggccaatccggaggtggcaagacgacagtggctagtctgttagagcgtttttacgaccccacggcaggcgtggtgatgctcgacggtcgggaccttaggacgctggacccctcatggttgcgagggcaagtggtgggctttatctcccaggagcccgtgctgtttggcaccaccattatggagaacattcggtttggcaaactggaggcttcagatgaggaagtttatacagctgctagggaagctaatgcacatgaattcatcaccagttttcccgagggatataatacggtcgtgggagaaagaggcacaacactgagcggggggcaaaagcagcggttagccattgctagagccctaattaagcaacccacagtactcatcctggatgaggcaacctctgcgctggacgctgagagcgagagggtggtccaggaagcccttgatagggcctccgccgggcggactgttttagtgatagcccaccggctgagcaccgtgaggggtgcgcactgtatcgtggtgatggcggacgggcgcgtatgggaggcaggcactcacgaagagctcctgaagaaaggcgggttatacgccgaactcatccggcgacaggcgctcgatgcccctcgcacagccgctcctcccccaaagaagccagagggtccaaggagccaccagcataaatcctag

SEQ ID NO: 179988 - DNA, 1296 bp, Artificial Sequence
  Description of Artificial Sequence: Synthetic coding sequence
atgctggtgcacctgttccgggtgggcatccggggcggccccttccccggacggctgcttcctcccttgagattccagaccttctccgccgtgagatacagcgacggctataggtcaagctcgttgctgagagcggtggctcaccttcgctctcagctctgggctcatctgcctcgagcccccctcgctcccagatggtctccctctgcctggtgctgggtgggtggcgccctgctggggcccatggttctcagcaagcatccacacttatgtcttgtggccctttgcgaggctgaggaagcaccccccgcttcctccactccacatgtggtcggcagcaggttcaattggaagcttttctggcagttcttacatcctcacctgcttgtcctcggagtcgccgtcgtgcttgctcttggagcagctctcgtgaacgtgcagattcccctccttctcggccaactcgtagaggtcgtggccaagtacacccgggatcacgtcgggtcattcatgaccgagagtcagaacttatcgacacacttactcattttgtacggagtgcaaggcctgcttaccttcgggtatctcgtcttgctgtcccacgttggcgaacgtatggctgtcgatatgagacgggctctttttagcagtctccttaggcaggatataacatttttcgacgccaacaaaactggacagctcgttagtagactgacaactgacgtgcaggagtttaagagctccttcaaattggtgatatcccaaggactgaggtcttgtacacaggtcgccggctgcctagtcagcctctctatgttgtctactagattgacactgttattgatggtggccacacccgccctcatgggagttggaacactgatgggatctggactacggaaactgagccgtcagtgtcaggagcagattgcaagggcaatgggcgtggcagatgaggcgctgggaaatgtgagaaccgttcgtgcctttgccatggagcagagagaggaagagcgctacggcgctgagttagaagcgtgtcgttgtcgggctgaagagctgggccgaggcatcgctttgtttcaaggcctgagcaacatagcgtttaactgcatggtcctgggaacactcttcattggcgggagcctggttgcaggtcagcagttgaccggcggcgatctgatgagttttttggtggcctcgcagacggtccaatcttttctacgggtcgccccttgtccgaacagtttgcctctgcaagccgtgacctttcatgcatggaaggatcacccctag

SEQ ID NO: 179989 - DNA, 2082 bp, Artificial Sequence
  Description of Artificial Sequence: Synthetic coding sequence
atgctggtgcacctgttccgggtgggcatccggggcggccccttccccggaagactcctgccaccactgagattccaaaccttcagtgccgtacggtacagtgatggttataggtcaagctctcttctcagggcagtggctcatctcaggtctcagctttgggcccatctgcctagggcacctctcgcgcctcggtggtcgccaagcgcttggtgttgggtgggcggggcacttctcggtcccatggtactatcaaagcatccacatctgtgtctcgtggcactgtgtgaagctgaggaggctcctcccgcatcatctaccccccatgtcgtcggatccaggtttaattggaaactgttttggcagttcctgcacccccacttgttagtgctcggcgttgctgtggttctggctctgggtgccgctcttgtgaatgtccagataccactactgttgggccagcttgttgaagtggtggctaagtacactcgggaccacgtgggttccttcatgaccgagtctcagaacctttccacccatttactcatcctctacggcgtgcagggacttctgactttcggctacctggtgttattaagccatgtgggcgagcgcatggctgtagatatgcggcgggctctcttttcctcacttcttaggcaggacataaccttttttgatgccaataagaccggtcagctggtgtccaggcttaccactgatgtgcaggagttcaaaagttctttcaagttagtgatttcgcagggattacgatcatgtacacaggtggcaggttgtctcgtgagtctcagtatgctgtcaacacgcctgacactccttctcatggtggcaactcccgctctgatgggggtgggaacactgatggggtcaggtctgcgaaagctgtccagacagtgtcaggagcagattgctcgcgcaatgggcgttgccgacgaggccctagggaatgttcggactgtgagagcctttgccatggagcaacgggaagaggaaaggtacggcgcggaattggaagcatgccgctgcagggcagaggagctgggccgaggcatcgctttgtttcaaggcctcagtaatatcgcttttaactgcatggtgcttggaaccctattcatcggtgggagccttgtggctgggcagcaactgaccggtggcgatctgatgtcttttcttgttgccagtcagaccgttcagcgctccatggcgaacctatctgtgctgtttggccaagttgtgcgcggtctgtccgcaggagcccgcgtgttcgagtacatggccctgaatccttgcatccccttgtctggcggctgctgcgtcccaaaggagcagcttcgaggatcggtcacctttcagaacgtgtgtttttcttatccctgccgcccggggtttgaggttcttaaagattttactttgacactgccgcccggaaagatcgtggctctggtgggccagagtggaggggggaagacaacggttgcttcattgctcgagagattctatgatcctacagcaggcgtcgttatgttagacggtcgtgaccttcgaaccctggatcctagctggctacgcggtcaagtggtcggcttcataagccaggaacctgtactctttggtaccacgattatggagaatatcagattcggtaagttagaagcctcagacgaggaagtatacacggccgctcgcgaagctaacgctcacgaattcatcacgtctttccctgagggttataacaccgtggtcggggagcgcggcacgaccctgtctgggggccagaaacagcgtctggctattgcaagagcgctgattaagcagcctactgttctcatcctggatgaggcaacaagtgctctggacgcagaaagcgaaagagtagtgcaggaagcactagatcgggcctctgccggccgaactgtcctggcgggcacccatgaggaactgctgaagaaagggggcctttatgctgaactgattcgaaggcaggccttggacgccccacgaaccgcagctccaccaccgaaaaaaccagaaggtccacgctcccatcagcataagtcgtag

SEQ ID NO: 179990 - DNA, 1893 bp, Artificial Sequence
  Description of Artificial Sequence: Synthetic coding sequence
atgcgggtgaagctgctgctgcccgccgcccccgtgctgccccggcagcatgctggagctttcattagtggacgcgattctggctggccaattcccaggcaggccgccacagctccaccattaccggatattctgtcttgtcaactggcccttggtgcagcactagtgaatgtccaaattccattgctcttgggccagctcgtggaagtggtggcaaagtatacaagagatcatgttgggagctttatgactgagtcgcaaaatctttccactcatcttttgattctgtacggggttcagggattgctcacttttggctatctggtgctgctgtctcatgtgggggaaagaatggctgtggacatgagacgcgcactatttagcagcctgctgagacaggatataaccttctttgacgctaataagacagggcagctggtttccagactgaccacggatgtacaggagttcaagtctagctttaaattggtaataagtcagggactgagatcatgcacacaggttgccggatgtcttgtgtctctctctatgctgtctacccggctgacactgctcctgatggtggccacgcctgcacttatgggtgtcggcactctaatgggcagcggcctgagaaaacttagcaggcagtgtcaggaacaaatcgcccgggctatgggtgttgccgatgaggccttgggaaatgtccggactgtgagggctttcgccatggaacagcgtgaggaggaacgctacggagcagaactagaggcatgtagatgtcgggccgaagagttaggtaggggaattgcacttttccagggactgagcaacatcgcattcaactgcatggttctggggacgctctttatcggggggagcttggttgcaggccaacagctgactgggggggacctgatgtcattcttagtggcatcacaaactgtgcagaggagtatggctaatctgagcgttttgttcggccaggtggtgcgcggactctccgccggggctagggtgttcgagtacatggcgttaaatccatgcatacctctatcgggcggatgctgcgtgcctaaggagcagcttcgagggagcgtcactttccagaacgtgtgtttttcttatccttgtcggcctggctttgaagtgttgaaggacttcacccttactctgcctccaggcaaaatcgtggctttagtgggacaaagcgggggtggaaaaaccacagttgcatctttgctcgaaagattttatgacccaaccgctggtgtggttatgctggacggtcgggacctaaggaccctggatccatcctggctcaggggccaggtcgtgggatttatctcacaggaaccagttctcttcgggacgaccattatggaaaacatcagattcggcaaacttgaagcgtccgacgaagaagtttacaccgctgctcgtgaagctaacgcacatgaatttatcacctcattcccagaaggatataacacagtggtgggagaacgggggactaccctgagcggcgggcagaagcagagactcgccatcgcccgggccctgatcaaacagccaactgttctgattctagacgaagccaccagtgcattggatgccgaatccgagcgcgttgttcaggaggcactggatagggctagcgcaggaaggaccgtactggtgattgcccaccgtctgagtactgtgaggggcgcccactgtattgtcgtcatggcagacgggagagtttgggaagcggggacacacgaggagctgttgaagaaaggtggactttacgccgagcttattagaaggcaggccttggatgctccaagaacagccgccccacctccaaaaaagccagaagggcctcgcagtcatcagcacaaaagctag

SEQ ID NO: 179991 - DNA, 2301 bp, Artificial Sequence
  Description of Artificial Sequence: Synthetic coding sequence
atgcggctgtggaaggccgtggtggtgaccctggccttcatgagcgtcgatatctgcgttaccacggccatctacgtcttctctcacctggaccgctccctgttggaggacattagacatttcaacatttttgattcggtactcgatttgtgggccgcatgcttgtaccggagctgcctactgctgggggctactataggggtggccaaaaattctgctctgggccctcgaagactccgcgcttcttggttagttatcaccctcgtctgcctgttcgtgggaatctacgcaatggtgaagctgttgcttttttcagaagttaggagacccataagagacccatggttttgggccctctttgtgtggacctacatcagcctcggcgcctcatttttactctggtggctgctgtcaacagtgcgccctggcacacaagcactggaacctggggctgctacagaggccgaaggtttccccgggagcggcaggccacctcctgagcaggccagcggagcaactctacagaagctcttgagctacaccaagcccgacgtggccttccttgtggccgcttctttttttctcattgtggctgcactgggggagacctttttgccctactacacggggagggcaattgatggcatcgtgattcagaagtccatggatcaattctcaacagccgtggtaattgtctgtcttctggcaatcggctcctcctttgccgccgggatccgaggtgggatcttcacattgatttttgccagactcaacatccgcttgcggaattgcctgtttagatcactggtctcccaggaaacctcattctttgatgagaatcggacgggcgacctcatcagtagactcacctcagataccaccatggtatcagatctggtctcccaaaacattaatgtgtttcttcggaatactgtcaaagtcactggggtggtggtttttatgtttagcttgtcctggcaactgtcattggttactttcatggggtttcctattatcatgatggtcagcaatatctatggtaaatattacaaacgcctcagcaaggaagtgcagaatgcactagcccgagcgtccaataccgccgaagagacaatatcagccatgaaaaccgtccgctcattcgccaatgaagaggaggaggccgaggtatacctgaggaaactacagcaggtatacaagctgaatcgaaaggaagccgccgcctatatgtactatgtatgggggtcaggtttaaccctccttgtagttcaggtttctattctgtattatggcggccacctggtcattagcggtcagatgacttctggaaatttaatagcgtttattatctatgagtttgttctcggagactgtatggaaagcgtgggaagcgtttactcagggcttatgcagggggttggtgccgccgagaaggtattcgagtttatcgacaggcagcccactatggtgcacgacggatcccttgcacctgaccacctcgaaggccgcgtagactttgagaacgtcacttttacatataggaccaggccacatacccaagtgttgcagaacgtgtcgttttccctgagtcccggaaaagtgaccgcgctcgtcgggccctccgggtccgggaagtccagctgtgtgaacatcttagagaacttctaccccctggaaggaggccgcgtgctgctcgacggaaagccaatctcagcttacgaccataagtacctccatcgggtgatcagtcttgtctcacaggagcccgtccttttcgccaggagcatcacagacaatatcagctatgggctgcccacagtgcctttcgaaatggttgtcgaggccgcacaaaaagctaacgctcatggcttcataatggaactgcaggacggatacagcacggagacgggagagaagggggcgcagctgtctggcggccagaagcaacgggtagcaatggcacgggcgctcgtgcgtaacccgccggttttgatccttgacgaggccactagcgccttagatgcagagtcagaatacttgatacagcaggctatccacggtaacctgcagaagcacactgtcttgattatcgcacaccggctttctaccgtcgaacatgctcatctaattgttgttctggacaagggtcgcgtcgtgcaacaggggacccaccagcagctgctagctcaggggggtttgtatgcaaaactggtgcagcgtcaaatgctcggcctccagcctgcagccgactttaccgccgggcataatgaacccgtagccaacggctctcacaaagcatag

SEQ ID NO: 179992 - DNA, 2172 bp, Artificial Sequence
  Description of Artificial Sequence: Synthetic coding sequence
atgcggctgtggaaggccgtggtggtgaccctggccttcatgagcgtcgatatttgcgtcacaacagctatttacgttttttcccacctcgacaggtcattacttgaagatattaggcacttcaacatcttcgattccgttcttgacctttgggctgcgtgtctctataggtcttgcttactgttgggggcgaccataggagtagccaagaatagtgctcttggtcccagacgtttgcgggcctcctggctggtgataactctcgtttgcctgtttgtcggcatctacgcaatggtgaagctgctgctgttctccgaagtgcgtcgccccatcagggacccttggttctgggccctgtttgtgtggacatacatctccttgggagcaagctttcttctctggtggcttctgagcacagtgcggcctgggacgcaggctctggagccaggcgctgctacggaagcagagggtttccccggcagcggaagacctccccccgagcaggcctcaggtgctaccctgcagaagctgctttcttacactaagcctgacgttgcattcctggtggctgcctctttctttctgattgtcgccgcgctgggcgagacctttttgccatactacaccggcagagccattgacggcatcgttatccaaaaatctatggaccaatttagtaccgccgtagtgatcgtgtgccttctggcaatcggcagcagcttcgctgccggcatccgcggtggaattttcacactgattttcgccaggctgaatatccgtctaaggaactgcctatttcgctctttggtttcacaggagacctccttcttcgacgagaaccggacaggcgacctgatctcacgcctgacatccgatactacaatggtgtctgatctggtgagtcaaaacattaacgtttttttgaggaacactgttaaagttacaggggtggtggtgtttatgttttccttaagctggcaactctccctcgtgacattcatgggctttccaattattatgatggtctctaatatctacgggaaatattataagagattaagtaaagaagttcagaatgccctagcccgcgcatctaacacggcagaggagacaatttcagccatgaagacagtcaggtccttcgccaacgaagaagaggaagccgaagtatatctcagaaaacttcagcaagtttacaagctgaacagaaaagaggcagccgcctatatgtattatgtgtgggggtccggctcggtgggcagcgtgtactccggactgatgcaaggagtgggtgccgcagagaaagtctttgaattcattgatcgccagccaacgatggttcacgatgggtctctggcgcccgaccacctggagggccgggtggattttgagaacgtcacttttacctataggacccgcccccatacacaggtgctccagaatgtctcttttagccttagtccgggcaaagtgactgcccttgttgggccctctgggagtggaaagtccagttgcgttaatatcctggaaaacttttatccccttgagggaggacgcgtgctcctcgacggcaagcccatcagtgcctacgaccataaatatctgcaccgcgtgatctcacttgtaagccaggagccggtcctgttcgccagaagcatcaccgataatattagttatgggctgccaactgtcccctttgaaatggtggtcgaagccgctcagaaggctaacgctcatggttttatcatggaattacaagacggctatagtacagagaccggcgagaagggtgctcagctgtccggcgggcagaagcagcgcgtagctatggcgcgcgcactagtgcgcaacccccccgtgctcatcctcgacgaagctacctctgccctggatgccgaatcagaatacctgatacagcaggcgatccatggtaaccttcaaaagcataccgtgctgattatcgcccatagactcagcaccgtagagcatgcccatttgatcgtggttctagacaaaggacgtgtagtgcagcaaggaactcaccagcagctgctggctcagggtggcctgtacgccaagctggtccaacggcagatgctgggactgcagcccgctgcagattttacggctgggcataacgagcccgtagccaacggaagtcacaaggcctag

SEQ ID NO: 179993 - DNA, 2301 bp, Artificial Sequence
  Description of Artificial Sequence: Synthetic coding sequence
atgcggctgtggaaggccgtggtggtgaccctggccttcatgagcgtggatatatgcgtgacaaccgctatctatgtgttttctcacctggacagatctctactggaggatattcgtcatttcaacattttcgactctgttctggacttatgggctgcctgtctgtaccggagctgcctgctgcttggtgctaccattggtgtcgcaaagaactccgccctgggcccacggcggctgcgtgctagttggcttgtgataaccctcgtgtgtctcttcgtgggcatctatgcgatggtcaagctgctgctcttttccgaagtaagacgacccatcagggatccctggttctgggcgctctttgtttggacctatatttcactgggagccagtttccttctctggtggctgttgagcacagtgcggccagggacgcaggccttggaacccggagctgcaaccgaggctgaagggttccctgggagtggcagaccaccccccgagcaggcctcaggagccaccctccaaaagttgctctcctacactaagcctgacgtggcctttctcgtcgccgcgagtttctttctgattgttgccgctttaggcgagacattcctcccatactacacaggcagggcaatcgatggaatcgttatccaaaagagtatggatcagttctcaacagccgtggtcattgtctgcttgctggccataggatcttcttttgcagccgggattagaggcggcatcttcaccctgatctttgcccgcctcaatatccgattgagaaattgtctgtttcgatcgctcgtgagccaggagacgtccttcttcgacgagaacagaacaggggacctgataagcagactgactagtgacacaaccatggtgagcgacctggtgagtcagaatattaatgtttttctcaggaataccgtcaaagtgactggggtggtggttttcatgttcagtctttcatggcagctttccctggtgacatttatggggtttcccataatcatgatggtctctaacatctacgggaagtattacaaaaggttgtctaaagaggtccaaaacgctctggcacgcgcatccaataccgcagaggaaacaatctctgccatgaagaccgttaggtcctttgccaacgaggaagaagaggccgaagtctacctgaggaagttgcaacaggtttataagctgaaccgcaaggaggctgcagcatacatgtactatgtatggggttcgggactgactctgctggtggtccaagtctctattctgtactacggcggacacctcgtgatcagcggccaaatgacaagcggcaatttgatcgccttcattatctacgagtttgtgcttggcgactgtatggaatccgtcggatcagtctatagtggtcttatgcagggagtaggagcagccgagaaagtgttcgagtttatagataggcagcccactatggtgcacgatggctcgcttgcgcccgatcatctcgagggaagggtggatttcgagaacgtaactttcacgtatagaacacgcccacacacacaggtcctccagaacgtgagtttttccctcagccctggtaaggtcacagcactggtgggtcctagcggctctggaaaaagctcatgtgttaacattctggagaacttttatcctctggagggagggcgagtcttgctggatggcaagcccattagcgcctatgaccacaaatatctccacagagtaatctctttggtcagtcaggaacctgttttatttgcaagaagcataaccgataatatcagctatggtctacccaccgtaccttttgagatggtcgtagaagcagcgcagaaagctaatgcccacggattcatcatggagcttcaagatggttactccacagaaaccggagaaaagggcgcgcaactgagcggcggtcagaaacagcgcgtggccatggccagggcactggtgagaaatccaccagttctgatcctggatgaggctacctcagcgctcgatgccgagagtgagtatctgatccagcaggccatccacggtaacttgcagaagcacactgtattgatcattgctcatcggctttccacagttgagcatgcccacttgattgtggtgctggacaaaggccgtgtcgtgcagcagggcacacaccaacagcttctggcacaaggcggcctgtatgctaaattagtccagcgccaaatgctcggacttcaacccgccgcagactttactgccgggcataatgaaccggtggcaaacggaagtcataaggcgtag

SEQ ID NO: 179994 - DNA, 2310 bp, Artificial Sequence
  Description of Artificial Sequence: Synthetic coding sequence
atgcggctgtggaaggccgtggtggtgaccctggccttcatgagcgtggacatctgtgtgactacagctatatacgtctttagtcatctggatcggtccttgttggaggacatcaggcactttaacatctttgattctgtgcttgatctgtgggccgcatgcctgtaccggtcatgcctgctgctgggagccaccattggcgtggcaaagaactccgctttagggccaagacgcctgcgcgcctcctggctggtcatcaccctagtgtgcctgttcgtgggtatctacgccatggtaaaactgttactattctccgaggtgagacgccccattagagatccttggttctgggccctgttcgtgtggacatatattagtctgggagctagctttctgctgtggtggctcctctcgacagtccgaccaggcacccaggccctggagcccggggctgccacagaagcggaggggttcccaggcagtggacggccaccgccggaacaggccagtggagccactcttcagaagctcctgtcctacactaaaccagacgtggccttcctggtggctgccagcttttttctgattgtagccgccctcggggaaaccttcctaccttattatactgggagggctattgatgggattgtgattcagaaatccatggaccagttctcgacagcggtggtgattgtctgtcttctggccattggtagctcttttgccgcagggattcgtggcggcatctttactttgatctttgcgaggctcaacatccggcttaggaattgcttgttccggtccctggtctctcaggagaccagcttttttgatgagaacaggaccggggacctcatttctaggctcacaagcgatactactatggtgtccgacctcgtaagccaaaacattaacgtgtttctgagaaacacagtgaaggtcactggcgttgtggtattcatgtttagtcttagctggcagttgtctctggtgacattcatgggcttcccaattatcatgatggtaagcaatatctacggtaagtactacaagaggttatccaaggaagtgcaaaatgcattagctcgtgcctctaatacagccgaggagaccatctcagcgatgaagactgtccgcagctttgctaatgaggaggaagaagccgaggtttaccttagaaagttgcaacaggtgtacaagctgaaccgaaaggaagcagccgcttacatgtattacgtctggggctccggtctaaccttgttggtagtgcaggtgtctattctttactacgggggtcacctagtgatctcagggcaaatgacgagtggcaatctgatcgcattcattatttatgaattcgtgctgggtgattgtatggagagtgtgggatcagtatacagcgggttgatgcagggagtgggcgccgcagaaaaggtctttgagttcatagacaggcaacctaccatggtccatgacggttcactggcccccgatcacctggaagggcgagtggactttgaaaatgtgacctttacctatcggacacgcccccatacccaggtcctgcagaacgtatctttcagcttgagcccgggaaaggtcacggcgctcgtgggtcccagtggttctggaaagtcctcgtgcgttaatattctggagaacttttacccgctggagggtggtcgcgtgctcctggacggaaagcccatttccgcttacgatcataaatacctccacagggtgattagtctcgttagtcaggagccagtgttgttcgctcgctctataaccgacaacatatcctacggactccctactgttccattcgaaatggtggtcgaagccgcccagaaggcaaacgcacatggattcattatggagctccaggacggctactctacagagacaggggagaaaggggctcagcttagcgggggccagaagcagcgcgtggccatggctcgtgctctggttcgcaatccccccgtgttaattctggacgaagctacctctgctctcgacgctgagtctgagtatttaagcccacaaattcagcaggccattcatggaaaccttcagaaacatacagtactgatcatagcacaccggctgtctactgtggagcatgcccatttaattgtggtattggataagggcagagtggttcagcaggggactcaccaacaactgctggcccagggcggcttgtacgccaaactcgtgcagagacaaatgctggggttgcaacctgctgccgacttcactgccggacataatgagcctgtagccaatgggtcacacaaagcctag

SEQ ID NO: 179995 - DNA, 2112 bp, Artificial Sequence
  Description of Artificial Sequence: Synthetic coding sequence
atgcggctgtggaaggccgtggtggtgaccctggccttcatgagcgtcgacatttgtgttacaaccgccatttatgtattctcacacttagatcgctcgctgctggaagacataaggcacttcaatatcttcgattcagtcctcgacctctgggctgcctgtctttaccggagctgcctgctgctgggcgccactattggggtcgccaagaatagtgccctggggccacggcgcctgcgcgcatcatggttggtcattactttggtttgtctttttgtgggaatctacgcaatggttaaactactgctgttcagcgaggtcaggcgtcctattcgtgacccttggttttgggctcttttcgtctggacctacattagtttaggcgcttcgttcctgctgtggtggcttctctctaccgtgcgcccgggcactcaagctctcgagccgggggctgcaacggaggctgagggcttcccagggagcggcagaccacccccggaacaggcttctggtgccacactccagaagcttcttagttacaccaagccagatgtagccttcctggtggccgcctcctttttccttatcgtagcagccctcggcgagacatttttgccttactacaccggcagggccattgacggcatagtgatccagaagtcgatggaccaatttagcacagccgttgtaattgtgtgcttgcttgcgattgggagttcatttgctgccggcataagggggggcatctttactcttatctttgccaggttaaatattcggctgagaaattgcttattcagatccttggtcagccaagagacctcttttttcgacgaaaaccgcactggggatctgatttctaggctgactagcgatacaacgatggtcagtgaccttgtgtcccaaaatatcaacgttttcttacggaacacggtgaaggttaccggagtggttgtgttcatgttctccctgtcatggcagctctcattagttactttcatgggcttccctattatcatgatggtgtcgaacatctacggaaagtattataaaaggttgagcaaagaagtgcagaacgcactggctcgggcaagcaatactgcagaagagactattagcgccatgaagaccgtgcggagttttgccaacgaggaagaagaagccgaggtgtatctgcggaagctgcagcaggtatacaaacttaaccggaaggaggcagcagcctacatgtattatgtctggggatccgggctgacgctgcttgttgtgcaggtgtctattctttattatggagggcacctggtgataagtggtcagatgaccagtgggaacctcatcgctttcattatctatgaatttgtcctgggagactgcatggaaaacgtctcctttagcctgagtccgggaaaggtaactgcactggtagggccttctggatccggcaaatcctcatgcgtgaatatcctcgagaatttctaccctttggagggcggcagggtactgctggacggaaagcccatatccgcatacgaccacaagtatctgcaccgcgttataagtctggtgtcacaagaaccggtgctcttcgctcgttctataaccgacaacatttcctatggcctccccacagtccctttcgagatggttgtggaagctgcacaaaaggccaacgctcatggttttatcatggagcttcaggatgggtactccaccgaaaccggcgagaagggggcccagctttctggggggcagaaacagcgcgttgccatggcaagggccctggtgaggaaccctcctgtcttaatcctggatgaagccaccagcgcactcgatgcagaatctgaatatctcatccagcaagccattcatgggaacctccagaagcacaccgtgctcattatcgcccataggctgtccaccgtagaacacgcacacttgatagtcgtcctggacaaggggagggttgtacagcaggggactcaccagcaactgctggcacagggcgggctatacgccaagctggtgcagcgacagatgttggggctgcagcctgcagctgattttacagcaggccacaacgagccggttgctaatggaagccacaaggcttag

SEQ ID NO: 179996 - DNA, 2301 bp, Artificial Sequence
  Description of Artificial Sequence: Synthetic coding sequence
atgcggctgtggaaggccgtggtggtgaccctggccttcatgagcgtggacatctgcgttacaactgcaatctatgtcttttcccacctcgatcgctcactgctcgaggatattcgccacttcaacatttttgacagcgtcctcgatttgtgggccgcttgtctctaccggtcgtgcctccttcttggtgcgacaataggagtagccaagaactcagctctcggtccccgcagactccgagcatcatggctcgtgatcacgctggtctgtttgtttgtgggtatatacgcgatggtcaagctgctgctcttcagtgaggtgaggaggcctattcgggatccttggttctgggctttgttcgtgtggacgtacatctctctgggtgcatcattcctgctgtggtggctcttgtcaacagtgcgccctggtacccaagctctcgaacctggcgctgccaccgaagctgaggggttccctggcagtggccggcccccccctgagcaggcatctggggccacattacaaaaacttttgtcatataccaagcccgacgtcgccttcctggtagccgcatcatttttcttgatcgttgctgcactgggcgaaacttttctgccatattacacggggagggcaattgacggcatagttatccagaaaagcatggatcagttttctactgccgtagtgattgtatgtctactggcgatcgggagcagtttcgcagccggcatccgcggaggcatctttacgttgatctttgcaagacttaacatcaggctaaggaattgtctgtttaggagtctcgtgagccaagagacatcctttttcgatgagaaccgaaccggggacttgatttcccgtctgacatctgataccactatggtgagtgatctggtgagtcagaatatcaacgttttcctccggaataccgttaaggtgaccggcgtggtggtatttatgttttccctgtcatggcaactgtcgctggttactttcatgggcttcccgatcatcatgatggtctccaacatttacggtaaatactataaacggttatcaaaggaagtgcagaacgcattggctagagcaagcaatacagccgaagagaccatcagcgctatgaagactgtgcggtcattcgcaaacgaggaggaagaagctgaggtgtacttaagaaagttgcagcaggtctataagctgaatagaaaagaggcagccgcctacatgtattatgtgtgggggtctggactcaccctgctggtcgtgcaagttagcattctgtactatggcggccatctggtgattagcgggcagatgacgtccggtaacttgatagcctttatcatctatgagttcgtgttgggtgattgtatggagtccgtgggctcagtttatagtgggttgatgcaaggtgtgggcgccgcagagaaagtatttgagtttattgatagacagcctaccatggttcacgatggctcccttgcacccgatcaccttgaaggacgggttgactttgaaaatgtgacctttacctacagaacccgacctcatactcaggtgttacagaatgtctcgttctctctctcgcccggcaaggtgacagcattggtcgggccttcggggtcagggaagtcgtcatgcgtcaacatccttgaaaatttctacccactggagggtggccgtgtactcctggacggtaagcctatctcagcatacgaccacaaatatttgcacagggtgataagcttggtgtctcaggaaccggttctgtttgcacgttccattaccgataatatctcttatggacttccgaccgtgcccttcgaaatggttgttgaagcagctcagaaagcgaatgctcatggattcataatggaactgcaagacgggtattcgaccgagaccggagaaaagggagcccagctgtccggaggccaaaagcagagggtggctatggcacgggcactggtgcgcaatccacccgtgctaatcctcgacgaggccacatcagcgttggacgcagagtcggaatatctgatccagcaggccatccacggcaatttgcagaagcacacagtgctcattatcgctcaccgcctaagcacagttgagcacgcccacttaattgtggtgcttgataaggggcgtgtcgtccaacaagggacccaccagcagctgctcgcacagggcgggttgtacgctaagctggtacaacggcagatgcttggccttcagccagctgcagacttcaccgcgggacataacgaacctgtcgcaaacgggtctcacaaggcatag

SEQ ID NO: 179997 - DNA, 4395 bp, Artificial Sequence
  Description of Artificial Sequence: Synthetic coding sequence
atgtgcctgctggtgttccccctggtgccccggagccccgactacatattgccatgtagccccggctggaggctgagattggccgcctcatttctgttgtctgtgttccccctgttggacctcctcccagttgctctgccccccggcgcgggcccaggcccgatcgggctggaggtccttgctggctgtgtggcagctgtggcatggatctcccattctctcgccctctgggttctggcccattctccacacggccactccaggggtccccttgccctcgcactcgtggccttgcttccggctccagcccttgtacttactgtcctgtggcattgccagaggggtaccctgcttcccccactgctcccgggacctatggctcgcctgtgtctcctgatcctccagcttgcagcactgttggcctatgccctggggtgggctgcaccaggtggcccccgtgaaccatgggctcaggagcccctcctgcccgaggaccaggagccggaagttgctgaggatggcgaaagctggctgagccggttctcatacgcttggttagcccccttactggcccgaggtgcttgcggagaactgcgacaacctcaggacatctgtaggctgcctcaccggctgcagcccacctatctcgcccgggtgttccaggcacactggcaggagggcgccagactctggagagcattatacggtgcatttggtaggtgctatctcgctttgggcctgctcaagcttgttggaaccatgttgggtttcagtggccccctgttattgtctcttcttgttggctttctggaagaaggacaggaacctctgtctcatggactgctgtacgccctagggctggcagggggggctgtgttaggcgccgtgctgcagaatcagtacggatacgaggtctataaagtcacccttcaggcccgtggggcagtgctgaatattctctactgcaaagccttacagctgggaccatctcgtccgcccaccggcgaagcactgaacctgctcggaaccgattccgagcgactgttgaacttcgccggcagtttccacgaggcatggggcctgcctctccagctcgcaataacgctgtatcttctctatcaacaagtaggagtggccttcgtggggggattaattttggccttactcctggttcctgtcaataaggtcatagcaacgcggatcatggcttccaaccaggagatgctccagcataaggacgcccgcgtgaagctcgttaccgagctgctctccggcatccgcgtgattaagttctgcggctgggaacaagcgctgggggccagggtggaagcatgccgggcccgggagctgggccggctgcgagtcataaaatatctggacgctgcgtgtgtgtatctttgggcggccctgccagttgtgatctccatcgtgatctttatcacatacgtcctgatggggcaccagctaaccgctactaaggtgtttacagccctcgccctcgtccgcatgctcatcctgccgcttaacaactttccttgggttatcaatggcctgcttgaggcgaaggtgtctctcgataggatccagttgtttcttgatctacctaatcacaacccccaggcatactactctccagattgcgggcgcctgggcgcccaaataaagtggctgttgtgtagcgatcctccagccgaacctagtaccgtgctggaactgcatggcgctctgttcagctgggatcccgtcggcacgagcctcgaaactttcatttcacatttagaagtaaaaaaaggtatgttagtcggaatagtgggcaaagtagggtgcggcaagtctagtttgcttgctgctatcgctggagagctgcacagattacgcggacacgtggcggttaggggactctcaaaagggtttggcctcgccacccaagaaccttggatacaatttgcgactatacgggacaacatactgtttggcaagacatttgatgcgcagctttacaaagaagtattggaagcttgcgcactgaacgatgacctgtccattttaccagcaggtgatcaaaccgaggttggagagaagggcgttacgctctcaggcggtcaacgcgctaggattgcgcttgccagggcagtctatcaggaaaaagaactgtacctcttggatgaccctctggccgcggtggatgcagacgtggctaatcatctgctgcatcggtgcatccttggaatgttgtcatacaccaccaggctcttgtgcacgcaccgaaccgaatacctcgagcgagccgacgctgttctccttatggaggctggacgcctgatcagggcaggaccaccctccgagatattgcccctggtccaggctgtgcctaaggcctgggccgaaaacggccaagagagtgactcagcaaccgcgcagagcgtgcaaaaccctgaaaaaaccaaagaaggactggaagaggagcagagcacttcgggtaggcttctgcaggaagagtccaaaaaagagggcgcagtcgcactccatgtgtatcaagcctattggaaggcagtgggccaggggctggcattagccatcttattttccctgttgctgatgcaagcaactagaaatgccgccgactggtggctctcccactggatctctcagctgaaagctgagaactccagtcaggaagcacagccatctactagcccagcctcaatgggattattcagcccccagttgctcttgttttctcctggcaacctgtacattcccgtgtttccactgcctaaagccgcaccaaacggctccagcgacattcggttttacctgactgtctacgccaccatagctggggtaaacagcctgtgcacactgctgcgcgctgtcctctttgccgcaggcaccttgcaggccgcagccaccctgcaccggcgccttttgcatagagtgcttatggcaccagtaaccttttttaatgccaccccaacaggacgcatcctgaacaggttctcctctgacgtcgcctgtgctgatgatagcctgcccttcatactgaacatattgctggcgaatgccgctggcctgctcggcctcctagctgtgctagggtccgggctgccttggcttctcctgcttctgccccctttgtctataatgtattatcacgtgcaacgccactaccgagcgtccagtcgggagctgaggcgcctcggatctcttacacttagccccctttactcccacctggcagatactttagctgggctgtctgtactgagagccacaggcgctacctacagatttgaggaagagaatctgcgcctcctggagctgaatcagcgttgtcagtttgcaactagtgcaacaatgcagtggctggatataaggctccagctgatgggagccgccgtcgtgagtgctatcgccggcattgctctcgtgcagcaccagcagggactcgcaaatcccggcctggtcggactctctctgagctacgccctgagcctcaccggcctgttgtccggtctcgtgagcagcttcacacagaccgaagccatgctcgtttccgtcgagaggttagaggagtacacctgcgacctgccacaggaaccccaaggccagccactacagttgggtaccggctggctcacccaaggcggtgtcgaattccaggatgtggtcctcgcctaccggcccggtttgccaaatgccctggacggagtgaccttctgtgtgcagcctggggagaaattaggcatcgtaggccgcacagggtctggtaaatccagtctccttctggtgctcttccgtctgctggagcctagcagcggaagagttttgctcgatggggttgacacatcccagttagagctggcacagttgcgatcccaactggccatcattcctcaggaaccgtttttattctctgggactgtccgcgagaatctagaccctcagggtcttcataaagacagggctctctggcaggctctgaagcaatgccatctgagcgaggtgattacgagcatgggggggcttgatggggagttgggagagggagggaggtcactttctctcggccaaagacagttgctgtgccttgctcgcgcgctcctgactgacgccaagattctgtgcattgatgaagccaccgcatccgttgatcagaagacagatcagctgttacagcaaaccatttgtaagcgcttcgccaataaaactgtcctgaccattgctcatcggcttaacacaatcctgaactccgaccgggtgctagtgctgcaggctgggcgcgttgtcgaattagatagcccggccactttacggaaccagccacactccctattccagcagctgctacagtcctctcagcaaggcgtcccagcaagcttggggggcccgtag

SEQ ID NO: 179998 - DNA, 4479 bp, Artificial Sequence
  Description of Artificial Sequence: Synthetic coding sequence
atggagcggctgctggcccagctgtgcggcagcagcgccgcctggcctttgccactctgggagggcgatacgaccgggcattgttttacccaacttgttttatctgccctgccccacgcactgcttgctgtgttgtcagcgtgctacctcggtacgccccgatctccagattatatcttaccctgcagcccgggctggagattaagactcgcagcctccttcctgctgtcggtgttccccctgctcgacttactgcctgtcgctttacctcccggggctggcccaggacctattggcctcgaggtgctggcaggatgcgtggcagcagtagcttggatatctcacagccttgccctttgggtgctggcccactccccgcatggccactcccgtggcccccttgcccttgctttggtcgcgttgctgccggctcccgcccttgtgctcaccgtcctgtggcactgccagagggggactctgctgccccccctgctccctggcccaatggccagactgtgcctgttgattctgcaactggctgcactcctggcctacgctttgggatgggccgcccccggaggcccacgtgagccttgggctcaggagccgctgctgcctgaggaccaggagccggaggttgcggaagatggtgaatcctggttgagtcggttcagttatgcatggttggctccactccttgcgcgaggcgcatgtggcgagcttagacagccccaagacatttgcaggctgccacacaggttgcaacccacctacctcgcacgagtgttccaggcccattggcaggagggggcgcgactttggcgggccctctacggcgcctttgggcgctgctacctggcccttggactcctcaagctggtgggaactatgctgggattttcgggcccccttctgctcagcttgctggtgggcttcctcgaggagggacaggagccactctcccatgggctgctctatgcgctggggctagctgggggcgccgtgctcggagctgtcctccagaaccaatacgggtatgaagtctacaaagtgaccctgcaggcccgcggcgcagtattgaatatattgtattgcaaagcactgcagctgggaccttctaggcctcccacgggggaggctttaaacttactcgggacagattctgagagattgctcaactttgccgggagtttccatgaagcatggggtttacctctgcagcttgcaatcacactatacctgctctatcagcaggtgggagtcgccttcgtcggtgggttaatcctggccctgctcctggtacctgtgaacaaggtgattgccacccgaattatggcctccaatcaggagatgttacagcacaaagatgcaagagtgaagctggtaacagagctcctgtcgggaattcgggtcatcaagttctgtggatgggaacaggcccttggggcacgtgtagaggcgtgccgggcaagggaacttggacgactccgtgtgataaaatacctggacgctgcctgcgtatacctgtgggcagctttgcctgtggtcatcagcattgttattttcatcacatatgtgttgatgggccaccagctgacggcgacaaaggtgttcacagctctggcgctggttaggatgctgatacttcccttgaataattttccttgggttattaacgggctactcgaggctaaagtctccctcgaccggatccagctgttcctcgatctgccgaaccataacccccaggcatactactcccctgatccgcccgccgaaccctcaacggtgttagagctgcacggagcactttttagctgggaccccgtgggaacaagtcttgagacctttatatcacacctcgaggtcaagaagggcatgttggtgggaattgtcggcaaggtcgggtgcggcaagtcttcactgttggccgccatcgctggtgagctacatagattaaggggacatgtcgctgtgcgtgggctcagcaaaggatttgggttagctacccaggagccgtggatccagtttgctaccataagagacaacatcttattcggtaagacttttgacgcgcagctttacaaagaggtgctggaagcctgtgctctgaacgatgatctgagcattctgcccgccggagatcaaactgaggtcggtgagaaaggagtaacattgtctggaggacagagggcccggattgcacttgcgcgcgctgtttaccaagaaaaggagctgtacttactggatgatcccctggccgccgtagacgccgacgtggccaaccatcttctccataggtgtattttaggcatgttgtcctataccacaaggctcctgtgcacccatcggaccgagtatttagaacgcgcggatgccgtattactcatggaggcagggaggctgatacgcgcgggccctccatccgaaatattgccacttgtgcaagccgtccctaaggcatgggctgagaatggccaagaatcagattccgcaaccgcacagagcgtccagaaccctgagaagactaaagaagggctggaggaggaacagtccaccagtggtagactcctgcaggaggagagcaagaaggaaggcgccgtagctctccacgtgtaccaggcttattggaaggctgttggtcagggattagctttagccatcctgtttagcctgctgttaatgcaggccacccgaaacgctgctgactggtggttgtcacactggatctcacagctgaaggcagagaactcttcccaggaggcgcagccctccaccagtcccgccagtatgggccttttctcgccgcaactgctgcttttctctcctggcaacttatacattccagtatttcccctccccaaagccgctccaaacggatcctctgacatccgcttttacctaacagtttatgctacaattgcaggggtgaacagtctttgcacactgctgcgcgcagtcctcttcgctgcaggcacgttacaggcggctgcgacgttgcaccgccggcttctccacagagtcctgatggcgccagttaccttcttcaacgcgactcccacagggcggattctgaaccgtttttcatcagacgtggcctgtgcagacgattctctgccttttattctgaacatacttcttgctaatgccgcaggattgctggggctgttggccgtgctgggctcaggtctgccgtggctcctgttactgttaccacccctgtcaattatgtattatcacgtgcagaggcattacagggcttccagccgggaattacggaggctggggtccttaactctatcaccattgtattctcaccttgccgacacgttagctggactctccgttcttcgcgctactggggctacttacagattcgaagaggagaatctacggctgttggaattaaaccagcgatgccagttcgccaccagtgccacaatgcaatggcttgacatccgcttacagctcatgggtgctgcagtcgtcagtgctattgcagggattgctctggtacagcatcagcagggactggccaaccccggcctcgtgggtttgtcactgagttatgccctctcacttactggactgctgtccggactggtgagttctttcacccaaacggaagctatgctcgtcagtgtggaacggctcgaagagtatacctgcgatcttccccaagagccccagggtcagcctctacagctgggcaccgggtggctcactcaggggggggtcgaattccaggacgttgtcctggcttatcgaccgggcttgccgaacgcactcgatggggtcacattttgtgtccagcccggggagaaactgggaatcgtgggaagaaccggtagtggtaagtcctctctgctgcttgtgctcttccgactgctggagcctagttccggcagggtcctcctcgacggcgtagacacttcgcagcttgaactggcccagcttaggtcccagttagcgatcattcctcaggagcccttcctttttagtggaacagtgagggaaaaccttgacccccaggggctccacaaggacagagccctgtggcaggccctcaaacagtgtcatctgtctgaagtgatcactagtatgggcgggctcgacggggaattaggcgaaggcggccgaagtcttagcttgggccagaggcaactcctgtgcctggctagagccctgttaacagacgcaaaaatcctttgcatcgacgaggccactgcctccgtggaccagaagacagaccagctgttgcaacagactatatgcaaacggttcgctaacaagaccgtacttactatcgctcatcgcctgaatactatactaaattctgatcgtgtcctggtgctccaggccggtcgggtagtcgagctggactcaccagccactctcaggaaccaaccgcattctctattccagcagctgctccagtctagccagcagggggtgcctgccagtctgggcggaccttag

SEQ ID NO: 179999 - DNA, 4035 bp, Artificial Sequence
  Description of Artificial Sequence: Synthetic coding sequence
atgacccggaagcggacctactgggtgcccaacagcagcggcggcttagtcaacagaggaatcgacatcggggatgacatggtgagcggactcatctacaaaacatacaccctgcaggacggcccttggagccaacaggaaaggaacccagaggctccaggccgagccgccgtaccaccgtggggcaaatatgacgcagcactgcgaaccatgatcccatttcggcccaaacctagatttccagccccccagcccctggacaacgcgggtctgttcagctacctgactgtttcctggcttacccctctgatgatccaatccctgaggagcaggttggacgagaatacaataccaccactttcagtgcatgacgcatccgacaagaacgtgcagagactgcaccggctgtgggaggaggaagtaagccggcgcggaattgaaaaggctagtgtgctgctcgtgatgctcagattccagcgcactagacttatttttgatgccctgctggggatctgtttttgtatcgcttctgtcctcggtcccatacttattattcccaagattctcgagtattccgaggagcaactgggaaatgttgttcacggggtgggcctgtgctttgcactgttcctttctgagtgtgtgaagagtttgtctttttcctccagttggataatcaatcagcgcacggctatcagatttcgggccgctgtgtcgtcgttcgctttcgagaagcttattcagtttaagtctgtcattcacataacaagcggtgaggccatcagtttctttaccggcgacgtgaactacctgttcgaaggggtctgttatgggcctcttgttctcatcacgtgtgccagcctggtcatctgtagcatatctagctactttattattgggtatacagctttcattgctatcctctgctatctgctggtgtttccccttgctgtattcatgaccaggatggcagtgaaggcacagcatcacacaagtgaggtgagcgaccagcgtattcgggtcacttctgaagtgcttacgtgcattaagctgatcaaaatgtacacctgggagaagccatttgccaagatcattgaggatctccgacgaaaagagcggaagctcctggagaagtgtgggctcgtgcagtctctcacgagcatcacactattcatcattcctactgtcgcgacagctgtttgggtcctgatccatactagcttgaagctgaaactgaccgcgtcaatggcttttagcatgctggcgagcctcaatcttctgcgcttaagcgtcttttttgtccccatcgccgtgaagggactgactaattctaagagcgccgtgatgcggttcaagaaattttttcttcaagaaagtcccgtgttctacgtgcaaactttacaggatccttcaaaggctctagtattcgaagaagcaactctcagctggcagcaaacttgccctgggatcgttaacggagcacttgaactagagaggaatgggcacgcttccgagggaatgactcggcctagggacgcactcggcccagaggaggagggaaatagcctgggacctgaactccataagatcaatctggtggtgtctaagggcatgatgcttggggtttgcggtaacacaggatccgggaagtcaagtctcctgagtgccatcctagaggagatgcacctgcttgagggctccgtgggtgtgcagggatcgctggcatatgtgcctcagcaggcctggattgtgtcaggaaacattagagagaatatcctcatgggcggcgcctatgacaaggcccgctatctacaggtgttacactgttgctctctcaatagggatctcgagctcctgccgtttggagacatgacagagatcggcgaaagaggcctgaacctgtccggtggacagaagcagaggatatcactggcacgggccgtgtatagtgacagacagatttatctgctggacgatccattgtcggccgttgacgcccacgtgggtaaacacatattcgaagagtgcattaaaaagacgctgcgcgggaagaccgttgtgctagtgacacatcagctgcaatatctggaattttgcggtcagattatactcctcgagaatggcaagatatgtgaaaacggtacacacagtgagcttatgcaaaagaagggcaagtatgcccaattgattcagaagatgcacaaggaggcgaccagtgatatgctgcaagatactgccaagatcgcagagaagcccaaggtcgagtcacaagctttagccacaagtttggaggaaagcctcaatggcaacgccgttcctgaacatcaactcacacaggaggaagagatggaggagggctccctgtcttggcgagtctaccaccactatattcaggccgcaggagggtacatggtgtcttgtatcatattttttttcgtagttctcatcgtgttcctgacaatattttccttctggtggttgagctactggctggagcagggatccggaacaaattcctctagggaaagcaatgggactatggccgacctgggaaacatcgccgataatccacagctttccttttatcagctggtgtacggtctcaacgccctactgctgatctgcgtgggtgtttgctctagtggcatatttaccaaagttactcggaaagccagtactgccctccataacaagttatttaacaaggtgttcaggtgcccaatgagctttttcgacactattcctatcgggcgtctgctaaattgttttgcaggagacttggagcaattggaccaactgctgcctatatttagtgagcagttcctggtactgtcactcatggtcatcgcagtgctgctgattgtgtcagtgcttagcccgtatatcctcctaatgggtgcaatcatcatggtcatatgcttcatttactacatgatgtttaaaaaagcaatcggcgtttttaagagactcgagaattatagtagatctccactgttttcccacatccttaactcactgcaaggattgagctccattcatgtctacgggaagaccgaggattttataagtcagttcaaacggctcacagacgcgcaaaacaactatcttctcctcttcctgtcatcgacccgatggatggcactgcggctggagatcatgacaaatctggtcacactggcagtagccttgttcgtcgcattcggcatctcatccacgccatacagcttcaaagtcatggctgtgaacattgtgctgcaactggcatcatcttttcaggctaccgctagaattgggttggaaaccgaagcacagtttaccgctgtcgagaggattctccagtacatgaagatgtgtgtgtccgaagcccctctccacatggaaggaaccagttgtccccagggctggccccaacacggggagattatattccaggattaccatatgaaatacagagacaacaccccaacagtcttgcacgggatcaatcttactattagaggtcacgaggtcgtgggaatcgtggggagaacaggcagcggcaagtcttcactcggaatggctctgtttcgtttggtggagcctatggctgggcgcatactcattgacggcgtggacatctgctcgattggcctagaagaccttaggtccaagctgtccgtgatcccccaggaccccgtgttattgtccggcaccattcggttcaaccttgacccgttcgataggcacacggaccagcaaatctgggatgccctggagcgcacttttctcactaaggccattatcctcatcgatgaagcaactgcctcaatagacatggagacagataccctaattcagcgcacgatcagagaggcctttcagggctgcaccgtcctggttatcgctcatcgcgtgacaaccgtcctgaactgtgatcatatccttgtcatggggaatggcaaagtcgtggagttcgatcggcctgaagttctgcggaaaaagccaggaagcttgttcgccgccttaatggccaccgccacttctagtttgaggtag

SEQ ID NO: 180000 - DNA, 4149 bp, Artificial Sequence
  Description of Artificial Sequence: Synthetic coding sequence
atgacccggaagcggacctactgggtgcccaacagcagcggcggcttggtaaacaggggtatcgatatcggcgacgatatggtctctggccttatctacaaaacttatacccttcaggatggaccctggtcacaacaggagcgcaatccagaagctcccggcagagctgcagtgcccccctggggcaaatatgacgccgctttgcgcacgatgataccattcaggccgaagcctcggtttcctgccccacaaccattggacaatgcgggcctgttcagttatctcacagtgtcctggctcacaccgctgatgatccagtccctgcgcagccggctggacgagaataccattcctcccctctctgtgcacgatgccagcgacaaaaatgttcaaagacttcacaggctgtgggaggaggaggtgtcccgccgtggcatcgagaaagctagcgtgctactggttatgctgcgtttccagagaactaggctgatttttgacgccctgctcggcatatgtttttgtattgcctccgttctcggccctatcctgataatcccaaaaattctagaatattccgaggaacaacttggcaacgtggtgcacggtgtggggctatgttttgcactgttcctttccgagtgtgtcaaaagcctgagcttttcttcatcttggatcataaaccagcgtaccgctattagatttagagcggctgtcagtagttttgctttcgaaaaactgatacagtttaagtccgtaatccatatcacatctggagaggccatctctttcttcactggggacgtgaattacttgttcgagggcgtttgttacgggcctctggtgctcattacatgtgcgtccctggttatttgttccatctctagctactttatcatcggatacacagccttcatcgctatcctgtgctatttgttagtctttccactcgccgtgttcatgacccgaatggcagtgaaagcgcagcaccacacatctgaggtgtccgatcagagaattcgggtaactagcgaggtcctcacctgcattaagcttattaagatgtacacctgggaaaagccatttgctaaaatcattgaagacctgaggagaaaagagagaaaactgttggaaaagtgtgggctagtgcagagtctgaccagcattacactgttcataattccgacagtggccacagctgtttgggtgctcatccacactagcctcaagcttaaactgaccgcatctatggccttctccatgctggcttcacttaatcttttacggcttagcgtgttttttgtgcccatcgcagtgaagggtctcacaaattccaaaagcgccgtcatgaggttcaaaaagttttttctccaggaatctcccgtcttttatgttcagacgctgcaagacccttcgaaggcactggtgtttgaggaggcgacactgtcctggcagcagacctgtcccgggatagtgaacggcgccttggaactggagagaaatgggcatgccagtgaagggatgacaaggccgcgcgatgctttggggccggaagaggaagggaacagcctgggaccggagcttcataagatcaatttggtagtgtctaaaggcatgatgctgggagtgtgtggcaacacaggtagcggaaagagtagtctgctgtccgcaatcctggaagaaatgcatctattggagggatccgtgggggtgcagggttccctcgcatatgtgcctcagcaagcctggatcgtaagcggaaacattagagagaacattttgatgggtggtgcatacgataaagcccgctatctgcaagtcctccattgctgctccctcaacagagatttggaactcctgcctttcggcgatatgactgaaatcggcgagagagggctcaatttgtctgggggccagaagcagagaatttcattggcacgcgccgtgtactccgatcgccagatatacttactggacgatcccttgtcagccgtggacgcacacgtcgggaagcacatttttgaagaatgtattaaaaagacgctgagaggaaagactgtggtgttagttactcaccagttacagtacctggagttttgcggacagatcatcctcttggagaatgggaaaatctgtgagaatgggacacacagtgaactgatgcagaaaaagggaaagtacgctcagctgattcagaagatgcataaagaagcgaccagcgacatgctccaggataccgcgaaaattgccgaaaagcccaaagtggaatctcaggctctggctacgtctttagaagaatccttgaatgggaacgctgtgccggagcaccagctcactcaggaagaagaaatggaagagggctcactctcttggcgggtgtatcaccactatatccaggccgcaggcggatatatggtcagctgcattatctttttttttgttgtgctaatagtatttttaaccatattcagcttttggtggcttagctactggttggagcaggggagtggcacaaacagctcccgagaatccaacggcaccatggctgacctggggaacattgccgacaaccctcaactttcattctatcagctggtttacggactaaatgctctcctgctaatttgtgttggagtgtgctccagcggcatctttactaaagtgacaagaaaagcttccactgcactgcacaacaagctgttcaacaaagtcttccgatgccctatgtcgttttttgacactataccaattggacgcctgcttaattgttttgcgggagacttagagcagctagatcagttactgcctattttctccgaacagttcctggttttgagtctgatggtgatcgcagtgctgctgatcgtgtcagtcttgtcgccctacattctcctcatgggcgccatcatcatggtcatatgtttcatctactatatgatgtttaagaaggccatcggcgttttcaagcggctcgagaactactctcgatcccccctattttcacatatcctgaatagtctgcaaggcctttcaagcatccatgtgtacggtaagacggaggatttcatttctcagttcaagcgccttacagacgcgcaaaataattaccttctgcttttcctgtcctcgacacggtggatggctctgcgcctggaaattatgacaaatctggtgacactggctgtggctctttttgtggcctttggcatatcctcaactccctactctttcaaagttatggccgtgaatatcgtgctccagctagcctcaagttttcaggccactgctcgtattggtcttgagacggaagcccagtttaccgcggtagaacggattttgcagtatatgaaaatgtgcgtgtccgaggccccactccatatggagggaacctcttgtccacagggctggccccagcacggcgaaataatcttccaagactaccatatgaagtacagagataacacccctacggttctgcacgggattaacctcaccatccgaggacacgaagtcgttggtatcgtggggcgtactgggagcggtaaaagttctctggggatggccctatttcggctggtagaacccatggccggtcgcatactgatagatggcgtcgacatctgttctatcgggcttgaagacctgcggtctaagcttagcgttattcctcaagaccccgttctgttaagcggcacaattcgctttaatttggatccattcgacagacatacagatcagcagatctgggacgccctcgagcggacgtttttaaccaaggcaatcagcaaattccctaagaaactccacacggacgtggtggagaatggtggcaatttcagcgttggggaacggcagctcctgtgcatcgctcgggccgtgcttagaaacagcaaaattattttgatagatgaggcaacagcaagtattgacatggagaccgataccttgatacaaagaacaatcagagaagccttccaagggtgtaccgtcctcgtgatcgcacaccgagttaccaccgtgctgaattgtgatcatatactcgtcatgggaaatggaaaagttgttgaattcgaccgccccgaggtgctccggaagaaacccggttctctttttgccgccctaatggcaaccgcgacatccagcctgcggtag

SEQ ID NO: 180001 - DNA, 4149 bp, Artificial Sequence
  Description of Artificial Sequence: Synthetic coding sequence
atgacccggaagcggacctactgggtgcccaacagcagcggcggcctggtgaacaggggtatcgatatcggagacgatatggtctctggcctcatttataaaacatataccctgcaggacggaccgtggtctcagcaggaaaggaaccccgaagcccctggacgggccgccgtacccccctggggaaaatacgatgctgcactaaggacaatgataccctttcgaccaaaaccgcggtttcctgccccccagccactggacaatgcagggctgttcagttacttgacagtctcttggctgaccccgcttatgatccaatccttgagatcgcgactggatgaaaataccattcctcccctaagcgtacatgatgcctcagacaagaacgttcagaggctccatagactttgggaggaggaggtctcaagaagaggcatcgaaaaggccagtgttcttctggttatgctgcgattccagcgcacacgtttgatcttcgatgccctgctgggcatatgcttctgcattgctagtgtgctcgggcccatcctgattattccgaagatcctggagtacagcgaggagcaattaggaaacgtcgtgcacggcgtgggcctatgtttcgcgctgttcttgtcggagtgcgtgaaatctctgagcttcagttcaagctggataatcaatcaaagaacagcaattcgctttagggctgccgtgtcttcctttgcctttgagaagcttatccaatttaagagcgtaatacatattacgtctggagaagccatctcctttttcaccggcgacgtgaattacctcttcgagggcgtgtgttatggtcctctcgtgctgatcacttgcgcctcactggtgatatgctctatctcctcttactttatcatcggctacactgcattcatagcaatcctttgttacctacttgtctttccgctggctgtctttatgacgcgcatggccgtcaaagcgcagcatcacacatcagaagtatccgaccagaggatacgggtgacgtccgaggtgctgacttgcataaagctgatcaagatgtatacttgggagaagcctttcgccaaaattattgaggatcttagaagaaaggaacgcaaattgctggagaaatgcggccttgtccagtccttaacatcaatcaccttgttcattatcccaactgtcgctacggcagtctgggtgcttatacacacctcccttaaactcaagcttaccgccagcatggccttctccatgcttgctagtctgaacctgctgcggctctctgtgttcttcgtgcccatcgcagtcaagggcctgaccaactccaagagtgcggtaatgcgatttaagaagttttttcttcaggaatcacccgttttttatgtgcagacactgcaggatccatctaaggccctcgtttttgaagaagctacactttcttggcaacagacttgtccaggaattgtcaacggagccttggagctagagcgtaatgggcacgctagcgaaggcatgacgcgcccccgcgacgccctcggtcccgaggaggaaggaaactcactgggcccggagctgcataagatcaatcttgtggttagcaaggggatgatgctgggggtctgcggcaacactggtagcggaaagagttccctgctttcagccattctggaggagatgcatctgctagagggttccgtaggcgtgcaaggctctctggcttacgtcccccaacaggcgtggattgtgtctgggaatatccgcgagaatattttaatgggtggcgcctatgacaaagcaaggtacctgcaggtcctgcactgctgcagccttaacagagacctggaacttttgccattcggggacatgaccgagatcggagagcgcggcctcaacctctcaggaggacaaaagcaaagaatctccctggcgcgtgccgtttacagcgacaggcagatctatctcttggacgacccccttagtgccgtggatgctcatgtgggaaagcacatctttgaagaatgtatcaaaaagactctccgtggtaaaactgtggtcctagtgacccaccagttacagtatctagaattttgtgggcagatcattctcctggaaaacggcaagatatgcgagaacggaacacactcagagctgatgcagaagaagggaaaatacgcccagcttatacaaaaaatgcacaaggaggctacatcagacatgctgcaagacactgctaaaatcgcagagaaaccaaaggttgagtctcaggccctggcaacatccctggaagagtctcttaatggcaacgccgtccccgagcatcagctcactcaggaggaggagatggaggagggctctctgtcttggcgggtgtaccaccattacatacaggcagccggcggctacatggtgtcttgtatcattttcttttttgtcgttctgatcgttttcttgacaatctttagtttctggtggttgtcttactggttggaacaagggtctggcaccaacagctcacgtgagtccaatgggacaatggcggatctgggcaatattgcggacaaccctcagcttagtttttaccagttagtgtatggactgaatgctttgttgctgatctgtgttggtgtgtgcagctccggtattttcactaaagtgactcgcaaggcttcaactgcactgcataataagctgtttaataaagtgtttcggtgtccaatgtctttctttgacactattcccatcggcagacttctaaattgcttcgcaggtgacttggaacaactggatcagcttctgccaatcttcagtgaacagtttctggtgctatcactgatggtcatcgcagtgctcctgatagtgagcgtcctgtcaccatacatacttttgatgggagccattatcatggtcatttgcttcatttactatatgatgtttaagaaggccattggggtgttcaaaagactcgaaaattatagccgcagtcctctgtttagtcacatccttaattcccttcaagggctcagcagtattcacgtgtatggcaagactgaagatttcattagtcagttcaagaggctgacagatgcccaaaacaattatctgcttttgtttctgagctcaacacggtggatggcccttcgccttgaaatcatgactaatctcgtgaccctggcagtggcattgttcgtggcattcggaattagttccaccccgtatagttttaaggtgatggctgttaacatcgtgttacaactcgcctcttcctttcaggcaaccgcacggatcgggctggagacagaggctcaatttacggcagtagagagaatcctccagtatatgaaaatgtgtgtgagcgaagctcccctgcatatggaagggacgtcttgtccacaggggtggcctcagcacggcgaaatcatctttcaggattaccatatgaagtatcgcgacaacactccaactgtgcttcatggaattaatctgactattcgaggccatgaagtggtgggaatcgtggggcgaaccgggagcggtaagtccagcctaggtatggccctgttcaggctcgtagaacccatggccggccgcatcctgatagacggagtagacatatgcagcattggcctcgaagacctgcgctccaagttatctgtgatccctcaggaccccgtgctactctccggcactattaggtttaacctggatccttttgaccggcacacagaccaacaaatatgggacgcactggagcgcacctttcttacaaaggctattagcaaattcccaaaaaagctgcacaccgatgtggtggaaaacgggggtaatttttcagtcggcgagagacagctgctctgcatcgcgcgggcagtgctgaggaactctaaaatcatcctcatcgacgaggctacagcgtctattgacatggagaccgacacattgattcagcgcacgatccgcgaagcattccagggctgtaccgttttagttatagcccatcgggtcactacagtgctcaactgtgaccatatcctcgtgatgggcaatggaaaggtagttgagtttgaccgaccagaagtcctaaggaagaaaccaggctctctgtttgctgccctcatggccacggcaaccagctcactgaggtag

SEQ ID NO: 180002 - DNA, 4149 bp, Artificial Sequence
  Description of Artificial Sequence: Synthetic coding sequence
atgacccggaagcggacctactgggtgcccaacagcagcggcggcctggtgaaccggggcatagacatcggcgatgatatggtgagtggactcatttataagacatacactctgcaggacggtccctggtcccagcaagagcgtaatcccgaagcgcccgggcgtgcagccgtgccaccctggggcaaatacgacgccgccctccggacaatgattccatttcgaccaaagcctcgattccctgcgccacagccacttgataacgccggcttattctcctatctcacagtgtcatggctcacgccattgatgatccagtcgttgaggtcgcggctggacgaaaataccattccaccactctctgtccatgacgccagtgacaagaatgtgcagaggctacatagactctgggaagaggaggtatctcgacggggtatcgagaaggccagcgtcctcctagtaatgttgagatttcagcggactcggctaatttttgatgcccttctcgggatctgcttctgtatcgcatccgtactggggcctatccttattatccctaagattctggagtattccgaggagcagcttggtaacgtggttcatggtgtcggactatgcttcgctctgtttctctcagagtgcgtgaagtctctgtctttcagttcctcttggataattaatcaacgaactgccattaggtttagggctgcagtaagttcatttgccttcgagaaattaatccagttcaaaagtgttatccacattaccagtggtgaagccatatccttcttcaccggggacgttaattacctttttgagggagtgtgctacggaccattagttttgatcacatgcgcctcactcgtgatctgctccatatcaagctactttattatcggctatacagcctttatagcaatcttgtgctaccttttggtgtttccactggcagtgttcatgacacgcatggctgtgaaagcccagcaccacacctccgaagtgtccgaccagagaatccgagttacttcagaagtcttaacttgtatcaagctcattaaaatgtatacctgggaaaagcctttcgctaagattattgaggacctgaggaggaaagaaagaaagctgttggaaaaatgtgggctcgtgcagagcctgacctctataacactctttatcatccccaccgtagccaccgccgtgtgggtcctgattcacacctcattaaaacttaagcttaccgcgagcatggcgttctcaatgttggcttccttaaacctcttgagactttcagtgttcttcgtccctatcgctgtgaaagggcttaccaatagcaaaagcgccgtcatgcgattcaagaaattctttctgcaggaaagccctgttttctacgtgcaaaccctgcaagatccatcaaaggcactcgtcttcgaagaggcgaccctgagttggcagcagacgtgtcccggtattgtgaacggggccctggaactggagcggaacggtcacgccagtgagggcatgactagaccacgggacgccctgggtccagaggaagagggcaattctttgggccctgagctacacaagattaacttggtcgtgtcaaagggaatgatgctgggggtttgtggcaatactggaagcggcaagtcttccctgctctctgctatcttggaggagatgcaccttctggagggaagcgtgggcgttcagggatctctggcatacgtgccgcagcaggcttggattgtgagcggtaatatcagagagaatatattgatggggggagcctacgacaaagcccgctatctgcaggttctccattgctgctcactgaatagagacctcgagcttttaccattcggtgatatgaccgaaattggtgagagaggacttaacctcagcggcggacaaaaacagagaatctctctggcccgggccgtgtactcagacagacagatctacctgctggacgaccccttatccgctgttgacgcccatgtggggaagcacatcttcgaggagtgcatcaagaagacattacgaggaaaaactgtcgtgcttgtcacccatcagttgcagtacctggaattctgtggccagattattctcctagagaacggaaagatctgtgaaaatggtacccacagcgagctgatgcaaaagaaaggcaagtatgcccagttgattcagaagatgcataaggaggccacgagtgacatgctccaggacactgctaaaatcgctgagaaacccaaggtcgaatcgcaggctctggcaacaagcctagaagagtccttgaatggcaatgccgttcccgaacatcagctcacccaagaagaggagatggaggaaggcagcctcagctggcgtgtctaccatcactatatccaggccgccggaggttacatggtctcatgcatcatcttcttctttgtcgtgttaatagtttttttaacgatcttttcattctggtggctgagctactggctggagcaggggtcaggaacgaattctagcagagagtccaatggaactatggcagaccttggcaacattgcagataacccacaactgagcttctaccagctggtatatgggttaaacgctttgctgctgatctgtgtaggcgtttgcagctccggcatcttcaccaaagttactcgaaaagcctccaccgccctgcacaataagttgttcaacaaggtttttagatgtcctatgtcctttttcgatacgatcccaattggccgcctcctaaactgctttgctggagacctcgaacagctagatcaacttctcccaatcttcagcgagcagttccttgttttgtcgctgatggtcattgctgtccttctcatcgtgtccgttctgagcccctacatactgctgatgggggcaattattatggtcatatgctttatttactacatgatgttcaaaaaagcaattggggtgttcaagcggctggaaaattactctcgttcaccactgttcagccacatcctgaattctctgcaaggactgagctccattcatgtgtatggtaagacagaagacttcattagtcagtttaaaaggctcaccgacgcccaaaataactacctcctgctctttctgtcttccacacggtggatggcgctacgcctggagatcatgacaaaccttgtcacgctggcagtggctcttttcgtggcttttgggattagctctactccttactcttttaaggttatggccgtaaatatagtgctgcagctcgcaagctcttttcaggccacagcccgcatcgggttagagacagaggctcagttcactgctgtggaaaggatcctgcagtacatgaaaatgtgcgtcagcgaggccccactgcatatggaaggtacttcttgcccacaggggtggccccagcatggggaaatcatctttcaggactaccatatgaagtatcgcgacaatactccaaccgtgctccacggcatcaatctcaccatcagaggccacgaggtcgtggggatcgtgggcagaaccgggtccggcaaaagctctctaggcatggccctctttagactggtggagccaatggcaggacgaatcctgatcgatggggtagacatctgttcaattggattagaggaccttcggtccaaactttcagttataccccaggaccccgtactgctgtcaggtacgatccgctttaacctggatcctttcgatagacacactgatcagcagatctgggatgctttagagcgcacctttttgacaaaagcaatttcaaaattccccaagaagctacacactgatgttgtggagaacgggggaaatttctctgtgggagagagacagctcctgtgcatcgcacgagcagtactgcggaacagtaaaattattctgatagatgaggccaccgcttccatagacatggagactgataccttgatacagcggaccatccgagaagcatttcaaggttgtaccgtactggtcattgctcatcgagtcaccacagtgctgaattgcgaccacatccttgtcatgggaaacggcaaggtggtggaatttgaccgccccgaagtgctcagaaagaaacctgggtcacttttcgctgctctaatggccaccgccactagctcactcagatag

SEQ ID NO: 180003 - DNA, 2268 bp, Artificial Sequence
  Description of Artificial Sequence: Synthetic coding sequence
atgacccggaagcggacctactgggtgcccaacagcagcggcggcctggtgaacagggggatcgatatcggggacgatatggtctcggggctgatttacaaaacatacacgctgcaagacggtccttggagtcagcaagagcgaaatcccgaggcacccgggagagccgccgtgccaccatggggcaagtatgacgctgccttgaggaccatgatccctttcaggcccaagccccgttttcccgcccctcagcccctggataatgccggattgttctcttatctgacagtctcatggctcacaccactgatgattcagagtctgcggtctcgcctcgacgagaatacaattcccccactgtccgtacatgatgcatccgacaagaacgtccagaggctccatagattgtgggaggaggaagtgagtagacgcggaattgagaaggccagcgtgctcttagttatgttaagattccagaggacaaggctgatttttgacgctctcctggggatctgcttttgtatcgcttccgttctgggccctatcctcatcatccctaagattctggagtattccgaagagcagctgggcaatgtcgttcatggggtgggactgtgctttgcccttttcctgagtgagtgtgtgaagagtctcagttttagttcctcctggatcatcaatcagcgcacagctattcgcttccgggctgccgttagctctttcgcatttgaaaagctaatccagtttaagagcgtgattcacatcaccagtggagaggccatcagctttttcactggagacgtcaactacctgtttgagggtgtgtgctacggcccactagtgctgattacctgtgcttctctcgtgatttgtagcattagctcctacttcattataggatatacagcttttatcgcaatactctgctacttgctagtctttcctctggccgtatttatgacgcggatggcggtgaaggcacagcaccataccagcgaagtgtccgaccagcgcattcgcgtgacttcggaggtcttgacgtgcatcaagctgatcaagatgtacacatgggagaagcccttcgccaaaatcatcgaggatctccgcagaaaggagaggaaactcctggagaaatgtgggttggtacaaagcttaacctccattactctgttcattatacctaccgtcgcaacagcagtgtgggtgcttattcacactagtctcaaacttaaactgaccgcttctatggccttcagtatgctggcctccttgaacctgctgcgcctgtcggttttctttgtgcccattgccgtgaagggcttaaccaacagcaagagtgctgtgatgcggttcaagaagttctttctgcaggagtcaccagtattctatgtacaaacactccaggatccatccaaagccctggtttttgaagaggccacacttagttggcagcagacatgccctggtatagtaaacggtgccctggagttggaaagaaatggacatgctagcgagggaatgactcgcccacgggatgcattggggcccgaggaagagggcaactctctggggcccgagctgcacaagattaacctcgttgtgtccaaaggcatgatgttgggagtctgcggaaacaccgggtccggaaagtcgagcctgctgtccgcgatactggaggagatgcaccttctggaaggaagtgtgggagtgcaaggctccttggcatacgtccctcaacaggcatggatcgtgtcaggcaacattcgggaaaacatactcatggggggcgcctatgacaaagcccgttatttgcaggtgcttcactgctgcagtctaaatagggatttggaattactgcctttcggggacatgacagagattggagaaagaggactaaacctgtctgggggtcaaaaacagcgcatttcactggccagggcagtctactctgacagacagatttatctactagatgacccgctgagcgccgtggacgctcatgttggcaagcacatttttgaggaatgcattaaaaaaacgctacggggaaaaacagtggtgctagttactcaccagttgcagtacctggaattttgtggacaaataattctcttagaaaacggcaaaatctgtgagaatggaactcacagtgaacttatgcagaagaaggggaaatatgctcagttgatacagaagatgcacaaggaggccactagttgtagatctatatcctcgcaccgacgccgccgctggaagaaagccccttag

SEQ ID NO: 180004 - DNA, 4080 bp, Artificial Sequence
  Description of Artificial Sequence: Synthetic coding sequence
atggtgggcgagggcccctacctgatcagcgacctggaccagcgggggaggcgaagatccttcgcggaacgttatgacccttccttaaagacgatgattcccgttcgtccatgtgctaggcttgctccaaatccagtcgacgatgccgggctactgtcgtttgctaccttctcttggttaaccccagtgatggtgaagggctacaggcagaggcttaccgtcgatacacttcccccgctgtctacatatgatagctcagacaccaatgcaaaaagattcagggttttatgggatgaagaagtcgccagggttggaccagaaaaggcatctctctcccacgttgtgtggaagtttcaaagaaccagggtgctgatggatatcgtcgccaacattctttgtataataatggctgccatcggcccagtgattctgatccatcagatcttacagcagaccgagagaacttcagggaaggtctgggtggggatcggcctgtgcattgccctctttgccaccgagtttacaaaggtctttttttgggccttggcttgggccatcaattacagaacggccatccgattgaaggtggctcttagcacactggttttcgaaaaccttgtttcttttaaaactctgacccacatctccgtcggagaagtgctgaacatactgtcctccgactcatactcactgttcgaagctgcattattctgcccactgcctgccacaatcccaattctgatggtattctgtgcagcctatgctttcttcatcttaggacccaccgccctcatcgggatcagtgtatatgtgatattcattcctgtacagatgtttatggctaaactcaattctgcatttaggaggtcagctatcctggtgacggataagagagtgcagactatgaatgagttcttaacctgcattcggttaattaagatgtatgcctgggaaaagtccttcacaaatacaattcaagatattagaagaagagaacggaaactgctagagaaggccgggtttgttcagtctggtaacagcgcactcgcaccaattgtgagtaccatcgctatcgtactgacactgtcgtgtcacatcctgctgagacgcaagctgacggcccccgtggccttctcagtaatcgccatgttcaacgtcatgaagttctctattgctattctgcctttctcaataaaggcaatggccgaagccaacgtaagcttacgacggatgaaaaagatcctcatcgataagagtccgccctcatacattactcagcccgaggatcctgataccgtgctgcttctggctaatgccacacttacttgggaacacgaggcctccagaaagtcgacgcccaagaagctgcagaatcagaaacgacacttgtgcaagaaacagcggtctgaagcctatagcgagagaagccctccggcaaagggagccaccggacctgaagagcagagcgacagtctcaaatccgtactgcactcaatcagtttcgtggtgcggaagggaaaaatcctcggtatctgcggaaacgtgggatctggcaagtcctctttgctcgcagctctcctcggccagatgcaactgcagaaaggcgtggtcgccgtcaatggcactttggcctatgttagtcagcaggcttggatcttccacggaaatgtgagagaaaacattctgtttggggaaaaatacgaccatcagcggtaccagcatacggtccgcgtgtgtggcctccagaaagacctgtccaacctgccgtatggcgatctgaccgaaatcggcgaacggggattgaatctgtctgggggacagagacagaggatctcgctcgctcgcgccgtctactccgacagacaattatacctactggatgatcccttgtcagccgtcgacgcccacgtgggcaagcacgtatttgaggagtgcattaagaaaactctgcgcggcaagactgtggtgctggtgacacaccagctccagttcctcgaaagctgtgacgaggtcatactgctggaggacggtgagatctgtgagaaaggtacacacaaagagctgatggaggaaaggggaaggtacgcaaaacttatccataatctacgtggtctgcagttcaaagaccccgagcatctctacaacgccgctatggtcgaggcattcaaagagagcccagctgaaagagaggaagatgccggcattatcgtcctggccccaggaaacgaaaaggatgagggaaaggagtcggaaactggcagcgaatttgtggacactaaggtcccggagcatcagctgatccagacagagtctcctcaagaaggcacagtgacctggaagacctaccacacctatatcaaagccagcggcggatatcttcttagccttttcacagttttcctgtttctactgatgatagggtccgcagcattctcgaattggtggctggggctctggctggataaagggagcaggatgacatgcggcccacaaggtaatcgcaccatgtgtgaggtgggtgcagtgcttgccgacattggccaacatgtgtaccaatgggtatataccgcttcaatggtgtttatgcttgtattcggcgtgaccaagggcttcgtattcaccaaaacaacactgatggcaagttcctccctacatgacacggttttcgacaagatcttgaagtcccccatgtcatttttcgataccaccccaacaggacggcttatgaaccgatttagcaaggatatggatgagctcgacgttcgcttgccttttcacgccgagaacttcctccagcaattctttatggtggtgtttatcttggttatcctagctgccgtgtttccagcagtactgctggtagtcgccagcctggccgtggggtttttcattttgctgagaatcttccataggggcgtacaggaactgaagaaagttgagaacgtctcccgatccccatggttcacgcacatcacatccagcatgcagggcctaggtattatccacgcatacgggaagaaggaatcttgcatcacttatcacctgctgtacttcaactgcgcgctgcggtggtttgccctgcgcatggacgtcctgatgaacatccttaccttcacagtagcgctcctcgtgaccctgtcattcagtagcatttcaacttcaagtaagggtctctccctcagctacattatacaattgagtggtctgttgcaggtgtgtgtccgaacaggtaccgagacacaagccaagtttacctccgtcgaactgctaagagaatatatcagtacatgcgtgcctgagtgtacccaccccctgaaagttggcacatgtcctaaggactggccaagtaggggcgagatcaccttcagggattaccagatgagatacagagataatacccctttggtgctagattccctcaacctgaatatccaatcaggtcagaccgtcggtatcgttggtcgaacaggtagcggcaagtccagtcttgggatggccctgtttagattggttgagcccgcttcgggcacaattttcatcgatgaagtcgatatctgcatcctctccctcgaagacctgagaacgaagctaacggtgattccgcaggatccagtcctctttgtgggcacagtgaggtataatctggatccattcgagagccacaccgatgaaatgctctggcaggtgctggagaggactttcatgcgggacactattatgaagctcccggagaaattgcaagcagaagtcaccgaaaacggagagaactttagcgtcggggagcgccaacttctgtgtgtggcccgggctctgcttcgcaatagcaagattatcctgttagacgaggcaacagcctccatggacagtaagacggatacgctggtgcaaaacaccataaaggatgcttttaaaggttgcaccgtgcttacaatcgcccatcgcctgaacaccgtgctgaattgcgatcatgtactggtgatggagaacggcaaagtgattgagttcgacaagccagaagtcttggctgagaagcctgattctgcatttgccatgctgctcgccgccgaagttcgcctttag

SEQ ID NO: 180005 - DNA, 1902 bp, Artificial Sequence
  Description of Artificial Sequence: Synthetic coding sequence
atggtgggcgagggcccctacctgatcagcgacctggaccagcggggcaggcggcgtagttttgctgaacggtacgatccctccctcaagacgatgatccccgtgagaccctgtgcacgtctcgcccctaatcctgtcgatgatgctgggctcttgtctttcgccaccttttcttggttaacacccgttatggtgaagggttatagacaaaggttgacggttgatacattgccaccattgtctacatatgatagctcagatactaacgccaaacgctttcgcgtcctctgggacgaagaggtggcgagagtggggcccgaaaaagcgagtttaagccacgtggtttggaaatttcagcgtactcgcgtattgatggatattgtggcgaatatcttgtgtatcataatggcagctattggtcccaccgttctgattcaccaaatcctccaacagactgagcgtacaagtggcaaagtgtgggtcggtattggcctatgtattgccctcttcgctactgaattcacaaaggtgttcttctgggcccttgcctgggccattaactatcgcacagcgattaggctgaaggtggctctgtctacgctggtattcgagaatctggtgtccttcaagaccctgacacacatcagtgttggggaggttctgaacatcctctccagcgactcctactccctgtttgaggctgctctgttttgtcctctccctgccacgatacctatcttgatggtgttctgtgctgcctacgctttctttatcctgggaccaaccgctctaatagggatctctgtctatgtaatattcattcccgtccagatgttcatggcaaaactgaatagtgccttcagacggtctgccatcctggtcaccgacaagagggttcagacgatgaacgaattcctgacctgtatccgcctcattaaaatgtatgcatgggagaaatcctttaccaacacaattcaggacattaggcgccgggagcgtaaactgctggagaaagccgggttcgtacagtctggtaattcggcgctggcgccgatagtgtccacaatagctattgtgctaaccctatcctgtcatattttgctccggcggaaacttaccgcaccagtggccttctcagtgatagcaatgtttaacgttatgaaatttagtattgccatcctgccttttagcatcaaggccatggccgaggctaatgtgtcactccgcaggatgaaaaaaatcctgatagacaagtcaccaccctcttacataacacagccagaggaccccgatacagtactgctgcttgctaatgctacactgacttgggagcacgaagcttccagaaaatctacacctaaaaaactccagaatcagaagagacatttgtgcaaaaagcagcggagcgaagcttattcggaacggtcacctcctgcaaaaggcgcaaccgggccagaggaacaaagcgacagtctgaagagtgtcttacacagcatctctttcgttgtgcgcaaaggcaaaatcctgggaatctgcggtaacgtgggttctggcaaatcctcgttactcgctgctttgcttgggcagatgcaacttcagaagggggttgtcgcggtgaacgggaccctggcctacgtgtcacagcaggcttggatcttccacggaaatgtgcgtgagaatattctgttcggagagaagtacgatcatcaacgtctagggtctggggcttcgacttccctaggcggcaggggaagggggctggcttggccagctctttctaccccgaccgttagtagcacctgctggaccactccatgtagaccttggacgccaacttgggggtcaacttccctccggtccgccctacggaggcggtccggcgaacggcagagctcttggtag

SEQ ID NO: 180006 - DNA, 2808 bp, Artificial Sequence
  Description of Artificial Sequence: Synthetic coding sequence
atggtgggcgagggcccctacctgatcagcgacctggaccagcggggcagaagacgatcgttcgccgaaagatacgacccatcccttaaaaccatgattcccgtacgcccatgtgctagactcgccccaaaccctgttgacgatgccggtcttctgtcctttgccaccttttcatggttgacccccgttatggtgaagggataccggcagcggctgaccgtcgatacattgcctccactttctacttatgactccagcgatactaacgcaaaacgtttccgggtgctgtgggatgaggaagtggctcgggttgggccagagaaggcgtccctgtcccacgtcgtctggaagttccagcgtactcgcgtgcttatggacattgtagccaacatcttatgcattatcatggcggctatcgggccaaccgttctcatccaccagatcttgcaacaaaccgagaggacgtccgggaaggtctgggtaggcattgggctttgtatcgcattatttgctactgagtttacgaaggttttcttttgggccctagcctgggccatcaattatagaacagccattcggctgaaggttgcattgtccactctggtttttgaaaatctggtgagctttaaaactctgactcatatttccgtgggcgaggtgctgaacatactctcttccgattcgtactccctgttcgaggccgctcttttttgccccttgcccgccacaatcccaattctgatggtgttctgcgcagcctacgcctttttcatcttaggtccgactgccctgataggcatttctgtatacgtgatctttattcctgtgcagatgttcatggctaagctaaattcagcgttcagacgatcggccattctcgtgacagacaagcgcgtccagaccatgaatgagttcctgacctgcatcagactcatcaagatgtatgcctgggaaaaatcattcacaaacacaatccaagatattcggcgccgggagcgcaaactgttggagaaggccggatttgttcagagtggcaattccgcgctggcgcccattgtgagcacaatcgctatagtactgacgctgagctgtcatatactcctgaggaggaagctcactgctcctgttgcctttagcgtgatcgcaatgttcaatgtgatgaagttttccatcgccatactaccattctccattaaggctatggccgaggccaacgttagtctacgcagaatgaaaaagatattgatagacaagtcgcctccctcctatataacccaaccagaagaccccgacaccgtcttgctgcttgccaatgctaccctgacctgggagcacgaggctagccgcaagtcaactcccaagaaactgcagaatcagaagcggcatctgtgcaagaagcagcggtccgaggcgtatagcgaaagatcaccacctgctaaaggtgccacgggacctgaggaacagtccgacagtttgaagagtgtccttcactccataagtttcgtcgttaggaaggggaagatcctcgggatctgcggaaacgtgggctccggaaaaagttcattgctggcagccttactggggcagatgcaactgcagaagggcgtggtagctgtcaatggcacactagcttacgtctcccagcaggcttggatcttccacggcaatgtgcgagagaacatcctgtttggcgagaagtacgaccatcagcgttaccagcataccgtcagggtctgtggacttcaaaaggacctgtcaaacttgccctatggggaccttactgaaattggagagagagggctcaacctgtccggcggccaacgccagcgcatttcattggccagggccgtttactcggatagacagctatatctacttgacgatcctctgtcagccgtggatgcccacgttgggaaacacgtgtttgaagagtgtattaaaaagacccttcgcggtaagactgtggtgctggtcacacaccagctgcagttcctagagtcttgtgacgaggtgattctgctggaggatggggagatctgcgaaaagggaactcataaagagctgatggaggagagggggcggtacgcaaagctcattcacaacttgagagggcttcaatttaaagatcccgaacatttgtataatgcagcaatggttgaggcattcaaggaatctccagcagaaagagaagaagacgccgtcctcgcccctggaaacgaaaaagacgaaggaaaggagtccgaaactggatccgaattcgtggacaccaaagtgcctgagcaccaactgatccagaccgaaagtccacaggaagggacagtgacgtggaaaacttaccatacctatataaaggctagcggtggatatctcttatccctgtttaccgtgtttctgtttctcctgatgattggatcggccgcttttagtaattggtggctgggcctgtggctcgataaggggtcccgcatgacgtgtggccctcagggtaatcggactatgtgcgaggtgggcgctgtcctcgctgatatcgggcaacacgtctatcagtgggtatatacggcgtccatggtctttatgctggtgttcggcgttaccaagggattcgtgttcacgaagacgactctgatggcctcctcatcactgcacgacaccgttttcgacaaacacttccctcagcggtctccaggggcccaggagggaggcgaatgccagcctgtgaccctagtgcaccctcatcatctgttacacgctgggcccggccaccattctaggctttggcaagagggtgagctccaccacctcgtttag

SEQ ID NO: 180007 - DNA, 2793 bp, Artificial Sequence
  Description of Artificial Sequence: Synthetic coding sequence
atggtgggcgagggcccctacctgatcagcgacctggaccagcggggcaggcgacgtagtttcgctgagagatatgacccttccctgaagacgatgattcccgtgcgtccctgcgcacgtctggcccctaacccggtcgatgatgccgggcttctttcctttgccaccttcagttggctcaccccagtgatggtcaagggatataggcagcgccttaccgtcgacacacttccgccactgtcaacgtatgacagcagcgacacaaacgctaaaagattccgggtcctttgggatgaggaagtggcccgggtaggccccgaaaaagccagtctgagccacgtcgtgtggaagttccagcgcacccgggtgctgatggacattgtagctaatatactgtgtattatcatggctgccattggccctaccgtcctcattcatcagatcctgcagcagacagaacgtacatctggcaaggtttgggtaggcattggattatgcatcgcgctgttcgcgaccgagttcactaaggtgtttttctgggccctagcatgggcgattaactaccgcacagctatcaggttaaaagtcgctctgtcgaccctggtgttcgaaaacctcgttagctttaaaacactcactcacatctcagtgggcgaaatgtttatggccaaactaaattcagcgtttagacggtccgccattttagtgaccgataagcgggtccagacaatgaacgagttcctgacctgtataagactgattaaaatgtatgcatgggagaaatcatttactaatacaatccaggatatacgacggcgggagcggaagctgctggaaaaggctggctttgttcagagcggtaattccgcacttgcccccatcgtttcaacaatcgccatcgtactgactctcagctgccacattttgctgcgccgcaagctcaccgcccccgtagcgttctcggttatcgccatgttcaacgtgatgaagttttccatcgctattctgcctttcagtatcaaggcaatggctgaagccaacgtaagtttaaggagaatgaaaaagatcttaattgacaaaagtcccccctcctatatcacccagccggaggaccctgacactgtcctgctgctggctaatgccacgctgacatgggagcacgaagctagcaggaagtccaccccaaagaagttgcagaaccagaaaagacatctctgcaaaaagcagagatcagaggcatactctgaaaggtcgccacccgcaaaaggcgccaccggacctgaggagcaaagcgactccttgaagtctgtgttacatagcatatctttcgtggtgcggaagggaaagattctggggatctgcggtaacgtaggatctggaaaatcatccctcctagctgccctcctgggtcagatgcaattacaaaaaggggttgttgcagtcaacggtacccttgcctatgtgtcacagcaagcctggatttttcacggtaacgttcgcgaaaatatcctgttcggggagaagtatgatcatcagaggtaccaacacaccgtgagagtgtgcggtctccagaaggatttgagtaacctgccttatggcgatctcactgagataggggagcggggcctaaacctcagcggcggtcagcgtcaacgcatcagcctggcacgcgcagtatacagcgacaggcagctatatttgttagacgatccactctctgccgtcgatgcccacgtaggaaagcatgtttttgaagaatgcattaagaaaacccttcggggaaagaccgtggtgcttgttactcaccagctacagtttttagaatcttgcgatgaggttattctcctcgaggacggggaaatttgcgagaaaggaactcacaaagagttgatggaagagcgcggtcgatatgccaaactgattcacaacctccgaggcctccagttcaaagatcccgaacatctatacaatgcggccatggtggaagccttcaaagaatcccccgcggaacgtgaggaagacgccgggattattgtgcctgaacatcaactgattcaaactgagtcaccgcaggaaggaacagtgacctggaagacctaccatacctatatcaaggctagtggagggtacctgctttcacttttcacagtctttttattcctgctgatgattggctctgctgcgttctcgaactggtggcttggtctctggctggacaagggcagtagaatgacttgcggtccacagggcaataggacaatgtgcgaagtcggagctgtgctcgccgacattggccagcacgtttaccagtgggtctataccgcctctatggtcttcatgctcgtgtttggggtaacaaagggatttgtgtttacaaaaaccaccctgatggcttcatcttccctacacgacaccgtgttcgataaaatcctgaaaagcccgatgtcttttttcgacactacccctactggccgactgatgaaccgtttcagtaaggatatggacgagttagatgttagattgccattccatgccgaaaatttcttacaacagttcttcatggtggtcttcatcctcgtgatcctcgccgctgtgttccctgcggttctgctggtggtcgcgtccctggcagtgggcttctttattcttctgcggatattccacaggggcgtgcaagagcttaagaaggtcgagaacgtgagtagatccccctggttcacccatataacaagctcaatgcagggtttgggtataatccatgcttacgggaaaaaagagagctgtattacttag

SEQ ID NO: 180008 - DNA, 321 bp, Artificial Sequence
  Description of Artificial Sequence: Synthetic coding sequence
atggtgggcgagggcccctacctgatcagcgacctggaccagcggggtcgacgacgaagcttcgctgaacggtatgatccaagtctgaaaacaatgatccctgttcgaccatgcgctaggctcgcacctaatccggtggatgatgcgggcctacttagcttcgccacttttagttggctcactcccgtgatggtgaagggttatcgccagcggctcaccgttgatactcttcctcctcttagcacgtacgactccagcgataccaacgctaaacgcttccgggtgttgtgggacgaagaggttgccagagtgggtccatag

SEQ ID NO: 180009 - DNA, 858 bp, Artificial Sequence
  Description of Artificial Sequence: Synthetic coding sequence
atggtgggcgagggcccctacctgatcagcgacctggaccagcggggccgaaggcgctcttttgcagaaaggtatgatccatccctcaagactatgatccccgtgagaccttgcgctcgactcgctcctaatccagttgacgacgcaggcctgctgagtttcgctacatttagttggctgaccccagtcatggtgaagggctaccgccaaagactgacagttgatacactgcctccgttaagtacatacgactcttccgacaccaatgcgaagcgattcagagttctttgggatgaggaagttgcccgggtgggccctgaaaaggccagtctgtcgcacgtggtgtggaagtttcaacgcacgcgtgttctgatggatatagtggcaaatattctgtgcattatcatggcagcgatcggccctaccgtgctcattcatcaaattctccagcagaccgagcgcacgagcggcaaagtctgggtggggattgggctgtgtattgctctctttgcaacggagttcactaaagtcttcttttgggcactagcgtgggcgatcaactaccgtacagcaatcaggcttaaagtcgcccttagcaccttggtgttcgagaacttggtctctttcaaaactctcacgcacattagtgtcggcgaagtgctgaacatcctttcttccgattcctactcgctgtttgaagccgctctgttttgcccattgcctgccaccatccctatcctaatggttttctgtgccgcttatgccttctttattctgggccctaccgctctgattggcatctccgtgtgtctgtggccaagttccattcagttatccgaaggacagcaattctggtag

SEQ ID NO: 180010 - DNA, 882 bp, Artificial Sequence
  Description of Artificial Sequence: Synthetic coding sequence
atgctggagaagttctgcaacagcaccttctggaacagcagcttccttgattcccctgaggctgacctgcccctttgtttcgagcagaccgtcttggtgtggattcccctaggatatctgtggctgttagccccatggcaattattgcatgtttacaaatcccgcacgaaaagatcctcaacaactaagctatacctagcaaagcaggtctttgtcggcttccttctgattcttgcagccatagaacttgccctggtactcacagaggatagcggccaggccaccgtccccgctgtccggtatactaatccaagcctttatcttggaacatggctgttagtcttgctcatccagtattccaggcaatggtgtgtccagaaaaattcttggtttcttagtttgttttggattctctctattttgtgtggtactttccaatttcagaccctgattcggacacttctccaaggtgataactcaaatctggcatactcatgcttgttctttattagctacgggtttcagatcctgatactgattttctcagcattctctgagaacaatgaaagttccaataacccgtcctctatcgcttcgtttctgtcgagtatcacatatagctggtatgattcaataattctgaagggatacaagcgccccctgacactggaggatgtgtgggaggtggacgaagagatgaaaacgaagactctggttagtaaattcgagactcacatgaaacgggaactgcaaaaagcgcggagggcacttcagcgccgccaggaaaagtcgtctcagcagaacagcggggcgaggttacccggacttaacaaaaatcagtcccagagtcaagacgcgctggtacttgttaccttcccctag

SEQ ID NO: 180011 - DNA, 4638 bp, Artificial Sequence
  Description of Artificial Sequence: Synthetic coding sequence
atgctggagaagttctgcaacagcaccttctggaacagcagcttcctggactctcccgaagccgatctacccctgtgctttgaacaaactgtactcgtctggatccccttgggttacctgtggctactggcgccatggcagttactgcacgtatacaaatcaagaaccaaacgcagtagtacaactaagctttatctcgctaagcaggtgtttgtaggatttctgctgatattggctgctatcgagctggctctggtactgacagaagacagcgggcaggctacggtccccgccgtcaggtatactaacccatccctgtacctgggtacctggctgctggtgctgctgatccaatactccaggcagtggtgtgtccagaagaacagttggttcctatctttgttctggatcctgtcaatcctgtgtggtacttttcagttccaaactctcatcaggaccctgcttcagggtgataattctaacttggcgtactcctgtctgttcttcatttcatacggctttcagatcctgatcctgattttctccgctttcagcgagaacaacgagtcttcaaataacccctcctctattgcaagttttctgagttctattacctactcgtggtacgacagcatcatcctgaagggatacaaacggcctctgacactggaggatgtgtgggaagtagatgaggaaatgaaaaccaaaactctggtgtccaaatttgaaacccatatgaagcgcgagctgcagaaggcccgtagagcccttcaaagaaggcaagagaagagctctcagcaaaatagtggtgcacgcttgccgggccttaacaagaaccagtctcaaagtcaggatgcactcgtgctggaagacgtggaaaaaaagaaaaaaaagtcaggaacaaagaaggacgtgccgaaaagctggctgatgaaagccctgttcaaaaccttttatatggtcctgctaaagtcattcctgctcaaactggtgaatgacatcttcacatttgtaagcccacaactgcttaagttgctaatctcatttgcttccgatagggacacttacctgtggatcggctacctgtgcgcgattctcctatttaccgccgccctcatccagtcgttctgtcttcagtgttattttcagctgtgcttcaaactgggggtgaaagttaggacagctatcatggcctccgtctataagaaggctctgactctgagcaacctcgcacggaaggaatacactgtcggagagaccgtgaatctgatgtctgtggacgctcagaagttgatggacgtgaccaattttatgcacatgctgtggagctccgtgctgcaaatcgtcctgagcattttctttctctggcgtgagctgggacccagtgttctcgccggcgtgggggtgatggtgctagtaattcccatcaacgccatactcagcaccaaaagcaagaccatccaggtgaaaaacatgaaaaacaaggataaaagacttaaaataatgaacgagatcctcagcggcatcaagattctaaaatactttgcttgggagccaagcttcagggaccaagttcagaaccttcgaaaaaaggagttgaagaatctgctcgccttcagccagctgcaatgtgtggtcatctttgtatttcagcttaccccagtcttggtgagcgtcgttactttctctgtgtatgtattggtggactcaaacaatattcttgacgctcagaaggcctttacatccatcaccctgtttaacatccttcgatttcctctaagcatgctgcccatgatgatctccagcatgttgcaggccagtgtatctactgagaggctggagaaatacttgggaggggatgacctggatacatccgctataagacatgattgcaattttgacaaggccatgcagttctcggaagcttcgtttacatgggagcacgactcagaggcgacggtgagggacgtgaatttggacatcatggccgggcagctcgtggctgttattggccccgttggctccggaaagagctctctgattagtgctatgcttggcgagatggagaatgtacatggccacatcacgataaagggcacaaccgcttatgtgccgcaacagtcctggattcagaacgggacgataaaagacaatatactgttcggaacagagttcaacgagaaacgatatcaacaggtcctggaggcatgtgccctgctgcccgacttggaaatgctcccaggcggcgacctggccgagattggggagaagggaataaacttaagtggaggccaaaaacagcgcatatctttggccagagctacttatcaaaacttagatatttatctgctggacgatcctctgagtgccgtagatgcacacgtcgggaagcacatcttcaacaaagtactcggccccaatgggctcctcaagggtaagacgaggctactcgtgacacattcaatgcactttctgccccaggtggatgagattgtcgtcttgggtaacggtaccatcgtcgagaagggctcttattctgctttattagctaagaagggagagtttgctaagaatcttaaaacgttcctaagacacactggacccgaagaagaagctaccgtgcatgacggcagtgaggaagaggatgacgactatggacttatatcaagcgtggaagagatccctgaggacgctgccagcattacaatgcgcagggaaaactcctttaggcgtaccctttcacggagctcccggagcaatggacggcacctgaagagtttaagaaatagcttaaagacaagaaacgtcaattccctgaaagaagacgaggagttggtgaaaggccagaaattgattaaaaaagaatttatagaaacaggtaaggtgaagttttctatctacctagagtaccttcaggcaatcggactgttttccattttttttatcatcctggcttttgtgatgaatagtgtagctttcatcggatctaatttgtggctaagtgcttggaccagcgattccaagatcttcaattccaccgactatcccgcctcccagagagatatgagagttggagtctatggcgctttagggctagcccagggaatattcgtgtttattgctcacttttggtccgctttcggctttgttcacgctagtaatatcttgcataaacaacttttaaataatatccttcgagctcctatgcggtttttcgacaccacacctaccggacgtatcgtaaaccgatttgcaggagatatctctacagtggatgacacgttgccacaatcgctccgcagctggattacgtgtttcctggggatcattagtaccctcgtgatgatctgtatggccactcccgtttttacgattattgtgatccccctcggaattatttatgtctcagtgcagatgttctacgtgtctacctcccggcagctcaggcgccttgatagtgttacacgatcacccatatattctcatttcagcgaaacagtgtctggcctaccagtgatacgggcttttgaacaccagcagcggttcctgaagcacaacgaagtgcgcatcgacacaaaccagaagtgcgttttttcttggattaccagcaataggtggctggccatccgactggaactggtgggcaaccttaccgtcttttttagcgccctgatgatggtgatctaccgggacacgctctcgggcgacaccgtggggtttgtcctgagcaacgctctcaacataactcagacactcaactggctggtacggatgactagcgagatcgagacaaatatcgtggccgttgaacgaatcaccgagtacaccaaagttgaaaatgaagccccgtgggtgaccgacaaacggccacctcccgactggccatcaaaaggtaagatacagttcaacaactaccaggtccggtatcgcccagagttggacctcgtgcttcgaggcatcacttgtgacattggctcgatggagaaaatcggagttgtggggaggacaggagctggaaagagctcactgaccaactgcctatttcgaatcctcgaggctgcaggcggacagataatcatcgacggagtggatatagccagtatcggattgcacgacttgcgcgaaaagttaactatcattccacaggaccccatattattctccggctccctgcgcatgaacctggatcctttcaataattactcagacgaggaaatatggaaagccctcgaactggctcatctcaagtcctttgtagctagcctccagttggggctgagtcatgaggtcaccgaggcgggtggcaacctgtccataggacaacgacaactgctgtgtctcggacgcgccctgctacgcaagagtaagattctcgtgttggacgaggccaccgctgcagtagatctggagacagacaatctgatacaaacgacgatacagaatgaatttgcccattgcaccgtgataactattgcacatcgcctgcataccattatggactctgacaaggtgatggtgttggacaacggcaagattattgagtgtgggtccccagaagagctcctgcagattcccggccctttctacttcatggctaaggaagctggtatcgagaatgtgaactctactaaattttag

SEQ ID NO: 180012 - DNA, 4584 bp, Artificial Sequence
  Description of Artificial Sequence: Synthetic coding sequence
atggacgccctgtgcggcagcggcgagctgggcagcaagttctgggattcaaacctcagtgtgcacaccgagaatcctgaccttactccttgttttcagaacagcctgctggcctgggtcccctgcatctacctgtgggtggctctgccctgctatttgctctatctccggcaccactgtcgtgggtacattatattgtcccatttgagcaagctgaaaatggtcctgggggttctcttgtggtgtgtctcctgggccgacttgttttatagcttccatggtctggtccatggccgggccccagccccggtgttcttcgtcaccccactagtggtgggcgtgaccatgttgctagctactttactgatccagtatgaacggctgcagggcgtccaatcaagcggcgtcctcattatcttctggttcctgtgcgttgtgtgtgctattgtccccttccggtcaaaaattctgctcgctaaggcggagggggaaataagtgaccctttcaggttcacaactttttacattcacttcgccctggtgctcagtgccctgattttggcctgtttcagggagaagccaccgttcttctctgccaaaaatgtggatcctaatccttacccggagactagcgcggggtttttgtccaggctttttttctggtggtttacaaagatggctatctatggatatcgtcaccctctagaggaaaaagatctgtggtcactgaaggaagaagacagatctcagatggtggtgcagcagttgctggaggcctggcggaaacaagaaaagcagacagcacggcacaaggcatcagctgccccaggcaagaacgctagtggcgaggatgaagtgctcctcggggctcgccctagacccaggaaaccgtcatttctgaaggccttactcgcaaccttcggctcctcattcctcataagcgcatgcttcaagttgatccaggacctgctgtcgttcataaacccacaactgctgtcgattctgattcggtttatttctaaccctatggccccatcttggtggggattcctggtcgctggactgatgtttttatgctcaatgatgcaatcgctcatattgcagcactattatcattatatttttgtaacgggggtgaaattcagaactggtatcatgggcgtgatttacagaaaggcattggtaatcactaattctgtgaagagagcaagcactgtgggcgaaatagtgaacctcatgagcgtcgatgcacagaggttcatggacctcgcgccctttctaaacctgctgtggagtgcgccgcttcagattattcttgccatctacttcctgtggcagaatttgggcccttctgtgctggctggggtggccttcatggttctccttatcccccttaacggcgccgttgccgtgaagatgagagcttttcaggtgaagcagatgaagctcaaggattctcgtattaagctcatgtctgagatcctcaacgggataaaggtcctaaagctttacgcttgggagccctctttcctcaagcaggttgagggtatccgccagggtgagctccagctgctaaggacagccgcctatttacatacgaccacgacgtttacctggatgtgtagcccattcttggtgaccctcatcacgctgtgggtctacgtgtatgttgaccctaacaatgtgctggatgctgagaaggcctttgtcagtgtgagtctctttaacatcctaagactacccctgaatatgctcccccagctgatttctaatctgactcaggcttctgtgtccctcaaaagaattcagcagttcttgtctcaggaagagctagaccctcaatcagtagagagaaaaactatctctccggggtacgcaataaccattcacagcgggaccttcacctgggcccaagatctgccacccaccctccatagcctcgatatccaagtacccaaaggtgcattggtggcagttgtcggtcctgtgggctgtgggaaatcttcgctggtgagcgctctattgggagaaatggaaaaactcgaaggcaaagttcacatgaaaggttctgtcgcttatgtgccacaacaggcctggatccagaattgtaccttacaggagaatgtgttgttcggaaaagcactcaacccaaagaggtaccaacaaacactcgaagcgtgcgccctactcgccgaccttgagatgctgcctgggggtgatcaaaccgagataggggagaaaggaattaatcttagtggcgggcagagacaaagagtcagcctggctagagccgtgtatagcgatgcggatatcttcttgctcgatgaccccctgtccgccgtcgattcccacgtcgcgaagcacattttcgaccatgtgattggtcctgagggagtgcttgccggtaagaccagagtcttggttacccatggcataagcttcctgccccagaccgattttattatcgtcctggcagatggccaagtttcagagatgggcccatacccagccttgctgcagcggaacggttcctttgccaacttcctttgcaattacgcccctgatgaggaccaaggtcatctggaggattcctggaccgccctggaaggagccgaagacaaggaggcgttactaattgaggataccctgtcgaatcacaccgatttgaccgataatgaccccgtgacgtatgttgtacagaagcagtttatgagacagctgtctgccctgagttcagatggggaaggccaggggagacctgtgcctcggcgccacctgggaccctcggaaaaggtacaggtgaccgaagcaaaagccgacggggctctgacccaggaggaaaaagccgccattgggacagtagagctgagcgttttctgggattacgcgaaggccgtgggcctatgcaccacactggccatctgtctgctctacgtcggtcagtcggctgccgctattggagcgaatgtctggctgtctgcctggactaatgatgccatggcggattctagacagaacaacacatctcttcgactcggtgtgtatgcagctctcgggattctgcaaggcttcctggtgatgttagccgccatggcaatggcggctggtgggattcaggcggctcgggtcctgcaccaggcgttactgcacaacaaaatcaggagccctcagtcattttttgatactactccaagtggtaggatcctgaactgcttctccaaagacatctacgtggtggatgaagttcttgcacccgtgatcttaatgcttctgaactcgttctttaacgccattagtaccctggtggtgatcatggcatccactcctctctttactgtggtgatccttcccctggccgtgttatatacactggtacagagattttacgccgccacttccaggcagttaaagaggctggaatctgtctcacgaagccctatttactcccacttctcagaaacagtgactggagcctccgtgatccgtgcgtacaatagaagtagagatttcgagattatctccgacaccaaggtagatgccaaccagcgtagctgctatccctatattattagcaaccgctggctctccatcggcgtggagtttgtcgggaattgtgttgtactatttgcagcactgttcgcagtgattgggagatcctccctgaatcccggattggtcggcctttccgtatcctattctctccaggtcacattcgctctgaattggatgatccggatgatgtcagatcttgagtctaacattgtggctgttgagagggtaaaggaatactctaagactgagacggaggctccatgggtggtggagggctctagaccccctgagggatggccaccaagaggagaggtagaattcagaaactacagtgtacggtatcgaccaggcctggacctcgtcctgagggatttaagtctgcacgtgcatggtggcgagaaagttggcattgtgggcagaacaggagcaggaaagtcctccatgactctgtgcctttttagaattctggaagctgctaagggagagatcagaatcgatgggttgaacgtggccgacatcggcctccatgatctgagaagtcagctgacaataattccacaggacccaattctgttttccggcactctgcgaatgaatctcgaccccttcggctcctactcagaggaggatatttggtgggccctggaactttcacacctccacactttcgtgtctagccaaccagccggcctggacttccagtgttctgaaggtggggaaaatttaagtgtcggccagcggcaactcgtgtgcttggctagggccctgctgcgcaagtccaggatcctggtcttagacgaggccactgccgcaattgatctagaaactgacaacctgatccaggcaactatacgcacccaattcgacacgtgtactgtactgacaatcgctcaccggttgaacaccatcatggactatacccgtgttttggtactggacaagggcgtagttgccgagttcgactccccagccaatttgatcgcggccagaggcattttttatgggatggcccgggacgcagggctcgcctag

SEQ ID NO: 180013 - DNA, 1719 bp, Artificial Sequence
  Description of Artificial Sequence: Synthetic coding sequence
atggacgccctgtgcggcagcggcgagctgggcagcaagttctgggactctaacctgtcagtccacacagagaatcccgacttgacgccttgttttcagaatagcctgctagcatgggtgccatgcatttatctctgggtggcacttccatgctatctgctttacctcagacatcattgcagagggtacatcatactttctcacctctcaaagttgaaaatggtgcttggagtactcctctggtgcgtctcttgggccgatctgttctacagtttccacgggctggtgcatggtcgggcccctgcccccgtcttctttgtgacaccactggtggtaggagtgaccatgctgctggctactctgctcatccaatatgagagactgcagggtgtccagtcctccggtgtgttgatcattttttggtttctctgtgtcgtctgcgccatcgtgccatttcgatccaagatcttgctggccaaggccgaaggcgagatttctgatccctttaggtttacgaccttctacatccactttgcccttgttctttcggcactaattctggcctgcttcagggaaaagccaccttttttttctgcaaagaacgtggaccctaacccctatcccgaaacttcagccggatttctgtctcgcctgtttttctggtggtttactaagatggcgatctatggctatcggcatcccctggaagaaaaagacctttggtccttgaaggaagaagataggagccagatggtggtccaacaactcctcgaagcttggaggaagcaggaaaagcagactgcacgacataaggcgtctgcggcgcccggtaagaatgcaagcggcgaagacgaagtcttactgggcgcaaggcctcgccctagaaaaccatcattcctaaaggccctcttagctacttttggctctagttttctcatatcagcatgttttaagctgattcaggatctgctgtctttcattaatcctcaattgctctccattctgattaggttcatttccaaccctatggcaccttcatggtgggggttcctggtggctggattaatgttcctgtgctctatgatgcagagcctgattttgcagcactactatcactatatcttcgttacaggcgttaaattccggacagggatcatgggggtgatttaccgaaaggccctagtcatcactaattcagtcaaaagggcaagcaccgtgggggagatcgtcaacctcatgtcagtggacgcccagaggttcatggacctggcccccttccttaacttactttggagtgcgcctttgcaaatcatcttggccatttactttctgtggcagaacctcgggccatctgtcctggcaggcgtcgcctttatggtgctccttattcctctgaacggcgctgtggcagtgaaaatgcgtgctttccaagtcaaacaaatgaagctgaaggactcacggataaagctcatgtctgagatacttaatggaatcaaggtgctcaagctttatgcttgggaacccagttttcttaaacaggttgaaggtatcaggcagggcgagttgcaactgctcaggaccgccgcctacctgcataccacaaccaccttcacttggatgtgcagcccgttcctggtacgcctgggcactggtttaggaccttgcctgcaaggatctggatgtccaggaatggccagagctcattggactctgccttag

SEQ ID NO: 180014 - DNA, 3717 bp, Artificial Sequence
  Description of Artificial Sequence: Synthetic coding sequence
atggacgccctgtgcggcagcggcgagctgggcagcaagttctgggactctaatttgtctgtccatacagaaaatcccgatctcacaccgtgctttcagaacagccttctcgcctgggtgccctgtatttatctctgggtggcactgccatgctacctgctgtatctgcgacatcattgccggggatacataatcctgtctcacttatctaaactcaagatggtactaggggttttgctgtggtgcgttagttgggccgatctgttctattcctttcacggacttgtgcacgggcgggcgccagcccctgtgttcttcgtgaccccactcgtggtgggggttaccatgctcctcgccactctgcttatccaatatgaacgtttgcaaggagttcagagctctggcgtgctcattattttctggttcttatgcgtagtttgcgccatagtccctttcaggagtaaaattttattggcgaaggctgaaggggagatctcagatccatttagatttacaacattttacattcacttcgcgctcgtcctgtcggcactgatcctcgcctgttttcgagagaagccccccttcttttcagccaagaatgtagatcccaacccgtacccggagacatctgcaggcttcttgtcgcggctgttcttctggtggttcacaaagatggcaatttacgggtaccgccacccacttgaggagaaagacttgtggagcctgaaggaggaggaccggagccagatggtagtccagcaactcttggaagcgtggaggaaacaggaaaagcagacggccaggcataaggcgtccgcagccccagggaaaaatgctagcggagaagatgaggtacttctgggcgcacggcctaggcctcgcaaacccagttttctaaaagccctgctcgccacgttcggttcctcgttcctgatatccgcttgctttaagctcatccaagacctactgagcttcatcaacccacagctgttatcgatcctcattcgcttcataagcaaccccatggccccttcgtggtggggatttctcgtggccggattgatgtttctgtgctcaatgatgcagtccctgattttgcaacactactatcactatatcttcgtcaccggagtcaagtttcgcaccggcattatgggggtgatctatcgcaaggccttggttattaccaatagcgtcaagcgggccagcacagtgggcgagattgtgaatctgatgagcgtcgacgctcagcggtttatggacctggctccctttctgaacttgttatggtccgcccctctgcagattatactggctatctatttcctgtggcagaatctgggccccagcgtgttggcaggagtcgcgttcatggtgttgctaattcccctgaatggtgctgtggccgttaaaatgcgggcctttcaggttaagcaaatgaaactgaaagactcacggataaaattgatgtccgagatcctaaacggaatcaaggtgctgaagttatacgcttgggagccttcattcctcaagcaagtcgagggtatcaggcagggagaactgcagttactcaggactgccgcctacctccacacaactacgacatttacatggatgtgttcccctttcctcgtcacgctgatcacgctgtgggtatacgtatacgtggaccctaacaacgtgctggacgctgagaaggctttcgtgtctgtctccctgtttaacatattaaggctgccccttaacatgctcccccagctgattagcaacctgacacaggcctctgtgagtttgaaacgaattcagcagttcttatcacaggaagaattggacccacagtctgtcgaacggaaaaccatctccccgggctatgctataacaatccacagtggtacatttacgtgggctcaggacctgcctccaacattacacagcctagacatccaggtgccaaagggggcactggtcgccgtcgttgggccagtaggctgcgggaagagctctctcgtcagtgccttgttaggggaaatggaaaagctggagggcaaagtccacatgaaagggagtgtggcatatgtgccacagcaagcgtggatccaaaactgtacactgcaggagaacgtactgttcggcaaagctctgaaccctaagcggtaccagcagacgctggaggcatgcgccttgctcgccgacctggagatgttgcctggcggcgaccagacggaaatcggcgagaagggcataaacttgagcggtggccagcggcaacgagtatccttggcccgcgcagtgtactctgatgccgatatctttctcctcgatgatccactgtctgccgttgactctcatgtggccaagcacatattcgaccatgtgataggcccagagggcgtgcttgccgggaagactagagtgctcgtgacacatggcatctcattcctgcctcaaaccgacttcatcattgttctggccgatgggcaagtctcagaaatggggccatatcccgcgctgttacagcgtaatggctctttcgctaattttctgtgcaactacgctccggatgaagaccagggccatttggaggactcatggactgccttggagggagccgaagataaggaagccctgcttatcgaagacacgttgagcaaccatacagaccttacggacaatgatcccgtcacctatgttgtgcaaaaacagtttatgcggcagctgagtgctctgagttcggacggtgagggtcagggcagaccagttccaagaaggcaccttggaccatcggagaaggtgcaagtgactgaggctaaagctgacggcgccctaacccaagaagagaaggccgccatcggaactgtagagctgagcgtgttctgggactatgccaaagccgttggcctgtgcactactcttgcgatctgtctactgtatgtaggccaatcggcagccgctatcggtgctaatgtgtggctcagcgcatggacaaacgatgcaatggccgattcaaggcaaaacaatacatctctccggctgggcgtttatgccgccttgggcattcttcagggttttttagtaatgctggcagccatggcaatggctgccggcggaatacaggctgcacgcgtgttgcatcaggcactgttgcataacaagatccgcagcccgcagtcctttttcgacacaaccccttctggcaggatcctcaactgcttttcgaaggacatctacgtggtcgacgaggttctcgccccagtgattttaatgctcttgaactccttttttaacgccatcagcactctagtcgtgattatggcctccacaccactatttactgttgtcattctgcccctggcagttctctacactctcgtgcagcgattttacgcagctaccagccgacagctgaaacgcttggaatctgtcagcagaagccccatctactctcacttctcagagactgtgacaggcgcctccgtgatccgcgcttataatcgatctcgcgattttgaaattatctctgatactaaggtggacgccaatcagcggtcttgctacccgtatatcattagcaaccgctccgaggcagcgtctctcgcgccctgctcctcgcgcaatagccagcaagctctttggtgtagcgggtctttaagcctgctaagcccaaagcagaagacgggccctgcgctccccctgccacattttctcctcatatag

SEQ ID NO: 180015 - DNA, 3978 bp, Artificial Sequence
  Description of Artificial Sequence: Synthetic coding sequence
atgctgcccgtgtaccaggaggtgaagcccaaccccctgcaggacgccaatctgtgttctcgggtcttcttttggtggttgaaccctctgtttaaaatcggacacaagagaagattagaggaagatgacatgtatagtgtgcttcctgaagataggagccagcatttgggagaggaactacagggcttctgggataaggaggtgctccgtgctgagaatgacgcacagaagcccagcttaactagggccatcatcaagtgctactggaagtcttacctcgtcctgggcatctttaccctgattgaagagtccgcaaaagttatccaacccatcttcctaggaaagattattaattactttgagaactacgatcccatggattcagtggctctgaacacagcatacgcctacgccacagtgctgactttttgcaccttaatcctagccatcttacaccacctgtatttctatcatgtgcaatgcgcaggcatgaggttgagagtcgctatgtgccacatgatatataggaaagccctcagattgtccaacatggctatggggaaaactacaacggggcaaatcgtgaacctattgagtaacgatgtgaataaatttgatcaggtgaccgtgtttctccattttctatgggcaggccctctgcaggcgattgccgtcacagccctcttgtggatggagatcggcattagttgcctagcggggatggcggtcctcattatcttgcttcctttgcagtcctgctttggaaagctgttctcctcactgagatcgaaaaccgcgaccttcactgacgcacgcattcggacgatgaatgaggtcatcaccgggatcaggatcatcaagatgtatgcctgggaaaaaagctttagtaacctgatcacaaacctaaggaaaaaggagatttcgaagattctgagatcttcatgtctgagaggtatgaatctggcatctttcttttctgccagtaaaatcatagttttcgtgacatttaccacgtacgtccttttaggctccgtgatcaccgcatcccgggtgttcgtggccgtgactttgtatggcgccgtgagattgacagtgactttgttcttcccatctgcaatcgagcgcgtttccgaggcaattgtcagcatccgcaggatccagacattcctcctactagacgagatctcacagaggaatagacagcttcctagcgatggcaaaaagatggtgcatgtgcaggacttcaccgctttctgggacaaagctagtgagactcccactctgcagggcttatctttcacagtacggcccggagaactccttgccgtcgttggcccggttggagcgggcaagagttccctgctgtctgccgttctgggcgagctagctccttcccacggcctggttagcgtgcatggcaggattgcttacgttagccagcagccctgggtgttttccgggaccctgagatcaaacattctcttcgggaagaagtacgagaaagaaaggtacgaaaaggttatcaaagcttgcgcgcttaagaaagatctgcagttgcttgaagatggagatctgacagtcataggcgaccggggaaccaccctcagcggggggcagaaggctagagtgaacctggcacgcgcagtttatcaggatgcagacatttacctcttggacgatcccctgtcagccgtggatgctgaggtatcacggcacctgtttgagctgtgtatctgtcagattctacacgaaaaaataacaattttagtgactcaccagctgcagtatttgaaagcggccagtcagattctaatcctgaaagacggcaaaatggttcaaaagggcacttatacggagtttcttaaatctggtatcgactttggttcccttcttaaaaaggacaacgaggagtctgaacagcctcctgtccccggaactccgacacttagaaacaggactttttctgagtccagcgtgtggagccagcagagcagtcggccttctctgaaggatggggcattagagagtcaagacaccgaaaatgtccccgtaaccttatctgaggagaatcggagtgagggcaaggtgggcttccaagcctacaaaaattactttagggcaggggcccattggattgtgttcatctttttaattttgttaaatactgccgcccaggtggcttacgtgctccaggactggtggctgtcatattgggcaaacaagcagagcatgcttaatgtcacagtcaacggaggggggaatgtgactgaaaagctggatctcaactggtacctcgggatatatagcggccttactgtagcgactgtgctgttcgggattgcgcgttctctgctggtcttctatgtcctggttaacagctctcaaacacttcacaataaaatgtttgaaagcatactgaaggccccagtgttattcttcgatcggaacccaatcggcaggatcctcaatcgttttagcaaagacataggccaccttgatgacctactgcctcttactttcctggatttcatccaaacactcctgcaggtggtaggggttgtctcagtggccgtggccgtcatcccatggatcgccatcccactggtacccctgggcattatctttattttcctccgccgctatttcctggagacaagcagagatgtgaaacgactggagagcacgacccgctcacccgtgttttctcatctgtcgtcctcactgcagggcctttggaccatcagggcatacaaggccgaggagagatgtcaggagctcttcgacgcacaccaagacctccactccgaagcatggttcttgttcctcaccacatcgcgctggtttgccgttcgattagatgccatctgcgccatgttcgttatcatcgtggcatttggcagcctaatactggccaaaaccctagacgcgggtcaggttgggttggccctctcctatgctctgacactgatgggcatgttccagtggtgtgtgcggcagtccgctgaagtggaaaatatgatgatctcagtcgaacgagtgattgaatatactgacctcgaaaaagaagccccatgggaatatcagaaaagaccacccccggcctggccacacgaaggggtgatcatcttcgataatgtcaatttcatgtatagccctggagggccattggtgttgaagcatctaaccgccttgatcaaatcacaggaaaaggtgggtatcgtgggccgaactggtgccggtaagagctccctgatcagcgccttgttccgtctgagcgaacctgagggcaaaatctggatcgataagatactgaccacagaaattggactgcacgatctgcgtaaaaagatgtcgattatcccccaggagcctgtcctctttacagggaccatgagaaagaatcttgaccctttcaatgaacacacagacgaggaactctggaacgcccttcaagaagtgcagcttaaggagactattgaagatctgcctggaaagatggatactgagctcgccgagagcggctctaatttttctgtcggccagcgacagctggtttgtttagctagagccatattgcgcaagaaccagatcctgattatcgacgaagccacagctaatgtggatccacggaccgatgagctgatccagaagaaaatccgggagaagttcgctcactgcaccgtgttgaccattgcacaccgcctgaacactatcatcgatagcgataaaattatggttctggatagtggtagacttaaggagtacgacgagccttatgttttactgcagaacaaagaatcgttgttctataaaatggtgcagcagctgggcaaagcagaggcagctgccctcactgagaccgccaagcaagtgtattttaagcgcaattacccgcacattggccacaccgatcatatggtgacaaacacctcgaacggacaaccaagcaccctgactatttttgagacagccttatag

SEQ ID NO: 180016 - DNA, 3837 bp, Artificial Sequence
  Description of Artificial Sequence: Synthetic coding sequence
atgctgcccgtgtaccaggaggtgaagcccaaccccctgcaggacgccaacctatgcagcagggtgtttttctggtggctgaatcctctttttaagatcggccacaagaggcgcctggaagaagatgacatgtacagcgtgctgcctgaggaccgaagtcaacatttgggcgaagagctccaggggttctgggacaaggaggtgttacgagctgaaaacgacgcccagaagccctccctgactagggctatcattaagtgctactggaagtcgtatctcgtactgggcattttcaccctgattgaagagtctgccaaagtcatccagccaattttcctgggcaaaattattaactattttgagaactacgacccaatggatagcgtcgccctgaacacggcttatgcctatgctacagtactcacattttgcactcttatcttggccatactccatcacttatacttttaccacgttcagtgcgccggaatgaggctccgtgtagccatgtgtcacatgatctacagaaaggccctaagattaagcaatatggccatggggaagaccacaacaggtcagatcgtgaatctgctttcaaacgatgtgaataagtttgatcaggtcacagtgttcctccacttcctgtgggctggacctctccaggcaatcgcagtcacagcgttgttatggatggagatcggtatatcttgtctcgcgggaatggctgtgctgattattctcctccctctgcaaagttgctttggaaagctattttccagcctacgcagcaaaaccgccacattcaccgatgctcggatacggacaatgaacgaagtaatcactggtattcggattatcaagatgtatgcttgggaaaagagttttagtaacttgattactaacctcagaaaaaaggagataagcaagattcttagatcctcctgtctgaggggcatgaacctagccagcttcttttcagctagcaaaattatcgtatttgtaacctttactacatatgtactcctgggttccgtcattacagcatcacgtgttttcgtggcagtcaccctctacggggctgtccgacttacagtgaccctatttttcccgtctgcaattgagcgggtgagtgaagccatcgtcagcatccggcgaatccagacgttcctccttctggatgagatttcccagcgcaatagacagttacccagtgacggtaagaagatggttcacgttcaggacttcaccgccttttgggataaggcatcagaaacaccaactttacaggggctgagcttcacggtgcgccccggggagttgctggctgtggtgggaccagtgggcgccggcaagagcagcctactttccgccgtcctcggagaattggctccgagccatgggcttgtcagtgtccacggccgcattgcatatgtttcacagcagccttgggtgttctcgggcacgctccgctcgaacattttgttcggcaagaagtatgagaaagaaagatacgagaaggtcattaaagcgtgtgccctgaaaaaggatttacagctactcgaggacggtgatctaactgttattggagatcgaggaacgaccttgtcaggggggcagaaagcacgtgtaaaccttgccagagctgtgtaccaggatgcggatatatatctgctggacgacccactgtccgccgtggacgctgaagttagtcggcatttatttgagttgtgtatatgtcagattctgcacgaaaaaattactattctggttactcaccagctgcagtacctcaaggccgccagccaaatactcatcctgaaagatggcaaaatggtccaaaaggggacatataccgaattccttaagagtggtattgactttggcagtctgcttaagaaggataatgaagagagcgaacagcccccagtgcctggaacaccaaccctgcggaacaggaccttttctgagtcatccgtctggtcccagcaatcctcaagaccctcccttaaagacggagcgctagagtcacaggatgtggcctacgtgttacaagactggtggctgtcctattgggcaaacaaacagagcatgttgaatgtgaccgttaatgggggaggtaacgtaaccgaaaaactcgatctgaattggtacctgggcatctattctggtttgactgtcgcaacagttttattcggcatcgcccggtctttactagtgttctatgtgctggtgaatagctcacagaccctgcacaataagatgttcgagtccatattaaaagctccggtgctgttctttgacagaaaccccattggtcgcattctaaatcggttctccaaagacataggtcacctggacgacctgttgccactcacctttcttgactttatccagaccctactgcaggtggtcggggtagtctcggtagcggtcgcagtcatcccatggatcgccattcccttagtgccattaggcataattttcattttcttgaggcgatactttctcgaaacaagcagagacgtaaaacgactcgagagtactacgaggtccccagtattttcacacttgagctcctcattgcaagggctgtggactatccgtgcctataaagcggaagaacgctgccaggagctgttcgatgctcaccaggacctccattcggaggcctggtttctgttcctcacgacctccaggtggttcgccgtccggctggacgccatttgcgcgatgtttgtgatcatcgttgcctttggcagtctcattctcgccaaaacgctcgatgcggggcaggttgggctcgctctatcatacgccctgaccctcatgggcatgttccagtggtgcgtgagacagagtgctgaggtggaaaacatgatgatcagcgttgagcgcgtaatcgagtacacagatttggagaaagaagctccctgggaatatcagaagcgaccccctcccgcatggccccatgagggagtcatcatctttgacaacgtcaatttcatgtattcccccgggggacccctcgtgcttaagcatcttactgcgctaatcaagtctcaagagaaagtgggaattgtcggaaggaccggcgccggaaagtcaagcctgatttccgcactctttcgtctgtccgagccggaaggtaagatctggatcgacaaaatcttgacgacagagattggactacacgatctgcgaaagaagatgagcattattccgcaggagccagttctgttcaccggaaccatgcggaaaaacctagacccattcaatgagcacactgatgaagagctgtggaatgctctgcaagaagtgcagcttaaggagaccatcgaagaccttcccggaaagatggatacagagctagccgaatccggttctaacttctcagtcgggcagcgacagctcgtgtgtctcgctagagccattttgagaaaaaaccagatcttaattattgacgaggccacagcaaacgtggatcctaggacagatgaattaatccagaagaagatccgggagaagtttgctcactgcacggttctcaccatcgcccacaggctcaacacaattatcgactccgacaagatcatggtacttgactctgggagactgaaggaatatgacgaaccctatgtgctcctgcagaacaaggagagcctgttttataaaatggtgcagcagttagggaaggctgaagccgcagcattaacggagaccgccaaacaggtgtattttaaacggaattaccctcacattggccatactgaccatatggtgacaaacacgagtaatggccagccttccacactgaccatcttcgaaacagctctgtag

SEQ ID NO: 180017 - DNA, 2580 bp, Artificial Sequence
  Description of Artificial Sequence: Synthetic coding sequence
atgctgcccgtgtaccaggaggtgaagcccaaccccctgcaggacgcaaatctgtgtagtcgcgtctttttttggtggctgaaccccctattcaaaataggtcacaaacgccgtctggaggaagatgacatgtacagtgtcctgcctgaggaccgctctcagcatcttggggaggaactccagggattctgggacaaggaagtgctgagggcagaaaacgacgcgcagaaacctagtctgacccgcgcaataattaaatgttattggaagagctatctggtgttagggatttttactttgattgaggagtccgccaaggttatccaaccaatttttctcggcaaaatcattaattacttcgagaactatgatccaatggactcagtcgctctcaacacagcctatgcatatgcaactgttttaaccttctgcaccctgatcttagctatcctacatcatctttatttctatcacgtccagtgcgcaggcatgcgactcagggtggcgatgtgccacatgatctatagaaaggcattgcgcttgtcgaatatggctatgggcaaaaccacaaccggacaaattgtgaaccttctgtccaatgatgtgaataagtttgaccaggtgaccgtttttctgcattttctgtgggccggccccctgcaggctatcgccgttacggcgctgctgtggatggagatagggatcagctgcctagccggcatggcagtactgattatcttgctccccttgcagtcctgttttggaaaactgttttccagcctacggagcaaaactgccacctttactgatgcgagaatccgcacaatgaacgaagtgatcaccggcattcgaattataaaaatgtatgcgtgggagaagtcattcagcaatctcatcactaatctaagaaaaaaggaaattagtaagatactccggtcttcttgcctgagaggtatgaaccttgcgagcttctttagtgcttcgaagatcatcgtgtttgtcacctttactacctatgtgttgctcggaagcgttatcacagcatctagagttttcgtcgccgtgaccctgtatggggcagttaggttgacagtcacactgttctttccctcagccatcgagagggtgagcgaggccatcgtctctattcggagaatacagacatttcttcttctcgatgaaatttcacaaaggaacaggcagctgccgagcgacggcaagaaaatggtccatgtgcaggactttaccgctttctgggacaaggccagcgagaccccgacacttcagggactcagtttcactgtccgccctggagaacttctagcagtggttggccctgtgggagcaggtaagagttccctgctgtctgctgtactgggagagctggctccatctcatggcctggtatccgtgcacgggagaatcgcgtacgtcagccagcagccttgggtgtttagtggtacactacgttcgaacattctcttcggcaagaagtacgaaaaggaacgctacgagaaggtgataaaggcttgtgcactcaagaaggatttgcaactcttagaagatggcgacctgactgtgattggcgatcgcggcaccaccctgtccgggggacagaaagccagagtgaacctggcgagggctgtctaccaggatgcagatatctatctcctggacgatccactatccgccgtggatgcagaagtctcacgtcacttgtttgaactctgcatttgccaaattcttcatgagaagattaccatcctggtgacgcaccagctgcagtacctgaaggcggcctcccagatcttgattctgaaggatggaaagatggtgcagaagggcacttatactgagtttctaaaaagcggtatcgacttcggcagccttctgaaaaaggacaatgaggagagtgagcagcccccggtcccaggtacacccacacttcgcaacagaacattctccgaatctagtgtttggagccagcagtctagccggccctctctgaaggacggcgcattggagtcccaggataccgagaacgtccccgtgaccttgtctgaggagaacagaagtgaaggcaaggtcggtttccaggcgtacaaaaattattttagggccggcgctcactggatagtctttatcttcctgatattgctgaatactgcagcacaagtcgcctatgttctgcaagattggtggcttagctattgggctaataagcagtcaatgttgaatgtgaccgttaacggaggagggaatgtcacagagaagcttgacttgaattggtatctgggcatatacagtggcctgactgtggcaacagtgcttttcggcatcgcacgcagcctgcttgtattttacgtcctggtaaattccagtcagaccttgcataataaaatgttcgaatctatcttgaaggcgcccgtcctgttttttgatagaaatcctattgggcgaattcttaaccgcttcagcaaggatattggccacctggatgatctgctcccattgaccttcctggactttatccagagatgggacctcgcagtgctctcctggctggtttcgaattcttag

SEQ ID NO: 180018 - DNA, 2355 bp, Artificial Sequence
  Description of Artificial Sequence: Synthetic coding sequence
atgctgcccgtgtaccaggaggtgaagcccaaccccctgcaggacgctaatctgtgctcccgggtgttcttctggtggctgaacccactgtttaaaattggccataagcggcgcctggaggaggacgacatgtatagtgttctacctgaggatagaagccagcatttaggcgaggaactgcaaggattttgggataaggaggttctgcgcgctgaaaatgacgcgcagaaaccctcactcacacgggccatcatcaagtgttattggaagtcatatctcgtccttggcatttttacacttatagaagccttgagactgagcaatatggctatgggaaagacaacgacaggacagatcgtgaatctcctctctaacgatgtcaataaatttgaccaggttacagtctttctgcacttcctttgggctgggccactccaggcaattgcagtgacagctctgttgtggatggagatcgggatatcatgcctggccggcatggccgtcctgattattctcctgcccctgcaatcatgtttcgggaaactgtttagctctctaagatcaaaaaccgcaaccttcaccgacgccagaattcggactatgaacgaagtgatcaccggtatcagaatcattaagatgtatgcatgggaaaagtccttctccaacttgatcaccaatctgaggaagaaggagatcagtaaaattctgcggtcttcttgtttgcgagggatgaatcttgccagttttttctctgcctccaagatcattgtcttcgtaacgttcacgacatacgttttgctcggaagcgtgatcacggcctcgagagttttcgtggccgtgactctgtacggcgctgtgcgccttaccgtcaccctcttctttccatccgcgatagagcgcgtgtctgaagccatcgtgagcatcagaagaatacagactttcttgctcctcgatgaaatctcccaacgcaatagacagctgccttctgatggcaagaagatggtgcacgtccaggactttactgcattttgggataaagcctccgaaacacccacactgcagggcctgagcttcaccgttcgacctggcgagcttctggccgttgtgggtcccgttggcgccgggaagagctcgctgctctcagctgtgctcggagagctggcaccaagtcatggattggtttctgtgcacggacgcattgcatacgtgtcacagcagccatgggtcttctctggtacactccgcagcaacatcctcttcggaaagaaatatgagaaggagaggtacgagaaagtcatcaaggcttgtgcgttaaagaaggatctgcaacttctcgaagacggcgatctgactgtgatcggtgacagaggcaccactttgtccgggggccagaaggcccgtgtgaacctggcaagagccgtctaccaagacgccgatatttacctcctggatgatccactatcagccgtagacgcagaagtctcaaggcacttgttcgagctgtgcatctgtcagattttgcacgagaaaattacaattctagtcactcaccagctacagtatctcaaggcagcgtcacagattctgatcctgaaggatgggaagatggtacagaaggggacttacaccgagttcctgaaaagtggcatcgatttcggatccctgctaaagaaggataatgaagagtctgagcaaccaccagtgccggggacccccacactcagaaaccgcaccttctctgagagcagcgtttggtcacagcagtcctctcgcccaagcctgaaggatggggcactggagtcacaggacactgaaaacgtgcctgtgactctgtccgaggagaacaggtcagagggtaaggtgggattccaggcctataagaattattttcgagccggggcgcactggattgtgttcatctttttaatcttgttgaatacagctgctcaggtagcctacgtgctgcaggactggtggctcagctactgggccaacaagcagtctatgcttaacgtgaccgtcaatggaggggggaacgtcaccgaaaaactcgacctaaactggtatctgggtatctattccggactgacggtcgccactgttttgtttggcattgcccggagtttgctggttttctatgtccttgtgaatagctcacagacgttgcacaacaagatgttcgaaagcatcctgaaggcgccagtccttttcttcgatcgtaaccccatcgggcgaatcctgaaccgcttctctaaagatatcgggcaccttgatgacctgctgccattaacgttcctcgattttatacagagatgggacctggccgtgctcagctggcttgtgtcaaattcatag

SEQ ID NO: 180019 - DNA, 75 bp, Artificial Sequence
  Description of Artificial Sequence: Synthetic coding sequence
atgctgcccgtgtaccaggaggtgaagcccaaccccctgcaggacgctaacttatgtagccgagtgttcttctag

SEQ ID NO: 180020 - DNA, 4185 bp, Artificial Sequence
  Description of Artificial Sequence: Synthetic coding sequence
atgaaggacatcgacatcggcaaggagtacatcatccccagccccggatacagatcagtgagagagcgtacttccaccagtggcacccaccgggaccgcgaggattcaaagtttcgccgcacaaggccgctcgaatgccaggacgctctagaaacagcagcacgcgccgaggggctatccctcgacgcatcaatgcacagccagctccgaattctggacgaggaacatcccaagggaaaataccaccacggccttagtgcccttaagcccatccgcacgacttctaaacatcagcaccccgtggacaatgctgggttgttcagttgtatgacctttagctggcttagctctctggcaagggttgcacacaagaagggcgaactgtctatggaagatgtttggtctctgtcgaagcacgagtctagtgacgtgaactgcaggcgactggaaaggctgtggcaggaggagctaaacgaagttggcccagacgccgcctctctgcgacgagtggtgtggatattttgtcgtactagacttattttgtcaatagtttgtctcatgataacgcagctggctgggttcagcggtcctgctttcatggttaagcacctgctggaatatacccaggctaccgagagcaatctgcagtactccttgttgctggtgctgggtctgctgttgacagaaattgtgcggtcgtggagcctcgccctgacctgggcccttaactatcggacgggcgtgcggcttagaggcgcgatactaaccatggccttcaagaaaattctgaaacttaaaaatataaaagagaagtcactaggtgagctaatcaatatttgtagcaatgatggccagaggatgtttgaggcagccgccgtcggctcactgctagctggggggccagtggtggctatactcggtatgatttacaacgtgattatattgggtcctactgggtttctcgggtctgccgtgttcatattgttctaccccgctatgatgttcgcctcccgactgacagcctactttaggcgtaaatgtgtagccgccactgacgaacgcgttcagaaaatgaatgaggtactgacatacatcaaattcattaaaatgtacgcctgggtgaaggcattctcacagagcgtccagaaaatccgcgaagaagaaaggcgcatcctggagaaggctggctacttccaatccattaccgtgggtgtggccccgatagtggtcgtaatcgctagcgtggtcaccttttccgtgcatatgacgctcggttttgatctcaccgccgcccaagccttcactgtggtgaccgtttttaatagcatgacatttgcgctgaaggtcaccccattctctgtgaaatctttaagcgaagcctcagttgctgtggacaggtttaagagcctattcttgatggaagaggtgcacatgatcaagaacaagcccgctagcccacatattaaaattgagatgaagaacgctactttggcctgggatagctctcactcatccattcagaacagccctaagctgacacctaagatgaagaaggataagcgcgccagcaggggcaagaaagagaaagtaagacaactccaacgcacagagcaccaggcggtgctggcggagcagaaaggccatctgctgctggattcggatgagcggcctagtcccgaggaggaggagggtaagcacattcacctcggccatctgcgcttacagcgtaccctgcactcaatcgatctggagatacaagaaggtaaactggtaggtatctgcgggtctgttggctctggcaagacctccctaatcagtgctattctggggcagatgacgctgctcgaaggttcaatcgcaattagcggaacattcgcatacgtggcacagcaggcttggattctgaacgccacattgcgcgacaatattttgttcggcaaagaatacgacgaggagcggtacaactcggtactaaattcctgctgcctccgtcccgacctggccattctgccttccagcgacctgaccgagataggggagaggggggccaatctttctggaggacagcgccagaggataagccttgctcgggcactgtatagtgatcgctctatctacatcctcgatgatcccttaagtgctctggatgcacacgtcggtaaccatattttcaacagcgccataagaaaacatttgaagtccaagacggtgcttttcgttacacatcaattacaatacctggtggactgtgacgaggtgatcttcatgaaggaggggtgtattacagaacgaggtacccacgaggaactgatgaacctgaacggcgactacgctacaatatttaataacctgctcctcggggagacacctcccgtcgaaataaattcaaaaaaagaaacctctgggagccagaagaagtcccaagacaaagggcctaagactgggagcgtgaagaaagagaaagccgtgaaaccagaagagggacaacttgttcagttagaggaaaaaggacaaggaagcgtgccatggagtgtgtatggagtctacatccaggcagcagggggcccactggccttcctggtcatcatggcccttttcatgcttaatgtgggctcgacggcattttccacgtggtggctttcatattggatcaagcagggcagtggcaatacgaccgtaacccggggaaacgaaacttccgtgagtgactctatgaaagacaacccacatatgcagtactatgccagtatttatgccctgtccatggccgttatgctgatccttaaagcaatccgtggagtggtgtttgtaaagggcacgcttagagcaagctctcgattgcacgacgaactgttccgtagaatattacgaagtcctatgaagtttttcgatactactccaacaggcagaatcctcaataggttcagcaaagatatggatgaagtggacgtgcgtctgccgttccaagcggaaatgttcatacagaatgtgatcctcgtgttcttctgcgtgggaatgatcgcaggggtattcccttggttcctggtggccgtgggaccgctagtgatcctgttttccgtgttgcacattgtgtcaagataccaggaactgctggatgataatcaggcgccattttttctgttcacctgcgccatgcgctggttggccgtgcggctcgacttgattagcatcgccctgattactacgactggcctgatgattgtgttaatgcacggccagatcccccctgcatatgcggggctggccatctcctatgcagttcagttaacaggactgtttcaatttaccgtgaggctggcctccgagacagaggctcgtttcactagcgtggaacgtatcaatcactatattaagacacttagcctggaggcacccgcaagaattaaaaataaagctccgtcccccgattggccccaggagggcgaggtcacatttgaaaatgcggaaatgagatatagggaaaatctccctctggtgctgaagaaggtgagctttaccatcaagccaaaagagaagattggaattgtgggcaggacagggagcggaaaatcatccctgggcatggccttgtttaggctggtggaactgtcgggcggatgtatcaaaatcgacggcgtgagaatctcagacattggtcttgccgatttacgatccaagctttccatcattccccaggaacccgtgttattttccggaaccgtcagaagcaatttggatcctttcaaccagtacacagaggaccaaatctgggacgctttagagcgaacacacatgaaggaatgcatcgcacaactgcccctgaaactcgaatctgaggtgatggagaacggggataatttcagcgtcggtgagaggcagttgttgtgtatcgctagggcactgcttaggcactgcaagatcctgatcttggatgaggctacagccgccatggataccgaaacagatctgctgattcaggagaccatcagagaggccttcgccgactgtactatgctgaccattgcacataggttgcacaccgtgctgggctccgaccgcatcatggtactggctcagggccaagtcgtagagttcgacaccccatccgtactgctctctaatgatagctcacggttttacgccatgttcgcagccgccgagaacaaggtggccgtcaaaggatag

SEQ ID NO: 180021 - DNA, 4314 bp, Artificial Sequence
  Description of Artificial Sequence: Synthetic coding sequence
atgaaggacatcgacatcggcaaggagtacatcatccccagccccggctacaggtccgtacgggagaggacttctacttctggaacccaccgggacagggaggacagcaaatttcgccggactaggccccttgagtgccaagacgccctcgagacggcggcccgggcagaggggcttagtcttgacgcttccatgcacagccagttgcgcattctcgatgaagagcaccctaagggtaagtaccaccatggattgagtgcgcttaaacccatccgcaccacctcaaaacaccagcatccagtggataacgccggtctcttttcatgcatgacatttagttggttgtcatctctagccagggtggcccacaagaagggcgaactgagcatggaggacgtgtggagcctcagcaaacacgagtcaagtgacgtgaattgtagacgcctcgagcggctgtggcaagaagaacttaacgaggttggccctgatgccgccagccttaggagagtggtttggattttctgcagaacgagactgatcctgagtattgtgtgtttgatgatcacgcagttagctggtttctcgggtcccgcattcatggtgaagcacctgctggaatacacccaagctactgagagcaacttacaatacagcctgttgctggtgctgggacttcttcttacagagattgttaggtcctggtcacttgccctaacatgggcattgaactacaggactggcgtccgactgcgaggagccatcctcaccatggccttcaaaaagattctcaagctcaaaaacatcaaagagaagagcctgggcgagttaattaatatctgtagcaatgatggccagcggatgttcgaggctgccgcggtaggctctttactcgcggggggaccagtggttgctatcctgggcatgatttacaacgtgatcattctgggcccaaccggctttcttggctcagccgttttcattctgttctatccagccatgatgtttgcatcacggttgactgcctatttccgccggaagtgtgtcgcagccacggacgaaagagtccaaaagatgaacgaagtgttgacatatataaagttcatcaagatgtatgcatgggtaaaagctttctcacagtcggtgcaaaagatccgagaggaggaaaggcggatcctggagaaggccggctatttccagtcaataacagttggggtggccccgatcgtggtcgtgatcgcttctgtcgtgacttttagcgtgcacatgacgctagggtttgatcttacagccgctcaggctttcacagtcgtgacagtgtttaacagcatgacctttgctctcaaagttacgcctttttccgtgaagtcattgtctgaagcgtccgttgccgtggatcggtttaaatctttgtttctcatggaggaggtgcatatgatcaagaacaaacccgcctcccctcatattaagatcgagatgaaaaatgctaccctggcctgggacagttcacatagctcaattcaaaattctccaaaactgacacccaaaatgaagaaggacaaaagggcttcccgtggaaagaaggaaaaggtccgccagctgcagaggactgaacatcaggcggtccttgccgaacaaaaaggccacctcctcctggacagcgatgaacgcccgtctcccgaggaagaagaagggaaacatatccacctaggacatttgcgcctccaacgcacccttcatagcattgatctcgaaatccaagaagggaaactggtgggtatatgcgggtctgtgggatccggaaagacgtcgctcatctccgcaattctagggcaaatgactctactggagggtagtatagcaattagcggaacttttgcttatgtggcccagcaggcttggattctgaacgccacacttagagataacattctgtttggcaaagagtatgacgaagagcggtacaactctgtgctgaactcgtgctgtctaagaccggatctcgccatcctcccctcatctgacttgacagagattggggagcgcggtgccaatctcagcggaggccagaggcaaaggatctcgcttgcccgtgcactgtattccgacaggagcatctatatccttgatgaccccctcagtgctctggacgcccatgtgggtaatcacatctttaactcggccatcagaaaacaccttaaatctaaaacagtcctctttgtgactcaccagcttcagtatttggtcgactgtgatgaggtgatcttcatgaaagagggctgcataacagagagaggaacccatgaggagctgatgaatctgaatggcgactatgctacgatcttcaacaatctgctcttaggtgagacaccgcccgtcgaaatcaacagcaagaaggagaccagcgggtcccagaaaaagtcacaggataagggacccaagaccggatctgtcaaaaaggagaaggcggtaaaacccgaagaagggcagctggtgcagctggaggagaaaggacagggcagtgtgccctggtctgtgtatggcgtgtacatccaggctgctggcggtccactcgcctttttagtaattatggctctgtttatgctgaatgtagggagtacagcatttagtacctggtggctgagttactggattaaacagggttcaggtaacactaccgtcactagaggcaacgaaacatcagtgtccgacagcatgaaggataacccgcatatgcaatattacgctagcatctatgccctgtcgatggctgtcatgctcatccttaaggctatccgaggggtggtgtttgtcaagggaaccctgagggccagttcaaggctgcacgatgaactctttaggaggattttgcgttccccaatgaaattctttgatactacacccaccggacgcattcttaaccggtttagcaaggacatggacgaagtcgacgtgcgactcccgtttcaggccgaaatgttcatccagaatgtgatcctcgtgttcttttgtgttgggatgattgcgggagtgttcccctggttcctagtggccgtgggccctctggtcatcctgtttagcgttcttcacattgtctctagggttctgattcgcgagcttaagcgcttggataatataacgcaatcaccatttttgtctcatatcacgagcagtattcagggtcttgctaccattcacgcctacaacaagggtcaggagttcttgcacaggtaccaggaactcttggacgacaaccaggcaccattcttcctgtttacttgtgccatgagatggctcgctgttaggctcgaccttatctcgattgcactcattactaccacagggctcatgatagtgctgatgcatggacagatcccacccgcgtatgccggacttgcaatttcatatgcggttcagctgaccggactgtttcagtttacagttcggctcgccagtgagactgaggccaggtttaccagcgtcgagcgaattaaccactacattaagacactgagcctggaggctccagcgcggattaagaacaaagctcccagccccgactggcctcaggagggagaagtgacctttgagaacgccgaaatgaggtaccgcgagaatttaccactagtgctcaagaaagtgtcatttactatcaaacccaaggagaaaattggaattgtcggacgaaccggatctgggaagtcaagccttgggatggccctgttcagactcgtagagctatccggcgggtgtattaagattgatggagtccgaatttccgatataggcctcgctgatcttaggtccaagctatcaatcatcccccaagagcctgtgctttttagcggtacagtgaggagcaacttagacccattcaaccagtacaccgaggatcagatttgggacgccttggagcggacccatatgaaggagtgcattgcccagctgcctctaaagctggaatcagaggtaatggaaaatggcgataacttttctgtgggtgagcgccagttgttgtgcattgctcgggccctccttaggcattgcaagatccttatcttggacgaggcgaccgctgctatggacaccgagacagacctgctaattcaggaaacgatccgggaagcgtttgctgactgcaccatgctgaccatcgcacacagattacacacagttctcggcagtgaccgcatcatggtgttggcccaaggtcaggtggtcgaattcgatacaccttccgtacttttgtccaatgacagctcccgattttatgctatgtttgccgcggccgaaaataaagtcgcagttaaagggtag

SEQ ID NO: 180022 - DNA, 627 bp, Artificial Sequence
  Description of Artificial Sequence: Synthetic coding sequence
atgaaggacatcgacatcggcaaggagtacatcatccccagccccggctacaggagcgttagagagcgaacctctacgagtggcacccatcgcgaccgcgaagattccaagtttcggcggacacggcccctcgaatgtcaggacgctctggaaaccgcagctcgggccgagggcttgagtttggacgcctcaatgcatagccagctgagaatcttagatgaggaacatcccaaaggcaaataccaccacggtttaagcgccctcaagccaatcaggacaacgtctaaacaccagcacccagttgacaacgccggcctcttctcttgtatgactttcagttggctgagctccctcgcccgtgttgcacataagaaaggtgaactgtctatggaggacgtgtggtccctatcgaaacacgaaagttcagatgtaaactgccgcaggctggagcggctctggcaggaagagcttaatgaggtcgggcccgacgccgccagcttaaggagagtcgtttggattttttgcaggacaaggcttattttatcaattgtgtgtcttatgataactcagctggcaggattctccggccctaatttccaagacggatgtatcctccgctccgagtag

SEQ ID NO: 180023 - DNA, 2511 bp, Artificial Sequence
  Description of Artificial Sequence: Synthetic coding sequence
atgcacagccagctgcggatcctggacgaggagcaccccaagggcaaatatcatcacggcctgtctgccctaaagcccattcgcaccacaagcaagcatcaacatccggttgacaacgctggactgttcagctgcatgacattttcttggctcagtagccttgcccgggtggcccataagaaaggggagctcagcatggaggacgtctggagtctttccaagcacgagagttccgacgtgaactgtcgacgcttggagagactgtggcaggaggaactgaatgaagttggaccggacgcggcatcgctgaggcgggtcgtgtggatcttttgcagaacacgactcatactgagtatcgtgtgtctaatgatcactcagctggctggatttagcggacccgcgttcatggtgaagcatctcctggagtatacccaggccactgaaagcaatctgcagtactctcttcttcttgtgctaggtctgttgctgactgaaattgtgaggtcctggtcccttgcactgacctgggcgctgaactaccgtactggggtgcgactaagaggcgctatcttaacaatggcatttaagaaaatacttaagcttaaaaatattaaggagaagagcctgggtgagctcattaatatatgttccaatgacggccagaggatgttcgaggctgcggccgttggctctctcctggccggaggaccagtggtggcaatcctgggaatgatctataatgttataatcctcggtcccactggatttctgggatcagccgttttcattctgttctaccctgccatgatgtttgcatctagactcaccgcttacttccggcggaaatgcgttgcagcaacagatgagcgggtgcaaaagatgaatgaggtcctcacatacattaagttcattaagatgtacgcttgggtgaaggccttctctcagtctgtgcagaagattagggaggaagagcgtagaattctggaaaaggccggctactttcagtcaattacagtaggggtggccccaatcgtggtcgttatcgcgtccgtggttaccttttctgtccacatgacattgggattcgacctcactgcagcacaggctttcactgtcgtcactgtcttcaactctatgacattcgcgctcaaggtgactccattctcagtcaagtcattgtcagaggcatcggtggctgttgataggttcaaatctttgtttctgatggaagaggttcacatgatcaagaacaagcctgcttccccacacattaagattgaaatgaagaatgctactctcgcttgggacagctcacactctagtatccaaaattcacccaaacttactcctaaaatgaagaaagacaagcgtgcgtccagaggcaagaaagaaaaggtgcggcagctgcaacgaactgagcaccaggccgtgctggccgaacagaaaggacatctgctgctggacagcgacgaacggccttcacccgaagaagaggagggcaaacatatacatctgggtcacctccggttacagcggacactgcacagcatcgatctcgagattcaggagggaaagcttgtgggaatttgtggaagtgtggggagcggaaaaacttccttgatttctgccatcttggggcagatgacgctccttgagggcagcatcgcgatcagtggcaccttcgcctacgtcgcccaacaggcctggatactgaatgcgactttacgtgataacatcctgtttggcaaggaatatgatgaagaacggtataatagcgtgctcaatagttgttgcttgaggcctgacctcgctatcctgccttcctcggacctgacagagatcggagagcggggcgcaaacctgtcaggtggtcagagacagcgcatctcgctggccagggcactgtatagtgatcgttcaatttacattttggacgatccactgtcggccttagacgctcatgttggaaaccatatcttcaacagcgccataaggaagcatctgaaatccaagactgtgttattcgtcacccaccagctacagtacctggtagactgtgacgaagtcatttttatgaaagaaggctgcatcacagagcgaggaactcatgaggagctgatgaatctcaatggtgactatgcgacaatcttcaataacctgctgttgggagagactcctccggtcgagattaattccaaaaaagagacatctgggtctcaaaaaaagagtcaagataagggaccaaagactggaagtgtgaagaaagagaaggccgtcaagccggaggaggggcagctggtccagctggaagagaaagggcagggatctgtgccttggagtgtgtatggccaccccggctgctggggcccgttgggcattccaggttattacggtccctttcatgccgagtgtaggcagcaccggctccagcatctagtcgtcgagctcctggatcaagccaggaaacgcgaacaccactgcgattctcgggagcgggacctcggggaatag

SEQ ID NO: 180024 - DNA, 678 bp, Artificial Sequence
  Description of Artificial Sequence: Synthetic coding sequence
atgaaggacatcgacatcggcaaggagtacatcatccccagccccggatataggtctgtgcgcgagcgaacatcgacgtccggaacacacagagatagggaagattccaagtttagacggacaagaccactcgagtgtcaggatgctttggagacagccgctcgggctgaaggcctgagcctggacgcgtctatgcatagccagctgaggatcctggacgaggaacatcccaagggcaaatatcatcatgggttgtctgccttgaagcccattaggaccacatcaaagcaccagcacccagttgacaacgccggtctcttcagctgcatgaccttcagctggcttagctctctggcccgggtagctcataaaaaaggagaactgtcaatggaggacgtttggagtctgagcaaacacgaaagcagcgatgtcaactgtagacggttggaacgattgtggcaagaagagcttaatgaggtgggacctgacgccgcatctctgaggcgcgtcgtctggattttctgtagaacccgactgattttatctatcgtctgcctgatgataacacagctcgccgggttctccggtcctccatcattcggtgactgctccattagcgccgaagtatgcggcaaccggttgcattgtacagctatccttctctcttgtttcacctag

SEQ ID NO: 180025 - DNA, 696 bp, Artificial Sequence
  Description of Artificial Sequence: Synthetic coding sequence
atgaaggacatcgacatcggcaaggagtacatcatccccagccccgggtatcgcagcgtgcgcgaacgaacttcaactagcggcacacaccgtgaccgggaggacagcaagtttcgtagaactcggccactcgaatgccaggacgctctggaaacagccgcccgtgccgagggactttccctggacgcgtctatgcattcccaactgcgaattctcgatgaggagcatcctaagggaaagtaccaccacggcctgagcgccttaaagcctatccggaccacctccaaacaccagcaccccgtcgacaatgcgggattgttttcttgtatgacttttagttggctgagctctctggcaagagtggcacacaagaagggtgaactctctatggaagatgtctggtctctctcaaaacatgagagtagtgacgtcaattgtcgccgcttggagagattgtggcaggaggagctgaatgaagtggggcccgacgccgcctcactgcgcagagtggtgtggattttctgccgaacaagactgatactgagtatagtgtgcttgatgattacccagctcgcaggtttttcaggcccagtcagtagtaaccacccgttccgacagtcgccgggagcccgcccacgaccggcacttacccttctgttttgttgcagagggtgcgcccagctgtgggctagatag

SEQ ID NO: 180026 - DNA, 444 bp, Artificial Sequence
  Description of Artificial Sequence: Synthetic coding sequence
atgaaggacatcgacatcggcaaggagtacatcatccccagccccggttaccgcagtgttagggagcgcacttccacctctggcacccatcgcgaccgagaagacagtaaatttagacgtacgcggccactggagtgccaagatgccctcgagactgccgccagggcggaggggttgagcctcgatgcctcaatgcatagtcagctccgtattttggacgaggagcatcccaaaggaaagtaccaccacggacttagcgctctgaagcccattcggaccacctccaagcaccagcacccggtggataacgccggtttgttcagttgcatgacctttagttggctcagttctttagcacgcgtggctcataaaaaaggagagttgtctatggaggatgtctggtctttgagcaaacatgaatccagcgatgtcaactgtaggtag

SEQ ID NO: 180027 - DNA, 639 bp, Artificial Sequence
  Description of Artificial Sequence: Synthetic coding sequence
atgaaggacatcgacatcggcaaggagtacatcatccccagccccgggtacagaagcgttcgagagcggacctccactagcggtacacatcgagatcgcgaagacagtaaatttcgccgcacacgtcctctcgaatgtcaagacgctctcgagacagccgctcgtgccgaaggcctgtcactggacgcgagcatgcattcccagctaaggattctggatgaagaacaccccaagggtaagtaccatcacgggttgtctgcactgaaacccattagaacaacatcaaaacaccagcatccggtggataatgcagggctgttttcatgcatgacattttcatggctctcttctctcgcacgcgtggcgcacaaaaagggcgagttgtctatggaggatgtgtggtccctcagcaaacatgaatcttctgacgtcaattgtcgtcgcctggaaaggttatggcaggaagaactgaacgaggttggccccgacgctgcaagcctccgtagagtggtgtggattttttgtcgtactcgcctgatattgagtatcgtgtgcctgatgattacccagctagccggatttagcgggcccctggcatggtgttgtcaggacctggatctgggcggagtgtcactttag

SEQ ID NO: 180028 - DNA, 1530 bp, Artificial Sequence
  Description of Artificial Sequence: Synthetic coding sequence
atgcagagctggagccgggtgtactgcagcctggccaagcggggccactttaatcgaatttcccatggtttgcaaggtttgtccgccgtaccgctgagaacctatgcagatcagccaatcgacgctgacgtgacagtgatcggctccgggccaggaggctacgtagcagccatcaaggccgctcaactcggttttaagacagtgtgcatagaaaagaacgaaacgcttggcgggacttgtctgaacgtaggctgtatccctagcaaagcgcttctgaacaatagccactactatcatatggcacatggaaaagattttgcttcccgaggaatcgaaatgtccgaagttcggctgaacctcgacaagatgatggaacagaagagcacagccgtgaaagcacttactggcggcattgcacatctgttcaaacagaacaaggttgttcatgttaacggctacggaaaaatcactggcaagaatcaggttaccgccacaaaagcagatggcggtacccaggttatagacactaaaaatattctaatagcaaccggttccgaggttacacctttccccgggatcaccattgatgaagatactatcgtaagttccaccggtgcactctccctgaagaaggtccctgagaaaatggttgttataggggcaggggtgatcggagtcgagctaggctcagtctggcaacgccttggggccgacgtaaccgctgtggaatttctagggcacgtgggtggagtaggcattgatatggaaatttctaaaaacttccagaggatcttgcaaaaacaaggatttaagttcaaactcaacacaaaggttaccggagctaccaagaaaagtgacgggaaaatcgatgtaagcatcgaagcagcctctggcggaaaggccgaggtaataacttgcgatgtcctgcttgtctgtattggccgcagaccctttacaaagaaccttgggctcgaagagctgggaatagaactggatccacgcgggagaattccagtcaacacccgctttcagactaagattcccaacatttacgccatcggggatgttgtggctggtccaatgctcgctcataaagcagaagatgaaggtatcatctgcgtggagggaatggctgggggggccgtccacatagactataactgtgtaccctcggtgatatatacccatcccgaggtcgcgtgggtaggaaaaagcgaggaacagctgaaggaggaaggaattgagtataaggtcggcaagtttccattcgccgccaactcacgtgccaagactaacgccgacaccgatgggatggttaagattctgggccagaaaagtaccgatagggtgctgggcgctcatatcctaggtcccggtgccggcgagatggtgaatgaggccgcattagccctggagtacggtgcgagttgcgaagacattgcgagagtatgccatgcacatccaacgctgtccgaggccttccgcgaggcgaacctggctgcttcttttggtaagtctatcaatttctag

SEQ ID NO: 180029 - DNA, 4512 bp, Artificial Sequence
  Description of Artificial Sequence: Synthetic coding sequence
atggccgcccccgccgagccctgcgccggccagggcgtgtggaaccagacggaaccagagccagcggccacatcacttctatccttgtgctttctgcgaaccgctggagtttgggtgccacctatgtacctttgggtcctcgggcctatttacctcttgttcatacaccaccatgggagaggctacctgaggatgtccccactatttaaagccaaaatggtgctggggttcgctctgatcgtgctctgtacatcttctgtggcagttgctctgtggaaaatccagcagggaactccagaggcaccggagtttctgatacatcccaccgtttggctaacaacaatgagctttgccgtcttcttgattcacaccgaacggaaaaagggagtgcagagtagtggtgtcttattcgggtactggttgctgtgcttcgtgctgcccgctacgaacgccgctcagcaggccagtggagcaggctttcagtccgatccggtaaggcacctgtcgacttatctgtgcttgagtctagtagtcgcccaatttgtcctgtcttgcctagctgatcagccaccgtttttcccagaagaccctcagcagtcaaacccttgcccggaaacgggcgcggcctttccctcaaaagctaccttctggtgggtttcggggttggtgtggagaggatatcgccgaccactgagacctaaggatttgtggtctctcggaagagaaaattcctctgaagagctggtaagcaggctagaaaaagagtggatgaggaacaggagcgccgcccggcggcacaacaaggcaatcgccttcaagagaaaaggcggcagcggaatgaaagctcctgagactgaaccttttctgaggcaggaaggaagccaatggcgtcctttgctgaaggccatatggcaagtgttccactccactttccttttgggcaccctgtccctgattattagtgatgttttccggtttactgtacccaagctgctgtcgctgttcctggagtttattggtgatcccaagccaccagcctggaagggttacttgctcgctgtgttaatgttcctcagcgcttgcctccagaccctgtttgagcaacaaaatatgtatagactaaaagtgctccagatgaggctccgctccgctatcacagggctggtgtaccggaaagtactggccctatcaagcggatcgcgaaaagcatcagctgtgggtgatgtggtcaatctggtttccgttgatgtgcagcgcttaaccgagtctgtcctctatctgaacggactttggctacccctggtctggattgtagtctgcttcgtgtatttgtggcagctattaggacccagtgctctgactgcaattgccgtgttcctatccttgctccctctaaatttcttcatctccaaaaagcgtaatcaccaccaggaagaacaaatgagacagaaggattcccgagcacgcctgactagttctatccttcggaactccaaaacgatcaagtttcatggatgggaaggagccttcctggatcgtgtgctggggattcgtggccaggaactaggagccctccgcacctccggactgctattttcggtgtcactcgtgtcatttcaggtgtctaccttcctggtggctctggtggtctttgcggtccatacactcgtcgccgaaaatgccatgaatgctgagaaggccttcgttacactcaccgtgctcaatattcttaacaaggcccaagcttttttgcctttcagcatccacagcctcgtccaggctagagtctccttcgatcgcctcgtgacgttcctgtgtctggaagaggtggatcccggggtggtggacagcagcagcagcggcagcgccgctgggaaggactgtattacgatccattctgctacctttgcctggagtcaggagagcccgccatgcttgcataggatcaacctgacggtgccacagggctgcttgctggcagtagtgggccccgtcggcgccggaaaaagctctctcctctctgctctcctgggcgagttgtccaaagtggagggattcgtgtcaatcgaaggagccgtggcctatgttcctcaggaggcatgggtccaaaacacttccgtagtggagaacgtgtgctttggtcaggaactcgatccgccgtggcttgagagggttctggaagcatgcgctctgcagccagacgtagactcgtttcccgagggcattcacacctccatcggcgagcagggcatgaacttaagcggaggacagaaacagagacttagtctcgcccgggctgtctacagaaaagccgcagtgtacctgcttgacgaccccttggccgcgctggatgcacacgtggggcagcacgttttcaatcaggtgattgggcctggtgggcttctgcagggtacgaccaggatcttggtcacgcacgccctgcacattctcccgcaggcagactggattatagtgctcgccaacggggccatcgccgaaatgggcagctatcaagaactgttacaacgcaaaggcgctttaatgtgtctgctggatcaggcccggcagcctggcgaccgaggcgaaggggaaacagagcctggtacctcaaccaaggatcctcgtggaacatcagcagggcgccgaccggagttgagacgcgagcggagtatcaagtcagtcccggaaaaagacagaaccacatctgaggcccaaactgaggtcccgctggacgatccggatagagccgggtggccagctgggaaagattctattcaatacggaagagtgaaggcgacagtgcacctcgcgtatttgcgggcagttggcacacctctctgtctctatgctctgtttctattcttgtgccagcaggttgctagtttttgccgagggtattggctgagcttgtgggccgacgaccctgccgtggggggccagcaaacccaggctgccctccggggcggaatctttggactgctgggatgcctccaggctataggactgttcgctagcatggccgctgtgttactgggtggcgctagagcttctcgactgctgttccaaagattgctatgggacgtcgtccggagccccattagtttttttgagcgcacccctattggccacctcctgaatcggtttagcaaagagacagacactgtggatgtggacatacccgacaagttgagaagcttactgatgtacgcctttgggcttcttgaggtgtctctggtggtcgccgttgctaccccgctggcaactgttgccattttgcctctcttcctcctctacgccggattccagtccctttacgttgtctcgtcttgtcaactcaggcgtttagaatcagcatcgtacagttccgtgtgcagtcatatggcggagacgttccagggctcgaccgtggttcgcgccttccgcacccaggccccgtttgtggcccagaacaacgccagagtagacgagagccagaggatcagttttccgagattggttgctgataggtggctggccgcaaacgtagagctgctcgggaacggcctagtgtttgcggctgcaacgtgtgccgttttgagcaaagcccacctatctgctggtttggtgggcttcagcgtcagtgccgcactgcaagtcacacagacactccagtgggtcgtgagaaactggacagaccttgagaattccatcgtaagcgttgaaaggatgcaggattatgcttggactcctaaggaggcaccatggcgcctgccaacctgcgcagcacagcctccctggcctcaagggggacaaatcgagttccgcgattttggactgaggtaccgtcccgaacttccgctcgcggtgcagggggtgagcttcaaaattcatgctggcgaaaaagtcggtattgttggcaggaccggggcagggaagagtagtctcgcaagtggactgctccggttgcaggaggcggctgaggggggaatttggattgacggagttcccatagcacatgtgggactgcacaccctacgaagcaggatttctataattcctcaggaccccattctgttccccggatccttacgcatgaacctggacctgctgcaagagcattcagacgaggccatctgggccgccttggagacagtgcaacttaaggccctggtagccagcctgcccggacagctacagtacaagtgtgctgacagaggggaggacttgtccgtgggtcagaagcagttgctctgcctggcccgagccttactgcggaagacacagatactgattcttgatgaagcaaccgcagcagtggacccaggaaccgagttacaaatgcaggctatgttgggctcctggttcgcccaatgtactgtgctgctaatcgcacaccgactccgctcggttatggactgtgcccgggtgctggttatggacaagggacaggtcgcggagtctggcagccccgctcagctgcttgcgcagaagggtttgttttatagattggctcaggaatccgggttggtatag

SEQ ID NO: 180030 - DNA, 2616 bp, Artificial Sequence
  Description of Artificial Sequence: Synthetic coding sequence
atggccgcccccgccgagccctgcgccggccagggcgtgtggaaccagacagagcctgagcccgccgcaaccagtctcttgagcctttgcttcctgaggactgcaggtgtgtgggttcctcccatgtatctgtgggtgttgggccctatctacctcctatttatccatcaccacggccgagggtatttgcgcatgtcccccttatttaaggcaaagatggtcctgggctttgccttaattgtgctctgcacgtcgagcgtggccgttgccctgtggaaaatacagcagggaacacccgaggccccggagtttctcatccatccgacagtgtggctcacaacgatgagtttcgccgtgttcctcatacatacagagcgaaagaaaggagtgcaaagctcaggggtcctctttgggtattggctgctatgctttgttcttcccgcaacaaacgccgcccaacaagcttcgggagcagggtttcaatccgatcctgtaaggcatctctcaacctacctttgtctgtctttggtggttgcgcaattcgtgctttcatgcctcgcagatcagcctcctttcttcccggaggacccgcagcagagcaacccctgccccgaaacaggggcagcgttcccttcaaaagcgaccttctggtgggttagtgggttagtctggagaggctatcggaggccgctgcgccctaaggacctctggtctctgggaagagagaatagtagcgaagagctcgtttcccggctcgaaaaggagtggatgcggaatagatccgccgctaggcgccacaataaggcaatcgctttcaagaggaagggaggtagtgggatgaaagcccctgaaaccgaaccattccttcgtcaagaggggtctcagtggaggccactcctcaaggctatctggcaggtgtttcatagcacgttcttactgggaacactgagcctgatcatctcagatgtgttccgcttcacggtgcctaagttactcagcctgtttctggaattcatcggtgaccccaaacccccggcttggaagggttacctattggctgtgcttatgttccttagcgcttgtctccaaaccctgtttgaacagcagaatatgtatcgccttaaggttctacagatgagattgagatcagccattactggtttggtgtacagaaaagtgctcgcactatctagcggaagcaggaaggcctccgcggtcggggatgtggtgaatctggtttccgttgatgtgcagagattgacggagtccgtgctgtatctgaacggactttggctgccccttgtttggattgtggtgtgttttgtatatctatggcagttgttgggacccagcgcccttactgccatcgcagtttttctctcactgctgccccttaactttttcatttctaagaagcgcaaccaccaccaagaggaacaaatgcggcagaaggacagccgggcccgccttacttctagcatcctgagaaatagtaagaccatcaaattccatgggtgggagggcgccttcctggacagggtcctcgggatcagaggtcaagaactgggggccctcagaacctctgggcttctatttagcgtttcactggtgtcctttcaggtaagcacttttcttgtggcacttgtggtgttcgcggtgcacaccttggttgccgaaaacgcaatgaatgccgagaaagcgttcgtaactttgaccgtgctgaacattctcaacaaagctcaggcctttctgccatttagcatccattccctggttcaggccagagtttccttcgacagacttgtgaccttcttatgtctcgaggaagtggaccccggtgtagtggacagctcttcttcgggaagcgctgcgggaaaagactgcataactatccatagcgccactttcgcatggtcccaggagtcccctccatgtctgcatcgtattaacctcacagtcccccagggctgtcttttagctgttgtgggccccgtgggcgccggaaagtcttctctgctgtcagccctcctcggggagctaagcaaagtggagggattcgtgtctatcgagggagctgtagcttacgtgccccaggaggcatgggtccagaatacttcagtggtcgagaatgtgtgctttggacaggagctagaccccccctggctggagagggtcctcgaagcctgtgctctccagcctgacgtagattccttcccggaaggcatccatacctctatcggggagcaaggaatgaacctatcagggggtcagaagcagaggttatccctcgcacgggccgtgtatagaaaggccgctgtttatctcctagatgaccctctggctgcactggacgctcatgtcggtcaacatgtattcaatcaggtgattggcccaggcgggttgctgcaggggacgaagcaaaatctgggccccgcacctcggactccagaggcaccgctgcaggccgggggccccagcttagatgctagaggcccctccagtcagagccttagaagaacggtacctctgcaaaaacctcgtcagagattcttatggatgaccctcactgggcaggacggacaacaggaaaggaccgcctctaatacagcgggttag

SEQ ID NO: 180031 - DNA, 2019 bp, Artificial Sequence
  Description of Artificial Sequence: Synthetic coding sequence
atggccgcccccgccgagccctgcgccggccagggcgtgtggaaccaaacggaaccagagccagctgcgacttctcttctgtctctgtgtttcttgcgcaccgccggggtttgggtgccccccatgtacctgtgggtgttgggccctatttacctgctcttcatccaccaccacggtagggggtacctacgaatgtcacctctattcaaggctaagatggtagctgcaatacccggctctttggagcccggcaatgtgctcggcttcgccctaatcgtgctgtgtacctcatccgtcgctgtggcactttggaaaattcagcaggggactcccgaggctcccgaatttttgattcacccaactgtttggctgacaacaatgagctttgctgtcttcctcattcacacagagcgaaaaaagggcgtgcagagttcaggagtcctgttcggatactggctcctgtgctttgtgctcccagctaccaacgcagcccagcaggcctctggcgccggctttcagtccgaccccgttcgccacttgtccacctatttgtgcttgagcctggtagtggctcagttcgtactgagctgtctggctgaccagccccctttttttccagaggatccacagcagtccaacccttgtcctgagacaggagccgctttcccatccaaggcgaccttttggtgggtgagtggattggtgtggcgcgggtaccgtagacctctgcgaccaaaagacctttggagccttgggcgggagaactcttccgaggaactcgtgagccggcttgaaaaagagtggatgcgcaatagatctgctgcccggcgtcacaataaagccatagcattcaagcgaaagggtggatccgggatgaaggcgcctgagaccgagccttttcttcgacaggaggggtcacagtggagacccctccttaaagccatctggcaagtgtttcactcaacctttctccttggcacacttagtctgattatctcagatgttttccggtttaccgtgccaaagctgcttagcctctttctcgaattcatcggtgaccctaagcctccggcatggaagggttacctcctcgccgtcctgatgttcctaagcgcctgtttacagacgctcttcgaacagcagaacatgtatagacttaaggtattgcagatgcgcctacgaagtgccatcactggtcttgtgtataggaaagtgctcgccttgagctctggtagccggaaagccagcgcagtgggcgacgtggtcaatctcgtgtcagtggacgtacaacgtttgaccgaatcagtgttatatctgaacggtctttggctacccctggtctggatcgttgtgtgctttgtgtatctgtggcagttgctggggccctctgccttaaccgctatagcagtgtttctctctttgctacccctcaacttttttatcagcaagaagcggaatcaccatcaagaggaacaaatgcggcagaaggacagccgcgcgcggctgacgtcctcaattctcagaaatagtaaaaccatcaagtttcacggctgggagggagcttttttggatagagtgctggggattagaggacaggagctgggggccctgcgcacatctgggctcctgttcagcgtaagcctggtctccttccaggttagcacgtttcttgtcgcccttgtggtatttgctgtccacaccctcgtcgcggaaaatgctatgaatgctgagaaggctttcgttactctcacagtattaaacattctcaataaagcccaagcgttcctgccgttctccattcacagcttggttcaggcaagagtctcgttcgatcgattagtaactttcctctgcctcgaggaagttgacccaggcgtggttgactcttcttccagtggctcggctgccggaaaggattgtattactattcatagcgccacgttcgcttggtcacaggagtcccccccctgccttcaccgcgttctgctatatcacgctggttggtcagctatggcctag

SEQ ID NO: 180032 - DNA, 4650 bp, Artificial Sequence
  Description of Artificial Sequence: Synthetic coding sequence
atgagcctgagcttctgcggcaacaacatcagcagctacaacatcaatgatggtgtacttcagaatagttgtttcgtggatgcgctcaatcttgtaccccacgtattcctactcttcattaccttccccatcctcttcattgggtggggttctcagagcagcaaggtccagatacaccataatacgtggctccactttcccggtcacaaccttcgctggattctcacatttgccctactgtttgtgcacgtctgtgagatcgcagagggaattgtctctgacagtcgacgtgagagccgccatctccacttatttatgcccgcagtgatgggattcgtggctacaacaacaagtatcgtgtattatcataacatcgaaacctctaattttcccaagctcctgttggctctcttcctgtactgggttatggcctttataaccaaaacgattaagttagtgaaatattgccagtctggcctcgacataagcaacctgcgtttctgtatcaccggaatgatggttattctgaacgggctgcttatggcagtagagatcaatgttattagggtgcgtcggtatgtcttcttcatgaacccacagaaagtcaagccccctgaggatctgcaggatttaggggtgcgtttccttcagcccttcgtgaacctgttgtctaaggctacatactggtggatgaacacactgatcatatccgcacataagaagccaatcgatctgaaagcaattggaaagcttcctattgctatgcgggccgttaccaactatgtgtgcctgaaggacgcttacgaggaacagaaaaagaaagtagccgaccacccaaacagaacccctagtatttggctcgcgatgtaccgcgcttttggccgtcccatcttgctttcatctacattcagatatctcgccgacctactgggtttcgcagggccactctgcatctcaggcatcgtgcagagggttaacgaaacccaaaatggcacaaacaataccactggcattagcgagaccctaagcagcaaagaatttctggagaacgcctacgtgcttgccgtgctcctgttcctcgccctgatccttcaacgcacttttctgcaggcgagttattatgtgaccattgagaccggcatcaatctaaggggcgcattattggcaatgatatataacaagattctcaggctgagtacaagcaacttatccatgggggaaatgaccctgggacagatcaataatctcgttgcgatcgagactaaccaattaatgtggttcctgttcttgtgcccaaacctttgggccatgccggtgcagatcattatgggggttatactcttgtataacctgcttggttcgtccgctttggtgggagcagccgtcatcgttctcttagccccgatacagtattttattgctaccaagctggccgaggctcagaagtcaacactcgattactctaccgaacgactcaagaagaccaatgagatcctcaagggcatcaagcttctgaaactgtacgcgtgggagcacatcttttgtaaatccgtggaagaaacgaggatgaaggaactgagtagtttgaagacattcgccctgtataccagtttatcaatctttatgaacgccgccatcccaatcgctgcagttctggcaacatttgtgactcacgcgtacgcctccggaaacaaccttaagcccgctgaggcgttcgcgagccttagtctctttcacatcctcgtgacccccctcttcctactctccacggtggtgaggttcgccgttaaggctatcatctctgtccagaagcttaacgagttcttgctgagtgacgagattggcgacgatagctggcgcaccggcgagtcttccctgccatttgagtcatgtaaaaagcataccggtgtgcagccgaagacaattaaccgtaaacagcccgggcggtatcatcttgattcttacgagcagtccacacgcagactcaggcccgccgagaccgaagacatcgcgattaaggtcaccaacggttacttctcatggggaagcgggctggctactcttagcaatatcgacatccggatcccaaccggtcaactgacaatgatcgtcgggcaggtcggctgcggtaagtcctccctgctccttgcaatacttggcgagatgcagaccctggaggggaaagtgcactggtctaacgtgaacgagagcgagccatcatttgaggccacacgctccagaaaccgttatagtgtggcttacgcggctcagaaaccatggctgctcaacgctacggttgaggagaacattactttcggttccccatttaataaacagagatacaaagccgttacggacgcctgctcgctgcagcctgacattgatcttctaccattcggcgatcagactgagatcggtgagagggggatcaacctgtccggggggcaaaggcagagaatctgcgtggcacgcgcactctaccagaataccaatatagtgtttcttgacgaccctttctccgccctggatattcacctatccgaccacctgatgcaggaaggtatcctaaagtttcttcaggacgataaacgcacccttgtgttggtgactcacaaactgcagtacctcacccacgccgattggatcatcgccatgaaggacggatccgtgctgagggagggcactctcaaagatatccaaacgaaggacgtcgagctgtatgagcactggaaaaccctcatgaaccgccaggatcaggaactcgagaaggacatggaggccgaccaaacaacgctggaacggaagactctgagacgcgctatgtatagtagagaggctaaagctcaaatggaagacgaagatgaagaggaggaggaggaggaggacgaggacgataacatgtccacagtaatgcgcctaaggactaagatgccctggaagacgtgttggaggtatctgacctctggcggattcttccttttgatactcatgattttctccaaactattgaaacactcagtgatcgtggccattgactactggctggccacgtggacaagcgaatactctataaacaacaccgggaaagctgaccagacttattatgtcgccggattttctatactgtgcggagcggggatatttctttgtctggtgacttctcttaccgtggagtggatgggattaactgccgctaaaaacctgcatcacaatctgctaaataagatcatcttgggccccatccggttcttcgacacaactccactgggactcatactgaaccgcttttctgcggataccaacattattgaccagcacatcccccccacgcttgaatctctgacaagaagcactctgctttgtttaagcgccataggcatgatttcatatgcaacacccgtttttttggtagccctgctgcctttaggcgtggcgttctatttcatacagaaatatttcagagtcgcctctaaagacctgcaggagctggacgacagcactcagctcccccttctttgtcacttctccgaaactgctgaaggacttacaacaatccgcgcctttaggcacgagacacggttcaagcagagaatgctggaactgactgacacaaacaacatcgcctacttatttttgtctgcagccaacagatggctcgaagttagaactgattacttgggcgcgtgcattgtgctcaccgcgagcatagcatccatctccgggtcctccaactccgggctagtgggtctaggccttctgtatgccctgacaattacgaactacttgaactgggttgtgcggaacctggctgacttggaagttcagatgggagctgtgaaaaaggtaaactctttcttgactatggaatccgagaactatgaaggcactatggatccatctcaggttccggagcactggccgcaggagggtgagatcaaaatccacgacttatgtgtaaggtatgagaataatctcaaacctgttctgaagcacgtcaaggcttacattaaacctgggcagaaggtgggaatctgcgggagaacaggtagcggaaagtcttctctgtctttagcattttttcgaatggtcgatatttttgacggcaaaattgtgattgacggcatcgatatctctaagctgccactgcatactctccggagccgcctgtctataatcctccaagacccaattctgttctccggttccatccggtttaacctggatccggagtgtaagtgtactgacgaccgactgtgggaggcactcgagatagcacagctgaaaaacatggtaaagtcactgcccgggggcttggacgctgtggtcaccgaggggggcgaaaattttagcgtgggacagagacaacttttctgtcttgctcgggcctttgtccgcaagagcagtatactcatcatggatgaggcgactgcctcaatcgatatggccactgagaatatactgcagaaggtcgttatgactgctttcgccgataggacggttgtaacaattgcccatagggtccatactattctaaccgctgacttagtgattgtaatgaaaagaggtaatattcttgaatatgatactcctgaaagtctgcttgctcaagaaaacggcgtgtttgccagttttgttcgcgctgatatgtag

SEQ ID NO: 180033 - DNA, 4650 bp, Artificial Sequence
  Description of Artificial Sequence: Synthetic coding sequence
atgagcctgagcttctgcggcaacaacatcagcagctacaacatcaatgacggagtgctgcagaactcctgcttcgtcgacgccttaaacctggtccctcacgtgtttctgctgttcatcacatttcccatcctgttcatcggctggggctcccaatcgagtaaggtccaaatccatcacaatacttggctgcatttccccgggcacaacctacggtggatccttactttcgctctgctgtttgtacatgtgtgcgagattgcagagggcatcgtgagcgattcacggagggagtctaggcatctacacttgttcatgccagccgtgatgggctttgtagccactactacctccatcgtttattaccacaatatagagactagcaattttcccaaactgttgttggctctcttcctatattgggtgatggcctttatcacaaaaacgataaaactcgtcaagtattgtcaatctggactggacatttccaatctccggttttgtatcaccggcatgatggtcattctgaacggtctcctgatggccgttgagattaatgtgatccgggtaagacggtatgtctttttcatgaaccctcagaaggtcaagcctcctgaagacttgcaagatcttggggtgcggttccttcagcccttcgtgaacctattatctaaagcaacctattggtggatgaacaccctcattatttcagctcataaaaagcccattgatctgaaggcgatcgggaagctgcctattgcaatgcgtgccgtaacgaactatgtatgcttgaaggatgcttatgaggagcaaaaaaagaaagttgctgaccacccaaatcggacaccttccatctggctggcgatgtatcgcgcatttgggagacccattcttctgagtagcaccttcagatacctggcagacctgttaggtttcgctgggcccctgtgcatctccggtattgttcaaagggtgaatgaaacccagaacggcacaaataataccactggaatcagcgagactttgtctagtaaggagttccttgagaacgcttacgtgctggccgtgctgctgttcctggctctcattctgcaaagaaccttcctgcaagcttcatattacgtgactatcgagactggcatcaatctgcgcggggccttgctagccatgatctacaataagattctgcggctaagcaccagtaatctgtccatgggtgagatgaccttgggccagattaacaatcttgtggccatcgagactaatcagctcatgtggttcctgtttctgtgccctaatctatgggcaatgcccgtgcaaattataatgggcgtaattctgctgtacaatctgctgggctcctccgcgttggtaggtgctgctgtgattgtgttgctggcacccatccaatacttcattgccacgaagctggccgaggcacagaagtctaccctggactacagtaccgaaaggctgaagaagaccaacgaaatacttaagggaatcaagctcctcaagctgtatgcctgggagcacattttctgtaagtctgtagaagaaacccggatgaaagagctgtcctccttgaaaacctttgcactgtatacgtctctatctatctttatgaacgctgccatcccaatagcggctgtcctcgccaccttcgtcacccatgcctatgcctctggcaataacctgaagccagccgaggcgtttgccagtctgtctctcttccatattttggtgacacctctgtttcttctgtctaccgtagtacggtttgccgtgaaagccatcatcagcgttcagaaacttaatgaattcctgctctcagatgaaatcggtgatgacagctggcgtactggagagagtagcctgcctttcgagagctgtaaaaaacatacaggggtccaaccgaaaaccatcaaccggaagcagccagggaggtatcatctcgactcctatgaacagagcacaagacgcttgagacccgcagaaaccgaagatatcgccatcaaggtaacgaatggatatttctcctggggttcggggttggcgacgctgtcaaatatcgatattcgaatccctactggtcaactcactatgatagttggacaagtcggttgcggaaaatccagtctgcttctcgcaatccttggagaaatgcagacacttgagggaaaagtccattggagcaacgtgaatgagagtgaaccatcatttgaagcaactagatctaggaatagatattcagttgcttacgccgcccagaagccctggcttctaaacgctaccgttgaagagaacataacctttggcagtcctttcaacaagcagcggtataaggctgtgacagacgcgtgctccctgcagcccgacatcgatctactgccctttggagaccagactgagattggcgagaggggaatcaatctctcaggcggtcaaaggcaacggatttgcgtcgctcgtgccttgtatcaaaatacaaacatcgtctttctggatgacccttttagtgccctggacatccatttgagcgatcacttgatgcaggaggggatcctaaagttcctacaggatgataagaggaccctagttctcgtgacccataaattacagtatctgactcatgcagattggattattgcaatgaaagacggcagtgttctgagggagggcactctcaaggatatccagactaaagacgtggagctttatgagcattggaaaaccctgatgaaccgccaagatcaggagttggaaaaagatatggaagctgaccagaccactctggagcgaaaaactctgagacgagcaatgtacagtcgtgaggcaaaagcccagatggaagatgaagatgaggaggaggaggaggaggaagacgaggatgacaatatgtccactgtgatgaggctgcgcactaagatgccatggaaaacttgctggcgctacctcacctctggcggcttttttctgctcatcctcatgatcttttctaaactgctgaagcatagtgtaatagtggccatcgattattggttggccacatggacaagcgagtatagcatcaacaacacagggaaggccgatcaaacgtattatgtggctgggttctccatcctgtgcggtgcagggatttttttgtgcctggtcacctctctcacagtagagtggatggggctcaccgccgcaaaaaatctgcaccacaaccttctcaataagattatcctgggacctattagatttttcgatactaccccactgggtctgatactgaaccggttttccgcggatacgaatatcatcgaccagcatatccctcccactctcgaatctttgacccggtcgaccttgctgtgtctttccgccattggaatgattagctatgccacccccgtgtttttggtggctctgcttcctctcggggtggctttctactttattcagaaatatttccgggtggccagtaaagaccttcaggaattggacgactctacccagcttcctttattgtgtcatttcagtgaaacagccgaaggtttgactacaattcgcgcctttcggcatgagacacgatttaaacagaggatgctcgaactgacggatactaataacattgcttatctattcttgagcgccgctaaccggtggctggaggtgaggacggattacctgggggcttgcattgtcctcaccgcatcaattgctagcatcagtgggagcagcaattcaggcttggttggcctgggactgttgtacgctctcacaattactaattatctcaattgggtcgtaagaaacctggccgatctggaagtccagatgggtgccgttaaaaaggtaaactcttttctcacaatggagagtgagaactatgagggcaccatggatcccagtcaggtcccagaacattggccgcaggagggtgagatcaagatccatgacctttgcgtaaggtatgagaacaatctcaagcccgtgcttaaacatgtaaaggcctatataaagccagggcaaaaggttgggatctgcggccggaccggatccggaaagagttccctctctttggcttttttcagaatggtggacatttttgacggaaaaatcgtgatcgacggcatagatatctccaagctgcccttacataccttaaggagccgtctgagcattatcctgcaggaccctatacttttcagtgggtctattcggttcaatcttgatcccgaatgtaaatgtaccgacgaccggctctgggaagccctagagatcgcccagctgaagaacatggtcaaaagccttcctggcggacttgatgcagtggttaccgaaggaggcgagaacttcagtgtgggccagaggcagctgttctgcctcgcccgggcttttgtgcgtaagagctccatcctaatcatggatgaggccaccgcgagcattgacatggccaccgagaacatcctacagaaggttgtaatgactgcatttgccgatcggactgttgttaccatagcccacagggtgagttccatcatggacgcgggattggtgctggttttctccgaaggcatcttagttgaatgtgataccgtgccaaatctcctcgcacataaaaacggactgttcagtacactggtgatgactaacaagtag

SEQ ID NO: 180034 - DNA, 450 bp, Artificial Sequence
  Description of Artificial Sequence: Synthetic coding sequence
atgagcctgagcttctgcggcaacaacatcagcagctacaacatcaacgatggtgtgctgcagaacagttgcttcgttgacgccctgaatttggtcccccacgtcttcctccttttcattacattcccaattctgttcataggatggggcagtcagagcagcaaggttcagatccaccacaatacatggttgcatttccccggccataatcttcgctggattctgacgttcgcactactctttgtgcatgtgtgcgaaatcgcggaggggattgtgagcgattctcggcgggagagccgccacctccatttgtttatgccagctgtaatgggcttcgtcgccacgaccaccagcattgtatactatcacaacatagaaacaagcaattttcctaaactgctgttaggtttctcccaccacgaaagtaaaagttgctaccaacactcttag

SEQ ID NO: 180035 - DNA, 4542 bp, Artificial Sequence
  Description of Artificial Sequence: Synthetic coding sequence
atgagcctgagcttctgcggcaacaacatcagcagctacaacatcaacgacggtgtcctgcagaactcgtgttttgtagatgctttaaacctcgttcctcacgtcttcctactttttatcaccttccctatcttattcatcggatgggggagccaaagctccaaggtccagatccaccacaatacctggctccatttcccaggacacaacttgagatggatccttacattcgccctgctcttcgtacacgtatgcgagatagccgaagggattgtgagtgacagcaggagggagtcaagacacctccatctgttcatgccagccgtgatggggttcgtcgccaccaccaccagcatcgtgtattaccacaacatagagacgtcaaatttccctaaattgcttttggccctgtttctgtactgggtgatggcattcattaccaagaccataaaattagtgaagtactgtcaaagtggactcgatatcagtaacctgaggttctgtatcacagggatgatggtgatcctgaacggactgttgatggcagttgaaatcaatgtgatccgtgtgcggagatatgtattcttcatgaatccacagaaagtgaaacctccagaggatctgcaggacctcggcgtccgctttctgcaaccctttgtgaacctcttgagcaaggccacttactggtggatgaacacactgatcatctctgcgcataagaagccaatagacctcaaagctatcggaaagttaccaattgccatgcgagccgtcaccaattatgtgtgcctgaaggatgcctatgaggagcagaagaaaaaggtcgcagaccaccctaacaggacccccagtatttggttagctatgtaccgggctttcggccgtcccattttgctgtcttctacctttcgttatctggctgacctgttggggttcgctgggcctctctgtatctccggcatcgtgcagcgggtgaacgaaacccaaaatgggacgaacaacacaaccggaatcagcgagactctgtctagcaaggaattccttgagaatgcctacgttctcgcagtgttgctgtttctcgcacttattctccagaggactttcctgcaagcttcatactacgtcacaattgagacgggcataaacttacggggcgccctcttagccatgatctacaataaaattctcaggctgagcacttctaatctttcaatgggggaaatgaccctggggcaaatcaacaatctggtcgctatcgagaccaaccagttaatgtggtttctgtttctttgtcctaacctatgggctatgcccgtgcaaattatcatgggggttatcctgctgtataacctactcggttcttccgctttagtgggagccgcagttatcgtcttgctggcccccatccagtatttcattgccacaaagctggctgaagcacaaaagtctactttggactatagtactgagcggctgaaaaagactaacgagattttaaaaggcatcaaactactgaaattgtacgcctgggagcatattttttgcaaatcagttgaagagaccagaatgaaagagttgtcctccttgaaaacctttgctctgtacacctcgctctccatcttcatgaatgcggccatccctattgccgctgtgctggcaacattcgtaacacacgcttacgcatctggtaataaccttaagcctgcggaggcgttcgccagcctgtccctgtttcacatcctggttactcccctcttccttttgtcaactgtagtgcggtttgccgtgaaagccatcattagtgttcagaaactcaacgaattcttgctgtccgatgagattggagacgacagttggcggactggggagtcgtccctgccattcgagtcctgtaagaagcataccggtgtcgtgacaaacgggtacttttcgtggggctccggtcttgcgaccctgagtaatatcgatatccggatccccactggccagctcactatgatcgttggtcaggtaggctgcggaaaatcaagtctgctgctcgctattcttggcgagatgcagacgttggagggaaaggtgcactggtcaaacgtgaatgaatccgagccttccttcgaggcgacaaggtcaaggaatcggtactctgtggcctacgcagcccagaaaccctggctgcttaatgcaactgtggaagagaatattacttttgggagccctttcaacaagcagagatacaaggccgtgacagacgcgtgctctcttcaacctgacatcgaccttcttccgtttggtgatcagacagaaatcggtgagcgagggatcaacctgagcggcggtcagcgacagcggatatgcgtcgctagagctctatatcaaaataccaatatcgtctttctggacgaccccttctcagcgctggatatccacttgagcgatcaccttatgcaagaaggaatactgaagttccttcaagatgataagaggactctagtgctggtgacccacaaactgcaatacctaacccacgccgattggatcatagcgatgaaggacggcagtgtactgcgcgagggaacactaaaggatattcagactaaagacgttgagctctacgagcactggaaaaccctaatgaacaggcaagatcaggaattagagaaggacatggaagcagaccagacaacactcgaaagaaagacgcttcgaagggcgatgtattccagggaagccaaggcacagatggaggacgaagacgaagaagaggaggaagaggaggatgaagatgacaacatgagtaccgtgatgaggttacgaactaagatgccatggaagacctgctggagatacctgacgtcagggggttttttcctcctcattctaatgattttctcaaagcttctgaagcacagtgtcatcgtggcaatagactactggctggcgacgtggacaagtgaatactcgatcaataacacgggaaaggccgaccagacttattatgtggccgggtttagcattctgtgcggtgccgggattttcctctgtctcgttacatctttaacagtagaatggatgggattgaccgcagccaaaaatcttcatcacaatctcttaaacaaaattatcctgggccctataaggttctttgacacaacccctctggggctgattttgaatcggttctccgcggacactaatatcatcgatcagcacatacccccaaccctggaatctctcacccgcagcacattattatgcctgagtgccatcggcatgattagctatgccacaccagttttccttgtggcactgctgcccctgggagtggccttctacttcatccagaagtacttccgcgtggcctccaaagatcttcaggaattggacgatagtacccagcttcctttgttgtgtcatttttccgaaaccgcagaagggttgacaacaatacgggcattccgccatgagactcggtttaagcagaggatgcttgagttgaccgatacaaacaacattgcctacctgttcttgtccgctgctaaccgatggttggaagtcaggactgactatttgggagcctgcatcgtgctcaccgcttcaatcgccagcatcagcggcagcagcaatagtgggctggtcggtttgggcctcctgtacgctttgacaattaccaattatcttaactgggtggtcagaaacctcgccgacttagaggtgcagatgggggcagtgaagaaagtcaattccttcctgactatggaaagcgagaactacgaaggcacaatggacccttcacaagtgccagaacattggccacaggaaggcgaaattaagatccatgatctttgcgttagatatgagaataatttaaaacccgtgcttaaacacgtgaaagcctatattaagccagggcagaaggtgggcatctgcggtcgcacagggtctgggaagagcagtctgagtctggcattctttcgaatggtcgacattttcgatggcaaaattgttatcgatgggatagatatcagcaagctcccattacataccttgcgcagcaggttatccatcatattgcaggatccaatcctgtttagtggctccattaggtttaatctcgacccggagtgtaagtgcacggacgaccggctctgggaagccctggagatcgctcagttgaaaaatatggtgaagtccctgcccggtggactcgacgccgtggtcaccgagggcggcgaaaatttttctgtgggccagaggcagttattctgtttagctcgcgcgttcgttcggaagagctccattctcattatggatgaagccactgccagtattgacatggcaacagaaaatatcctgcagaaggtggtaatgactgccttcgccgaccgaaccgtggtcacgatagctcacagggtgagctcaattatggatgccggattagtcctagtatttagcgagggaatcttagttgaatgcgacactgtgcctaatctgctggcccataagaacgggttattcagtactctggtgatgacaaacaagtag

SEQ ID NO: 180036 - DNA, 1386 bp, Artificial Sequence
  Description of Artificial Sequence: Synthetic coding sequence
atgcagcgggtgaacatgatcatggccgagagccccggcctgatcaccatatgtctgctggggtatctgctgtctgcggaatgcacggtgttcctggatcatgaaaatgctaataagattctcaatcggccaaagcgctataattccgggaaactggaggagttcgtccaggggaacctcgaacgtgaatgcatggaggagaaatgctccttcgaggaagctcgggaggtgtttgagaacactgagaggaccactgagttctggaagcagtacgttgatggagaccagtgcgaatccaatccttgcctcaatggcggcagctgcaaagacgatatcaacagctacgaatgttggtgcccttttgggtttgaaggaaagaattgtgagctggatgtgacgtgcaatataaaaaatggaagatgtgaacagttctgcaagaacagtgctgacaacaaagtcgtgtgtagttgcactgagggctatcggctcgcagagaaccaaaaatcatgtgaacccgccgtgcccttcccatgcgggagagtctctgtgagtcagaccagcaaattgacaagagctgagacagtattccccgacgtagactacgtcaactccacagaggccgagacaatcctggacaatatcacacaaagcacgcagtctttcaacgattttactcgggtcgttggcggagaagacgcgaagcctggccagtttccttggcaggtagtgctgaacggtaaagtggacgccttctgcggagggtctattgtcaacgagaaatggatcgtcacagctgcccactgtgtggaaacgggagttaagattaccgtagtggcaggggagcacaacatcgaggagacggaacacacggagcagaagcggaacgtgattcggataatccctcatcacaattataacgccgccataaataagtataatcacgatatcgcgctgctggaactggatgaacccctcgtcctgaactcctacgtgacacccatctgtatcgcggacaaggagtatacaaacatcttccttaagttcggctccggatacgtatctgggtgggggcgcgtttttcataaaggcagatctgcattggtcctgcagtacctgcgcgtgcccctcgtcgacagagctacctgcctgagaagcaccaagtttaccatttacaacaatatgttctgcgcagggttccacgagggggggagagattcctgtcagggagattcaggagggcctcatgtgacagaggtggagggtacaagtttcctgacaggcataatttcatggggagaggagtgcgccatgaagggaaaatatggtatatacactaaggtgtcacgttatgtgaactggattaaggaaaaaacgaagctgacctag

SEQ ID NO: 180037 - DNA, 684 bp, Artificial Sequence
  Description of Artificial Sequence: Synthetic coding sequence
atggacggccggctgcggaaccccgaccagagcctgaccgaggacgtagtggccttcgccgcctcagtcgctcatctttatagtaaccttaccaaaccactgctggacgttgcagttacatcttataccctactgcgtgccgcaaggtctcgcggagccggcacagcatggcccagcgcgatcgctgggcttgtagttttcctgacggccaacgtgctgagagcattttcacccaaattcggagaattagtcgcagaggaggcacggaggaagggcgaacttcgatacatgcatagtcgggtcgtggccaatagtgaggaaatcgcattctatggggggcacgaagtggagcttgcactgcttcagcggtcctatcaggatctcgcaagccagatcaatcttatacttctcgaaagactatggtacgttatgctcgagcagttcctcatgaaatatgtgtggagcgcctcaggactgttgatggttgctgtccctatcattaccgcaaccggatactctgaatccggagaaacacagggttccaaacggatacaggcacggggtctctctccgattcctctgggggccgagctgacaagagcccaactctctcaacctgctgcccacttctgttgcagaggtcataggggaccagccgcctcactggacgctttcaggggttag

SEQ ID NO: 180038 - DNA, 672 bp, Artificial Sequence
  Description of Artificial Sequence: Synthetic coding sequence
tgactgttcagcaccgtggccgcccccttctacctgcccgccagcagtgtggggggatttcatttgtttattgtggcctccaccgatgccgaggcagtcaagaaagcagctctggagaaaaaggaagaggagctggtcagtgagcggacagaagccttcaccattgcacggaatcttcttacagcagccgccgatgcgatcgaacgcatcatgtcatcctacaaggaagtgacagaactggccggatacacagctagggtgcacgagatgttccaggtgttcgaggacgtacagcggtgccatttcaaacggccccgggagctggaagacgctcaggcagggtcaggaacgatcggcaggtccggtgttcgagtcgaaggacccctgaagatacgtggtcaggtggtagatgtggaacaggggattatctgcgagaacattccaatcgtgacgccctctggggaggtcgtggttgcatccttgaatattcgcgtagaggaaggcatgcacctgctaatcactggacctaacggttgtggcaagtcaagcttatttagaattctggggggactgtggcctacttatggcggagtcctgtacaaaccacctcctcagagaatgttctacatcccccagcgaccttacatgtctgtgggctctctccgcgactag

SEQ ID NO: 180039 - DNA, 2223 bp, Artificial Sequence
  Description of Artificial Sequence: Synthetic coding sequence
atgacccacatgctgaacgccgccgccgaccgggtgaagtggacccgttcttctgccgccaagcgtgccgcatgtcttgtggctgcggcctacgccctaaagaccctgtaccccattataggaaagaggctcaaacagtcgggccatgggaagaagaaagccgccgcctatcccgccgcagagaacactgagatactacattgtaccgaaacaatctgcgagaagccttccccaggagtgaatgccgacttcttcaagcagttgcttgagctgcgcaaaattttatttccaaaattggtgaccaccgaaaccggttggctgtgcctgcactcagtcgccctgatctccaggactttcctaagtatttacgttgccggcctggatggtaaaattgtgaagagcatcgtggaaaaaaaaccacgtaccttcattattaaacttattaagtggctgatgatagccattcccgcgacttttgtgaactcggcaattaggtatttggagtgcaagctcgcgctggcatttcgcactaggctcgtggatcacgcctatgaaacatactttaccaatcaaacgtattacaaggtgatcaacatggatggcaggctcgcgaatcctgatcagtctctgacagaggacattatgatgttcagccagtccgtcgcccacctttactctaacctgaccaagccaatattggacgtgatgctgacttcctacacgttgatccagaccgccacttctagaggggccagtccaatcggcccgacattgctggccggactggtagtgtacgcgaccgccaaggtgcttaaggcttgtagccctaaatttggtaaacttgtggctgaagaggctcaccggaaggggtacttgagatacgtgcactcgcggatcatcgctaacgtcgaggaaatcgcattttacagggggcacaaagtggagatgaagcagctacagaaatcttacaaagctctcgctgaccagatgaacctgatcctgagcaaacggctatggtacatcatgatcgaacaatttctgatgaagtatgtctggtcatctagcggactcattatggtggccattccaatcatcacggccacaggctttgcagacggggaagatggacagaaacaggtcatggtgtctgagcgcaccgaagccttcaccacagctcggaatcttcttgcatcgggggcagatgccattgagcgcataatgagcagctataaagaagtgaccgaactggcaggctacacagcacgggtgtacaacatgttttgggtgtttgacgaagtgaaaaggggcatttacaaaaggacagcagtgatccaggaatcagaatcccactccaaaaacggggctaaggtagaactgcctctgagcgacaccctggccattaaaggaaaagtgattgatgttgatcatgggatcatctgtgaaaatgtgccaatcatcactcccgctggcgaggtcgtggcatctagactgaatttcaaagttgaggaaggcatgcatctgctcatcaccggccctaatggatgtggcaaatcgtccctgtttcgaatattgagcggcctttggccagtgtatgaaggtgtcctgtacaaacccccgccccagcacatgttctatattccccagcgtccatacatgagcctgggatcactccgggatcaagtgatctatcctgacagtgtggacgatatgcatgataagggctataccgatcaggatctggaaagaattttacataacgttcacctgtatcacatagtgcaacgcgagggtgggtgggatgctgtgatggattggaaagacgtcctgagcggcggggagaagcaacgtatgggaatggcgagaatgttctaccacaagccaaagtacgcgttgttggatgagtgcactagtgcagtgtcaatcgacgtagagggcaagatttttcaggccgcaaagggcgcaggaatctccctgctttctatcacccaccggccatcgttgtggaaataccacacacacctcttacagtttgacggagagggtgggtggcggttcgagcagctggacaccgccattagacttacactttcagaggagaagcaaaaattggagtcccagctagctgggatcccaaaaatgcagcagcgcttgaacgagctgtgcaagatcctgggcgaagattccgtgctgaagaccattaaaaacgaggacgagactagctag

SEQ ID NO: 180040 - DNA, 711 bp, Artificial Sequence
  Description of Artificial Sequence: Synthetic coding sequence
atggccgccttcagcaagtacctgaccgcccggaacagcagcctggcaggcgccgccttcttgttactttgccttttgcataaacgccgcagggcgctcggcctccacggcaagaaaagcggtaagcctccgttacagaacaacgagaaggaaggcaaaaaagagcgggccgtcgtggataaagtctttttcagccgacttatacagatcctcaagattatggttccccgtacgttctgtaaggaaaccgggtacctggtccttattgcggttatgttggtctctcggacatattgcgacgtctggatgattcagaatggcaccttgattgagagtggcatcatcggtagaagcaggaaggattttaaacggtacttgctgaactttatcgccgccatgcccctgatcagcctggtcaataatttcctcaaatacggacttaacgagctcaagctctgctttcgagttcgcctgacaaaatacctctacgaagagtatctgcaggcctttacgtactacaaaatgggaaacttggataatcgcatcgctaacccggaccagttgctgacacaagatgtcgagaagttttgtaattctgttgtcgatctctactctaatctatccaaaccgttccttgacattgttctttatatatttaagttaacatctgccatcggagctcaggtacttggaaaaatcctctggcactag

SEQ ID NO: 180041 - DNA, 1980 bp, Artificial Sequence
  Description of Artificial Sequence: Synthetic coding sequence
atggccgccttcagcaagtacctgaccgcccggaacagcagcctggctggtgctgctttcttgctcctctgtctgctgcacaaacgacgtcgggccctgggcctgcatggaaaaaagtcaggcaagcctccactccagaataatgagaaagaaggtaaaaaagagcgggcggtggttgacaaagtgtttttctcccggttgatccaaatcctcaaaattatggtgccaaggaccttctgcaaagagacgggttatctggtactcattgccgtgatgttagtttcacgcacatactgtgacgtctggatgatccaaaatggaactctgatcgaatcaggcattattggacggtcccggaaggactttaaacgctatctgcttaactttatagctgccatgccgctgatttcgctggtgaataacttcctgaaatatggtctgaatgaacttaaattgtgcttcagagtgaggctcacaaagtacctttacgaggagtatctccaggctttcacgtattacaagatgggcaacctagataaccgaattgctaatccagaccagttgctgacgcaggatgtcgagaagttttgtaattcagtggtcgatctttatagtaatctgtcaaagcccttcctcgatattgttctgtatatctttaagctgacatctgcgatcggggcgcaaggcccagcttcgatgatggcatatctcgtagtgtcaggcctgttcttaacacggctaagaagacccataggaaagatgaccatcactgagcagaagtacgagggtgagtacaggtatgtgaactctcgccttatcacaaactctgaagagattgccttttataatgggaataaacgggaaaagcagaccgtgcacagtgtcttccgaaaattggttgagcacctgcataactttattctgtttcgtttttctatgggcttcatcgactctatcattgcgaaatacttagctactgtggtcgggtaccttgtggtctcgaggcctttcctggacttaagtcaccctagacatttgaagtcaacacattcagaactgctggaggattattaccagtccgggaggatgctgcttcgaatgtcacaagcgctagggcgcatagtgttggcgggcagagagatgactaggctggcaggcttcaccgctcgcatcactgagctgatgcaggtcttaaaagaccttaatcatggcaagtatgaaagaacaatggtcagtcagcaggagaaggggatcgaaggggttcaggttatccccctgatcccaggcgcgggagagattattatcgctgataatatcattaagttcgaccacgtgccgctggctactcccaacggtgatgtcttaatacgggatctcaactttgaggtccgtagtggagcaaatgtcttgatctgcggacccaatggctgcgggaaaagttctctatttcgcgtcctcggggagttgtggccgctgtttggaggacggctcaccaaacccgaaagaggtaaactcttctatgtcccacagaggccgtatatgacactggggacactgcgggatcaggtcatttatcctgatggaagagaggaccaaaaacgcaaaggcatctcagacctggtcctcaaggagtacttggacaacgtccaactggggcacattctagagcgggagggcgggtgggatagcgtacaggactggatggacgtgctttctggaggggaaaaacagcgcatggccatggcccgtctcttctaccacaagccccaatttgccatcctcgatgagtgcacatcggctgtatctgtcgacgtggagggttacatctactctcattgtcgaaaggttggcatcactctttttacagtgagtcatagaaagagtctttggaagcatcacgagtattatctccatatggatggcagaggaaactatgagtttaaacagattacagaggacacagtcgagtttggtagctag

SEQ ID NO: 180042 - DNA, 1650 bp, Artificial Sequence
  Description of Artificial Sequence: Synthetic coding sequence
atggccgccttcagcaagtacctgaccgcccggaacagcagcctggcaggagcagccttccttctcctctgtctcctacataaaagacgaagggcactcggactgcatggaaagaagagtggaaaacccccccttcagaataacgagaaagagggaaagaaagagcgggcagtggtcgataaagttttcttcagccggctcatccagattctgaaaatcatggtcccccgcactttctgtaaggagaccggctatcttgtgctgatcgccgtgatgttggtgagcaggacctactgtgatgtatggatgatccagaacggcactctgatcgaaagcggtattataggccgttctcggaaagatttcaaacgatacttgctcaatttcatagccgccatgccgctcatatccctggttaataacttccttaagtatggcctcaacgagcttaagctctgcttccgcgtgagactgactaaatacctgtacgaagagtacctccaggcgttcacttattataagatggggaatctggataaccgtatcgccaatccagatcagctgctgactcaagacgtggaaaaattctgtaatagtgtggtggacctgtattcgaacctgagcaaacctttcttggacatcgtcctgtacatattcaaactaacaagtgcgatcggagcccagggaccagccagcatgatggcgtacctggttgtttcaggccttttccttacaagactgcggcgccccattgggaagatgacaatcactgagcagaagtatgagggagagtatcggtatgtgaacagccgtcttattacaaactcctttaccgcccgtatcaccgaattaatgcaagtgctgaaggatctcaatcacggaaagtatgagcgcactatggtgtctcagcaggagaagggtattgagggggtgcaggtaatccctctgatccccggggccggggagatcattatcgccgacaacataatcaaattcgaccatgtgcccctggccacccccaatggggatgtgctgatccgggatctgaatttcgaggtgagatcaggcgccaacgtactgatttgcggccctaacggttgcggcaagagctctctgttccgtgtgctcggcgagttatggcccttatttggcggcagattaactaagcccgagaggggtaaacttttttatgttcctcagcgtccctacatgacactcggtacgctgcgggaccaagttatttaccctgatggccgtgaggaccagaagcgaaagggcatttcagatctggtgctcaaagagtaccttgacaatgtgcagctgggccatattctggagcgcgaaggagggtgggactctgtccaggactggatggatgttctgagcggaggggaaaagcagcgcatggccatggcccgcctcttttatcacaaaccccagtttgccattcttgacgaatgcacctcggccgtgtcggtcgatgtggagggttatatctactcccattgccgtaaggtaggcatcacactcttcaccgtctctcacagaaaaagtttgtggaagcaccacgaatactatcttcacatggatggcagagggaactacgaatttaaacagattactgaggacaccgtggagttcggatcgtag

SEQ ID NO: 180043 - DNA, 2052 bp, Artificial Sequence
  Description of Artificial Sequence: Synthetic coding sequence
atggccgccttcagcaagtacctgaccgcccggaacagcagcctggctggagccgctttcttgcttctctgcctgctacacaagcgtcgtcgagctctcggattgcacggatatttcatggaaacgtggcgcgagaaatctgacgaggtgatgggagaactgaccgaccatgtcactcactgcaaaaagagcggcaagccacccctgcagaataacgaaaaggagggtaagaaagaacgggctgtcgtcgacaaggttttctttagccgcttgattcagattctgaagattatggtgcctcggacattttgcaaagaaacaggttatcttgtgctcattgctgtgatgctggtgagcagaacctattgtgacgtctggatgatccagaatggcacactgattgaatcaggtattatcggccgttctagaaaggactttaagaggtatttgttgaattttatcgcggcgatgccgctgatatctcttgtcaacaatttcctgaaatacggcttaaatgaacttaaactgtgctttagggtccgactaacaaaatatctgtacgaggaatacctgcaggccttcacctattacaaaatgggaaacttagacaacaggattgctaatccggatcagctgcttacccaagatgtggagaagttctgcaactccgttgtggatctgtatagcaacttgagtaaaccatttttggatatcgtactgtatattttcaaactcacatccgccatcggtgcccaagggcctgcttctatgatggcgtatctggtggtctccgggctattcctaaccaggctacgccgcccaatcgggaagatgacaattactgagcagaaatatgagggcgaatataggtatgtgaactctcgcttaatcaccaattccgaagagatagcgttctataacggcaacaagcgtgagaaacagacggtccactccgtatttcgcaagcttgtcgagcatttgcacaatttcattctatttcgcttttcaatgggattcatagacagcataatcgccaagtacttggcgaccgtggtggggtacttggtcgtgtcacgcccatttttggatctctctcacccaaggcatctcaaatcaacacattcagagttacttgaggactactaccagtctgggcgcatgctgttgcggatgtcccaggcattaggacgaattgtgctggcaggtcgcgaaatgaccaggctcgccgggtttaccgctagaattactgagctcatgcaggtgctgaaggacttgaatcacggcaagtatgaacgaaccatggtctcgcaacaggagaaggggatcgaaggtgttcaggttataccgctgattcccggagccggggagattatcattgccgacaacattatcaaatttgaccacgtccccctggcaacacccaacggagacgtgctgattagagatctaaattttgaagtgcggagtggggccaatgtgttgatctgcggacccaatggctgcggtaaaagtagcctgtttcgtgtgctgggcgagctgtggccactgttcgggggccggcttaccaagccagaacggggaaagctgttttacgttccgcaacgtccctacatgactctgggaacattgagagaccaggtgatctatcctgacggccgcgaagaccagaagcgcaaaggaatttcagacctggttctcaaagagtaccttgataacgtgcaattaggccatattctggagcgcgaaggtggctgggactctgtgcaggattggatggatgtcctgtcaggcggcgagaaacagagaatggcaatggctagactgttttatcacaagccccagtttgccatacttgatgaatgtacatcagcagtctctgtggacgtggagggctatatctacagccactgtcgtaaggtgggcatcaccctcttcaccgtctcgcatcggaaaagcctgtggaagcatcatgaatactatcttcacatggacggacgcggaaactatgaatttaagcagatcaccgaggatactgtcgagttcggcagctag

SEQ ID NO: 180044 - DNA, 1761 bp, Artificial Sequence
  Description of Artificial Sequence: Synthetic coding sequence
atggtgccccggaccttctgcaaggagaccggctacctggtgctgatcgccgtgatgcttgtgtcccgaacttactgcgatgtgtggatgatccagaacggcactctgatcgagtcaggaattatcggtaggtccagaaaagactttaagcgctacctccttaacttcatagccgccatgccgctcattagtcttgttaataacttcctcaagtacggactgaatgagctgaaactctgtttcagggtgaggctgaccaaatacctgtatgaggagtacctccaggcattcacatattataagatgggcaacctagacaacaggattgctaacccagaccagctgctcacccaggacgtagaaaaattctgtaactccgtggtggatctgtacagcaatttaagcaagcccttccttgatattgtgctgtacatatttaagctgacgtccgcaatcggagcacaggggcctgcaagtatgatggcctatctcgttgtgtccggactgtttctgactcggctcagaagacctatcggaaaaatgacaattactgagcagaagtacgagggcgaataccgttacgttaacagtagattgattactaattccgaagagatcgctttctataacggaaataagcgggagaagcaaacagtgcactccgtctttaggaaactggtcgagcacttgcataactttatactctttagattcagtatgggattcattgactccataatcgccaagtatctagccaccgtggtgggctatctcgtcgtgtcgagaccatttctggacctcagccatcctcggcacctgaaaagcacacattcagagctgctggaggattattatcagagcggacgcatgcttttgagaatgtctcaggccctgggcaggattgtgttggctggcagagaaatgacccgcttggcaggatttactgctcggatcaccgagctcatgcaggttctaaaggatttgaaccatggtaaatatgaaaggacaatggtttcccagcaagaaaaagggatcgaaggcgtgcaggtaatccccctaattccaggtgccggcgagattatcatagctgacaatatcatcaagttcgaccatgtccctctggctacaccaaacggagacgtgttaatcagagatctcaattttgaggtgaggagtggcgcaaatgttttaatttgtggacccaacggctgtgggaagtcaagtctcttcagggtgctcggcgagctgtggcccttatttggtgggagattgactaaaccagaaaggggtaaactgttttatgtccctcagagaccttacatgactctcggaacactgcgcgatcaggtcatataccccgacggccgtgaagatcagaaaaggaaggggatttctgatctagtgttaaaggaatacctggacaacgtgcaactggggcatatactagaaagagaggggggttgggattcagtgcaggactggatggacgtgttgagcggcggggaaaagcagcgcatggccatggcaaggttgttttatcacaagccacagtttgctattctggatgagtgtacctctgctgtctctgttgatgttgagggctatatctatagccattgtcgcaaggtgggcattaccctgttcaccgtaagccaccgcaagtcactgtggaaacaccatgagtactatctccacatggatggcagaggaaattatgagttcaaacaaatcaccgaagacaccgtggagttcgggagctag

SEQ ID NO: 180045 - DNA, 1467 bp, Artificial Sequence
  Description of Artificial Sequence: Synthetic coding sequence
atgctgatcgtgctgaacagcaccctgaagagcttcgaccagttcacctgtaacctgctgtacgtttcatggaggaaggatctgaccgagcatctccataggctttattttcggggtagggcttattacacactgaacgttctaagagatgatatagacaaccccgatcagagaataagccaggacgtcgagaggttctgtaggcagctgagcagcatggcgtcaaagctgatcatctctccattcaccctcgtctactacacgtaccaatgctttcagagcacgggctggctaggcccagtgagcatcttcggctacttcatacttggaacggtggtgaacaagactcttatgggaccaatagttatgaaattagtgcaccaagaaaagttggaaggcgactttcgggcaggtcacgtagagcatatgcgaacggatcggcggctccaaagactcttgcagacccagcgggagcttatgtctaaggagctctggctttatattggtattaacacttttgactacttgggcagtattctctcatatgttgttattgctatacccattttcagcggagtatatggtgacctcagcccagccgagctgtcaactctcgtgagtaaaaatgcgttcgtatgtatttatctgatctcatgctttacgcaactgatagacctgagcaccaccctgtctgatgtagctggctacacacaccgaatcggccaactacgggagaccctactggacatgtcactcaaatcgcaagattgcgagatactcggggagtctgagtggggattagacactccaccaggttggcccgccgctgagccggcagatactgctttcctcctggaacgggtgtctatctctgcgcctagctctgacaaacctctgatcaaagatctgagcctgaagattagcgagggccagtcgctgctcattactgggaacacaggcaccgggaagacttctttgttaagggtgcttgggggattgtggactagtacaagaggcagcgttcaaatgttaaccgactttggacctcatggtgtgctattccttccgcaaaaacctttcttcacggacgggacactgagggagcaggtgatctaccccctcaaagaagtttatcctgacagcgggagcgccgatgacgaacgaatactcaggtttctggagttggcgggccttagcaatcttgtggcacgcaccgaaggtttggatcagcaggtggactggaattggtatgatgttctgagccccggggagatgcagaggctctcctttgctcgccttttctatctgcagcccaaatacgccgttctggatgaagctacatctgccttgactgaagaggtggagtcggaattatataggatcggccaacagctcggtatgacttttatctcagtgggccaccggcaatctcttgaaaaggtacctgtcctgactagaatggcctag

SEQ ID NO: 180046 - DNA, 1821 bp, Artificial Sequence
  Description of Artificial Sequence: Synthetic coding sequence
atggccgtggccggccccgcccccggcgccggcgcccggccccggctcgatctccagttccttcagcgcttccttcagattctgaaagtccttttcccttcctggagcagccagaacgctttgatgttcctgaccctcctctgcttgactcttcttgagcagtttgtgatttatcaggtcgggctcatcccgtctcagtattatggtgttctgggaaataaggacttagagggtttcaaaaccctgacgttcctggcagttatgctaatcgtgctgaacagcaccctaaagagttttgaccagttcacttgtaacctgctgtacgtgagctggcgcaaggacctgaccgagcatctgcaccgtctgtattttcgtggaagggcctattacactttgaacgtgctgcgagatgacatcgataatcccgaccagcggatttcccaggacgtcgaacgtttctgtcggcagttgagcagcatggcgagcaagctcatcatcagcccatttacactggtgtattatacataccaatgctttcagagtacaggatggctggggcccgtgtcaatttttggctactttatcttggggacagttgtgaacaaaacactcatgggaccaattgttatgaagttagtccatcaagaaaagcttgagggggacttccgattcaagcacatgcaaatccgcgtgaatgccgagcccgcggccttttatagggcagggcatgtagaacacatgcggaccgatcggcgccttcagaggctacttcaaacacagcgggagttaatgtctaaagagctgtggctctacattggtatcaacactttcgattatctcggtagtatcctgtcttacgttgtgatcgcgatacctatcttctcaggagtgtacggagacctgtccccagccgagctctccacattggtcagtaaaaatgcattcgtgtgtatctatttaatcagttgttttacccaattgatagatttgtctacgacactgagcgacgtcgcgggctacactcacagaatagggcaactaagggagacactgttggacatgagcctcaagagtcaggactgcgagattttgggcgagagcgaatggggcctagataccccccccgggtggcccgcagctgaacccgccgacaccgcattccttttagagagggtgtcaatctccgcaccgagttcagacaaacccctcattaaagacctgtcactaaagatctccgaggggcagtcactgctcataactgggaacactggaacaggcaaaacttccttgctgcgagtgctgggcggtctgtggacttccactaggggttctgtgcagatgctcacggactttggcccacatggtgttttgtttctgccccagaagccattttttactgacggaactctccgagaacaagttatttacccgctcaaggaagtgtatcctgattctggttcagccgacgatgagcgtattctgagatttcttgaactcgcaggtcttagcaacttggttgccaggacagaaggcctagatcagcaggtcgactggaattggtatgatgtgctgtctccaggagaaatgcaaaggttaagttttgctagattattctacctgcagcctaaatatgcagtgctcgacgaggctaccagtgctctgacggaggaggtcgagtcggagctgtaccgcataggtcagcagctcggcatgacgtttattagcgtcggccaccggcagtccctggaaaaatttcatagtctggtcctgaaactgtgtggaggaggacgctgggagctcatgcgcatcaaagtcgagtag

SEQ ID NO: 180047 - DNA, 297 bp, Artificial Sequence
  Description of Artificial Sequence: Synthetic coding sequence
atgcggagcctgctgctgagcaccgtgggcatcaacaccttcgactatctggggtctatcctgagttatgtggttattgcgattcccattttctctggagtctatggagatctctcgcctgccgaattgtccacactggtgagtaagaacgcgtttgtgtgcatttacctcataagctgtttcacacaactgattgacctgagtacaacactctcggacgtggcagggtacactcacagaattggtcagcttagagaaaccctgcttgacatgtctcttaaatcccaggactgttag

SEQ ID NO: 180048 - DNA, 1800 bp, Artificial Sequence
  Description of Artificial Sequence: Synthetic coding sequence
atggccgacaagctgacccggatcgccatcgtgaaccacgacaagtgtaaacccaagaagtgccgtcaagaatgcaagaagtcgtgtccagtcgtgagaatgggcaagctttgtatcgaagtgaccccacaatcaaagattgcctggattagcgaaacactatgcattggctgtggtatatgtatcaagaaatgccccttcggggcgctatcaatcgtgaacctgccttctaacctggaaaaagaaacgacacacagatattgcgctaatgcctttaagctccatagactgcctatccctcggccaggtgaggtgctcggactcgtcggtaccaatggcataggcaaatctactgctttgaagattctcgccgggaagcagaagcctaatcttggcaagtacgatgacccgccagactggcaggaaattctgacctattttcgcggttctgagctccagaactattttacgaagatccttgaggatgatctgaaagccataatcaaacctcagtatgtggaccagattcctaaagccgccaaagggaccgttggttcaatccttgataggaaggacgagacaaagacccaggctatcgtgtgccaacagctggatctcactcacctaaaagaacgaaatgtggaggacctctccggaggcgaactgcagaggttcgcatgcgccgtggtatgcatccagaaagccgacatattcatgtttgatgaacccagctcatatctggacgtgaaacagcggctgaaggctgctatcaccattagaagtttgattaatccagataggtatattatcgtcgtggagcacgacttgagcgtgctggattaccttagcgattttatttgctgtttgtacggggtcccatctgcatacggtgtggtaactatgccgttttctgtgagagagggtataaacattttcttagatgggtacgtgccaaccgagaatcttcgtttccgggacgcttccctcgtttttaaagtggcggaaaccgccaatgaggaggaggtcaagaaaatgtgcatgtataagtacccaggcatgaagaaaaaaatgggcgagtttgagctggccattgttgccggagaatttacagactccgagatcatggtgatgttgggcgagaatggcaccggcaaaacaacgtttatacggatgcttgccggccgcctaaagccagatgaaggcggagaagtgccagtcctcaatgtgagctataagccacagaagatcagtcccaaatccactggttccgtgagacagctcctccatgaaaaaattagggatgcatacacacatccccagtttgtgacagatgtgatgaagcctctgcagatcgagaatatcattgatcaggaagtgcagacactgagcggcggtgagctccagcgcgtcgcactggcgctttgtctcggcaagccagcggatgtctacctgatagatgaaccatctgcctatctggactctgagcagcggcttatggcagcccgtgtggtcaagaggttcattttgcatgcaaaaaagactgcattcgtggtggaacacgatttcataatggccacgtatctcgctgaccgcgtgatagttttcgacggtgtaccgagtaaaaatacagtggccaacagtccacagactcttctcgccggcatgaacaaattcctcagccagctagaaattactttccggcgcgacccgaacaactaccggcccaggatcaataagttaaattccatcaaggacgtcgagcagaaaaaatcaggcaattatttttttctggacgattag

SEQ ID NO: 180049 - DNA, 633 bp, Artificial Sequence
  Description of Artificial Sequence: Synthetic coding sequence
atggccgacaagctgacccggatcgccatcgtgaaccacgacaagtgcaagccaaagaaatgtcggcaggagtgcaaaaagtcatgcccagtcgtgaggatgggtaaattgtgcatcgaggttacgcctcaatctaagatcgcctggataagtgaaacactttgcatcgggtgcggaatctgcatcaagaagtgtccttttggggctctgagtatcgtgaatcttccatccaatctggaaaaagaaacaactcatcgctactgcgcaaacgccttcaagctgcaccgactgcccattccaaggccaggcgaggttctaggtctcgtgggaaccaatggtattggaaaatcaaccgctttgaaaatcctggctggtaagcagaaacctaacttggggaagtacgacgaccctcctgactggcaggagattttgacctactttcggggtagcgaactccagaactacttcaccaaaattctggaagatgacctgaaagccatcattaaaccccagtatgtggaccaaatccctaaggcagcaaaggggactgtaggatccatcctggacaggaaagatgaaaccaagacccaggcaatcgtgtgccagcagctggatctgacacatcttaaatag

SEQ ID NO: 180050 - DNA, 2538 bp, Artificial Sequence
  Description of Artificial Sequence: Synthetic coding sequence
atgcccaaggcccccaagcagcagccccccgagcccgagtggatcggggacggtgagtccacttcgccaagtgacaaggtggtgaaaaaaggcaagaaggacaagaaaatcaaaaaaacattctttgaggagctggctgtggaggacaaacaggccggtgaggaggaaaaggtccttaaagaaaaagagcagcagcagcagcagcagcagcagcagcagaagaagaagagagataccagaaaggggcgccgaaaaaaggatgtcgacgatgatggggaggagaaagagttgatggagcggctcaagaagctctctgtgcctacttccgacgaagaagatgaggtgccagctccaaaacctcgggggggaaagaaaactaaagggggcaatgtctttgcggctctcattcaggaccagagtgaggaagaggaagaggaggagaagcaccctccaaagccagccaaaccagagaagaaccggattaataaggctgtaagcgaagagcaacagcctgcgctgaaggggaaaaaaggaaaagaggaaaagagtaaaggcaaggcaaaacctcagaataagtttgctgcactggacaacgaggaggaagacaaagaggaagaaattattaaagagaaggagcctcctaaacagggaaaagagaaagctaagaaagccgaacagggcagcgaggaggagggcgagggtgaggaggaggaagaggagggaggagagagcaaggctgatgatccgtacgctcacctcagcaagaaagaaaaaaagaaactgaagaagcagatggagtatgaacgtcaggtggcgtctctgaaggctgccaatgccgccgaaaatgacttctcagtgagtcaagccgaaatgagctcacgtcaggctatgctggaaaacgctagcgacattaagcttgagaagttttctatatcggctcacggcaaggagcttttcgttaacgctgacctctacatcgttgccggtcgtcggtatggactggtcggtccaaacggtaagggcaagaccactcttctgaagcatatcgcaaacagagcgctctccattccccccaatatcgatgtcttactgtgcgagcaggaggttgtggcagacgaaacacctgccgtacaagcggtgctgagggccgacactaagagactgaagctgttggaggaggagagaagactgcaaggccaattagagcagggagatgatactgcagccgaaagactagaaaaggtatatgaggagcttagagccacaggggccgctgccgccgaggccaaagctcggcggatattggcaggcctgggcttcgatcccgaaatgcagaatcggccaacccaaaaattctcaggcggctggcgtatgagagtttcacttgcccgggctctgttcatggagcctactctgcttatgcttgatgaacctaccaatcatctggaccttaatgcggtgatctggctgaacaactacctgcagggttggagaaagacgctgttgattgtgtcccacgatcagggatttctagatgacgtctgtacagatattatacacctcgatgcccagcggctgcattattatcggggaaactacatgacgtttaagaagatgtaccagcagaaacagaaagagttgctgaaacaatatgagaagcaagaaaagaagttgaaagagctgaaagctggtggaaaaagtaccaaacaagccgagaaacagaccaaggaggcgctgactcgtaagcagcaaaagtgtagacgaaaaaaccaagatgaagaaagtcaggaggccccagagttgctgaagaggcccaaagagtacaccgtccgcttcaccttcccggatcccccccctctgtccccccccgtattgggactacatggagtgacttttggttatcaaggccaaaagcccttgtttaaaaacctggacttcgggatagacatggatagccgaatctgtatcgtgggacccaacggcgtggggaagagcacactgctgctactgctgacaggtaaattaacacctacacatggggaaatgcgtaagaaccaccgtcttaaaattggattctttaaccagcagtacgccgagcaacttaggatggaagagaccccgaccgagtacttacaacgtgggttcaatctgccttaccaggacgcacgaaaatgtttgggccgctttggcctcgaatctcacgctcatactatccagatctgcaaactgtctggaggtcagaaggcacgcgtcgttttcgccgaactcgcatgtagagaaccggatgtgttaattttagatgaacccaccaataacctagacatcgagagcattgatgcactgggggaagctattaacgagtacaagggcgctgtcattgtagtctcccacgatgctcgactaatcactgagacaaattgtcagttgtgggttgtggaggagcagagtgtctctcagatcgacggggacttcgaagattataaaagggaggtactcgaagccctgggcgaggtcatggtgagtcgcccacgcgaatag

SEQ ID NO: 180051 - DNA, 2424 bp, Artificial Sequence
  Description of Artificial Sequence: Synthetic coding sequence
atgcccaaggcccccaagcagcagccccccgagcccgagtggatcggggatggtgaatctactagtccatcagataaggtggtaaagaagggaaagaaggacaagaaaatcaagaaaactttctttgaggagttagcagtcgaagacaaacaggcgggagaggaggaaaaagtactgaaagaaaaagagcagcaacagcagcagcagcagcaacagcagaagaaaaagagggacacacggaagggcaggcgcaagaaagatgtcgacgatgatggtgaagagaaggagttgatggagcgactcaagaagctgtcagtgccaacgagtgacgaagaagatgaggtccccgcccccaaaccccgaggcggtaagaaaactaaaggaggtaacgtgtttgctgccctcattcaggaccagtctgaagaggaagaggaggaagagaaacatccccccaagccggcaaaaccggaaaaaaatcgcattaataaagcggtcagtgaggagcagcaacccgctctaaaaggcaagaaaggcaaagaagaaaaaagtaagggcaaagccaagcctcagaacaaatttgctgctcttgataatgaagaagaagataaagaggaggaaattatcaaggagaaggagcctccaaagcagggaaaagagaaagctaaaaaagccgagcaaatggaatatgaacgacaagtggcctctctaaaagccgccaacgcagcagagaacgacttctcagtttctcaggctgaaatgtcttctcggcaagctatgctggaaaatgcctcagacataaagctggagaaattctcaatttcggcccatggaaaggagcttttcgtcaacgccgatctttatatcgtggccggtaggagatatggtcttgtgggcccaaacggcaaagggaaaaccaccctcctcaaacacattgccaaccgagcactatctatcccaccgaatatcgacgtgttattgtgtgagcaagaggtcgtggcagacgaaacacccgctgttcaggccgtgctgagagctgatacaaagcgtctcaagctcctggaggaggagcgccgcctccagggacagctcgagcagggtgacgacacagctgcggagcgattagagaaagtctatgaagaactgcgggcgaccggcgccgctgctgcggaggccaaggctcggagaatcctggctggcctcggcttcgaccccgaaatgcagaatagacccacacagaaattttctggaggatggcgcatgcgggtttcactcgcacgggccctttttatggaacccacactgctgatgctggacgagcccaccaaccatttggatttgaacgctgtgatttggcttaataattatcttcagggctggagaaaaacactcctcattgtgagtcacgatcaggggttcctggatgacgtctgtactgacattatccacctcgatgcacagcgcctgcactattacagaggaaattacatgacattcaaaaagatgtaccagcaaaagcagaaagagttgctgaaacagtacgagaagcaggaaaagaagctgaaggagctgaaagccggcggtaaaagtaccaagcaagccgagaagcagacaaaagaagccttaacacgcaagcaacagaaatgcagacggaaaaatcaggacgaagagagtcaggaggcccctgaactcctcaaacgtcctaaggagtacacggttcggtttacgtttcccgaccccccacccctctcccctcccgtcttaggtctccatggggtcacattcggataccagggacaaaaacctctgttcaaaaacctggacttcggcattgatatggactcccgcatctgtatagtgggtccaaacggtgtggggaaatcgacgctgttgctgctgttaaccggaaaacttactcctacccatggtgagatgagaaagaaccaccgactcaagattggattttttaatcaacagtacgctgaacaactgagaatggaagaaacccccactgaatacctccaaagagggttcaacctgccttatcaggacgctagaaaatgtctgggcaggtttggtttggagtcacacgcacataccatccagatctgcaagctgtccggcggacagaaagccagagtggtgttcgcagagctcgcctgtcgggagcccgacgtactgatccttgacgagcccacaaacaatctggacattgagtctatcgatgccctgggagaagccataaatgaatataaaggggcagtcatcgtagtgagccacgacgcccgactgattaccgagacgaactgccaactatgggtagtggaggagcagagcgtcagtcagattgatggcgatttcgaggattacaaaagggaggtgctggaagcgctgggggaggttatggtctctcgccccagagaatag

SEQ ID NO: 180052 - DNA, 2424 bp, Artificial Sequence
  Description of Artificial Sequence: Synthetic coding sequence
atgcccaaggcccccaagcagcagccccccgagcccgagtggatcggagacggcgagtccaccagtccctcggataaggtggtcaagaaagggaagaaagataagaagattaaaaagaccttttttgaggagctggcagtggaggataagcaagccggtgaggaggagaaggtgctgaaagagaaagaacagcagcagcagcagcagcagcaacaacagaaaaaaaagcgcgatactaggaagggcagacgcaagaaggacgtggacgacgatggtgaggaaaaggaattaatggagcgactaaagaaactgtctgtaccaacctccgacgaggaggacgaagttccggccccaaagccccggggagggaaaaagaccaagggcggtaatgtttttgccgctttgatccaggaccagtctgaggaagaagaggaggaggaaaagcacccacccaaaccagctaagccagagaaaaaccggatcaataaggccgtcagcgaagagcagcagcccgcgttaaagggcaaaaagggcaaggaggaaaaatcaaaggggaaggcaaaaccacagaacaagtttgccgccctggacaatgaggaagaggacaaggaagaagagatcattaaggagaaggaaccacctaagcaaggcaaagagaaagccaaaaaggctgagcagatggaatacgaacgtcaggtggccagcctgaaggccgctaatgccgctgaaaatgattttagcgtgagtcaggccgaaatgagttcaaggcaagctatgctggaaaatgcatctgatatcaaattggagaaatttagtataagcgcgcatggaaaagagctctttgttaatgctgatttatacatcgtcgcaggtaggcgctacggccttgtggggccaaacgggaaaggaaagactaccctcctcaagcatattgccaatcgtgccctgtcaatcccacccaatattgacgtccttctgtgcgagcaggaagttgtggccgacgaaacaccggcagttcaggccgtgcttcgggcagataccaaaaggctaaaactgctagaagaggagagacggctgcaggggcaactggaacagggtgacgacacggccgccgaacgcttagagaaggtttatgaagagcttcgggctaccggagctgcggcagctgaggccaaagcaaggcggatcctggcagggttgggatttgatccagagatgcaaaacaggccaactcaaaaattttccggcggatggagaatgagagtttccctggctagggccctctttatggagccgacgctcctgatgctggacgagcctacaaaccacttagatctaaacgcggtaatttggctgaataactacctacaaggatggcggaaaactctgctaatcgtctctcacgatcaggggttcctagacgatgtttgtaccgacatcatccaccttgatgcgcagagactgcattactaccggggcaattatatgacctttaagaaaatgtatcaacagaaacagaaagaactgttgaaacaatacgagaaacaagagaaaaagctgaaagagctcaaagccgggggcaaaagcactaaacaggccgagaagcagaccaaggaagcgttaacgaggaagcagcagaaatgtcggaggaagaaccaagacgaagagagccaagaagctcccgaattgctgaaaaggccaaaggaatacacagtgagattcaccttcccagaccctccaccattgtctccacctgtattgggacttcatggcgtaacctttgggtatcagggccagaagcccctctttaagaatctggatttcgggatcgatatggattcccgaatctgtatcgttggaccaaacggggtcggcaagtcaactctcctactgctgttgaccggcaaactcacccctacacatggagagatgcggaagaatcacaggcttaagatcgggttctttaatcagcagtatgctgaacagctcagaatggaagagacgcctacagaatacctacagagagggttcaacctgccgtatcaggacgctcgtaaatgtctcgggcgatttggcctcgaaagtcatgcccatactatccagatctgtaaactctctggcggacagaaagcaagagtggtttttgctgaactggcctgcagggagccagacgtgctgattctggacgaaccgaccaacaatctggatatagagagtattgatgctctgggggaggcaatcaatgagtacaagggagctgtgattgtggtaagtcacgatgccaggttgataaccgagacaaattgccagctatgggtggtcgaggaacagagtgtgagccagatcgacggtgacttcgaggattacaagcgagaagtactcgaggctttgggggaagtgatggtgtctcgccccagagagtag

SEQ ID NO: 180053 - DNA, 2538 bp, Artificial Sequence
  Description of Artificial Sequence: Synthetic coding sequence
atgcccaaggcccccaagcagcagccccccgagcccgagtggatcggcgatggcgagagcacaagtccttctgacaaagtggttaaaaagggcaaaaaggacaaaaagatcaagaagacctttttcgaagagctggccgtggaggataaacaggccggcgaggaggaaaaagtactaaaggagaaggaacaacagcaacaacagcagcaacaacagcagaaaaagaaacgtgacacaaggaaggggcgcaggaagaaagacgtggatgatgacggcgaagaaaaagagctgatggagcgactgaagaaactgagtgtgcctactagtgatgaggaagatgaagtgccagcacctaagcctaggggtggaaagaagacgaagggtggaaatgtcttcgccgctcttatccaggatcagtccgaggaggaagaagaggaagaaaagcaccctcccaaaccagccaaacccgagaagaaccgcatcaacaaagctgttagtgaagagcagcaacctgcccttaaaggaaagaagggaaaggaagaaaaaagcaaagggaaagctaaaccacagaataaatttgcagcactggataatgaagaagaggacaaggaagaggagattattaaggaaaaggagcccccaaaacaaggaaaagagaaggccaagaaggctgaacaggggtcagaggaagagggagaaggcgaagaggaggaagaagaaggaggggaaagcaaagcagacgatccttacgcacatttgtctaagaaagaaaaaaaaaagctgaaaaaacagatggaatatgaacgccaggtggcctccctaaaagccgctaacgcagccgagaacgatttctcggtgagccaggctgagatgagcagtagacaggccatgctggagaatgccagcgacataaagctagagaaattttccatcagcgcccacggtaaagagttattcgttaacgccgacctgtacatcgttgcagggcgacgctacggccttgtcgggcctaacggaaaagggaagactaccctgctgaagcatattgccaacagggctctgagcatccctccgaatatcgacgtgcttctctgcgagcaggaagtcgttgccgacgagacacctgcagtgcaggccgtactccgggccgacaccaaacgtctgaagctcctcgaggaagagcgtcggttgcaggggcaactggaacagggcgacgatacagcagccgagcggttggaaaaggtctatgaagagcttcgtgccaccggagccgctgccgctgaggctaaagctcgccgtattctggctgggttgggttttgatccagaaatgcagaatcgaccaacccagaagttctctggaggatggcggatgagagtgtccctggcaagagcactcttcatggagccgactctcctgatgctggacgagcccactaatcatctagatctcaatgccgtgatctggctcaacaactacctccagggttggcgcaagacccttctcattgtgtcgcacgaccagggctttctggacgatgtgtgcaccgacatcatccacctggatgcccagcgcctgcattactatcgtggcaactacatgactttcaagaaaatgtaccaacagaagcagaaagagctcctgaaacagtatgaaaaacaggagaaaaagctgaaagagctgaaggcgggcggcaagtccacgaaacaagccgaaaaacagacaaaggaagcactgacccggaaacaacagaagtgtcgccgcaaaaaccaagatgaagagtctcaggaagcaccggagctattaaagcgccctaaggagtatacagttcgattcaccttccccgacccgcctccgctcagtccaccagtcctcggcttacacggtgtgacatttggttatcaggggcagaaacccctattcaagaacctggatttcgggatagacatggattccaggatttgtatagtcggtcctaacggagtgggcaagtccacattactgctccttcttacgggaaagcttacccctacgcatggcgagatgaggaaaaatcaccgcttgaagattggcttcttcaatcagcagtatgccgaacaactccggatggaagaaacccctaccgagtatctccagcgaggcttcaatctaccgtatcaggatgccaggaagtgcttagggcgattcggtctggagtcccatgcacatacaattcagatctgtaaactgtcaggaggccagaaagcacgagtggtgttcgctgagcttgcatgccgggaaccagacgttcttatcctggatgagcccactaacaaccttgatattgaatccatcgacgctctgggagaggcgattaacgaatacaagggggctgtgatcgttgtgagccacgatgcacgactgattactgagaccaactgccagctctgggttgttgaggagcagtcagttagccaaattgatggagacttcgaggattacaagcgtgaagtactggaggctttaggcgaagtcatggttagcagacctcgggagtag

SEQ ID NO: 180054 - DNA, 717 bp, Artificial Sequence
  Description of Artificial Sequence: Synthetic coding sequence
atgcccaaggcccccaagcagcagccccccgagcccgagtggatcggagacggtgaatcaaccagcccttccgataaagtggttaagaagggtaagaaggacaagaaaatcaaaaagacattcttcgaggagctcgcagttgaggacaagcaagccggagaggaagagaaggtgctcaaggaaaaagagcagcagcagcagcagcagcagcaacagcagaaaaagaagcgcgacacccgtaagggacggcgcaagaaggacgtggacgatgacggtgaagaaaaagagctcatggagcgcctgaagaaactgagccgggggttcaatctcccataccaagacgcacgcaaatgcctggggcggttcggccttgaaagccacgcccataccatccagatttgcaagctttccgggggccagaaagccagagtcgtgtttgctgaactggcctgccgcgaaccggacgtcctgatactggacgagcctacaaataatctggacatcgagagtattgacgccctgggtgaggctataaacgagtataagggggccgtgattgtggtctcacacgatgcacgactgatcaccgagaccaattgtcagttatgggttgttgaggagcagtcagtgagccagatcgacggagactttgaggactacaagcgcgaggtcctggaagcgctgggggaagtgatggtctctcggcctcgggaatag

SEQ ID NO: 180055 - DNA, 2424 bp, Artificial Sequence
  Description of Artificial Sequence: Synthetic coding sequence
atgcccaaggcccccaagcagcagccccccgagcccgagtggatcggtgacggggaatcaacgagcccttccgataaggtggtaaagaagggcaagaaggataagaaaattaagaaaacatttttcgaggagctggccgtggaggataagcaggccggcgaggaggagaaggtcctgaaagaaaaggaacagcagcagcagcagcagcagcagcagcagaagaagaaaagggataccaggaagggtagacgcaagaaggacgttgacgacgacggagaagagaaggagctaatggaacgtctgaagaagctgtctgtgcctacaagcgacgaagaagacgaagtgcccgcaccaaagccacggggcggaaagaagacaaaaggcgggaatgtgtttgctgcactgattcaagatcagagcgaagaggaggaggaggaagagaagcacccgccaaagccagccaagcccgagaaaaatcgtataaacaaagctgtctcagaggaacagcaacccgctctgaagggtaagaaaggcaaggaagagaaatctaagggtaaagccaaaccccagaacaaattcgccgccctcgataatgaagaagaggacaaggaggaagaaattatcaaagaaaaggagccacccaaacaggggaaggagaaagcaaagaaagctgagcaaatggaatacgaacggcaggtcgcctctctgaaggcagctaacgcagctgagaatgatttctcagtgtcgcaggctgagatgtctagcagacaggcaatgctcgaaaacgcctctgatattaagctggaaaaattttcaataagtgcacacgggaaggaactcttcgtgaatgccgatctgtacattgtcgcaggcagaagatatggtctggtgggaccaaacggcaagggtaagactaccttactgaagcacatcgccaaccgcgccctttcaattccccctaatatagatgttctgctgtgtgagcaagaagtggtcgctgacgaaactcctgcggtgcaggccgtgctccgagccgacactaaacgactgaagctcctcgaagaagaaagacggctgcaaggccagctggaacagggcgacgataccgcagctgaaaggctggagaaggtgtacgaagagctgagagctactggcgcagcggctgccgaggctaaagctcgccggatcctggcaggcctcgggttcgaccccgaaatgcagaaccggcctacacagaaattttcaggaggctggagaatgagagtgagtctggcgcgagctttatttatggaacccactcttcttatgttagacgagccaactaaccacctcgatttgaacgcagtgatttggttgaataactatctgcagggttggagaaaaacacttctgatcgtgagccacgaccagggatttctggatgacgtatgcaccgacattatacatctggatgcccagcgcctgcactactatcgcggcaattacatgacctttaagaaaatgtaccaacagaaacagaaggaactgctgaagcagtacgaaaagcaggagaaaaagctcaaagaattgaaggccggtggaaaaagcactaagcaggccgaaaaacagacgaaagaagctctgacgagaaagcagcagaagtgtagacgcaaaaaccaggacgaagaatctcaggaggctcctgagttgctgaagaggcccaaggagtacactgtacggttcacatttcctgaccctccacctttaagccccccagtcctgggcttgcatggtgtcaccttcggctatcagggccaaaagcctctgttcaagaatttagactttggcatcgatatggatagcagaatatgcatcgttggcccgaacggcgtggggaaatcaaccctacttctgcttctcaccgggaagttgactcctacacacggcgaaatgaggaagaaccaccggctgaaaatcggcttctttaatcaacagtacgctgaacagcttcgcatggaggaaaccccaacggaatacctgcagcgggggttcaacttgccctaccaggacgccagaaaatgcctgggtcgctttggtctcgaatcacatgcccatacaatccagatttgcaagttgtctggaggacaaaaggccagagttgtatttgccgaattggcctgtagagaaccagatgtcctgatcctcgatgagcccaccaacaacctcgacattgagagtatcgatgccttgggggaagcaatcaacgagtacaaaggggccgtgatagtggtgtcacacgatgcaaggcttattacagagacaaactgccagttatgggtcgttgaagagcagagcgtgtcacagatcgacggcgattttgaagattacaaaagggaagtgttggaagcactcggagaggtgatggtctcgcgcccgagagagtag

SEQ ID NO: 180056 - DNA, 717 bp, Artificial Sequence
  Description of Artificial Sequence: Synthetic coding sequence
atgcccaaggcccccaagcagcagccccccgagcccgagtggatcggtgacggcgaatctaccagccccagcgacaaggtcgttaaaaaaggtaagaaagataagaaaatcaagaagactttctttgaagaactcgccgtcgaggacaaacaagctggggaagaggaaaaagtgttaaaggagaaggaacaacagcaacagcagcagcagcagcagcagaagaaaaagagagatacacgtaagggtagacgtaagaaagatgttgatgacgacggcgaagagaaggaactgatggaaagactgaagaagctgagccgcgggttcaatttgccctaccaggacgcacggaaatgcctggggcggttcggcctggaatcccatgcacatactatccaaatctgtaaactgtctggaggccagaaagctagagtcgtctttgccgagttagcgtgtcgggaacctgatgtcctgattctggatgaaccgactaacaatcttgatattgaatccatcgacgcactgggcgaggcaatcaacgaatacaaaggagcagtcatcgtggtcagccacgacgcaaggctgataaccgagaccaactgccagctgtgggtcgtggaggagcaaagtgtgtcccagatcgacggggacttcgaagactacaaacgggaagttctggaggctctgggagaagtgatggtgagtcggcctagggagtag

SEQ ID NO: 180057 - DNA, 1023 bp, Artificial Sequence
  Description of Artificial Sequence: Synthetic coding sequence
atgcccaaggcccccaagcagcagccccccgagcccgagtggatcggagacggcgagtcaacaagcccctctgacaaggtggtgaagaaagggaagaaggataagaagatcaagaagacattcttcgaggagctggctgttgaagataagcaagctggtgaagaagagaaggtacttaaggaaaaggagcagcagcagcaacaacagcagcaacaacagcagaaaaaaaaacgcgacaccaggaagggtcggcgtaaaaaagacgtggatgatgacggggaggagaaggagcttatggaaagactcaaaaaactctcagttccaactagtgacgaggaagatgaagttccggcccccaagcctcggggggggaaaaagaccaaggggggaaacgtgttcgccgccctgatccaggaccagtctgaagaagaggaggaagaggagaagcacccccctaagcctgcaaaacccgagaagaacagaatcaacaaggctgttagcgaggaacagcagcctgcactcaaaggaaagaaaggcaaagaagaaaagagcaagggcaaagcgaagccgcaaaataagttcgctgcactggataacgaggaggaagataaggaagaagagataattaaagaaaaagagcctccaaaacaggggaaggagaaagcgaagaaggccgagcaggggtccgaagaggaaggggagggtgaggaagaggaggaagagggcggtgagagtaaggcagatgacccctatgcccatttgagtaaaaaggaaaaaaaaaaattgaagaagcagatggagtatgaacgacaggtagcctctttgaaggccgccaatgcagctgaaaacgactttagcgtaagccaggctgagatgagttcaagacaggcaatgctggagaacgcttcagatattaagctggaaaaattttcaatcagcgcacacggcaaagagctgtttgttaatgcagatctgtatattgtggctggaaggcgatatggcctggttggtcctaacgggtag

SEQ ID NO: 180058 - DNA, 2538 bp, Artificial Sequence
  Description of Artificial Sequence: Synthetic coding sequence
atgcccaaggcccccaagcagcagccccccgagcccgagtggatcggcgatggcgagagcacgtctccctccgataaagtagttaagaagggaaaaaaggataagaagattaagaagactttttttgaggagctcgccgtagaggataagcaggcaggtgaagaggaaaaggtcctgaaggagaaggagcagcaacagcagcaacagcagcagcagcagaaaaaaaaaagagatactcgcaagggcaggcgcaaaaaagacgtagatgatgatggggaagagaaagaactaatggagcgattgaaaaagctgtctgtcccaacctctgacgaagaagacgaggtacccgcccccaagccccgcgggggcaagaagacaaagggaggcaatgtatttgcagccctgattcaggaccaatccgaagaggaagaagaggaggaaaaacacccgccgaagccagctaaaccagaaaagaaccgaatcaataaggccgtctcagaggaacagcagccggctctgaaaggaaagaaaggaaaggaggagaaatctaaaggaaaggctaaaccccagaacaagttcgctgccctagataacgaagaggaagataaggaagaggagatcattaaggagaaagaaccacccaaacaagggaaggaaaaagctaagaaggcagagcagggctctgaagaagaaggtgaaggggaggaggaggaagaagaaggcggcgaatctaaagccgacgacccctacgctcatctgtccaagaaagagaagaaaaagctcaagaagcaaatggaatacgagcgccaggtggctagtctgaaagccgcaaatgcagcggaaaatgatttcagcgtaagccaggctgaaatgtctagcaggcaggccatgcttgagaatgcatctgacataaaattagaaaagttttccatcagtgctcacggcaaagaattgtttgtgaatgcggacttgtacatagtcgctggccgcagatacgggctcgttggccccaacggaaaagggaaaaccaccctgctgaagcacattgctaatcgcgcactcagtattccacctaatatcgatgttctcctatgcgaacaggaagttgtcgccgacgaaacccctgccgttcaagccgttctcagggctgacactaagaggctcaagctcctggaggaggaacgaagacttcagggacagcttgaacaaggagatgataccgctgccgaacgtttggagaaagtgtatgaggaactgagggccactggagcagccgcagccgaagcaaaagctagaagaatactcgctggccttgggtttgacccagaaatgcaaaacaggccgacgcaaaaattctcaggtggctggagaatgagggtctcccttgctagggcactgttcatggaaccgactttgctcatgctcgatgagcctacaaaccatctggacctgaatgccgtcatatggctgaacaactacctccaggggtggcgtaagaccctccttatcgtgagtcacgatcagggctttttggatgacgtgtgcaccgatattattcacctggatgcacagcgactacattactacagaggcaattacatgacgtttaaaaagatgtaccagcagaagcagaaggaactgctgaaacagtacgagaaacaagagaagaagctaaaggaactcaaagccggaggaaaatctacaaaacaagccgagaaacagaccaaggaagctttgaccaggaaacagcagaagtgcaggcggaagaatcaagatgaggaatcgcaggaggctccagagcttttgaagcgcccaaaagaatacacagtccggtttaccttccccgatccgcccccactctcgccacccgtcctcggtctccacggcgttaccttcgggtaccagggtcaaaagcccctatttaaaaatctcgatttcggcatagatatggattcacgtatttgtatagttggccccaatggcgtcggcaaaagcaccctgttactcctcctcacgggaaaactgactccaacacacggggagatgagaaagaaccaccgattaaagatcgggttctttaaccagcagtatgcagagcagttgaggatggaggaaacccctaccgagtacctccagagaggatttaatttgccatatcaggacgcacgtaaatgtctgggccgcttcggactcgaaagccacgcccacacgatccagatctgtaaactttccggtggccagaaagcccgcgtagtgtttgccgaattggcatgtcgggaaccagacgtactgattttagacgaacctaccaataacctcgatatcgaatctattgatgctttgggtgaagccatcaacgaatacaagggtgcagtcatcgtcgttagccatgacgcaagacttataacagaaacgaactgccagctttgggtagttgaggagcagtccgtgagccagattgacggagacttcgaggactacaagcgggaagtactcgaggccctgggcgaggtgatggtgagcagacccagagagtag

SEQ ID NO: 180059 - DNA, 2424 bp, Artificial Sequence
  Description of Artificial Sequence: Synthetic coding sequence
atgcccaaggcccccaagcagcagccccccgagcccgagtggatcggcgacggggagtcaactagcccaagtgacaaggtggtaaagaaagggaagaaggacaagaagattaagaagactttcttcgaggaactcgcagtggaagataaacaagctggagaggaagagaaggtcttgaaggagaaggagcaacagcagcagcagcagcagcagcagcagaagaaaaagagggacacgaggaaaggccgtcggaagaaggacgtcgacgacgacggcgaggagaaggagcttatggaaaggttaaagaagctcagcgtgccgaccagcgatgaagaggacgaggttcccgctcccaaacctcgcggcggcaaaaagactaaaggtgggaatgtttttgctgccctgattcaggatcagtctgaggaagaagaggaggaagagaagcacccccctaagcccgccaagccagagaaaaaccggatcaataaggcagtaagtgaggagcagcaacctgctctgaagggcaaaaaaggaaaggaggagaagagcaaggggaaagctaagccgcagaataagttcgcggcacttgataacgaagaagaggacaaagaagaggaaattataaaggagaaagaacctccaaaacagggaaaagaaaaggcaaagaaggctgaacagatggagtatgaaaggcaagtcgcttcattaaaggctgcgaacgctgccgagaacgatttctctgtctcacaggccgagatgtcgagccgacaggccatgttggagaacgcctcagatattaaactggaaaagtttagtatcagtgcccacgggaaggagctttttgtgaacgcagacctgtacatagtggccggcagacggtacgggctggtagggccaaatgggaaagggaaaaccaccctgctgaagcatattgccaatcgggctctatccattccaccaaacattgatgtgttactgtgtgaacaggaggtggttgcagatgaaacgccagcagttcaggctgtccttcgagcggataccaaaagactgaagctgctggaagaggagcggagactgcaaggacagctcgaacagggagatgataccgccgccgagcgcctcgagaaagtgtatgaagagctgcgcgcaactggggctgcagccgctgaggcaaaagcacgccggattctagccggcctagggtttgaccccgaaatgcagaaccgccccactcagaaattttcaggagggtggcgcatgagggtatcactggcaagagccctcttcatggaacccacacttctaatgctagacgagcccaccaatcacctggatcttaacgcagtcatttggctcaataactacctgcagggctggagaaagacactactcatcgtctcccacgatcagggatttttagatgatgtctgtaccgatattatccatctagacgctcagagattgcactactaccgaggcaattacatgaccttcaagaaaatgtatcaacagaaacagaaagaactactaaagcagtatgagaagcaggagaagaagctgaaagaactgaaggccggagggaagagcacaaaacaggcagaaaaacaaaccaaggaggcactcacgaggaagcagcagaagtgccgaagaaagaaccaggatgaagagtcccaagaagcacccgagctgctgaagaggcccaaggaatacacagttaggtttaccttcccagatccacctcccctcagtcctcctgtgttgggactccacggggtgacttttgggtaccagggacaaaaacctctgttcaagaacctcgatttcggcatcgacatggacagtaggatttgtatcgtggggcctaacggtgttggcaaatctactcttctgttactcctgaccggaaagctcactccaacgcacggcgagatgaggaaaaaccacaggctcaagatcgggtttttcaatcagcagtacgcggagcagcttcggatggaggagacgcctaccgaatatttgcagagaggtttcaacttgccatatcaggacgcccgaaagtgcctcggccgcttcgggcttgagagtcatgcacatactattcagatctgtaaactgtcaggaggacagaaggcacgcgtcgtcttcgcagaacttgcctgccgtgagcccgatgttctaattctcgacgagcccacgaacaatctggatatcgaatcaattgatgcgctgggcgaggccattaacgagtacaaaggcgctgtgatcgtcgttagccacgatgctcggctgatcactgaaacgaactgtcagctgtgggttgtggaagagcagagcgtttctcagatcgatggggacttcgaggactataagcgcgaggtcttagaggcactgggcgaggtgatggtgtcccgccctcgagagtag

SEQ ID NO: 180060 - DNA, 2424 bp, Artificial Sequence
  Description of Artificial Sequence: Synthetic coding sequence
atgcccaaggcccccaagcagcagccccccgagcccgagtggatcggggatggtgagtctacttctccaagcgacaaagtcgtaaagaaaggtaagaaagacaagaagatcaaaaaaacctttttcgaagaacttgctgtggaggacaagcaggctggagaggaggagaaagtcctgaaagaaaaagagcagcagcagcagcagcagcagcagcagcagaaaaagaagcgcgacactcgcaaaggacggcgaaagaaggacgttgatgacgacggcgaggaaaaagagctgatggagaggctgaaaaaactgagtgtacctaccagtgatgaagaagacgaggtgcccgcgcccaagccacgggggggcaaaaagactaaagggggaaacgttttcgcggcgttaatccaagatcagtcagaggaggaagaggaagaagagaagcatcctcccaaaccagcgaagcctgagaaaaataggattaataaggccgtgtcagaagagcaacaacctgctctgaaaggaaaaaagggtaaagaggaaaagtcaaaagggaaagccaagccgcagaataagtttgcagccctggacaatgaagaagaagacaaagaagaggagataattaaggaaaaggaacctcctaagcagggtaaggaaaaggcaaaaaaagctgagcagatggagtacgagcgacaggtagctagcctgaaggctgctaatgcagccgaaaacgattttagcgtgagccaagccgagatgtcctcccggcaggcaatgctggagaatgcttctgacattaaactggaaaaattttcgatttcagctcatggaaaggaacttttcgtgaatgccgacctgtatatcgttgcaggacggaggtatggactcgtgggccctaatgggaagggcaagaccaccttgttaaagcatatcgccaatagggcgctgtccattccgcctaatattgatgtgcttctctgtgagcaggaggtggtcgccgatgagaccccagctgtgcaggccgtccttcgcgccgacaccaagagactcaagcttttagaggaagaaaggcgactgcagggccaacttgagcagggcgatgacaccgcagccgaacgtctggagaaggtgtacgaggagctgcgcgctaccggcgccgccgccgctgaggccaaggcacgacgcatcctggcgggcctgggatttgacccggagatgcagaatagacccacgcaaaagttctcagggggatggcgaatgcgagtgagtcttgctcgggccttatttatggaacccactctattaatgctcgacgagccgactaatcacttggacctgaatgcggtaatttggctgaataactacttgcaagggtggcgcaagaccctgctgatcgtatctcacgatcaggggttcttagacgacgtgtgtacggatattattcacctggacgctcaacgcctccactactataggggcaactatatgacctttaagaagatgtatcagcagaagcagaaggagctcttgaaacaatatgagaagcaggagaagaaactgaaagaattgaaggccgggggcaaatccacgaaacaggccgagaagcagaccaaagaggccctgactagaaaacaacaaaaatgccggaggaagaatcaagacgaggaaagtcaggaagctcccgagctgcttaaacgtcccaaggagtacaccgtgcgatttaccttccccgatcccccaccactgtctcctccagttctcggactccacggggttacctttggatatcagggccagaaaccgctatttaagaacctggatttcggaattgatatggattcgcggatctgcattgtaggtccgaatggggttggcaagagtaccctgttattgcttttaaccggcaagttgactcccactcacggcgaaatgcgcaaaaatcataggctcaagattggtttcttcaatcagcagtacgccgagcaactgagaatggaagagaccccaaccgagtatcttcaacggggcttcaatctgccataccaggatgcccgcaaatgcttggggagattcggcctggaatcccacgcccacacgattcagatatgcaaactgagcgggggccagaaggctagagtcgtgttcgccgagctcgcttgcagagagcctgatgttcttatcttggacgagcctacgaacaacctcgacattgagagcattgacgcgttgggggaggcaataaatgaatataagggagcagtgattgtcgtatcccacgatgcacgtctgatcacagaaacgaattgccaattgtgggtggtggaggagcagtccgtgagccagatcgatggggattttgaggactacaaaagggaggtcctggaggcattgggcgaggtcatggtgtcaagaccgcgggaatag

SEQ ID NO: 180061 - DNA, 717 bp, Artificial Sequence
  Description of Artificial Sequence: Synthetic coding sequence
atgcccaaggcccccaagcagcagccccccgagcccgagtggatcggcgacggggaaagtacctctccaagcgacaaggttgtgaaaaagggcaagaaagataaaaaaattaaaaagaccttcttcgaggagcttgcagttgaagacaagcaggccggggaggaagagaaggtcctcaaggagaaagagcagcagcagcagcagcagcagcagcagcagaaaaaaaaaagggacacaaggaagggccggcgcaaaaaggatgtggacgacgacggggaggagaaagaacttatggagcggctcaagaaactctcccgaggctttaacctgccgtatcaggatgctagaaaatgcctgggtaggtttggcctggaatctcacgcacatacaatccagatttgcaagctcagtggcggacagaaggccagggtcgtttttgccgagctggcgtgtcgcgaacctgatgtactaatcctggatgagcccaccaacaacttggatatagagtccatcgacgccctgggcgaagctatcaatgagtataaaggggccgtgatagttgtatcacacgacgcaaggctcatcactgagacaaattgtcagctctgggtggtggaggaacagagcgtgagccagattgatggtgactttgaagactacaaaagggaggttctggaggcactgggagaggtgatggtaagccggcctagagaatag

SEQ ID NO: 180062 - DNA, 1023 bp, Artificial Sequence
  Description of Artificial Sequence: Synthetic coding sequence
atgcccaaggcccccaagcagcagccccccgagcccgagtggatcggggacggcgaaagtacatccccttcagataaagttgttaaaaagggcaaaaaagataagaaaataaagaagacgttttttgaggagctggccgtggaagataaacaggcaggcgaggaagagaaggtgttgaaggaaaaagaacaacagcaacagcagcagcagcagcaacagcagaaaaagaagagagatactaggaaggggcgtagaaagaaggacgtagacgacgatggcgaggaaaaagaactaatggaacggctcaaaaaactgtccgtacctacttctgatgaggaagatgaggtccctgcccccaaacctagagggggtaagaagacaaagggcggaaatgtcttcgccgcgctgatacaggaccagagtgaagaggaagaggaagaggagaaacacccgccaaagccagccaaaccagaaaagaatcggatcaataaggctgtgtccgaggaacagcagccagcgcttaagggaaaaaaggggaaagaagagaaaagcaaaggcaaagcaaaaccacagaataaattcgctgccctagacaatgaggaggaggacaaggaagaagaaatcatcaaagagaaggaacctcctaaacagggaaaggaaaaggcaaaaaaggccgaacagggcagtgaagaggagggggagggcgaggaagaggaagaagagggaggcgagtctaaggcggacgacccatacgcccacctgtcgaagaaggagaaaaaaaagctgaagaaacagatggagtacgagagacaagtcgcctcgttaaaggcagccaacgcagccgagaacgacttttccgtgagtcaggctgagatgtcctcaaggcaggccatgctggagaacgcttccgacatcaagttggaaaaattttccatttccgcgcacggcaaggagctgtttgttaatgccgacctgtacatcgtcgcagggcggcggtatggcctcgtcggccccaatgggtag

SEQ ID NO: 180063 - DNA, 2538 bp, Artificial Sequence
  Description of Artificial Sequence: Synthetic coding sequence
atgcccaaggcccccaagcagcagccccccgagcccgagtggatcggagatggcgagtccacctctccaagtgataaggtggtgaagaagggaaagaaggacaagaagataaaaaaaacattttttgaagagctagccgttgaggataagcaggccggtgaagaagaaaaggtacttaaagagaaggaacagcaacaacagcagcaacagcagcagcagaaaaagaagagagacactcgcaaggggaggcgtaaaaaggatgtggacgacgatggagaagagaaagagctgatggaacgtctgaaaaaactttcagtgcccacgtctgatgaggaggacgaggtgccagcccctaaacctcgcggcggcaaaaagacgaagggaggtaatgtctttgctgctctgatacaggatcagagcgaggaggaggaagaggaggaaaaacacccacctaagccagccaagcctgagaagaatagaatcaacaaagcagtttccgaggagcaacagcctgcactgaagggaaagaaaggtaaagaagaaaagtctaaaggtaaggccaagccccagaacaagtttgccgccctggacaatgaggaggaagataaggaggaggagattattaaagaaaaggagcccccgaagcaggggaaagaaaaagctaaaaaggccgagcaggggtctgaagaggagggggagggagaagaagaggaggaggaaggaggagaaagcaaggctgacgatccctacgctcacttatcgaaaaaggaaaagaaaaagttgaaaaagcaaatggaatacgaaagacaggtggcgtccttaaaggctgccaacgcagcagagaatgatttttccgtgtcccaagcggagatgtcctcccggcaagcgatgctggaaaacgcctcagatattaagttggagaagttcagtatctcggcccacggaaaggagctgttcgtgaacgctgacttgtacatcgtcgctggccggcgctacggactcgtgggccccaacggcaagggtaaaaccacacttctgaaacatattgctaatcgagccctgagcataccaccaaacatcgacgtcctcctgtgtgagcaggaagtggtggccgacgagactccagctgtccaggccgtcctcagggctgataccaagcgtcttaagcttcttgaggaagagaggcgtctgcagggccagctggaacagggtgatgacaccgccgctgagcggctcgagaaagtctatgaggaactgagggccacaggggctgccgctgccgaggctaaggcacgtagaattcttgctgggttaggttttgatcccgaaatgcagaacaggccaacccagaaatttagtggagggtggagaatgcgtgtgagcctcgcccgagccctgttcatggaaccaacactgcttatgttagacgaacctacaaaccacctggacctcaacgctgttatctggctgaataactaccttcaggggtggcgcaagaccctcctgatagtaagccacgaccaaggtttcctggacgacgtctgtactgacataattcatctcgatgctcaaagactgcattactatagaggtaactacatgacattcaagaagatgtaccagcagaagcaaaaggagttgctgaagcagtatgagaaacaagagaagaagctgaaggaactaaaggctggaggtaagtctaccaaacaggcagagaaacagactaaagaagccctgacacggaagcagcagaagtgtcgccggaagaaccaggacgaggagtcacaggaggccccagaattgctgaagcgacctaaagagtatacagtgcgattcacctttcccgatcccccaccgttgtccccccctgtgctggggcttcacggagtgacattcggataccagggccaaaaaccactttttaagaatcttgatttcggaatcgacatggactcacgcatttgcattgtagggccaaatggcgtgggcaaatccactttgttgctcctgttgaccggcaagcttactcctacccatggagagatgcggaaaaatcatagattgaagattggtttcttcaaccaacaatatgccgagcaactgaggatggaggaaacaccaactgagtacttgcagagggggtttaatctgccctatcaggatgccagaaagtgtttaggaaggtttggcctggagtcgcacgcgcataccatacagatctgcaaactgagcggtggccagaaagcaagggtagtctttgcggaactcgcctgtcgtgaacccgatgtcctgattctggatgagcctaccaacaatctcgacatcgagtccatcgacgccttgggtgaggccattaatgagtataagggagcagtgatcgttgtttcacacgatgctaggctgattacagaaaccaactgccagctgtgggtggttgaagagcagtcagtgagtcagattgatggggactttgaagattacaagagagaggttctagaggcccttggtgaggtgatggtttcaagaccaagagaatag

SEQ ID NO: 180064 - DNA, 1023 bp, Artificial Sequence
  Description of Artificial Sequence: Synthetic coding sequence
atgcccaaggcccccaagcagcagccccccgagcccgagtggatcggggatggagaatcaaccagccctagtgacaaggtggtgaaaaagggtaaaaaggacaaaaagataaagaaaacgttcttcgaggagttggcagtggaggataagcaggcaggtgaggaagagaaagtgctcaaagagaaagaacagcagcaacagcagcagcagcagcagcaacagaagaaaaaaagggatacaagaaaaggacggagaaaaaaggacgtagacgacgacggagaagaaaaggaattaatggagcgtcttaagaagttgtctgtgccaacttcggacgaggaggatgaagttcctgcgcccaaacctcggggaggaaaaaagactaagggagggaatgtgtttgccgcactcatacaggaccagtcagaggaagaggaagaggaagaaaagcacccgccaaaacccgcgaagccggaaaagaacagaattaacaaggccgtgagcgaagaacagcaaccggccttaaagggcaaaaagggaaaggaggagaagagcaaaggaaaggccaagccacagaacaaattcgctgctcttgataacgaagaggaagataaagaagaggagattatcaaagagaaggaacctcccaaacagggtaaagagaaagccaaaaaagcggaacaggggtctgaggaagagggcgaaggtgaggaggaggaggaggaaggcggagaatctaaagccgacgatccctacgctcatctttccaaaaaggaaaagaagaagttgaagaagcaaatggaatatgaaaggcaagtcgccagtttgaaagccgctaatgctgccgaaaatgatttctccgtttctcaggcagaaatgtcgagtagacaggccatgctggagaatgccagcgatattaagctggaaaaatttagcatctccgctcacggcaaggagctgttcgtcaacgcagatctatatatcgtggccggaaggcggtacggattggtcggccccaacggctag

SEQ ID NO: 180065 - DNA, 2538 bp, Artificial Sequence
  Description of Artificial Sequence: Synthetic coding sequence
atgcccaaggcccccaagcagcagccccccgagcccgagtggatcggggatggcgaaagcacatctccctcagataaggtggtcaagaaaggaaagaaagataaaaaaatcaagaaaaccttcttcgaagagctggctgtcgaggacaagcaggctggggaggaagagaaggtgctgaaagagaaagaacaacagcagcagcagcagcagcagcagcagaaaaagaagcgtgacacaagaaaaggcaggcgcaaaaaggatgtagacgacgatggggaagaaaaggagctgatggagcgtctgaaaaagctgtctgtgcccacctccgacgaagaggacgaagtccctgctcccaaaccgcgcggtgggaagaagactaaaggcggtaacgtgttcgcagccctgatccaagaccagtccgaggaggaggaggaagaagagaaacaccccccaaagccagccaaacctgaaaaaaaccgcattaacaaagcggtgtccgaggagcagcagcccgccttgaaaggtaaaaaggggaaagaggagaagtcaaaaggaaaggcaaagccgcaaaataagttcgcggctctggataacgaggaggaagataaggaagaagagatcattaaggagaaagagccacccaaacaggggaaggagaaggcaaagaaggcggagcagggatctgaggaggaaggcgagggagaggaagaggaagaggagggtggtgaatccaaggccgacgacccctatgcacatctgagcaagaaagagaagaaaaaactaaaaaaacagatggagtacgagagacaggtcgcctccctgaaggccgctaatgcagcagagaacgatttttccgtgagccaggctgaaatgtcctcccgacaagctatgctggagaatgcttcagacattaagctggaaaaattctctatcagcgcacacgggaaagagctctttgttaacgctgatctgtatattgttgcgggacggagatacggactcgtcggccccaacggcaaggggaaaacaacactattaaaacatattgcaaaccgggctttgtcgatccctcccaacattgacgtgctgttgtgtgaacaagaggtggttgctgacgagacgcccgcagtccaggcagtcctgagagccgacacaaaaaggctgaagttgttggaagaggagaggaggctccagggccagctggaacagggcgacgatacggcagcggagcgcctggagaaggtatatgaagagctgagagcaactggcgctgcagccgctgaggccaaagctagacggatcctggcaggactgggttttgaccccgagatgcagaatcgcccaacacagaagtttagtggcggctggaggatgcgagttagtctggctcgcgccttatttatggaacctaccctgctcatgctggacgaaccgacaaaccacctcgacctgaatgccgttatttggctgaataactacttacaaggttggcgcaagacattactgatagtatcccacgaccaaggctttttggatgacgtgtgtactgacatcatccacctcgatgcacaacgtctccattattacagaggcaactacatgacattcaaaaaaatgtatcaacaaaaacagaaggaactcctcaaacaatacgaaaaacaggaaaagaaactcaaagaactgaaggccggtggcaaatcaaccaaacaggccgagaaacagaccaaagaagccttgactcggaaacagcagaaatgcagaaggaagaaccaggacgaggagtcacaggaggcccccgaactactaaagcggccaaaagagtatacagtccgtttcacctttccagaccctccacctctgagtccacctgtattgggcttgcacggggtcacatttggctaccagggacagaagccattatttaagaacctggacttcggaatcgatatggactccagaatctgtatagtgggacccaacggggttggaaagtcgacactgctcctgctcctgacaggcaagttgactcccactcacggtgaaatgcgcaaaaaccaccggctaaagattggcttcttcaaccaacagtacgcggagcagcttcgtatggaagagacacctacagagtacttgcagcggggcttcaacctgccatatcaggacgcgcgcaaatgtttggggaggttcggattggaaagccatgcacatacgatccagatctgcaaattgagcgggggccagaaagcgcgggtagtctttgcagaattggcctgccgagaacctgatgtgctcatcctcgacgagcccaccaataatctggatatcgagagcatagacgctttgggcgaggccattaatgagtataagggagcagttatcgtggtcagccatgatgccagactgatcacggaaactaattgccagctgtgggtggtggaagaacagtccgtatcacagatcgacggcgatttcgaggattataagcgggaggtcttggaggctttgggcgaagtgatggttagtagaccacgggaatag

SEQ ID NO: 180066 - DNA, 1023 bp, Artificial Sequence
  Description of Artificial Sequence: Synthetic coding sequence
atgcccaaggcccccaagcagcagccccccgagcccgagtggatcggcgatggggagtctacttctccaagcgataaggtggtgaagaagggcaaaaaagataaaaagattaaaaaaactttctttgaggagctggctgtggaagataaacaggctggggaagaagaaaaagtgctgaaggaaaaagagcagcagcagcagcagcaacagcagcagcaacagaagaaaaagcgggacactcgtaaaggcagaagaaagaaggatgtggacgacgatggagaagagaaggagctgatggagaggcttaagaaattatccgtgccgacctccgatgaagaggatgaggtcccggcccccaagccacgggggggaaagaaaacgaaggggggaaatgtgtttgctgcgctgatccaggatcagtctgaagaagaggaggaggaagagaagcatcctcctaaacctgcaaaacctgagaagaaccgcataaacaaggccgtatcggaggagcaacaaccagcactgaaagggaaaaagggcaaggaggagaagagtaaagggaaagccaaacctcagaacaagttcgccgcactggataacgaggaggaggacaaagaggaggaaattattaaggaaaaagaacctcccaaacaaggaaaagaaaaagcaaaaaaggccgagcaaggctccgaggaagagggtgaaggggaggaggaggaggaggagggtggggaatctaaagcagatgatccgtacgcgcatctgtctaaaaaggaaaagaaaaagctgaaaaaacaaatggaatatgagcgccaagttgcttctctgaaagccgctaatgccgccgagaatgatttttcagtgtcccaagccgaaatgtcctcgagacaggcaatgcttgaaaatgcctctgatattaagctggagaagttttcgatttccgcccatggtaaggagctgtttgttaacgctgacctttatattgtcgctgggcggagatatggcctagtgggtccgaacggctag

SEQ ID NO: 180067 - DNA, 1023 bp, Artificial Sequence
  Description of Artificial Sequence: Synthetic coding sequence
atgcccaaggcccccaagcagcagccccccgagcccgagtggatcggcgatggggagagcacttctccctctgataaagtcgtgaagaaaggcaaaaaggataaaaaaattaagaagacgttctttgaggagctggctgtggaggacaaacaggcaggagaggaagaaaaagtcctaaaggagaaggaacagcagcagcagcagcagcagcagcaacaacagaagaagaagcgcgatacccggaagggaaggcggaagaaggatgttgacgatgatggggaagagaaagaactgatggaaaggttgaagaaactctccgttcccacatctgacgaggaggatgaggtgccggcccctaagccacggggcggaaaaaaaaccaaagggggcaacgtgttcgctgcccttatccaagaccaatctgaagaagaggaagaagaggagaaacaccctccaaagcctgcaaaaccagagaaaaatagaatcaacaaagcagtgagcgaagaacagcagcccgctctcaagggaaaaaaaggaaaggaagagaagtcaaagggaaaagcaaaacctcagaacaagtttgccgcactggacaatgaggaggaggacaaggaggaagagattattaaggaaaaggagccgccaaagcaaggcaaagaaaaagctaagaaagctgagcaggggagcgaagaagagggggagggggaagaggaggaagaggaagggggcgagtctaaggcagatgacccttatgcacacttatcaaagaaagaaaagaaaaaactaaaaaagcaaatggagtacgagaggcaggttgcatcactcaaggccgcaaacgcagccgagaatgatttctccgtgagccaagcagagatgagctcccgtcaggcaatgctcgaaaatgctagcgatattaagctcgagaaatttagcataagcgctcatggaaaagaactatttgtgaatgccgacttgtacattgtggctggtaggcggtacggtctggtgggacccaatggatag

SEQ ID NO: 180068 - DNA, 1023 bp, Artificial Sequence
  Description of Artificial Sequence: Synthetic coding sequence
atgcccaaggcccccaagcagcagccccccgagcccgagtggatcggggatggtgaatccacatcacctagcgataaggtggtcaaaaagggtaagaaagacaagaaaatcaagaaaacattttttgaagagctggctgttgaagacaaacaggccggggaggaggagaaggtgttgaaagaaaaggaacagcagcagcagcaacagcagcaacagcagcagaagaagaaaagagacacacgcaagggacgccgcaaaaaggatgtagacgatgacggcgaggagaaagagctgatggagcgcctgaaaaagttgtctgtaccaacctccgacgaagaggacgaggtgcctgctccaaagccacggggcgggaaaaagactaagggaggcaacgtgttcgcggcgctgatccaggaccagagtgaggaagaggaagaggaagaaaagcacccaccgaaacccgctaaaccagagaagaaccgcatcaacaaggctgtgtcagaggagcaacagccggccttaaagggcaaaaagggaaaggaagagaaaagcaaggggaaggccaagccgcagaataaattcgccgctctggataacgaggaggaggataaagaagaagaaataataaaggagaaagagccacctaagcagggaaaggaaaaggcaaagaaggccgaacaaggaagtgaggaggagggcgaaggtgaagaggaagaggaggagggcggcgaatccaaagccgatgacccctacgcacatcttagcaagaaggagaagaaaaaactgaaaaaacagatggaatacgagagacaggtggcatctttaaaggccgcaaatgccgctgaaaacgattttagtgtgtcccaggccgaaatgagctctagacaggccatgttagaaaatgccagtgatatcaaactggagaagttctccataagcgcgcacggcaaggagctgtttgtgaacgctgatctgtatatcgtggctggacgcaggtatggactagtcggacccaatgggtag

SEQ ID NO: 180069 - DNA, 1023 bp, Artificial Sequence
  Description of Artificial Sequence: Synthetic coding sequence
atgcccaaggcccccaagcagcagccccccgagcccgagtggatcggggatggggagtcaacttcaccgtcggataaagtcgttaaaaaaggaaagaaagacaagaaaattaagaagactttcttcgaagagctggccgttgaggataaacaggcaggcgaagaggagaaagtactaaaagagaaggagcagcagcaacagcagcagcagcagcagcaacagaaaaaaaagagagatactagaaaggggcgaagaaagaaggatgtcgacgatgacggggaagagaaagagcttatggaacgcctgaagaaactgtctgtcccgactagtgatgaggaggacgaagtgccggctccaaagcccagaggagggaagaagaccaagggtggtaacgtgttcgccgcgctgattcaggaccagtctgaggaggaagaggaggaggagaaacaccccccaaaacccgcaaagccggaaaagaataggatcaataaagccgtgtccgaggagcagcagccagcactaaagggaaaaaagggaaaggaagaaaagtctaagggtaaggccaagccccagaataaattcgctgctcttgataacgaggaggaggacaaagaggaggaaatcataaaagaaaaagagcctccaaaacagggaaaggagaaagccaagaaggctgagcagggtagtgaagaagagggggagggcgaggaggaggaagaagagggcggtgagtctaaggccgatgatccctacgcccacctctctaagaaagagaagaagaaattgaagaaacaaatggagtacgagcgccaagtggcttccttaaaagctgccaatgccgccgagaatgatttttccgttagccaggccgaaatgagtagcagacaagctatgctggaaaatgcatccgacatcaaattagagaaattctccatcagtgctcatggcaaggagctcttcgtgaatgccgatctgtacatagttgccggccggagatatggactggtaggacctaacggatag

SEQ ID NO: 180070 - DNA, 2424 bp, Artificial Sequence
  Description of Artificial Sequence: Synthetic coding sequence
atgcccaaggcccccaagcagcagccccccgagcccgagtggatcggggacggtgaaagcaccagcccatcagataaggtggtgaagaagggcaagaaggataagaagatcaagaagaccttcttcgaggaattggctgtggaagataagcaagctggggaggaagagaaggttctgaaagaaaaagagcagcagcagcaacaacagcagcagcagcaaaaaaaaaaaagagacacacgtaagggaaggcgcaaaaaggacgtggatgatgatggagaggaaaaagaactgatggaacgtctgaaaaaactctccgtgcccactagcgatgaagaggacgaagtgcccgctcctaagcctaggggggggaagaagaccaaagggggcaacgtgttcgcagccctgatacaagatcagtccgaggaagaagaggaagaggagaaacaccctccaaaacccgcaaagcccgaaaagaaccgcattaacaaagccgttagcgaagaacagcagcccgcattgaaaggtaagaaagggaaggaggagaagagtaagggcaaagccaaaccccagaacaaattcgccgccttggacaacgaagaggaagataaggaggaggaaatcataaaggagaaggagcctccaaaacaaggtaaagaaaaagccaagaaagccgagcagatggaatatgagcgccaggttgctagccttaaggctgccaatgcagctgagaatgacttttcagtgagccaggcggaaatgagctccagacaggcgatgctcgagaacgcctctgacatcaaattagagaagttctccatcagtgcacacggtaaagaactgttcgtgaacgccgacttatatattgtggctggtcggcggtatgggttggtcggaccgaatggtaagggaaagaccactttattaaagcacattgccaacagggcgctgtcaataccgccaaacattgacgtgctcttatgcgagcaggaagtagtggcagacgaaacaccggccgtgcaggccgtgctgagagccgatacgaagaggttaaaactgctggaagaggaacgccgtctgcaaggtcagcttgagcaaggtgatgacacagccgcagagaggctggaaaaggtgtatgaagagctgcgcgccaccggcgctgctgccgccgaagctaaggcacggcgtattctggcaggtctgggatttgatcccgagatgcaaaatagacccacccagaagttttctggcggctggcgaatgcgcgtatcactggcaagagccctgttcatggaacccacccttctcatgctggacgaaccaaccaaccatctcgacctgaatgcggtgatatggctgaataactatctccagggatggcgaaaaaccttgctgattgtgtcacatgatcagggtttcctcgacgacgtttgtaccgatatcatccaccttgacgctcaacggttacactattataggggcaactacatgaccttcaaaaaaatgtaccagcagaagcagaaagaactgctgaaacagtatgagaaacaggaaaagaagttgaaagaattgaaggccggaggcaaaagtacaaagcaggctgaaaagcaaaccaaagaggcactcacaaggaagcaacagaaatgcagacggaaaaatcaagacgaggaaagtcaggaagcacctgagcttttgaagagacccaaagaatatacagtgcgctttacattcccagatcctcctcccttgagtccgccagtactagggctccatggggtcacgtttgggtatcagggacagaaacctctttttaaaaacctcgatttcggcatcgacatggattcgcgaatttgcatcgtggggccaaatggagtcggaaaatcaacattgcttctgctcttgacaggcaagctaacccctactcatggggagatgcgaaagaatcacaggctgaaaattggcttctttaaccagcagtacgccgaacagctaagaatggaggaaacacctaccgagtacctccagcgagggtttaatctgccgtatcaagatgcccggaagtgtctgggcaggtttgggctagagagtcatgctcacaccatccagatctgcaaactgagcggtgggcaaaaggcaagggtcgtcttcgctgagttggcttgccgtgagccagacgtgctcatcctagatgagcctaccaataacctggacatagaatcaatcgacgccctgggcgaggccattaatgaatacaaaggtgccgtgattgttgtctcacacgatgcccgactcataaccgagaccaactgccagctctgggtagtggaagagcagtccgtttcacaaattgatggggactttgaggactataagcgggaagttctcgaagctctcggcgaagtgatggtttctagaccgcgggagtag

SEQ ID NO: 180071 - DNA, 2424 bp, Artificial Sequence
  Description of Artificial Sequence: Synthetic coding sequence
atgcccaaggcccccaagcagcagccccccgagcccgagtggatcggcgacggcgaatccacctctccctccgacaaggttgtgaaaaaaggcaagaaagacaagaaaatcaaaaaaacgtttttcgaggaattagcagtagaggacaagcaggcaggagaagaggagaaagtgctcaaggaaaaggaacagcagcaacagcagcagcagcagcagcagaagaaaaaaagagataccaggaagggacgccgcaagaaagacgtcgatgacgacggcgaggagaaggaactcatggaaagactaaagaaattatccgtacccacaagtgatgaagaggacgaagtcccagctcctaaaccaagaggtggtaaaaagaccaaaggcggtaatgtgtttgccgccctcatacaggaccagtccgaggaggaagaagaggaggaaaaacaccctcctaagcccgcaaaaccggaaaaaaataggattaacaaggcagtcagtgaagaacagcaaccagccttgaagggcaaaaaaggcaaggaggaaaagtcgaagggtaaagccaagccccagaacaaattcgccgcattagacaatgaggaggaggataaggaggaggaaatcataaaagaaaaggaaccacctaaacagggtaaggaaaaagctaaaaaagctgagcaaatggagtatgaaagacaagtcgcctcactgaaagccgctaatgcggctgagaacgactttagtgtgtctcaggccgagatgtcctctagacaggccatgcttgaaaatgctagtgacattaagctggaaaagtttagcatctcagctcacggcaaagagttgtttgtgaacgcagacttgtatatcgttgccggccgtagatacggtctcgtaggccctaacggaaaaggtaagaccacacttctcaagcatatagccaatagggccttaagcatccccccaaacattgacgtgctcctctgtgaacaggaggtcgtggctgacgagacgccagccgtccaggcagtgctcagggccgacacaaagcggctcaaactgctcgaagaggagaggcgactgcaaggtcagctagaacagggggacgataccgctgccgaacggttggagaaggtgtatgaggagttgcgggccaccggcgccgcggctgctgaggctaaagcacgtaggatcctcgcaggactgggttttgaccccgagatgcagaatagacccactcagaaattttctggtggatggcgcatgcgtgtatctcttgcgcgggccctgttcatggagccgactctcttgatgctggacgagccgacaaaccaccttgacctgaatgccgtgatctggctgaacaactatctccagggatggcgcaagacacttttgatcgtgagccacgaccagggcttcctcgacgacgtgtgcacagatatcattcatctggacgcccagaggctgcattattatcgaggcaattacatgaccttcaagaaaatgtaccagcaaaagcagaaggaattgctcaaacagtatgagaaacaagagaaaaaactgaaggagctcaaagcagggggcaagagcacgaaacaagccgaaaagcagaccaaagaagcactaacccggaagcaacagaagtgccgtcgaaaaaaccaagacgaggaaagtcaagaagcaccggaactgctgaagcgaccgaaggaatacacagtgaggttcactttccctgaccctcctcctttgagccctccggtgctcgggctccatggcgtcacctttggctatcaggggcagaaacccctctttaaaaatctggattttggtatcgacatggactcaaggatatgcattgtcggtcctaatggcgtcgggaaatccactctgttgctccttctgactggaaaactaacacccactcacggagagatgagaaagaaccaccgcctgaagatcggattcttcaaccagcagtacgcggagcagctcaggatggaggagaccccaacagagtacctacagagagggttcaatctgccttaccaagatgcccgaaagtgcctaggccgttttgggctcgaatcccacgctcacacaatccaaatctgcaagctgtctggcggtcagaaagccagggttgtgtttgcggaactcgcctgccgggagccagacgttctgattctggacgagcctacaaacaatttggatatcgagtctattgatgccctcggtgaggcaatcaacgaatacaaaggggctgtgattgtggtgtctcacgatgcacgcctgattacggagaccaactgccaattatgggttgtggaagaacaatccgtctcccagatcgacggggacttcgaggattacaagagagaggtgctggaggctctaggagaagtgatggtcagccggcctcgggaatag

SEQ ID NO: 180072 - DNA, 717 bp, Artificial Sequence
  Description of Artificial Sequence: Synthetic coding sequence
atgcccaaggcccccaagcagcagccccccgagcccgagtggatcggagatggcgaaagcaccagcccttctgacaaggtagttaagaagggcaaaaaggacaaaaaaatcaaaaaaacattttttgaggaactggcggttgaggataagcaggcaggcgaagaagaaaaggtgttaaaagagaaggagcagcagcagcagcagcagcaacagcagcagaagaaaaaacgtgatacacgcaaagggaggaggaagaaagatgtggacgacgacggggaggagaaagagctcatggaaaggctgaagaagctgtcacgtggtttcaatctgccctatcaagacgccagaaaatgtctgggccggtttgggctcgaatcacacgctcacaccatccagatctgcaaactctccggcggtcaaaaggcaagggttgtgtttgccgaactagcgtgccgagagccagatgtgcttattctcgatgaacctactaacaacctcgatattgagagcatcgatgccctgggggaggcaatcaacgaatacaagggcgcggtgattgtcgtgtctcacgatgcaaggctcattactgaaacaaactgccaattatgggtcgtggaagaacagagcgtgagtcagatagatggtgatttcgaagactacaaacgggaagtgctcgaagcgctgggcgaggtgatggtgtccaggcctagggaatag

SEQ ID NO: 180073 - DNA, 1602 bp, Artificial Sequence
  Description of Artificial Sequence: Synthetic coding sequence
atgcccaaggcccccaagcagcagccccccgagcccgagtggatcggcgatggcgagtcaacttcaccatccgataaagttgttaaaaagggaaagaaagacaagaagatcaagaagaccttttttgaagagctcgccgtagaggataagcaggctggtgaagaagaaaaggttctcaaggagaaagagcagcaacaacaacagcagcaacaacagcagcaaaagaaaaagagagatacacgcaagggacgacggaaaaaagatgtggacgatgacggtgaggagaaggaactgatggaacgacttaaaaagctgtccgtgccaacatccgatgaggaggatgaagtcccagcccccaagcctagagggggaaaaaagacaaaaggcgggaacgtgttcgcagccctcatacaggaccagagtgaggaggaggaggaggaagaaaaacacccgcctaaacctgctaaacccgagaagaataggatcaataaggccgtgtccgaagaacaacagccggcccttaaggggaaaaaaggtaaggaagaaaaaagtaagggaaaggccaagccccagaacaaatttgcagctctggataacgaggaggaggacaaggaggaggagattataaaagagaaggagcccccgaagcagggaaaggagaaagcaaaaaaagcagaacagggctctgaggaggagggcgagggcgaagaggaggaagaagaaggaggcgaatcgaaggctgacgacccttatgcgcatctatccaagaaagaaaagaaaaagctcaagaagcagatggagtatgaacggcaggtcgcctccctcaaggccgccaatgccgctgagaatgacttcagcgtgagtcaggccgagatgagctccaggcaggccatgttggaaaatgctagcgacatcaaactcgagaagttttctatctcagcccacgggaaagaattgttcgtgaatgctgatctctatattgtcgcgggccgacggtacggattggtcgggcctaatggaaaagggaaaacgactctccttaagcacattgccaaccgtgcgctgtcaatccctcctaatatagatgtcctactatgcgaacaagaagtcgtggccgatgagactcccgctgttcaggcagtgctccgggacgatactgccgccgaaaggctagaaaaagtgtatgaggagctcagagccactggcgctgcggccgcagaagctaaggccagaaggattctagccggactgggatttgaccctgaaatgcaaaacaggccgacacagaaatttagtgggggctggcgcatgcgggtgtctttggccagggctcttttcatggaaccaacactcctcatgctcgatgaacccaccaacaacttggacatcgaatctatcgatgcattgggtgaggcaattaacgagtacaagggagcagtcatagtcgtttctcatgacgcaagactcatcacagaaactaactgtcagctatgggtcgtggaagagcagtctgtgtctcagattgacggggattttgaggactacaagagggaagtgctggaggctctcggggaggtgatggttagtcggccacgggagtag

SEQ ID NO: 180074 - DNA, 717 bp, Artificial Sequence
  Description of Artificial Sequence: Synthetic coding sequence
atgcccaaggcccccaagcagcagccccccgagcccgagtggatcggcgatggtgagagtacttcgccctctgataaagtggtgaagaagggaaagaaagataagaaaattaagaagaccttcttcgaagagctcgcggtggaagataagcaggccggcgaagaggaaaaagtcctcaaggagaaagagcagcaacagcaacagcagcagcaacagcagaagaaaaagcgcgacactcggaaaggtcgcagaaaaaaagacgtcgatgacgacggggaggagaaggaactcatggagcgattgaagaagttgagtcgggggtttaacttaccatatcaagatgctcggaaatgtcttgggcgctttggccttgagtcacacgctcataccatccagatttgcaagctgtcaggaggtcagaaggctagagtcgtatttgccgagttagcttgcagagaaccagacgtcttgatcctcgacgagcccacgaataatctggatattgagtccatagacgccctcggggaagctatcaacgagtacaagggtgctgtgattgtcgtgtcacatgacgctaggctaattaccgagaccaactgccagctttgggtcgtcgaagagcagagtgtttcccaaatcgacggcgatttcgaggattataagcgggaggtcttagaagccttaggcgaagtgatggtcagcaggccaagggaatag

SEQ ID NO: 180075 - DNA, 2538 bp, Artificial Sequence
  Description of Artificial Sequence: Synthetic coding sequence
atgcccaaggcccccaagcagcagccccccgagcccgagtggatcggggacggtgaaagcacaagccccagtgataaggtcgttaaaaagggcaagaaggataagaagatcaagaaaacatttttcgaggaattggcagtcgaagacaaacaagccggagaggaggaaaaggtgctgaaagagaaagagcagcagcagcagcagcagcagcagcaacaaaaaaaaaagcgggatacacgcaaaggccggagaaagaaagatgttgatgatgacggcgaagagaaggaactcatggagaggctgaagaagctgagcgtgccaacctcagatgaggaggacgaggttcctgctccgaagccgcgcgggggcaagaaaacaaaggggggcaatgtcttcgccgccctgatccaggatcaaagtgaagaggaggaagaagaggaaaaacatcctcccaagcctgcaaagccagaaaagaatcgcattaacaaggccgtgtccgaggagcagcagcccgcattgaaagggaaaaaagggaaagaagaaaaaagtaaaggcaaggcaaaaccccagaataagtttgctgcccttgacaacgaagaagaggacaaggaggaggagattattaaggagaaggagcctcccaaacagggcaaagaaaaagccaagaaagccgagcaaggtagtgaggaagagggcgaaggagaagaggaagaggaagaaggcggcgaatccaaagcggatgacccatatgcccaccttagcaaaaaagaaaagaaaaaattgaagaagcagatggaatacgaacgccaggtagcaagcctgaaggccgcaaacgcggcagagaacgatttttcggtgagccaggcagaaatgagctcccgtcaagccatgctggaaaatgctagtgacatcaaacttgagaagttctccatttcagcccatggcaaagagctgttcgttaatgcagacctgtatatcgtggcagggaggcgatatggactggtggggcctaatgggaaaggaaagactacactgctgaaacatatcgctaaccgagctttgtccatcccacctaacatcgatgtcctgctgtgtgagcaagaagttgttgctgatgaaacaccagctgtacaggctgtgctcagggcagataccaaacgcctgaaactgcttgaagaagagagacgcctacagggtcagctagagcagggagacgatactgccgcagagagacttgagaaagtctacgaagaacttcgcgcaacgggggcggccgccgccgaggccaaggcaagaagaatcctggcaggccttgggtttgacccagaaatgcagaaccggcccacacaaaaattctcgggtggctggcgtatgcgcgtgagcctagccagggccctgttcatggaaccgactttactgatgctggacgagccaacaaaccacctggacctgaacgctgtgatttggctcaataactatctgcagggatggaggaagacgttattgattgtgagtcatgaccaaggattcctcgacgacgtgtgcacagacataattcacctcgatgctcaacggctgcattactaccgcggaaactatatgacctttaagaaaatgtatcaacagaagcagaaggagcttcttaagcagtatgaaaaacaggaaaaaaaactcaaggagctgaaggctggcggcaagtcaaccaagcaggcagagaagcagactaaagaggccctgactaggaaacaacaaaaatgtaggcgcaagaaccaagatgaagaatcacaggaggctccagagctgctcaaacgccctaaggaatacactgtgcggtttaccttcccagatccaccacccctgtctccccccgttcttggccttcatggggtgactttcggttatcaggggcagaaaccattgtttaaaaatctagactttggtatcgatatggactcccgaatctgtatcgtgggacctaatggagtgggaaaatcaactctgctgctgctgctgaccggcaaactgaccccaacccatggcgagatgcgcaaaaaccatcgattgaaaatagggttcttcaatcaacagtacgctgagcagctgcggatggaggagacccctaccgagtacctgcaaaggggttttaatctgccctaccaggatgctagaaaatgcctgggcaggttcggtttggaaagccatgcccacacaattcaaatctgcaaactgtccgggggtcaaaaagccagagtagtgttcgcagaactggcttgcagggaaccagacgtactgatactcgacgaaccaactaataatttggacattgagtccattgatgcactgggcgaagctattaatgaatacaagggtgccgttatcgtagtgtcccatgatgcccgcctcattacagagactaactgccaactgtgggttgtggaggaacagtcagtgtctcagatagatggcgacttcgaagactacaagcgcgaagttctggaagctctgggtgaggtgatggtctccagacccagggagtag

SEQ ID NO: 180076 - DNA, 2538 bp, Artificial Sequence
  Description of Artificial Sequence: Synthetic coding sequence
atgcccaaggcccccaagcagcagccccccgagcccgagtggatcggggacggcgagagcaccagcccatctgataaggtagttaaaaaaggcaaaaaagacaagaagataaaaaagaccttctttgaggaactggccgtagaggataaacaggccggcgaagaggaaaaggtcctcaaagagaaggaacagcaacagcaacaacagcagcagcagcagaaaaagaagcgtgatacacgcaagggtaggagaaagaaggacgtggacgatgacggggaggaaaaggaactgatggagcgcctgaagaagctctccgtgcctacttccgatgaggaagatgaggtgccagcccccaaaccacgcggggggaagaagacaaaaggcggcaacgtattcgccgcactcattcaggatcaatccgaagaagaggaggaagaagaaaagcatcccccaaaaccagcgaagcccgaaaaaaatcgaatcaataaagccgtttcagaggagcagcaacccgctttaaaaggcaaaaaaggcaaagaggagaaatcgaaaggcaaggctaaaccccaaaataaattcgccgcgctcgataacgaagaagaggacaaggaggaagagataatcaaagaaaaggaacctcccaagcagggaaaggaaaaggctaaaaaagccgaacagggttcagaggaggaaggcgaaggagaggaggaggaggaggaagggggtgaaagtaaggccgacgacccttatgcacatttatccaagaaagagaaaaaaaagctgaagaagcagatggaatacgagcgtcaggtggcaagcctgaaggcagcaaacgcagcggaaaatgacttcagcgtgagtcaggccgagatgtcttcaaggcaagctatgctcgaaaacgcctccgacattaagctggagaagttttctatcagcgcgcacggaaaggagttgttcgtaaatgccgacctgtatatcgttgctggccgaaggtacgggctggttgggccaaatggaaaggggaaaaccactctgcttaaacatattgccaatagggcactttccatcccacccaacatcgacgtcctgttatgtgagcaggaggtggtagctgacgagactcccgctgtgcaggccgtgttgcgtgccgataccaagcggctcaagttacttgaggaggaaagacggttgcaagggcaactcgagcaaggggacgacacagccgctgaaagactcgaaaaagtgtacgaagaactcagggccaccggagccgctgcagcagaggccaaagcaagaagaattcttgcgggacttggtttcgatcctgagatgcagaatcggcctacccagaagttttcagggggctggcggatgcgagtgtccctcgcaagagccctttttatggaacccactctcttaatgttggatgagccaactaaccacctcgatctcaatgccgttatatggctgaataattatctgcagggatggagaaagacacttctcatcgtctcccacgaccaggggtttctcgacgacgtgtgcacggatatcatccatctggacgctcagcgccttcactactaccgcggtaactacatgacattcaaaaagatgtaccagcaaaagcagaaggagttacttaaacagtacgagaagcaggaaaagaaattgaaggaactgaaggccggggggaagagcacaaaacaagcagagaagcagactaaagaagccctgactaggaagcagcagaaatgtagacgcaagaaccaggacgaggaatcccaggaagccccagagctgctcaagcgacctaaggagtacacagttaggttcacgttcccggatcccccaccactgtctccgcccgtgctcggcttgcatggcgtaacattcggctatcaaggccagaaacccctctttaagaatctcgactttggaatcgacatggatagccgtatttgcatcgtggggcccaatggagttgggaagtcgactctgctcctgcttctcacagggaaattaacccccacccacggagaaatgcggaagaaccacaggctgaaaattggcttcttcaaccaacagtatgccgagcaacttaggatggaagagaccccaactgagtacttgcaaagaggatttaatctcccctatcaagatgctcggaaatgtctagggaggttcgggctggagagccacgcccacacaatccagatctgtaaattaagcggcggacagaaagctcgagtggtgttcgcagagttagcttgcagggagccagacgtcttgatcttggatgaacctacgaataaccttgacattgagtccattgatgcacttggagaggccatcaatgagtacaaaggtgctgttattgtggtttctcacgatgctcgcctcatcacagaaaccaactgtcagctttgggtcgtagaagagcagtctgtgagtcagattgacggtgacttcgaagattataagagggaagtgctggaggccctgggagaggtcatggtatcgaggccaagggagtag

SEQ ID NO: 180077 - DNA, 717 bp, Artificial Sequence
  Description of Artificial Sequence: Synthetic coding sequence
atgcccaaggcccccaagcagcagccccccgagcccgagtggatcggggatggagagtctaccagtccaagcgataaagtggtgaagaagggcaaaaaggacaagaagattaagaaaaccttctttgaggagttagccgtcgaagacaagcaggctggcgaagaagaaaaagtgcttaaagagaaggaacagcagcagcagcaacaacagcagcagcagaagaagaagcgcgatactagaaagggccgtaggaagaaagacgttgatgacgatggtgaagagaaagaactcatggagagactcaaaaaactgagtagaggcttcaatctgccctatcaggatgccaggaaatgcctgggcagatttggccttgaatctcatgctcatacgattcagatctgtaaactgtctggtggacaaaaggcccgtgtggtcttcgctgagctcgcctgccgggagccagatgtgctaattctcgatgagcctacaaacaatctggatatcgagagcattgatgcgttgggtgaggccataaacgagtataaaggcgcagttatcgtcgtgtctcacgacgcgcggctgatcacagagacgaactgtcagctatgggtagtggaagagcagtctgtcagccaaatcgacggcgatttcgaggactataagcgtgaagtactcgaagcactgggcgaggtaatggtgagccgccctcgggaatag

SEQ ID NO: 180078 - DNA, 1602 bp, Artificial Sequence
  Description of Artificial Sequence: Synthetic coding sequence
atgcccaaggcccccaagcagcagccccccgagcccgagtggatcggtgacggggaatccaccagtccatctgataaggtggtgaaaaaagggaaaaaagataaaaaaatcaagaagacctttttcgaagaactagccgtggaagacaagcaggcaggtgaggaagagaaagttctcaaggaaaaagaacagcagcagcagcaacagcagcaacagcagcagaagaagaaacgtgacacccggaaaggcaggcggaaaaaggacgtggacgacgacggggaggagaaggaattaatggagcgattaaagaagctcagcgtacccacctctgatgaagaagatgaggtccctgcccccaagcctagaggcggcaagaagacgaaaggggggaacgtgttcgctgccctgatccaggaccagagtgaggaagaagaagaggaggaaaaacacccgcctaagcccgcaaagccggagaaaaacaggataaataaggcggtatcagaggaacagcagccagctctgaagggcaaaaaaggtaaggaggagaagagcaaaggcaaggcaaaacctcagaataaattcgccgcgctggataacgaagaggaagataaggaagaagaaattatcaaggagaaggaaccccctaagcagggaaaggagaaggccaagaaggccgagcaaggatccgaggaggaaggggaaggagaagaagaggaggaggagggcggcgagagtaaggcagacgacccttacgcacacttatcgaagaaagagaagaagaaattgaagaaacagatggaatatgagagacaagttgcctcactcaaggcggcgaacgcagctgagaacgatttttcggtaagccaggccgagatgagctcgaggcaggccatgctggagaatgcctccgacatcaagcttgagaaattctctatctccgcacatggcaaagagctgtttgtgaatgcagatctctacattgtagccggaagacggtacgggctggtgggccctaacggaaaaggcaagaccaccttactgaaacatatcgccaaccgtgctctcagtatcccaccgaatatagatgtattattgtgcgagcaagaagtggtagcagatgagacccctgcggttcaggcagtgctccgggacgataccgcggccgagagattagagaaggtgtacgaagagctgcgtgccacaggggccgccgctgccgaggcaaaagctcgacgcattctcgccggtttgggctttgaccctgaaatgcagaatcggcctacacagaagttttccggaggctggcggatgcgcgtctcccttgctcgcgcactgtttatggaaccaaccttgttaatgctggatgaacccacgaataaccttgacatcgagtcgatagatgctctgggggaggccatcaatgaatataagggggccgtgatagtggtgagtcacgatgcgcgcctaatcactgaaactaactgccagctctgggtggttgaggaacagagcgtcagccaaattgatggcgattttgaggattacaagcgagaggtcctcgaagccttgggagaagtcatggtgtctaggccgcgagagtag

SEQ ID NO: 180079 - DNA, 1599 bp, Artificial Sequence
  Description of Artificial Sequence: Synthetic coding sequence
atgcccaaggcccccaagcagcagccccccgagcccgagtggatcggtgacggcgaaagcacttctccatccgacaaagtggttaagaaaggaaaaaaggacaaaaagataaaaaaaactttttttgaggagttagccgtcgaggataaacaggctggcgaagaagaaaaagtgctcaaagaaaaggaacagcagcagcaacagcagcagcaacagcagaagaagaagcgagacacgcgcaaaggacgacgaaagaaggatgtggacgacgatggcgaagaaaaagaactgatggaacggttgaaaaagctttccgtccctacctcagatgaagaagacgaggtgcccgcgccaaagccgcgcggaggaaagaaaacaaagggcggaaacgtgttcgccgcactgatacaggatcagtcagaggaagaggaggaagaggaaaaacacccaccaaaaccagccaagccggagaaaaaccgaattaacaaggcagtgtcagaagagcagcaacctgctctgaagggtaagaaaggcaaagaagagaagagcaagggtaaggccaaaccacagaataaatttgctgctctcgacaacgaggaagaggacaaggaagaggagattataaaagaaaaggagcccccgaaacaaggtaaagagaaagcaaaaaaagccgaacagggcagtgaggaggaaggggagggcgaagaagaagaggaagaaggcggggaaagcaaggcagatgatccttacgctcacctgtccaagaaggaaaaaaagaaacttaagaaacagatggagtatgaacggcaagtggccagtcttaaagccgccaacgccgcggaaaacgacttcagcgttagtcaggcagaaatgagttctcggcaagccatgctggaaaatgcttccgacataaagctggaaaagttctctatctcggcacatgggaaggagctttttgtcaatgccgacttatacattgtcgccggaaggaggtatggcctggtgggcccgaatggtaagggcaagacgaccctcctaaaacacattgcaaatagggccctgtctatcccccccaacatcgatgttctattgtgtgagcaggaggtggtagctgatgagaccccagctgtgcaggccgtattgcgagacgatactgcagccgaaaggctggagaaagtgtacgaagaattgagggccactggtgcagctgccgcggaagcaaaagcacggaggatactcgcaggcctggggtttgatcccgagatgcagaatcgaccgacgcagaagttcagtggtgggtggaggatgcgcgtgtcgcttgcaagggcgcttttcatggaaccgaccctgctcatgttggacgagcctacaaacaaccttgacattgaatccatcgacgccctgggtgaagctataaacgagtataagggtgcggtcatcgtggtttcacacgacgccagactcattactgaaaccaactgccagctgtgggttgttgaggagcagagcgtctctcagatagacggtgactttgaggactacaaaagagaagtgctggaggctctgggcgaggtgatggtgtctaggcccagggaatag

SEQ ID NO: 180080 - DNA, 1599 bp, Artificial Sequence
  Description of Artificial Sequence: Synthetic coding sequence
atgcccaaggcccccaagcagcagccccccgagcccgagtggatcggggatggcgaatctactagtccttccgataaggtggtcaaaaaggggaagaaggataagaaaatcaaaaagactttttttgaagaactagccgtggaggataaacaggccggagaagaagaaaaggtgttaaaagagaaggagcagcaacagcagcagcagcaacagcaacagaaaaaaaaaagggacactcgcaagggaagaaggaaaaaggatgtagatgatgacggagaggaaaaagagttgatggaaaggctgaaaaaactctccgtccccacatcggacgaggaggacgaggtgcctgcgccaaagccccggggcggcaagaaaaccaaagggggcaacgtcttcgcggccctgatccaggatcagagcgaggaggaagaagaagaggaaaaacatccgccaaaacctgctaagccagagaagaataggattaataaagccgtgtcagaagaacagcagcccgctctgaaaggcaaaaaagggaaggaagaaaagagcaaaggcaaagcaaaacctcagaataagtttgctgcgcttgataacgaagaggaagataaagaggaagaaatcattaaggagaaggagccacccaagcaaggaaaggagaaggccaagaaggccgaacagggtagtgaagaggagggcgagggcgaagaggaggaagaagagggcggagagagcaaggccgacgatccatatgcacacctcagcaagaaagagaagaagaaacttaagaaacagatggaatatgagcgccaggtcgcatctctgaaagccgcaaacgccgccgaaaacgatttttcagtctcacaggccgaaatgagcagccgtcaggctatgctcgagaatgccagcgacatcaaacttgaaaagttttccatctcagctcacggaaaggagctctttgtgaacgccgatttgtacatcgtggccggacgtcggtacggcctggtaggtcccaacgggaaggggaagactaccctgttaaagcacatagccaacagggccctgagcataccgccaaacatcgacgtactcctttgtgaacaagaagtggtggccgatgagacacccgccgtgcaggcagtactgagagatgatacagcggcggagcgactggaaaaggtgtatgaggaactgagggcaactggcgctgcagcagccgaggcaaaagccagaagaatccttgctggcttgggctttgaccctgagatgcagaatagaccaacccaaaaattcagtgggggctggcggatgcgtgtgtccctcgcaagagccctgttcatggaacccacacttctcatgctggacgagccgacgaacaatctggatatcgagtcgatagatgcactgggagaggccattaacgaatacaagggggctgtgattgttgttagtcacgatgcccggctaattacggaaactaattgccaactgtgggtggttgaagagcagagtgtctcacaaatcgatggagactttgaggattacaagcgggaagtcttggaggccctcggagaagtaatggttagtaggcctcgagaatag

SEQ ID NO: 180081 - DNA, 1599 bp, Artificial Sequence
  Description of Artificial Sequence: Synthetic coding sequence
atgcccaaggcccccaagcagcagccccccgagcccgagtggatcggggatggagagtctaccagtcccagcgataaggttgtgaaaaaaggcaagaaggacaagaagatcaaaaagaccttttttgaagagctggcggtggaggataaacaggctggcgaggaagaaaaggtgctgaaagagaaggaacaacagcagcaacagcagcaacagcagcaaaaaaaaaagagggacaccagaaagggcaggaggaagaaggacgtagacgatgatggcgaagaaaaggaactgatggagagactgaagaagctcagcgtaccaacttctgacgaggaagacgaggtccccgcccccaagcctaggggcggaaagaaaactaaaggcggcaatgtattcgcggcacttatccaggatcaaagtgaagaggaggaggaggaggagaagcaccctcctaaacccgccaagcccgagaagaataggatcaacaaagcggtctcagaagagcagcaaccagccctgaaagggaagaagggaaaggaggagaagagtaaggggaaggctaagccacagaacaagttcgccgctctggataatgaggaggaagacaaagaagaagagatcataaaggagaaagaacccccaaagcagggaaaagagaaggccaagaaggcagagcaagggagcgaagaggagggggaaggagaggaggaggaagaagaagggggcgagtccaaagcggatgacccttacgctcatcttagcaaaaaagagaaaaaaaagctgaaaaaacagatggaatacgagaggcaagtcgcctcattgaaggctgctaacgcagcggagaatgatttctccgtatcccaagccgagatgtctagcaggcaggccatgctcgaaaatgccagcgacattaaactcgaaaaatttagcatctccgcccacgggaaggagctcttcgtaaacgcagatctgtatatcgtggctggtaggaggtatggtcttgtggggcccaacggaaagggtaaaacgacccttcttaaacatatagccaatagggctctcagtatccctccaaacatcgatgtcttgctgtgtgagcaggaagtggtcgccgatgagacgcctgctgttcaggcagtgcttcgcgatgacaccgctgctgagcggctcgagaaggtgtacgaagagctgcgggctactggggccgctgcagcagaggccaaggcaagacgcatcctcgccggcctcggtttcgaccccgaaatgcaaaaccgtcccacacagaagtttagcggtgggtggcgaatgcgcgtgtctcttgctcgggcgctgtttatggaaccgacactgctgatgctcgatgagccaacgaacaacctggatatcgaatccatcgatgccctcggcgaggccataaatgagtataaaggcgcagtcatcgtcgtatcacacgatgccaggctgatcactgagacaaactgccagctatgggtcgtagaagagcagtctgtctcccagatcgatggggactttgaagactacaaaagagaagtgttggaagccctcggggaggtcatggtgtcacggcctagggaatag

SEQ ID NO: 180082 - DNA, 1599 bp, Artificial Sequence
  Description of Artificial Sequence: Synthetic coding sequence
atgcccaaggcccccaagcagcagccccccgagcccgagtggatcggcgatggggagagcaccagcccatccgacaaggtggtcaagaaagggaagaaggacaaaaagatcaaaaagacatttttcgaggagctggctgttgaggacaagcaggctggagaggaagagaaggtgctcaaagagaaagaacagcagcagcaacaacagcaacagcagcagaagaagaaaagagatactcgtaagggccggagaaagaaagatgtggatgacgatggcgaagagaaagaactcatggagaggctgaagaaattgtccgtgcctacatctgacgaggaagacgaggttccggctcctaaacccagaggcgggaagaaaacaaagggaggtaatgtgttcgcagcccttattcaggaccagtcagaagaggaggaggaggaggagaagcaccctcccaagcccgccaagcccgagaagaacaggattaataaggctgtgagtgaggagcagcagccagccctaaagggcaagaaaggcaaggaagaaaagtcaaaaggcaaggcgaagccacagaacaagttcgccgccctggataatgaagaggaggacaaggaagaagaaatcattaaagagaaggagccaccaaaacaggggaaagaaaaagcaaaaaaagcagaacaaggatcggaagaagaaggagaaggggaggaagaggaagaggaagggggggagagcaaagctgacgacccttatgctcatctgtccaaaaaagagaagaaaaaactaaagaaacaaatggagtatgaacgccaagtggcgtcattgaaagccgctaacgctgcggagaatgacttctccgtgagccaggcagagatgtcaagtcgacaagcgatgttggaaaacgcgtccgatattaagttggaaaagtttagcatctccgcccacggcaaagagcttttcgtgaatgcggacttgtacattgtagccgggcggcgttacgggctcgttggacccaatggcaagggcaagaccacactcctgaaacacatcgctaacagggccctgtccattccgccaaatattgacgtgttgctctgtgagcaggaggtggttgctgatgagacccctgccgttcaggccgtgctaagagatgacaccgctgcggagcgtcttgagaaagtgtatgaggagttgagagctacaggcgcggctgccgccgaagcaaaggcaaggaggatactggccggcttgggctttgacccagagatgcaaaaccgaccaacccaaaaattttcgggtgggtggcgaatgagggtgtcactagctcgagcactgtttatggagccgaccctcttaatgctggatgaaccgacaaataatttggatatcgagagtatcgatgccctcggagaggctattaatgaatacaagggcgctgttatcgtagtatctcatgatgcacgactcatcactgagaccaattgtcaactgtgggttgtggaggaacaatctgtcagtcagatcgacggcgacttcgaagattacaagcgggaagtgctggaggctctgggagaggtgatggtctctcgaccaagagagtag

SEQ ID NO: 180083 - DNA, 1602 bp, Artificial Sequence
  Description of Artificial Sequence: Synthetic coding sequence
atgcccaaggcccccaagcagcagccccccgagcccgagtggatcggagatggcgagtccacttcacccagtgataaagtcgtgaagaagggcaagaaagataaaaaaattaaaaagacctttttcgaggaacttgccgtggaggacaaacaggctggagaagaggagaaagtgctgaaggagaaggagcagcagcaacagcagcaacagcagcagcagcagaaaaagaagcgggacacgcggaaaggacgtagaaagaaagacgtggatgatgacggtgaggaaaaggaactgatggagcgactcaagaagttgtccgtgcctacctctgacgaagaagacgaggtcccggctcccaagcctagggggggcaaaaagaccaagggaggtaacgttttcgctgctctgattcaggatcagagtgaagaggaggaggaagaagaaaagcacccacctaagcctgcgaaacctgaaaagaataggatcaacaaggctgtctctgaagagcaacaaccagctttgaaagggaagaaaggtaaagaggagaaatccaaggggaaggccaagcctcagaacaaatttgcagccctggacaatgaggaagaggataaagaagaagaaataatcaaggagaaagaacctcctaagcagggtaaagagaaagctaagaaggcggagcaaggatctgaggaggaaggggagggcgaggaagaagaggaggaggggggcgagtctaaggctgacgacccctatgcccacttgagcaagaaggagaagaagaagcttaagaagcagatggagtatgagcgccaagtcgcgtcccttaaggcggctaacgccgcagaaaacgatttttcagtatcacaggccgagatgtcaagtcggcaggcgatgctggagaatgcaagcgacattaagcttgaaaaattctcaataagtgcccatgggaaggagctgttcgtgaacgccgacctgtatatcgtggccggcagaaggtatggactcgtcggcccaaacggcaaaggtaaaaccacactcctgaaacacattgcaaatagggcgcttagtatccctccaaatattgacgtactactgtgcgagcaggaggtcgtggcagacgagaccccggcggttcaggccgtgttgagagacgatacagcagccgaaaggcttgaaaaggtgtacgaggagttgcgcgcgacaggcgcagccgccgccgaagctaaggcacggcggatactagcagggctgggctttgatccagaaatgcagaatagacccactcaaaagttttctggcggatggcgaatgagagtgtcactggcacgagctctcttcatggaaccaacactcctcatgctggatgagcctacgaacaatcttgatatagaatctattgacgcgctgggcgaggccatcaacgagtacaagggcgccgttatcgtggtgtcccatgacgcccgcttgatcactgaaaccaattgtcaattgtgggtcgtcgaagagcagtcagtcagccagatcgatggtgacttcgaagattacaaacgggaggtcttagaggcccttggagaggtgatggtgagcagaccaagagagtag

SEQ ID NO: 180084 - DNA, 1515 bp, Artificial Sequence
  Description of Artificial Sequence: Synthetic coding sequence
atggacctgatccccaacttcgccatggagacctgggtgctggtggccaccagtttggtcctgctgtatatttatggcacccactcgcataagttgttcaagaagcttggaatccctggacctactcctctcccctttttgggcacaatacttttttacctgcggggcctgtggaactttgatcgagagtgcaatgagaagtacggggaaatgtggggcctgtacgaaggccagcagcctatgctggtaatcatggatcctgacatgatcaagaccgtgttggtgaaagaatgctattcagtatttactaatcagatgcccctcggccccatgggatttctcaaaagcgctttgtcgttcgccgaagacgaggagtggaagcgcataaggaccctgctgtctcctgccttcacctcggtgaagtttaaagaaatggttccaattataagccagtgtggggacatgctggtgcgttcactgcgccaggaggctgagaactctaaatctatcaacctcaaggacttcttcggcgcttacacaatggacgtaataacgggaacactgtttggggtgaatctcgactcactgaacaacccacaggatccctttttaaagaatatgaagaagctcctcaagctcgatttcttggatcccttcctactgctgattagcctgtttcccttcctgactcctgtcttcgaggcactgaacatcggcctgttcccaaaggatgtcactcattttttaaagaactctatagaacgaatgaaggaatctagactcaaggacaaacagaagcacagggtggatttttttcagcagatgattgattctcaaaactctaaggaaaccaaatcacacaaggccctgtccgacttagagctggtggctcagtcgatcatcatcatattcgccgcatacgacacgacttctacaacactccctttcattatgtacgagctcgcaactcacccggatgtccaacagaaactgcaggaggagatagacgcagtcctccctaataaggctccagtgacatacgatgcattggttcagatggagtaccttgacatggtggtaaatgagactctgaggttgttcccggtggttagtcgcgttacaagagtctgcaaaaaagacattgaaatcaacggcgtcttcatccctaaagggctggcagtcatggtaccaatctatgccttacatcatgacccaaagtactggacagagccagaaaagttttgtcccgaatctcgctttagcaagaaaaacaaggactccatcgacctgtatagatatattcccttcggtgccgggcctcgcaattgcattggaatgagatttgcactgaccaacatcaaacttgccgtgatcagagcattacaaaatttttcgtttaaaccttgcaaggagacccagatccccctcaagctagacaatctgcctattctccaaccagaaaaacccatagttctgaaggtgcatcttagggatgggattactagcggcccttag

SEQ ID NO: 180085 - DNA, 1872 bp, Artificial Sequence
  Description of Artificial Sequence: Synthetic coding sequence
atgcccagcgacctggccaagaagaaggccgccaagaagaaggaggctgctaaggcacgccagcgaccaaggaaggggcatgaggagaacggagatgtggtaacggagccacaagtggcagaaaaaaacgaggccaacgggcgcgagactacagaggtggacctcctgaccaaggagctggaagacttcgaaatgaagaaggccgctgctagagccgtgaccggggttttggccagccaccctaatagcaccgatgtacacattataaatctttccttaaccttccacggtcaagagctgttgtcggacaccaagctggagttgaattcaggaaggaggtatggcctcattggtctaaatggaattggcaaatccatgctgttgtccgccataggaaaaagagaggtgcctattccagaacacattgacatataccatctgacgcgagaaatgccaccctcagataagactcctctgcactgtgtcatggaagtggacacggaacgcgccatgctcgaaaaagaggccgagaggctggcccatgaagatgctgaatgcgagaagctcatggaactgtatgagcgcctggaagaattggacgccgataaggctgaaatgcgtgctagtcgcatcctgcatggtctgggatttaccccagccatgcagcgtaagaaactgaaggacttcagcggaggttggaggatgcgcgtggctctggcccgtgccttgttcattagacctttcatgttgctcctcgatgagccaaccaaccacctggacctggatgcttgcgtgtggttagaggaagagctcaagaccttcaaaagaatactggtgttagtgtcgcactctcaggactttttgaatggggtctgtacgaacattattcatatgcacaacaagaagctgaaatattatactggcaactatgaccaatatgttaaaacgcgactcgaacttgaggaaaaccagatgaagaggttccactgggagcaggatcaaattgcccacatgaagaactatatcgccagattcgggcatggttcagccaaactggcaagacaagcccagagcaaagaaaaaacacttcagaagatgatggcgtccggactgaccgagagagttgtgtccgataagactctgagcttctacttccccccttgcggcaagattcccccccctgtgataatggtgcagaatgtttccttcaaatacacaaaggatggcccctgtatatacaacaacctggagttcggcattgatctcgacaccagggtggcactggtaggacctaatggcgccgggaaatcaacactgcttaagctcctgacaggagaactactacccacagacggcatgattcgtaagcattctcacgtgaaaatagggcgctaccaccaacatctgcaggagcagttggatttagacctgtctcccctcgaatatatgatgaaatgctatccggaaattaaagaaaaggaagagatgcgcaaaattattggccgatacggtttgacagggaagcagcaagtgagtcccatacgcaatctgagtgacggccagaagtgtcgggtgtgcctcgcctggctggcatggcagaatccacatatgctgttcctggacgagccaacaaaccacctcgacatcgagactatcgacgctctggcagacgcaatcaatgagtttgagggcggaatgatgctggtcagtcatgattttcgcttgatccagcaggtggcccaagagatctgggtctgtgagaagcagactatcaccaagtggcccggcgatatactggcgtacaaggagcacctgaaaagtaagctggtcgacgaagaacctcagctcactaaacggacccacaatgtttag

SEQ ID NO: 180086 - DNA, 723 bp, Artificial Sequence
  Description of Artificial Sequence: Synthetic coding sequence
atgcccagcgacctggccaagaagaaggccgccaagaagaaggaggccgccaaagcgagacagaggcctcgaaagggccatgaggagaacggagacgtcgtgaccgagccacaggtcgctgagaagaacgaggccaacggaagggaaaccactgaagtcgacctgctgacaaaagagcttgaagactttgaaatgaagaaagctgccgcaagggctgttacaggggtccttgcctcccaccccaacagtaccgacgtgcacatcattaacctgtcgctgaccttccatggacaggaactcctgtccgacacgaagttggagttgaactcaggacggcggtacggactcatcgggttgaatggcattggcaaatcaatgctgctgtctgccatagggaagagagaagtcccgattccagagcatattgacatctaccacttgaccagggagatgccccccagcgacaaaaccccgctgcattgtgttatggaggtggatacggagagagctatgctcgaaaaggaagctgagcggctcgcgcatgaagacgctgagtgcgagaaactgatggaactctatgaacgcttagaggagctcgatgccgataaagctgagatgagagcgtctagaatcctacacggcttgggctttacaccagcaatgcagcggaaaaagctaaaagacttcagtgggggttggcggatgagagtggccctggcctag

SEQ ID NO: 180087 - DNA, 867 bp, Artificial Sequence
  Description of Artificial Sequence: Synthetic coding sequence
atgcccagcgacctggccaagaagaaggccgccaagaagaaggaggcggccaaggcgcgccagcgtcctcgcaaggggcatgaggagaacggggacgtggtgacagagccccaggtggccgagaagaacgaagccaatggccgggagaccacggaggttgacctgctcaccaaagaactggaagacttcgagatgaagaaggcagcagcacgagccgtgaccggagtgctcgcgtcgcaccctaactcaacagatgtccacataattaatttgtctctcactttccacggccaagagttacttagcgacacaaagctcgaactcaatagcggccggaggtacggactgatcggtcttaacggcattgggaagtctatgctgctgagcgccattggaaagcgtgaagtccctatacctgagcatatcgatatctaccacctcactcgcgagatgcccccaagcgataagacgccactccactgcgtgatggaagttgacaccgagcgagcaatgttagagaaggaggctgagcggttggctcacgaggatgctgaatgtgaaaaactgatggaactctatgagcggctcgaggagctagacgcagacaaggccgagatgcgcgccagcaggatacttcacggactcgggttcaccccagccatgcaaagaaaaaagctgaaagacttttcagggggatggcgaatgagggtcgcgctggcacgagcgctcttcatacgccccttcatgctgctgcttgacgagccaactaaccatttggaccttgatgcgtgtgtatggcttgaggaggaattgaagaccttcaaaagaatactcgttttggtttcccattcccaggatttcctgtag

SEQ ID NO: 180088 - DNA, 2361 bp, Artificial Sequence
  Description of Artificial Sequence: Synthetic coding sequence
atggtgcggcggggctggagcgtgtgcaccgccatcctgctggccagactctggtgcctggtccccacccataccttcctctctgaatatcccgaggctgccgaatatcctcatccaggatgggtctactggctgcagatggccgtggcacccggtcacctacgcgcatgggtcatgaggaacaacgttactaccaatatcccgagcgctttttcgggcactctgacacacgaggagaaggcagtgctcacagtgttcaccggaaccgctactgcagtacacgtgcaggtggcagcactggcttcagcaaagctggaatctagcgtctttgttacggattgtgttagctgcaagattgagaacgtttgcgacagtgcactccaagggaaaagagtgcccatgtcaggcctacagggttcctccattgtaattatgccaccatctaatcggcctctgaaggcaagcgccgcgtcttgcacctggtcggtgcaagtgcagggggggccgcatcacttgggagtggtcgccatcagtggcaaggtgttaagcgctgctcatggcgctggcagagcctacggatgggggttcccaggcgatccaatggaagagggctataaaacactcctgaaaggcatcagcggaaagttcaattccggagaactcgtcgccattatgggaccatccggggctggcaaatctacgctgatgaacatcctcgcaggctaccgcgagacgggaatgaagggcgctgtgttgatcaatgggctgccaagggacctacgatgttttaggaaggtgagctgttacatcatgcaggatgacatgcttctgccccacctgacggtccaggaagcaatgatggtttctgctcacctgaagctccaggaaaaggatgagggtcgccgagaaatggtcaaggagattctaacggcccttggacttttgtcatgcgccaatacccgcactggatcgctgtccggcggccagcggaagaggttggccatagccctcgagctggttaacaatcctcctgttatgttctttgatgagcccaccagcggcctggactcagcttcgtgcttccaagttgtttcccttatgaaggggctcgcccagggcgggagatccatcatctgtaccatccaccaaccctctgccaagctttttgagctttttgatcagctgtatgtgcttagccaggggcagtgcgtgtatcgcggtaaggtgtgtaatttggtcccctatctaagggatttgggcctgaattgtccaacataccacaacccagcagattttgtcatggaagtcgctagcggcgagtacggtgaccagaatagtagactggtgagagccgtcagagagggaatgtgtgactccgaccataagagggatctcggaggcgatgccgaggtgaaccctttcctgtggcatcggccaagtgaagaggtgaaacaaacaaaaaggctaaagggattgcgaaaggacagttctagtatggagggttgccactccttttcggcatcatgccttactcagttttgtattctgtttaagagaacctttctgagcatcatgagagatagtgtcctgacccatttgcggatcactagccatatcgggattgggctgctcataggtctactgtacctgggcattggcaatgaggcgaagaaagtactttctaactctggatttttatttttttctatgcttttccttatgtttgctgcccttatgcccaccgttttaacgtttccattggagatgggggtatttctgagggagcaccttaactactggtattccttgaaagcctattatctcgccaaaaccatggcagacgtgccttttcagattatgtttcccgtagcctattgttccattgtatattggatgacctcccagccttccgatgccgtgcgctttgtgctattcgctgccttgggcacaatgacatctctggttgcccaatccttagggctgctcatcggggcggccagtaccagtttacaggtagcgacctttgtcggtccagtgacagccatcccagtactgcttttcagtggctttttcgtgagttttgataccatcccaacatatctccagtggatgagctacatctcttatgtccgttacgggttcgaaggtgtgattctctcaatctatggcttggatcgggaggatctccactgcgatatcgatgaaacctgtcactttcagaagtctgaggccattctgagagaactggacgtggagaacgcgaaactatatctggatttcatcgtgctgggaatctttttcattagtctgcgcctcatagcttacttcgtgctgcgatataagataagagccgaacgctag

SEQ ID NO: 180089 - DNA, 2034 bp, Artificial Sequence
  Description of Artificial Sequence: Synthetic coding sequence
atgcggatcagcctgccccgggcccccgagcgggacggcggcgtgagtgcctcttctcttctggataccgtgacaaatgcatcatcttactcagccgagatgactgagcctaagtcagtctgcgtgtcagtcgatgaggtggtgtccagcaatatggaagctacagagactgatttgctgaatggccatctgaagaaggtcgacaacaatctgacagaggcgcagaggtttagctcgctgccccggcgtgcggccgtgaatatcgaatttcgcgatctttcctacagcgtccctgaggggccttggtggagaaagaaaggctacaaaactttgctcaagggtatcagcgggaaatttaattctggagagctggttgctattatgggccctagcggcgccggcaagagtactctgatgaatatccttgctggatacagagaaaccggaatgaaaggcgccgttcttatcaatggactgccccgagaccttcgctgcttcaggaaggtgagttgctacattatgcaagacgacatgctgttacctcacctaactgtccaggaagcgatgatggtgtccgcccatctgaagttacaggaaaaggatgaaggtcgcagggaaatggtaaaggagatactcacagccctgggtctgctcagctgcgccaatacccggactggctctctctccggagggcaaagaaaaagactcgcaatagcactggagctggtaaataaccccccagtgatgtttttcgacgagcccaccagcggacttgattctgctagctgtttccaggtggtaagtctcatgaaaggactcgcccagggcggcagatccatcatatgtaccattcatcagccctctgctaaactgttcgaactttttgaccagctttacgtcctgagtcagggccagtgcgtctaccgaggtaaggtgtgcaatttggtgccatacctcagagaccttggccttaactgcccaacctaccacaacccagcagacttcgtgatggaggtggccagcggtgaatatggggatcagaattcgaggctggtcagagcagtacgggaggggatgtgtgactctgaccataagagggatctgggaggggacgctgaggtgaatccttttctgtggcaccggccgtctgaggaggacagcagttctatggaaggctgccactcgttttcggcatcttgcctcactcaattttgtatcctttttaaacgcaccttcctgagcatcatgagagactctgtcctgacccacttacgcattacgtcgcatattggtatcggcctgttgattggtctcctgtacttggggattggcaacgaggccaaaaaggtgctatccaacagtggattcctgtttttctccatgctcttcctgatgtttgctgcactcatgccgaccgttctgacctttcctctggagatgggcgtgttcttacgcgagcacttgaactactggtattcacttaaagcctattatctggcgaagactatggccgatgtccctttccaaattatgtttccggtagcttattgttctatcgtctattggatgactagccaaccaagtgacgccgttcggttcgtgctgtttgccgccctgggcaccatgacttccctcgttgcccagtctctcgggctgttgatcggagccgctagcacaagcctacaagtcgctacattcgtgggtcccgttactgcaatccccgtcctccttttttccggctttttcgtctccttcgacactatacccacttacttgcaatggatgagttatatttcatacgtgcggtatggtttcgagggagtcatcctgtcgatatacggactcgaccgcgaagaccttcactgcgatatcgacgagacatgccatttccagaaatcagaagctatccttcgggagctggatgtagaaaatgccaaactctacctggatttcattgtcctggggattttttttatcagcttacggctgatcgcttattttgtcctgcgttacaaaattagggccgagcgttag

SEQ ID NO: 180090 - DNA, 1992 bp, Artificial Sequence
  Description of Artificial Sequence: Synthetic coding sequence
atgatcatgcggctgccccagccccacggcaccaacgccagcagctatagtgcagagatgactgaacccaagtccgtctgtgtcagcgtggacgaggtagttagcagcaatatggaagccacagagacagaccttcttaatgggcatctcaaaaaggtagataacaacctgacagaggcgcaaagattcagtagcctccctagaagggcagccgttaacattgaattccgggatttgtcctattccgtacccgaaggcccttggtggaggaagaagggatataagaccctcctgaagggaatttccggaaaatttaattctggggagttggtggctatcatgggcccgagtggggctggaaagtcaacgctgatgaacatccttgccggttacagagagacaggaatgaagggggccgtgctgattaacggtctacctcgggacctcaggtgctttcgtaaggtcagctgttatattatgcaagatgacatgctgctgccccatctgacagtgcaagaggccatgatggtttctgctcatctgaagctgcaggagaaggacgaagggcggcgcgagatggtgaaggagatcctgaccgccctcgggttactttcctgtgcgaataccagaacgggttcactgagcggcggccaacggaaacgccttgccatcgcgttggagcttgtgaacaaccctcccgtgatgttctttgacgagcccacctccgggctcgacagcgcatcttgttttcaggtcgtttccctcatgaagggccttgcccagggaggtcgcagtatcatttgcaccatccaccagcccagcgcgaagctcttcgaactctttgaccagctctacgtcctgtctcaaggccaatgtgtctacagaggaaaagtctgtaacctagtcccatatctacgcgacctcggcctgaattgccctacttaccataacccagctgattttgtgatggaggtcgcttccggggaatacggggaccagaatagtagactggtccgcgccgttagggaagggatgtgcgatagcgatcacaagcgcgatctcggcggcgatgcggaagtaaacccctttctctggcatagaccaagtgaggaagatagctcaagtatggaaggttgccactccttctccgcctcgtgtctgactcagttctgtatcttatttaagaggaccttcctgtccatcatgcgggatagcgtccttactcatttgcgaatcacttctcatatcggaattggtctcctcatcggcctgctataccttggcattggaaacgaggctaagaaggtactgagcaactcaggctttctcttctttagcatgttgttcctgatgtttgccgctttgatgcctaccgtgctaaccttccccctggagatgggggtttttctgcgagagcatctgaactattggtacagcctgaaggcttattatctggccaaaaccatggccgacgttccatttcagattatgttcccagtggcttactgctcgatcgtatattggatgacttcacagccgtccgacgcagtgcgatttgtcctgtttgctgcgttaggaaccatgacctcacttgtcgcccagtcactcgggctgttgattggcgccgcaagcacctcccttcaagtggctacgtttgtaggaccagtgactgccatcccagtcttgctgttctcaggtttttttgtgagtttcgacactatccctacgtacttgcagtggatgtcgtatataagctatgtaaggtatggatttgaaggcgttatcctcagtatttacggactcgaccgggaggacttgcactgcgacattgatgaaacctgccactttcagaagtctgaagcaatcctgagggagctcgacgtagaaaacgctaagttgtacctggatttcatcgtgttagggatttttttcatttcgctaaggctgattgcttacttcgttcttaggtataaaatccgggcggaacgttag

SEQ ID NO: 180091 - DNA, 2037 bp, Artificial Sequence
  Description of Artificial Sequence: Synthetic coding sequence
atggcctgcctgatggccgccttcagcgtgggcaccgccatgaacgcaagctcctacagcgctgagatgacagaaccaaagtccgtgtgtgtcagtgtagacgaagttgtcagttccaacatggaagccacggaaactgacctgctgaacggacatctgaaaaaagttgacaataacctcacagaggctcaaaggtttagttctcttcctcgccgggccgctgttaacatagaatttagagatttgtcctattccgtcccagaaggaccgtggtggaggaaaaaaggttacaaaacccttctgaaagggatcagcggaaaattcaatagcggggagttagtcgccatcatgggacccagtggcgccgggaagtcaactttaatgaacattctggcaggctacagggagaccgggatgaaaggagcagtcctgattaatggcctgccacgtgacctgaggtgttttcggaaagtcagctgctatatcatgcaggacgatatgctattacctcatctgacggtccaggaggcaatgatggtttctgcacacctcaaattgcaagaaaaggatgaggggagaagggagatggtgaaagagatacttactgccctcggactgctgagttgtgccaacacacgtactgggtccttgagcggaggtcagaggaagcggctggcgattgctttggagctggttaacaatccaccagtcatgttcttcgatgagccaacctccggacttgattcagcgtcatgctttcaggttgtctcactcatgaaaggactggcccaaggggggcgatcgatcatttgcactatccatcagccaagcgctaagctgttcgagcttttcgatcagctatacgtgctttcacagggccaatgcgtgtaccgagggaaggtgtgcaatctcgtcccatacttacgtgacttagggctgaattgccccacatatcataatcccgctgattttgtcatggaggtggcttccggcgagtatggagaccagaatagtcggctggtgcgggccgtgagggagggaatgtgtgactctgaccacaaacgggacctcggcggtgacgctgaggtgaatccattcctgtggcacagacctagcgaggaagtgaagcagacaaaaagactaaaggggctgcgcaaagacagcagctccatggaggggtgccattcattttctgctagctgtctgacccaattttgcattttgttcaaaaggacattcctgtccatcatgagggatagtgtcttgacccacctgaggataacatcgcatataggtatcggtcttctgatcggcctactatacctgggtatcgggaatgaggccaaaaaagtgctgagtaatagtggatttctttttttctctatgttgttcctgatgtttgccgctctaatgcccacagtactaacctttcccttggagatgggagtcttcctccgcgagcacttgaactactggtattccctgaaagcttactacttggcaaaaacaatggcagatgtgccctttcagatcatgtttcccgtggcctattgctccatcgtgtactggatgacctcccagccttctgacgccgtgcgattcgtgctgttcgccgcccttgggacaatgaccagtctggtggcacagagcctggggctgctgatcggagctgcgtccacgtccttacaagtggctacttttgtcggccctgtcactgccatccctgtcctgctcttctccggattcttcgtttctttcgatactattcccacttacctgcagtggatgagttacatctcgtacgtacgctacgggtttgaaggggtgattcttagtatctacggtttagatcgggaagacttgcactgcgatattgacgagacctgccattttcagaaaagtgaggccatactgcgggaactagatgtggagaacgccaagctgtatctcgattttattgttctggggatctttttcatcagcttgcgtctcattgcatacttcgtgctgcgttataagatacgagcagagcgttag

SEQ ID NO: 180092 - DNA, 2475 bp, Artificial Sequence
  Description of Artificial Sequence: Synthetic coding sequence
atgctggccgtgcagcagaccgagcacctgcccgcctgcccccccgctcgcagatggtcttccaacttttgtcctgagagtactgagggaggtccaagcctccttggtctgcgtgatatggtaagacgggggtggagtgtttgcacggcgatactgttggctagactatggtgtctcgttcctacacataccttcctgagcgaatatcccgaggcagcggaatacccacaccccggatgggtctactggctccagatggccgtagcgcccggccacttacgggcctgggttatgcgcaacaacgttacaaccaacatccctagcgcattcagtggaacactgacacacgaagaaaaagcggtgttgaccgtgttcaccgggacggcaaccgcggttcatgtgcaggttgctgcactcgcatccgccaagctggaaagctctgtattcgtcacggattgcgtctcatgcaaaattgaaaacgtctgtgactccgctttacaaggcaagcgagtgcccatgtccggattgcagggatcttctatagtgattatgcctccatcaaaccggccgctggccagcgcggcctcctgtacctggagtgtccaggtccagggcggacctcatcaccttggtgtcgtggcaatctccggcaaagtactgtccgcagcccacggagccggccgagcttacgggtggggcttccctggcgaccccatggaggagggatacaagacactgctgaagggcatttcgggaaagtttaattccggcgaacttgtggcaataatgggtccatctggagccggtaaatccactttaatgaatatattggcgggctatcgcgagaccggtatgaaaggcgccgtcttaattaatggcctgccaagggacttgcgctgtttccgcaaagtgtcttgttacattatgcaagatgacatgctgctcccacacctcactgtgcaagaagccatgatggtaagcgcccacttgaagctgcaggagaaggacgaggggagaagagagatggtcaaggaaattttaacggcccttggcctgctgtcatgcgcaaacaccaggaccggatccctatctggcggccagcgcaagagactggccatagcacttgagctcgtgaacaatcctcctgtcatgttcttcgacgagcccactagcggtttggattccgcgtcttgttttcaggtcgtttctctgatgaagggacttgcccagggcggtaggtccattatttgcaccatccatcagccaagcgcaaaattgtttgagctgttcgaccaactctatgtccttagtcagggtcaatgcgtttataggggcaaggtttgcaacctggttccttatctgcgcgatttgggcttaaactgtccgacttaccataatccggccgactttgtcatggaggtggccagcggagaatatggggaccagaattcacgactcgtgagagccgtgagggaaggaatgtgtgactccgaccacaaaagagatctgggcggggacgcagaggtgaacccctttctgtggcaccgccctagcgaggaagtgaagcagacgaagagattaaagggactgagaaaggactccagctcaatggaaggctgccactccttttccgccagctgtctgactcagttttgcattttattcaagcggacctttttgtccattatgcgggattctgttcttacacatctgcgtattacctcccacatcggtattggtctgctgatcggcttgctttacctgggaattggtaatgaagccaagaaggtgctgagtaactctggattcctgttcttcagcatgctgtttctgatgtttgccgcattaatgcctaccgtgcttaccttccccctggagatgggagtgttcctcagggagcacctgaattattggtattctctcaaagcatattatttagccaaaacgatggcagatgtgccctttcagatcatgttcccagttgcctattgcagtattgtgtattggatgacctcgcagccttccgacgcggtgaggttcgtcctattcgcagcgctggggactatgacgtccctggtggctcaatctttagggctcctgatcggggcagccagcacttctctccaggtggcaacatttgtcggccccgtcacggctattcccgttctgcttttttctggtttcttcgtgtccttcgacactattcctacttacctgcaatggatgagttacatcagttacgttaggtatggcttcgaaggcgtgattctatctatctacggccttgaccgcgaagacctgcactgtgatattgacgaaacttgtcacttccaaaaatcagaagctatcctgagggagctggacgtggaaaacgctaagctctacctggatttcattgtcttgggaatttttttcatttctttacgcctaatagcatattttgtccttagatacaagattcgtgcagagcgatag

SEQ ID NO: 180093 - DNA, 2001 bp, Artificial Sequence
  Description of Artificial Sequence: Synthetic coding sequence
atggcctgcctgatggccgccttcagcgtgggcaccgccatgaacgcctcatcctattccgcagaaatgacagaacccaaatcggtgtgcgttagtgtcgacgaggtcgtgagttcaaacatggaagccactgagaccgacctgttgaacggacatctgaagaaggtggacaacaacctgaccgaggcccaaagattttcctccctaccacggcgcgctgctgtcaacattgaattccgggatctttcctacagcgttcccgagggaccctggtggcgcaaaaagggctataagacactgctgaaagggatttcgggtaaattcaattccggggaacttgtggccattatgggaccctcaggcgccggcaaatcaacccttatgaatatccttgcaggctacagagagaccggtatgaagggggcagtcctaataaacggcctgcctagagatctgaggtgtttccggaaggtgtcttgttacatcatgcaggatgatatgttattaccacacctgaccgtccaggaagccatgatggtttccgcgcacctgaagctccaggaaaaagatgagggccgcagggagatggtgaaggaaatcctcacagccctgggactgctgtcatgcgccaacactagaacaggtagcctgagcgggggtcaaagaaagagactggcaattgctctcgagttggtgaacaatccccccgtgatgttctttgacgagcctacctcggggttagattctgcttcttgttttcaggtagtaagcctgatgaagggactggcgcaggggggtcggtccattatttgtacaatccaccagccatcggccaagctcttcgaactgttcgatcagttgtatgtcctgagccaggggcagtgcgtgtatcgcgggaaagtgtgtaatctggtcccttacctgcgagacctgggtcttaattgccccacctaccataaccccgccgactttgtcatggaggttgcctccggcgaatacggggaccagaactcaaggttagtaagggctgttcgagagggaatgtgcgacagtgaccacaaacgcgacctcggcggagatgccgaagtgaaccccttcttgtggcatagacctagcgaggaagattcgtccagcatggaaggatgtcatagcttttcggcaagctgtctcacgcagttctgtatccttttcaaacggaccttcctgtctatcatgcgcgatagcgttttaacacacttgcgcataacgtcgcatatcgggatcgggttgctgattggcctgttataccttggaattggaaatgaggcaaagaaggtgctttccaatagcggctttctgttttttagcatgcttttcctgatgttcgcagccttaatgcccaccgtgttgacgttccccctggagatgggagtcttcctgcgagaacatctaaattattggtattcacttaaagcttactatctggcaaaaactatggctgacgtaccatttcaaattatgttcccggttgcgtattgttccatagtgtactggatgacctctcagccatcagatgccgtgcgattcgtgctttttgccgctcttggtaccatgacatccctggtggctcagtctttgggcttactcattggagcggcctctacctctcttcaggtggccactttcgtagggccggtgaccgctatccctgtactgcttttcagcggcttctttgtgtcttttgacactatccccacctacttgcagtggatgtcctacatttcctatgttaggtatggctttgagggtgtgatcctaagcatatatggtctcgatcgggaggatctacactgcgatatcgacgagacctgccatttccagaaaagcgaggccatcctgagagaacttgatgtggaaaacgccaagctttacttggatttcatcgtcttggggatcttctttattagcctgcgtcttattgcatatttcgtgttgagatacaagatacgcgccgaacgttag

SEQ ID NO: 180094 - DNA, 2007 bp, Artificial Sequence
  Description of Artificial Sequence: Synthetic coding sequence
atgctgggcacccagggctggaccaagcagcggaagccctgcccccagaatgcttcttcgtattctgccgagatgactgagccgaagagcgtctgcgtgagcgtagacgaggttgttagctccaatatggaagcgacggagactgatttgctcaacgggcacctgaaaaaagttgacaataatctaaccgaagcacagagattctcatccctacctaggcgggccgccgtaaatattgagtttcgagacctgtcttactcggtgcctgaaggcccctggtggcgcaaaaaaggttataagacactgctgaagggaatatcagggaagtttaacagcggcgagctcgttgctataatgggaccttctggggcaggcaagtcaacgttgatgaatattctcgccggctaccgcgaaaccggtatgaaaggggccgtgttaataaatggactcccccgggatctgcgttgttttagaaaggtgtcatgttatattatgcaagatgatatgcttttaccacacctgactgtgcaagaggctatgatggtgagcgctcacctgaaactacaggagaaggacgagggcagacgagagatggtgaaagaaatcctgactgccttgggtctcctgtcttgcgctaataccaggaccgggtctctgagcggcggccaaagaaaacgactcgcgatcgctttggagctcgtgaacaaccctcctgttatgtttttcgacgagccgaccagcggcctagatagtgcgtcctgtttccaagtggtgagcctcatgaaaggactagcccaggggggccggagtattatctgtaccatccaccagcctagcgccaagctcttcgagctgttcgatcagttatacgtcctctcccagggtcagtgtgtgtataggggtaaggtctgcaatctggtaccatatctccgagaccttgggttgaattgtccgacctaccataatcctgccgattttgtgatggaggtagcttccggcgaatatggcgaccagaacagtagactcgttcgcgctgttcgcgagggcatgtgcgacagcgaccataaacgggatctgggtggagacgcagaagtgaatcctttcttgtggcatcgacctagcgaagaagattcttcctccatggaaggttgtcatagtttcagcgcaagttgtttgactcagttttgcatacttttcaaacgcaccttcctttctataatgagagactctgttcttacacacttgcgaattacaagccacatcggtatcggacttctgattggactcctgtacctgggcattgggaatgaggcaaagaaggtcctaagcaactcagggtttctctttttcagtatgttgttcctgatgttcgcggcactgatgcccaccgttttaacattcccgttggaaatgggcgtgttcttgagggaacacttgaactattggtatagtttgaaagcctattacttggccaagaccatggccgatgtcccgttccagataatgttcccagtcgcttattgttccatagtgtactggatgacctctcagcctagcgacgcagtacggtttgttcttttcgcggccttgggcaccatgacctcactggtcgctcagtctttgggtctgctgattggtgccgcatcaacctccttgcaggtcgcgacattcgtcggtcctgtcaccgcaattccagtgctgctcttttctggcttttttgtatcatttgatactattccaacctacttgcagtggatgtcatacatctcttatgtgcgttacggctttgagggcgtcattttgtctatttacggattggaccgagaagaccttcactgcgatattgatgagacatgccactttcagaaatccgaggcaatcctccgcgagctcgacgtagagaatgccaagttatacctggatttcattgtgctcggtatctttttcatcagccttcgcctgatagcttatttcgtccttcgatataaaattagagccgagcggtag

SEQ ID NO: 180095 - DNA, 1941 bp, Artificial Sequence
  Description of Artificial Sequence: Synthetic coding sequence
atggccgagaaggccctggaggccgtgggctgcggcctgggccccggggccgtggccatggcagtgacactggaggatggtgcagagccgcccgtgttgacgacccacctcaagaaggtggaaaatcacattactgaggcccagagattcagccatttaccaaagcggagcgccgtcgacatcgagtttgtggagctctcttattctgtaagagaaggcccttgttggcggaagcgcggctataaaaccctgctcaagtgcctttctggaaagttttgcaggcgggaattaataggcatcatgggaccctctggggcagggaagtccaccttcatgaacatcctggcaggatacagggaatccgggatgaagggccagatcctagtaaacggaagacctcgagagctccgcaccttcaggaagatgtcatgttacatcatgcaggatgatatgctgctgcctcacctgactgtcttggaggccatgatggtgtcagccaaccttaagctgagcgagaagcaggaggtgaaaaaagagctggtgaccgagatcctcacagctctcggactcatgagctgtagccacacgaggacagcgcttttgagcggagggcagcgcaagaggctggccattgccttggaattagtgaacaacccacctgtcatgttcttcgacgagccaacgagcggcctcgacagtgcaagttgcttccaagttgtcagcctgatgaaaagtctcgcgcaaggcggcagaaccatcatttgcaccatccaccagccctccgccaagttgtttgaaatgtttgataagctgtatatcctgtcccagggacagtgtatatttaagggagtcgtcactaatctgattccctacttaaaggggctggggttgcattgcccaacttatcacaaccccgcggatttcattattgaggtggctagcggggagtatggagacctgaatccaatgttgttcagagccgtgcagaacgggctgtgcgcgatggctgagaagaagtcgtcacctgaaaagaacgaagtccctgcaccatgtccaccctgccctccggaagtggatcctatcgaatcacacacattcgcaacgtccacactaacccaattttgtatcctgtttaagcgcacgttcctctctatcctgcgggacacagtgctgacgcatctgaggtttatgagtcatgtcgtgattggcgtcctgattgggctattgtacctgcacatcggcgatgacgccagtaaggtcttcaacaataccggatgcctctttttcagtatgctttttcttatgtttgcagcattaatgccaacggtgctgacgttccccctggaaatggctgtttttatgcgggaacacctgaactactggtacagtctcaaagcatactacctcgcgaagacaatggctgacgtgccttttcaggtagtctgccccgttgtgtactgtagcatcgtgtactggatgacaggccaacccgcggagacttcccgttttctgctcttttcagctctggccaccgcgactgcactagttgctcaatctctggggctccttatcggggccgcctccaactctctccaagttgcgaccttcgtgggccccgtcacggctatcccagttctgctgttcagcggcttttttgtgtcattcaagaccatacccacttatcttcagtggagtagttatctctcatatgtgagatacggattcgagggagtgatcttaacaatctacggcatggaaagaggggaccttacgtgtttagaggagaggtgccccttcagggagccccagagtatccttagggcgctggatgtggaggatgccaagctctatatggacttcttagttctcgggatcttttttttggctcttagactgctagcctacctcgttctgcggtaccgtgtgaagtctgaaaggtag

SEQ ID NO: 180096 - DNA, 1941 bp, Artificial Sequence
  Description of Artificial Sequence: Synthetic coding sequence
atggccgagaaggccctggaggccgtgggctgcggcctgggccccggcgcagtggcgatggctgtcactttggaggacggcgcagagcctcctgttttaactacccatctgaaaaaggttgagaatcacattaccgaggcccaacgcttctcccatttgccaaaacgctctgccgttgatattgagttcgtagaactgtcctatagcgtgcgtgaaggcccctgttggaggaaacggggctacaaaactctgttaaagtgcctatccggaaagttttgtaggagagagcttataggaattatgggccccagtggggccggaaagtccacctttatgaatattctggctggctacagagagagcggaatgaagggccaaattctggtgaatggtagaccaagggagctgagaacctttcgcaagatgagctgctacataatgcaggatgacatgctgctgccacacctgacggtgctggaggcaatgatggtatctgccaatctgaagctcagtgaaaagcaagaggtgaagaaagaactggttaccgagattctcaccgctttgggtctcatgtcttgcagccacacccgcacagcgctactgtcaggggggcagcggaaaaggctcgccattgccctggagctggtcaacaatcccccagtaatgtttttcgatgaacccacatctggactagattccgcgtcttgtttccaggtcgtgagtcttatgaaaagccttgcccagggcggcaggacaattatttgcactattcaccagccgtcggcgaagttattcgaaatgttcgacaagttatacattctctcgcagggccagtgtattttcaagggagtggtgaccaacctgatcccctatttgaaaggactgggattgcactgtcccacttatcacaacccagctgactttatcatcgaagtggcatccggggagtacggggatctgaaccctatgctattccgagccgtccagaacgggctgtgtgccatggccgagaagaaaagcagcccagaaaagaatgaagtcccagctccttgtcctccttgtccccctgaggtagatcccatagagtcacacacgtttgcaactagcaccttaacgcagttttgtatactgtttaagagaaccttcctgtcaattctgcgcgacacagtactgacacacctgcggtttatgagccacgtggtaattggggtcctgattggcctcctatacctgcatatcggcgacgatgcttctaaggtattcaacaacacgggctgcctcttctttagtatgttgttccttatgtttgccgcattgatgcccaccgtgctgacattcccacttgagatggcagttttcatgcgagagcacctcaactactggtacagcttgaaggcctactatctggcaaaaactatggctgatgtaccttttcaagtggtctgcccagtcgtctattgctcaatcgtatactggatgaccggacagcccgcggagacatcccggttcttacttttttctgctctggccactgccacagcactggtggcacaatctttgggcctgttgataggcgctgcctctaacagcctccaggtcgccacattcgtggggcctgtgacagctattccagtcttactgtttagcggattttttgtgagtttcaagacaatccctacatacctgcagtggtcatcctacctgagctacgtcaggtacgggtttgagggcgtgattctaaccatttatggaatggagaggggcgaccttacatgcctggaagagcggtgcccgttccgcgaaccacagagcattttacgcgccctcgatgtggaggacgcaaaactgtacatggatttcttggtcctgggtatcttctttctggccttacgcctgttggcctacctcgtgctgaggtatcgtgtaaaaagcgagcgatag

SEQ ID NO: 180097 - DNA, 1941 bp, Artificial Sequence
  Description of Artificial Sequence: Synthetic coding sequence
atggccgagaaggccctggaggccgtgggctgcggcctgggccccggggctgtcgcaatggccgtcactttggaggacggagctgagccgcccgtgctcactacgcacctgaagaaagtggagaatcacataaccgaagctcagcgctttagccacttaccaaagcgtagtgccgtagacatcgagtttgtcgaactttcttatagtgtgagggagggaccctgctggcggaagagaggttataagacgcttttgaagtgcctctccgggaagttctgccgcagggagttaatcggtataatggggccatctggagcaggcaagtccacattcatgaatatcttagcgggttaccgtgaatcgggtatgaaaggccaaattctggttaacggccggccacgcgaactccgtacctttcggaaaatgagttgttatatcatgcaggatgacatgttgttgcctcatctgacagttttagaggctatgatggtctctgcaaacctcaagctcagtgaaaagcaagaggtaaaaaaggagttggtaaccgaaatcctcaccgctctgggactaatgtcctgctcccacacgcgcaccgctcttctgtctggcggccagcggaagagactggccatcgctttggagttagtcaacaatccccctgttatgttttttgacgagccgacatcgggcctcgactctgcctcttgttttcaagtggtaagtctgatgaagtcccttgcacaagggggcaggacaattatttgtactatccatcagccaagcgctaagttgtttgaaatgttcgataagttgtacatccttagccagggccagtgcatcttcaaaggggtagtgaccaacttaattccctaccttaaagggctgggactccattgtcctacttaccacaatcccgccgactttattatcgaggtggccagcggcgagtatggtgatttgaaccctatgctctttcgcgctgtacagaatggactctgcgcgatggccgaaaaaaagtctagtcccgagaaaaacgaggtacctgcaccctgtccaccctgtcccccagaagtggatcccatagagtcacataccttcgccaccagcaccttgactcagttctgcattctgtttaagagaaccttcctgtccatcttgagggatacggttttgacacacctacgattcatgtcccacgttgtaatcggagtgctcataggccttctgtacctgcacattggagatgatgcttctaaggtgtttaacaatactgggtgtctattcttcagcatgttgttcctgatgttcgctgcccttatgcccaccgtgcttacattccccctggagatggccgtgttcatgagagagcacctcaactactggtacagcctgaaagcatactatttggccaagaccatggctgacgttcctttccaagttgtatgccccgtggtgtactgtagtatcgtgtattggatgaccggccagcccgcagaaacatcaaggtttctgctgttttccgctctcgcaaccgccacagctctggttgcccagtctctggggttactgatcggagccgctagcaattcactgcaagtcgcaactttcgtaggtcccgtcaccgccattcccgtgttgctgttctcaggtttcttcgtctcttttaagaccattccgacctatctccaatggagttcatacttaagctatgtacggtatggcttcgaaggcgtcattctgaccatctacggaatggaacgcggagacttgacatgcctggaagagagatgtcctttccgagaaccccagtccatcctgcgggccctcgatgtggaagatgctaagctgtacatggacttcttggttctgggtatcttctttcttgcgctgaggctactggcttatcttgttctaagatacagagtgaagtccgagcggtag

SEQ ID NO: 180098 - DNA, 1956 bp, Artificial Sequence
  Description of Artificial Sequence: Synthetic coding sequence
atgggcgacctgagcagcctgacccccggcggcagcatgggcctgcaagtaaatcgtggttcccagtctagtctggagggcgctcctgccacggcgcccgagcctcatagtcttggaattttgcacgctagctattctgtgtctcaccgcgtgcggccttggtgggatataacttcatgccgtcagcaatggacccgccaaatcctgaaagacgtatctctgtatgttgaatctgggcagatcatgtgcatcttggggagcagcggaagcggcaagacaacgctgttagatgccatgagtgggcggcttggccgcgccggaacattccttggggaagtttatgttaatgggcgcgcgctccgtcgtgagcaatttcaagattgctttagttacgtgctgcagagcgatacattgctgtcctcactgacggtgcgggagaccctgcattataccgcattactggctatccgcagaggaaatcctgggagctttcaaaagaaggtggaggcagtgatggcggaactcagtctgagtcacgtcgccgaccgcctgattggtaattattctcttggcggtatcagtaccggagaaaggcgccgagttagcattgctgcccagctcctgcaggatccgaaggtcatgttgtttgatgaacccacaactggattggactgtatgacagccaaccagatcgtggttctgctggtggaattagcccgcagaaataggatcgtcgtgttgaccatccatcaacctagatccgagctgtttcagctgtttgacaaaattgcgatactgtcattcggggagttgatcttttgtggcactccagcagagatgcttgactttttcaacgactgtggctacccgtgccccgagcacagcaacccgtttgatttctacatggatctcacctccgttgatacacaaagcaaagagagagagatcgaaacgagcaagcgtgtgcagatgatcgaaagcgcgtacaagaaaagcgctatctgtcataaaaccctgaaaaacattgagcgtatgaaacatcttaagaccctgcccatggtgccctttaaaactaaggactcaccgggtgtgtttagcaagctcggagtcctgttacggagagtgacgcgtaacctggtgaggaataaactggctgtcatcacaagactgctacaaaatcttatcatgggactgttcctgctcttttttgtgctccgcgtgcggagcaatgtgctaaaaggggctatacaggaccgggtgggcttactttatcagtttgtgggcgcaacaccgtataccggcatgctgaacgccgtaaatctgtttccagtgctgagagcagtgtctgaccaagaaagccaggacggactctatcagaaatggcagatgatgctcgcctacgcccttcacgtgttgcccttcagcgtggtggcaactatgattttctcttccgtgtgttattggacactggggttgcaccctgaagtcgcaagatttggatatttctccgctgctttactggctccgcatctgatcggcgaatttctgacactcgttctgttaggtattgttcagaaccctaatattgttaactccgtggtcgcactgctcagcattgccggggtgctcgtcgggtccggatttcttcgcaatatacaggaaatgcccattcccttcaagattatctcctacttcaccttccagaaatattgcagcgagatactcgtggtaaatgagttctatggcctgaatttcacttgtgggtcttccaatgtaagcgtcaccaccaaccccatgtgcgccttcacccagggcattcagttcatcgaaaaaacatgtccaggcgcaacatcccgtttcactatgaattttctcattttgtattccttcatccctgcgctggttatcttgggcatcgtggtattcaagattagggatcatttaatttctcggtag

SEQ ID NO: 180099 - DNA, 1443 bp, Artificial Sequence
  Description of Artificial Sequence: Synthetic coding sequence
atgtgcatcctgggcagcagcggcagcggcaagaccaccctgctggacgccatgtcaggacggctcggaagagccggcaccttccttggggaggtgtacgtcaatggacgcgctctccgtagagagcagttccaggattgtttcagctacgtactacagtctgatactctgctgtctagtctcactgtcagggagaccctccattatacggctctgctagcaattaggcggggcaatccaggttctttccagaaaaaggtagaggcagtgatggcagagctctctctcagccacgtggcggatcggttgatcggaaactacagtcttggcggcatatctaccggtgagcgtcggcgcgtttccattgccgcccagcttctacaagatcctatggacttgaccagcgtggatacacagagcaaggagagggagatcgaaaccagcaagcgggtacagatgatcgaatctgcttacaaaaaaagcgcaatttgccacaagacactcaaaaacatcgaacgtatgaagcacctgaagaccctgcctatggtgccgtttaagactaaggatagcccgggggtgttttcaaagttaggggtgctccttagacgggttactcgaaacctggtccgcaacaagcttgcagtgattactcgtctgctccaaaatctcataatggggctgtttctactgttttttgtcctccgggtgcggagcaatgttttgaagggggcaattcaggatcgcgtggggctcctgtatcaattcgtaggagctaccccttacacaggaatgctgaatgccgtgaacctgtttcccgttcttcgcgccgtgagcgaccaagaatcccaagacggcctctatcagaagtggcaaatgatgctggcatacgccctgcacgtgctaccgtttagcgtggtggcaacaatgatcttttcaagcgtctgttactggacactcggtctgcacccagaggttgctaggttcgggtatttctcagctgccctcttggcaccacatctaatcggagaattcctgactctggtgctgctcgggatagtgcagaaccctaatatcgttaacagcgtggtggctctcctgagcattgctggtgttcttgtgggctccggatttctaagaaacattcaggaaatgcctataccattcaagattatttcctactttaccttccaaaagtattgctctgagatacttgtggtgaacgaattctatgggttgaactttacctgtggcagtagtaacgtatcggttaccaccaatcccatgtgcgcctttacgcagggaatccagtttatagaaaagacatgcccgggagctacctcgcgcttcacaatgaacttcctgattttatactccttcattccagcactggtcattttgggaattgtagtgttcaagatccgggaccacctgattagcagatag

SEQ ID NO: 180100 - DNA, 771 bp, Artificial Sequence
  Description of Artificial Sequence: Synthetic coding sequence
atgggcctgttcctgctgttcttcgtgctgcgggtgcggagcaacgtcctcaaaggtgccatccaagaccgggtgggcctgctttatcaattcgtgggagcaacaccgtacacaggaatgctcaacgctgtgaacttgttcccggttctgagagcagtgtccgaccaggagtcccaagacggactgtaccagaagtggcaaatgatgttggcctacgcactgcacgtactgccgttcagcgtcgtcgccacgatgatttttagtagtgtctgctactggactctgggactgcatcccgaggtggcgaggttcgggtatttctcggccgctttgctcgccccccatctaattggggagttccttaccctggtactgcttggaattgtgcagaatccaaatatcgttaactccgtggtggcactgctgtccatcgccggcgtgctagtggggagtggcttcttgagaaacatccaagagatgcccatcccatttaaaattatcagttactttacatttcaaaaatactgttcagaaattctcgtggtgaacgaattttacggactgaattttacctgcggatcttcaaacgtaagcgttactaccaaccctatgtgcgccttcacgcaggggatccagttcatcgaaaagacttgtcctggagcaacatccagattcactatgaattttctgattctgtattctttcatccccgctctggtcatcttgggaattgtggttttcaagatccgggaccacctgataagcagatag

SEQ ID NO: 180101 - DNA, 2022 bp, Artificial Sequence
  Description of Artificial Sequence: Synthetic coding sequence
atggccggcaaggccgccgaggagcggggcctgcccaagggcgccacaccgcaggacacatccggcctccaggacagactgttcagcagcgaatctgacaatagcttgtattttacctattccggccagccaaataccctggaagtccgggacctgaactaccaggttgatctagcatctcaggtcccttggtttgagcagctcgcacagtttaagatgccctggacttccccctcctgccagaactcttgcgagctgggcatacaaaatcttagctttaaagtccggagcgggcaaatgctcgccatcatcggcagttccgggtgtggcagagcaagtctgctcgacgtgattacaggccgtggccatgggggaaagattaagagcggtcagatctggatcaacgggcaaccgagctcccctcagttagtcagaaagtgcgttgcccatgtacgacagcacaatcaactactgcccaatctgacagtccgcgaaaccttggctttcattgctcagatgagactaccgcgcacctttagccaggcgcagagagacaagagagtggaggacgtgatcgctgaactacggctgagacagtgcgcagataccagggtcggcaatatgtatgtgcgcggtctctcaggcggagagcgccggcgtgttagtattggagtgcaactgttatggaaccctggcattctcatactggatgaaccaacttctggactagacagctttacagcccataatctggtaaagacactgtctcggctcgccaaaggcaaccgcttagttcttatcagcctacatcaaccaagatcagacattttcaggttgtttgatctggttctgctcatgacttccggcacacccatttacctgggggccgcccaacatatggtccaatactttaccgcgattggatacccttgtccccgttactctaatcccgccgacttctacgtcgacctgacatcgatcgaccgcagaagccgtgagcaggagctagctacacgcgagaaggcccagtcactagctgctcttttcctggaaaaggtcagagatttagacgatttcttgtggaaggctgaaacaaaggatctggacgaagatacgtgcgtcgagagttccgtgacacctcttgacaccaactgtctgcctagccctaccaagatgcccggtgccgtgcagcagttcactaccctcatccgccgccagatttcaaacgacttcagggacctgccaaccttgctaatccatggagcggaggcctgcctgatgtctatgacgattggttttctgtatttcggacatgggagtatacaactgagcttcatggacacagcggccctgctctttatgataggggcgttaattccgttcaatgttattctggacgtcataagcaaatgctacagcgagagggcaatgctctactacgaattagaggatggcctgtacaccaccggcccttattttttcgcgaagattctgggagagctgcccgaacattgcgcctatatcatcatctatggtatgcccacttactggcttgcaaacttgcgcccaggactgcagcccttcttactccattttctactggtctggctggtggtgttttgctgccggattatggccttggccgccgctgcgctgcttcctacttttcacatggcttccttcttttcaaatgctctctacaatagtttttacctcgctggcggtttcatgatcaacctgagcagtctctggacagttccggcttggatatctaaagtctcctttttgcgatggtgctttgaggggctcatgaaaatacagttttctcggaggacttacaaaatgccgctgggcaaccttactatcgcggtatctggggataagatcctgagcgttatggagttagacagctatcctctgtacgccatatatctcatagtcattgggctgagcggagggttcatggtgctatactacgtcagtctacgtttcattaagcagaaacctagccaggattggtag

SEQ ID NO: 180102 - DNA, 2376 bp, Artificial Sequence
  Description of Artificial Sequence: Synthetic coding sequence
atggccggcaccagcgcccccggcagcaagcggcggagcgagccccccgcgccacgcccaggccctccccctggaacaggccatccccctagcaaacgggcacgcggtttttcggcggctgccgccccggatcccgacgacccattcggcgctcatggagattttacagcagacgatctggaagagctggacacgcttgcctcccaggctctgtcccagtgcccggctgccgcccgggacgtgagttctgatcataaggtccatcgactgctggatggtatgagcaaaaatcctagcggaaaaaatcgggagactgtgccaattaaagacaattttgagttggaggttctccaggcacagtataaagaattaaaggagaaaatgaaagttatggaagaggaggttctcatcaaaaatggcgagatcaagatactaagggatagtctccatcagacagagtcagtgctggaagagcagagaaggagccactttctactcgaacaggaaaaaacccaggccttgagcgacaaagagaaagaattctctaagaaattgcagtctctgcagtccgagttgcagttcaaagacgctgagatgaacgaactccgcaccaagctgcagacaagtgagcgggctaacaagctggcagctccctccgtcagtcacgtcagcccccgtaagaatccgtccgtggtgatcaagcccgaggcctgttccccccagttcggcaagacatcctttcccaccaaagagtccttttccgccaacatgtctctgccccatccctgtcagacagagagtggctataagcctctggttggtcgggaagattccaagcctcactcgctcaggggagattcaataaaacaggaagaggcacaaaagtcctttgtggactcatggcgccaacgctccaacacacagggctccatcctcatcaacctgcttctgaaacagccgttgatccctggttccagcctgagcctctgtcatctcctgtcgtcatcgtctgaatcccccgcaggcacacctctacagccaccaggctttggatctaccttggccgggatgagtggactgcggacgacgggatcatacgacggcagcttcagtcttagtgctctacgcgaggctcagaatctggcattcacagggttgaatttggttgccaggaatgaatgcagtcgcgacggcgaccctgctgaaggcggccgccgagcttttccattgtgtcagctccccggggctgtgcactttctcccactggtccagttcttcatcggcctccactgtcaggctttacaagacctggctgccgctaaacgcagcggcgctcccggagacagtcccactcatagctcttgcgtgtcatcaggtgtcgaaactaatcccgaagactctgtgtgtatattggagggattcagtgtgacagctctgtcaatcctccaacacctcgtatgtcactctggcgctgtggtcagcctgctgctgagcggggtgggcgctgattcggcagccggagagggaaacaggtcacttgtacaccgactctcggacggggacatgacgagtgccctccggggtgtagccgacgatcaggggcagcacccactgctcaaaatgcttctccaccttctggcgttctcatccgctgcgactgggcacttgcaggcttcagtgctcacgcaatgtttaaaggtactggtcaagttggccgaaaacacatcctgcgattttctgcctaggttccagtgcgtatttcaagtgttgccaaagtgtctgtcaccagagacaccactcccctcagttcttttagccgtagagctcttgagtttgctggcagaccatgatcagctcgctcctcagctttgttctcacagtgaggggtgcctccttctattactgtatatgtacatcacaagcagacccgacagggtggctctagaaacccagtggcttcagttggagcaggaagtggtctggctcctggcaaagctgggggtgcagtccccattgccccccgtgactggctcaaattgccaatgcaacgtcgaagtggtccgagctctgaccgtaatgctgcaccgacagtggttgaccgtgcggagagcaggaggaccccctcgtacggaccagcaacgtcggactgtccggtgtctccgggacactgtcttactcctccatggattgtctcagaaagacaaactgttcatgatgcattgcgtggaggtgctacatcaattcgaccaggtgatgcctggggtgtccatgctgatcaggggcctgccagacgtcactgattgtgaagaagctgcactggatgatctctgtgcggccgagacagacgttgaggaccccgaggtagaatgcggttag

SEQ ID NO: 180103 - DNA, 2295 bp, Artificial Sequence
  Description of Artificial Sequence: Synthetic coding sequence
atggccggcaccagcgcccccggcagcaagcggcggagcgagccccccgcacctaggcctggtccacctcccggaaccgggcatcctccttccaaaagggcaagaggcttctctgcagctgccgccccagatcctgatgacccatttggagcccacggagatttcactgcagatgacctggaggagctcgatactctggcttctcaggcactcagccaatgcccggcagctgctcgagacgtcagttcagaccataaggttcacagactgctggatggcatgagcaaaaacccgtctggcaagaatagggaaaccgtgccaatcaaggataatttcgagttggaggtactgcaggcccagtacaaggagctaaaggagaagatgaaggtgatggaagaagaagtgctgattaagaatggggaaatcaagatactacgcgattccctgcaccaaacggaaagcgtgctggaggaacagcgacgatctcacttcttactcgaacaggaaaagacgcaggcgctgagtgataaggagaaggagttttctaaaaagttacagagtcttcaatcagagctacagtttaaggacgctgaaatgaacgaactgaggactaagcttcaaacatcagaacgtgccaataagctagccgcacccagtgttagccatgtgtccccaaggaagaacccgtcagtggtaataaagcccgaggcctgtagtccacagtttggaaaaacttccttcccgacaaaagagagtttctccgccaatatgagcctcccgcacccatgtcaaaccgaaagtggctacaaaccactggtcggacgtgaagatagtaagccccactcactgcggggcgacagtatcaagcaggaggaagcacagaaaagttttgtggattcatggcggcagaggagtaatactcagggaagcatattgattaatctcttgctcaagcaacctttgatccctggcagcagtctgtctctgtgccacctgctgtcaagttcgtcagaatcccctgctggaacccctctgcagcctcccggctttggcagcaccctggcgggtatgtcaggcttacgcaccacaggcagttatgacggttcattttctttatctgctctcagggaagcacaaaacctggcattcaccggcctgaacttagtggcaaggaatgagtgttcaagggacggtgatcccgcagaaggcggcagaagggcatttccattgtgccagctccccggagctgtgcattttcttcctctggtccagttttttatcggtcttcactgccaggcactgcaagatttggccgctgcaaagcgatcaggtgcccccggagactcacctacgcatagctcttgtgtgtccagcggggtcgaaacgaatcccgaggatagcgtttgtatcctcgagggtttttcagttacagccctttcaattctacagcacctggtttgccacagtggcgccgtggtttccctactgctatcaggagtgggcgccgatagcgccgctggcgaggggaaccggagcttggtacatagactgtctgacggggatatgacttccgcactgaggggggttgcagacgaccaaggacagcatcctttactaaaaatgctgctgcatttgctggcattcagttcagcagccaccggccaccttcaggcttcggtcctcacacagtgcctgaaagttcttgttaaattagcagagaatacctcatgcgattttctgccaagattccagtgcgtgtttcaggtgctgcccaaatgcttaagcccagaaactcctttaccctcagtgttactggcggtggaactgttgagcctgctggcggatcacgaccagttggcaccgcagctgtgttcacactccgaagggtgcctattgctcctcttgtatatgtacatcacaagccgcccagaccgggttgccctagagacacagtggttgcagcttgaacaggaagtcgtgagagcccttactgtgatgctgcatagacagtggctaaccgtccggagagccggtggaccacctaggacagatcagcagagacggactgtaaggtgtctgagagacacagtgttattgctacacggcttgagtcaaaaagataaactgttcatgatgcattgtgttgaggttcttcatcagttcgatcaggtaatgcccggcgtgagtatgctaattcgtggcctgcctgatgtaaccgactgcgaagaggccgccctggacgacctgtgtgctgcagaaactgacgttgaagatccagaagttgaatgcgggtag

SEQ ID NO: 180104 - DNA, 1995 bp, Artificial Sequence
  Description of Artificial Sequence: Synthetic coding sequence
atgaaggtgatggaggaggaggtgctgatcaagaacggcgagatcaaaattctgcgagatagtctccaccaaacagagtctgttctggaagagcaacgacgaagccacttcctgctggagcaggaaaagacccaggcactctccgataaggagaaggaattcagcaagaagctgcagtctctgcagtccgaactccagttcaaggacgctgagatgaatgagctccgaacaaagctgcagaccagcgagagagcaaacaagctggcggccccttctgttagccatgtatcccctaggaaaaacccctccgttgtcatcaagcccgaagcatgctccccacagttcgggaagacatcgttccctaccaaggagagtttcagtgctaacatgagcttgccccacccttgtcagaccgaaagcggatataaacccctcgttggtagggaagatagtaagccccactcactacgcggcgatagtataaagcaagaggaagctcagaagagctttgtggactcatggagacagcggtctaatactcaaggttctatcttgatcaatctacttctgaagcagcccttgatccctgggagttcactcagcctgtgccacttgttatcgtctagtagcgagagtcccgcagggacccctttgcagccccctggcttcggatcgacgttggctggcatgtcagggctgcggaccacaggatcatatgatggctctttttcattgagcgccctccgcgaagcccagaatttggcattcaccgggctcaacctcgtcgccagaaacgaatgctcccgagacggcgaccccgccgagggggggcgcagggctttccccctgtgtcagttaccaggggcagtacactttctccctctggtccaatttttcatcggcctccattgccaggccctgcaggatttggccgctgcaaagagatctggtgccccaggagactctccgacgcattccagctgcgtgtcatccggggtggagacaaatcccgaagacagcgtatgcatacttgaaggtttctcagtgaccgccctgagcatcttgcaacatttggtgtgccactccggggcagttgtgtccctcctgcttagcggagtcggtgctgactctgccgccggagaagggaatcggagtctggtccataggctgtctgatggtgatatgacttcggccctgcgaggcgtagcagatgaccaaggacagcaccccctccttaagatgctgcttcacctcctggctttttcctccgccgcgacgggtcacttgcaggctagtgtgctgactcaatgtctaaaggttctggtcaagttggcagagaacacttcatgcgactttctgcctcggttccaatgtgtctttcaagtgttacccaagtgtctgagtccggaaacgccattgccatctgttctgctggccgttgagttgctatcacttctggctgaccatgaccagctcgccccgcagctttgctctcactcagaaggttgtctgcttctgctgttatatatgtatatcaccagcagaccggaccgggtagctctcgaaacccagtggctgcagctcgagcaggaggtggtgtggttgttggctaaacttggcgtccagtctccactaccccctgtgactggaagcaactgccaatgcaatgtggaagtggtgcgcgcgttgactgtgatgctccaccgccagtggttaaccgtgcggagagccgggggcccaccaaggacagaccagcaacggagaacagttcggtgtcttcgggacactgtgctgctcttacatggactgagccagaaggacaaactctttatgatgcactgcgtggaggtgctgcatcaattcgaccaagtaatgccaggagtgtctatgctaatccgggggcttcctgatgtaactgattgcgaggaggcggcgctcgacgatctctgcgccgccgagaccgatgttgaggaccccgaagtggagtgtggatag

SEQ ID NO: 180105 - DNA, 2097 bp, Artificial Sequence
  Description of Artificial Sequence: Synthetic coding sequence
atgagcaagaaccccagcggcaagaaccgggagaccgtgcccatcaaagacaactttgagctggaggttcttcaggcgcagtacaaggaacttaaagaaaaaatgaaagtaatggaggaggaggtgctaattaagaatggagagattaaaatactgagagatagcttgcatcagacagagagcgtgctggaggagcaacgccgtagccactttctgctggaacaggaaaagacgcaggctctttccgacaaggaaaaggagttttctaaaaagctgcagtcactgcagtctgagctgcagttcaaggacgccgaaatgaacgaactgcgcacaaagcttcagaccagcgaaagggccaataagttggcggcgccttctgtttctcacgttagtcctcgcaaaaacccttcggtagtcatcaaaccagaagcatgtagcccacagtttggcaaaacctcattccccaccaaggagagcttctcagcaaatatgagcctgccgcatccgtgccaaaccgagagcgggtacaagcccctggtgggcagggaggactcaaagccccactcactacgcggggatagcataaaacaggaggaagctcaaaaatcttttgttgattcttggcgacaacggtcaaacacacagggctcaattctgatcaatctgctcctgaaacagcccttaattccaggtagcagtctctccctgtgccatcttctgtcctcatcatccgagtctcccgctggaacgccactacaacctccaggcttcggctcaaccttagcaggaatgtcgggactgcgaacgactggctcgtacgatggcagctttagcctaagtgcattacgcgaagcacaaaacctggcatttacgggattgaacctagtcgcccgaaatgaatgttcgagggacggagatcccgcggagggcggccgtcgggctttccctctttgtcagctccctggggccgttcacttcctgcccctggtgcaattcttcatcggcctgcactgtcaggcactgcaggatcttgcagcagcgaaacgcagcggggccccaggcgacagcccaacccactccagctgcgtgtcctccggcgtggaaaccaatcccgaggacagcgtctgtatcctcgagggatttagtgttacagccctatctattctgcaacaccttgtgtgccatagcggcgccgtggtaagtcttctgctctccggtgtgggcgcagatagcgccgccggggaggggaatcggagtcttgtccacaggctgtcggatggagacatgactagcgccctgaggggcgttgccgacgaccagggccaacaccctctcctcaaaatgctgttacatttgctggctttctcttcagctgcaaccgggcatctgcaagcctccgttctgactcagtgccttaaagttctggtgaagctggccgagaatactagttgcgactttttgccacgctttcagtgtgtgttccaagtgctccctaaatgtttgtctcccgagacgcctttgccgagcgttttactagctgtggagctgttatctttactggcagatcacgaccagcttgcgccacagctgtgtagccactccgaggggtgtctcctgctcctgctctacatgtacatcacatcaaggccagatagggtagccttggagacgcaatggctacagctggaacaggaggtcgtttggctgcttgcgaaacttggggtccagtctcctctgccacctgtgactggtagcaactgccagtgcaatgtagaggtggtacgggccttgactgtaatgctgcatcggcaatggctaacagtgcggagagctggcgggccaccaagaacagatcagcaacgaaggacagtccgctgtctcagggacactgtcctgctgctccatggcctctctcagaaggataagctttttatgatgcattgtgtcgaagtcctccaccaattcgaccaggtgatgcccggggtctctatgctcatccgtgggctgcccgacgtgacagactgtgaggaggccgcgcttgatgatctgtgcgcggccgagactgacgtggaagatcctgaagtggagtgcggctag

SEQ ID NO: 180106 - DNA, 591 bp, Artificial Sequence
  Description of Artificial Sequence: Synthetic coding sequence
atgagcaagaaccccagcggcaagaaccgggagaccgtgcccatcaaggacaatttcgagctagaggtgttgcaggcccagtacaaggaacttaaagaaaagatgaaagtgatggaagaggaagtgctcattaaaaatggggagataaagatattgcgggacagtcttcatcagaccgaatccgtccttgaggagcagagaaggtcacactttctcctcgagcaagagaaaacccaggctctcagcgacaaagagaaggagtttagcaagaagctccagagcctgcaatctgagctacagtttaaggacgctgagatgaatgaactgaggacaaaactccagactagtgagagggccaataagctggccgctcccagcgtctctcacgtgtctccccgaaaaaaccccagtgtggttatcaaacctgaagcctgcagcccacaattcgggaaaacatcattccctactaaggaatcctttagcgcgaatatgtcgttgccacacccctgtcagacggaatccggatataagcccctcgtcggacgggaggactccaagcctcacagtctgcgcggcgattccatcaagtag

SEQ ID NO: 180107 - DNA, 141 bp, Artificial Sequence
  Description of Artificial Sequence: Synthetic coding sequence
atgagcaagaaccccagcggcaagaaccgggagaccgtgcccatcaaggacaattttgaactggaggtgcttcaggcgcaatacaaggagctgaaggagaaactctgcaagaaggctgatacgagctatcatcacctgtag

SEQ ID NO: 180108 - DNA, 1305 bp, Artificial Sequence
  Description of Artificial Sequence: Synthetic coding sequence
atgagcatcgagaagatctgggcccgggagatcctggacagccggggtaaccctacagtcgaggttgacctgtataccgcaaaaggactattcagagcggccgtgccctctggagcatccactggcatctacgaagctttggaattgagggatggagataaacagagatatctcggcaagggagtgcttaaagcggtggatcatattaactccacgattgcacccgcactgatttcgagtggactatccgtcgtggaacaggaaaaactggacaatctgatgttggagctggacgggacggaaaataaatccaagtttggggccaacgctatcctgggggttagcctagccgtatgtaaggctggtgccgcggaacgtgagcttcctctgtaccggcatatagctcagcttgctggaaactctgacctcatcctcccggtgcctgcattcaatgtgatcaatggtggctcccacgccgggaacaagctagcgatgcaagaattcatgatcctgccagttggggctgagagttttcgcgacgctatgaggctgggagccgaggtctaccacacattgaaaggagttatcaaggataagtatgggaaagacgccacgaacgttggggacgaaggcgggtttgccccaaatatactggaaaattccgaagccctcgaacttgtcaaggaggccattgacaaggccggctacactgagaagatcgtaatagggatggatgtagctgcatccgagttctacagggacggtaagtacgacttagattttaaatcaccaaccgatccatcacggtacattaccggggaccagttgggtgcgctgtaccaggattttgtgcgtgattatcctgtggttagcattgaggatccctttgaccaggacgactgggccgcttggtcaaaatttactgcgaatgttggtattcagattgttggcgacgacctgacggtgaccaacccaaagcgtatcgagcgcgcggtagaggagaaggcttgtaactgcctccttcttaaggtgaaccagataggttctgtcactgaggccattcaggcctgtaagctagctcaggagaacggatggggcgtgatggtctcacacaggtcaggggagaccgaagatactttcatcgccgaccttgtcgtcggtctttgtacaggccaaatcaagacaggtgcaccatgccgcagtgaaaggctggctaagtacaaccagctgatgcgtatcgaagaggaactcggtgacgaggcccggtttgctggacataacttcagaaatccttccgttctctag

SEQ ID NO: 180109 - DNA, 3573 bp, Artificial Sequence
  Description of Artificial Sequence: Synthetic coding sequence
atgaagacccggcagaacaaggacagcatgagcatgcggagcggcaggaaaaaagaagcgcctggaccccgcgaggagttacggtctcgggggcgggcaagccctggcggcgtgagcacaagtagctcagatggtaaagcggaaaagtcacgccaaactgccaagaaggcccgagtcgaagaggcctctaccccgaaagtaaacaaacagggacgtagcgaggagatttccgagagtgaaagtgaggagaccaacgcgccaaagaagacgaaaactgagcaggagctccccagacctcaaagcccatcggaccttgactcgctcgacggtcgctctctgaacgatgacggctcaagcgatcccagggacattgaccaggacaacaggagcacatcaccgtctatatactcgcctggatcagtggagaacgattcagactcatcttccggtctatcccagggacctgcgcgaccatatcatccaccccccctctttccaccctcccctcaaccccctgacagcactcctcgacagccagaagcctccttcgaaccccacccaagtgttacccctaccgggtatcatgcccctatggagccgccaacttctaggatgtttcaggctccacctggagcccctccaccgcatccgcagctctatcccggtggcaccggcggagttctttctggccctccaatggggcctaagggtgggggcgcggcatcttccgttggcggcccaaacgggggaaagcagcatcctcctcccaccacccccatcagcgtgtctagctcaggggctagcggagctccacccaccaaacctcccaccaccccagtaggcggaggtaatctgccaagcgcacctcctccagccaactttccccatgtcacacctaatctgcctccccctcccgccctgcggcccttgaacaacgcatccgccagccctccaggactaggtgcccagccattacccggccacctaccatccccccatgctatggggcagggcatgggagggctcccccctggacctgagaaaggcccgacattggccccaagcccacattcgctcccacctgcatccagcagcgcccctgcgcccccaatgagatttccctacagttcttcctcaagttcctcagctgccgcgtcctcaagcagcagctcgtcttcttcgtctgcttcacccttccctgccagtcaggccctacccagctatccgcattcctttccaccccctacatcactgtctgtgagcaaccagccacctaaatacacacagccttctttgccatcacaggccgtatggagtcagggcccccctcccccccctccttacgggagactactcgccaatagcaacgcacacccaggcccattccctccctctactggcgcacagtctaccgcccacccaccagtctccacccaccatcatcaccatcaacagcagcagcagcagcaacagcaacagcaacagcaacagcaacagcagcagcagcatcacggaaatagcggcccacccccaccgggcgcattccctcaccccctcgagggagggagctcccatcacgcccatccatacgctatgagcccaagtctgggttccctgagaccgtatccacccggtcccgctcatctgcctccaccccacagccaggtcagctacagtcaagccggacctaatggacctcccgtttccagctcatcaaacagcagctcatcaacatctcaaggttcatacccctgctcccatccatctcccagccagggccctcagggggccccctacccctttccccctgtgcctacagtgactacatcatcagctacactgtccaccgtgatagcaactgtagcctctagcccagccggatataagactgcaagccctccaggtccccccccatacggaaagcgcgcgccaagccctggcgcctacaagacagcaacgccaccggggtataagcctggaagcccaccgtcctttaggaccgggacgccccccgggtacagaggaacgagccctccagcggggcctgggacgttcaagccaggctcccccactgttggacctggaccgctacctccagctggaccctcgggcctgcctagcctccctcctccccccgctgcaccagcttccggaccgccactctcagccacccagataaagcaggagcccgctgaagagtacgagacccccgaaagccctgtaccgcctgcaaggagcccatctccccctccaaaagttgttgatgtcccaagtcacgccagtcaatcagcccggtttaataaacacctggaccgcggcttcaactcatgtgcccggagcgatttgtacttcgtcccattagagggctctaagctagctaagaagagagccgacctcgtcgaaaaggtgcgccgcgaagcagagcagcgtgcgcgggaggaaaaggagcgcgaaagagagcgggagagggagaaggagcgagagcgcgaaaaggagcgtgagttggaacgctccgtcaaactcgcgcaggaggggcgagccccagtcgaatgtccgtctcttggccccgtgccacaccgacccccctttgaacctggaagcgcagtggctaccgtgcctccttacttaggccccgacacacccgccctaaggactctgagtgagtatgctcgcccacacgtgatgtctcctggcaataggaatcaccccttctacgtacccctaggagcagtagatcccggcctcctcggatacaatgttcccgcactgtattcatccgaccctgcggccagagaaagagaacgggaggcccgagagagagatctgcgcgacagactcaaacctggtttcgaagtgaaaccctcggagctagagccccttcacggagtgccaggacccggcctcgacccttttccccggcacggaggtctggcgctgcaacccggcccccctggtctgcacccatttccgttccatccgtctctagggcccctggaaagggagcgattggctctggccgctgggcctgctttaaggccggatatgtcttacgcagaaaggctggctgccgagaggcagcacgcagaaagagtggccgcactgggcaatgatccgttagctcgcttacagatgctgaacgttacaccccatcaccatcagcactcacacattcattcccatctgcacctgcaccagcaggacgcaatacacgcagcctccgctagtgtgcacccattaatcgaccccctcgcatctgggagtcacttgacccgcatcccctaccctgccggaacactgccgaacccccttctacctcatcccctgcatgaaaatgaggtgttacgccaccagttattcgccgctccgtatcgggatcttcctgcgtccctcagcgctccaatgtccgcggcgcaccagctgcaggccatgcatgcccagtctgcagaactgcagagactggctctcgagcaacaacagtggctgcacgcccaccatcctttacattccgttccactacctgcccaggaggattattactcccatctgaagaaagaatccgataagcctttgtag

SEQ ID NO: 180110 - DNA, 3573 bp, Artificial Sequence
  Description of Artificial Sequence: Synthetic coding sequence
atgaagacccggcagaacaaggacagcatgagcatgcggagcggcaggaaaaaggaggctcctggtccccgggaggagttgcggagtcggggccgcgcctcaccagggggcgtgagcacttcttcctccgacggtaaagcagagaaaagcagacagacggcgaaaaaggcacgcgtagaggaggcgtccacacccaaagtgaacaaacagggtaggtcagaagagattagtgagtcagagagcgaggaaacaaacgcccctaaaaaaacgaagaccgagcaggagctgcctcggccacaaagcccctccgacctggactcgctggatggtcggtcccttaatgatgatgggagttcagatccccgggacatagaccaggacaacaggtctaccagtccaagtatctacagtccagggtcagtggagaatgatagcgacagtagctcaggactctctcagggtcctgcccgcccttaccaccccccgcccttgttcccccccagccctcagccaccggattcaaccccacgccagccagaggcctcattcgagcctcatccctccgtgacgcccaccggctatcacgcccctatggagccacccacgagtagaatgttccaggcaccgccaggggccccaccgccgcacccacagctgtaccctggcgggacaggcggggtcctgagtgggccacctatgggccctaagggcggaggagctgcaagttcagtgggaggccccaacggcggtaaacaacatccccctcccacgactccaatctcggtttcaagctctggggctagtggcgccccacccacaaagccacccactaccccagttggaggaggtaacctcccgtcggctccgcctccggccaatttccctcacgtcaccccaaacttgcctccccccccagctctgcggccccttaataatgcctcggcttctcctcctggtctcggagctcaacctctgcccggtcacctgccatccccgcatgctatgggccaaggaatgggtgggctgccccctggtcccgaaaaggggcctacactggctccaagcccacattctctaccaccagcttcatcgtctgcccccgctccccccatgaggttcccctactcctcaagcagcagctcgtctgccgccgctagttctagttcttcaagctcctcttcttccgcctcaccatttcccgcgagccaggccctgccaagttacccccattcatttccacctccaacaagcttgtccgtttcaaatcagccccccaaatacacccaaccttcactgccaagtcaggctgtgtggtcacaggggccgcccccccctcctccatatggaagacttctcgccaacagcaatgcccatcctggaccctttcctccgagcacaggagcacagagtactgcccatcctcccgtcagtactcaccaccatcaccatcagcaacaacagcagcagcaacagcagcaacagcagcagcagcaacaacaacaacaacaccatggaaattcaggtccacccccgcccggggcatttccacaccccctcgaaggcggatccagccatcacgcccatccgtatgcaatgtcgccatctcttgggtcattgcgtccttaccccccagggcctgcccacctacctcctcctcattcccaggtgagctattcacaagcagggccaaacggcccaccagtgtcatcctcgagtaattcttctagtagcacttcccagggctcctacccttgtagccacccaagtccaagtcagggaccccaaggtgctccttacccattcccacctgttccaactgtgactacttctagtgccaccctgagcaccgtcatagccaccgtcgcttcttcacctgccggatacaaaaccgcttctccacccggacccccgccctatggaaaacgggcccctagccccggggcctataagaccgcaacacctcccgggtataaaccggggtcaccaccttccttcagaactggcacaccaccaggttacagggggacatcacctcccgccgggcccggaacttttaagccaggaagccctactgtaggcccagggcccctaccacctgctggaccatccgggcttccttcactccctccaccgcctgctgctccggcctcaggaccaccgctaagtgccacccagattaaacaggagccggcggaagaatacgaaactcccgaaagccctgtgcccccagcccgttcccctagcccgccaccgaaggttgtggacgtgccctcccacgcttcccagagtgcccgttttaataagcatctggacagaggcttcaattcatgtgcccgatccgacctctactttgtgcctctcgagggttctaaactggccaagaaacgggccgacctggtcgagaaggtgagaagggaagctgagcagagagcacgggaggagaaggagagggagagggaacgcgagagggagaaggagagagaacgcgaaaaggagagggagctcgagcgcagcgtgaaattggctcaggagggtagggctccagtcgaatgtcccagcctcggtccagtgccccacaggcctccttttgagcctgggtcagcagttgcaactgtacccccttatctgggtccggacaccccagcgttgagaaccttatcagagtatgcccggccacacgtcatgagcccaggcaatagaaatcaccccttttatgtcccacttggtgctgtcgatcctggccttctcggttataacgtgccagcactttattcgtctgatcctgccgcccgcgaacgggagcgcgaagcccgggagagagacctgagggatcggctgaagcctggattcgaggttaaacctagcgagctggagcccttgcatggcgtacccggacctgggttggacccttttccgcgtcatggggggctcgcccttcagccgggtccccccgggttgcaccctttcccctttcacccttcattgggtcccttggagcgcgagagattagccctggctgccggcccagccctgcgacccgacatgtcttatgcagaacgtctcgccgcagaaaggcagcatgccgagcgggtcgccgctctcggcaatgacccattagctcggctccagatgctaaacgtaacacctcaccaccaccagcactctcacattcactcccacttgcacctacaccagcaggatgccattcatgcggcctctgcctcagtgcacccactaatcgaccccctcgcctctggttcccacctgacgaggattccatatccagctgggacgctccctaacccactgttgcctcaccccctccacgaaaatgaagttttgaggcaccaattgtttgccgccccttacagagacctccctgcttctctgagcgcgcccatgtcggccgctcaccagctgcaagccatgcacgcacagagtgccgaactgcaacgattagctttagagcagcagcagtggttacatgcccaccaccccctccatagcgtgcccctgcctgcacaggaagattactactcccatttgaagaaagaaagcgacaaacctttatag

SEQ ID NO: 180111 - DNA, 3573 bp, Artificial Sequence
  Description of Artificial Sequence: Synthetic coding sequence
atgaagacccggcagaacaaggacagcatgagcatgcggagcggccgcaagaaggaggcgcctggacctagagaggaactgagatctcgaggaagggccagtcctggcggagtgagtacttcaagtagtgacggtaaagccgaaaaatcgcggcaaaccgccaaaaaagccagggtcgaagaagcttccacccctaaggtgaacaagcagggccggagcgaggaaattagcgagtcagaatcagaggagactaacgctcccaaaaagactaaaacagaacaggagctcccaagaccgcagagcccctccgatctggactccctggacgggagatcacttaacgacgacggctcctccgaccccagagacattgaccaggacaaccggagcacttccccatcgatctattctcccggtagcgtggaaaatgactctgattctagctccggactcagccaaggaccagcacggccgtaccatccacctcctctgtttccacctagtccacagccccccgattcaactccgaggcagcccgaggcttcattcgaaccgcatccctccgtgacacctactggttaccatgccccaatggagcctccaacttcacgaatgttccaggcaccgccaggcgcaccaccaccccatccacaattgtacccgggcggcacaggaggagtgctgtccggccctcctatggggccaaaaggaggcggcgccgcctcctctgtaggagggcctaatggcgggaagcagcacccaccgccaactacccccatttctgtgagcagcagtggagcatctggtgccccaccgaccaagccccccaccactccagtcggaggcgggaacctcccaagcgccccgccgcccgccaatttcccccacgtcaccccgaacctccctccccctccagcacttagacccctgaacaatgccagtgcgtccccacccggactgggagctcagcctctgcccgggcaccttccaagcccacatgctatgggtcagggtatgggagggcttccccccggcccagagaagggccctacacttgcccccagtccacattcattgcccccagcctcatcgtctgctccggcccctcctatgcgctttccatactctagttcttctagtagtagtgccgccgcaagctccagcagctcttcatcctcatcctccgcatccccattcccagcatcacaagcactccctagttatccccattccttcccgccccccacatcactgagtgtaagtaatcaaccccccaaatacactcagccctcgcttcccagccaagctgtctggagtcagggcccgccgcctcctccaccatacggacgtctgctcgctaactctaacgcgcatccaggcccctttccaccaagtacgggcgcccaatctaccgcacatcctccggtctccacacaccatcaccaccaccagcagcagcaacaacagcagcagcaacaacagcaacaacagcagcaacagcaacagcaccacggaaattcaggaccccctcccccaggcgcttttccacacccactcgagggcggcagctcccaccacgctcatccatacgccatgtcgccatcactggggagcctgcgcccctaccctccaggccctgcgcatctaccgcccccccactcacaggtgtcttacagccaggctgggccaaacggccctcccgtcagcagctctagcaattcttcgagttcgacgtcccagggatcgtatccttgcagccatccgtccccctcgcagggtcctcaaggggctccttatccctttcctcctgtgcccaccgtgactacgtcctcagcgactttgtctaccgtaatagcaactgtggccagcagtccagcaggttacaagactgcctcccctccaggtcctccaccttacgggaagcgcgcaccgtctcctggggcttataagacagcgacgccacctggctacaagccaggaagcccaccctcatttcggaccgggacaccccctgggtacagaggcacgtctccgcctgccggccccggcacctttaaaccgggaagtcctaccgtcgggcccggacccctgccacccgcaggaccatcaggactgcctagcctgccgcccccaccagctgctcctgcaagcggcccgcctctgtcagcgacacaaatcaaacaggaaccagccgaagagtacgaaacgccagagtcacccgtgcccccagccaggtcaccatccccccctcctaaggtggttgacgtaccatcccatgcctctcaaagcgcgaggttcaataagcatcttgaccgcggattcaattcctgcgctcgcagcgacttgtattttgtccctcttgagggaagcaagttagctaagaagcgggccgatctggttgagaaagttaggcgggaagccgaacagagggcgcgggaggagaaagagcgggaacgcgaaagagagcgcgagaaggaacgtgagagagagaaagaaagagagcttgaaaggagcgtgaagctggcccaagaaggtcgagcacctgtcgaatgcccaagcctgggccctgtgccccataggccaccctttgagcccggtagtgccgtggcgacagtgccaccttacctgggtcccgacactccagccttaagaacgttgtctgaatacgcaaggccccatgtgatgtcaccaggtaatagaaaccatccattttatgtacctcttggagccgtagatcctggacttctgggctacaatgtaccagccctgtattcatctgaccctgccgccagagaacgagaacgcgaggcaagggaaagagacctgcgcgatcggcttaaacccgggttcgaagtgaagccaagcgagttagaacctcttcacggggtacctggaccagggctggacccgtttccacggcatggaggactggcactacagcccggtcccccagggctgcaccccttcccgtttcacccatcactgggtcctctggagagagagagactggcccttgctgctggccccgctctgcggcccgacatgagctacgctgaacggctcgcagccgaaagacagcacgcggagagagtggccgccttaggcaatgaccctctagctcggctgcaaatgttaaacgtgactcctcaccatcaccagcattcccatatccacagccatctgcatttacatcagcaggacgctatacatgctgccagtgccagcgtacacccactgatcgacccacttgcctccggaagccacctgactcggataccataccccgccggtaccctgcccaatccattgttgccccacccacttcatgagaatgaggttctcaggcaccagctctttgcagcaccctatcgagaccttcccgcgtcactgagcgcccctatgagtgccgcccaccagctacaggctatgcatgcacagagtgccgagctgcagagactggcccttgagcagcagcaatggctgcacgcccatcaccctttgcatagcgttcccttgcctgcacaggaggattattattcgcacctgaagaaagagagtgacaagccactgtag

SEQ ID NO: 180112 - DNA, 519 bp, Artificial Sequence
  Description of Artificial Sequence: Synthetic coding sequence
atgctggtgatccacctggaggagcacgtgatcatcgccttcagccagcataacacaatcatggatctggttcagtttttcgtgacattcttcagctgtttcctgagcctcttgctggtcgcagcggtcgtctggaaaattaaacagacctgttgggcctctaggcggcgcgaacagctgctccgcgaacgacagcagatggcaagccgcccctttgctagcgtggacgttgctctggaggtgggcgcggagcaaacagagttcctgcggggacccctcgagggcgctccaaaacctatcgccatcgaaccctgcgcaggaaatagggctgctgtcttgacagttttcctctgcctgcctcggggctcctcaggcgctcccccccccggccagagcggacttgccatagctagcgctcttatcgatattagccaacagaaggcgtccgactctaaagataaaacaagcggcgtacggaatcgaaaacatctgagcacccgccaggggacctgcgtctag

SEQ ID NO: 180113 - DNA, 4140 bp, Artificial Sequence
  Description of Artificial Sequence: Synthetic coding sequence
atggagaccggcggccgggcccggaccggcaccccccagcccgccgctcccggtgtttggcgcgcgcggccagcgggcggtggagggggcggggcttcgtcttggctgctagatggtaacagctggctcttatgctatggattcctgtacctcgcgctgtacgcacaagtgagtcagagtaagccttgtgagcgtacaggatcttgctttagcggacgctgcgttaacagtacttgcctgtgtgaccctggatgggtgggcgaccagtgtcagcactgccagggacggtttaagctgactgaaccatccggatatctgacagatggccccatcaactacaaatacaagactaagtgcacttggctaatcgaaggatacccaaatgcggtgctccggctccgattcaatcacttcgcaacagagtgttcatgggaccacatgtatgtctacgatggtgatagcatctatgcgccactaattgcagtgctctctgggctgattgtacctgagatccgtgggaatgaaacagttccagaggtggttactacaagcggttacgctcttctgcacttcttctcagatgctgcctacaatcttaccggttttaacatcttttattccatcaacagctgtccaaacaactgttctgggcacggaaagtgcacaacatccgtatcagttccgtcccaggtatattgtgaatgcgacaagtattggaagggggaggcttgtgacattccatattgcaaggccaactgtggctcccccgaccatggctactgtgatctgactggagaaaagctctgtgtatgcaacgacagctggcaagggcccgattgttctctaaacgtgcccagtacagagtcatactggatattgccaaacgtaaaacctttcagcccgtcagtcggccgagcctctcacaaggctgtactgcacgggaagtttatgtgggtgatcggcggatacacattcaactacagtagcttccaaatggtcttgaactataacttggagtcatctatctggaatgtcggtaccccttcccgggggcccttacaacgttatggacactctctcgctctctaccaggaaaatatcttcatgtatggtgggagaattgaaacaaacgacggaaacgtgaccgacgagctatgggtatttaacatacactcccaatcttggtctactaagaccccaactgtgctcggccatggtcaacaatacgccgtggaaggacactcagctcacataatggagctggatagccgagacgtggtcatgatcatcattttcggctattcagctatttatggctacacttccagcattcaggaatatcacatttcaagcaatacatggctcgttccagagactaagggggcaatcgtccagggtggctatggccatacatctgtgtacgacgagatcacaaagtcaatctacgtccatggcggttacaaagcactgcccggcaacaaatacggactggtcgatgacctctacaaatatgaagtgaacactaagacttggacaattttaaaagaaagtggttttgcccgctaccttcactctgccgtcctaataaatggagccatgctgatctttgggggaaacacgcacaacgataccagcctaagcaatggggcgaagtgcttttccgccgactttctggcctacgacattgcctgcgatgagtggaaaattcttccaaaaccaaatttacacagggatgtaaatcgtttcggacacagtgccgttgtgatcaacggatccatgtatatttttgggggtttctcaagtgtgttgcttaatgatattctggtgtataagccccctaattgcaaagcatttagggatgaagaactttgcaagaatgcagggcctggcatcaaatgtgtctggaacaagaaccattgcgaaagctgggaaagtggcaacacaaataacatcctgcgcgcaaagtgtccccccaagacagctgctagtgacgatcgatgctaccggtacgctgattgcgcaagttgcaccgctaatactaacggatgtcaatggtgtgatgacaaaaaatgtataagtgcaaattcaaattgtagtatgtccgttaagaattacacaaagtgccacgttcgcaacgagcagatctgcaacaagctgacgagttgtaaatcttgttcgctgaatctgaactgtcagtgggaccagagacagcaagaatgccaagctctgccggcccacttatgcggcgaggggtggtctcatattggagacgcctgtttgcgtgtaaactctagccgggagaactatgataacgcgaaattgtactgttacaatttgtcaggaaacctcgcaagcttgaccaccagcaaggaggtcgagttcgtgctggatgagatacaaaagtacacgcaacagaaggtgtctccctgggtggggttaagaaagatcaacatctcctattggggatgggaagatatgtccccctttacaaacacaacgctccagtggttgcctggtgagcctaacgatagtgggttctgcgcatacctagagcgcgcagcggtcgcagggctgaaagccaatccctgcacttctatggccaacgggctggtgtgcgagaagccagtggtgtctcctaatcaaaatgcgcgcccatgcaagaagccctgcagcttacgtacctcctgtagcaactgtacaagtaatgggatggaatgcatgtggtgttccagcactaaaagatgcgtggattccaacgcttacataattagcttcccctacggtcagtgtttggagtggcagaccgccacctgtagtccacaaaactgttcaggacttcggacatgcggccagtgtctggagcagcctggatgtggctggtgtaatgatccgtctaatacaggccgtggccactgcatcgaaggctcgtcaaggggaccgatgaaattgatcggtatgcaccatagcgagatggtgcttgacaccaacctgtgccccaaagaaaaaaattatgagtggagtttcattcagtgtccagcatgccagtgcaatggtcattccacttgtatcaacaataatgtttgcgagcagtgtaaaaacctgactacaggcaagcagtgccaggattgcatgcctggatactatggcgacccaactaacggggggcagtgcaccgcatgtacatgtagtgggcacgctaatatatgccaccttcacaccggcaagtgtttttgtacgacaaagggcataaagggggaccaatgccaactgtgtgattcagagaaccggtacgtggggaaccctcttcgcggcacttgttactattccctcctcatagattatcaattcaccttcagcctgctgcaagaggatgacaggcaccataccgctatcaattttattgccaaccccgaacagtctaataagaatctggacataagcatcaacgcgagcaacaattttaatcttaacatcacatggtctgtgggctcgactgccggaactatttctggcgaagagacatccatcgtgagcaagaataacattaaagagtaccgggactcattcagctacgagaagttcaacttccgctctaaccccaacatcacattttacgtgtacgtgtccaacttctcctggcctattaaaatacagattgcatttagtcagcataacacaatcatggatttagtgcagttctttgtgacatttttctcctgtttccttagtctcttattagtggccgcggtggtgtggaaaattaaacagacatgttgggcaagccgccgcagggaacagttgctgcgagagcgccagcaaatggccagtcgtccatttgcttccgttgacgtagccctcgaggtgggcgccgagcagactgagttcctgcgggggcccttggagggagcccccaagcccatcgccattgaaccctgtgcaggcaatagggccgcagttcttactgtgttcttgtgtctgcctcgagggtcaagcggcgcccctcctcctggccagagcggccttgctattgcctctgccctgattgatatcagccagcaaaaggcttccgactctaaggacaagacgtcgggggtcagaaaccgcaagcacctgagtactcgccagggtacctgtgtgtag

SEQ ID NO: 180114 - DNA, 1293 bp, Artificial Sequence
  Description of Artificial Sequence: Synthetic coding sequence
atggagtgcatgtggtgcagcagcaccaagcggtgcgtggacagcaatgcctatatcatttcatttccttacggtcaatgccttgagtggcagacagcgacctgtagcccccaaaattgcagcggcttaagaacatgtggccaatgcctcgagcagcccgggtgcgggtggtgcaacgatccaagtaacactggccgtggccattgcatagaaggatctagccgaggaccgatgaagctaatcggtatgcatcattccgagatggtgttggacacaaacctgtgtccaaaagaaaagaactatgagtggagtttcatccagtgccccgcctgcacatgttccggacacgccaatatatgccatctgcacacaggcaaatgcttttgtactactaagggtattaaaggcgaccagtgtcagctttgcgattcagaaaatcgctatgtcggcaaccctttgaggggcacgtgttactacagtctcctcatcgactatcagttcacatttagtttgctgcaagaggacgaccgccatcacaccgctattaacttcatcgcgaatcctgagcagtccaataaaaacctggacatctcgatcaatgcctccaacaacttcaatttaaacattacgtggtcggttggaagtactgccgggaccatctctggcgaagaaacatccatcgtatccaagaacaacattaaggaatatcgtgacagcttttcctacgagaaatttaatttcaggtcgaacccaaacattaccttctatgtgtacgtgtccaacttctcttggcccataaaaattcagatcgcattcagccagcataataccattatggacctcgttcagttcttcgtgacgtttttctcttgttttctcagcctgctgctggtcgccgccgtggtctggaagatcaaacagacatgctgggcatcacgaaggagggaacagctactcagggaacgacagcagatggcatctcgcccgttcgcttccgtggacgtggccttagaagtgggggctgaacagactgaattccttaggggacccctggagggggcccccaagccaattgccatcgaaccatgtgcaggcaaccgagccgctgtgctaactgtgtttctttgtcttccccgcggcagctcaggcgctcccccaccgggtcagtccggcctcgcaatcgcgagcgcgctgatagacatcagccagcagaaggcctcagatagcaaagacaaaacttccggcgtgcggaatcgcaagcacctcagtaccagacagggaacctgcgtttag

SEQ ID NO: 180115 - DNA, 207 bp, Artificial Sequence
  Description of Artificial Sequence: Synthetic coding sequence
atgcccaagcacgagttcagcgtggacatgacctgcggcggctgcgcggaagccgtttcccgagtgctgaataagttagggggcgtgaaatacgatatcgatctcccaaataaaaaagtttgcatcgaatcagaacactcaatggacacactactggctaccttaaagaagactggtaagactgtgtcctacctcggcctggaatag

SEQ ID NO: 180116 - DNA, 207 bp, Artificial Sequence
  Description of Artificial Sequence: Synthetic coding sequence
atgcccaagcacgagttcagcgtggacatgacctgcggcggctgcgccgaagccgtctctagagttctgaataagctgggaggagttaagtatgatatcgacctccccaacaagaaagtgtgcatcgaatcagagcactctatggataccctgctcgctacactgaagaagacaggcaagacagtgagctatctgggactcgagtag

SEQ ID NO: 180117 - DNA, 207 bp, Artificial Sequence
  Description of Artificial Sequence: Synthetic coding sequence
atgcccaagcacgagttcagcgtggacatgacctgcggcggctgcgctgaggccgtaagcagagtcttgaataagctgggcggggtgaagtatgacatcgatctgccaaataagaaggtgtgtatagaaagtgaacatagcatggatactcttctggccaccttgaagaagaccgggaaaaccgtcagttaccttgggctcgaatag

SEQ ID NO: 180118 - DNA, 933 bp, Artificial Sequence
  Description of Artificial Sequence: Synthetic coding sequence
atggccgccgccgtggccgccgcccccggcgccctgggcagcctgcacgcgggtggcgcccggctcgtggcggcatgcagtgcctggctgtgtcccggtcttcggctgccaggctctttggcgggccggagggcaggtccagcgatttgggcacagggctgggtcccagccgcaggggggcccgcccctaagcgcgggtactctagcgagatgaagactgaggacgagctgagagtcaggcatctcgaggaagaaaataggggcatcgtggtcctggggattaaccgagcctatggaaagaactcactctctaagaacttaattaagatgctatccaaagcagtggacgctctcaagagtgacaagaaggtgagaaccatcataatcaggtccgaagtgcctggtattttctgtgccgcaaacctgccagtcccaaccatagccgctatcgacggcttggccctgggcgggggcctagagctggctcttgcatgcgatatacgagtggccgcgagctctgccaaaatgggtcttgtagagactaaactggccataattccagggggcgggggtacgcagcgactccccagagctattggaatgagcttggcgaaagaactgattttttctgcacgcgtccttgatggcaaagaggctaaagcagtgggtctcatctcgcatgtactggaacaaaatcaggagggtgatgccgcctacaggaaagccctggacttggctagagaatttctgccccagggcccagtggcaatgcgagtagccaagctagccattaatcaggggatggaagtagatcttgtcactggtctcgccattgaggaggcttgttacgctcaaactattcctaccaaagatcgtctcgagggactcctcgccttcaaggagaaaagaccacctcgctataaaggcgagtag

SEQ ID NO: 180119 - DNA, 1020 bp, Artificial Sequence
  Description of Artificial Sequence: Synthetic coding sequence
atggccgccgccgtggccgccgcccccggcgccctgggcagcctgcacgcaggtggagcccggctcgtggccgcctgtagcgcctggctatgccctggcctcagactcccaggatctctggccggacgacgagctggacctgcgatctgggcccaagggtgggtgcccgctgctgggggcccagctccaaagcgtggatatagctctgagatgaagacagaggatgaactgcgggtgcggcacctggaagaagaaaaccggggcatcgtcgttctgggcatcaaccgggcctatggaaagaactcgctctccaagaatcttattaagatgctgtcaaaggcagttgatgctctaaagagcgacaagaaagtgaggacgatcatcatacggtctgaggtgccagggattttctgcgctggggccgacctaaaggagcgcgcaaagatgagcagtagcgaggtcggcccatttgtgagcaagattcgcgctgttattaatgacattgccaatctgccagtgccgacaattgcagctattgacggactggctttggggggcggactggagttggccttagcttgtgacatcagggtggccgcttcttcagccaaaatgggactggttgagactaaattagccatcatccccggggggggaggaacacagcgcctcccgcgggccatagggatgagtctcgctaaggagctgattttcagcgctcgcgttcttgacggcaaggaggctaaggctgtggggctcattagccacgtactggaacagaaccaggaaggcgatgctgcttaccgaaaagcactggatttggcaagagagttcttgccccaaggccctgtggcaatgagggttgccaagctcgccataaaccagggcatggaggtcgacttagtgaccggattggctattgaggaggcatgttacgcccagacaattccgaccaaggaccgcttggaaggcctattggctttcaaagaaaaacggcccccccgttataagggggagtag

SEQ ID NO: 180120 - DNA, 768 bp, Artificial Sequence
  Description of Artificial Sequence: Synthetic coding sequence
atggccgccgccgtggccgccgcccccggcgccctgggcagcctgcacgcaggcggggcccgtctcgtcgctgcttgctcagcttggctgtgtccagggctcagacttcccggtagcctcgcaggcaggcgggcagggcccgcaatctgggcacagggttgggtgcccgcggcagggggccccgccccaaagcgcggctacagctctgagatgaagacggaagatgaactcagagtacgccacctggaagaagaaaaccggggcatcgtcgtactgggtataaatcgcgcctacggaaagaatagtctgtcgaaaaacttgattaagatgttaagcaaggctgtggacgccctcaaatcggataagaaggtgagaaccattatcatccgaagtgaggtccccggcattttttgtgccggagccgacctgaaggaacgagcgaaaatgagttcctctgaggtagggccgtttgtgtctaagattcgcgcagtaatcaatgatatcgcgaacctccccgtgccaaccattgctgctatcgacggtttagctcttggaggaggcctggagcttgctctcgcatgcgacatccgggttgctgcctcgtcagccaagatgggcctcgtggagactaagctggccataatccccgggggcgtaacctcttccacagaggttctgaaccccagcaaaagttcgatgaagatcggaattatcatcttccagacccccgtaaatattgacatcctggccagctcacacgaatcttag

SEQ ID NO: 180121 - DNA, 1932 bp, Artificial Sequence
  Description of Artificial Sequence: Synthetic coding sequence
atgcccctgctgttcctggagcggttcccctggcccagcctgcggacttacactgggttgagtgggctcgctctgcttggcactattatctctgcttaccgtgccctgtcccagccagaagccggacctggtgagccagaccaactgaccgcatctcttcagccagaacctccagcaccagctcgtccttcagctgggggcccccgagcacgggacgtagctcagtatctgctcagcgatagccttttcgtttgggtactagtgaatacggcctgttgtgttttgatgttagttgctaagcttatccaatgcatcgtgtttggccccctgagagtgtctgaaaggcagcacctgaaagataaattttggaattttattttttacaagttcatcttcatttttggcgtcctgaacgttcagaccgtggaggaggtagtcatgtggtgcctatggttcgctggtctcgtattcctccatttgatggtgcagctatgtaaggaccggttcgagtacctgtcattctcacccactactccaatgtctagtcatgggcgtgtgctgtccctgctggtggcgatgctcctctcctgctgtggactagcagctgtctgcagtattaccggatacacccatggcatgcataccctggcgttcatggccgcagaaagtctcttggtcacggtgcgcactgctcatgtcatcttacggtacgttatccatctgtgggatctgaaccacgagggcacatgggaggggaagggaacttacgtctattatacggactttgtcatggagctgaccttgctttccctggatttgatgcatcacattcatatgttactcttcgggaatatttggctcagtatggcctcccttgtcattttcatgcagctcaggtacttgttccatgaggttcagcggcgcatccgccgccataagaattacctacgcgtggtaggcaacatggaggctcggttcgccgtggcaactccagaagagctggcagtgaataatgacgactgcgccatttgttgggattccatgcaggctgcacgaaagctcccctgcggccacctgtttcacaatagctgtctgcgaagctggctcgagcaggatacaagctgtcccacttgtaggatgtccctcaatatcgctgataataacagggtccgcgaagagcatcagggagagaatcttgatgagaatctcgtgcctgtcgccgctgcagagggcaggcctcggttgaaccagcacaatcacttctttcatttcgatgggtccaggattgcctcctggctaccaagcttttcagtggaagtgatgcatactaccaacatactgggaatcacacaggcgtccaatagtcaattaaacgcgatggcacaccaaatccaagagatgtttcctcaggtgccatatcacctggtgctgcaggatttacagcttactcgctccgtggaaatcaccactgacaatattctcgaggggcgaatccaagtccccttccccactcagcgatccgactccatccgtcctgcactgaacagccctgttgagcgtccgagctccgaccaggaggagggcgagacatcagcccagactgagcgggtgcccctggatctgagcccacgactagaggagacactagatttcggcgaggtggaagtggaaccatcggaggttgaggatttcgaagcccgcggatctcgtttttcaaaatctgcagacgaacgacaaaggatgcttgtgcaacggaaagacgagctgctccaacaggcgcggaagaggttcttgaacaaatcctccgaagacgatgccgcctccgaaagcttcctgccttctgagggggcttcaagtgatcccgtcacgttacggcggagaatgttggccgccgctgcagaaagacgccttcagaagcagcagaccagctag

SEQ ID NO: 180122 - DNA, 954 bp, Artificial Sequence
  Description of Artificial Sequence: Synthetic coding sequence
atgcgggacagcgcctgctggcagcggaaggacgagctgctgcagcaggcccgtaaaagatttctcaacaagagttcagaagacgacgccgcctccgagtcgtttctcccctccgaaggtgcctcaagtgaccccgtgacactcaggaggaggatgctggccgcccgcaacggggggttcagatcttctcgacccccctctgctccactcccctcctccgcagcttcctgcgccctctgtcctaccgactggcgccgccccgtaccaatcccgctgcatggcaaggccggcctgaccgccctgcccctatacaaagcttgtgggttgattgtgttcggacagttgatcaatctcatccttctatgcaacaccttttatgtgacgtttttgtttcctcttgagactctccagattctgacagtcggaatgatctcctccggcgtcgactggaccgcttggggtggcggtaggagcggaggctctgaggtggcctgcctgcaacaggcggctagtacaccggctagttgtgtgcggcccactaacgcaggtgtgttatccaccacccctagtgggaagtccgttggtgaagctcacagcgtaagcccaccgccccgacgaggggtgacgtcggttattaagctcttatcacttttgtggaaacacgtggactgcgcacggcgcccaacaggatcatgtacacctcagcaggggattcttgagaaagaactgttagtgcgttacctagagcaacgtagggggaagagtagagccattggctgcgatgaggtgacccccttttgtcccactactagcggaactgattttccctctttacagtcaaaggctggcctaatatccgtaaattccggtgctccagcttcacatgagtgtgcaccttgggtgcctagtcctctaagcatctctctgagtaggctcgaccttggatccggctag

SEQ ID NO: 180123 - DNA, 1638 bp, Artificial Sequence
  Description of Artificial Sequence: Synthetic coding sequence
atggccaccgacgccgccctgcggcggctgctgcggctgcaccggacagaaattgccgtggctgtcgactccgctttcccgctgctgcatgccttggctgatcacgatgtcgtgcccgaagacaaattccaagagaccctgcacctcaaggaaaaggaagggtgtccacaggccttccatgcgctgctatcatggctcctcacacaggacagtaccgctatcctggacttctggcgagtgctctttaaagactataacctcgaaaggtatggtagactgcaacccatcctggacagcttcccaaaagacgttgacctgagccagcctaggaaaggacgcaagcctcccgcagtgcctaaggctctggtgcccccaccccggttgcccaccaaaaggaaggcgagcgaagaagcacgagctgccgcacccgcagctcttaccccacgtgggaccgcctctcccggtagccagctcaaggctaaaccacctaaaaaacccgagagttccgcggagcagcaacgcctgcctctcggcaatggaattcagacaatgtccgcgtctgtccagagggcggtcgctatgagctcgggggacgtgccaggggcaaggggtgctgtggaggggattctgatccagcaggtctttgagagtggaggaagtaaaaagtgcattcaagtggggggggagttctacactcccagcaaattcgaagacagcggctctgggaaaaataaagccagaagtagctctggacctaaacccctcgtacgtgccaaaggggcacagggcgctgcccccggcggaggtgaggcacggttagggcaacaggggagcgttccagctccgttggcattgccaagcgaccctcagctgcatcagaaaaatgaagatgagtgcgcagtgtgccgggatggcggagagcttatctgttgcgacggctgtccaagagccttccatctcgcttgcctgtctccacctctgcgcgaaataccatcgggtacttggaggtgttcttcatgcctccaggccaccgtccaggaggtgcagccgagagccgaggagcccaggccccaggagccccctgtggagacgccactgccccccggcctgcggtctgctggcgaagaggtacggggtccccctggcgagccgctggctggcatggacactacactggtctataaacacctgcccgcgccacccagcgcggctccgttgcctggcctggactcatcggccctgcatcctttgttatgtgtcggtccagaagggcagcaaaacctcgctcccggcgctcgctgtggcgtgtgcggggatgggactgacgttctccggtgcacccattgtgcagcagcattccactggagatgtcactttccagccggaacatcaagacccggcacaggcctccggtgccgctcctgttccggggatgtaacccccgcccctgtggagggggtgctggcacccagccctgcacggttggcccctggccctgctaaagacgatacagcatcacacgagccggccttgcacagggacgacctggaatcccttctgtcagagcatacattcgacggaatcctgcagtgggcgatacagtccatggctcgaccggcggcaccattccctagctag

SEQ ID NO: 180124 - DNA, 735 bp, Artificial Sequence
  Description of Artificial Sequence: Synthetic coding sequence
atgtggctggtgtacagcagcggcgcccccggcacccagcagcccgctagaaacagggtttttttcccgataggcatggctccggggggagtgtgttggagacccgatggctggggcacagggggccaaggacgcattagtgggcccggcagcatgggcgcaggacaaaggctcggctcgtccggaacccagcggtgttgctggggaagctgtttcggaaaagaagtggccttgcgaagagtcctccaccccagccccaagaatgaggatgaatgtgccgtctgtcgggatggcggcgagctaatatgttgcgacggctgtcctagagcatttcatctagcttgcctcagcccaccgctgcgggaaatcccctctggaacctggaggtgtagcagttgcttgcaggctactgtgcaggaggtgcagcccagggccgaggagccacggccccaagagccaccagtcgaaactcccctaccgcctggtcttcggagcgctggagaagagcctaggtgtcaggggtggacccccagaccttgcacaccttactgcgtctgggtgcttcgcgtgtcgcgaacctggctcttggtgcgcgtcgcgggctgcgcagagatggtgcggacttgctgtggggttttgactgcccccctcccgtcaactggtgcggccacgtcccaacctgctcctcccggacccggccgcgcatgtgccgccgatccagcacaggagacatag

SEQ ID NO: 180125 - DNA, 1047 bp, Artificial Sequence
  Description of Artificial Sequence: Synthetic coding sequence
atgtggctggtgtacagcagcggcgcccccggcacccagcagcccgcgcgaaaccgagtgttcttcccaatcggaatggcccccggcggtgtgtgttggcgacccgacggatggggaacaggaggacagggacgaatcagtggacccggatcaatgggcgccggccaaaggctgggctcctccggcactcaacgctgctgttggggctcatgtttcggtaaagaggtggctctgcggagggtgttacaccccagccctgtgtgtatgggcgtgagttgtctgtgccagaaaaacgaggatgaatgcgccgtttgtagggatggaggggagttaatatgttgcgatggatgtccacgtgctttccacctggcttgcctcagccctcccttacgggagatacccagcggcacctggcgttgttcaagctgcctgcaggcaactgtccaagaggtgcagccgagggctgaagagcctagacctcaggagcctcctgttgaaacaccactgccccctgggctgagatctgcgggggaggaggttagagggccgcctggggagcccctggccggtatggataccaccttggtgtacaaacatctcccagcccccccgagcgccgctccgttgccaggcttggatagctccgccctccatccgctactgtgtgtgggccccgagggccaacagaacctggccccaggagcacggtgtggggtatgcggggatggaacggacgtgctacgctgcacacattgtgcggcagcatttcattggcggtgtcactttccagctggcacatccagaccaggtacaggactgaggtgccgctcatgtagcggagatgttacccccgcacctgtagagggagtgctggccccgagtccagctcgcctggcgcctgggccagctaaggacgatacagcgtcacacgaacccgctcttcaccgtgacgacctggagtcactgctcagcgagcacacattcgacgggatcctccaatgggctattcagagtatggcccggccagcagcacctttccctagttag

SEQ ID NO: 180126 - DNA, 1017 bp, Artificial Sequence
  Description of Artificial Sequence: Synthetic coding sequence
atgtggctggtgtacagcagcggcgcccccggcacccagcagcccgctagaaacagagtctttttcccaatcgggatggccccaggcggagtgtgttggaggcccgatggctgggggacgggcggacaaggccgcatttctggacccggctccatgggtgcaggccagaggctcggctctagtgggacacagagatgctgctggggctcatgtttcggcaaggaagtcgctctgcgtcgtgtactgcacccttctcccaaaaatgaggacgaatgtgcggtctgtagagacggcggtgagctgatttgctgcgacggttgtcccagagccttccacctggcatgtctttctcctccactgcgcgagatcccctctggcacatggagatgcagcagttgtctgcaagccactgtgcaggaagtgcaacctcgggcggaggagccgagacctcaggagccacctgtagaaacacctctacctccaggattgagatctgctggggaagaagtcaggggacccccgggcgagccactcgctggcatggacacaacactagtttacaagcatctgcccgcgccacccagcgcagcgcctctcccaggcctcgatagcagcgctctgcaccctcttttgtgcgttggccccgaagggcaacaaaacctagcccctggcgcccggtgtggcgtctgcggggacggaaccgatgtgttaagatgtacgcactgtgctgcagctttccattggagatgtcatttccctgctggtacatcgcgcccaggcactggcctgcgttgtcgatcttgttccggggacgtgacccctgcccccgtggagggagttctggcccccagcccagcgaggttagctccgggccctgcaaaggatgataccgcttcacacgaaccagcccttcatagggacgatcttgaaagccttctttccgagcacacattcgacggaattctccaatgggctatccagagcatggcaagacccgctgcaccctttccttcctag

SEQ ID NO: 180127 - DNA, 1047 bp, Artificial Sequence
  Description of Artificial Sequence: Synthetic coding sequence
atgtggctggtgtacagcagcggcgcccccggcacccagcagcccgccagaaatcgcgtgttttttcctatcgggatggcaccagggggcgtgtgctggagacctgacggctggggcactggcggacaggggcggatctccggcccaggcagcatgggcgcgggccagagactcgggtcctccggaactcagcgatgctgttgggggtcttgcttcggtaaagaggttgcgctcaggcgcgtgctgcacccgtcaccagtgtgtatgggagtctcatgtctgtgtcaaaagaacgaagacgagtgcgcagtgtgtcgggatggcggcgaacttatctgctgcgatgggtgtccacgcgccttccatctcgcttgcttaagcccaccgctgagagaaattccaagcggcacttggcgctgtagtagttgtctgcaggccaccgtacaagaggtccagccccgggctgaagagcctagacctcaggaacctcctgttgagacccccttgcccccaggcctgcgcagcgcgggagaagaagttagaggtcctccaggggagccactggccggaatggatacaaccctggtgtacaagcaccttcccgctcccccgagcgccgcccctctgccaggcctggacagcagcgcgctgcatccactcctttgcgttggtcccgagggccaacagaatctggcccctggagccaggtgcggcgtatgtggcgacgggactgatgttctccgttgtacccactgtgccgccgcctttcattggagatgtcatttccctgcaggtacaagccggcccggaactgggcttaggtgccgatcgtgcagtggcgacgtgacaccggcaccagtagagggggtgcttgcaccttcccctgcccgactggcccctggtcccgccaaagacgacaccgcctctcacgaacccgccttacatcgggatgacctcgaaagccttctcagcgaacacactttcgacgggatcttgcagtgggccattcagtcgatggcgagaccggctgcccctttccctagttag

SEQ ID NO: 180128 - DNA, 3717 bp, Artificial Sequence
  Description of Artificial Sequence: Synthetic coding sequence
atgaaggtggtgcccgagaagaacgccgtgcggatcctgtggggcagggagaggggggcccgcgctatgggggcccagcggttgctccaagaactggtcgaggacaaaacgcgttggatgaagtgggaaggcaagagagtggagctgcccgactctccaaggtcaacattcctgctcgctttttccccagatagaacattgttggcctcgacgcacgtgaaccataacatttacattactgaagtgaagaccggtaaatgtgtccatagccttatcggtcaccgtcgcaccccttggtgcgtgacatttcatccgacaattagcgggctgattgctagtggctgcctggatggtgaagttagaatttgggatttgcacggtggaagcgagagttggttcaccgactctaataacgccatcgctagcctggccttccatccaactgcacagttgcttctaattgcaaccgccaatgaaatccacttttgggactggagtagacgagagccatttgcggtggtcaagactgcaagcgaaatggagcgggtgaggttagtgcgctttgatcctctcggacactatctcctcacagccattgtgaatccgagcaaccaacaaggtgatgatgaaccagagatccctatagatggtaccgagctgagccattacagacagagagccttactgcagtctcagccagtgcggcgcactcctttgctgcataactttctgcacatgcttagttcccggtccagtggtattcaagtgggtgaacagagcaccgtgcaggatagtgcaacccccagcccacctcccccccccccccaaccctctactgagaggcctaggacctcagcttacatacggctgcggcagagagtcagctaccctacagccgagtgctgtcagcatctgggcatactgtgtctgtgctccaggtgtagcggaaccagggttccctctcttttgccacatcaggacagtgtacctcccgcctcagcacgcgccacaactccaagtttttccttcgtgcaaaccgagccatttcacccgcctgagcaggcatccagtactcagcaggaccaaggtttgttgaaccggccttctgccttttctacagttcagtcctctaccgccggcaacaccctcaggaatctatccttagggcctaccagacgcagtctgggcggacccctctcttcgcatccttcacgataccaccgggagatagccccagggctgacaggcagtgagtggacaaggaccgtgctttcattgaatagtaggagtgaggccgagtcaatgccacctccgagaacatctgctagcagtgtctcccttctgtctgtgctgagacaacaggagggggggagccaggcttccgtgtatactagtgccacggaaggcagaggctttcctgcctccgggcttgcaacagagagtgacggaggcaatggcagctctcaaaacaatagtggctctatcaggcacgagctccagtgtgatctgcgtcgattctttcttgaatatgaccggttacaggagctggatcagagcctgtccggagaggccccccagacccagcaggctcaggagatgcttaacaataatatcgaaagcgaaagaccaggaccgagccatcagcctaccccccattccagcgagaataactcgaatctcagtcgcggccacttgaaccgctgtagggcatgccacaacctgctcaccttcaacaacgatactttgaggtgggagcggaccacaccaaactacagtagcggggaggccagctctagctggcaagtccccagctctttcgagtctgtcccaagcagcggaagccagctcccccccctagaacggactgagggccagaccccttctagcagtcgccttgaattgagtagctccgcaagccctcaggaagagcggaccgttggcgtggcttttaatcaagaaacggggcattgggaaaggatctacactcagtcttcaaggagcggaaccgtctctcaggaggccctccatcaggacatgccggaggaatcaagcgaggaagacagcctccgaagacgccttctcgagtccagtctgatctctctttcacgttacgacggggcagggtcacgcgagcacccaatttaccccgatcctgcccgcgataacggcgacaggtcaagacatcgcgctccccgaaacgccagaatgtctgccccatcactagggaggttcgtgcctagacggtttctattacccgagtacctcccgtacgccggaatttttcatgagcgtggacagcctggcctcgctacacacagtagtgtcaaccgggtgctggccggcgcagtaataggagatggccagtcggctgtcgcgtccaacatcgccaatactacatatcgcctgcagtggtgggactttaccaagtttgacctcccggagattagcaatgcaagcgttaacgtccttgttcagaactgcaagatctataacgatgcctcctgcgacatttctgctgacggtcaactcctcgccgcattcattccaagttcccaaaggggtttcccagatgaagggatcctggctgtttatagcttggcgccccataacctgggagagatgctctatacgaagcgatttggaccaaatgccattagtgtaagtctgtctcctatgggccgctatgtgatggttggtctggcatccaggcgtattctgctccacccatccactgagcatatggtcgctcaggtcttcagactgcagcaggcacatggtggtgagacttcaatgcgaagagtcttcaatgtactgtatccaatgccagccgaccagcgccgacatgtgagcattaactccgcaagatggctgccggagcctggtctgggtttagcctatggaacgaacaagggggacctggtgatttgtaggcctgaggccttgaattctggcgtggagtactattgggaccagctgaatgagaccgtgttcacagtccattcaaatagtaggagttcagagcggcccggtacaagtcgagcaacctggcggaccgaccgggatatgggcctgatgaacgctattggccttcagccacgcaaccctgcaacatcagtgactagtcagggaacacagacactggcattacaactgcagaacgcagaaacgcaaacggagagagaggtccctgaacccggaactgctgcctcaggccctggcgaaggcgaggggtccgaatacggcgcctcaggggaggatgccctatcacgaatccaaaggctgatggccgaaggcgggatgaccgccgtggtccagcgagagcagtctaccactatggcgagtatgggcggatttgggaataacataattgtttcccaccgaatccatagatcctcgcagactggaacagagcctggtgctgcacacaccagttcaccacagcctagcacgagtcgcgggttgctacctgaggccgggcaactggctgagagaggcttgtctccaaggaccgcttcatgggatcagcctggtacccccggtcgagaacctacgcagcccacacttcccagttccagtccagttccgatacccgtgagcctcccgagtgcagagggccccaccttacactgtgagctcacgaacaacaaccatctgcttgacggcggaagtagtaggggggacgctgctgggccacgtggtgagccacgaaatcgctag

SEQ ID NO: 180129 - DNA, 2169 bp, Artificial Sequence
  Description of Artificial Sequence: Synthetic coding sequence
atgaaggtggtgcccgagaagaacgccgtgcggatcctgtggggccgagagcgaggagcccgagcaatgggggcccagcgcctcctccaggagctggtggaagacaagacacgttggatgaagtgggagggcaagagagtggagttgcccgactccccacgctccaccttcttgctggcctttagtccagatagaactctcctggcaagcactcacgtgaatcacaatatctatatcactgaggtaaaaactggaaaatgcgtccactccctgatcggtcatcgtcgcactccttggtgcgtgacgtttcatcccaccatcagtggcctcatagcatctggctgtctggacggggaggtgcgaatttgggatctccacgggggctccgagtcctggtttaccgacagcaacaacgctatcgccagcctggcatttcatcctacggcacagctgctgctcattgcaaccgccaacgagatccatttttgggattggagcagaagggagccttttgcggtggtgaagaccgcatccgaaatggaaagggttcgccttgtgaggttcgatccattagggcactatcttctgaccgcaattgtgaatccctccaaccagcagggcgacgacgaaccggaaatcccaatagatggaaccgaactcagccattatcgccagcgcgcgctcctgcagtcacagccggtgcgcagaacgccactgcttcataacttccttcacatgttaagtagccgatcttctggcatccagacagaacctttccacccccccgagcaggcaagctccactcaacaggatcaggggctacttaatagacccagtgcattcagcaccgtccagtcttcgacagccggtaatacactccggaatcttagcctaggcccaacccgccgaagtctaggtggaccactgagctctcatccgagtagatatcaccgggagatcgcccctggtctgactggtagtgaatggaccagaaccgtcttaagcttgaattcacggagtgaagcagaatcgatgccgcctccaaggacgtccgcctcctcagtgagcctgctatccgtactgaggcagcaggagggtggttctcaggccagcgtctacacaagtgcgacagaaggccggggtttccctgcatccggattagccactgagtccgatggaggcaatggctcttctcaaaataattctggatctattcgacacgaattgcagtgtgacctgcgaagatttttcctggagtacgatcgtttgcaggagcttgaccaatccctgtcaggcgaagcacctcagactcaacaggcacaggaaatgttaaacaacaacattgaatcggaacggccaggaccgtcccaccaacctacacctcacagttctgagaataactctaacctctcgagaggccatctcaaccgctgtcgcgcatgtcacaaccttctcacatttaacaatgataccctgcgctgggagcggacgacgcccaattattcaagtggcgaggccagttcatcgtggcaggtgccctcatccttcgagagtgttccctcctcaggatctcagttacccccactggagaggaccgaggggcagaccccttcttcatcccgacttgaactgagcagcagcgccagccctcaggaagagcgcaccgtaggggtggctttcaaccaggaaacaggtcattgggagcgcatttatacacagtcgtctaggagcgggactgtaagccaggaggccttgcatcaagacatgccggaggagagcagcgaagaggacagtctgcgaagaagatctcttgcactgtctcctcgactcgagtattccggagctatcctggcccattgtaagctcaggttacccggaagttgtcacagccccgcgtcagcctctcaggtggccgggaccacgggtgctcaccaccacgcgaggttaatttttgccttcctggtggagatggaattccatcatgtttctcaggcaggtttggagctacttaccagtggcgacttaccaacatcggcatcccagagcgctggcattaccggggtgagccatagagcatggcctcgcttactggagtcatcactcatatcattatcaaggtatgatggggccggatctagagagcacccgatctaccccgatccagcctag

SEQ ID NO: 180130 - DNA, 3627 bp, Artificial Sequence
  Description of Artificial Sequence: Synthetic coding sequence
atgaaggtggtgcccgagaagaacgccgtgcggatcctgtggggcagggagcgcggagcccgagctatgggcgcacagaggctcctccaagagctggtggaagacaagacaagatggatgaaatgggagggaaaaagagttgagctccccgatagccctagatctacctttctgctggccttcagtccagataggacacttttagcatctacccacgttaatcacaatatatacattactgaggtgaaaacaggaaagtgcgtgcacagcctgatagggcacaggcgcacgccctggtgcgtgacttttcatcccaccatcagcggattgatcgccagcggctgcctggacggcgaggtgcgcatctgggacctgcatggcggttccgaaagttggtttaccgactcgaataacgcaatcgcctctctcgcattccaccccactgcacaattgttgctgatcgccacagcgaacgagattcatttctgggactggagtcgacgggagcctttcgcagtggtgaagacagcatcagagatggaacgcgttcgtctcgtgagatttgacccattgggccattacttactaactgccattgttaatccctccaaccagcagggtgacgatgagcctgagatacccattgacgggaccgaactgagtcactatcgccaacgcgctttactgcagagtcagcccgtcagacgcactcccctgctccacaactttctgcacatgttgtcatctaggtcctccggcatccaaactgagccgtttcacccacccgagcaggcctccagcactcaacaggatcaaggactccttaacaggccgagcgcctttagcacggtccagagcagcacggcaggaaacaccctacgcaatctcagcctgggaccaacccggcgctccttggggggcccgctgagctcgcatccgtcccgctaccaccgcgagatcgcccccggcttgaccggatcggaatggacaaggacggtgttgtcactcaatagtcgatctgaagctgagtctatgccgccaccgaggaccagcgcttcatccgtcagcctcctaagcgtcctgaggcaacaggagggtgggtcacaggcctccgtgtatacatctgctacagagggacggggctttcccgcgtctggccttgcaaccgaatccgatggcgggaatggctcttcccaaaacaacagtggctccattaggcacgagctgcagtgtgatctgagaagatttttcctagaatatgataggctgcaggagctggaccagagcttaagtggtgaggctccacagacacagcaggctcaggagatgcttaataacaatatcgaaagcgagcggcccggcccttcacatcagccgacaccccactccagcgagaacaattccaacttgtccagagggcaccttaatcggtgccgtgcatgccacaacctgctgaccttcaacaacgacactctccggtgggagcggaccacccctaactactcctctggagaagcgtcatcctcctggcaagttccttccagctttgagtctgtgcccagcagcggatctcagctgccgcctcttgaacgtacagagggacagacgccttctagttccagactggaactgtcctcaagcgctagtccacaggaggaacgtaccgtgggcgtggcttttaatcaagagaccggtcactgggagcggatctacacacagtcgtcacgcagcgggacagtaagccaagaggctctccaccaggatatgcctgaggagagttcagaagaggatagtttgaggcgccgcctcctggaatcgagcttaatctcactttcacgatatgatggggccgggtcccgggagcatcccatttaccctgatcccgcaagactgagccctgccgcatactacgcacagcggatgatccagtacctctctcgccgggatagcattagacagagatcaatgaggtaccagcaaaatcgacttcgcagtagtaccagttcgtctagttctgacaatcagggtcctagcgtagagggcactgacttagagttcgaagactttgaagataacggagaccgctctagacatcgcgcccctcgcaatgcccggatgagcgctcccagcctcggccgcttcgttcctaggcggtttctgctgcctgagtacctgccatacgctggaattttccacgagcgcggtcagccaggactggcaacacatagctccgtaaatagagtcctggccggagccgtcatcggcgatggtcagtcagctgtggcttctaacatagcaaatacaacgtaccgtcttcagtggtgggattttaccaagtttgatctccctgaaattagcaatgcctccgtgaacgtgcttgtacagaattgcaaaatctacaatgatgcctcctgtgatatatcagcagacgggcaactgctggccgcctttattccaagctcccagcggggttttcccgacgagggcatactggctgtctacagccttgctccccacaaccttggggagatgctgtatacgaaaaggtttggccctaatgcgatttccgtctcgctcagccccatggggcggtatgtcatggttggactcgcttctcgaagaattttactacacccctcaaccgaacacatggtcgcacaagtgttcagattacagcaggcccacggaggcgagactagcatgcgaagagtctttaacgttctgtacccaatgccggccgatcagcggcgccatgtgtccatcaatagtgcaaggtggcttcctgaacccggcctggggttggcatacggcactaataagggtgacctcgtaatttgccggccggaagcgctgaattctggagttgagtattattgggaccagcttaacgaaaccgtgttcactgtgcacagtaatagtcggtcctctgagaggcccgggacttctcgggcgacttggcgaaccgatagggacatgggccttatgaatgccatcggactccagccacgaaatcccgcaacaagcgtgacctcccagggaacacagacactagcattacagcttcaaaacgcagagactcagaccgaacgggaggttcctgaaccggggactgccgcttcgggccctggcgagggagaaggcagtgagtatggcgcgtcaggcgaggatgctctgtctcggattcagcgcttaatggccgaaggcggtatgaccgccgtggtgcagagagaacaaagcacgaccatggccagtatggggggctttggcaataacattatcgtgtcccatagaatccacagaagttcacagaccggcacggaacctggcgccgcccacaccagttcccctcaaccttcaacctccaggggcctcctccccgaagctgggcagctcgcagagaggggtttgtcacctcgcactgcgtcctgggatcagccaggtactccaggcagggagccaacccagcccactcttccttcttccagtcctgttcctattcccgtctctctgcctagcgctgaaggccccactctgcactgcgagctgacaaataacaatcatctgttagatggaggcagttcacgtggggacgcagccggtcctcggggagaacctcggaacaggtag

SEQ ID NO: 180131 - DNA, 3810 bp, Artificial Sequence
  Description of Artificial Sequence: Synthetic coding sequence
atgaaggtggtgcccgagaagaacgccgtgcggatcctgtggggccgcgaaaggggagcacgagcgatgggtgctcagagattactgcaggagttggtcgaagataagaccagatggatgaaatgggagggaaagagggtggagttgcctgattcaccgaggtccacgtttctcttagcattttctcctgatcgtaccctgttagcctctactcacgtcaatcacaatatttatatcacagaggtcaagacagggaaatgcgtgcattctctgataggccacagaagaaccccctggtgcgtgacatttcatcccactatatcagggttaattgcctcagggtgtctggatggcgaagttcggatatgggatctgcatggagggagcgagagttggttcacagattccaacaatgctatcgcaagcctggccttccaccccaccgctcagcttctgctgatcgccacggccaatgagattcacttctgggactggtcccggagagagccctttgcagtggtgaaaaccgcctctgagatggaacgggtcagactggtgcggtttgatcccctgggacattatctgctgactgccatagtgaacccatcgaaccaacagggagatgacgaaccggagatacccattgacggaaccgaactaagccattacaggcagcgtgccctgctgcagagtcagcctgttaggcgtacaccattattacacaatttcctgcacatgctgagcagcagatccagtggaatacaagttggcgaacagtccacggtccaggattctgcgaccccctccccaccgcccccgcctccgcagccaagtaccgagcgtcccagaacgtccgcgtacataagactgcgccaacgcgttagttatcctactgccgaatgctgtcagcacttgggcatcctttgcttatgttccaggtgcagcggtacccgagtaccttcgttgctgccgcaccaggattccgttcctcctgcttcagcccgcgcaacgactccgtctttctcttttgttcagaccgaaccctttcatccccccgagcaggctagttccacccagcaggaccagggtctcctcaatcgacctagtgcattttccactgtgcagtcatccaccgcaggaaacacgctgaggaatctgtctcttggtccaactcggcgaagtctaggtggccctctttctagccatccaagcagatatcaccgagaaatagctccgggcctgacgggttcagaatggacgagaacagtattgagcctgaatagccgctccgaagcagagagtatgccaccacctcgcaccagtgcatccagcgtgtccctgcttagtgtgctgagacagcaagagggcggaagtcaggcctccgtctacactagcgccaccgaggggcgaggattccctgcatccggcctcgccaccgagtccgacgggggcaatggttccagccagaacaatagtggaagcatccgccacgagctgcagtgcgatctgaggaggttctttttggaatatgatagactgcaggagttagaccagtccttgtcaggagaggccccccagacccagcaggcacaggagatgctgaataacaacatagaatcggaaagacctggaccatcccaccaacccacaccccactccagtgaaaacaactcgaatcttagtcgagggcacttaaacaggtgccgtgcctgccacaacctcctgacatttaacaatgacacgctccgatgggagcgcactacacctaactactcatcgggagaggccagctccagttggcaggtgcctagcagctttgagagtgtgccgtcgagcggatctcagctgccacctctggagcggacagagggccaaacgccgagctcttcccggttggaactctcaagctcagcgagcccccaagaagagagaactgtgggcgtcgcattcaaccaggagacgggccattgggaacggatctatacccagagctcaagatctggcactgtatctcaagaggccctgcatcaggacatgcccgaagaatcttccgaagaggattctctcagaaggttatctcctgcagcctactatgcccagagaatgatacagtaccttagccggagagattctatccggcagcgctccatgcggtatcaacagaaccgccttaggtcgtcaactagtagctcatcttcagacaatcaggggccatcagtagaagggacagaccttgagtttgaggatttcgaagacaacggtgatcggtcccgacaccgcgcgccccggaatgcgagaatgtccgcgcctagtctgggacgcttcgttccaagacggttcctgctgccagagtacctgccttatgcaggcatttttcacgaacgcggacagcctggactggctacgcactccagcgtaaaccgcgtcctagccggtgccgtcattggagatggtcagagcgcagttgccagtaatatagctaatactacgtatcgcctacagtggtgggattttactaagttcgacctgcctgaaatatccaatgcaagtgtgaatgtgctggtgcaaaattgtaaaatttacaatgacgcatcttgcgatatttctgctgatgggcagctcctcgccgcttttatccctagtagccaaagaggattccctgacgagggtatactggctgtctattcgctcgcgcctcacaacctgggtgagatgttatacacaaaacgctttggcccgaatgccatcagtgtcagccttagtccaatgggtaggtacgtcatggtcgggctggcatcaaggaggatcctcctccacccatcaacggagcacatggtcgcacaggttttccgactgcagcaagcgcatgggggggagaccagcatgagacgcgtgttcaacgtcctgtatcccatgcccgccgaccaacggcgtcatgtcagtatcaactcggctaggtggctccccgagccaggactgggactggcttacgggactaataagggggatctagttatttgcagacccgaagcacttaactccggggttgaatactactgggaccaactgaacgagaccgtgtttacagtgcattccaacagtcgttccagtgagcgtcctggaacgagccgcgccacatggcggactgatcgtgacatgggtctgatgaacgccattggcctgcagccacggaatcccgccacatcagtgacatctcaaggaactcagaccctggcactgcagctccaaaatgctgagacacagaccgagcgtgaggtgcctgaacctggcacagctgccagcgggcccggagaaggggaggggtcagagtatggcgcaagcggagaggacgccctgagtcgcatccaaaggctgatggccgagggtggaatgacagctgtggtgcagagggagcagtctactaccatggcctctatgggtggatttggaaataatatcatcgtctcccacagaatccataggagcagccaaacaggaactgaacctggggccgctcacacgtcatccccacaacccagcacctcccgtggcctactacctgaagcaggtcagctggctgagaggggcctgagtcctcggacggcaagttgggaccagccaggtacgcctggcagagagcctacacaaccgaccctgccaagcagctcgccggtgcctatacccgtctcactcccttcagcagagggacccacactgcactgcgaactgacaaacaataaccacctattggatgggggatccagccggggagatgcagccggcccccgaggcgagccgaggaaccgatag

SEQ ID NO: 180132 - DNA, 3897 bp, Artificial Sequence
  Description of Artificial Sequence: Synthetic coding sequence
atgaaggtggtgcccgagaagaacgccgtgcggatcctgtggggcagagagaggggtgcacgcgcaatgggagcacagcggctcctgcaggagttagtggaagataagactcgatggatgaaatgggaaggcaagagagtcgaattacccgattcaccccggagcacctttttgcttgccttcagccctgacaggacactccttgcttctacccacgtgaaccacaacatatacatcaccgaagtgaaaaccgggaagtgtgtgcactcgctcatcgggcaccggagaacgccttggtgcgtaacattccatcccacaatttcaggtctcattgcgtccggctgcctcgacggtgaagtcagaatctgggatctacatgggggttccgagtcttggttcactgattctaacaacgctattgccagcctcgcctttcacccaactgcccagctgctcctgatagctaccgccaacgagatacacttttgggactggagccgccgtgaaccttttgccgtcgtgaaaactgcgagtgaaatggaacgggtgcgtcttgtgcgatttgatccactcggccattatttgttaacagccatcgtgaacccctccaaccagcagggcgacgacgagcctgagatccccattgatggcaccgagctgtcacactatcgccagcgggcactgctgcagtcacaaccggttagaaggacccctctgctgcacaatttcctgcacatgctctcaagccgcagctctggcattcaagtgggggagcaatcgacagtccaggattcagctacacccagtcctccccctcctcctccccagccttctacggagcgcccaaggactagtgcctacatccgacttcgacagcgagtcagttatccaacagcggaatgttgtcaacacctggggattttatgtctgtgctcccgatgtagcggaactcgagtgccttccctgctcccacatcaggactctgtgccacccgcttctgcacgcgccactaccccctctttcagcttcgtgcagaccgagccctttcaccctcctgaacaagcatcctctacccaacaggatcagggactactaaaccgtcctagcgctttttctacggtccagagcagcacggctgggaacacactgcgcaatctgagtctggggcctacacggcggtcattgggggggccactgtcttctcatccttcaagatatcaccgtgagatcgctccagggttaactggaagcgagtggacccgcaccgtgttgagcctgaacagtcggagcgaagcagagtccatgcctcctcctcggactagcgctagttcagtcagcctcttatccgtgttacgccagcaggaaggagggagccaggccagcgtgtatactagcgctaccgaaggaaggggatttcctgctagcggacttgctacggagtctgacgggggtaatggcagctcccagaacaatagtgggagcatccggcatgagttgcaatgcgacttgcgaaggttcttcctcgagtatgaccgccttcaggaactcgatcagtcactgtcaggggaggctcctcagacgcagcaagcccaagaaatgctgaataacaacattgaatctgaaaggccgggtccctcgcaccagccgacccctcactcctcagaaaataacagcaacctgtccagggggcatctgaacaggtgccgagcctgtcataatctgttgaccttcaacaatgatactttgaggtgggagaggaccacgcccaattattcttctggcgaggcctctagtagctggcaggtgccctcctcgttcgaatcagtaccaagctcgggttcgcaactgccccctttggagcgtaccgagggacagacaccttcaagcagtcggcttgaactgtcttcaagcgcgtcacctcaggaagaacgaaccgtcggtgttgctttcaaccaagagacgggccactgggagaggatctacacccagtcttcccgttctggtacagtcagccaggaggccctgcaccaggatatgccagaagaatctagtgaggaggatagtctccgccgacggctgctcgagtcctcactgattagtctgagcaggtacgacggtgcgggatctagggaacatcctatctaccccgaccccgctcgcctgtcccctgccgcgtactacgcgcaacgcatgatacagtatctctcaagacgcgatagcatccggcagaggagcatgcgctaccagcagaaccgcttgcgcagtagcacatcaagctcaagttcagacaaccaggggccctcagtggagggcacagatttggaattcgaggatttcgaagacaacggcgacagatccagacatcgggcaccccgaaatgctcggatgtccgctcccagcctggggcgtttcgtaccccggcgctttctgcttcctgagtatctgccttatgccgggatcttccatgagaggggtcagcccgggctggctacacattctagcgtgaacagggtactggcaggagcagttattggggacggccagtctgctgtggccagcaacatcgcgaatacgacctacagattacagtggtgggactttactaaattcgatttacccgaaatcagcaacgcatccgtgaatgtgctcgttcaaaattgcaagatctacaatgacgcaagctgtgacatttctgccgatggccagctgctagcagccttcattccctcctcccagcgggggtttcccgacgaggggattctggcagtgtattcactcgccccccacaacctgggggaaatgctatacacaaagagatttggccctaacgctatctcagtttccctgagtcccatggggaggtacgtaatggtgggcctggcgtctcgcagaatactgctgcacccttctaccgaacatatggtagcgcaggtgttcaggttgcagcaggcccatggcggggaaacatccatgcggcgcgtgtttaatgtgctctatcctatgccagccgaccaaagaagacacgtgtccatcaactcggcgagatggctgccggaaccaggcctcggcctcgcctatggcacgaacaaaggcgatctggtcatctgccgaccagaagccctaaattcaggagtggagtactattgggatcagctgaatgaaacagtatttaccgtgcatagcaacagtcggtcctcagaacggcccggaacgtcgcgcgccacttggagaaccgaccgcgacatgggactgatgaacgctataggtctgcagccgaggaatcctgccactagcgtaaccagtcaaggcactcaaaccctggccttacagcttcagaacgcagaaacccaaaccgaacgcgaggtgcctgagcccggcaccgccgcctctgggcctggagagggggaaggctctgagtatggcgcttctggcgaagacgctctgtctcggattcagcgactgatggcggagggcggaatgactgccgttgttcagagggagcagagcaccacaatggcgagcatgggtggcttcggaaataacattatagtgtctcataggattcacaggtcaagccaaacgggaactgagcccggagctgcccacacctcgagcccgcaaccctctacctcacggggacttctgcctgaggccggccagctggccgaaagaggcctgagcccacgaacagcttcgtgggatcagcccggtacgcccggccgggaacctacacagccaaccctgccatccagttctcccgttccaatccccgtcagtctaccgtccgccgaaggcccgactctgcattgcgaactgacaaacaataaccatttgttggacgggggatctagtagaggtgatgccgctgggcctaggggagaacctagaaacagatag

SEQ ID NO: 180133 - DNA, 75 bp, Artificial Sequence
  Description of Artificial Sequence: Synthetic coding sequence
atgaaggtggtgcccgagaagaacgccgtgcggatcctgtggggcagggaaaggggagcgcgggccatgggatag

SEQ ID NO: 180134 - DNA, 3810 bp, Artificial Sequence
  Description of Artificial Sequence: Synthetic coding sequence
atgaaggtggtgcccgagaagaacgccgtgcggatcctgtggggccgcgaaaggggtgcccgagctatgggcgctcagcgcctactgcaggagcttgtcgaggataagacccgttggatgaagtgggagggtaagagggtcgagctgcccgactcaccacgttcaacctttctgctcgcattttcgccagaccggacactgttggcctctacacacgttaaccacaacatttacataacagaagtgaagacaggaaaatgcgtgcattcacttatcggacatcgccgcacgccctggtgcgtcaccttccaccccacaatctctggactgatcgcatcagggtgtcttgatggcgaagtcagaatttgggatttgcacgggggctccgagtcctggttcactgacagtaataatgccatagcctctctggcattccaccccactgctcagctgctcctgatagcgacggctaacgagatccacttctgggactggagcaggcgagaaccatttgctgtggtgaagacagcctctgagatggagcgggtgagactcgttaggttcgatcccctgggtcactacctcctcaccgcaattgtaaatccttctaaccagcagggagacgacgagccagagatccccattgacgggactgaactcagccattaccgccagagagcgctacttcagagtcagcccgtcagacgtacccctctgctgcacaattttctgcatatgctgagctcacgctccagcggtatccaggtcggagagcagtctaccgttcaggacagcgcaaccccttccccaccccccccaccaccacagccttccaccgaacggccaagaaccagcgcttacattcggctcagacaacgcgtctcttatccgaccgcagaatgctgccagcatcttgggattttgtgtctctgcagccgttgttccggaacgcgcgtgccatctctgctgccacatcaggactccgttcccccagcttctgccagggccactaccccaagcttctcattcgtgcagacagagcccttccatccaccggagcaggcatcctccactcaacaagaccagggccttctcaaccgcccttctgcattttcaaccgtccagtcgtcaactgccgggaacactttaaggaacctgtcacttggtcccacccgcaggtctctgggaggacccctgtctagtcacccatcgcgttaccatcgcgagatcgctccaggtctgaccggttctgaatggactcgtacagtgctgagtctgaacagtaggagtgaagcagagagcatgccacctcctaggacttccgccagtagcgtgagcttgttaagtgtgctaaggcagcaggagggcgggtcccaggcatctgtttacacttccgccaccgagggtaggggcttccccgcctctggcctggccacagaaagtgatggaggaaatggcagcagtcagaataattccggctcaatccgccacgaactgcagtgcgatttgcgaagattcttcctggaatatgaccggctgcaggagctggaccagtccctgtcaggcgaagccccccagactcagcaggcgcaagagatgctaaacaacaacatcgagagtgaaagaccgggaccatcacaccagcctacaccgcactctagcgagaacaacagtaacctgtcccgggggcacttgaaccgctgcagggcctgccacaatctactcacttttaataacgataccttacgatgggaaagaacaacaccaaattactcctctggcgaggcaagcagttcttggcaggtgccgagtagttttgagtcggtgccttctagtggctcacaactcccccccctcgagaggacggaggggcagaccccctcctcctcccggctcgagctgagcagcagtgcatctccacaggaagagaggacagtgggggttgcttttaatcaggagaccggccattgggagcgtatctatacccagtcctccaggtcaggcacagtcagtcaggaagctttacaccaggacatgcctgaggagagcagtgaggaagactcccttcgcaggctgtcacccgcagcttactacgcccagaggatgattcagtacctttcccgccgcgattcgattcggcagcgctcaatgcgctaccagcaaaatcggttgcggtctagtaccagcagttcttcgtccgataaccagggcccatcagtcgaggggaccgatttagagtttgaagacttcgaggataacggagacaggagtcggcacagagctccacggaacgcaagaatgtctgccccttccctaggcaggttcgtgccccgaagatttctgttgccagagtacctcccttacgctggaattttccacgaacgagggcagcccgggctcgcaacccattctagtgtaaatcgagtgcttgccggggctgtcattggcgacggccagagtgccgtggcttccaatattgcgaataccacgtacagactgcagtggtgggactttacgaaattcgacttgcctgagatttccaacgcttcagtgaacgtgctcgttcagaattgcaagatttacaatgacgcctcctgcgatatctccgcagatggtcagttgctagctgcctttattccctctagccagagggggttcccggacgaggggatactggccgtctacagcctggcgccccacaatctgggggagatgttgtataccaaaagatttggtccaaacgccatcagcgtgtctctttccccaatgggacgctacgtcatggtcgggctggcctctcgtaggatactcctccacccttctacggaacatatggttgcccaggtgttccgcctccaacaggctcacggaggcgaaacatcaatgcgacgcgtgttcaatgtgctgtatcccatgccggctgaccaacgccgacacgtgtcaattaacagcgccaggtggctgcctgagcccggcttagggttagcctacggtaccaataaaggcgacctcgtcatctgtagacctgaagcactgaactcgggagtcgaatactactgggaccagctcaacgagactgtgtttaccgtgcacagcaattcgaggtcatcggagagacccggcacctctcgtgctacctggagaaccgatcgagacatgggattgatgaacgccattggtctccaaccaaggaatcccgccacaagcgtgacctcacagggcacccagactttggcactgcaactgcagaacgcagagactcagactgagcgcgaggtgcccgagccaggaacggctgcatccggtccaggcgagggagagggatccgagtacggcgccagcggcgaggatgccctgagtcgaattcagcggctcatggctgagggcggcatgactgccgtagtgcagcgagagcaatcaactactatggcttccatgggaggattcggcaataacataattgtttctcaccgaatccatcgcagttcccaaactggaactgaacctggggccgctcatacaagctctccccaaccctctacttcccgtggccttttgcctgaggcaggacagttggctgagcgaggattaagcccaaggacagcctcctgggatcagccgggcactcccgggcgagagcccacgcagccgacactccctagtagctcaccagttcccatacccgtgagtcttccctctgctgaaggccctacattgcactgcgagttaaccaacaacaaccatctcttggacggtggctcctctaggggcgatgctgctggacccaggggagagcctagaaacaggtag

SEQ ID NO: 180135 - DNA, 3717 bp, Artificial Sequence
  Description of Artificial Sequence: Synthetic coding sequence
atgaaggtggtgcccgagaagaacgccgtgcggatcctgtggggcagggagcggggcgcaagggcgatgggcgcacagagacttcttcaggagctcgtggaggacaaaaccagatggatgaagtgggagggcaagcgagttgaactgccagattcacccagaagcacctttctgctggcattctcccctgatcgaacattgctcgcatctacccacgtgaatcataacatctacattaccgaagtgaaaaccggtaagtgtgtgcactctttaattgggcatagacggaccccgtggtgtgtcaccttccatcctacaatatcagggctgatcgctagtggttgtctcgacggcgaagtgcgtatctgggacctgcacgggggctctgaatcgtggtttacagactctaacaacgccattgccagtttggcattccatccgactgcacagctgctgctgatcgctacagccaacgaaatccacttctgggactggtcaagaagggagccgttcgcagtggtcaagacagcctccgaaatggagagagtgaggctcgtgcggttcgatccattaggccactatctactgaccgcaatagttaacccttcgaatcaacaaggagatgatgaacctgagattccaatcgatggaaccgaattgagccactaccgccagagagctctcttacaaagccagccagtgaggcggactccgttgctccataactttctgcatatgctcagttcccgttccagcgggattcaggtgggcgagcagtcaactgttcaagactctgccacacccagtcctcctcctcctccacctcaaccttctacggagaggcctcgcacaagtgcttacattcgcctgcggcagagggtcagttaccccacagcagagtgctgccagcacctgggtattctctgcctgtgttcacgttgctccggcacccgagttccctcacttctgccacatcaggacagcgtaccacccgcttcggcccgggcgacaaccccctcttttagttttgtccagactgagcccttccatcccccagaacaggcctccagcactcagcaggatcagggattattgaatagaccttccgcattcagcactgttcaaagtagtaccgccggaaacaccttaagaaatttgagcctcgggcctacaagaagatcacttgggggcccactgtcctctcacccttcccggtaccacagagagatagccccaggcctgaccggctctgagtggacccgcaccgttctctctctgaactctcggagtgaggcagagagcatgccccccccacggacaagcgcaagcagcgtctctttgctgtctgtcctgaggcagcaagagggtggctcccaagctagtgtctacaccagcgcaaccgaagggcgcggattccctgccagcggtctggcgaccgagtccgatggcggcaacgggtcttctcagaataatagtgggtccattagacacgaactccaatgcgacctgcgcaggtttttcctagaatatgaccggctgcaagaactggatcagtccctttcaggtgaagcccctcagacacagcaagcgcaagagatgctgaataacaatattgagagcgagcgaccaggcccgtctcaccagcccaccccccactcatctgaaaataattctaatttgtccagaggccacctgaatcggtgcagagcctgtcataacctccttaccttcaataatgatactctccgatgggaacggaccacgcccaactactcctcaggcgaagcaagttcctcctggcaggtcccaagttccttcgagtccgtgccaagtagcggctctcagctccctcccctcgagagaactgaagggcagaccccctcatctagtcggttggaactctctagttctgcctcgccacaagaggaacgtacagttggagtggcctttaatcaagagaccggtcactgggaaagaatatatacccagtcatccagatctgggacggtttcacaggaagccttgcaccaggatatgcccgaggagagctcggaggaggattccctccgacgccgcctgttagaaagctctctgatcagcctcagcaggtacgacggggccggaagcagggaacaccccatctatcctgaccccgccagagataacggggaccgctctcgccatagagcaccaagaaacgcccggatgagtgcaccttctctcggcagatttgtgccaagacgttttcttctgccagagtacctgccatacgctgggatatttcatgagaggggtcagcctggtctggctactcacagttcagtgaaccgcgttctggctggcgcggtgattggtgacggccaaagcgccgtcgctagcaatatcgccaacacgacgtacaggcttcaatggtgggattttaccaaatttgatctccccgagatcagcaatgcctccgtcaacgtgctggtccagaattgtaagatctacaatgacgcatcttgcgatatcagtgctgatggacagttgctggcagccttcatcccatcttcccagagaggtttccctgacgagggcattctggccgtttacagtctggcacctcacaacctcggggagatgctgtataccaagcgatttggccctaatgccatcagcgtctcattatctccaatggggaggtacgtgatggtggggctggccagtcgcaggattctcctccatccgagcaccgagcatatggttgcacaggtctttcggcttcagcaagcacatggaggtgagacttccatgcgacgggttttcaacgtgctgtatcctatgccagctgatcagaggaggcacgtgagcatcaattccgccagatggctgcctgaacctggcctcggtctcgcgtacggtacgaacaagggagatttggtcatctgtaggccagaggcactgaatagcggagttgagtactattgggaccagcttaatgaaaccgtttttaccgtccatagtaatagcaggtcatctgaacgcccaggaaccagtcgggccacctggagaaccgacagggatatgggtctgatgaatgctattggcctgcagccccggaaccccgccacaagcgtcacttcccagggcacacagaccctcgccctgcaactgcaaaatgctgaaacccaaacagaaagggaagtgccagagccaggaaccgccgcgtccggtccgggggagggagagggaagcgaatacggggcatctggtgaggatgctctgtcacgaatacaacgccttatggcagagggcggaatgaccgccgtcgtgcagcgagagcagagcacaacaatggcctcaatgggcggtttcggcaataacattatcgtttctcataggattcatcgctccagccagaccggcacagagcctggagccgcacacacctcgagcccacagccatcaacatccagagggctgttacctgaggctggccagctggcagaaagagggctgagcccccggacggcatcatgggatcagcctggcactccaggacgagagccaactcagcccacactgccgagttcatctcctgtgccaatccccgtatcgcttccttccgccgagggacccacgctacattgtgagctcaccaataataaccacctattggatgggggctcttcaaggggagacgccgccggtccacgcggtgaacctagaaaccggtag

SEQ ID NO: 180136 - DNA, 3540 bp, Artificial Sequence
  Description of Artificial Sequence: Synthetic coding sequence
atgaaggtggtgcccgagaagaacgccgtgcggatcctgtggggcagggagcgtggcgccagagcaatgggggcccagcggctccttcaggagttggtggaagacaaaaccaggtggatgaagtgggaaggaaaacgggtggagctcccagactcaccacgatccaccttcctgctggcattctctcccgataggacattgctcgccagtacacacgtgaatcataatatatacatcactgaggttaagactggaaaatgtgtgcacagcttgataggacacagaaggaccccatggtgcgtgacttttcacccaacaataagtgggctcattgctagtggatgcctcgacggcgaagtgcgcatctgggatctacatggtggatcagaatcgtggttcacagacagtaacaatgcaattgccagtctagctttccacccaaccgcccagctcttactgatcgcgaccgcaaatgagattcatttctgggactggtcccggcgggagccgtttgctgtcgtaaagacagccagtgagatggaacgcgtgcggttggttagatttgatcctctcggtcattacctgctgacggcaatagtgaatccatcaaaccagcagggggacgatgagccggagatcccgattgatgggacagagctatctcactaccggcagcgagccctgctgcaatcccagccagtgcgacggacccccctgctgcacaatttccttcacatgctcagcagtagaagtagtggcattcagactgagccctttcatcccccagagcaagcgagttccacacagcaggaccaagggctcctgaaccggcccagcgccttttctaccgttcaatcatctaccgctggtaacacccttaggaacctatccctggggcctacgagacgcagtctgggcgggccccttagcagccatcctagccggtaccatagggagatcgcgccagggcttactggtagtgagtggacacggactgttttgagcttgaactcaagaagtgaagctgagagcatgccaccgccccgaacttctgccagttccgtgtctttgctgagcgttctgcgccagcaggaaggaggttcccaagcctccgtgtatacgagtgctacagagggaagagggttccccgcctccggccttgccacagagagcgacgggggaaatggaagctcccagaataattcaggttcaatccggcacgaactgcagtgtgatctccggcgcttctttctagaatatgacaggctgcaggaacttgaccagagtctaagcggcgaagccccgcagacccagcaggcacaagaaatgttaaacaacaatatcgagagcgagaggcccggtccctcccaccagcccacaccacactcttccgagaataattccaatctcagtagagggcatctgaacagatgtagagcgtgccacaaccttctgactttcaacaatgatacgctgcgctgggaacgtaccacccctaactactcgagcggggaagcaagttcctcctggcaagttcccagcagctttgaatctgtgccctcatccggttcccagctcccccccttggaacgtacagagggccagactccctctagctctcggctcgagctgtcttcttccgctagcccacaggaggaacgaacagtgggcgtggcttttaaccaggagactggacactgggagaggatctacacacagtctagccgcagcggcacagtgtcccaagaagctttgcaccaagacatgcctgaggagagctcagaagaagactccctccgacgcctctcccctgcggcgtattatgcccaacgcatgatacagtacttgtcccggagagatagcatccgccaacggtctatgagataccagcaaaatcgcttgcggtcatccacatcttcttcatcctccgacaaccagggcccatcagtggagggcacggatttggagtttgaggactttgaagacaacggcgatagatcacgccaccgggctccacggaacgctaggatgagtgccccttctctgggcagattcgtgcctcgtcggtttctgctaccggaatatcttccgtacgccgggatctttcatgagcgcggacagccaggcctggctacccattccagcgtaaaccgagtgctggcaggtgcagtcattggagacggacagtcggccgtcgccagcaacattgctaatacgacctatcgactccagtggtgggattttaccaagtttgatctcccggaaatctctaacgcttctgttaacgttctcgtccagaactgtaaaatctacaacgatgccagctgcgatatatcagctgatgggcaactcctcgctgcgttcatcccttcctcacaaagaggcttccctgacgagggtatactggctgtgtatagcctggccccgcacaatttaggcgagatgctttacaccaaacgatttggcccgaatgccatcagcgtttcgctgtcaccgatggggcgatatgtgatggttgggttggcttccagacgaattctccttcacccgagcacggagcatatggtggcacaggtattcaggctccaacaagcccatggcggcgaaaccagtatgcgtcgagtctttaatgttttgtaccccatgcctgcagatcagcggaggcacgttagcatcaatagcgccagatggcttccggagccaggcctcgggctcgcatacggaacgaacaagggcgacctggtgatttgccggccagaagcattgaatagcggtgtggagtattattgggaccagctgaacgaaacggtgttcactgtgcattctaattctaggtcctccgagcgtcccggcaccagtagggctacctggagaacagatcgggacatggggttgatgaatgcaattggcttacagcctcgtaatcctgccacttccgtgacttctcagggcacacagacgctcgcattacagcttcagaacgccgagacccagactgaacgggaggtgccggagcccggcacagcagcttccggccccggagagggcgaagggtccgaatatggtgcatccggcgaggacgctcttagccgtattcaaaggctaatggcagagggcggtatgaccgcggtggtgcagcgggagcaaagtaccaccatggcgagtatgggtggattcggcaacaacatcattgtctctcaccgaatccacaggtctagtcagaccggtacggaacctggggcagcacacactagcagcccacagccctccacttccagaggccttctgcctgaggctgggcagctcgccgagcgggggctgagccccaggactgcaagttgggaccagcctggcactccaggcagggaacccacacagcccactctgccttctagttcccccgtccctattcctgtgagcttaccttcagctgagggcccaacgctccattgcgagctgactaacaacaaccacctgttagacggtggaagttcacgcggcgacgccgcaggtcctcggggagagccacgcaacagatag

SEQ ID NO: 180137 - DNA, 1947 bp, Artificial Sequence
  Description of Artificial Sequence: Synthetic coding sequence
atggagaaggcccggcggggcggcgacggcgtgccccggggccccgtgctccatatcgttgtcgtgggctttcaccacaaaaaaggatgtcaggtcgagttcagttatccacccctgattcccggagatggtcatgatagccacacactgccagaagaatggaaatacctcccctttctggccctgcctgacggagctcataattatcaggaggatacggtgttcttccacctaccgcccagaaatggaaatggcgccaccgtcttcggtatctcatgctatagacagattgaagccaaggccctgaaagttaggcaagccgacattacccgagagacggtgcagaaaagcgtgtgcgttctctcgaagttgcctttgtacggactgcttcaagcaaagctgcagctgatcacccacgcttacttcgaggagaaggatttcagccagatcagcattctcaaggagttatacgagcatatgaattccagcctgggaggcgcgagccttgaggggagtcaggtgtacttgggactttcccctcgggatcttgtgctgcacttccgtcacaaagtgctgatcctgtttaagttaattctcctggagaagaaggtcttattctacattagccctgtaaacaagcttgtcggggccctaatgacagttctcagcctattccctggcatgatcgaacacgggttaagtgattgctcacagtaccggcccagaaagtccatgagcgaggacggcggcttgcaggaaagcaatccctgcgctgacgacttcgtgagcgccagcaccgccgacgtgtcacatactaatctcggcactatcagaaaggttatggctgggaatcacggggaggacgcggccatgaagacagaggaacctctcttccaggtcgaggacagcagcaaaggccaggagcccaacgacacaaatcagtacttgaagccgccttcacgtccctctccggatagctcggagtccgattgggaaactctggaccctagcgtcctggaggaccccaatttgaaagaacgtgagcagctgggctcggatcaaacaaacctgttccccaaggatagtgtgccctctgaatctctgcccataaccgtccagccccaggccaacaccggacaggtggtgctgatacctgggttaatctcaggccttgaggaggatcaatatggcatgcccctggcaattttcactaaagggtatctgtgcctcccatatatggcactgcagcaacatcatctgctttccgatgtcactgtcagaggtttcgttgccggggccacaaacatattatttcgacaacagaagcacttaagcgatgccatagtggaagttgaagaagccctgatccagattcatgacccagaactgagaaaactcctcaatcctaccacagcagatttgcgttttgcagattacctcgtgcggcacgtgaccgaaaaccgtgacgacgtgttcctggacggcactggatgggaaggaggggacgaatggatccgtgctcaatttgctgtgtacattcatgcactgttggccgcgactttacagctggataatgagaaaatactctccgattacggcacgacattcgtaacagcttggaaaaatacccacaattatcgggtgtggaatagcaacaagcatccggctctggctgagatcaaccctaaccatccctttcaaggtcaatactccgtgtccgatatgaaactgcgcttctctcactcagtccagaacagtgagagaggcaagaaaattggcaatgtgatggttacaacctcacggaacgtggtgcagacaggtaaggctgtgggccagtctgtgggcggtgccttcagcagcgctaagaccgcaatgtcctcctggctgagtacattcaccacaagcacgtcccagagcctgacggaaccccctgatgaaaagccctag

SEQ ID NO: 180138 - DNA, 1773 bp, Artificial Sequence
  Description of Artificial Sequence: Synthetic coding sequence
atggagaaggcccggcggggcggcgacggcgtgccccggggccccgtgctccacatcgtggtggtcggcttccatcacaaaaagggctgtcaggtggagttctcctaccccccactcatacctggtgacggtcatgactcacacaccctgcctgaggaatggaagtatcttccatttcttgcactgcctgatggagcccataactaccaggaagacacggtattctttcacctccccccaaggaatggaaacggagcaaccgtattcggcatatcatgctacagacagatagaagctaaagctctcaaagtcagacaggccgacatcaccagggagacagtccagaaaagcgtgtgcgtgctctctaaactgcctctgtatgggctgctgcaggccaaattgcagttgatcactcacgcttactttgaagagaaagacttttcccagatctctatactgaaggaactgtacgagcatatgaatagctctctaggaggcgcaagcctcgagggatctcaggtttatctggggttgagccccagggacctggtgctgcatttccggcacaaggtactgatattattcaagctaatcttgttggagaaaaaagtcttgttctacatttctcctgttaataagctggttggcgcccttatgaccgtcttgagcttgtttcccgggatgatcgagcacggcctgtccgactgcagccagtacaggcccaggaaaagcatgagtgaagatgggggcctacaggagtccaacccgtgcgctgacgacttcgtgtcggcatcaaccgccgacgtcagtcacaccaatctgggaactattagaaaggttatggccggcaatcacggcgaggatgccgctatgaagaccgaggaacctctgtttcaggtggaggattcttctaaaggacaggagcccaatgacactaatcagtatttaaaaccaccatcgcgaccctccccggacagtagtgagagtgattgggaaacgctagacccatctgtcctcgaagacccgaacctgaaagaacgggaacagctgggttcagaccaaacaaatttgttccccaaagatagtgtccccagcgaatccctcccaataacagttcagccacaagcaaacacgggccaggtcgtcctgatcccaggactgataagtgggttggaggaggatcagtacggcatgcctctggccatcttcaccaaaggctatctgtgccttccctacatggcgttgcagcaacaccacctcctgtccgatgtcactgtgcggggattcgtcgctggagccacgaatattctgtttcgtcaacagaaacacctttctgatgccatagtggaagtggaagaagctctcattcagattcatgaccctgaactccgcaagctgttgaatcccactacggctgatctcaggttcgctgattacctggtgcgccacgttacagaaaaccgagatgatgtgttcctggatggcacaggatgggagggcggagatgagtggattcgggctcagtttgctgtttacatccatgctctgctagctgctactttgcagctagtgctcttcagaatcgttaacgtgaagaagatcggaaacgtaatggtgaccacatcacgcaacgtggtccagactgggaaagccgtcggccaaagcgtgggaggagcctttagttctgcaaagactgctatgagcagttggttgtccacattcacgaccagcacatcccagagcttgacggaaccgccagacgagaagccgtag

SEQ ID NO: 180139 - DNA, 1392 bp, Artificial Sequence
  Description of Artificial Sequence: Synthetic coding sequence
atggagaaggcccggcggggcggcgacggcgtgccccggggccccgtgttgcacatagtggtggtcggattccatcacaagaaaggctgccaggtcgagttcagctacccaccccttattcctggagacgggcacgattcccatactctcccagaagagtggaagtacctaccctttctcgctttacctgacggggctcataattatcaggaggacactgtgtttttccacctgccgcccagaaacggcaatggcgccactgtgttcggaatctcttgttaccgccagattgaggctaaggcgttgaaggtgagacaggccgatattacccgcgagacagtgcagaagagcgtttgtgttctgtccaaactcccactctatggacttcttcaagcaaaattgcaattaatcacacacgcttattttgaggagaaggacttttcacagattagtatcctgaaggaactgtacgaacacatgaattcgtcccttgggggagcatctctggaggggagccaggtttatctgggcctgtctccgagagatctggtcttacacttccgccataaagtgttgatactcttcaagttaatcctgttggaaaaaaaggtgcttttttatatttctccagtgaacaagctagtgggcgcattgatgactgtgctgtccctctttccagggatgattgaacatggtctgtcagattgtagccaatatcgaccaagaaagagcatgtccgaggacggaggcctgcaggagtctaatccctgtgccgacgattttgtttcagcctcgactgcagatgtctcccataccaacctcggaacaattcgcaaggtaatggctgggaaccatggggaagatgccgccatgaagaccgaggagcccctatttcaagtggaagactctagcaagggtcaagagcccaacgatactaatcagtacctaaaacctccctctaggcccagccccgatagcagcgagagtgactgggagaccctcgacccatctgttctagaagacccaaatctgaaggaaagggagcagctgggatctgatcagacaaacttgttccccaaagattcagtgccgtccgagtctttacctatcaccgtccagccacaggccaacactggccaggtggttctcattcctggcctgatctccggccttgaagaagatcagtatggaatgccactggccattttcaccaagtgcacgcaggatgtgctgccgcaggccaaccatagtttcaagtttcttattacagatagacggattacaccaagacccctgcggaggcgtctagtttcagccacactgaccaacatgctccaggagaagtcttgctggaagaaacatatcaagtgtcggaggcgcgtacaaaaatag

SEQ ID NO: 180140 - DNA, 2532 bp, Artificial Sequence
  Description of Artificial Sequence: Synthetic coding sequence
atgagcagcgccatgctggtgacctgcctgcccgaccccagcagcagctttagggaggatgctccgaggccgccagttccaggagaagagggcgagaccccgccgtgccagccgggcgtgggcaaagggcaggtgacaaagcccatgcctgtgtcttccaacacgagaaggaacgaggatggcctgggagagccggagggcagagcctcccctgactcccccttaacaagatggaccaagtctctgcattcactattgggagaccaggatggagcctaccttttccgaacatttctggagagggaaaagtgtgtggacactcttgacttctggtttgcttgtaacggctttcgtcagatgaatctcaaagatactaagaccctgcgagtggcaaaagccatttacaaacggtatatagagaataatagcatcgtgtcaaagcagctgaaaccggcaactaagacatacatccgagacgggattaagaagcagcaaatagattctattatgtttgatcaagctcagactgagattcagagcgttatggaggagaatgcttatcagatgttcctgacctccgacatttatttggagtacgtccgatctggaggcgaaaacacagcatacatgtctaatggaggtctggggagtctcaaagtggtctgcggttacctccctacactaaacgaagaagaggagtggacctgtgcagactttaaatgtaaactgtcgccgaccgtcgttgggttgtcttcaaaaaccttgcgtgctaccgcaagcgtgcgaagtacagaaactgtcgactctggatatcgttctttcaagcgatccgatcccgtcaacccttaccatatcggctctggttatgtgttcgcccccgccacctccgccaacgactcagagattagctccgacgcccttaccgacgatagtatgtcgatgaccgactctagcgtggacggcatccctccctatcgcgttgggagcaagaagcagctacagagggaaatgcatagatcagtgaaagctaacggacaggtgtcgctgcctcacttcccgcgcacacacaggttgcccaaagaaatgacccccgtggaaccagctacttttgccgcagagctgatcagccgtctggagaaactgaaactggagctagaatctagacactctctggaggaacgcctgcagcagatcagggaggatgaggaaagggagggcagtgaactgactttaaattcccgcgagggcgctcctacccagcaccccctctctctgctgccatcagggtcatacgaggaggaccctcagaccatcctcgatgaccatctatccagggtgttgaagaccccagggtgtcaatctccgggggtgggccggtactccccgagatccagaagccctgaccatcatcatcatcaccactcgcagtaccactctttactaccccctggcgggaaactgccacccgccgccgcctccccaggagcttgtccactcttaggcggaaaaggatttgttaccaagcaaactactaagcatgtgcaccaccactacattcatcatcatgctgtgccaaaaacgaaagaggagatcgaagccgaggcaacacaaagggtccactgtttttgcccgggaggctcggagtactactgctactccaagtgcaagtcgcacagcaaagccccagaaaccatgcctagcgagcagttcggaggctcacggggctcaacactcccaaagaggaacggaaaggggacggagccgggtttggctctgccagctagggaaggcggggcccctgggggcgccggcgccctccagctcccgcgagaagagggcgataggtcccaagacgtgtggcagtggatgctggagtctgagcgacagagtaaacctaaaccacacagtgcccagtctacaaagaaagcttatccattagaatctgccagatcaagcccaggagagcgagcttcaagacatcacctgtgggggggaaattccgggcacccccgtactactccaagagcacatctgttcactcaggaccccgcaatgccacctcttaccccacctaatacattagctcagcttgaagaggcttgtcgcagactcgctgaggtttctaagccaccaaaacagcgatgttgcgttgcttctcaacagcgggacaggaatcattcagcgaccgtccaaacaggggccactcccttttctaaccccagcctggctcctgaggatcacaaggagcccaaaaaacttgccggagtgcacgcactgcaagctagcgaactggtcgtgacctacttcttttgcggcgaagaaatcccttacagaagaatgctgaaagcacaatcgctgactctcgggcattttaaggaacagttatcaaagaagggtaactatcgctattatttcaagaaggcaagcgacgagttcgcctgcggggctgtcttcgaagagatctgggaagacgagactgtcttgcccatgtatgagggcaggattttgggtaaagtggagcggattgactag

SEQ ID NO: 180141 - DNA, 2337 bp, Artificial Sequence
  Description of Artificial Sequence: Synthetic coding sequence
atgagcagcgccatgctggtgacctgcctgcccgaccccagcagctctttccgtgaggacgccccacggcccccagtccctggagaggagggtgaaactcccccctgtcagccgggcgtaggcaaggggcaagtcaccaagcccatgccggtaagctctaatactcgcagaaatgaggacgggctgggcgaacccgaaggcagggccagccccgattcacccctgacgaggtggacaaagagccttcattccctcttgggggaccaggacggagcctacttattcagaactttcttagaacgcgagaaatgtgtggatacactcgatttttggtttgcatgtaatgggttcaggcaaatgaacctcaaagataccaagacccttcgcgtcgcgaaggccatatacaagagatacatcgagaataatagcatcgtatctaagcagctgaaacctgcgaccaagacctacattagagatgggatcaaaaaacagcagattgacagtattatgttcgaccaggctcagaccgagattcaatcggtgatggaagaaaacgcgtaccagatgttcctgacctcggatatttacctggagtacgttagatctggcggagaaaatactgcctatatgagcaacggaggtttgggcagccttaaagtagtgtgtgggtacctcccaactctgaacgaagaagaagaatggacctgtgccgacttcaagtgtaagctttccccgaccgtggtgggcctcagctccaagactctaagagccacggctagcgtgcgctctacagaaaccgtggacagtggctaccgctcatttaagcgcagtgatcctgtcaatccgtatcacattgggtccgggtatgtttttgctccggcaacatcagccaatgatagcgagatctcaagcgatgcattaacagatgacagtatgtcaatgacagattccagcgttgacgggatccccccttatcgtgtgggctctaaaaagcaactgcagcgcgagatgcacagatctgtgaaggcaaacggtcaggtgagcttgcctcacttccctagaacacacagactgccaaaagaaatgaccccagtggagccagcgacttttgcagctgaactgattagcagactcgagaagctgaaactcgaattagagtcacgccactccctcgaagaaaggctgcagcagattcgagaggacgaagaaagggaggggagcgagctcaccctcaattcacgcgagggagcgcccacacagcaccccctgtcactgctcccatcaggcagctacgaggaagacccacagaccattctggatgatcatctctctagagtgctaaagacacccggctgccagagccctggggtgggccgctatagccctaggagtaggtctcctgaccatcaccaccaccatcattctcaatatcattcgctgctgccaccaggtggaaaactgccccccgctgctgctagtccgggagcgtgtccgctattgggaggaaagggatttgttaccaagcagactactaaacatgttcatcaccattacatacatcaccatgccgtgcccaaaaccaaagaggaaatcgaggctgaggcgactcagcgggttcattgcttttgtcctggcggatccgagtactactgctatagtaagtgcaaatcccacagtaaggcccctgagaccatgcccagcgaacagtttggggcacagagcacaaagaaggcctatcctctggaatccgctagatcttcaccgggtgaacgcgcttccaggcatcacctgtggggagggaatagcggccacccacgaactaccccccgggcccacctgtttacccaggatccggctatgcccccactcacacctccgaatacattggctcagctggaggaagcctgccggaggcttgccgaggtctcgaaacctccaaaacaacgctgctgcgtcgcctctcagcagcgagacagaaatcatagcgctaccgtacagactggagcaacaccattcagcaatccttcactcgccccagaggaccataaagagcccaaaaaactggcaggagttcatgccttgcaggcctcagaactggtggtcacatacttcttctgtggggaggagattccctatcgacgtatgctcaaggctcagtcattgaccctaggacactttaaagagcagctgtcaaaaaaaggaaattaccggtattattttaaaaaggcctcggacgagtttgcgtgcggcgccgttttcgaagagatctgggaagatgaaacagtgctgcccatgtacgaaggacggattctaggaaaggtggaaagaatcgactag

SEQ ID NO: 180142 - DNA, 483 bp, Artificial Sequence
  Description of Artificial Sequence: Synthetic coding sequence
atgagcagcgccatgctggtgacctgcctgcccgaccccagcagcagctttcgcgaagatgctcctaggccaccagtgcctggggaagaaggtgaaaccccaccttgccagccaggcgtgggaaaaggccaagtgactaaacccatgccagtgagctccaacaccagacggaacgaagacggattaggcgaaccagaggggagagccagtcctgatagtcccctgacccgctggaccaaaagtctacattccctgctaggagatcaggacggtgcttatttatttcgtacttttctggagcgcgagaaatgtgtcgacacactcgacttctggttcgcttgtaatggattcagacaaatgaacctcaaggatacaaagactttgcgcgtcgtgaacgacttctgccacgacatactcttctatttgtattgcaagctctgcatcataaagtctagttttaaggagaattacttggttcagtag

SEQ ID NO: 180143 - DNA, 921 bp, Artificial Sequence
  Description of Artificial Sequence: Synthetic coding sequence
atgagcgaggtgacccggagcctgctgcagcggtggggcgccagcttccgacgcggtgcggactttgatagttgggggcaactggtcgaggctattgatgaataccaaatacttgcccgacacctccagaaagaggcccaggctcaacacaacaactctgagttcaccgaggagcagaaaaagaccatcggaaaaattgctacttgtcttgagctgcgttccgccgccctccagagtacacaaagtcaagaggagttcaagcttgaggatctgaagaagctagaacctatcctgaagaatatcctcacttacaataaggaatttcctttcgacgttcagcctgtaccgctaaggcgcatactggccccaggggaggaggagaatcttgagttcgaagaggacgaggaagaaggaggggcgggtgctggcagccccgactccttccctgctcgggttcccggtaccctcctgcctagactgccctccgaaccaggcatgacactactgacaatcagaattgagaagatcggcctgaaggacgccggccagtgcatcgatccgtatattaccgtaagcgtaaaggacctcaatggcattgatcttactccagttcaggatacgcctgtggcttcccgcaaagaagatacatatgtgcattttaacgtggatattgaactccagaaacatgtggaaaaactgacaaagggtgccgcgatttttttcgagtttaagcattataaaccaaaaaagcggtttacttctacaaaatgttttgcttttatggagatggatgaaattaaacccggacccatcgtgatcgaactttataagaagccaacagattttaagcgtaagaaactccaacttctgactaagaagcccttatacctgcacctgcaccaaacactccataaggagtag

SEQ ID NO: 180144 - DNA, 675 bp, Artificial Sequence
  Description of Artificial Sequence: Synthetic coding sequence
atgagcgaggtgacccggagcctgctgcagcggtggggcgccagctttaggaggggtgcagacttcgactcatggggtcaactcgtggaagctatcgatgagtaccaaatcttagcccgacacctccagaaagaagcccaggcccagcacaataactccgaattcacagaggagcagaaaaagactattggtaaaattgctacctgcctggagctgcggtctgctgccctccagagtacccagtcccaggaggaatttaaacttgaggatctgaaaaaactcgaacccatcctgaaaaatattcttacctacaataaagagtttccattcgatgtgcagcctgtgccactgagacgaattcttgctcccggagaggaagaaaacctggagtttgaagaggatgaggaggagggaggagcaggagccggatctcccgattcctttccagcccgcgttcctggggccgcgatcttctttgaattcaagcactataaaccaaaaaaaagattcacaagcacgaagtgctttgcctttatggaaatggatgaaatcaaaccaggtccaatcgttatcgaactatacaaaaagcccaccgatttcaagcggaaaaagctgcagctgctcactaaaaagcccttatacctccacctgcaccagactctgcacaaggagtag

SEQ ID NO: 180145 - DNA, 849 bp, Artificial Sequence
  Description of Artificial Sequence: Synthetic coding sequence
atgatcgccaccgaggccgtggtgcgggccgcccagggcctggcccgtcatctccagaaggaggcccaggcccagcacaacaatagtgagtttacagaggagcagaagaaaacgatcggcaaaatcgctacctgcctggaactgcgctccgcggcacttcaaagcacacagagccaggaagaatttaagttagaagaccttaaaaagcttgaacccattcttaaaaatatcctgacctataataaagagttcccatttgatgtgcaaccggtcccattgcggagaattttagctcctggcgaagaggagaatctggagttcgaagaggatgaggaagaaggcggggcaggagcagggagcccagactccttccctgctcgtgtcccaggcacgctgttacccagattgccctccgagcccggcatgactctgctgaccattcggattgaaaagatcggcctcaaagacgccggccaatgcattgacccatacattaccgtaagtgtcaaggacctcaatggaatcgaccttacccccgtgcaggacacccctgttgcatcaaggaaagaggacacctatgttcatttcaacgtggatatcgaactgcaaaagcatgtggagaaactcacaaaaggggcggccatctttttcgagtttaagcattacaaacctaaaaagagattcacaagcactaaatgctttgcctttatggagatggatgaaattaaacccggccctatcgtgattgaactgtataaaaagcctacggacttcaagaggaagaagctccaattacttacgaaaaaacctctttatttgcatctgcaccagacgctccataaagagtag

SEQ ID NO: 180146 - DNA, 2685 bp, Artificial Sequence
  Description of Artificial Sequence: Synthetic coding sequence
atggcctggcggtgcccccggatgggccgggtgcccctggcctggtgcctcgccctttgtggctgggcttgcatggcaccaaggggaacccaggcagaagaatccccttttgtcggcaatcccggcaacatcaccggtgcacgaggcttgacaggtactctgagatgccagcttcaggtacaaggagaaccacccgaggtgcactggttacgcgacggtcagattttggagctggcagattccactcagactcaggtacctttaggggaggatgaacaggacgattggatagtggtaagtcagttgcggataacctcacttcagctgagtgatacaggtcagtatcagtgtcttgtgttcttgggccatcagacgttcgtatcccagccgggctacgtgggattggaaggattgccctattttttggaagagccagaggatcgcaccgtggccgccaatacacccttcaatttgtcctgccaggcacaggggccccccgaacccgttgatcttctctggctgcaagacgccgtcccccttgcaacagcccctggacatggaccacagagatctcttcacgtgccgggactcaacaaaacatccagtttctcctgtgaggctcataacgctaaaggtgtgaccacctctcgtactgccaccatcacagttctcccccagcagccgcgtaacctgcatctggtatctcgccagcctacggagttggaagtcgcatggaccccaggcctgagcggaatttatcccctcacacactgcaccctgcaggccgtcctgagtaacgacggcatgggcatacaagccggggagcctgatcccccagaagaaccgctgacaagccaagccagcgtgccgccccaccagctgagactcggctctctgcaccctcataccccctaccatattagggtcgcttgcacctctagccaggggccaagctcatggacgcactggttgccggtcgaaacacccgaaggagtgcccctcgggccccctgagaacatttcagctacccgtaacggatctcaggcgttcgtgcattggcaggaaccccgcgcccctctgcagggtacccttctgggctaccggctggcctatcaggggcaagatacgcccgaggttctgatggatattgggttgcggcaagaggtcacgttagagctccagggcgacgggagtgtctcgaatctgactgtgtgcgtggctgcttatacggctgccggtgatggcccttggagcctccctgtccctttagaagcttggcgcccaggccaggctcagcccgtccaccaactggtaaaggagccttcgaccccggctttttcgtggccgtggtggtatgtcctgctgggcgccgtcgtggcagctgcatgcgtgctgattctggctctgtttctggtgcaccggcggaagaaagaaacaaggtacggggaggtcttcgagcccactgttgagcggggcgaactggtcgtgaggtacagggtgaggaaaagctatagtaggcgcacgactgaagccactctgaacagtcttggaatctcagaagagttaaaggagaagttgagggatgttatggtggatcgtcacaaagtggctttggggaagacgctcggggagggcgaattcggagctgttatggagggacagcttaaccaggatgatagtattctgaaggtggcagtgaagaccatgaaaattgccatctgtactcggtcggagctggaggacttccttagcgaggccgtgtgcatgaaagaatttgatcacccaaacgtaatgaggctcatcggcgtatgtttccaaggatctgagcgggaaagtttcccagcccccgtagtgatactcccattcatgaagcatggagacttacactccttcctcttgtactcccggctgggagaccagcctgtgtacctaccaactcagatgctagtcaagtttatggcggacatcgcttccgggatggagtatctaagtactaaacgcttcattcaccgtgatctagctgccaggaactgcatgttgaacgaaaatatgtcggtttgcgtcgcagattttggactctcaaaaaagatctataacggagattactaccgtcagggccgcatcgccaaaatgccggtgaaatggatcgccatagaatcgctggccgatagagtttatacctccaaatctgatgtgtggtcgttcggggtaacaatgtgggagatagcaacacgaggccaaaccccctaccctggggtggaaaattctgaaatttatgactatctccgtcagggaaataggctcaaacaacctgctgactgcctagacggcctttacgccctgatgtcaagatgctgggaattgaacccccaggatcgcccttcctttaccgagcttagagaggatctcgagaacacgcttaaagccctaccacctgcccaggagcccgatgaaattctgtacgtcaacatggatgaaggaggcggatatcccgagcctcctggtgccgccggcggcgcagacccaccaacacaaccagacccgaaggacagctgctcttgtctaactgctgcggaggtccatcccgctggaagatacgtcctatgcccatcaactacaccttcacctgcccagcctgctgatagaggctcaccagcggcacctggccaagaagatggggcatag

SEQ ID NO: 180147 - DNA, 2658 bp, Artificial Sequence
  Description of Artificial Sequence: Synthetic coding sequence
atggcctggcggtgcccccggatgggccgggtgcccctggcctggtgtctagccctctgtggatgggcctgtatggcccctagggggacccaggccgaagagtctcctttcgtcggaaaccccggcaatataactggggctcgggggctgacaggtactctgaggtgccaacttcaagtgcagggagagcctcctgaggtccactggctcagggacggccagatcctggagctagcagacagcacacagactcaagtgccactcggtgaagatgagcaagacgattggattgtggtctcccaattgaggatcaccagccttcaactgagcgatacaggtcaatatcaatgtctggtgttcctgggacaccaaacattcgtttcccagcccggatacgttggacttgaagggcttccttattttttggaggagccggaggacagaactgtcgcagctaacaccccattcaacttgtcctgtcaggcccaagggcctcctgaaccagttgatttactgtggctccaggacgctgtgccactcgctactgcccctggtcacggtcctcagaggtccctccatgtccccggccttaacaagactagctccttttcttgcgaagcacataatgctaagggtgttacaacatcgcgcaccgcaaccattacagttttgccacagcaaccccgaaatttacacttggtgtcccggcaaccaacagagttggaagtggcctggacacctggactttctggtatataccccctcacacactgtacgttgcaagcggtgttgagcaatgatggaatggggattcaggcgggtgagcctgatcctcccgaagagcctttgacatcacaggcctccgttccaccgcatcaactaagattgggctctcttcatccacacacgccttaccacatccgcgtagcttgtactagcagccaaggtcctagtagctggactcactggctcccagtggagacgcctgagggtgtgcctctgggtccacctgagaatatttcagccacccgaaacggctctcaggccttcgtccactggcaggagccacgcgcccccctgcagggcacacttctcgggtacaggctcgcttatcaaggccaggacacacccgaagtgctgatggatataggcctgaggcaggaggttactctggagctgcagggcgatgggtctgtcagcaacctcaccgtgtgtgtggcggcctacacggctgccggagatgggccatggagtctgcctgtaccactggaggcgtggcgccccgtgaaggaaccttctactcccgcattcagctggccctggtggtacgtcttactcggggccgttgttgccgccgcttgcgtgctgattctcgccctttttctggtccacagacgcaagaaagaaactagatacggagaagtcttcgagccaacagtggaacgtggggaacttgtggtgcgatatcgtgttcgtaaatcctacagtcgccggacaaccgaagccacactcaacagcctcggcatttccgaggaactaaaggagaaactgcgcgacgtgatggtcgacaggcataaagttgccctgggcaagacactgggtgaaggcgaattcggtgccgttatggaaggccagctgaatcaggacgatagcattctgaaagtagcagtgaagacgatgaaaattgctatatgcactcgttctgagttggaggattttctgtccgaggcagtgtgcatgaaagagttcgaccatccaaacgttatgagattgatcggagtctgttttcagggctccgagcgtgagtctttccccgccccagtggtcattttgcctttcatgaagcatggagatcttcactccttcctgctctactcaagattgggggaccagcctgtctaccttcccacccagatgctggtcaaattcatggccgacatcgcatcaggaatggaatacctgtctacgaaaagattcatccacagggatctagctgccaggaactgtatgttgaatgagaacatgagcgtctgcgtcgctgactttggattgagcaaaaaaatatataatggagactactacaggcaagggcgcatcgccaagatgcccgtgaaatggatcgctattgagagcctcgctgaccgtgtctacacgtctaagtcagatgtgtggtcttttggcgtcacgatgtgggaaatcgctaccaggggtcagactccttatcctggagttgagaattcagaaatctatgattatttacgccaaggaaatcgcttaaagcaacctgccgactgtctagatggcctgtacgcactgatgagccggtgttgggaactgaacccccaggataggcctagctttacggagcttagagaagatctcgagaacaccttaaaggccctgccccccgcacaggagcctgatgagatcctatatgtcaatatggatgaaggggggggctatcctgagccaccaggagccgcagggggcgcagatcctccaacccagccagatcctaaggattcctgctcttgcctcacggcggccgaagtgcatccagccggaaggtatgtgctatgtcctagcacaacacccagtccagcgcagccagcagaccgcggatccccagccgcccctggtcaggaagatggcgcctag

SEQ ID NO: 180148 - DNA, 2439 bp, Artificial Sequence
  Description of Artificial Sequence: Synthetic coding sequence
atggagcccctgggcaactggcggagcctgcgggcccccctgccccctatgctgttactgctgttgctgcaggtggcgggaccagtgggagctctggccgagaccctgctcaatgctccacgggccatgggcacctcctcatcacctccatcccccgcttccgtggtggccccagggaccacgctgttcgaggagagcaggctgcctgtgtttacactcgactatcctcacgtccaaatcccatttgagattaccctgtggattctgcttgcgagcctggctaaaattggatttcacctctaccataaactgcccacaatcgtgccggaatcttgcctgttaattatggtgggtctactgctcggcggaataatctttggggtggatgaaaagtcgccccccgccatgaaaactgatgtgtttttcctgtatttactgcccccaatcgttttggacgctggatatttcatgccaaccaggccgttcttcgaaaacattggtacgatcttctggtatgcagtagtcgggacgctttggaattccatcggtattggagtgagcctgttcggtatctgtcagatcgaggctttcggcctttctgacataaccttgctgcagaatttgctttttggatccctgatctctgctgtagatcccgtggctgttctggccgtgtttgaaaatattcatgtgaatgagcagctctatatcctagtctttggcgaatcactattgaatgatgcagttaccgtggttctgtacaacctgtttaagtcattctgccagatgaagacaatcgagaccatcgacgtgttcgcaggcatagcaaacttctttgtggtgggcattggcggagtattaatcggaatatttctgggcttcattgccgccttcaccactcgcttcacccacaacattcgggtgatagagcccctttttgtgttcctgtatagctatttatcctacataaccgccgaaatgtttcacctatcgggtatcatggcaatcaccgcctgcgccatgacaatgaacaagtacgtagaagaaaacgtaagccagaaatcttacaccacaataaagtacttcatgaagatgttgtccagcgtgagtgaaacactaatttttatttttatgggcgtgtctacagtggggaagaatcacgagtggaattgggcctttgtttgtttcacgctcgcattttgcctgatgtggcgagctctaggcgtctttgttctgactcaggtcatcaaccgattcaggacaattcccctgacatttaaagatcagtttatcatcgcctatggagggctgaggggtgccatctgttttgccctcgtcttcttactcccagcagcagtgttccctaggaaaaaactctttatcacagctgcaattgtggtgattttcttcaccgtgtttattttgggaattaccatacgaccgctggtggagttcctcgacgtgaaacggagcaataagaaacagcaggccgtcagtgaagagatctactgtcggctgttcgaccacgtaaagacggggatcgaggacgtgtgcgggcactggggacacaatttctggcgtgataagtttaaaaagtttgacgataaatacctgcgtaagttactgatcagggagaaccaaccaaagagctctattgtgtccctttataagaaacttgaaattaaacacgccatcgaaatggctgaaactggcatgatctcaacggtcccaacatttgcctctttgaacgactgcagggaagaaaaaatcaggaaagtgacaagctctgaaaccgatgaaatccgagaattattgagccgcaacctgtatcagatcaggcagaggaccctaagttataatcgtcactcacttaccgctgatacaagcgagcgccaggccaaggaaattctgattcgccggcggcacagtctgcgtgaaagtatccgcaaagactccagcctgaaccgggagcacagagcttccacctctacaagtagatatctgtctctccccaaaaatacaaaactgcccgaaaaactccagaaaaggaggactatcagcatcgctgacggaaatagtagcgacagcgacgccgatgcaggaactactgtgctgaaccttcagcctagagcgaggcgcttcttacccgagcagtttagcaaaaagtctcctcagagttataagatggaatggaagaatgaggtcgacgtcgatagcgggcgggacatgccctccacacctccaacacctcacagtagagagaaggggacccaaactagcgggttactccagcagccgttgttaagcaaggaccagtccggaagcgagcgtgaggacagcctcactgaggggattccgcccaagccacctccaagactggtctggcgggcatccgaaccgggcagcaggaaggccaggtttggatccgaaaagccatag

SEQ ID NO: 180149 - DNA, 681 bp, Artificial Sequence
  Description of Artificial Sequence: Synthetic coding sequence
gccgagggcaagtggggcctggcccacggccgggccgaggcccacgtctggcctggacaggggggctggcggctaggccctccccagggcaggtggacaggctcatctcccctactcgacatcgtaggcggccgcaaggccagacctcgacagtttcctttcctcgcatccatccagaaccaagggcggcacttctgcggaggagcgctgatacatgctcggtttgttatgacagccgcttcatgttttcagagccagaaccctggtgtcagcacagtggttctcggggcctatgacctccgcagacgggagcggcaatctcgacagacattctctattagctctatgtctgagaatggctacgaccctcaacagaacctcaacgacctgatgctcctacaactggaccgcgaagctaatctaacgtccagcgttaccatccttccgctcccgctgcagaacgccactgtggaagccggcacccgctgccaagtcgcaggctggggaagccaaagatccggaggcaggctgagccggttccctcgttttgtgaatgtgacagtgacaccagaggaccaatgccgccctaacaacgtgtgtaccggcgttctgacgagaaggggaggtatttgcaacgtttctgccccctgtggggggagacgcggtccggagaggtattag

SEQ ID NO: 180150 - DNA, 7875 bp, Artificial Sequence
  Description of Artificial Sequence: Synthetic coding sequence
atgttccggcgggcccggctgagcgtgaagcccaacgtgcggcccggagtcggcgcacgcggtagcaccgctagcaatccacagagagggagggagtcccctcgccctcccgatcccgccaccgatagcgccagcaagcccgcagaacctaccgacgttcctacagtcgactttgggggggcggagccacaagaaaaagccccacgatcttctaccgagaagactggcggagataacgatgttgaggaaagctctcggagtagcagcactgtttcacagagacggaaacgcatcagttctacatcttctctggttaaatcatctgtatctgttcccagcgagtcccaccccctttcaaccattaatcaggaagccccacagcccacagcaacttccaccaaggagaaacagccctgttccgaccggtataggatatacaaggcacagaagctaagagagatgctgaaggaggaactcagaaaggaaaagaagcagtggaagaacaaatacgccattaacgagtcccagagaccaccagatcgatccaagatgactatgcgcgacttcatctactaccttccagataacaatccaatgacctcgagcctggaacaggagaagaaaacagagaaaccaagtacgcccgtgcagacccgggagcaagaggggaagtctactcccaacgctgaggacaacgagatggaagaggaaaccgatgatggtccactcctggttccacgtgtgaaggtcgcagaggacggaagtatcatcctagatgaagaatcccttaccgtggaggtcctccggaccaaaggaccatgcgtcgtcgaagaaaatgacccaatcttcgaaagagggtccacaaccacatacagctccttccggaaaaattattactcgaaaccttggtcgaacaaagagactgacatgttcttcctggccatctcaatggtgggtactgacttctcaatgattggtcagctattcccgcatcgagcacgcattgagattaagaacaaattcaaacgtgaggagaagacgaacggatggagaattgacaaagcgttccaagagaagcgccccttcgattttgattttttcgcccaccttctacaaaaggtgctggccgaagaggagaagcgcaagcagaaatcggtaaagaatcattccctgaaagaaaaaaagagcaccaagccgcggaagaatgtcaaagtgaaaaaagtcgcctgcgaaggggtcaacaatgatccggacgaaagcatgagctcaaggatctctgacacggagcgtagccagaaggatgcccagacagtcgaagaggagtcccttactcttagtcgcgaggacgcagagcaggtcgctttggaagtggacctcaatcagaagaaaaggcggaggaagaaacaggacggagcaaatgagctcggggtaaacaacctgctcgagaacgctacagtccaggctggaccgtccaagggggaaaagcataaaaacaagtgccaggccattcgtccagagctcaaggaaggcgagtgtagcaaggaacaaatgttgtcatgcactcaaaatatcgacgggatcgtcggtttcgcaagcaccgaaaaagtggaaaagagaaccgatccgatcctgagcctcagcaatcagcaggatgccacctctgtcgcgacggagagctccgaatcaagcacgagcgatctgccaagttttgaggtgggaattcgcgccttatgtgaagttaataatgccgaggggtcgtgcattgaggagagaaatgtagacttaaagaataattctctcgagatcgatcagaccgagaacgtgaagcctatgctccgtggacgattccagcgcccgaagccgaatctgagtagggcaggcaaaaagagtgtgctttcgcaagggaaaaccgaaagtgagtctaaaaactctcactccaagacgtccgtcgagaagaaccatgttgagaaagacaaaatgaacactctggacattcttcggatggaaaccacagaacgagagaacccggaagcagagacagtcagcgtattgggcgaaaagaactgccttcaagaaggatctcagctgaaggccctgcgcccggtgcaggttcgtggcagactgcagaagccaaagcccaacgccggcaaggctgcagaacgcaaagaaattcttatttcgcaggaagaaatcggagcaaacgtggaaaaaaacgagaacgagagctgcgcggatagggataccccacagcacatggaggaccagagccggaaagacttcgaggaggaagatgtgatcttacagccagaaaaaaacgattcattccagaatgtccaaccagatgaacctaaggtcctgaatgaatgcctgagcgtgcaggagaacaataaagctaacaaactgaaccaggtacctattctgaggacccggtttcagaagccgaagcctaatatcgggagaggaacaggacgcagggagatctcaagcaaggaagaggtcctcgagaagatcctcgtgagcggcgaaatggcagctgcgctgcgcgagaccgtccgattggacacgtctcctaaggagatggtgccggcggagattaatacaaaagaaatgcaatcggatctgaaggagactggtcgccgagcgatatccccaagggaaaaaattcttgatgtcattgatgatactatcgagatggaaaccggattaaaagcgatgggtagagagatctgtctaagggagaagacacccgaagtaattgacgccacagaagagatcgacaaggatctggaggaagcaggccggagagagatcagtccccagaaaaacggcccagaagaggttaaaccactcggtgaggtagagacagacctgaaggcgacaggcaacgagtcaagtcctcgggagaagaccccagaggtaaccgacgccaccgaagaaattgacaagaaccttgaggagactggtaggcgaaagatctcacctagagagaacggaccagaggaagtaaagcccgttgacgaaatggagacggacttgaacgcaacgggtagggagtcatccccaagagaaaaaactcctgaagtgatagatgcaaccgaggagatcgacctggaagaaaccgaaagggaggtgtcccctcaggaaaacggactcgaggaagtgaagcccctgggggaaatggagaccgatcttaaggccacagggagggacagcttcccccgtggaaagaccccagaagtgatagacgctattgaggagattgaaattgatctggaagagactgaacgcgaaatcagcccccaagaaaatgggttggaagaagtcaagcccctgggcgagatgcagactgatttaaaagccaccggtcgcgagatctccccacgtgagaagacacctgaagtgatcgatgctactgaagagattgataaggatctcgaggagactgggagacgggagataagccccgaagaaaacgggcctgaggaagtgaagcccgtggacgaaatggaaactgacctgaaaactactggccgcgagggatcttccagagaaaagactagagaagtgattgatgcagccgaagttatagagacagatttagaggagaccgagcgagaaatatcaccccaggagaatgggcccgaagaagtaaagccggtaggcaagatggagactgatctgaaagagatcagagaggagatctctcagcgcgaaaaggtcctggccgaattctccgccattcgcgagaaggaaatcgaccttaaggaaacaggtaagcgagatatccctatcatggagaaagtttctggcaagatggccgttgtcgaggagatggaggccgatctgaaggaaaccggaaaagaaaatttcagagaacgtgggtccgaggagatctgtgttacagaggagaaggtggcagaactgaagcagacagggaagaccgatatctcacccagagaaaatgagctggaggaaacatctacaagccggcaaaccgatacccatctgatgcaaagtggttctaacgatttctccgccgtcccttcgctcgatatccagaatatttcctctgaggtgttgagcatgatgcacactcctgtcgaagagaagagaaacagcgagaaagaagtgtccagccatttttctcacttcaaaatcagcagtcaaacccacgaatctgacaaaactgaagtgcagggaattcagtcaccagatgtccccgagcagttcagtgacattaatctctccaaaagcctgccacaggagcagaaacccctggagattaaaccggcaccgtttgttcggtcccggtttaagcggcccaagcccaatctggcccgggctgccctcaagagggagaccaccgaatccgagaagtatatatatgagaaaaagtccgaaacaaaaaaaatggaaactatcgtaatgcaagaaaataacgagcaaaccgacactctgccatcccagcacgacgaagcaagtctgatgatctccagggagaaggataccttagggcaccgcaacgaggaggccgtcatactgccctgtactcaaactgagcgcaacttgtccccctcaaacagctgcgaaccgaaagaagagtctcagtctgcaccagtacagaaaaatgactctgtggtgtctgtggggaccaataatgtaaacacgtttcagcaggagatgaaggagagtgtgatacagaccgctcggcaagtacgaggtcggctgcagcgtccacgccccaacatacggaagacgggacagaggcagattgtggataaaggggaagccaaagggattattaaggaggggaggactatcctgccaaaggatgaaactgaaaaaaaagtgctcactgtatctaattcccagatcgaaactgaaatcgaagtgccttcaagcgctgtcccagagcataggatgtatgaaaaccagagtcaagtggtactagtagaaaacctgcacgtgaataaaactaacgagacgattcgtcatgaaaataagccatacgtgcctagctcagcacagatgacaaggaggaagttccagaaggctaaacccaacttgggcagggcacactccaaaaaagaggaacctgtgctcgagaaggtgacaaccgaccagagtaaggagggaaagcccgaagatcatcttctccagaaaggcgccagcaacacacagctgcttctgaaggagaaggcagaactgctcacctctctggaagtgtccgcacgaaaggattgcgttgggagcaaagagagtgccctcgccaaaattgatgccgagctggaggaggttgggcccagccgcagggtgggcgaggaaactgtaggggacaactctccctcaagtgttgtcgaagaacaatacctgaacaaattgacatcatgccctcagcctctgaacgagaccagctacagtaagattgccttggatggcaagacgactatttctagcacctctgagtatgagcgcaataggggtgaaaggagaagtcataagaagttcaaacctaatgtgaccagggggaggggctccaagagggtgcgggggaaaacctccaagaaggagccccgtgcaagcaaggccatgctggtgactctgcgcgcatcgcaagaagaggacgacgacgcagatgatttcgagagcgattatgaagaagagtcataccatcttgctccggaagaagtgaacaaggcacctgtgttcgtcccagtggggctgcgctccccagagccagtgtcggcgcagatcgaggaaacaatggaagagctggagattactgtcaacgtgcccgatgtgggatgcatagccgtcgtagaacatgaattacctaacactgacgtgaccaccgaagaaatgaagcaggaggagaacctctctgtgccatttgagatgactaccagcgaacacatccaggacgagcctgggactaacgatggctctactgaggcagccatcactttgcttacaatgggtgacctggtgttacagtctgaaatctcttcagagcagggagatgtgggagtatgcatcatcccacatgtgcacagcaaagataagagccacataccttcctccctggataatgtgaatcacaaaatcgttcacgagtgtcaggaactgtcatctcccgttatcaccacctcccctgcgagttttgaggaaaataaaattgtactggaggagcaaagctcgagggaggagatctccctgatggagaaagtgaaggaaaacgcgacgccaacacgaaacacaataagcaaggtcactagtaacctgcgaatacgcagccggctagccaagccgaaacctaacctcgagaagaccctgggcacaaaccggcttgatgactaccaggaggtatcctccctttgtgttacgaaaggagccgagatggaaactcagcgagagacagagaagaatgcatccaaagccaccgagttggaaaataaaaatttggggcctgttacaaccgccgagaacaaagaccaaagtaagctggcctgtgtacacggcatcaagggcactagcatcagcagcgaagtgaatctcaccgagaggaatgagaaccaggaagagtcctctcaggaagtgcatatgctcagcgtggcacccgtcgcgtcgtccgagacgggtccttgcaccctagggttggaccgggggttaggggaaaacagcgtggaggagccacagatcaaggattcaaaaggtgattccgtactgactctgcccgtccctgaatacacacccacatctatcccagaggtgcaacaggaaaacattatcaatcctcaggatctcactgtgaacctcgtcgctaatgtgccccaggacggcgaggatgagcaagcattcatactgaccctcgttgagatccccgccaatgctgtggaagaatttaccgatgcaacggcccagtttatgcccaacccacttttgcctgcccccatcttggtgaagtcagtgaacactgaagagcgcggtgacatgtctatctgccttccagccacatcagtcggtcaggacgctatgggcctcagtattagtgggcgcgataattccaaaaagccaccggacaatctggacctcgtatcgcgaaagcgctttcagtgccgcctggacaagaatgaccatatcccccccgctaagaaacgatctttgaccctgagggatgactgtcaggagtatactacagaggtgcattccaaagaactcaccaacgtgtttgaggaaactggggaaagccataagggccaggatatctttcttacttcgggcagcacccttacaactccggagcctcagcgacagcaggtagaagcggcctttcaatcccgtggctcaagatctccagatgcctgcatggacaagaatgtcccccagctgccccaggacgagatgatcgtgtccgacaaggaagaacggacagatgctgcccctaagtcacagcagatggattcacgaacctcctcctccaaggctagtctctcccgaccaggacgacgcccactgggctttctaagcttgatttgcagcaaaaattcgctcgagtcagacgaaccaatgcaggttcactctaagaagcgacttaagccattgatccccggcctccgcaagaaattaaaacgcagcaatccattcaatgagtcgcaagaaaaaaatagggaaagttccgatttgctgccctccccctccgtgatcactacccagagcgaaaatatttcgtcatccgcaactcaggtgtcatgcgaccagcctctgttgaaggaggggtataaaagcgcccaaaagcgcgccccacaaggggaggctacaactgttagcgagtacttcttcaacgatatcttcatcgaagtagatgaaactgaatag

SEQ ID NO: 180151 - DNA, 1392 bp, Artificial Sequence
  Description of Artificial Sequence: Synthetic coding sequence
atgctggtgaccctgcgggccagccaggaggaggacgacgacgccgacgattttgaatctgactatgaggaggagtcatatcatcttgcacccgaagaggtcaacaaggcacccgttttcgtgcccgtcggattgcggtctcccgagcctgtgtctgctcagattgaggagactatggaggaactggagatcaccgtgaatgtgcctgacgtgggttgtatcgccgtcgttgagcatgagctgcctaatactgacgtgaccacggaagagatgaagcaggaagaaaatttgtccgttccatttgaaatgactaccagcgagcacatacaggatgagccaggaacaaacgacggatctactgaagccgcaattaccttgctgacaatgggagacctggtgcttcagtctgagatttcttcagaacagggagacggcgtctgcataatcccacatgtgcatagtaaggacaagagccacataccaagttcactggataacgtcaaccacaaaattgttcacgagtgccaggaattatccagtcctgttataaccactagccccgcatcgttcgaagagaataagattgtgctagaggagcagtcgtctagagaggaaatttcgctgatggagaaagtcaaagaaaacgcaacccctactagaaacacgatctcaaaagtcacgtccaacctccggattcgttccagattggcaaagcccaagcctaatctggaaaagacactggggacgaatcgcttggatgattaccaggaggtgtcgtccctgtgcgtaaccaaaggggctgagatggaaactcaaagggagacggagaagaacgcgagcaaggcaaccgagctggaaaataagaatttgggccccgtcacaactgcggaaaacaaagaccagagtaaactcgcttgcgtgcatggaatcaagggcacgagtatttcatccgaagtgaatctgaccgagcgtaacgagaaccaagaggagtcctcgcaagaggtacacatgctgagtgttgcacccgttgcttcatcagagactggcccatgtaccctagggctagacagagggctgggcgaaaactccgtggaggagcctcagatcaaagattcaaaaggagatagcgtattaaccctaccagttcctgagtatacgccaacaagtattccggaagtgcagcaggaaaatatcatcaatcctcaagacctgacagtgtttgtgtaccagcagctccagctcgtaaagatgccatgggtttacttatttctcgaggagatcatactgaaaagtagactgatcatttggatcctatacttaggtagggatttcaacgcaggattgattaagatgactacttttctcctgcctaaaaacgtgcattcactgtag

SEQ ID NO: 180152 - DNA, 2445 bp, Artificial Sequence
  Description of Artificial Sequence: Synthetic coding sequence
atgttccggcgggcccggctgagcgtgaagcccaacgtgcggcccggcgtcggagcacggggcagtaccgcctcgaacccacagaggggacgggaaagccctcgaccacctgacccagctactgactcggcttcaaaacctgccgagcctacagatgttcccacagtcgacttcggaggcgcagaaccccaggaaaaagccccccgcagcagtaccgaaaagactgggggggacaacgacgtagaggagtcctcaagaagcagcagcactgtgtcccaacgacggaaacggatctcctcgacatcctctttagtgaagtcctcggtatcggtcccttctgaatcgcatcccctgagtaccatcaaccaggaggcacctcagccaaccgcaacttctacaaaggaaaagcagccatgttccgaccggtaccggatctataaggcccagaaactcagagagatgctgaaggaagagctacgtaaggaaaaaaaacagtggaagaataaatacgcgatcaatgagtcacagagaccccccgaccggtccaaaatgacaatgcgagattttatctactatttacccgataacaaccccatgacgtccagtttagaacaagaaaaaaaaactgaaaaaccaagtacaccagtccagactcgggagcaggaaggtaaatccacacctaacgccgaggacaacgagatggaagaagagactgacgacggaccattgttagtcccaagggtgaaggttgctgaagacggctccattattctggatgaggagagtctcacggtcgaagtgctcaggactaagggaccatgtgtcgttgaggagaatgaccccatcttcgagaggggcagcactactacttactcttccttccgcaagaattattactccaagccttggtctaacaaagaaaccgatatgttcttcctggctattagcatggtaggaacggatttcagcatgattggccagcttttccctcaccgtgcccggatcgagattaaaaataagttcaagagggaggagaagacaaatgggtggaggatcgataaagcctttcaggaaaagagacctttcgattttgatttctttgctcacttactccaaaaggtgctggctgaggaggagaagcggaaacagaaatccgtgaagaatcatagcttaaaggagaagaagagcaccaagcctcgcaagaatgtgaaggtcaaaaaagtcgcctgtgaaggtgtaaataacgacccagacgaatctatgtccagtcgcattagcgacacggagaggtcccaaaaggacgctcagacggtggaggaagagtcactgactctgagtagagaggacgccgagcaggtcgctcttgaagtcgaccttaaccaaaagaagcgtcggagaaagaaacaggacggagcaaacgagcttggcgttaataacctgttggagaacgctactgtgcaggctgggccatcaaagggcgagaagcacaagaacaagtgccaggctatacgcccagagctcaaggagggggaatgcagcaaagaacagatgctgtcctgcacccagaacatcgatggcattgtcgggtttgcctcgacagagaaagtagagaaacgtactgatcctatactgtccttgagtaaccagcaggacgccacctccgtagctaccgagtcatccgagtcaagtacatctgatctgccatcgtttgaggtcgggatccgcgccttgtgtgaggtgaacaatgcagagggatcatgcatcgaagaacggaatgtcgacctgaaaaacaattcgttggagatcgaccaaaccgaaaatgtcaagcctatgctccgtgggcgatttcaacgcccaaaacccaatctgagtagagctggcaagaaaagcgtgctgtctcaaggcaagacggagtcagaatctaagaactcccactccaaaacctcagtggagaaaaatcacgtggagaaagataagatgaatactctcgatatcctgagaatggaaacaacagagagagaaaaccctgaggccgaaacagtctctgtgctcggcgagaaaaattgtctgcaggagggttcacagcttaaagcactacgcccagtgcaggtcaggggcagactgcagaagcctaaacccaacgcaggtaaggcagctgaaaggaaggaaattctaatttcacaggaggagataggtgcgaatgtcgaaaaaaatgaaaacgagagctgtgcggacagggacacgccccagcacatggaagatcagtctcggaaagactttgaggaagaagacgtcattctgcaaccagaaaagaacgattcattccagaacgtccagccagatgaacccaaagtgctgaatgagtgcctttcggtccaggagaacaacaaggcaaacaaattgaatcaggtgccaatcctcagaacacgtttccagaagccctag

SEQ ID NO: 180153 - DNA, 2541 bp, Artificial Sequence
  Description of Artificial Sequence: Synthetic coding sequence
atgttccggcgggcccggctgagcgtgaagcccaacgtgcggcccggcgtaggggcaaggggttctaccgcctcgaatccacagcgcgggagagaaagcccccgcccccccgaccctgcaacagatagcgcttcaaagcctgcagaacccactgatgttccgacagtggattttggaggtgcagagccccaggagaaagcaccacggtcttccaccgagaagaccggtggagacaatgacgtcgaggagtcctctcgatctagctccactgtgtcccagagaagaaaacggatctccagtacatcaagcctcgtcaagagctcggtttccgttccttccgaatcacatcctttaagcaccatcaatcaagaggcaccacagccgactgccacctctactaaggagaagcagccatgttccgatcgctaccgtatctataaggcccagaagttgagagaaatgctcaaggaagagctccggaaagaaaaaaagcagtggaaaaacaaatatgctattaatgaatctcagagacctcccgatcgctccaagatgaccatgcgggactttatctattacttgcccgacaataaccccatgacgtcaagtttagaacaggaaaagaagactgagaaacctagcactccagtgcagactcgcgaacaggagggaaaatctactccaaatgctgaagataacgaaatggaagaagagacagatgacgggcctcttctcgtgcctagggttaaagttgccgaggacgggagtattattttggacgaggagtccctgacagttgaagttctgcgaacgaagggcccatgcgtagttgaggagaacgacccaatattcgagcgaggcagcacaaccacttacagttcattccggaagaactattattctaaaccttggagcaacaaggagacggacatgttcttcctggccatttctatggttggaacggacttttctatgattggacagttgttcccacacagggctagaatcgagattaaaaataagttcaaacgcgaggagaagactaacgggtggcgcatcgataaagctttccaggagaagcggcctttcgatttcgacttttttgcccacctgctccagaaggtcttagccgaagaagaaaagcgaaagcaaaagtccgttaaaaaccactcactcaaagagaagaagagcacgaaacctcgcaagaatgtaaaagtgaaaaaagtggcctgtgagggggtgaacaatgacccggatgagtcaatgagttccaggatttctgacaccgagcgctcacagaaggatgcgcagacagtggaggaagagtcactcacactcagccgcgaagatgctgaacaggtagcccttgaagtggacctcaatcagaaaaaacggcgccgaaaaaaacaagacggagcaaatgagctgggcgttaacaatttgctagagaatgccactgtccaggcgggccctagcaagggcgaaaaacacaaaaataagtgccaggcaatacgtcctgagctcaaagaaggagagtgttccaaagagcagatgctctcttgcactcaaaacatcgatggcatcgtgggatttgcgtcaacagaaaaggtggaaaaacggactgaccccattctaagtctctccaaccagcaggatgcaacttcagtggcaacggaatcgtctgagtctagcacgtccgacctccctagttttgaggtgggaatcagggctttatgcgaagtcaataacgccgagggctcatgcatcgaggagcggaatgtagatcttaaaaacaatagcctagagatagatcagactgagaacgtcaagcctatgctgaggggacggttccagaggcccaaacctaacctgagtcgggctggcaagaagtcggtgcttagtcaaggcaagaccgagagtgaatcgaaaaacagccattccaagacctctgtggagaagaatcacgtggaaaaggacaaaatgaatactctggatattctgcgcatggaaaccaccgagcgggagaatcccgaggccgagacagtgagcgttctcggagagaaaaattgtctccaagaaggatcacagctgaaagctctcagaccagtccaggtcagggggcggctgcagaaacctaaacccaatgctggaaaggctgccgaacgcaaggagatacttattagccaggaagagataggagccaatgttgagaagaacgaaaacgaaagctgcgcagatcgtgatactccccaacatatggaggaccagtctaggaaagactttgaagaagaggacgttattctgcaacccgagaaaaatgactcatttcagaacgtgcagccggatgagccaaaagtactcaacgagtgtctgagcgtgcaagagaataacaaggccaacaaattaaaccaggtcccaatccttcgaacacggttccagaagccgaaacccaatattgggaggggtacgggccggcgcgagattagctccaaggaggaggtacttgaaaagatcctgagcctaggcaaatggagacagcattag

SEQ ID NO: 180154 - DNA, 6399 bp, Artificial Sequence
  Description of Artificial Sequence: Synthetic coding sequence
atgagcagccggatcagcgacaccgagcggagccagaaggacgcccagacagtcgaagaagagtctcttacgctaagccgtgaggacgccgaacaggtggcgctagaagtcgacctgaatcagaaaaagcggagaaggaaaaagcaggatggcgctaacgagttgggcgtcaacaacctgttggagaatgccaccgtgcaggctggaccgtcgaaaggggaaaaacataaaaataagtgtcaggcgattagaccggaactcaaggagggtgagtgctccaaggaacagatgctctcctgtacccagaatattgacggcattgtgggcttcgccagtactgagaaagtagagaagagaacggatcccattttaagcctgagcaaccagcaggacgctacctctgtggccactgaatcgtcagaatccagcacctcggacctgccctcttttgaagttggtatcagggctctatgtgaggtgaataacgcggaagggtcatgtatcgaggaacggaatgtggacctcaaaaacaactcccttgaaatcgatcagaccgagaacgtcaagccaatgcttcgcgggcggttccaacgccccaagccaaacctaagtcgagctggcaagaaatctgtgctgtcccagggaaagactgagtccgagtctaaaaattcacactccaaaaccagcgtggagaaaaatcacgtcgagaaagataaaatgaacacccttgacattctgcggatggaaacgaccgaacgcgagaaccctgaggcggaaacagtatctgttctcggtgagaagaattgtttgcaagagggctcacaattgaaggcgctcagacccgtgcaggtgcgcggcaggctccagaagcccaagcccaacgccggaaaggcagctgaacggaaagaaatcctcatctctcaggaagagattggggctaacgtcgagaagaacgagaacgaaagctgcgccgaccgcgacacacctcagcatatggaggatcagtctcgcaaagattttgaggaagaggacgttatattacaaccagaaaaaaacgattctttccaaaacgttcagccagatgaacccaaggtgttgaacgagtgtctgagcgtgcaggaaaacaataaagcaaacaagctgaatcaagtgcctatcttgagaacccggtttcagaagccaaaacccaatattggacgcggaacgggacgcagggagatctcatctaaggaagaggtcctcgaaaaaatcctcgtgagcggagaaatggcggctgcgcttcgagagactgttaggcttgacacgtcccccaaagagatggttcccgcggagatcaacaccaaggagatgcaaagcgatctcaaagagacaggcaggagggctatttcccctcgggagaagattttggacgtgatcgacgatacaatcgagatggagacaggcctgaaagctatgggtagagaaatttgcctgcgcgagaagacaccagaggtgatagatgcgactgaggaaatcgataaagacttggaggaggcaggtcgccgcgagatatcgccccaaaagaatggaccagaggaggtcaagcctttaggggaagtggaaactgacttgaaggcaacaggcaatgaaagctccccgcgagagaaaacgccagaggtgactgatgctacagaggaaattgacaagaatttggaggagaccggcagacgcaaaatctccccgagagaaaatgggcccgaggaggtgaagcctgtggatgagatggaaactgatctcaacgctacgggacgggaatcaagtcctcgcgaaaaaactcccgaggtgatagatgcaacagaagagatcgatcttgaagagaccgagagagaagtctcgccacaggagaatggcctcgaagaagtgaagcccctcggcgagatggaaacagacttaaaggccactgggcgagacagctttccgagggggaagaccccagaagtcatagacgccatcgaggagatcgagatagatctcgaagaaaccgagcgcgaaatttcaccgcaagagaacggactagaagaggtgaagcctctcggagaaatgcagaccgacctgaaggcgactggacgggaaatttctccccgagagaaaactcccgaggtgatcgatgccaccgaggagatcgataaggacctcgaagaaacgggccgaagagaaatttctcccgaagagaacggccccgaggaagtgaaacctgtggatgagatggaaactgacttgaagaccacaggacgggagggaagcagccgcgagaagacacgggaagtcatcgacgccgcggaagtgatagagacagatttggaggaaactgaaagagaaatcagtccacaggaaaacggccctgaggaggtgaagccagtggggaagatggagaccgacctgaaggagatcagagaggagatttcccaacgggaaaaggttctggcggaattctcagccatccgggagaaggagatagatcttaaagagacaggaaagcgggacattccaatcatggaaaaggtgtcgggaaaaatggccgttgttgaggaaatggaagcagacctcaaggagacgggaaaggaaaatttccgtgagcgcggctcggaagaaatctgcgtgacggaggagaaggtcgccgaactgaagcagaccggtaaaactgatatttccccacgcgagaacgagctcgaggagacctctacctcacgacagactgatacccacctaatgcagagcgggtcaaacgacttttcagccgtgccttccctggacatccaaaatatcagctccgaggtgttgtctatgatgcatacgccggtcgaagagaagcgcaactctgagaaagaggtctcgtctcacttcagtcattttaaaatctccagccagacccacgagagcgacaagaccgaagtccaaggaatccaaagtccggacgtgcccgagcagttttctgatatcaacctgagcaagtctctgccgcaggaacaaaagcccctggaaatcaagccagccccttttgtacgaagtcgatttaagcggcccaagcccaacctggctcgggcggcactgaaacgcgagaccactgagtcagagaagtacatttacgaaaagaagtccgaaaccaaaaagatggagacaatcgtgatgcaggagaataatgagcagactgacactctaccaagccagcacgacgaagcatccctgatgataagccgggagaaagatacgctgggccacaggaacgaggaggctgttatactgccgtgtacccagacggaaagaaacctctcgcccagtaactcctgcgaacctaaagaggaatctcagagtgcccctgtccagaagaatgacagcgtagtgtccgtgggaactaacaacgttaacacctttcagcaagaaatgaaggaatccgtcatccaaactgctaggcaggttcggggacggttacagcgaccccgccccaacatccgcaaaacaggccagagacaaattgtcgataaaggagaggccaaaggcatcatcaaggaaggtcgcaccatactcccaaaggacgagactgagaaaaaagtactcaccgtcagtaacagccagattgagaccgaaattgaagtaccatcctctgcagtcccagagcatcgcatgtacgaaaaccagagccaggtcgttctggtcgaaaatctacatgttaataaaaccaacgagaccataagacacgagaataaaccctacgtccccagcagcgcacaaatgactcgtagaaagtttcagaaagctaaacccaacctcggcagagctcactctaagaaggaggaacctgtcctggagaaagttaccactgatcagtccaaggagggtaagccggaagaccacttacttcagaagggggcctcaaatactcagctgctcctgaaggagaaggccgaactcctgacctcgttagaagtaagtgcgaggaaagactgtgtgggttctaaggagagcgcccttgccaagatcgacgctgagctggaggaagtcggaccttctaggcgcgtaggcgaagaaaccgtgggcgacaactctccgtcgtcggtcgtagaggaacagtacctgaataagctgacctcttgccctcaaccactgaacgagacgtcctatagcaaaattgctctggacgggaaaaccaccattagctcaacctctgagtatgagcggaatcggggcgaaaggagaagccacaagaagttcaagcccaatgtcacgagaggacggggcagcaaacgggtgagggggaaaacctccaaaaaagagcctagagcttcaaaagctatgcttgttacactgcgggctagtcaggaggaggatgatgacgcggatgatttcgagagtgattacgaagaggagtcttaccacctagcccccgaggaggtcaacaaggccccagtgttcgttccagtcggcctacgtagcccagagcctgtctcggctcagatcgaagaaacaatggaagagcttgaaataaccgtgaacgtacctgacgtcggttgcatagctgtggtcgagcatgagctgccaaacacagatgtgaccaccgaagagatgaaacaggaggaaaaccttagcgtcccatttgaaatgaccacttctgagcatattcaagacgaaccaggggtttgtatcatcccccacgtgcattcaaaagataaatctcacattcccagcagtctagataatgtgaaccacaaaattgtacatgagtgccaggaactgagctcgcctgtaattacaacgagcccggcatccttcgaggaaaacaagattgttcttgaggaacagtcatcgagagaagagatctccctgatggagaaagtgaaagaaaacgctacgccaacaagaaacactatctccaaggtgacttccaatcttcgaatccggagtcgcctcgcaaagcctaagccaaatctggagaaaacccttggaacgaacaggttagatgattatcaagaggtcagttctctatgtgtgaccaagggtgctgagatggagacccaacgggagacagagaaaaacgccagtaaggcaaccgaacttgagaataagaatttggggccggtgacaactgccgagaataaagatcaaagcaagttggcctgcgtgcatggtatcaaagggacaagcatatcatcagaggttaatttgacggagcgcaacgagaaccaggaagagagctcccaggaagtccatatgctcagcgttgccccagttgcttccagtgaaactggaccgtgtactctgggcctggatcgcggcctgggagaaaattcagttgaggagccccaaatcaaagactccaagggagatagcgttctgactctcccagttccagaatatactcctacgagcattccagaagttcagcaggaaaacatcattaacccccaggatctgactgtaaacctggtggctaatgtgccccaggatggggaggacgagcaggcttttatcttaaccctggtggagatccccgcaaacgctgtcgaggaatttacagatgccactgcgcaattcatgccgaatcctttgttgcctgccccgattctggtgaagagcgtcaacaccgaagaacggggtgacatgtcaatatgtctccccgcaacatctgtgggtcaggatgccatgggcctatcgatcagcgggagggacaattccaagaaaccacctgacaatctggatttagtgtctagaaagcggttccaatgcagattggataaaaacgatcacatccccccggctaagaagcgtagcctgacgctgagagacgactgtcaggagtacacaaccgaggtccattctaaggaacttaccaacgttttcgaagaaactggagagtcacataagggccaagatatctttttaacctccggaagcacattgacaacaccagagccacagaggcagcaggtggaggcggctttccagtctaggggtagtcgctcccccgatgcatgcatggacaagaacgtgccacagctgccgcaggacgagatgatagtgtctgataaggaagagcgaactgacgccgctcccaaaagccagcagatggactctaggactagctcctccaaggcatccctctcccgtcccgggcggcgccccctgggctttctgtcactcatttgctctaagaattccttagagtccgatgagcccatgcaggtccatagtaaaaagaggcttaagcccctgatacccggacttcggaagaagctgaaacggagtaaccctttcaatgaaagccaagaaaaaaaccgtgaatcttctgacctgctcccctcccccagcgtcatcacaactcaatccgaaaacatcagctccagtgccactcagagtccgttttag

SEQ ID NO: 180155 - DNA, 1392 bp, Artificial Sequence
  Description of Artificial Sequence: Synthetic coding sequence
atgctggtgaccctgcgggccagccaggaggaggacgacgacgccgacgactttgagtcagactacgaagaggagagctaccatctcgccccagaggaggtgaacaaggcacctgtgttcgtcccagtgggactgcggagcccagaacctgtgtcagctcaaattgaggagacgatggaagaactggagataacagtcaacgtgcccgacgtgggatgcatcgccgtggtggaacatgaactgccgaatactgatgtgacgaccgaggaaatgaagcaggaagagaatctgtccgtgcccttcgaaatgactacaagtgaacacattcaggacgagcccggcacaaacgacggaagcacggaagcggccatcacactgctgacaatgggcgacctcgtgctgcagagcgagatatcgtccgaacaaggagacggcgtgtgtatcatcccccacgtccacagcaaggacaagagccatatcccttccagtctcgacaatgtcaaccataagatagtgcacgagtgtcaggagctctctagccccgtgattacaacatctccagcttcatttgaggagaacaagattgttttagaggagcagtctagcagagaggaaatttctttaatggaaaaagtaaaagagaacgctacccctacaaggaacaccatatcgaaagtgactagtaatctgcggatacggtcacgtttggccaagccaaaacctaatctggaaaaaactctgggtaccaacagactagatgattatcaggaagtaagttctctatgcgtgactaagggcgctgaaatggagacacagcgggagaccgaaaaaaacgcctcgaaagccaccgaactggagaataaaaatctgggacccgtgactacagcagagaacaaggatcagagcaagcttgcgtgcgttcacggcatcaagggtacctcaatctcaagtgaggtgaaccttacagaacggaacgagaaccaagaagaatcatcacaggaggtccacatgctgtctgtagcgccagttgctagttccgaaaccggcccctgcactctcggcctggatagaggcttgggcgagaattcggtggaagagccccaaatcaaggactctaagggagatagtgtgttaacccttcctgtaccagagtacacaccaacttccattcctgaggtacagcaggagaacatcattaatcctcaggatttgaccgtgttcgtataccagcagctgcagcttgtcaagatgccgtgggtctacttgttcctcgaagagattatcctgaagagtagattgatcatctggatcctatatctggggagggatttcaacgcagggctcatcaagatgactacctttctcctcccaaagaacgtccacagcctgtag

SEQ ID NO: 180156 - DNA, 1518 bp, Artificial Sequence
  Description of Artificial Sequence: Synthetic coding sequence
atgggcctggtgagcagcaagaagcccgacaaggagaagcccatcaaggagaaggacaaagggcagtggtccccccttaaggtgagcgcccaagataaggacgctcctcctcttcctccactcgtggtgtttaatcacctaacccctcctcccccagatgagcatctggacgaagataaacattttgtcgtggctctctatgattacacggctatgaacgatcgggacctgcagatgctaaagggcgagaaactccaggtactcaagggtactggagattggtggctggcacgaagtctggtcacaggacgggaaggttatgtgcccagtaatttcgtggcgcgcgtagagtctctggagatggaacgctggttcttcagatcgcagggcaggaaagaagccgagaggcagttacttgcgcctattaacaaggccggttcatttcttatcagagaatccgaaacaaataaaggcgctttcagcctgagcgtgaaggacgtgacaacccaaggcgagttgattaagcactacaagatacgctgcctggacgagggcgggtattacatttccccccggattactttcccaagcctgcaggcccttgtgcagcactactccaaaaagggcgacggcctgtgtcagcgcctgacactgccttgcgtgaggcctgcaccccaaaatccgtgggcccaggatgagtgggaaatacccaggcagtctctgcgcttagttaggaagctcggtagtggccagtttggggaggtgtggatggggtattacaagaataacatgaaagtggcaattaaaacgctgaaagagggcactatgtccccagaggcatttctaggagaagctaatgtcatgaaagctctccagcatgaaagacttgtgcggctctatgccgtcgtcacaaaagaacccatatacattgtgacagagtatatggctagaggttgcctgctggactttctaaagacagatgaaggaagtcggctaagtctacccagactgatcgatatgtcggcccaaatcgcagaagggatggcttatatcgaacggatgaattctatccaccgagaccttagagcagcaaacatattggtgagtgaggctctttgctgtaaaatcgctgactttgggttagctaggattatcgactctgaatataccgctcaggagggggccaagtttcctattaaatggacggcccccgaggccattcactttggggtattcaccattaaagcagatgtgtggtctttcggcgttctgctcatggaagtcgtgacctatggaagagttccttacccaggaatgtcaaaccccgaagtcatacgtaacttggaacgaggttataggatgccaagaccagacacctgccccccggaactgtacagaggcgtgatcgccgagtgttggagaagcaggcctgaagaaagaccaaccttcgagtttctccaatctgtgttggaagacttttacaccgcaacagagaggcagtatgagctgcagccctag

SEQ ID NO: 180157 - DNA, 1773 bp, Artificial Sequence
  Description of Artificial Sequence: Synthetic coding sequence
atgggcctggtgagcagcaagaagcccgacaaggagaagcccatcaaagaaaaagacaaggggcagtggtctcccctgaaggtcagtgcccaggacaaggatgctcctccattgccccctctggtcgtgtttaatcaccttactcctccgccacccgacgagcacctcgacgaggataagcacttcgttgtggccctatacgattacaccgccatgaatgaccgcgatttacagatgcttaaaggagaaaaactgcaggttctcaaagggaccggggattggtggctggctagaagcttggtaactgggcgggagggatatgtcccttcaaacttcgtggcccgagtggaaagtcttgagatggaacgatggttcttccggtcccagggccggaaggaagctgagaggcagctgttggcccctattaataaggcggggtcttttctaatcagggaatctgagaccaataagggcgcatttagtctctccgtcaaagatgtgactactcaaggcgagttgattaagcactataagatccgatgtctggatgagggcgggtactacattagccccagaattacattcccatctttacaggcgctggtgcagcactactccaagaagggcgacggcttatgtcaacgtttaacccttccatgcgtgaggccggcaccccagaatccgtgggcccaggatgagtgggaaatcccacgtcaaagcctgcgcttggtccgaaagctgggctccgggcagtttggtgaagtttggatgggatactataaaaataacatgaaggtggccatcaaaacgctgaaggagggcaccatgagccctgaggcgtttcttggggaggcaaatgtcatgaaggctctccagcacgaacgacttgtgcggctgtatgccgtggttaccaaggaaccaatctacatagtcacagagtacatggctcgggggtgtttgctggacttccttaaaacggatgaaggatccaggctgtccctcccacggcttattgacatgtcagcacagattgccgaagggatggcgtatattgagagaatgaattctattcatcgagacctacgagccgcaaacattctcgtgtcagaggccctctgctgcaaaatcgctgacttcggtcttgcaaggattattgattcggaatacacggcacaggagggcgccaagtttccaatcaagtggactgccccagaggccatccatttcggtgtgttcacaattaaggctgacgtgtggtccttcggggtgctgctgatggaggttgtaacctacggccgcgtaccatacccggggatgtcaaatcctgaagttattcgtaatctggaaagaggttatcgcatgccccgaccggatacatgcccacccgagctctaccggggcgtgattgctgagtgttggagatcacggcctgaggagagacccacgttcgactgcacacctggcagagttacccgacctctgtgcgcggcctcgttcgtggagggctgcaattcggatcttgccaggtcatcgggcgtgttatccccaagcaaagtgtttcgcactggaaaaaggctctcgtcaagtaaggctcctgtgctgggcaccccaagggccggcagagttcctgctagcgcaccatgcgtagaccccgctctgcccaggtaccggagtcagaccggctctcgcgggcggcaacagggacaaccccagccaagactcagaagcagcacggctggcctcttttgtaataaagtcactagcgtccgttag

SEQ ID NO: 180158 - DNA, 615 bp, Artificial Sequence
  Description of Artificial Sequence: Synthetic coding sequence
atggccaccgccagccccagcgtgttcctgctgatggtgaacggccaggtagaatcagcccagttcccagagtatgatgatctctattgtaaatattgctttgtgtacggtcaggattgggccccaaccgcaggtctggaggaaggcattagccagattacctccaaatcccaggacgtacgccaggccttggtgtggaacttccctatcgatgtgacctttaaaagcactaatccttacggatggccccaaatcgtactgtccgtatacggccccgatgtgttcggaaatgacgtagtccgagggtacggcgctgtgcacgtacccttctctcccggacgccacaaacgtactatcccaatgttcgtccccgaaagtactagtaaacttcagaagttcaccagctggtttatgggtaggagacccgaatacacagaccctaaggtggtcgcccagggagagggcagagaggtcacacgcgttcgatcacagggattcgtcaccctgctgtttaatgtcgtgactaaggatatgcgaaaactggggtacgataccggacccagcgacacccaaggggttttaggtccgtcaccgcctcagagctttccacagtag

SEQ ID NO: 180159 - DNA, 462 bp, Artificial Sequence
  Description of Artificial Sequence: Synthetic coding sequence
atggccaccgccagccccagcgtgttcctgctgatggtgaacggccaggttgaaagtgcccaattccccgagtacgacgatctgtactgtaagtattgttttgtctacggtcaggattgggctccaaccgcaggactggaggagggcatctcccagatcacttctaaatctcaagatgtgcgccaagctttggtgtggaattttcccatagatgtaacattcaaatccactaatccttacggctggccccagatagtattgagcgtgtatggacctgatgttttcggaaacgacgttgtccgcggatacggagccgtgcatgtgccctttagtcctggtaggcacaaaagaacgatacccatgttcgtacctgaatcaacgtccaagctgcaaaaatttaccagcctctgtctcgtggcaagcagcgatctgcaggccgccccacctaccgaagacaagtag

SEQ ID NO: 180160 - DNA, 486 bp, Artificial Sequence
  Description of Artificial Sequence: Synthetic coding sequence
atggccaccgccagccccagcgtgttcctgctgatggtgaacggccaggtggagtcagcccagttccccgaatacgatgatctctattgtaagtactgtttcgtctacggccaggactgggctccaaccgccgggttggaggagggtatctcccaaatcaccagtaaatcccaagacgtgcgacaggctttggtgtggaatttcccaatcgatgttactttcaagtctaccaatccatacgggtggccccagatagtgctgagtgtttacggccctgacgtgttcggcaacgacgttgtgcgcgggtatggggcagtccatgtgccttttagccccggacgccataaacgaactattccaatgttcgtgcctgagagtacctctaagctgcagaagtttacctcctggtttatgggacggcgccccgaatatacagatcccaaggtggttgcacaaggggagggccgggaggcgcagcctggctag

SEQ ID NO: 180161 - DNA, 564 bp, Artificial Sequence
  Description of Artificial Sequence: Synthetic coding sequence
atggccaccgccagccccagcgtgttcctgctgatggtgaacggccaggtcgaatccgcccagtttcctgaatacgacgatttgtattgcaaatattgctttgtgtacggccaagactgggcccccacggccggactcgaggaggggatttctcaaattacatctaagagtcaggatgtgcgtcaggcgctggtgtggaattttcccatagacgtcacctttaagtctactaatccatatggatggcctcagatcgtcctgagcgtctacggcccagatgtgtttggaaacgatgtcgtgagaggctatggagcagtgcatgttcctttcagtccaggtcggcataagcggactatccccatgtttgtgcccgagagcactagcaagttgcagaagtttacatcctggtttatgggcagacggcctgagtacacagaccctaaagtggtggcgcaaggtgaggggcgtgaggatgagaacgccgaagcggaaatccctcgctccacatgggtctcactctgtccatcccccgcgtggctgatgttgccgttctgcccccagtag

SEQ ID NO: 180162 - DNA, 402 bp, Artificial Sequence
  Description of Artificial Sequence: Synthetic coding sequence
ctgctgatggtgaacggccaggtggagagcgcccagttccccgagtacgacgacctgtactgcaaatattgcttcgtctatggccaagactgggcacccaccgccggtctggaagaaggcataagtcaaatcacaagcaagagtcaggacgtgcggcaggctctcgtgtggaactttcccatagatgtgaccttcaagagcaccaatccctatgggtggccccagatagtgctttctgtatatggccccgacgttttcggcaatgatgttgtgcgcggatatggtgccgtccacgtgccattctcacccgggcgccacaaacgaaccattcctatgtttgtacctgagtcaacttccaagctccagaagtttacgaggtctgcatcttgctcaactcactag

SEQ ID NO: 180163 - DNA, 615 bp, Artificial Sequence
  Description of Artificial Sequence: Synthetic coding sequence
atggccaccgccagccccagcgtgttcctgctgatggtgaacggccaggtggaatcggcgcagttcccagaatatgacgacttgtattgtaagtactgcttcgtctacggccaggactgggcccctaccgcgggcttagaggaaggcatttcccagatcacttccaagtctcaagacgttcgacaggctttggtatggaacttcccgatcgatgtcacctttaaatcaactaatccttatggctggccacaaattgtcctctcagtctacggcccagacgttttcggcaatgacgttgtcaggggctacggagctgttcacgtaccattttcccctggcaggcacaagaggaccatccctatgtttgtaccggagagcacctccaagctccaaaagtttacttcttggttcatgggcaggcgtcccgagtatacagacccaaaggtagtggctcagggggaaggccgcgaagtgacccgagtcaggtcacaaggattcgtgacgctcctgtttaacgtcgtcaccaaggacatgcggaagctcggctacgacactggcccttccgacacacagggcgttctgggtcccagccctccccagtcatttcctcagtag

SEQ ID NO: 180164 - DNA, 444 bp, Artificial Sequence
  Description of Artificial Sequence: Synthetic coding sequence
atgatgaccagcaccgccagcaccgccctgtgcaccgcccggaccggtcctccgcagagggtgtggaggcggggtagtcaccggtctcaccccagggctaagatgtgcggcaaacactggtgcggtacaagccccctgatgagccccctcaaggcccccacccctactgctggccacaggtcatgctcagcctgcatggaccaaatgtgcagtgggacaatgtggtttgaagcaatgggtccgtgtacttgtccatcacacttagcgggcacaaaggggccgtctccttgtctctcgcagaatcttaggctcaattgtaggtccctgcaggccggatcctggggaggtgggccatccactcagacgccaagatggtggctccgagttaaggcagggaagccgcccagcgggttgagcgtaaaagattcatcagtgtcgagatag

SEQ ID NO: 180165 - DNA, 528 bp, Artificial Sequence
  Description of Artificial Sequence: Synthetic coding sequence
atggccgaggtgcacgtgatcggccagatcatcggcgccagcggcttctcagaaagttccttgttctgtaagtggggaatccataccggtgccgcttggaaactgttatcaggcgttagggaggggcagactcaagttgatactccccagattggcgatatggcttactggtcacatcctattgacctccacttcgcaacaaaaggattacaaggctggccgagactccattttcaggtatggtcccaggatagctttgggagatgccagcttgcgggttacggattttgtcatgttccctcctccccaggcacgcaccaacttgcatgccccacatggcgtcctttaggcagctggcgcgagcagcttgctagggcattcgtaggaggtgggccacagcttctacatggcgacactatttactctggagcggaccggtatagattgcataccgccgcgggggggacggttcaccttgagataggtctactcctgcgcaactttgaccgatatggtgtcgaatgttag

SEQ ID NO: 180166 - DNA, 1452 bp, Artificial Sequence
  Description of Artificial Sequence: Synthetic coding sequence
atgaccgaggtggagtacacccagctgcagcacatcctgtgcagccacatggaagccgcagctgatggggagttggaaactaggcttaacagcgcccttttggcggctgccggccccggagcaggagcgggcgggttcgcagctggggggcaggggggcgcagcccccgtatacccggttctctgcccgagcgcattggccgcagatgcgccttgcctgggccacatcgacttccaggagctgagaatgatgttactgagtgaagcaggcgcagcagaaaaaacctcgggcgggggcgatggcgccagagcgcgggcagacggagcggccaaggaaggggctggggccgctgccgccgccgcaggacctgacggcgctcctgaggctcgggctaaacccgccgtcagggtaaggttagaggaccgatttaactctatcccagcagagcccccacccgcaccgaggggcccggaacccccagaaccagggggtgccttgaacaatctggttaccctaattcgtcatccctccgagctgatgaacgtgccgctgcagcagcagaacaagtgcaccgccttagtgaagaacaaaactgccgcaaccacaaccgctctccagtttacctatccactttttaccacgaacgcttgttctacttcagggaactccaacctgagtcagacgcaatcatcttccaactcctgttctgtcctcgaggccgcaaaacaccaggacataggcctgccccgcgctttctctttctgttatcaacaggaaatagagagcacaaagcaaacgctggggagccgaaacaaagttcttcccgagcaggtatggatcaaggtgggagaggccgccttgtgcaaacaagctctaaaaaggaatagaagtcggatgcgccaactagacacgaatgtcgagaggcgggcactgggggagattcagaatgtcggcgagggtgcaacagccacccagggcgcatggcagtcctctgaatcaagccaggcaaatttaggggagcaggcccagtccggcccccaaggtgggaggtcccagcgacgagagagacacaatcggatggagcgcgaccggaggaggcggattcggatttgctgtgacgaactgaacctgctggttcctttttgcaacgcagagactgacaaggcgaccactttgcagtggaccaccgctttcttaaagtatattcaggagcgccatggggactctctaaagaaagtgctgtcaactaacagtcgctatgtaatgctatggacctgctttttaaagatgaaatctgcggttgacggcaaaaacccacagcacgcttaccggacagcaaatcacaaatggttgtgtctgcacgaagcccggtctttcgctttcgaggtatccatctgggcccattttcagctctttagggtgagaattccagagggatttctgagcatatag

SEQ ID NO: 180167 - DNA, 843 bp, Artificial Sequence
  Description of Artificial Sequence: Synthetic coding sequence
atgggccccaaggacagcgccaagtgcctgcaccggggcccccagccttcccactgggcagcgggtgatggaccgactcaggaacggtgtggcccacggagcttgggtagccctgtgttgggtctcgacacctgtcgggcctgggatcatgtggatggccagatcttgggacagctgcgaccactaactgaagaagaggaagaagaaggcgccggcgcgactctatcccgtggaccggcttttcctggcatgggctctgaagagctgagactggcctcgttttacgactggccactaactgctgaagttccacctgagttgctagccgccgcaggattttttcacaccggacaccaggacaaggtccgttgctttttctgctacggcggcctgcagtcatggaagaggggtgacgatccttggacggagcacgcaaagtggttccctagttgtcagttcctcctacgcagcaagggccgtgacttcgtgcattccgttcaagaaacccactcccagttgctcgggtcttgggatccgtgggaagaacccgaagacgccgcacctgtggcgccctcagtgccagccagtggctatccagagctgcccactccgagaagagaggtgcagtccgagtccgcccaggaacctggagcccgcgacgtggaggcacagttacggaggctacaggaagaaaggacgtgcaaggtctgcctggaccgagctgtctccattgtttttgtgccctgcggacatttagtgtgcgcagaatgtgcgcctgggctccaactgtgccctatttgtcgcgcaccagtgcggtctcgcgtgagaacctttctatcctag

SEQ ID NO: 180168 - DNA, 3564 bp, Artificial Sequence
  Description of Artificial Sequence: Synthetic coding sequence
atgcggccccggggcgccgccttcgccgccggcccccccggcgacctgcacctcgggacagccataggcttcgccggagcgatttggcgtagccgatctcctgccatgtccaccttgctcgatattaagagcagcgtgctgaggcaggtccaagtgtgcccttcatttcgacggagaactgagcaggacccggggagtgcatccgccgacccccaggaacccgcgactggtgcatggaaaccaggggacggcgtcgagttcttcgcccacatgagactgatgctgaagaagggggaaggtaggcaggggctcccctgtttggaagtgccactgaggagtggctctcccgcgcctcccgagcccgtggacccatcgcttggcctccgtgccctggcgcccgaagaagtggagatgctctacgaggaagctctttataccgtcctatatagggcaggcaccatgggacccgaccaggtagacgatgaagaggccctcctctcttatctccagcaggtcttcggtacatcgttggaagagcacactgaggcaattgaacgcgtacgcaaggccaaggccccaacttatgccttaaaggtctcagtgatgagagctaagaacctcctcgccaaagatcccaacggtttctccgatccatattgtatgctgggtatcctgccggccagcgatgccacaagagagcccagggctcagaaagagcagaggttcggattcaggaagggatcaaaacgagggggcccccttccagccaagtgtatacaagtgactgaagtgaaatcttccacacttaaccctgtctggaaagagcactttctctttgaaatcgaagacgtgagcactgatcagctacatctcgacatctgggatcacgatgacgacgtgagtctcgtggaggcatgcaggaagttaaatgaggtgatcggcctcaagggcatgggcagatacttcaaacagattgtaaagtccgccagagccaacggcacagcaggacctaccgaagatcacactgacgactttcttgggtgtctgaatatacctgtccgggaggtccccgtggcgggagtggacagatggttcaaactggagcctcgatcgtccgcaagtagagtgcagggccattgtcacctagttctgaagctgatcacaacgcagcgagataccgctatgagccagcggggccgcagcggttttctatctcatcttcttctactgagccacctgctgcgactcgaacactcagcagaagaacccaatagcagctcctggcggggcgagctgtctaccccagctgccacaattctgtgcttgcacggcgctcagtcaaacctctcccccctccagctggcggtgttacattggcaggttagcagccgacatcaccaaacatgcactcttgactattcttacctgctaggactgttagaggacatgcaagcccactgggaggaagccccgtcactgcctcaggagcaggaggaatcgctggcagactcgctgtcagccttcagcgaattcggactgcagctgcttagacagctgcgcgactatttcccagcaacaaacagcaccgccgtgcatagactcgagctgctgcttaagtgtttgggcaagcttcagctctttcagccaagtttcgagatctgtccctttgagtccgagctaaacatggatatcgcagcggcgctcaagcgcggcaaccgcgaatggtatgatcgtatcttgaatgacaaaagtccccgcgaacagcctggcccgcagcgattgcccgggcttgttgtcctggcagacgctgtgtacgacgatcttcagttttgctactccgtgtatgctagcctttttcactccatccttaatgttgatgtcttcactcttacatttcgtcaattggaacgcctggtggctgaagaagcctgggtgcttactgaggagttgagtcccaagatgacccttgaggttgcttccggcctgttcgagctgtacctaacactagcagacctacagcgcttctgggactcgattcccggcagggacagtagatctctcgcccttgctgggattcacgcccccttcctcccagcagttaagctgtggttccaggtgctccgcgatcaagctaagtggcggctgcagggggcagtggatatggacaccctggaaccggtcgatgcgagtagcagacattcgtctagtgcggccaccgcaggactttgcctttcacatatccaagaactgtgggttaggctggcttggcccgacccagctcaagcccagggcctggggacccaacttgggcaagacgtctgtgaagccacactgttctacaccgagctattgagaaaaaaggtcgacactcaacctggtgccgccggcgaagcagtctccgaggctctgtgtgttgtactgaacaatgtggaactggttcgcaaggcagctgggcaggccctcaagggcttggcgtggccggagggcgcaacaggaccagagggcgttctccctaggccactcctgagttgtacgcaggctctcgatgatgatctgcaacgcgaggcccataccgttacagctcacttgacctctaagatggttggagacatcagaaaatacgtgcagcacatttccctttcacctgattcaatacagaatgacgaggcagtcgcgcccctcatgaaatacctggacgagaaactggctctgttgaacgcctccctcgtgaaaggaaatctctcaagagtgctcgaggcgctgtgggaactcctcctgcaggcgatcctgcaggctctcggcgcaaatcgagacgtctccgctgacttctactctagattccacttcactttggaagctctggtcagctttttccacgccgagggccagggactgccacttgagtccttgcgagacggatcctacaaacggttaaaagaggagttaagactgcacaagtgcagcacgagggagtgtatcgagcagttttatctcgacaagctgaagcagagaaccctcgagcagaataggtttggcagactctccgtccggtgccactatgaggccgccgagcaacgtctggcagtggaggtacttcacgctgccgatttactgcctctggacgcaaatgggctgtccgatcctttcgtgatagttgagcttggcccaccacatctattcccactggtgcgctcgcagcggactcaggtcaaaacacgaacactgcatcccgtgtacgatgaactgttctacttcagcgtgcctgccgaagcatgtcgccgtagggccgcgtgtgtgctgtttacagtcatggaccacgactggctttcgacgaatgactttgcaggcgaagcggccctcggactgggtggcgtgaccggcgttgctcgacctcaggtaggcggtggtgcgcgtgctggccagcccgtgacacttcatttgtgcagaccgcgcgcccaggtcagaagtgcgctccgtaggctcgagggccggacgtcaaaggaggcccaggaattcgtgaaaaagctgaaggaactcgaaaagtgtatggaggctgacccttag

SEQ ID NO: 180169 - DNA, 3510 bp, Artificial Sequence
  Description of Artificial Sequence: Synthetic coding sequence
atgagcaccctgctggacatcaagagcagcgtgctgcggcaggtgcaagtgtgcccaagtttccgaaggcgcaccgagcaggatccaggctctgcctcggcagacccgcaagagcctgccacgggcgcttggaaacctggcgatggcgttgaattttttgcacatatgagactaatgctgaagaaaggcgaggggaggcagggcctgccatgcctggaggcatggggatcgccgtgccgtcagtccccccacccaggcccgcacacacaggttccactgagaagcggaagtccagctcccccagagcccgtcgacccatctctgggtctcagagccctcgccccggaggaagtggaaatgttatacgaggaggctctatacaccgtactctatcgtgccgggacaatgggcccagatcaagtggatgatgaagaggccttactgtcttaccttcaacaggtattcggaacttccctggaagaacacactgaggccatcgagcgggtccgcaaagctaaagctcctacttatgcactaaaggtctctgtgatgcgagctaaaaacctcttggctaaagaccccaacggattttcagacccctactgcatgctgggcattctgcccgcgagtgacgctacacgcgagcctagagcccaaaaggagcaacggttcggatttagaaagggctctaagcggggcggccctctgcccgcaaagtgcattcaggtcactgaggtgaagagctcgaccctgaatcccgtttggaaggagcacttcctgtttgagatcgaagatgtatcgaccgaccagttacacctggacatctgggaccatgacgatgatgtgtcccttgtggaggcctgcaggaagctgaacgaggtaatcggacttaagggcatgggtcgatacttcaagcaaatcgtgaagtccgcccgcgccaatgggactgcagggccgacagaagatcacacggacgatttcctaggctgcttgaatatcccagtccgggaggtgcccgtggccggtgttgaccgttggttcaagctcgaaccccgctccagcgcctcaagggtccagggtcattgccatctagtgcttaaactcataaccacccaacgcgacaccgcgatgagtcaacgcggtagaagcggttttctgtcccacctgttgctgctctcccacctgcttcgcctcgaacacagtgcggaggaaccaaattcgagctcctggcggggggaactgagcaccccagctgcaaccatcctgtgtctacacggggcgcagtccaacctaagcccgcttcagctagcagtacttcattggcaggtgagctcccggcaccaccagacatgcaccctcgactactcatatttgttagggctgctggaggacatgcaagcgcactgggaggaagcacctagcttaccccaggaacaggaggagtctctcgccgacagtcttagcgctttctctgagttcggactgcagttgttgagacagctgcgagactattttcccgctacaaatagtacagctgtgcatagattggagctgctgctgaagtgcctcggcaagcttcaactgtttcagccatcctttgagatctgccccttcgagtccgagctcaacatggatatcgcagccgccctcaaacgcggcaatagagaatggtacgacagaatcttaaatgataaatcaccccgggagcagccaggcccacagaggcttccaggcttagtcgtcctcgccgacgccgtttatgatgacctgcagttttgttatagcgtctacgcctccctgttccacagtattctgaatgtagacgtgtttacactcacttttaggcagttggaaagattggttgccgaggaggcgtgggtgcttactgaggagctatcacccaaaatgacattagaagttgcatctgggctgtttgagttatacctcaccctcgcagacctgcagagattctgggattccattcccggtcgagatagccggtcgctggcgctcgccggaattcacgcccccttcctgcccgcagtcaaattatggtttcaggtgttgcgggatcaggctaagtggcgcctgcagggcgcagtcgacatggacacattggaaccagtggacgcctcatcgagacattcttccagcgccgctactgcgggcttgtgtttgtcacatatccaggagttgtgggtgcggctggcttggcccgacccagctcaggcgcagggtttgggcacccagctgggccaagatgtttgcgaggccaccctgttctatactgaactactcagaaaaaaggtggacactcagcctggggccgctggagaggcggtctctgaggcattgtgtgtggttttaaacaatgtagagcttgtcagaaaagccgctggtcaggcacttaaaggcctcgcctggcctgaaggtgcaacaggaccggagggagtcctgccacgacctctcctcagctgtacccaagctttggatgatgacctgcagcgtgaagcacacacagtcacagcacaccttaccagtaaaatggtcggagatattaggaaatatgttcaacacattagcttgtcccctgattccattcagaacgatgaggccgtcgcacccctgatgaagtatctagacgagaagctggcactgctcaacgccagccttgttaagggcaacctctcacgggtgctggaggccctctgggagctgttgctacaagccattctacaggcgctgggcgctaatcgagacgtttctgccgacttctactcgaggtttcactttactctggaggcactcgtgtcctttttccacgccgagggacagggattaccactcgagtcattacgtgacggctcttacaagcgtttaaaggaagaactgaggctccacaagtgctccacacgcgaatgcatcgagcagttctacttagacaaattaaagcaaagaaccctcgaacagaacaggttcggccggctgtccgtgcgttgccattacgaggctgcagagcaaagactagccgttgaagtgctgcacgccgctgacctgctgcctctggacgctaatggactgtccgaccctttcgttatagtcgagctgggcccaccccatttgttccccttagttaggtcccagcgcacccaggtgaagacccgcaccctgcatccagtctatgatgaattgttttacttctccgttcccgcagaagcctgccgccgccgcgcggcgtgcgtgctgtttaccgtcatggatcatgattggctgtccaccaatgatttcgcaggcgaggccgcactgggactcggaggcgtgaccggggttgccagaccccaggtgggcggcggagcaagagcaggccaacccgtgaccctgcatctatgccgacctcgagctcaagtccgctccgccctgcgacgcctggaaggccgcactagcaaagaagcccaggagtttgtgaaaaaactgaaagagctggaaaaatgcatggaggccgatccgtag

SEQ ID NO: 180170 - DNA, 3510 bp, Artificial Sequence
  Description of Artificial Sequence: Synthetic coding sequence
atgagcaccctgctggacatcaagagcagcgtgctgcggcaggtgcaggtgtgccctagtttccgaagacgaacagagcaggaccctggctctgcttctgccgaccctcaagagcccgccaccggcgcctggaaacccggggacggcgtggaattcttcgcccacatgagactgatgctgaaaaagggcgagggtcggcagggcttgccgtgcctggaagcctggggcagtccgtgccgacagagcccacaccctggcccgcatactcaggtgccgctccggagcggcagtcccgcgcctcccgagcccgtagatccctccctgggccttcgagccctcgcgccagaggaagttgagatgctatatgaagaagcgctctacaccgtgttgtacagagccggtaccatgggcccagatcaggtggatgatgaagaggccctgctttcttacctccagcaagtcttcggcaccagtctcgaggaacatacggaggccattgagagagtccggaaagcaaaggcacccacatacgccctcaaggtgtcggtgatgagggccaaaaacttgctcgccaaggatcccaacggattcagtgacccatactgcatgctcggcatactgccagctagtgacgctacacgcgaaccccgggcccaaaaagaacagcgatttggctttaggaagggtagtaagaggggggggcctcttccagccaagtgtatccaggtgacggaagtcaagtcaagcaccctgaatccggtttggaaggagcacttcttattcgaaatcgaagatgtgtcgactgaccaattgcacctggacatttgggatcacgatgatgatgtgtcactcgttgaggcctgcagaaagctgaacgaggtgattggtctgaaaggcatgggtaggtactttaagcagattgtcaaatctgcccgagcaaatgggactgcaggccccacagaggatcacaccgatgatttcctgggatgcctgaacattcccgtgcgtgaggtccccgtggctggcgttgaccggtggtttaagctggaacccagatcgtcggcttccagggtgcagggacactgtcatctggtgcttaagttaattaccacccagcgggataccgccatgtcgcaacgcgggcgcagcgggttcctcagtcatctcctgctattgtcacacctgcttcgccttgagcattcagccgaagaacctaactcatcatcttggaggggtgagctgtctactcctgccgctaccatcctatgtctccatggcgcccagagcaacctatctcctttgcagctagctgtgctgcattggcaggtctctagtagacatcaccaaacctgcacccttgattattcatatctcctaggactccttgaggatatgcaggcccactgggaggaagccccttcattgccgcaggaacaggaggagtcgttggctgatagcctgagtgccttctccgagtttgggctgcagcttcttagacagctgagggactactttccagccacaaatagtacggccgttcacaggctggagcttctgctgaagtgcctcggaaaactccagctgtttcagcccagcttcgagatttgcccgtttgaatctgaattaaacatggatatcgccgctgccttaaaaaggggaaaccgcgagtggtatgatcgcatcctaaacgataagagccctagggaacagcctggcccccaacggctgcccggtctcgtggtactcgctgatgccgtgtacgatgaccttcagttctgttactcagtctacgcaagtctctttcattccatccttaacgtggatgtgtttacgctaacattccgccaactagagaggctggtggccgaagaagcttgggtactgaccgaggaactgagccctaaaatgacacttgaagtggcctcggggctctttgaactgtaccttacacttgcggatctgcagaggttttgggattccatccccggtagagacagtcggtcactcgcattggccggtattcacgcaccgttcttacccgccgttaagctctggtttcaggtgttgagggatcaggccaagtggcgccttcagggtgcagtggatatggacaccctggaacccgtggatgctagctcaagacatagttcgtccgctgccactgcaggattatgcctgtcccacatacaggaactgtgggtgcgcctcgcctggcccgacccggcccaggcccagggtctgggcacacagctgggccaggacgtctgtgaagctaccctgttttacacagaactccttaggaagaaagtggacactcagccaggggctgccggagaagccgtctctgaagctttatgcgtcgtactgaacaatgtggagttagtccggaaagcagccgggcaggcccttaaagggctagcatggcccgaaggggctacaggacctgagggagttttacccaggccactgttatcttgtactcaagctcttgatgatgatctgcaaagggaggcccacacagtgaccgcgcatctgacttcgaaaatggtgggagacatccgcaaatacgtgcagcatatatcactctcacctgattctatccagaacgatgaggccgttgcacctctgatgaagtacttagacgaaaagttggctttattgaatgcatctctcgtaaagggtaacctgtcacgcgtactggaggcactttgggaactcttgcttcaagccattctgcaagcactaggagctaatagggatgtcagtgctgacttttattctagatttcattttactctggaagccttggtctccttttttcacgcagaagggcaaggactgccactcgagtcgctgagggacggcagctacaagcggttgaaagaggaactgcgactccataaatgctccacacgggaatgtattgagcaattttacctggataaactcaaacagcggacacttgagcagaacaggttcggccgactaagtgtaaggtgtcattatgaagccgcagagcagcgtctggctgtggaggttttacacgctgcagatctactccccctggacgccaatggcctttcagacccattcgtcatcgtggagctagggcctcctcatctgtttcctctggtaaggagccaaaggacccaagttaaaacccgaactctccaccccgtgtacgatgaactgttttattttagcgttccggccgaggcatgtagaagaagggcggcctgtgtccttttcacagtcatggaccacgattggcttagcacgaacgatttcgcaggtgaagctgccctggggttggggggtgtgaccggtgttgccaggccacaggtgggtggcggtgcaagggctggccagcctgtcacattgcacctgtgcaggcctagagcccaggtccgcagcgcactgcgtagactggaaggacgcacctcgaaagaggcccaggagtttgtgaagaagcttaaagaactcgaaaagtgcatggaagctgatccatag

SEQ ID NO: 180171 - DNA, 3351 bp, Artificial Sequence
  Description of Artificial Sequence: Synthetic coding sequence
atgagcaccctgctggacatcaagagcagcgtgctgcggcaggtgcaggtttgtccttcttttagacgaagaactgaacaggaccccgggtccgccagcgctgacccacaggaaccagccactggagcgtggaagccaggcgatggagtggaatttttcgcccacatgaggcttatgctgaaaaaaggtgagggcaggcagggtctgccatgcctcgaagtgccgctccggtctggtagtccagccccccccgagcccgtggatccaagtctgggcctgcgggcactcgcaccagaggaggtcgagatgctgtacgaggaagctctctatactgtgctttacagagcaggaactatgggaccagaccaagtggatgatgaggaagctttgctgagctacttacaacaagtctttggcacgagcctcgaggagcacactgaagccatcgagcgggtgagaaaagctaaagcaccgacttacgcactgaaagtgtccgtcatgcgggccaaaaacctgctggccaaggatccaaacggattctctgacccttattgtatgttgggaattctccctgcctcagacgcaaccagggagcctagggcacagaaggaacagcgcttcggatttcgaaaagggtcaaaaaggggaggcccacttccagcaaagtgcatccaagtgaccgaggtgaaatcttcaaccttgaacccggtgtggaaagagcacttcctttttgaaatcgaagatgtatccaccgatcagcttcacttggatatttgggatcacgacgatgatgtatcactggtggaggcctgtcgcaaactgaatgaggtgattgggttgaagggcatgggccgctacttcaaacagattgtcaaaagcgcccgggccaatgggactgccggccccactgaggatcataccgacgactttcttggctgtctaaacatcccagtgcgtagagataccgccatgtcccaacgaggaaggtcagggttcctctcccacctgctcctactgtctcatctgctcagactggagcactcagccgaagaacccaatagctcgtcttggaggggagaactgtccactccagcggccaccattctgtgtctgcacggggctcagtctaatctctctccactgcagttggcagtgcttcactggcaggtaagcagcaggcatcatcagacgtgtactctggactattcttacctgctggggttgctggaagatatgcaagcccattgggaagaagcgccctcgctgccacaggaacaggaagagagcctcgctgactctttgagcgcattttccgaattcggcttgcagctcctgcgacaacttcgtgactacttccctgccaccaattcaaccgctgtacatagactcgaactactgctcaagtgcctgggaaagttgcagctttttcagccctctttcgaaatctgtcctttcgaatctgaactcaacatggacattgccgcagccctgaagcgcggtaatagagaatggtatgacaggattctgaacgacaaatccccccgtgaacagccaggcccccagagactgcctggtctggtcgttctggccgacgccgtatatgatgatttgcagttttgctactcagtctacgccagcctttttcacagcatacttaatgtcgatgtttttacactgacattcagacaactcgagaggctcgtggcagaagaagcatgggtgctgacggaggaattatctccaaagatgactctggaggtggcatctggtctgtttgagctttatttaaccctggctgatctgcaacgtttctgggatagtatccctggccgcgattcgaggtccctggcgttggcaggaatccacgctcccttcctccctgccgttaagctttggtttcaagtgctgcgggatcaagccaagtggagacttcaaggagctgtcgatatggacacactggagcccgttgatgcgagcagtcgacactcatcctccgctgccaccgccggactttgcctgtcgcacatccaggagctgtgggttaggctggcctggccagaccctgcacaggcccagggcctgggcacccagctgggccaagatgtctgcgaggctactcttttctacacagagcttttgcgaaaaaaggtcgatacccaacccggagctgctggagaggctgtctccgaagcactgtgcgtggtgctgaataatgtggagcttgtccgaaaggctgcgggccaggccctcaagggcctggcatggcctgagggcgcgactggacccgagggggtactgcccagacctcttttgtcttgtactcaggcactggacgacgacctccaacgggaggcccacaccgtgacggcccacctgacaagcaaaatggtgggtgatattcgtaagtatgtacagcacatctccctcagtccagattccatccaaaatgacgaggcggtagctccactaatgaaatacctggatgaaaaactggcattactgaacgcgtcgctagtgaaaggcaatctttccagggtgctggaagctctgtgggagctcctgcttcaggcaatcttgcaggccctgggcgccaatagggacgtgagcgccgacttttactccaggtttcacttcacactcgaagctctcgtgtcctttttccatgccgaggggcagggacttcccttggaaagcctgcgggatggttcttacaagagattgaaagaagagctgcgtctgcataaatgttccactcgtgaatgcatcgagcagttctacctggacaagctaaaacagcgtacattggagcagaataggttcggccgcctatcagtcagatgccattacgaagccgcagagcaacggcttgctgtcgaggtgctgcatgccgccgaccttctcccactagacgccaacgggctgtctgacccttttgtgattgtggagctcgggccccctcatctgtttcccctggtcagatcgcagcggacccaagtgaagaccaggacactgcaccccgtgtatgacgagttgttttacttctctgtacctgcagaggcgtgtagacggcgggccgcgtgcgtcctgttcaccgtgatggatcatgactggctgagtacaaatgacttcgccggagaagcagcgctcggattgggcggtgtgaccggcgtcgccagaccccaggttggtgggggtgctagggccgggcagccagtgacactgcatttgtgtcgccccagagcccaggtgagatccgcacttcgcagactagaaggtaggactagcaaagaggcccaggagttcgtgaaaaaactgaaggagttggaaaagtgcatggaagcagatccatag

SEQ ID NO: 180172 - DNA, 3459 bp, Artificial Sequence
  Description of Artificial Sequence: Synthetic coding sequence
atgagcaccctgctggacatcaagagcagcgtgctgcggcaggtgcaggtctgcccaagttttagaagaaggacagagcaggacccagggagcgccagcgccgatccacaggagcccgccactggagcctggaagcctggtgacggcgtggagttcttcgcccacatgcgacttatgttgaagaagggcgaaggcaggcaaggcctgccttgcctggaggtcccactgagaagcggaagcccggccccaccagagcctgtcgatccaagcctggggctgagagccctcgcccctgaggaagtggaaatgctttatgaagaggccctgtacacagtgctataccgggcggggacgatgggcccggaccaggtggacgacgaggaagccctgctgagttacctgcagcaggtcttcggtacaagtcttgaggagcacacagaggctattgagagagtccgtaaagctaaagcccccacctacgcactgaaggtatcagttatgagagccaaaaacttgctcgcaaaagatcccaatggattttccgacccctactgtatgttaggcatccttccggcctctgacgctactcgggagccacgcgcccagaaggagcagcggttcggttttcggaagggaagtaagcgagggggcccactgcctgcaaagtgtatacaagttaccgaggtgaaatcttcaacacttaaccctgtctggaaggaacactttttattcgaaatcgaggatgtgtcgacagaccagcttcacctcgatatatgggaccacgatgatgacgtttcgctggtggaggcctgtcgaaagctgaatgaagttattggcctgaaaggcatgggacgctacttcaagcaaattgtgaaatctgcacgtgccaatggaacagctggcccaacagaagatcacacagatgacttcctgggctgcctgaacatcccagtccgggaagttcctgttgccggagtcgacaggtggttcaagttggaacctagatcttccgcttcgagggtgcagggccattgtcatctggtgctgaagttgatcacaactcagagagacacggccatgtctcagagaggaagaagtggatttctgtcccaccttcttcttttgagtcatttactgagattggaacatagcgccgaggagccaaatagtagttcctggcgaggcgaactttctacccccgcagctactatcctctgtttgcatggcgcccagagtaatctgtcccccctacagctcgccgtgttgcattggcaggttagctcccgccaccaccagacatgcaccttagattactcttatctcctgggactgctggaggatatgcaagcacactgggaagaagcgccgtctcttcctcaagaacaagaagagagccttgccgacagtctgtccgcctttagtgagttcgggctgcagctcctaaggcagcttagggattacttcccagcgaccaatagtaccgccgtccatagattggagctgctgctgaagtgtctagggaagctgcaactctttcagccgagcttcgagatctgcccgtttgaatcagagttgaatatggacattgcagccgctctgaaacggggcaacagggaatggtatgacaggattctgaacgacaagtcacctagagaacagcccggtccccagaggctgcccggcctcgtggtgctggccgacgcagtgtatgacgatctgcaattctgctacagtgtgtatgcaagcctgtttcacagtattttgaacgtcgacgtgttcactctgacatttaggcaactcgaacgtctggtcgcagaggaggcgtgggttctgactgaagagttgagccccaaaatgacgctagaagtagcatcaggattgttcgaactctacctcacactggctgacttgcagagattctgggacagtatcccaggtcgcgattcccggtccttagctctggccgggattcacgcaccctttcttcccgcagtgaagctgtggttccaggtgctgagagatcaggccaaatggcggttgcagggggcagtcgacatggataccctggagcctgtggacgcatcttctcggcattcaagctctgccgcaacggctgggctatgtctgtcacacattcaggagctttgggtaagactggcttggccagatcccgctcaagcccaggggctgggtactcagctgggtcaagacgtgtgcgaagccacccttttttacacagagctcctgcgtaagaaagtcgacactcagcctggcgccgcaggtgaagcagtgagtgaggcactctgtgtggttctgaataacgtagaactcgtgaggaaagccgcgggacaggccttaaaggggcttgcctggccagagggggcaacaggccctgagggcgtcctgccccgccccctgctcagctgcacgcaagcactcgacgatgacctacagagagaggcccacacagtgaccgcccatctcacatcaaagatggttggggatattagaaagtatgtccaacacatatcactgtcaccagactccatccagaacgacgaagcggtcgctcctctgatgaagtatctagacgagaagctggccctgcttaatgcttcccttgtgaaaggcaacctgtcccgagtgctggaagccctgtgggaattgttgctgcaagctatcctgcaggccctgggggctaacagggacgtgtccgcagacttctactctaggttccattttaccctggaggctcttgtaagctttttccatgctgaggggcaaggactccccctggagtctttaagagatggctcttataaaaggctgaaagaggagctccgattacacaaatgctcgactagggaatgtattgagcaattttacctcgacaaactcaaacagagaacactggaacagaataggtttggtcgcctgtccgtgcgatgccactatgaagccgcagagcagcgacttgccgtggaagtgctacacgcagctgatctgcttccactagacgcgaacggcctgtctgaccccttcgtcattgtggagctcggccctcctcatctgttcccactagtaaggtctcaaaggacacaagtaaagactcgaaccctgcacccagtgtacgacgaattgttctacttttctgttccagcagaggcatgcagaagaagagcagcctgtgtgctctttaccgtgatggatcacgattggctcagtacaaatgacttcgcaggggaagctgctttaggattggggggcgtcacaggggtcgcaaggccgcaggtagggggaggagccagagccggccagccggtgacactccacttgtgtcgaccacgagcccaggtgcgaagcgccctccgtagactggagggtcgtacatctaaggaggcgcaagaatttgtcaagaaactcaaagaattagagaaatgtatggaggcagacccgtag

SEQ ID NO: 180173 - DNA, 537 bp, Artificial Sequence
  Description of Artificial Sequence: Synthetic coding sequence
atgagccagcggggccggagcggcttcctgagccacctgctgctgcttagccacttacttcgactggagcacagcgcagaggagcctaattcgtcttcttggaggggcgaactgtctactcctgctgccacgattctatgtctgcacggcgcccagtctaacttgtcccctctacagctagctgtcctacattggcaggtctcttcacgccatcaccaaacatgcacacttgactactcttatttgctcgggctgctggaggatatgcaggcccactgggaggaggcaccttctctccctcaggagcaggaggagtccctagccgattctctgtccgcctttagcgaatttgggctacagttgctaagacagcttcgcgactactttcccgctacaaactctacagctgtccaccgattggaactactgctgaaatgtctcggaaagttgcagctgtttcagccttcttttgagatctgtcccagagtgggagctgaacatggccactgttgcggccctgaagagaggcagccatag

SEQ ID NO: 180174 - DNA, 1782 bp, Artificial Sequence
  Description of Artificial Sequence: Synthetic coding sequence
atggccgccgccagcagcagcgacagcgacgcctgcggcgccgagagcaacgaggctaatagtaagtggctcgacgcacactacgatcctatggctaacattcatacttttagcgcctgtctggctctcgcagatctccacggcgacggcgagtacaagctggtggtaggagacctgggccccggaggccaacaaccccgcttgaaggtcctaaagggcccgcttgtgatgaccgagagtcccctcccagccttgccggctgctgctgcgacatttctcatggagcagcatgaaccaagaacgcccgcacttgccctggcgtccggaccgtgtgtctatgtgtacaaaaacctgcgcccctattttaaatttagcctgccgcagttacctcccaaccctttggagcaagatttatggaatcaggccaaggaagatcgaatagacccgctcaccttgaaggaaatgcttgaatctattcgtgagactgccgaggaaccattgtccattcagtctctacgctttctccagcttgaactgagtgaaatggaagccttcgtcaatcagcacaagtcaaactctattaaacgtcagacggtcattaccacaatgaccactttgaagaagaacctcgcagacgaggatgccgtgagttgcctggtgctgggaacagagaataaggaacttctcgtcttagacccagaagctttcactatcctggccaagatgtcactgcccagtgtcccagtttttctggaggtgtctggacagttcgatgttgagttccggctcgccgccgcttgtaggaatgggaatatttacatcctccgacgggacagtaagcaccccaaatattgcattgagctgtctgcccaacctgtggggcttatacgcgtgcataaggtccttgtggttgggtcaactcaggatagtcttcatggattcacccacaagggaaagaagctttggaccgttcagatgccagccgcaatattaactatgaatctcctggagcaacatagccgcgggctgcaggcagtgatggccgggctcgcaaacggagaggtgcgaatttaccgggataaagctctcctgaacgtcatacatacgcccgacgccgtgacatcgctctgctttgggagatatgggcgggaagacaacactctgatcatgacaacccgcggaggaggtttaataattaagattctcaagcggacagcagtcttcgtagaaggcggatcagaggtgggacccccgccggctcaagctatgaagctaaacgtgccccgcaaaactcggctgtacgtagaccagactcttagggaaagggaggccggaacagctatgcaccgcgccttccagactgatctgtatttgttgcgactccgcgccgcccgcgcctatttacaggcccttgaaagttcattatcacctctgtcaactaccgcccgcgaaccattgaagctccatgctgtggttcaggggctcggcccaaccttcaaactcaccctgcatctgcaaaacacctctacgaccaggcccgtgctcggattgctcgtttgtttcctgtataatgaggccctgtatagtctcccacgggcattctttaaggtgcctctgctggttcctgggttaaactatcccctcgagacatttgtggaaagcctttctaacaaaggaatttcagacataataaaggtccttgtgctccgtgaggggcaatcagctcccctgctctccgcacacgtgaacatgcccgggtcagagggtctggctgccgcgtag

SEQ ID NO: 180175 - DNA, 498 bp, Artificial Sequence
  Description of Artificial Sequence: Synthetic coding sequence
atgagccccggcccccagctgtggcacctgctgcaggccctggtgtctatgtgcattcggatttcagacccaacgagcagtagtgcttgccccaattgtctgcaaatattgtggaacaagacatttggcaccaggcctaaaagggaaaccgctgaagagccactgagtattcagagccttcgattcctgcaattggaactctccgagatggaagcatttgtgaaccagcataagtctaatagcatcaaacgacaaactgtgatcacgacgatgaccaccttgaagaagaacctggccgacgaggacgcagtgtcctgccttgtgttggggactgagaataaggagctcttagtgctggaccccgaggcgtttacaatcctcgcgaaaatgtccttaccttcggttccagtttttcttgaggtttccgggcagtttgacgtagagttcaggctggcagccgcctgcaggaatggcaatatctatatcctccgacggtag

SEQ ID NO: 180176 - DNA, 2172 bp, Artificial Sequence
  Description of Artificial Sequence: Synthetic coding sequence
atgctgagcagcatggccgccgccggcagcgtgaaggccgccctgcaagtggcagaggtgctcgaggctatagtgagctgttgtgtaggtccagaaggccgacaggttctgtgtactaagccaaccggcgaagttctcctgtccagaaacggggggaggttgttggaagccctgcacctagagcatccaattgcaagaatgatcgtcgactgcgtcagttcccatcttaaaaaaaccggagacggagccaagacattcatcatattcctttgccatctgctcagaggattacatgctataacggatcgggaaaaagacccgctaatgtgtgaaaacattcagacccatggaagacattggaagaattgcagtaggtggaagttcatctcacaggccctactcacgttccaaacccagattctggatggcattatggaccagtatctgtcacgccatttcctttcaatcttctcttctgccaaggagcgtactctgtgtcgctcaagcctagaactcctgttggaggcatacttttgtggaagagtgggtcgcaacaatcataaattcatctcccaattgatgtgtgactacttttttaagtgcatgacttgcaaatccgggataggtgtcttcgaacttgtagacgatcatttcgtggaactgaacgtcggggtgacgggacttcccgtgtccgattcaagaattattgcaggtctggtcctccagaaagactttagtgtctaccgcccagccgatggcgatatgcggatggtgattgttactgaaacaatccagccactttttagtacctctggctcggagtttattctgaactctgaggcccagttccagacaagtcagttttggattatggagaaaacaaaggctatcatgaagcatctccactctcagaatgtgaaactcttaattagtagcgtcaagcagcccgacttggtctcttactatgctggcgtgaacggcattagcgtggtggaatgcctgtcttccgaagaagtgtcattgattcggagaatcatcgggctgtcaccatttgttcccccacaggcattcagtcagtgcgagattcctaatacagctctggtgaagttttgcaagccactgattttacgctccaaaaggtatgtccatctgggactgatctccacttgtgcgttcataccccactccattgtgctgtgcggtccagttcacggtctcatcgagcaacacgaggacgctttacatggggccttgaaaatgcttcgccagttatttaaagatttggatcttaactatatgacacagaccaacgaccagaacggaacatcctcactatttatatacaaaaacagtggggagtcctaccaagcccctgaccccggcaatggaagcattcagagaccctaccaggacactgtggcggaaaacaaggacgctctcgaaaaaacccagacatacctgaaagtgcattctaacctcgttatacctgatgtcgagctggagacatacattccatattctactcctacactgaccccaacagacacttttcagactgtcgagaccctgacttgtctgagtctggagagaaatcgtctgaccgattattatgaacccctgctgaaaaataactcaacagcttacagtaccagggggaataggattgagatctcctacgaaaacttacaggtgactaacattaccaggaaagggtctatgctccccgtgtcgtgtaaactgccaaacatggggacgagtcaaagctatctatcttcgtccatgcccgctggctgtgtcctaccagtcggcgggaacttcgagattctgctccattattatctgttgaactacgccaaaaagtgccaccagtccgaggagacgatggtgagcatgatcatcgccaatgctttgttaggcattcccaaagtactgtacaagagcaagaccggcaaatactcattcccacacacatacattagggctgtgcacgccctgcagacaaatcagcccctcgtctcatctcaaaccgggctcgagtctgttatgggcaaataccagctcctgacctctgtgctgcagtgcctaactaaaattctcactattgatatggtgataactgtgaagcgtcatcctcaaaaagttcacaatcaggactctgaggatgagctctag

SEQ ID NO: 180177 - DNA, 2133 bp, Artificial Sequence
  Description of Artificial Sequence: Synthetic coding sequence
atggtgatggcctgccgggtggtgaacaagcggcggcacatgggccttcagcagctctcatccttcgccgagaccggcagaacttttctggggcccctgaagagctccaagttcattattgacgaggaatgccatgagtctgtgctgatttctagcactgtcaggctgttagagtctcttgatctgacctccgccgtagggcagcttctgaatgaagctgtccaagctcaaaataatacctaccgcacgggtatcagtaccctgctctttctggtcggcgcgtggagctccgcagtggaggagtgtctgcacctgggcgttcctataagcatcatcgtcagcgttatgtcggagggcctgaatttttgtagcgaagaggttgtcagtctgcatgtaccagttcataatatattcgattgcatggattccaccaagactttctctcagctcgagacattttccgtgagtttatgccccttcctgcaggtccccagcgacaccgaccttatcgaggaattacacggactcaaggacgtcgcgtctcagactttaacaatctctaacctgtcagggaggcctttgaagtcttacgagttattcaaaccgcagacaaaggttgaggccgacaacaacaccagccgcaccctgaagaattccttattggcggatacctgttgcaggcagtctattctgattcattcaaggcatttcaacagaaccgacaatacggagggggtgagcaaaccagacggcttccaagagcatgtgacagcaacacacaagacgtatcgatgtaacgatctggtggagctcgccgttggtctcagccacggcgaccactcatccatgaagctggtcgaggaagctgtacagctgcagtatcagaacgcctgtgtgcagcagggaaactgtaccaaaccattcatgtttgatatatctcggatctttacctgttgcctcccaggcctacctgaaacgagttcctgtgtgtgccccggatacattacggtggtctcagtgtccaacaatcccgtgataaaagagctccagaatcaacctgtgaggattgtgctcatcgaaggcgacctgaccgagaactaccgtcacttgggcttcaataaaagcgcaaacatcaagacagtgctcgattccatgagacttcaggaagatagctccgaggagctgtgggctaaccatgtactgcaggttctaatccagttcaaggtgaatctcgttctggtgcaggggaatgtctccgagaggctcattgagaagtgcatcaatagcaagaggttggtgattggctccgtcaatggatccgttatgcaggcctttgccgaggcggccggcgccgtccaggtggcctacatcacacaggtcaacgaagactgtgtaggcgacggcgtctgtgtgacattctggcgctcttctcccctcgatgtggtcgatagaaataatcgcattgctattcttctaaagacagagggaatcaatcttgttacagcggtgcttacaaatccagtgactgcgcagatgcagattaaggaagacaggttttggacttgcgcctatagactctactacgcactcaaggaagagaaagtgtttctggggggtggcgccgttgagtttctctgtctcagctgcctgcacatcctggccgaacagtcactcaagaaggaaaaccatgcatgctctgggtggctgcataacacctcatcctggctggcatccagtcttgccatctatcgccccactgtactgaagttccttgctaacggatggcagaaatacctttcaaccctgctgtataacactgccaactacagcagcgagttcgaagcttctacctacattcagcaccatttgcagaacgccacggacagtggcagcccctctagttacatcctgaacgagtattcaaaattaaattcaaggatctttaactctgacatcagcaacaaactggaacagatccctcgcgtttatgacgtcgtcaccccaaaaatcgaggcctggcgcagggctttggatttagtcttgctggtcttgcaaactgacagcgagatcataaccggccacggacatactcagataaacagtcaggaacttacaggttttttgttcctatag

SEQ ID NO: 180178 - DNA, 576 bp, Artificial Sequence
  Description of Artificial Sequence: Synthetic coding sequence
atggtgatggcctgccgggtggtgaacaagcggcggcacatgggcctgcaacagctttccagcttcgccgaaactggacgcacctttctcgggcctttaaagtcctcaaaatttataatcgatgaagagtgccacgaatccgtgcttatctcctcgacagttcgcttgctggagagtcttgatctgaccagtgccgtggggcagctacttaacgaggctgtgcaggcgcagaacaacacgtaccgtaccggaatttctacactgttgtttctagttggcgcgtggtcttccgctgtggaagaatgcttgcacctgggcgtccctatctccataatcgttagcgtcatgtctgaaggactgaacttctgttccgaagaggttgtaagcctccacgtgccggtgcataatatattcgactgtatggattctaccaagacatttagtcagcttgagacgtttagtgtatccctatgtccctttttgcaggtgccctctgatacagatctcatcgaagaactgcatggcctcaaagacgtggcatcccaaacccttaccatatctaatctgtcaggatag

SEQ ID NO: 180179 - DNA, 2133 bp, Artificial Sequence
  Description of Artificial Sequence: Synthetic coding sequence
atggtgatggcctgccgggtggtgaacaagcggcggcacatgggcctgcagcagctcagctccttcgctgaaacaggtcggacatttttaggaccactgaagtcaagcaaattcataatcgacgaggagtgccatgaatccgttctcatctcctcaacagtgcgcctcctggaaagtttagatcttacttcagctgtgggtcaactgctgaatgaggctgtccaggctcaaaacaacacctacagaacaggaatctctacactgctgttcctagtcggggcatggagctccgccgtggaagaatgtctgcacttaggagtgccaatcagcattatcgtctctgtgatgtcagagggcctgaatttttgcagcgaggaggtggtgagcctacatgtccccgtccacaacatcttcgactgtatggatagtaccaagactttctcccagttagaaactttcagcgtcagtctgtgcccatttttacaggtgcccagtgacaccgacctgattgaggaactacacgggttaaaagacgtggcatcccaaacactcaccattagcaacctgtccgggcgacccctgaagtcctatgaactcttcaagcctcaaactaaagtggaggcagacaataacacctcccgtaccctgaagaacagccttctggctgacacctgttgtagacagagcatcctaattcactctcgacactttaaccgtaccgataacactgaaggagtgtccaaacccgacggtttccaggagcatgtcaccgccacacacaaaacttatcgttgtaacgatcttgtcgaactggcagtaggactttctcacggtgatcactcctccatgaaactggtcgaggaggcagtccagctccagtatcagaatgcttgcgttcagcagggcaactgtacaaagcctttcatgttcgacatatccagaatttttacctgctgcctccctgggctgccagagacctcgtcttgtgtgtgccccggttatatcaccgtggtttccgtgagcaataatcctgtaataaaggaactgcagaaccagccagtgcgtattgtgttgattgagggagatctcactgagaattaccgacatctggggttcaacaaaagtgctaatattaagactgttctggacagcatgcgcctccaggaagactcaagtgaagaactgtgggctaatcacgtcctgcaggtcctgatccagttcaaggtgaatctggtcctggtccagggcaacgtgtctgaacggcttatagaaaagtgcataaattccaagagactcgtgattgggtcagtgaatggcagtgttatgcaggcttttgcagaggccgcaggcgccgtgcaggtggcctatataacccaggtgaatgaagattgcgtgggcgatggcgtgtgtgtgacattctggaggtcgagtccccttgacgtagtcgatcgcaataaccggatcgccattctcctcaaaacagaagggattaatctcgttacagccgtgttgactaacccagttacagcacagatgcagatcaaggaggaccgtttttggacgtgcgcttaccggctgtactacgcccttaaagaggagaaggtatttctcgggggcggcgccgtcgagttcctgtgcctctcttgtttacatatattggccgaacagtctttaaagaaggagaatcatgcctgctctggctggcttcataacaccagctcgtggctagctagttcattggcaatctatcggcctacagtgttgaagttcttggccaacggttggcagaaatacctctccaccctgctgtacaacacggcaaattacagctctgaattcgaggctagcacatacatccagcaccacctgcagaatgctactgatagcggcagcccttcctcatatattctcaacgaatacagcaaactgaactcacgaatttttaactctgatatctccaataagcttgagcagatccctcgcgtgtacgacgttgtgacaccgaaaattgaggcatggcgaagggcacttgatttggtcctgctggtgctgcagacagattcagaaatcattacaggacacgggcacacacagataaactcgcaggaactgacggggttcttgtttctgtag

SEQ ID NO: 180180 - DNA, 2166 bp, Artificial Sequence
  Description of Artificial Sequence: Synthetic coding sequence
atgctgctgcccgtgttcaccctgaagctgcggcacaagatcagcccccgaatggtggccatcggccgctacgatgggacacatccgtgccttgccgcggctacacagaccggcaaggtgtttatccataacccgcatacgcgcaaccagcacgtctctgcctctcgggtctttcagtccccattggaatccgatgtgagcctcctgtctatcaatcaagctgtatcatgcctgactgcaggggtgctgaacccagagctaggctacgacgcacttctggtgggcacacagactaacttgctggcttacgatgtgtacaacaattctgacctgttctaccgcgaagtggccgacggtgcgaatgcgatcgtgcttggaacgctcggcgatatctctagcccccttgccatcataggcgggaactgcgcccttcagggcttcaaccacgaggggtctgacctgttctggacagtgaccggggataacgtgaattctctggccctctgtgattttgatggggatggtaagaaggagcttttagtcgggtctgaggattttgacattcgggttttcaaggaggacgaaatcgtggctgagatgaccgaaactgaaattgtgacgagcttatgtccaatgtacggttctcgctttggatacgcactgagtaatgggacggtcggcgtgtacgataagactagccgctattggcggatcaaaagcaaaaaccatgccatgagcatccacgcctttgacctgaatagtgacggcgtaaatgaactgattaccggttggagtaatggtaaagtggatgcaagatccgaccggacaggtgaagtaatcttcaaagacaatttttcatccgcaattgccggcgtcgtggagggggattataggatggatggtcatatccaactcatttgctgtagcgtagacggggagattagaggttaccttccaggcactgctgaaatgaggggaaatctcatggatacttctgctgagcaagatcttatcagagaactcagtcagaagaaacaaaacctgctgctggagctgcggaattacgaggaaaacgcaaaggctgaattggcgagcccgctgaacgaggcggatggtcacagggggataatccccgcaaacactaggttacacactaccctatccgttagccttggtaacgagacgcagactgcccatactgagctgcggattagcacctcgaatgatactataattagggcggtcctcattttcgctgaagggattttcacaggggagagccacgtagtacatccatccattcacaacctcagctcttctatctgtataccaattgtccctcctaaggatgtgcccgtcgacctgcacctgaaagcttttgtgggatatcgctcaagtacccagttccatgtgtttgaaagtacccgccagctgccccgcttctcaatgtatgcgctgacttccctggatccggcgtccgagccaattagctatgtcaacttcacaattgcggaacgcgctcaacgggtagttgtgtggttgggccagaatttcctgctgcctgaggacacacatattcagaacgctccgtttcaagtttgttttacctcacttcgaaatggagggcacctccatatcaagatcaagctttctggcgagattactatcaatactgatgatattgatctagcaggggacatcatccagtcgatggcatcttttttcgctatcgaggaccttcaggtggaggccgactttcctgtgtattttgaggaactgaggaaagttcttgtaaaggtggatgaataccactcagtccaccaaaagctttcagccgatatggcggatcacagtaatctgatccggagcctgctggtgggggccgaggatgcacggttgatgagggatatgaaaacaatgaaatcccgctatatggagttatatgacctgaatcgggacctgctgaacggctacaagatccgatgcaataatcataccgagctgctggggaatctgaaggccgtgaatcaggccatccagagagcgggccggctgcgcgttggcaagcccaaaaatcaggtgataactgcttgtagggacgcgataagatcaaacaatattaatactctgttcaagattatgagggtcggaaccgcatctagctag

SEQ ID NO: 180181 - DNA, 1560 bp, Artificial Sequence
  Description of Artificial Sequence: Synthetic coding sequence
atggccgaggagcgggtggccacccggacccagttccccgtgagcactgagagccaaaagccgaggcagaaaaaggctcctgagtttcccattctggaaaaacaaaattggcttatccatctacactatattaggaaggactacgaggcttgtaaggccgtcataaaggagcagctacaagagacccagggactttgtgaatacgcaatatatgtgcaggccctgatctttcggctagaaggtaacatccaggagtccttggagttatttcaaacctgcgccgtgctcagcccccagtcggcagacaaccttaagcaggtcgcacgatccctgttcctcctcggcaaacacaaggctgccattgaggtctacaacgaggcagccaaactgaatcagaaggactgggagataagtcataaccttggagtctgctatatttacctgaaacagtttaacaaggcgcaggaccaattgcataacgctctcaatctgaaccggcacgatttaacctacatcatgctgggaaaaatccacctgctggaaggcgatctggataaggcaatcgaagtttacaaaaaggccgtggagttctcgcctgagaatacggagctgctcacgactctcggactcttgtatttgcaattaggcatctatcagaaggcttttgaacatctcgggaacgcccttacctacgatccaactaattataaggccatccttgccgccggttcgatgatgcagactcacggcgactttgacgtggccctgacaaagtaccgcgttgtcgcctgtgccgtgcccgagtcgccccccttgtggaataacatcgggatgtgtttctttggtaaaaagaagtatgtggcagcaatctcatgcctgaaacgggctaactacctggcaccattcgactggaagattctttataatttgggcctcgtccacttaaccatgcagcagtacgcctctgccttccacttcctgagcgctgcgattaattttcaacctaagatgggcgagctgtacatgctcttggccgtcgccctgaccaacttagaggacattgagaatgctaagcgcgcttatgcagaagcagtccatttagataagtgtaacccactggttaatctgaattacgctgtgctgctgtacaatcagggggagaagaaaaatgccttggcccagtaccaggaaatggagaagaaagtgagcctgttgaaagataatagttcgctagaattcgatagtgagatggtggaaatggcccagaagctaggagccgcccttcaggttggggaggcactggtttggaccaaacccgtcaaggacccgaagtcaaagcaccagactacatcaactagtaagcctgcgtcgttccagcagcctcttggttcgaaccaagccctgggccaggctatgagctccgcagcagcctataggaccttaccctctggggctggcggaacaagccagttcacaaaaccccccagcctgcccctggagcctgaacctgcggtggagtcatctccgaccgagacctccgaacagattagagagaaatag

SEQ ID NO: 180182 - DNA, 1584 bp, Artificial Sequence
  Description of Artificial Sequence: Synthetic coding sequence
atggccctgaccgtggtgcccagcttcagcgtgagcggcgtgtggaaacgtactcagtttccggtcagtacagaatcacaaaagcctcgacagaagaaagcccctgaatttcccatcctggaaaaacagaattggctgatccacctacactatattaggaaggattacgaagcgtgtaaggcagtgattaaggaacagctgcaagagacacagggcctctgtgaatacgcgatctacgtgcaggctctgatctttcggctcgagggtaatattcaggagagtctggagcttttccagacctgtgccgtcttgtcccctcagtctgctgacaacttaaagcaggtggccagaagtttattcctccttggtaaacataaagctgccattgaggtgtataacgaggctgcgaaactgaaccagaaagactgggagatctctcacaatctgggggtgtgttatatttacctcaaacaatttaacaaagcccaggaccagctccataatgcgcttaaccttaaccggcatgatctgacatacatcatgctggggaaaatccaccttttggaaggcgatctagataaggccatcgaagtgtacaagaaagctgtcgaatttagccctgaaaacacagaactgctcaccactctgggactgttgtatttgcagctgggtatctaccagaaggcatttgagcatctaggaaacgcgctcacctatgaccccacgaattacaaggccatcctcgccgccgggagcatgatgcagacacacggagactttgacgtggctcttacgaaataccgagtggtggcctgcgccgtccccgaatccccgcctctgtggaacaacatcggtatgtgtttcttcggaaagaagaaatatgtggctgccatcagttgtctcaaacgagcgaattacttagcccccttcgactggaagattctgtacaacctgggcctggtgcacctaactatgcagcagtacgcgtctgcctttcacttcctgtctgccgccataaactttcaacccaaaatgggggaattgtacatgctgctagccgtcgcccttaccaatcttgaggacatcgagaacgccaaaagggcatacgctgaggcggtgcacctggacaaatgtaatccattggtcaatctgaactatgccgttcttctgtataatcaaggggagaagaagaacgctttagcccagtaccaggagatggaaaaaaaagtgtcgctgctgaaggataattcctccctggagttcgatagtgaaatggtggaaatggcccaaaagctgggtgccgccctgcaagtgggagaggccctggtctggaccaaaccggtaaaagatccaaagtctaaacaccagactacctctacgagtaagcccgctagtttccagcagccgctgggttcaaatcaagccctgggccaggccatgagctctgccgccgcatataggactttaccgtcgggagccggcggcacctcacagtttacaaagccgcccagcttgcctctggagccagaaccagcagtcgaatcctcgccaacagagacttccgagcaaataagagagaagtag

SEQ ID NO: 180183 - DNA, 1524 bp, Artificial Sequence
  Description of Artificial Sequence: Synthetic coding sequence
atgatctggaacacccggaacagcacctacatcttcaccgcccccgaatttcctattctggaaaaacaaaactggctgatacacctgcactatatccgaaaagactacgaagcttgcaaggccgtgatcaaggagcaacttcaggagacacagggactttgcgaatatgcaatctatgtgcaggccctgatttttcgcctcgagggaaacattcaagagtccttggagctgtttcagacttgcgctgtcctgtcacctcaatccgcagataacctcaaacaagtggcaagaagtttatttctcttgggcaagcacaaggctgctattgaagtttacaatgaggcagcaaagcttaatcagaaggattgggagatttcacataatctgggggtgtgctatatctacctcaaacagtttaacaaggcccaagatcaactacataacgctctgaatttgaataggcatgacctcacatatattatgttagggaaaatccatctgcttgagggtgatcttgacaaagccatagaagtgtataaaaaggctgttgaattcagtcccgagaacactgagctgcttactactctgggactgctttacctgcagctaggaatttaccagaaggcctttgagcacttaggcaacgctctaacctacgacccgacgaattataaagctatcttggccgcaggaagcatgatgcaaacccatggcgattttgacgtggctctcaccaagtatcgcgtagtggcctgtgccgtgcctgagtcccccccattatggaataatatcggcatgtgcttctttggcaagaagaaatacgtggctgctatttcttgtctcaaacgggcgaattatctggccccattcgactggaagatcttgtacaacctggggctcgtgcatctgacaatgcaacaatacgcctctgctttccatttcctaagtgccgctattaatttccagcctaagatgggggaactctatatgctgctcgcagttgccttaaccaacctcgaggatatcgaaaacgccaaaagagcgtacgccgaggccgtgcacttggacaaatgtaatcctctcgtgaacctgaattacgccgtgctgctctacaatcagggagagaagaagaacgctctggctcagtaccaagagatggagaagaaggtgagcctgttgaaggataacagctctctggaattcgacagcgaaatggtagagatggcccagaaactgggggccgccctccaggtgggggaagcgctggtgtggacgaaaccagtgaaagaccctaagtcgaagcaccaaactactagcacaagtaagcccgcttccttccaacagccactggggagtaaccaggccttgggccaggctatgagttccgctgctgcataccgtacactgccatccggagcgggggggacctcacagtttacaaagcctcctagcctgccacttgagcctgagcctgccgtagagagctcgcctaccgaaaccagcgagcagattagggagaaatag

SEQ ID NO: 180184 - DNA, 1044 bp, Artificial Sequence
  Description of Artificial Sequence: Synthetic coding sequence
atgctgggcaagatccacctgctggagggcgacctggacaaggccattgaagtgtacaagaaggccgtggagtttagccccgagaatactgagcttcttacaactctggggctgctgtacctgcagctaggaatttatcagaaggcctttgaacatctcgggaatgcactaacctatgatcccactaattacaaagctattcttgccgcgggcagcatgatgcagacacatggagatttcgatgtcgcgctcaccaaatatagagtggtggcatgcgcagtgcctgagtccccccccctgtggaataacatcggcatgtgcttcttcgggaaaaagaaatatgtggcagccatctcttgcctgaagcgggctaattaccttgctccgtttgactggaagattctctacaacttgggtttagtccacctcacaatgcagcaatacgcctcagcattccactttctgagcgcggccatcaactttcaacctaaaatgggcgaactgtacatgctgctggccgtggccttaaccaatcttgaggatatagagaatgcaaagagagcctatgccgaagcagttcaccttgataagtgtaacccgctggtcaatctaaattatgctgttctactgtacaaccagggagagaaaaagaacgcacttgcccagtaccaggagatggagaagaaggtcagccttctcaaagataactcgagtctggagttcgactccgaaatggttgagatggcgcagaagctcggtgccgcactgcaggtgggcgaggccttagtctggaccaagccggtgaaagacccaaagtcaaagcatcaaaccaccagcacgtccaagccagcctcttttcaacaacccttgggctcaaaccaggctctggggcaggcaatgtcttcagccgctgcctacagaaccctcccgtcgggcgctgggggtacatctcagttcaccaagccaccttctcttccactggaacctgagccagctgtggaatcgtcacctacggagacttcagaacaaattcgcgaaaaatag

SEQ ID NO: 180185 - DNA, 1026 bp, Artificial Sequence
  Description of Artificial Sequence: Synthetic coding sequence
atgagcgtgctggacgccctgtgggaggaccgggacgtgcggttcgatctgtcggctcaacagatgaagactcggcctggcgaagttctgatcgattgcttggattctatcgaggatactaaagggaacaatggcgatcgtggtcgactgttggttaccaatctgcgaatactctggcactccctggctttatctcgcgtcaacgtgtctgtggggtataattgtatcctaaacatcactaccaggactgccaacagcaagcttagaggccagacggaagccctgtatatcctcacaaagtgtaactcaacccgcttcgagtttatctttaccaacctagtgcccgggtcgcctcggttattcaccagcgttatggctgtacatcgtgcatacgagacctccaaaatgtacagggattttaaattgcgcagtgcccttattcagaacaaacagctgcggctgctcccccaggaacatgtctatgataagatcaatggtgtgtggaatctatccagcgatcagggtaatctggggacattctttattacaaatgtgcgaatcgtgtggcacgctaatatgaacgacagttttaacgttagcatcccctatcttcagattcgctcaattaaaattcgtgacagtaaattcggtctcgctttagtgatcgaatcgtcccagcagagcgggggatatgtgcttggcttcaaaatcgatcctgtcgaaaaactgcaggaaagcgtcaaggagatcaactcgctccacaaagtgtactctgccagtcctatctttggagtagactatgagatggaagagaaaccacaaccattggaagcactaactgtagaacagattcaagacgacgttgagatcgattctgatggacacactgacgcctttgtagcttatttcgcggatggaaataagcagcaggaccgcgaacctgtattctctgaggaactcggactggctatcgagaagcttaaggacgggttcactttacagggtctctgggaggtcatgtcctag

SEQ ID NO: 180186 - DNA, 963 bp, Artificial Sequence
  Description of Artificial Sequence: Synthetic coding sequence
atgagcgtgctggacgccctgtgggaggaccgggacgtgcggttcgatctgagcgcacagcagatgaagacgcggccgggcgaggttctaatcgactgcctggacagcatcgaagatactaaagggaacaacggtgaccggggccggctgcttgtcaccaacttgcggatcctctggcactccctcgccttgtctcgggtcaacgtgtcagttggatacaattgcatcctgaatatcaccacacggaccgccaacagtaagcttaggggccagacggaagcgttgtatattctgacaaaatgcaattcaactagattcgagttcatcttcactaatttggttcctggctctccccggctatttacgtcagttatggcggtgcatcgcgcatatgaaacaagcaagatgtaccgggactttaaactgcggagcgcgctcatacaaaataagcaactacgattgttgcctcaggaacatgtgtacgataaaattaatggcgtgtggaatctctccagtgatcagggcaatcttggcacattttttatcacaaatgtgcgaatcgtatggcacgccaatatgaacgatagctttaacgtgtctatcccctatctgcaaatctctggaggatacgtgctgggcttcaagatcgaccctgtggaaaagctacaggaaagcgttaaggagattaattcattgcacaaggtctacagcgccagccctatcttcggggtcgattacgagatggaggagaagccacagccactggaggccctgactgtggagcagattcaggacgatgtggagattgattctgacggtcatacggatgcgttcgtagcttatttcgcagacggcaataaacagcaggatagagagccggtcttctctgaggaattaggtttggctatagaaaagctcaaagacggctttacactccagggcctgtgggaggtcatgagctag

SEQ ID NO: 180187 - DNA, 1635 bp, Artificial Sequence
  Description of Artificial Sequence: Synthetic coding sequence
atgagcgtgctggacgccctgtgggaggaccgggacgtgcggttcgatctgagtgctcagcagatgaaaaccaggcccggcgaagtactgatagactgtttggacagtattgaggatactaagggcaataacggggaccgagggcgactgttggtgaccaatttgagaatactgtggcattccttggccctatccagggtgaatgtttcagtggggtataattgtatactgaatatcactacaaggactgccaactctaagctgaggggacagacggaagcgctgtacatcctaactaaatgtaacagtacaagatttgagttcatcttcaccaatctggtcccagggtccccacgcctattcacaagtgtgatggccgtccacagggcatacgagacttccaagatgtatcgagatttcaagcttcgctcggctctaatccagaataagcagctcaggctgcttccgcaagaacatgtgtacgataagatcaatggggtatggaacctgtcttctgatcaggggaacttgggtacattctttataacgaacgtgagaatcgtgtggcacgccaacatgaacgattcatttaacgtgagtataccatatctccaaatcagatctatcaaaatccgcgattcaaagttcgggctcgctttggtaatcgaatcaagccagcagtctggcggctacgtcctgggattcaagattgacccagtggaaaagctgcaggagagtgttaaggagatcaactctttgcacaaggtgtactccgccagtcccatcttcggagtcgactatgaaatggaagaaaagcctcagcccctcgaagctcttacagtggagcaaatacaagatgacgtagaaattgacagcgacggccacactgacgccttcgttgcgtactttgctgacgggaacaagctggacagcatcgcttcggaatgggtgggtctgccacctttaccctctgcgaggtgcctctttgggcttggggaggtggatgacaagatctatgttgtggcaggtaaagacctgcagacagaagcgtctctggacagtgtgctctgttatgatcctgtcgccgcaaaatggaacgaggtgaagaagttgccgattaaggtttatggacataacgtgataagccacaagggcatgatatactgcctgggcggtaaaactgatgacaagaagtgcacaaatcgtgtgttcattttcaaccccaagaaaggagattggaaggatttagcgcctatgaagatccccaggtctatgttcggtgtggctgtgcataagggcaagatcgtcatcgcaggtggtgtcacggaggatggactatccgcatcggttgaggcattcgatcttactaccaataagtgggacgtaatgaccgagtttccgcaggagagatcgtcaatctctcttgtgtcactcgccgggagtctctacgctattggagggttcgccatgatccaactggagtcaaaagaatttgctcctactgaggttaacgatatttggaaatacgaagacgataaaaaagaatgggctggaatgctaaaggaaataaggtatgcttccggggccagttgtctggctactagacttaacctgttcaagctcagcaaactttag

SEQ ID NO: 180188 - DNA, 2148 bp, Artificial Sequence
  Description of Artificial Sequence: Synthetic coding sequence
atggacctgatcctgaaccggatggactacctgcaggtgggcgtgacttctcagaaaactatgaagcttatccctgcatcaagacaccgcgctacccaaaaggttgtaatcggggatcacgacggtgtcgtcatgtgcttcggaatgaaaaaaggtgaggccgccgccgtgtttaaaaccctccctggacccaagatcgcccgactggagctgggcggagtgattaacactcctcaggagaaaatctttatcgcagccgcttctgaaatccgaggcttcaccaaacgcggcaaacagtttctgagcttcgagaccaatctcactgagtcaattaaagcaatgcacatatctgggtctgacctctttctgagcgcctcgtatatttataatcactactgcgactgcaaggatcaacactattatttgtcaggagacaagatcaacgacgttatttgcctgcctgtggaacggctcagcaggatcactccagtgctggcttgtcaggatcgcgtgctccgtgtcctgcagggaagtgacgtgatgtatgctgttgaggtccccggaccaccaactgtgctggcactgcataatggcaacggcggagactccggcgaagatctgttgtttggcacatctgatgggaaactggccctgatacagatcaccacttctaaaccggtccggaagtgggagatccagaacgagaaaaaacgaggtggtattctgtgcatcgacagcttcgacatcgtgggggacggcgtaaaggaccttctggtggggcgcgacgatggtatggttgaagtgtattccttcgataacgccaacgagcctgtcctccggttcgaccagatgctcagcgagtcagtcacctcaatacaaggcggttgcgtgggcaaggactcatatgacgagatcgttgtatctacatacagcgggtgggtgaccgggctgactacggagccgatacataaagagtcagggcccggagaagaactgaagataaatcaggaaatgcagaacaagatttcctcactgagaaatgaactcgaacatcttcagtacaaggtgctgcaggaacgagagaattatcaacagtccagccagtccagtaaggcaaagagcgcggtccctagcttcggtatcaatgataagtttaccctcaacaaagacgatgcctcatactcgctgatccttgaggttcaaacggctattgacaacgtgctgattcaatctgacgtgccaatcgacctgctagacgtcgacaaaaacagcgcagtggtctcctttagcagttgcgattccgagagtaacgacaacttcctactggctacttatcggtgccaagccgacactacaaggctggagctgaagattaggagtatcgaagggcagtacggtactctccaggcgtatgttacgcctagaatacagccgaaaacttgtcaggtgcgacaataccatatcaagccactctccctccaccaacggacacatttcatagatcatgatcgtccaatgaacactctcaccctgactgggcagttctcctttgcagaggtccattcctgggtggtcttttgcctccctgaagttcctgagaaacctcctgcaggcgaatgtgtgactttctacttccagaacacttttctggacacccagcttgaaagcacttaccggaagggtgaaggcgttttcaagtctgataatatcagtacaattagtattttgaaggatgtgttatctaaggaagctaccaagcgcaagataaaccttaatatctcatacgaaattaacgaggtctccgtcaaacacacgcttaagctgatacatccaaaactggagtaccagctccttcttgcaaaaaaagtgcagttgatagatgctctgaaggagctgcagattcacgaaggcaacactaatttcctcatcccagaatatcactgcatactggaagaggctgatcacctacaggaagagtacaaaaagcaaccggctcatctggagcgcttatatgggatgattactgacctgtttatagataagtttaaatttaaagggacgaacgtaaagactaaagttccactgctgctggagatcctggacagctacgatcagaatgctctgatctctttttttgatgcagcttag

SEQ ID NO: 180189 - DNA, 2019 bp, Artificial Sequence
  Description of Artificial Sequence: Synthetic coding sequence
atggacctgatcctgaaccggatggactacctgcaggtgggcgtgacatcacagaaaacgatgaaactaattccagcatcccggcacagggccacccagaaggtcgtcattggagatcacgacggtgtggtcatgtgttttggcatgaagaaaggagaagctgctgctgtatttaagaccctgcccggcccaaagatcgcacggctggagctgggcggagtgatcaacacaccacaggagaaaattttcattgcagccgcctctgaaattcgcggttttacaaaacgcggcaaacagtttctaagttttgagactaacctgacagagagcattaaagcaatgcacatcagcgggtcagatcttttcctatctgcgtcatacatctacaatcactattgcgattgtaaggaccaacattattacctgagcggcgacaaaatcaacgatgttatctgtctgccagtcgagcggttgagccggataactcccgtcctcgcctgtcaagacagggtgcttcgagttcttcagggttccgacgtaatgtatgccgtcgaagtgccaggacccccaactgttttggccctgcacaacgggaacgggggggattcgggggaagacctgctgtttgggactagcgacgggaaattagcactgattcagattaccaccagcaaacccgtgaggaagtgggaaattcagaatgagaagaagaggggcggtatcttatgtatagactcttttgatattgtaggagacggcgttaaagatttgttagtgggcagagacgatggcatggttgaggtgtatagctttgataatgccaacgagcctgtgctgcgatttgatcagatgctcagcgagtcagtgacatccattcagggcggctgtgtggggaaagactcttacgatgagattgtcgtcagcacctactccggctgggtgaccggcctcacaacagaaccaattcacaaggaaagtggacctggtgaagagttaaaaattaaccaggagatgcaaaacaaaatatcctctctgcgcaatgagcttgaacacctgcagtataaggttctccaagaacgagaaaactaccagcagtcatcacaatcttctaaggccaaaagtgcggtgccaagcttcggaatcaacgacaagtttacgttgaacaaggacgacgcatcatactcccttattctggaagttcagaccgcaatagacaatgtcctaatccagagtgatgtccccatcgatctactggatgtggataaaaactctgctgtggtgtcatttagctcctgcgatagcgagagcaatgacaattttttgcttgctacctacagatgtcaagctgataccaccaggcttgagctaaagatacgctcaattgaagggcagtacggaacgcttcaggcttacgtgacaccaagaatccaaccaaaaacctgccaagtaagacagtaccatataaaacccctgtccttgcaccagcgaacacactttattgaccacgaccgaccaatgaataccctgacacttaccggacaattttctttcgctgaagtgcactcttgggtcgttttctgcctgccggaggttccagagaagccgccagcgggggaatgtgtgactttttattttcagaatactttcctcgacacgcaactggagagtacttaccgcaaaggtgagggagtgttcaaatctgataacattagcactatcagcatacttaaagatgttttgtctaaggaagcaacaaagagaaaaatcaacctaaatatttcttacgaaattaacgaggtgtcagttaaacacaccctgaaactcatccatcccaagctggagtaccagctgctactggcaaagaaagtgcagctcatcgatgccctcaaggagctgcagattcatgaaggcaataccaatttcctgattccagaataccactgcatactcgaggaggcggatcacctgcaggaagaatataagaaacaacctgcccatttggaaagactctatggctag

SEQ ID NO: 180190 - DNA, 417 bp, Artificial Sequence
  Description of Artificial Sequence: Synthetic coding sequence
gacgtgctgagcaaggaggccaccaagcggaagatcaacctgaacatcagctatgaaattaacgaagtgtcagttaagcatactctgaagctgattcaccccaaactggaatatcagctgctgcttgctaagaaggtgcagctgattgacgccctcaaagagctgcagatacatgaaggcaacaccaattttctgatccccgagtatcactgcatactcgaagaggctgatcacctgcaagaggagtataaaaaacagcctgcccacttggaaaggctttacggcatgataactgatctgttcatcgacaaatttaagttcaagggcactaatgtgaagacaaaagtgcctctgctactcgaaatcctggacagctacgaccagaacgctctaatctccttcttcgacgctgcatag

SEQ ID NO: 180191 - DNA, 2664 bp, Artificial Sequence
  Description of Artificial Sequence: Synthetic coding sequence
atgagcctgttcaaggcccgggactggtggagcaccatcctgggcgacaaagaggagtttgatcaagggtgcctgtgtctggctaatgtggataactccggaaacggtcaagataagatcatagtaggctccttcatggggtaccttcggattttttccccacatcctgccaagactggagacggcgctcaggctgaggatctcctactggaggtggacctgcgagacccagtcttgcaggtagaagtgggaaagttcgtgtccgggactgaaatgctgcatctcgccgtcctccattcacgtaagttatgcgtgtactcagttagcgggacattgggcaatgtggaacacggaaaccagtgccaaatgaagttgatgtatgagcataatttgcaacgtacagcttgcaatatgacatacggctcctttggcggcgtgaaggggcgcgatctcatctgtattcagtccatggacggaatgctaatggtgtttgaacaggagagctacgctttcggcaggttcctccccggcttcctcttaccaggcccactcgcctactcttccaggacggactcattcctaactgtgtcatcatgccagcaggtggagtcctacaagtatcaggtgttggcctttgctacagacgccgataaacgccaagagacagaacagcaaaaactggggtccggaaaaagactcgtcgttgattggaccctgaacattggtgaacaggctctggatatttgtatagtgagcttcaatcagagcgccagctctgtcttcgtgttgggtgagcggaacttcttctgcctgaaggataacgggcaaatccgcttcatgaaaaagctagactggtctccttcgtgcttcctaccctattgtagcgtctctgaaggaaccattaataccctaatcggcaaccacaataacatgttacatatttatcaggacgtcaccttgaagtgggccactcagttacctcacatacctgtggcagtgcgggttggctgtctgcacgatctgaagggagtgattgtgacgctttccgatgatggccacctacaatgcagctaccttggaacagatccatccctgttccaagcgcccaatgtgcaatcacgggaactcaactacgatgaacttgatgtcgagatgaaagaattacagaaaatcataaaagacgtgaacaagtcccagggcgtgtggccaatgacagagcgggaggatgatctgaatgtctcagttgtggtgtcgcccaacttcgactctgtctctcaagccaccgacgtcgaggtgggaactgaccttgtcccatcagtaacagtgaaggttaccctgcagaatcgtgtaatcctacagaaggctaagttatcggtttacgtccagccccccctagagttgacttgcgaccaatttacattcgagttcatgaccccagacctcactcggacggtgtccttctcggtgtacctgaaacgtagctataccccgtcggagctcgaagggaatgctgtggtgagctactcaagaccaactgacaggaacccagatggtattccccgggtaattcaatgcaagtttcgtttacctctgaagctcatttgcctgcctggccagcctagcaaaacagccagccacaaaataactattgacaccaacaagtcccctgttagcctgctgtcactgtttcccggattcgctagtcaatctgacgacgaccaggtcaatgtgatgggatttcactttctgggtggtgccagaatcacggtcttggcgagcaagactagccaaaggtacagaattcaaagcgagcagtttgaggatctctggctgatcaccaatgaattaatactgagactccaggagtacttcgagaagcaaggggtgaaggacttcgcatgctcgtttagcggctcgataccgctgcaagaatacttcgaactgatcgaccatcactttgagctgcgaatcaacggcgagaaactagaagagctgctctccgagagggcagtacagttccgggcaatccagcgccgactactggcacggttcaaagacaagacacctgcaccactgcaacatcttgatacacttctggacggcacttacaagcaggtgatagccctagctgatgcagtggaagagaaccagggcaacctctttcagtcttttacacggctcaagagtgccacccatctggtgattcttttaatagctctttggcagaaattgtcagctgatcaggtagctatactcgaagccgcctttctgccactgcaggaggatacgcaagagctcgggtgggaggagactgtcgacgcagctatctcccacctgctgaaaacttgtctgtcaaagtcgagcaaggaacaggcattgaatcttaatagccagctcaatattccgaaggacacaagtcaactgaaaaaacacatcactctgctctgtgacagactgtcaaagggcggacgtctgtgtctcagcacagatgccgctgctccccaaacaatggtgatgcccggcggctgcacaaccattcctgagagcgacctggaggagcggtcagtggagcaagactctacggagctgttcacaaaccaccgacatctcaccgccgagactccccggcccgaggtctcaccactgcaaggcgtctccgagtag

SEQ ID NO: 180192 - DNA, 2544 bp, Artificial Sequence
  Description of Artificial Sequence: Synthetic coding sequence
atgagcctgttcaaggcccgggactggtggagcaccatcctgggcgataaagaggaattcgatcagggatgcctgtgtcttgcaaatgtagacaactcaggtaacgggcaagacaagattatcgtcggatctttcatgggctacctccgaatattttcccctcacccagctaaaaccggagatggtgctcaggctgaggacctcctactggaagtcgaccttagagatcctgtcttgcaggtggaagtaggaaagttcgtctccggaacggaaatgctgcatctcgcggtcctgcactccaggaagctgtgcgtgtactctgtgtcgggaactctcggaaatgtggaacacggcaatcaatgccagatgaagctgatgtatgagcacaatctccaaaggactgcatgcaacatgacctacggttcatttggtggtgtcaagggccgagatctcatttgtatccagtcgatggacggaatgctcatggtgtttgaacaagagagctatgcatttggacgattcttacctggctttttactccccggacctctggcctatagcagccgtacagattcttttctcactgtttcctcctgccagcaggtggaaagttataaataccaagtgctggcattcgccacagatgcggacaaaagacaagaaacagagcagcagaaactcggctccgggaagcgcctggttgtggactggaccttgaacattggcgagcaggccctggacatttgtatcgtttcattcaatcagtccgcctcttccgtcttcgtactgggggaacgcaactttttctgcctgaaagataatggacaaatccggtttatgaagaaactcgattggtctccttcctgtttccttccatattgtagcgtgtctgagggaaccatcaacactctgattgggaatcacaacaatatgttgcacatctatcaagatgtgacactaaaatgggctacacagctgccccatatccctgtggccgttagagtcggctgtctccacgatctgaaaggcgtgattgtgaccttgtccgacgatgggcaccttcaatgttcgtacctcgggacggaccctagcctcttccaagcgccaaacgtgcagagcagggaacttaactatgacgagctcgatgttgagatgaaggagctacagaagattatcaaggacgttaataagagtcaaggtgtgtggcctatgactgaaagagaggatgacctgaacgtcagcgtcgtggtctctccgaactttgattctgtttcccaggcaacggatgttgaggtgggcaccgatcttgtgccatcagtgacagtgaaagtgactctacagaaccgcgttatcctccagaaggctaagctcagcgtttatgtgcagccaccgcttgaattgacatgtgatcagttcacatttgaattcatgtcaattccccgcgtcattcagtgcaagttccggctgcctcttaaacttatttgcctccctggccagcccagcaagactgcatcccataagattacgatcgatactaacaaatctcctgtctccctcctctccctcttccctggcttcgcttcacagtcagatgacgaccaggtcaacgtgatgggcttccattttttaggaggcgcacgaatcaccgttctagcctcgaagacatcccagcgctatcgtattcagtccgagcagtttgaagacttatggctcattactaatgaactgatcctccgattacaggaatatttcgaaaagcagggtgttaaagatttcgcatgctctttttccggctctataccgctccaagagtacttcgaactaatcgaccaccatttcgagctaagaataaacggagaaaagctagaggagctgctgtctgagcgggcagttcagttcagagccattcaaagacggttgctggccaggtttaaagataagacaccggccccgcttcaacacctggataccttactagacggcacttacaagcaagtgatagcgcttgcggatgcagtcgaagaaaatcaaggcaatctctttcagagttttacaaggctgaagtctgcaacacatttagtgatcttgctcatcgctctctggcagaaacttagtgctgatcaggtggctattctggaagcagcattcctgcccctccaagaggacactcaggagcttggatgggaagagacagtggacgccgccatcagtcacttgctgaagacttgtctgagcaagagctctaaggagcaggcgcttaacttgaacagtcagcttaacatccctaaggatacaagtcaactgaagaagcatatcacactgctgtgcgatcgcctctccaaagggggtcgcttgtgcctgagcaccgatgcagctgcgccacaaaccatggtgatgccaggggggtgtacaacaattccagaatcggatttggaggagagaagcgtggaacaggacagcaccgaactgtttaccaaccatagacatctgacggctgagactcccagaccggaagtaagtccgctacaaggggtgagtgagtag

SEQ ID NO: 180193 - DNA, 2559 bp, Artificial Sequence
  Description of Artificial Sequence: Synthetic coding sequence
atgagcctgttcaaggcccgggactggtggagcaccatcctgggcgataaagaggagttcgaccaaggatgcctgtgcttggcgaatgtggacaatagtggaaacggacaagataaaattatcgtaggctctttcatgggatacctgcgtattttttccccacacccagctaaaacgggggatggtgcccaagccgaagacctcctgctggaggtcgatcttagggaccccgtgctccaggttgaggttggcaagttcgtctccggcactgaaatgttgcacttagccgtactccacagtcgaaagctgtgtgtgtactcggtttctgggacactgggcaatgtcgaacatggcaaccagtgccagatgaagctaatgtatgagcataatctgcagagaactgcatgtaacatgacgtatgggagtttcggaggagtcaagggcagggatctcatatgcatccaaagcatggatggtatgctcatggtgtttgagcaggagtcctacgcgttcgggagatttctgccgggcttcctgctccctggacctctggcatactcttccagaaccgactcttttttgaccgtcagctcttgccagcaagtggagtcctataagtaccaggtgctggcttttgccactgacgccgataagcgtcaggagactgagcagcaaaaactggggagtggtaagaggctggtggtcgattggacgctgaacatcggggagcaggctctggatatatgtatagtttcatttaatcagtctgcctcatccgtattcgtgttgggcgagcgaaattttttttgtctgaaggataacggacagataaggttcatgaaaaaactcgattggtcacctagctgttttctgccctactgtagtgtcagcgagggtaccattaacacacttatcggtaatcacaataacatgctgcacatttatcaggacgttaccctcaaatgggcaacgcagttaccccatatacctgtggcggtgcgagtaggctgtctccatgacctcaagggggtgatcgttacactgagcgacgacgggcacctgcagtgttcctatctggggacagatccctctctgttccaggcccctaatgtgcagtctagagaacttaactacgacgaactggatgtggaaatgaaggagcttcaaaaaataatcaaagacgtgaataaatcccagggcgtgtggccaatgacggagagggaggacgatctgaacgtgtcggtagttgtcagcccgaattttgacagtgtgagccaggctacggatgttgaagtgggtactgacctcgtgccttccgtcactgtaaaggtaaccctgcagaatagagtgatcctgcaaaaagcaaagctcagcgtttacgtgcagcctcccctagagcttacatgtgaccagttcacatttgagtttatgtccttgaatgttcttggaatccctcgagtgattcaatgtaaattcagactgccacttaagctcatctgcctacccggtcaaccttccaagacggcctctcacaaaatcaccattgacaccaacaaaagcccagtgtcacttttaagccttttccccggatttgcatcacagagcgatgatgaccaggtgaacgtaatgggcttccacttcttagggggcgcacgcattacagttctggcatctaagactagtcagcgataccgcattcaaagcgaacagttcgaagatctttggctcattacaaatgagctgatactacggttgcaagagtatttcgagaagcagggggtcaaggacttcgcttgctcgtttagtgggtcgatacctttgcaggaatatttcgagctgatcgatcatcatttcgaactgaggatcaatggcgagaaactagaggagcttctctctgagagggccgtgcaattccgggctatccagcgtcggctgcttgctcgattcaaggacaagacccctgcacccctccagcacctggacactctgctggacgggacctacaagcaggtgattgccctggccgacgccgtggaggaaaatcaaggaaacctctttcagtctttcacaaggcttaaaagcgccacccacttggtcattctccttatcgccctctggcagaagctcagcgcggatcaagtagccatcctggaagctgccttcttgccactccaggaggacacccaggagttgggatgggaagagactgtcgatgcagcgattagtcacctgttgaagacttgcctctccaagagtagtaaagaacaggcactaaatttgaattcacaactgaatatccccaaagatactagccaactgaagaagcatatcacccttctgtgtgaccggctatctaaaggcgggcggctatgcttgtctacagacgccgcagcacctcagacgatggtaatgcctggggggtgcactacaattcccgaatcagaccttgaagaacggtcggtggagcaggactccaccgaattgttcacaaaccatcggcatctgaccgcggaaacaccgcgcccagaggtctcaccgcttcaaggggtcagcgaatag

SEQ ID NO: 180194 - DNA, 2649 bp, Artificial Sequence
  Description of Artificial Sequence: Synthetic coding sequence
atgagcctgttcaaggcccgggactggtggagcaccatcctgggcgacaaggaagagttcgatcagggatgtctctgccttgccaacgtagataactccggcaacggccaagacaagattattgtggggtcctttatgggatatctgagaattttctcacctcatcctgccaagactggcgacggcgctcaggctgaagatctgctcctggaggtcgatctgcgggacccggtgctgcaggtagaagtgggtaagttcgtttccggcactgagatgctgcatctggccgtcctacacagtcgtaagctctgtgtctattccgtttccgggaccttggggaatgtcgaacacggtaaccaatgccagatgaagctgatgtatgaacacaatctccagcgcaccgcttgtaatatgacatatgggagctttgggggggtgaagggaagggacttgatatgcatccagtcaatggatggcatgctgatggttttcgagcaggaaagttacgcctttggccggttcctgcccggtttcctgctgccggggccattagcctattcaagccgaaccgactctttcctgacagtgagctcgtgccagcaggttgaaagctacaagtatcaggttctggccttcgcgactgacgctgataagcgccaggaaaccgagcagcagaaactcggatctgggaaacgcttggtagtggattggacacttaatattggggagcaggccctggacatctgtatcgtaagcttcaaccagagcgcctctagcgtctttgtcctgggcgaaaggaattttttttgcttgaaggacaatggacaaatccggtttatgaagaagctcgattggtcccccagttgctttctgccctattgcagcgtcagcgagggcacaatcaacaccctgattggtaaccacaacaatatgcttcacatttaccaagatgtcacgcttaagtgggcgacccagctgccccacatcccggtggcagtgcgcgttggatgcctgcacgacctgaagggagtgattgtcacactctcggatgatggccatttacagtgttcctatctgggaaccgatcccagcctgtttcaagctcccaatgtccaaagcagggaactaaactatgatgaactggatgtggagatgaaagagttacagaaaataatcaaagatgtgaacaagagtcaaggggtttggccaatgaccgagcgcgaagacgacctgaatgtctcagtcgtggtctcgcccaatttcgacagcgtctctcaggccacagatgtagaagtggggactgacctagtcccgagcgttaccgtcaaagtgacactacagaatagggtgatcctacaaaaggcaaagctaagtgtgtatgtgcaaccccccctggagctgacgtgtgaccaattcaccttcgagtttatgacccccgatttgactagaacggtcagtttctccgtttatctgaagagatcatatacccctagcgagctggaaggaaacgctgtggtgtcgtacagtagacctacggggatacctcgggtaattcagtgcaagttccgcttgccccttaagctaatctgtctccccggccagcctagcaaaaccgcaagccacaagatcaccatcgatactaacaagagtcccgtgtcactcctttcactgttcccagggtttgcgagtcaatccgacgacgatcaagtgaacgtcatgggatttcatttcctcgggggcgcaagaataactgtccttgcttcaaagacatctcagcgatacaggatacagtctgaacagttcgaagacctgtggctgatcaccaatgaattgatactaagactgcaggagtactttgaaaagcagggcgttaaggattttgcctgctccttttcaggatcaattcccctacaggagtattttgagttgatcgaccatcactttgaactgaggataaatggcgagaaattggaggagcttctttccgaaagagccgtgcaattcagagccatccagcgacggttactggctcggtttaaggataaaacaccggctccacttcagcatttagacaccttattagacggcacttacaaacaggtgattgctctcgcagacgcagtcgaagagaatcagggcaatctgttccaaagctttacccgcttgaaaagcgctactcacctagtgatcttacttattgccctgtggcagaaactctcggcggatcaggtggctatactcgaggccgctttcctgcctctgcaggaggatacgcaggagctcggatgggaggagacagtggacgccgccataagtcatctactcaagacatgcctgtccaagtcttccaaggagcaagccctcaatctgaatagccaactgaacatccctaaagatacctctcagttgaaaaagcatataacattgctctgtgatcggctgagcaagggtggtcgactgtgtctctcaaccgatgctgctgccccgcaaaccatggtgatgcctggcggctgcaccacgatccccgagagcgacttggaagagaggtctgttgagcaggactctacagagctattcacaaatcaccggcacctgaccgctgagacaccacgcccagaagtgtctcctcttcagggtgtgtcagagtag

SEQ ID NO: 180195 - DNA, 1446 bp, Artificial Sequence
  Description of Artificial Sequence: Synthetic coding sequence
atgagcctgttcaaggcccgggactggtggagcaccatcctgggcgacaaagaggaattcgatcaaggctgcctgtgccttgcaaacgtggacaactctggcaacgggcaagataagatcattgtgggcagctttatggggtacttgcggatctttagcccccatcctgccaaaactggcgatggggcgcaggctgaggacctgcttctggaagttgatcttcgcgatccagttctgcaggtggaagtggggaaattcgtgtccggaactgagatgctccacttggccgttttgcactcccgcaagctctgtgtgtattccgtgtcaggtacactgggcaatgtggagcatggtaaccagtgtcagatgaagctgatgtatgaacacaacctccaaaggactgcctgtaacatgacttacggcagttttggcggggttaagggcagggatttgatttgtattcaatctatggacggtatgctgatggtgttcgagcaagagtcttatgcttttggcaggtttctgccagggtttctcctgccgggccctctcgcatactcaagcaggactgattccttcttgaccgtatcgtcctgtcagcaagtggagtcgtacaaataccaggtcctcgcctttgccacggacgcagataaaaggcaggaaacggaacagcagaaactgggctccggcaaaaggctggttgtcgactggactctgaatattggggagcaggccttggacatctgtatcgtgtcttttaaccagagcgcctcttcagtttttgtcctgggggagaggaacttcttctgtctgaaggacaacggccaaatcaggtttatgaaaaagttagactggtccccaagttgctttctcccttactgctccgtgtccgagggcactataaacactctaattgggaaccataacaatatgcttcacatctaccaggatgtgactctgaaatgggctacccagctgccacacatcccagtcgccgtccgagtgggatgtctgcacgatctgaagggtgtcattgtcaccttgtccgacgacggacacctccagtgcagttacctggggaccgacccatcattgttccaggcgcccaacgttcagtctcgagaactgaactacgacgagctcgatgtcgagatgaaagagcttcagaagattatcaaagacgtcaacaaatcgcaaggcgtatggccaatgacagaaagggaggacgatctgaacgtcagtgtcgtcgtctctccaaatttcgactcagtctctcaagccacagatgttgaggtaggaacggaccttgtacccagtgtgaccgtgaaagtgacacttcagaacagagttatactgcagaaggctaaactcagtgtctacgtgcagcctccccttgagctgacgtgtgaccagttcactttcgagtttatgaactttcctagttag

SEQ ID NO: 180196 - DNA, 2559 bp, Artificial Sequence
  Description of Artificial Sequence: Synthetic coding sequence
atgagcctgttcaaggcccgggactggtggagcaccatcctgggcgataaagaagaattcgaccagggctgtctctgtctcgcaaacgttgacaattccgggaatggccaagataaaattatcgtgggctcctttatgggctatctaagaattttttctccacatccagcgaaaaccggagatggcgctcaagctgaagatcttctattggaagttgatctacgtgacccagtcctccaggtcgaggttggcaagttcgtctctggaaccgagatgctccatttggcggtgttgcactcgaggaaattgtgtgtgtatagcgtctcgggcacattggggaatgttgagcacgggaatcagtgtcaaatgaaacttatgtacgaacataaccttcagaggaccgcctgcaatatgacctacggctcctttggcggggtcaaaggtcgggacctgatctgtatccaaagcatggatggaatgctgatggtctttgaacaagagtcctatgccttcggccgattcttgcctggcttccttctgcctggccccctagcatatagcagtaggactgattcatttctcaccgtgtcatcatgtcagcaggtcgagtcctacaagtaccaggtgctagccttcgcaacagatgcagataagcgtcaggagacggagcaacaaaaactgggatccggaaagagactcgtggtggattggacgctgaatatcggagagcaggccttggacatctgtatagtgtcctttaatcagtcggcctctagcgtattcgtcttaggggagaggaactttttttgtctgaaggataacgggcagatccgcttcatgaagaaactcgactggtccccatcgtgctttctgccgtactgctctgttagcgaaggtaccatcaacacccttatcgggaaccataataacatgcttcatatctatcaggacgtgaccctcaaatgggctacacagttaccccatatacctgtagccgttcgggtgggctgcctccacgatctaaagggcgtgatcgtaaccttatcggacgacggtcatctccaatgctcctacctgggcacagacccatccctctttcaggccccaaatgttcaatctcgcgagctgaactacgatgagttagatgtcgagatgaaggagttgcaaaaaatcatcaaagacgtgaacaaatcacagggagtctggccaatgaccgagcgagaggatgatttgaacgtgtctgtcgtggtgtctccaaatttcgacagcgtttcccaggcaactgatgtcgaagtgggtaccgacctcgtgccttcggtcactgttaaggtgacactccagaaccgggtgatcttacagaaggcaaaattgtctgtctacgtccagccacctttagaactgacttgcgatcaatttactttcgaatttatgaacaggaatcctgacggtataccgagagttatacagtgtaagttccgtctgccactcaaactgatctgtcttccaggccagccaagcaaaaccgcttcccataaaatcacaatagacacaaacaagagtcccgtcagcttgttgagcctgttccccgggttcgcctctcaatcagatgacgatcaggtcaatgtgatgggcttccactttctggggggcgcgagaatcaccgtgctggcaagtaagacgagtcagcgctacaggatacagtcggagcagttcgaggatttgtggcttatcaccaatgaattgatcctgagactgcaggagtatttcgagaaacaaggagtcaaagacttcgcttgcagcttctccggatcgatcccactgcaggagtacttcgagctgattgaccaccactttgaattgcgcattaatggggaaaaactcgaggaactgctgtccgagcgagctgtgcagttcagggccatacagagacgccttctagcaagatttaaggacaaaactcccgcgccccttcaacatttggatacactgcttgatggaacgtataaacaggtaattgccctggccgacgccgtcgaagagaaccagggcaatctatttcaatctttcactaggttgaagtcagcgacacatcttgtgatcctgctcatcgctctttggcagaaactgagcgctgaccaggtagctattctcgaggctgcatttctgcccctccaagaggacacccaagaactggggtgggaggaaaccgtggacgctgcaataagtcacctccttaaaacttgcctctccaagtccagtaaggaacaggcgcttaatttgaactctcagctcaacattccaaaggatactagtcagctcaagaaacacatcacattactttgtgataggctgtcaaagggcggaagactgtgcctttccaccgatgctgccgcgccccagacgatggtgatgccgggaggatgcacgacaatccctgaatctgatctggaagagcgatccgtggaacaggactctacggagttgtttaccaaccataggcacctcacagctgagactccccggcctgaggtttctcccctacagggagtttcagagtag

SEQ ID NO: 180197 - DNA, 2664 bp, Artificial Sequence
  Description of Artificial Sequence: Synthetic coding sequence
atgagcctgttcaaggcccgggactggtggagcaccatcctgggcgataaagaagagttcgatcagggctgtttgtgcctagcaaatgtggataattcaggcaacggccaggataagataatcgtgggctcctttatggggtatctaaggattttctcccctcaccccgccaagacaggagatggcgcccaagcagaggaccttctgcttgaggtggatctgcgggatccagtcctgcaggtggaagtaggaaagtttgtctccgggacagagatgctgcatctggccgtgcttcactcgcgaaagctgtgtgtatattcggtttccggcacacttggcaatgttgaacatggcaaccagtgccaaatgaaactgatgtatgagcacaatctgcagcgcacggcctgcaacatgacctacggatctttcggcggcgtgaaaggccgggacctgatctgcatacagtctatggatgggatgctcatggtcttcgaacaggaaagttacgccttcggcagatttttgcctggatttctgctgcccggccccttggcttatagcagccggacggattctttcttaaccgtgtccagttgccagcaagtggaaagctataagtaccaggtgctggcctttgcaacagatgcagataagcgtcaggagaccgagcaacagaagcttggcagcggtaaacggctggtcgttgactggacccttaacataggagaacaggccctcgatatctgtatcgtttcctttaatcagtccgcttcatctgtgtttgtccttggagaacgtaatttcttctgccttaaggataacggccagatccggtttatgaagaagctggattggtcaccaagctgcttcctaccatactgtagtgtctccgagggaaccattaacaccctgatcgggaaccataacaacatgctccacatttaccaggatgtgactttaaaatgggcaactcagctcccccacattccggtggcagtacgcgtgggctgtctccacgaccttaagggcgttatagtaacactcagcgatgatggtcatctgcagtgtagttatcttggaaccgatccaagtctattccaagcccctaacgtgcagtcgcgggagctaaattacgatgaactcgatgtcgagatgaaggaactgcaaaagatcatcaaagacgtgaataaatctcaaggtgtatggccaatgacagagcgggaggatgatcttaacgtgagcgtggtggtctcacctaacttcgactctgtcagtcaagcgaccgacgtagaggttggaacagacctggtgccctcagtgaccgtgaaagtaactctccagaaccgcgtgatccttcagaaggctaagctcagcgtctacgttcagcctccattggagttgacctgcgaccagttcacctttgagttcatgaccccagatctgaccagaaccgttagtttttccgtttacctcaagagatcttatactccctccgaactggagggaaatgccgttgtgtcctattcccgaccaactgttcagaacagtctgggtattccgcgggtgattcagtgcaaatttagactgccccttaagttgatctgtctaccaggtcaacctagtaagacagccagccataaaatcaccatagacacgaacaaaagtccagtatctctgctctctctgtttccagggttcgcttctcaaagcgacgacgatcaggttaatgtgatgggtttccactttctgggcggcgcccgaataactgtgctggcatccaagacatcccagcgttataggatccagtctgaacaattcgaagatttatggctgatcacaaacgagttgatacttagattgcaggagtatttcgaaaagcaaggcgtgaaagatttcgcgtgcagcttttccggtagcatccctttgcaagagtattttgagctgattgatcatcattttgaactcaggattaacggggaaaaactggaggaattgctctctgagagggccgtgcagttccgtgctatccagagaaggcttctcgctaggtttaaagataaaaccccagctccccttcagcacctggacactctgctggatggcacctataaacaggtgattgccctggccgacgccgtggaggaaaaccagggcaacctcttccagtcctttacccggctcaagagtgcaacccatcttgtcattctgctcatcgccctgtggcagaaactctccgccgaccaggtagccattctggaagcagcctttctgccattacaggaagatacccaggaattgggctgggaagaaacagtggacgcagccataagccatctgcttaagacttgcctcagtaagtccagcaaagagcaagcgctgaacctgaactcccaattgaatatccctaaggatacctcacaacttaaaaagcacattactttgctctgtgatcggctgtctaagggggggcgattatgcctgagtactgatgccgccgcacctcaaacaatggtgatgccagggggatgcactacaatacccgaaagtgacctggaggagcgaagcgttgagcaggactccaccgagctgtttacaaaccacaggcaccttaccgcagaaaccccgcgcccggaggtgagtcccctccagggcgtttccgagtag

SEQ ID NO: 180198 - DNA, 933 bp, Artificial Sequence
  Description of Artificial Sequence: Synthetic coding sequence
atgggctacctgcggatcttcagcccccaccccgccaagaccggcgacggggcccaggccgaggatttgttgctggaagtggatctccgagatcctgtgctccaagtggaggtagggaagttcgtgtccggcaccgagatgctgcatctggccgtgttacactcccgcaaattgtgcgtgtacagtgtcagcgggaccctcggtaacgtcgaacatggtaatcagtgtcagatgaagctcatgtacgagcacaacctgcagagaaccgcttgtaatatgacctacggaagctttggcggagtaaagggccgcgacctgatctgcattcagagtatggacggtatgcttatggtcttcgaacaggaatcatacgctttcggccgctttctgcccggattcttactcccaggtcccctcgcgtatagttcccggacagacagtttcctgactgtgtcctcttgtcagcaggttgagagctataagtatcaggtgctggcatttgccacagatgcagacaaaagacaggagacagagcaacagaaactgggttcaggcaagcgcctggtcgtcgattggacactcaacataggagagcaagccctcgatatctgcatcgtgtccttcaaccagtccgccagctccgtgtttgtactgggggagcgaaattttttctgcctgaaggataatggacagattcgattcatgaagaagttggactggtcacccagctgtttcctcccttactgcagcgtatcggaaggcaccattaatacccttattggcaatcacaataacatgctgcacatctatcaggatgttaccctgaagtgggcaacccagctaccgcatatccctgtggcagtcagagttggttgcttgcagttctcgctgtggaagcacctgctccccaggagttcaacacttgagaaatag

SEQ ID NO: 180199 - DNA, 294 bp, Artificial Sequence
  Description of Artificial Sequence: Synthetic coding sequence
atgagcctgttcaaggcccgggactggtggagcaccatcctgggcgataaagaagaatttgaccagggatgcctgtgcctcgcaaatgtggataattctggcaatggacaggacaaaatcattgtgggatcttttatgggttacctcagaatctttagcccacaccccgccaaaactggagacggcgcccaggcggaggacctgctgctggaggttgacctccgggatcctgttctgcaggtggaggtagggaagttcgtgagtggcaccgagatgctccacttggctgtttag

SEQ ID NO: 180200 - DNA, 1365 bp, Artificial Sequence
  Description of Artificial Sequence: Synthetic coding sequence
tgagacctggtgcccagcgtgaccgtgaaggtgaccctgcagaaccgcgttatcctgcaaaaggccaagctatccgtgtatgtgcagcctcctctggaactaacctgtgatcagttcacttttgagtttatgactcccgatctcacacggacagtcagtttcagcgtgtatctgaagaggtcttacacaccaagtgagctggagggtaacgcggttgtctcctacagccgccctactgaccgcaaccccgatggcatcccaagggttatccaatgtaagtttcggttgccactaaaacttatttgcctgcctggccagcccagtaagactgcatcccacaagattaccattgacacgaacaaatctccagtaagtctgctgagtctttttcccggctttgcgtcgcagtcagacgacgatcaggtgaatgtcatgggctttcattttctaggtggagctcgcattaccgtgcttgccagcaagacgtcccagaggtaccgcattcaatcggagcaatttgaagacctgtggctcataacaaatgagttgatcctcaggttacaggagtacttcgagaagcagggggtgaaagacttcgcctgcagctttagtggaagcatccccctgcaggaatactttgagttgatcgaccatcactttgaactcaggatcaacggcgagaagttagaagagctcctcagcgagagggctgtgcagtttcgagccatacagagacgactactcgcccgatttaaagacaaaacgcctgccccactgcagcatctggatacattgttggacggcacctacaagcaagttatagccctggccgacgctgtagaggagaatcagggtaacttattccagagcttcaccaggttaaagtccgccacccacttagtgatcctgctgatcgcgctctggcaaaagctcagcgccgaccaggttgccattctcgaggccgcgttcctgccactgcaggaggatacacaggaattgggatgggaggagacagtggatgccgccatctcccacctgctcaagacctgcctcagcaaaagcagcaaggaacaggcactgaacctgaacagtcagctgaacatcccaaaagacacatctcagctgaaaaaacacattacccttctgtgcgatcgcctctctaagggcggccgactgtgtctgtctacagatgcggcagccccacaaacaatggttatgcctggaggatgcaccaccatccccgaatccgacctggaagaacggtccgtggaacaagacagtacagaactgttcactaaccacaggcacctgactgccgaaactcctagacccggcaagcggctcgatgggctgcacaaaaggtag

SEQ ID NO: 180201 - DNA, 1227 bp, Artificial Sequence
  Description of Artificial Sequence: Synthetic coding sequence
atgaagctgatgtacgagcacaacctgcagcggaccgcctgcaacatgacctatggctcctttggcggggtcaaaggaagagacctgatttgcatccaatccatggatgggatgctgatggtgtttgagcaggagtcctatgcctttggccgctttctgcctggatttctcctgcccgggcctctcgcgtactcctcccgaacagactcattcctcacagtcagctcttgccagcaggtagagagctacaagtaccaagtgctcgcattcgccacggacgctgataaacggcaagaaacagaacagcaaaaactagggtcaggcaagcgcctggtcgtggactggactttgaacataggcgagcaggcactggacatctgcatagtaagcttcaaccagtcagcaagtagtgttttcgttctcggcgaacgcaactttttctgtttaaaagataatggacagataaggttcatgaaaaaactggattggtcaccttcctgcttcctgccctattgtagcgtgagtgagggcaccattaataccctgattgggaaccacaataatatgctccacatttatcaagacgttacactgaaatgggcgactcaacttcctcacatccccgttgctgtgcgcgtaggctgtctgcacgacctgaagggtgtgatagtgactctatccgatgacggccacttacagtgctcttacttagggactgacccatccctgttccaggccccgaatgtccagtccagagagcttaactatgacgagctcgacgttgagatgaaagaattgcagaaaatcattaaagacgtcaacaagtcgcagggggtgtggcccatgaccgagcgtgaggacgatctcaacgtttccgtggtggtgtcgccaaatttcgattccgtgtctcaggccaccgatgttgaggtcggcactgacctagtcccatccgttaccgtcaaggtcactctacagaatagagtgatccttcaaaaagctaaattgtctgtgtacgttcagccaccccttgagctgacatgtgatcaattcacctttgagtttatgacacctgatttaacccgcaccgtgtccttcagcgtgtatctgaagaggtctatccatcatcagaattggaaggagatgcttttgttcctgatcccagaccagcagatagaaatcttgatggctttccgggagctgtcaaacgtcaatctggactttccctag

SEQ ID NO: 180202 - DNA, 984 bp, Artificial Sequence
  Description of Artificial Sequence: Synthetic coding sequence
atggagggcagcaacggcttcggcatcgacagcatcctgagccaccgggcgggatcccctgccctgcctaagggtgaccccttactcggcgactgccgttctccccttgagctctcgcctaggagcgagagcagcagcgactgctctagccccgcctcgcccgggcgagactgtttagagacggggactcctagacctgggggagccagtggtcctggcctggattctcatctccaacctggtcagctttctgcaccggcgcagtcacgaaccgtgacaagctcattcctaatccgagacatcttagccgattgtaaacctctggccgcgtgcgcaccttactctagctcagggcagccagccgctcctgagcctggtgggcgcttggctgccaaggcagcggaggattttcgagacaaattagataagtcaggttccaacgccagctccgatagtgaatataaggtaaaggaggagggtgatagggagatctcgtcttcccgtgacagccccccggtccgccttaaaaagccccggaaggctcgcactgcattcactgatcatcagcttgcccagttagagcgcagtttcgaacgccagaaatacctttctgtccaggacagaatggaactagccgcttcactcaatttgaccgatacgcaggtaaaaacctggtaccagaataggagaacaaaatggaaacgccagactgcggtcgggctggaacttcttgccgaagcgggaaactacagcgccctgcagaggatgttccccagcccttacttctatcctcagtccctcgtctcaaacctcgacccgggagctgcactgtatttatacagaggcccatcagcacctccgcctgccctgcagcgcccactggtgcctagaatcttgatacatgggttgcaaggcgcttctgagcccccacccccactgccccccctcgccggtgtgctgcccagggctgcacaaccaagatag

SEQ ID NO: 180203 - DNA, 984 bp, Artificial Sequence
  Description of Artificial Sequence: Synthetic coding sequence
atggagggcagcaacggcttcggcatcgacagcatcctgagccaccgggcgggttcccctgcgctacctaagggggaccctcttctgggcgactgtagatcccctcttgagcttagtccccggagcgagagctcatccgattgtagcagtccagcttccccagggagggattgcctagagaccggcactccaaggcccgggggtgcatctgggcctggactcgactctcatttgcagcctggacagctcagtgccccagcccagtcacgaactgtgacttcttcctttttgatccgcgacatactggccgattgcaagcctttagcagcctgcgcaccatacagctccagtggtcagcccgcggccccagaaccaggcggccggcttgctgctaaggccgctgaagacttccgagacaaactcgacaaatccgggtccaacgcctcctctgactctgaatacaaggtgaaggaggagggagaccgtgaaatttccagtagtagggatagtccccctgtacgactgaagaagcctagaaaggcgcgaaccgcctttacggaccatcagctcgcacagctcgaaaggtcctttgagagacagaaatatttatccgtgcaagaccgaatggaactcgccgctagcctgaacctgaccgacacacaagtgaaaacttggtaccaaaacagacggacgaagtggaagagacagacagccgtgggtctggagcttctggctgaagccggaaattactcggcattacagcggatgtttccttctccctacttttatccgcagtccctggtcagcaacctcgatcccggcgcagcactttatctttacaggggaccttcagccccaccccccgcactgcaaaggcctttagtgcccaggattttaatccacgggctgcagggcgcttccgaacctccccctccccttcctccacttgccggcgtgcttccacgcgcagcgcagccccgttag

SEQ ID NO: 180204 - DNA, 270 bp, Artificial Sequence
  Description of Artificial Sequence: Synthetic coding sequence
atgaccaccagccagaagcaccgggacttcgtggccgagcccatgggcgagaaacccgtaggcagcctcgctggcattggagaggtgctggggaaaaaactagaagagcgcggttttgataaggcctatgtggtgcttggccagtttctggttctcaaaaaggatgaggacctgttcagagagtggctcaaggatacttgcggagcaaacgcgaaacagtctcgcgactgctttgggtgcctccgggaatggtgcgatgctttcttatag

SEQ ID NO: 180205 - DNA, 270 bp, Artificial Sequence
  Description of Artificial Sequence: Synthetic coding sequence
atgaccaccagccagaagcaccgggacttcgtggccgagcccatgggcgaaaaacccgtgggatccctggctggcattggtgaagtgctagggaagaagttagaggaacgcggcttcgacaaggcatatgtcgtgctggggcagttcctcgtgctgaaaaaagatgaagacctgttccgcgaatggctgaaggacacctgcggagccaacgctaaacagtcaagagattgctttggctgcctccgggagtggtgtgatgcctttttatag

SEQ ID NO: 180206 - DNA, 270 bp, Artificial Sequence
  Description of Artificial Sequence: Synthetic coding sequence
atgaccaccagccagaagcaccgggacttcgtggccgagcccatgggggagaagcccgtgggctctctggctggcattggggaggtcctcggtaagaagctggaggaacgcggcttcgataaagcctacgtggtcttaggccagttcctggtcttaaagaaggacgaagacctctttagagaatggttgaaagacacatgcggcgcaaacgcaaaacagtcaagggactgcttcggctgcctccgagagtggtgcgacgctttcctctag

SEQ ID NO: 180207 - DNA, 87 bp, Artificial Sequence
  Description of Artificial Sequence: Synthetic coding sequence
atgaccaccagccagaagcaccgggacttcgtggccgagcccatgggagaaaaacctgtagggagccttgcgggcattggcgagtag

SEQ ID NO: 180208 - DNA, 270 bp, Artificial Sequence
  Description of Artificial Sequence: Synthetic coding sequence
atgaccaccagccagaagcaccgggacttcgtggccgagcccatgggggagaaacctgtggggagccttgctggaataggggaggtgcttggcaagaaactggaggagaggggcttcgacaaggcatatgtcgtgctgggtcagttcctggtacttaaaaaggatgaggatctttttagggaatggctgaaggatacctgcggcgcgaatgccaagcagtctcgcgactgctttggatgtctgagagaatggtgtgatgcttttctatag

SEQ ID NO: 180209 - DNA, 963 bp, Artificial Sequence
  Description of Artificial Sequence: Synthetic coding sequence
atggccgacgagaagaccttccggatcggcttcatcgtgctgggcctttttctgctagcactgggtaccttccttatgtcgcatgatcggccacaggtgtacgggactttctatgcaatgggttcggtcatggttatcggcggcatcatctggtctatgtgtcagtgttacccgaaaattacgtttgtgcctgctgactccgattttcagggcatcctctctcccaaggcaatgggactccttgagaatgggcttgcggccgaaatgaaatctcctagccctcaacctccatacgtaaggctttgggaggaagctgcctatgatcagagtttaccagacttcagccacatccagatgaaagtgatgagttattcagaggaccatcgcagcctgctcgctccagaaatgggccaacccaaactgggaaccagtgacggaggcgagggcggacctggagacgtacaggcttggatggaagccgccgtggtgatacacaaaggctctgacgagtccgaaggcgaacgccgcctgacccagtcctggcctggtcctctggcttgtccccagggccctgcccctctggcatccttccaagatgacctagacatggatagctccgagggctcgagcccaaatgccagcccccatgatcgcgaggaagcttgttcacctcaacaggagccgcaagggtgtcggtgtcctctggatcgattccaggacttcgccctcatcgatgcacccacactggaagatgagcctcaagaaggccagcagtgggagatcgcgctgccaaataattggcagaggtacccaaggactaaggtcgaggagaaagaagcttctgacactggtggcgaggagcctgagaaggaggaagaggatctgtattacgggctgccggatggagccggggacttattaccagataaggaattgggcttcgagcctgatacccaaggctag

SEQ ID NO: 180210 - DNA, 765 bp, Artificial Sequence
  Description of Artificial Sequence: Synthetic coding sequence
atgcagcggcccggcgagcccggcgccgcccggttcggcccccccgaggggtgtgctgaccaccgccctcataggtaccgatcctttatgatcgaagaaatactgaccgagccacctgggcccaagggggccgctccagctgctgctgccgctgcagcaggagaattgctgaagtttggagtgcaggccctgctcgctgctcggcctttccatagccacctcgcagtactcaaagctgagcaagctgctgtatttaagttccccttagctccactcggctgctccgggctttcgtcggcgctacttgccgccgggccaggactgccaggggcagcgggggctccacacctgccactagaactccaacttcggggaaaactggaggccgccggccctggcgaaccggggaccaaagctaaaaaaggcagaaggtcgcggacagtcttcacagaattgcagctgatgggtcttgagaagagatttgaaaagcagaagtatctgtccaccccagatagaatcgacctggcagagagcttgggtctctcccagctccaggtcaagacgtggtatcagaacagacggatgaagtggaagaagattgtgctgcagggcggaggattagaaagcccaaccaagcccaaaggccgccctaaaaagaacagcatccccaccagcgaacagctgaccgagcaggaacgagcaaaggatgccgagaagcctgccgaagtgcccggagaaccgagtgacagaagccgcgaagattag

SEQ ID NO: 180211 - DNA, 303 bp, Artificial Sequence
  Description of Artificial Sequence: Synthetic coding sequence
atgggcctggagaagcggttcgagaagcagaagtacctgagcacccctgatagaatcgacttggcagaatcgttgggactctcacaactgcaggtgaaaacttggtaccagaaccgccgtatgaagtggaagaagattgtcctgcagggcgggggcttagagtctcctacaaagccgaaaggccgacccaagaaaaatagtataccaactagtgagcagctgacagaacaggagagggctaaggacgctgaaaaacctgcagaggtgcccggagagccgtctgatagatcccgagaggactag

SEQ ID NO: 180212 - DNA, 840 bp, Artificial Sequence
  Description of Artificial Sequence: Synthetic coding sequence
atgcactgccacgccgagctgcggctgagcagccccggccagctgaaagcagcccgtaggcgctataagaccttcatgatcgatgagatcctcagcaaggagacatgcgactactttgaaaagctgagcctttacagtgtgtgtcccagcctggtcgttcgcccaaagcctctccattcttgcacaggatctccttcactgcgagcctatcccctgctctcggtgatcaccagacagccgacggtaatcagtcacttggtgcccgcaacccctgggatcgcgcaggctctgtcatgccaccaggtgaccgaagcagtctctgcagaagctccaggtggggaagcactggcaagtagtgaatctgaaacagaacagcctacacctcgtcagaaaaagcctcggcgcagcagaacgatttttaccgagcttcagctgatgggtctggagaagaagtttcagaaacagaaatacctttccacacccgatagactggacctggctcagagcctgggcctgacccagctacaagtcaaaacctggtaccagaacaggaggatgaaatggaagaagatggtgctcaagggcggtcaggaagcccctaccaagcccaaagggaggccaaaaaaaaacagcatacctaccagcgaagagatcgaagctgaggaaaaaatgaacagccaggcacaaggccaggaacagctggaacctagccaaggccaagaagaactctgcgaagcacaggaacccaaggctagggatgttcccctggaaatggccgaacctcctgaccctcctcaggaactccccatcccatcttctgagcctcccccactctcttag

SEQ ID NO: 180213 - DNA, 1887 bp, Artificial Sequence
  Description of Artificial Sequence: Synthetic coding sequence
atggagccccccgacgcccccgcccaggcccggggcgccccccggctcctactcctcgcggttctgctcgccgcacatcccgatgctcaggctgaggtgagactgagcgtaccgccgctagtagaggtgatgaggggcaagagcgtgatcttagattgtacacctaccggcacccacgaccattacatgctcgaatggtttctgaccgatcgatccggggctagacctaggttggcgagtgctgagatgcagggaagcgagctgcaagtgacgatgcacgacacccgcggaagatccccaccgtatcaattagattctcagggacgccttgtactggctgaggcccaggtcggggacgaaagagattacgtctgtgtggtgcgggcaggggcggccggcaccgctgaggcaacagccagactgaacgtcttcgctaaacccgaggccactgaggtgtctcccaataaaggtaccctgtctgtgatggaggactcagcacaggagatagccacctgcaacagccgtaatggtaaccctgcccccaaaatcacgtggtacaggaatgggcagaggctggaagtgcccgtcgaaatgaatcctgaggggtacatgacctcccgcactgtgagagaggcgtctggtctcctctctttgacttccaccttgtacttgagactgaggaaggacgatcgcgacgcctcctttcattgcgccgctcattacagtttgcctgaaggacgccacggcaggttagacagtcccactttccacctcacactacactatccgacggagcacgtgcagttctgggttgggagcccgtcaacaccagctggctgggtacgcgaaggagacactgtgcaattactctgtcggggcgatggtagcccatcaccagagtacacgctgttccggttgcaggacgagcaggaagaagttttaaacgtgaacctcgaggggaatctgaccctggagggagtgactagggggcagagcggcacctatggctgccgagttgaagactacgatgccgcagacgacgtccaattgagcaaaaccctcgaacttcgagtcgcctatctcgaccctttggagctctccgaggggaaggttcttagcctgccgctcaatagcagcgcagtcgtcaactgctccgtgcacggattaccaactcccgccctgcgttggaccaaggattccactccgttgggtgacggacctatgctgagcttgtcctcaattacctttgactccaacgggacatacgtgtgcgaggcgagcttgccaacagtccctgtgctctcccgaacccagaatttcacactgctcgttcagggcagccctgaactcaagacagcagaaatcgaacccaaagccgacggctcttggagggagggggatgaagtgacactgatctgcagtgcaagagggcacccagatccgaagctgtcctggtcccagctcggtggctccccagctgaaccaatccccggacggcagggatgggtgtcatcttccctcaccctgaaggtcacatctgcccttagccgggacggaatatcctgtgaagcatccaatcctcacggaaataaaagacatgtttttcacttcggtactgtgtcgccgcaaacatcacaagcaggcgttgccgtgatggccgttgccgtttcggtaggacttcttttgctggtggtggctgtcttttactgtgtgaggcgtaagggcggtccatgctgtagacagcggagggagaaaggcgcacctcctccaggggaacccggactcagccactctggcagcgagcagcccgagcaaaccgggctgctcatgggcggcgccagtggcggagccaggggcggttccgggggattcggcgatgagtgctag

SEQ ID NO: 180214 - DNA, 1767 bp, Artificial Sequence
  Description of Artificial Sequence: Synthetic coding sequence
atggagccccccgacgcccccgcccaggcccggggcgccccccggcttctgttactggctgttctgttggctgcgcatcctgatgcacaggcagaagtacggctgagcgtaccccccctcgtagaggtgatgagagggaaatctgttatcttggactgcacccctactggaacacacgaccactatatgctggagtggttcctgacagacaggagtggagccaggccccgcctggcaagtgcggagatgcaaggtagcgaactgcaggtgacaatgcacgatactcggggacgctcccctccctaccaattggactcccagggacggctggtactcgcagaagctcaggtaggagacgagagagactacgtgtgtgtcgttcgagctggagccgccgggacagcagaggccaccgcgaggttgaacgtcttcgcgaagccagaagcgacagaggtgagtcctaacaagggtaccctgtctgtaatggaggatagcgcacaagagatagccacctgcaattctcgtaatgggaatccagctccaaagatcacatggtaccgcaacgggcagaggctggaagtgccggttgagatgaatcctgaggggtatatgacaagccggacagtgcgcgaggcttctggtctcctgtccctgacatcaactctatacctgcggttaaggaaagatgatcgagacgcctcttttcattgcgccgcccattactcactaccagagggccgacacggccggctcgactcccccacgtttcatctgacactccattatccgaccgaacacgttcagttttgggtaggctccccttctactcctgccggatgggtgagagagggggataccgttcagctgctttgcagaggagacgggagtcccagccctgagtatacattgttcagactgcaggacgagcaagaggaagttctgaacgtcaacctggaagggaatctgacgcttgagggagtcactaggggacagagcggcacatacggctgcagggtggaagattatgacgcagctgatgatgtccagctatccaagactctcgaattacgagtagcctatctcgaccccctcgaactttcagaggggaaagtgctaagcctgcctttgaacagtagcgcggtggtgaactgttccgtgcatggacttcccacccccgctctccgatggactaaggatagtacccctctgggcgatgggcccatgttgtccctctcttctatcacctttgattctaatggcacctacgtctgtgaagcctctctgcccactgttcctgtcctctctaggacccaaaatttcactctcctggtccagggttcgcctgaactaaagactgccgagattgagccaaaagcagacggttcatggcgagagggggacgaggtaacactgatttgttcagcccgcggtcatccagaccccaagttgtcatggtctcagctgggcggaagccctgctgagccaattcctgggcgacaaggatgggtttcgagcagccttacactcaaagtgaccagcgctctttcaagggacgggatttcctgcgaggcttctaacccgcacggcaacaaacggcatgtgttccacttcggcacagtttccccgcaaacgagtcaggctggggtggcagttatggcggtggccgtcagtgtgggattgctgctgctggtggtcgccgtcttctactgcgtcagaaggaaaggcggaccttgttgtcggcagaggcgcgaaaagggagccccatag

SEQ ID NO: 180215 - DNA, 321 bp, Artificial Sequence
  Description of Artificial Sequence: Synthetic coding sequence
atgatgaccctggtgccccgggcccggacccgggccggccaggaccattatagtcacccctgtccccgttttagtcaggtgctcctgaccgaaggaatcatgacatactgcttgacgaagaacctgtcagacgtgaacatcctccaccgtttgctcaagaatggaaacgtacggaacactctgctacaatctaaagtcggcctcttgacctattacgtgaagctatacccgggtgaggttacattgctcacaaggccatctattcagatgaggttatgctgcatcacggggagtgtctcccggccccgaagtcagaagtag

SEQ ID NO: 180216 - DNA, 321 bp, Artificial Sequence
  Description of Artificial Sequence: Synthetic coding sequence
atgatgaccctggtgccccgggcccggacccgggccggccaggaccactattcgcacccctgcccacggttctcacaggtgctccttacagagggaattatgacgtattgcttgacaaagaatctgagtgacgtgaatatcctgcataggctgctgaagaatggcaacgtaaggaataccctcctccagagcaaagtcggtctgcttacctactacgttaagctttaccccggagaggttactctgcttactcgcccatctattcagatgaggctgtgctgcataacagggtctgtaagtcgcccccgaagtcagaaatag

SEQ ID NO: 180217 - DNA, 1146 bp, Artificial Sequence
  Description of Artificial Sequence: Synthetic coding sequence
atggagcggggcatgcacctgggcgccgccgccgccggcgaggacgatcttttcctgcacaaatcactctcagcgtcaacatcgaaacggctcgaagcagctttcagatccacaccacctggaatggaccttagcctcgccccgcctccgcgtgagcgccccgccagctccagttcctcccccctggggtgtttcgaacctgctgacccggagggcgctggactcctgctgccgccacctggcggggggggcggcggttccgccgggtctggcgggggcggggggggcggtgtgggtgttcccggattgctcgtcgggtcagcaggtgtgggaggggatccatccctctcttctttaccagcaggcgctgcactctgtttgaaatatggggaaagtgcaagccggggatcagtggcagagtctagtggaggagagcagagccccgatgacgacagcgacggccggtgtgagctcgtattgagggccggtgtggcagacccacgagcatctccaggcgctgggggagggggagctaaggccgccgagggttgtagcaatgctcacctgcatggtggcgctagcgtgcctcccggtggcctcggggggggtggaggcgggggcagttctagtggtagttccggtggaggaggtggttccggatcaggatcgggtgggagctcatccagctcatccagtagctcaaagaaaagcaaggaacaaaaggcgctgcgcctaaacatcaacgcccgcgaaaggcgtcggatgcacgatctgaatgacgctttagatgagttgcgcgctgtgatcccttacgcacatagccctagcgtgaggaagctctccaaaattgcaaccctgttgctggccaaaaactatatcctgatgcaggcgcaggccctcgaggaaatgcgtcgattggtggcctatcttaaccaggggcaggcaatcagcgccgcaagtttaccgtcatctgccgctgctgctgcggcggccgcggcattacatccagccctgggagcctacgagcaggctgccggctatccattctccgccggcctacccccggccgcgtcctgtccagaaaagtgcgcactgttcaacagcgtcagctcatccctatgcaaacagtgcacagaaaagccctag

SEQ ID NO: 180218 - DNA, 678 bp, Artificial Sequence
  Description of Artificial Sequence: Synthetic coding sequence
atggccgagctgaagagcctgagcggcgacgcctacctggccctgagccatggctacgcagcagctgctgcagggctggcttatggtgcagcacgtgaacctgaagccgcacgaggatacggcactcctggccccggcggcgatctcccggcggcccctgcgcccagggcgccggcccaggccgcagaaagtagtggtgagcagtcaggtgacgaagatgacgccttcgagcagaggcgtcggcgccgaggccccggctctgcagccgacggcaggaggaggccacgcgaacagagaagtctgagactgtcaatcaacgctagagagcgcaggcggatgcatgatctgaacgacgcacttgacggcctgagagctgtgattccatacgcccactctccatctgtgcgcaaattgtccaaaatcgccacactgttgctcgcgaaaaactacatattgatgcaggctcaagcattggacgagatgcgtcgattggtagcgtttctgaatcaaggccagggcctggcagccccggtgaatgccgcacctttgacccccttcggacaggccacagtgtgcccgttctctgccggggcagctctgggcccatgtcctgacaaatgcgccgcgttcagcggaacgccctctgccctgtgcaaacattgtcacgaaaagccatag

SEQ ID NO: 180219 - DNA, 1239 bp, Artificial Sequence
  Description of Artificial Sequence: Synthetic coding sequence
atggagcggatccccagcgcccagcccccccccgcctgcctgcccaaagctcctgggctggagcatggcgacctgcctggtatgtaccctgcccatatgtaccaagtgtataaaagccggcggggtataaaaagatccgaggactctaaagaaacatataaactcccccacaggttgattgaaaaaaagcgtagggacagaatcaacgaatgcatcgcacagctcaaggatctcctgccagagcaccttaagctcaccactctagggcaccttgagaaagccgtggtgctcgaacttactctgaagcacgtcaaagcgctcactaacctaatcgaccagcagcagcagaagatcatcgcccttcagtctggtctacaggccggggagctgtcgggccgtaacgtggagaccgggcaggagatgttttgttccgggttccaaacctgtgcccgggaagttctgcagtatctggccaaacacgagaacacccgggacctaaaatcaagtcagctcgtgacgcaccttcaccgcgtggttagcgaactgcttcagggaggaactagtagaaaaccatctgatcccgctccaaaagtaatggacttcaaagaaaaaccatcttcccctgcgaaaggctctgagggacctggaaaaaactgtgttccggtaatacagagaaccttcgcccactccagcggcgagcagagtgggagtgacactgatactgattctggctacggtggcgaaagcgagaaaggcgatctgcgctctgagcagccatgctttaagagcgaccatgggcgtcgcttcactatgggagaacgcatcggcgccatcaaacaagaaagcgaagagcccccaacaaagaagaaccgcatgcagttgtctgatgacgagggccatttcacatccagtgacctgatatcctcgcctttcttggggccacatccccaccaaccgccattctgcctgcctttttatttgattcccccaagcgccacagcgtatctcccaatgctggaaaagtgctggtaccccacctccgtgccagtgctttatcccggattgaacgcttccgccgctgctttaagtagcttcatgaatcccgacaagatttccgcacctttactgatgccccagcgtctgcccagcccactccccgcccacccctctgttgactcgtccgtgctcctgcaggcactgaagccaattccgcccttaaatctggaaacaaaagattag

SEQ ID NO: 180220 - DNA, 378 bp, Artificial Sequence
  Description of Artificial Sequence: Synthetic coding sequence
atgccccacagcagcgacagcagcgacagcagcttcagccggagccccccacctggaaagcaggactcaagcgatgacgtcagacgcgtccagagacgggagaaaaacaggattgccgcccagaaatctagacagcggcaaacgcagaaggctgacacgcttcaccttgagtcggaagatttagagaagcagaacgctgcattgagaaaggagataaagcagctgactgaggagctaaagtatttcacatccgtgctgaattctcacgaaccactatgctccgtgttggccgcttctaccccaagccctccagaagttgtatactctgcccatgcttttcaccagccccatgtgagtagcccacgttttcagccatag

SEQ ID NO: 180221 - DNA, 384 bp, Artificial Sequence
  Description of Artificial Sequence: Synthetic coding sequence
atgagccagggcctgcccgccgccggcagcgtgctgcagcggagcgtagccgccccagggaatcaaccgcaaccccaaccgcagcaacagagccctgaagacgacgaccggaaggtgcgccgcagggaaaagaatagagtcgctgcccagagaagtaggaaaaaacaaacacagaaggctgacaaactccacgaggagtacgaatccctggaacaggaaaatactatgctgcgacgggagatcggtaaactcactgaggagctgaaacacctgacagaggctttgaaagaacatgaaaaaatgtgtcctttactactgtgccctatgaatttcgtccctgttccaccgcggccagatcctgtggccggatgtctcccccgatag

SEQ ID NO: 180222 - DNA, 489 bp, Artificial Sequence
  Description of Artificial Sequence: Synthetic coding sequence
atgaaggagaccatcatgaaccaggagaagctggccaagctgcaggcacaggtgcgaatcggtggcaagggcaccgctcggaggaagaaaaaagtcgttcatagaacagctacagccgatgacaagaagctccagttctctctgaagaagctgggagtcaacaatatcagcggtatcgaagaggttaacatgtttactaaccaagggaccgtgattcattttaataaccccaaagtacaggccagtctcgctgccaacaccttcacaatcactgggcatgctgaaaccaaacagctgacggagatgctgcccagcattctcaatcagctcggggctgattccctaacttctctcagaaggctcgctgaagctctgccaaagcaatccgtggatggcaaggctcccctggcaacaggggaagacgatgatgacgaggtcccagatctcgtcgagaattttgatgaggcttcaaagaacgaggctaattag

SEQ ID NO: 180223 - DNA, 621 bp, Artificial Sequence
  Description of Artificial Sequence: Synthetic coding sequence
atgcggcggaccggcgcccccgcccaggccgacagccggggccggggacgcgcccggggcggatgtcccggtggcgaggccaccctgagccaacctccgccaagaggcggtactcgaggccaggagccgcagatgaaggaaacaattatgaatcaggagaaattggcaaagctgcaggcccaggttaggattggcggtaaggggaccgcacggcgcaaaaaaaaagtcgtccatagaacagcgactgctgacgacaaaaagctgcaattttcccttaagaagctcggcgtaaacaacatatccgggattgaggaggtgaacatgtttaccaaccagggcaccgtgatccacttcaacaatcccaaggtgcaggcctctctggcagctaacacgtttaccatcaccggtcatgctgagacaaaacaattgacggagatgctgccaagcatcttgaatcaactcggggcggacagcctgaccagtttgaggcgcttggctgaggcattgccaaaacagagcgtggatgggaaggctccactggccaccggcgaagatgatgacgacgaggtccccgacctggtggagaacttcgatgaagcaagcaagaacgaggcaaattag

SEQ ID NO: 180224 - DNA, 1158 bp, Artificial Sequence
  Description of Artificial Sequence: Synthetic coding sequence
atggccgccgccctgttcgtgctgctgggcttcgccctgctgggcacccacggcgctagcggggctgcaggattcgttcaggcgcctctctcccaacaaagatgggtggggggatcagtggagctgcattgtgaagccgtgggcagtcccgtgccagagatccagtggtggtttgaggggcaaggcccaaatgatacatgttcacaactttgggacggagcgagactggaccgtgttcacatccacgcgacctaccatcagcacgctgcgtccactattagcatcgacactttggtggaagaggacacaggcacttacgaatgccgtgcctccaacgaccccgaccgcaaccatctgacgcgtgctccgcgtgttaagtgggtgcgagcccaagctgtggtcctcgttctcgagcccggaactgtgtttactactgtcgaggatctggggtctaagatactgttaacctgcagtttaaacgattccgccaccgaagttaccgggcacaggtggctgaaggggggcgtcgtacttaaggaggacgcattgccagggcagaagactgaattcaaggtggatagcgatgaccaatggggggaatactcttgtgtttttctgccagaacccatgggaacagcaaatattcagcttcacggacctccccgggtgaaggccgtcaaatcatccgaacatattaacgagggcgagaccgccatgctggtatgtaagagcgaatctgtccccccagtgaccgactgggcctggtacaagatcacggatagcgaagacaaagccttaatgaacggttctgagagccgcttcttcgtatcttcatcccagggccgatcggagcttcacatagagaatcttaatatggaggctgaccccggtcagtatcgttgtaacggtacctcttcgaagggaagcgatcaggcaatcataacccttagggtcagatcccacctggccgccttgtggcccttcctgggtatcgtggcagaggtgttagtcctggtgacaatcattttcatctatgaaaagcgacggaagccggaagatgtcctcgacgacgatgacgccgggtcggcaccactgaaaagtagcggtcagcaccagaatgacaaaggcaaaaacgttagacagagaaacagtagttag

SEQ ID NO: 180225 - DNA, 618 bp, Artificial Sequence
  Description of Artificial Sequence: Synthetic coding sequence
atgaagcagagcgacgccagcccccaggagcgggtggacagcgacgatcagtggggagaatactcatgcgtgtttctgcccgaaccaatgggcactgcaaatatccagctgcacggcccacctcgggtcaaagccgtgaaaagcagcgaacatattaacgaaggcgaaactgcaatgcttgtgtgcaagtctgagtccgtgccccctgttactgattgggcctggtacaagatcacggacagcgaggataaggcgcttatgaatgggagcgaatcacggttttttgtgtcctcgtctcagggacgctccgagctgcacatcgagaacctcaatatggaagcagatccgggtcaataccggtgcaacgggaccagctccaaaggctctgatcaggcaatcatcactttgcgcgttaggagccacctggcagctctatggcctttcttaggtattgtggcagaggtactggtgctcgtaacgatcatatttatttatgagaagcgcagaaaacccgaggacgtcctcgacgacgatgacgcaggctcagcacccctcaaatcttctggccagcaccagaatgacaaaggcaaaaacgtgagacagcggaattcatcttag

SEQ ID NO: 180226 - DNA, 810 bp, Artificial Sequence
  Description of Artificial Sequence: Synthetic coding sequence
atggccgccgccctgttcgtgctgctgggcttcgccctgctgggcacacatggggccagcggggcggccgggactgtctttactacagttgaggacctggggtcaaaaatactcctcacatgctcccttaacgatagcgcaactgaggtgacagggcatagatggctcaaaggcggagtcgtcctgaaggaagacgcactgcctggacagaagacggagttcaaagttgattccgatgaccagtggggggaatactcttgcgtgttcctaccagaaccgatgggcactgctaatatccagctccacggtccaccccgcgtcaaggccgtgaagtcttcagaacacatcaatgaaggagagacagctatgctagtgtgcaagtccgagtctgtgccgccagtgactgattgggcctggtataaaattactgattcagaggacaaggcgctaatgaacggctcagaaagccgcttctttgtctcttcatcgcagggtaggagtgagctgcatatagaaaatctgaacatggaggctgatcccggccagtatcgctgtaacgggactagctccaaggggtccgaccaagctataatcacgctccgggtgcgttcccatctggccgcactgtggcccttcctgggtattgtcgccgaagtgctggttttggtgacaattatattcatttatgagaagcgtcggaagcctgaggacgtgcttgacgacgacgacgcggggagcgctcccttgaaatcctctggacagcatcaaaatgataagggaaaaaatgtgcgtcagcgcaacagttcatag

SEQ ID NO: 180227 - DNA, 531 bp, Artificial Sequence
  Description of Artificial Sequence: Synthetic coding sequence
atgggcaccgccaacatccagctgcacggccccccccgggtgaaggcagttaagtcctcagagcacattaacgaaggcgagactgccatgcttgtctgtaaaagcgaatccgtgccaccagtgacagattgggcctggtacaagatcaccgatagcgaagataaagccttaatgaacggttcagagtcccggttctttgtcagttcctctcaggggagatccgaattgcacattgaaaacctcaacatggaggcagaccccgggcaataccgctgtaacgggacctcctcgaaaggtagcgatcaagctatcattacactgcgagtgagatcccacctggctgccttgtggccctttctcgggattgttgccgaggtgttggtcttggtgacgattatctttatttatgaaaagagacgtaagccagaagacgtgctggacgacgacgacgctggctctgctcccctaaaatcaagcggtcagcaccagaacgacaagggaaaaaatgtccgtcagcgcaatagctcgtag

SEQ ID NO: 180228 - DNA, 2985 bp, Artificial Sequence
  Description of Artificial Sequence: Synthetic coding sequence
atgcggcggcggccccccagccggggcggccggggcgccgcccgggctagggagactcgaaggcaaccccggcacaggagcggtcggaggatggctgaggcaatttcttgtacccttaactgctcttgtcagagctttaaaccagggaaaatcaatcataggcagtgtgaccagtgcaagcatgggtgggtggcccatgcactgagcaagctcaggatcccgccgatgtacccaacatcccaggtggaaatcgtgcagagcaatgtcgtgttcgacatctcttctctgatgctgtacggcacccaggcaatcccagttcggctgaagatactgctcgacaggttattctcagttcttaagcaagatgaagtgctccagatattgcacgctctcgactggaccctgcaagactacattcggggttatgttctccaagacgccagtggaaaggtcctcgatcattggtctatcatgacctcggaagaggaagttgcaacactgcaacagtttctgaggtttggggaaacaaaaagcatagtggagctgatggctattcaggagaaggaggagcaatcaattatcatccctccgagtactgcaaacgtggacattagggcatttatcgagagttgttcacacaggtcatcctctcttccgaccccagtagacaagggcaatccaagctctattcatccgtttgagaatttgatcagtaacatgacttttatgctcccatttcaatttttcaaccccctgcctccagctcttatcgggagtctgccagaacaatacatgctggagcagggccacgatcagagccaggatcctaagcaggaagtgcacggtccttttcccgacagtagcttcctgacctcttccagcaccccatttcaggtggaaaaagatcaatgcctgaattgcccagacgcgatcacaaagaaagaggattcaacacacctgtccgacagcagcagctataacattgtgacaaagtttgaacgcacacagctgtcccccgaagcgaaggttaaacccgaaagaaactctctaggaaccaaaaagggaagagttttttgcaccgcttgcgaaaaaacattctatgacaagggtacgttgaaaattcactacaacgctgtccacctgaagattaaacataagtgcaccatcgaggggtgcaatatggtattttcaagcctgcgttccagaaacaggcactctgcgaacccgaacccccgattacatatgcccatgaaccgcaacaatcgggacaaggatctacggaattctctgaatctggcctccagtgaaaactacaaatgtcccggatttactgtgaccagtccagactgcagacctcccccatcgtaccctggcagcggagaagacagcaaaggccagcctgcatttcctaatattgggcagaatggggtgctttttcccaacctgaaaacagtccaacctgtcctgccattttaccgttcaccagccacacccgcagaagtggcgaacacccctggtatcttgccctcgttacctttattgtccagcagcatcccggagcagttgatctcgaacgagatgccattcgacgccctgccaaaaaagaagagtcgaaagtcatccatgcccattaagatcgagaaggaggcagtagaaattgccaacgaaaagcgccataacctgtctagtgatgaggatatgccactgcaggtggtgtctgaagatgagcaagaagcctgctctcctcagagccacagggtttcggaagaacaacatgttcagtcaggcggcttgggcaagccctttccagaaggagagagaccttgtcatagggaatcagttattgagtcatctggcgccatcagccagacccctgagcaggcgacccataatagcgagcgagaaacagaacagactccagcccttattatggttcccagggaagtcgaagatggaggtcacgaacactacttcactccaggtatggaaccccaggtcccattcagcgattacatggagctacaacagcgactgttagccggaggattatttagcgccttgagcaaccgcggcatggcattcccttgcctagaagactcaaaagaactggaacatgtggggcagcatgcacttgctcggcagatagaggaaaaccgcttccaatgcgatatttgtaagaagactttcaagaacgcctgctccgtgaagattcaccacaaaaacatgcatgttaaagaaatgcatacatgtaccgtggaagggtgcaacgctacgtttccaagccgcagatccagggatcgacatagtagcaaccttaatctgcaccagaaggctctgtcacaggaggctcttgagagtagcgaggaccattttagggctgcctatctgctaaaggatgtggctaaagaggcataccaagacgtcgcctttacgcagcaggctagccagacatcagtgatcttcaaggggactagccgcatgggtagcctggtctatcccattacccaggtgcattctgcaagtctggaaagttacaacagcggccctctaagcgaggggacgatcctggatttatctacaacaagtagtatgaaatccgaatcgagcagccacagttcttgggattcagacggagtgtcagaagagggaacggttctcatggaggactctgatggtaactgtgaaggctctagtctcgtgcccggggaagacgagtatcctatctgcgtgttgatggaaaaggcagaccaatccctagcatcgttgccctccgggctgcctatcacctgccacctgtgtcagaagacatatagtaacaagggcacttttcgcgcgcactataagaccgtccacttgcggcagcttcataaatgcaaggtccctggctgtaatacgatgttttcaagcgtcagatctcgaaaccgccactctcagaacccaaatcttcacaaatcattggcctcaagcccgagccatttgcagtag

SEQ ID NO: 180229 - DNA, 2964 bp, Artificial Sequence
  Description of Artificial Sequence: Synthetic coding sequence
atgcggtgccggaacatgttcttcagcttcaaggccagcctgtgcgggtgcggtgctgctactgcaccaagcctcacagcaatctcttgtacactgaactgttcatgtcaatcgttcaaaccaggtaagatcaatcatcgtcagtgtgaccaatgtaaacatggctgggtggcacatgcgcttagcaagttgcgaatccctcctatgtaccccacaagccaggtcgagatcgtacaatctaatgtggtctttgatatctcgagtctgatgctgtatggcactcaggcgattcctgtgaggctgaagatcctgttggaccggctgttcagcgtgctgaaacaggatgaggtgctgcaaattctgcatgcactggattggactctccaggactacatccgaggctatgttcttcaggatgcttctggcaaggtactggatcactggtccatcatgaccagcgaagaggaagttgccacactccagcagttcttgagattcggcgaaaccaagtccatcgtcgaacttatggccattcaagaaaaagaagagcagtcaattatcataccgccgagtacagctaacgtggatattcgcgcttttatcgagagctgttcacaccgttcctcctccttaccaaccccggtcgataagggtaatccctcttcaatccacccctttgagaacctcatctcaaatatgacctttatgctacctttccagttctttaaccctctcccaccagctctgatcggaagtcttcctgaacagtatatgctcgaacagggacacgaccagtcccaggatcctaagcaagaagtgcatggacccttccctgattcatccttcctgacaagttcttcgaccccattccaggtggaaaaagatcagtgtttaaactgccctgacgcaatcaccaagaaggaagactctacccacctctccgacagctcatcctataatatcgtaaccaaatttgagagaacccaacttagcccagaggctaaagttaagcccgaaagaaattctttgggtactaagaagggcagagtcttctgcacggcttgcgaaaagactttctacgataaaggcacattgaaaattcactataacgccgtacatttgaaaataaagcacaagtgtaccattgaggggtgcaacatggttttctcttcgttgcggagtcggaatcggcattccgccaatcctaaccctaggctgcacatgccgatgaaccgtaacaatcgcgataaagaccttcggaacagtctgaatctggccagctccgagaactacaagtgccctggcttcacggtcacttcaccagactgtcgaccgccaccgtcatatcctggcagcggtgaggattctaaaggacaacctgcttttccaaacatcgggcagaacggcgtgctgtttccaaatcttaagacagtccagcccgtccttccattttaccggtctccagccacccctgcagaagttgccaacactcctggaatactcccctccttgcccctcctttcctcaagtattcctgagcagctcatctccaatgagatgcctttcgatgccttgcctaagaagaagagccgcaagtcaagcatgccgattaagatagagaaagaggcggttgagatcgcaaacgagaaaaggcataacctaagctcggatgaagacatgccactgcaggtggtgtctgaagatgagcaagaagcttgctcaccccaaagccaccgcgtctccgaagagcagcatgtacagtccggtggtctggggaaaccgttccccgagggtgagcggccctgccatagggagtctgttattgagagtagtggggcaatctcccaaactcctgaacaggcaactcacaactctgaacgcgaaaccgaacagaccccagccctgatcatggtaccccgcgaagtagaggatggcggtcacgagcactatttcactcctggcatggagccacaggtcccgttcagcgattacatggagttacaacagcgcctgttagcaggggggctgttcagcgcgctttcaaatcggggaatggcttttccttgcctcgaggattcaaaagaactcgagcacgtgggccagcatgctctcgcccgccagattgaggagaatcggtttcagtgtgatatctgtaagaagaccttcaagaatgcatgttctgttaaaatccaccacaaaaacatgcacgtgaaagagatgcacacatgcaccgtcgagggttgcaatgcaacatttcccagtcgcagatcccgcgatagacactcttctaacctgaacctccaccagaaagccttgagccaagaggccctggaaagctccgaggatcatttcagggccgcctatctcctcaaagatgtggcgaaagaggcataccaggacgtggctttcacacagcaggcctcccagacctccgtgatttttaagggaacatctagaatgggtagtctggtctatccaatcacccaggtccactctgcttcgctcgaatcatataactcagggcctctatccgagggcacaatcctcgacctgagcaccacaagtagcatgaaaagtgagtcctcgtcccattctagttgggacagcgatggcgtctctgaggaaggcacagtcttgatggaggacagcgacggcaattgcgaggggagttcactggtcccaggggaagatgaataccctatctgcgtgctaatggagaaggctgaccaaagcctagcctccttgccctccgggctccctataacttgccacctctgccagaagacatacagcaataaggggacctttagggcccattacaaaacagtgcatctgcgccaactgcacaagtgcaaggtgccagggtgcaacactatgttcagcagtgtccgatcacgcaatcgtcattctcagaatcccaacttgcacaagtctctcgcatcatccccctctcacctccaatag

SEQ ID NO: 180230 - DNA, 2712 bp, Artificial Sequence
  Description of Artificial Sequence: Synthetic coding sequence
atggcccacctgggccccaccccccccccccacagcctgaactacaaatccgaagatcggctttcggagcaagactggcccgcctactttaaagtaccatgttgtggtgtggatacatcccagatcgagagtgaggaagctgaagtggatgtgagggagcgggagacccagcgcgacagagaacccaagagagcgcgcgacctaactctgagagatagctgcacagataatagtatgcagtttggtacccgcaccactaccgctgaaccggggtttatgggaacctggcagaacgctgacactaatttactctttagaatgtctcagcaggctatccgttgcaccctcgtaaattgtacatgtgagtgttttcaaccaggaaaaataaacctcaggacgtgtgatcagtgcaagcatggatgggttgcccacgctctcgacaagttatccacccagcatctttaccaccccacacaagtcgaaattgtgcaatcaaacgttgtgttcgacatctccagcttgatgctgtatggtacccaggccgtgcccgtgcgtttaaagattttgctggacagattgttctccgtgctgaagcaggaagaggtcctccatatcctccatggtctgggatggacactgagagactacgttcgaggatatattctgcaggacgctgcgggaaaggtcctggaccgatgggctattatgtcccgcgaagaggaaatcatcacgctacagcagtttctgcgattcggcgagaccaagtccattgtggagctcatggccattcaagagaaggaggggcaagctgtcgctgtcccttcgtctaagactgactctgacataaggacatttattgagagcaacaatcgcactagatccccaagtctgttggcccacctcgaaaatagtaatccatcatctatccatcactttgaaaacataccgaacagtttggcgtttctgttgcccttccagtacattaaccctgtgagcgcgcctctcttagggctgccacccaacggccttctgctcgaacaaccaggcctccgcctgcgggagcccagcctgtctacacagaatgagtataatgagagtagtgagtcagaggtgtcacctactccttataaaaacgatcagacaccaaatcgaaatgccctgacatcgatcactaacgttgagccgaagactgagccagcctgtgtgtccccaatccaaaacagcgcacccgtttccgacctgacgaagacagaacacccaaagtcttccttccgtatacaccggatgcgtcgtatgggctctgcctcacgcaagggcagggtattctgcaatgcttgtgggaagacattttacgacaagggaacattgaagattcactacaacgctgtgcatttgaagatcaagcatcggtgcaccatagaggggtgtaatatggtcttttcatctcttcgctctaggaacagacatagcgcaaaccccaacccgcgcctgcacatgccaatgcttcgcaacaaccgcgataaggatctcataagagccacatcgggcgcggctacccctgttatcgccagcacgaagagtaacctggcgctgacaagtccaggaagaccaccgatggggtttacaactccaccactggacccagtcctgcaaaatcccctaccatctcagctcgtgttttccggacttaaaaccgtgcagcccgtgcctcctttttatagatccctgttgaccccgggagaaatggtcagcccccccacatccctgccgaccagccctatcattcctacaagcgggacgattgaacaacaccctccgccccctagtgagccggttgtgccagccgtgatgatggcaactcatgagcccagtgcagacctggctccaaagaagaagcctcggaagagctctatgccagttaagatcgaaaaggagatcatcgataccgccgacgagttcgatgatgaggacgatgacccgaatgatggaggagcagttgttaacgacatgtcacacgataaccactgtcactctcaggaagaaatgtctccgggtatgagtgttaaggacttcagtaagcataatcggacgcgctgtatctcacgcacagaaatcagaagggcggattcaatgacctcggaagaccaggagcccgaaagggattatgaaaatgagtccgagtcctcggagccaaaacttggtgaagaaagtatggagggagacgaacacatccattctgaggtgtccgagaaggtgttaatgaatagcgaacggcctgacgagaatcattcagaaccctctcaccaagatgtcattaaggtgaaagaagagtttacggatccaacttacgatatgttttacatgagccagtacggcctatacaacgggggcggggcaagcatggctgcactccatgagagtttcacctcttcacttaactacggaagtcctcagaagttctcccccgagggtgatctgtgtagctctccagacccaaagatctgttatgtgtgcaaaaagtcctttaagtccagttattctgttaaactccattaccgcaacgtccatctgaaggagatgcacgtatgtaccgtagccggttgcaacgccgcattcccatccaggagatcccgggaccgctattgggaaaaatcaaacgaacagaacgggttactggtctcatggggcgagaccctgagttcactgaaatag

SEQ ID NO: 180231 - DNA, 3099 bp, Artificial Sequence
  Description of Artificial Sequence: Synthetic coding sequence
atggcccacctgggccccaccccccccccccacagcctgaactacaagagcgaggaccggctatcagaacaggactggcctgcatacttcaaggtgccctgttgtggagtggataccagtcagattgaggcaatcaggtgcaccctcgttaactgcacctgtgagtgtttccagcccggcaagattaatctccgcacttgtgaccagtgcaagcacggttgggtggcccacgccttggacaagctgagtacacagcacttgtatcatcctactcaggtagagattgttcaaagtaatgtggtcttcgatatttctagcttgatgctgtacgggacacaagcagttcctgttaggctcaagattctactcgacagacttttttctgtcctgaaacaggaagaagttctccacatactgcacggcctggggtggacactgcgcgattatgtgcgaggatatatcctccaggacgctgccggaaaggtgctggacaggtgggcgataatgtcacgggaggaggaaataattactctccagcagttcctgcggtttggagagaccaagtccatcgtggaactgatggcaattcaggagaaagagggacaggccgtggctgtgccctcaagcaaaaccgactctgacatacggacctttatcgagagcaacaacaggacaagaagcccttctcttctggctcatctggagaactccaatccaagcagtatccaccattttgagaacattcccaacagcctggcctttctgctcccctttcaatatattaaccctgttagcgcacctctactggggctcccaccaaatggcctcctgctggaacagcccggcctgcgacttagggagcctagcctgagcacccagaatgagtataatgagagctcagaatctgaggtcagccctacaccatacaagaacgatcagacacctaatcggaacgcgctgacctctattacaaatgtggagcctaagaccgagcctgcctgcgtgagccccattcaaaatagcgccccagtctcagacctgaccaagacagaacacccaaaaagttcctttagaatacaccgcatgcggcggatggggtccgcgtctaggaaaggaagggtgttctgcaacgcttgtggtaaaacattctacgacaagggcaccctgaagattcattacaacgccgttcaccttaaaatcaagcatcgttgtacgattgaagggtgtaacatggttttttctagcttacgatctcggaaccgacatagcgccaaccccaacccccggctgcacatgcctatgttacgcaataaccgcgacaaagacttgattagggctacgtcaggtgccgctacccccgtaatcgcatcgacaaaatctaatcttgctctcacaagcccgggaaggcctccaatggggttcacgacccctccgctggaccctgtcctgcagaatcctctcccttctcagcttgttttctccggactgaaaaccgtgcagcccgttcctccattttatcgcagcctgcttactcctggagagatggtttcgccaccaacaagtctgccaacgagcccgatcattccaacatctggcaccattgagcaacatccccctcccccgagtgagcccgtggttcccgctgtcatgatggcgactcatgaaccaagtgctgatcttgcgccaaagaaaaagcctcgcaaatcctccatgcccgtaaaaatagaaaaggagattattgacaccgcagacgaatttgacgacgaagatgatgaccctaacgacggaggcgcggtagttaatgacatgtcgcacgacaatcattgccacagccaagaggaaatgtccccaggtatgtctgtaaaagacttcagcaagcataacaggacccggtgcatcagtcgtacagagatacgacgggccgactctatgacttccgaggatcaggagcccgaacgagactacgagaatgagtcagaaagctcagaacccaagttaggcgaagagagcatggagggggatgagcatattcactcggaggtatcagagaaggtgctgatgaactctgaaaggccagacgaaaaccactccgaaccttcacaccaggatgtcatcaaagtgaaagaggagttcacagatcctacttacgacatgttctacatgtctcaatacggtctttataatggaggcggggccagcatggcagccttgcacgagagctttacttcctccttgaattacggtagcccacagaaattttcacccgagggggacctgtgttcttcacccgaccccaagatctgttatgtgtgcaagaagagcttcaagtccagctattccgttaagcttcattatcggaacgtccatttgaaggagatgcacgtttgcaccgtggcaggctgcaatgcagccttcccatccaggcgatctagagatcggcatagtgctaacattaatctacacagaaagctgcttacaaaagagcttgatgatatggggctggactcttctcagccgtccctgtcaaaggacctccgcgacgaatttcttgtgaagatctatggcgcgcagcaccctatgggcctggacgtgcgcgaggacgccagtagccccgccggtacagaggattcacatcttaatgggtacgggagaggaatggccgaagattacatggttctcgatctgagtactactagctcgctgcaatcaagttcctcgattcactccagcagggaaagcgacgcgggcagcgacgagggcatcctgttggacgacatagatggagcatctgacagtggtgaatctgctcacaaggccgaagcgcctgctctcccaggttcactgggcgctgaggtctccggttcactgatgttcagtagcctgagcgggtctaacggcggcatcatgtgtaacatatgccataaaatgtatagcaataagggcacgctacgagtacactacaagaccgtgcatctgagggagatgcacaaatgtaaggtaccgggttgcaacatgatgttcagcagcgtaagatctcggaaccgccactcccagaatccaaacctccataaaaacatcccatttacatcagtcgactag

SEQ ID NO: 180232 - DNA, 3300 bp, Artificial Sequence
  Description of Artificial Sequence: Synthetic coding sequence
atggcccacctgggccccaccccccccccccacagcctgaactacaaatctgaagacaggctatcggaacaggattggccggcatactttaaggtgccttgctgtggggttgacactagccagatcgagagtgaagaggcagaggtagatgtgcgcgaaagggaaacccagagggatcgtgaaccaaaaagggcaagggacctcactttaagagatagttgcacagataactccatgcaattcggtactcggacaactaccgccgaacccggattcatgggaacctggcagaatgcggacactaacttgctgttcaggatgtctcagcaggccattcgctgtacacttgttaattgcacctgcgaatgtttccagccgggcaagatcaatctccgtacttgtgatcagtgcaagcatggatgggtagctcacgcactggataagctctcaacacagcacctgtaccacccaactcaggtggaaatcgtgcaaagcaacgtggttttcgatatttcgagcctgatgttatatggaacccaggcggtccctgtccggctcaagatcttactggaccggttatttagcgtcttaaagcaggaggaagtgctccatatcctccatggactcgggtggacgttacgagactacgtgcgagggtacatcctccaagacgccgctgggaaggtcctggaccgttgggcaatcatgagccgcgaagaggagattataaccttacaacaatttctgcgcttcggagagacaaaatcgatagtagagttgatggcaattcaggagaaggagggacaggctgtcgccgtccccagctccaaaactgatagtgatattaggacattcatcgagtcaaataatagaaccaggagcccctcactcttagcccatcttgaaaatagtaatccttcttccatccatcacttcgagaatattcctaattcattagccttcctcttgccctttcagtacatcaatccagtctccgcgcctttactaggactgccgcctaacgggctgcttctggagcagccaggacttagactgcgcgaaccctccctgagcacccagaatgaatacaatgaatcatctgaatccgaggtatcacctaccccgtacaagaatgaccaaacccccaatcggaatgccctgacatcaatcactaatgtcgaacctaaaacagaacctgcgtgcgtttcccccatccagaacagcgctcctgtgtcagatctgactaagacagaacaccccaaaagctctttcaggattcaccgaatgagaaggatgggcagcgcatctaggaagggtagagtattctgcaacgcgtgcggaaaaacattctatgacaaagggaccctgaagattcattacaacgccgtacatcttaaaatcaaacatcggtgcacaatcgagggttgtaatatggttttcagtagcctccggagccggaaccgacacagtgctaatccgaaccctaggcttcatatgccaatgcttcgcaataatcgggacaaggacttaatcagagcaacatcgggggcagctacccccgttattgccagtactaaatcaaatctagcactgacctcaccaggaaggccacctatgggcttcacaacaccacccctggatcctgttcttcagaacccccttccgtctcaacttgtattttcaggactgaagactgtgcaaccagtaccacccttctaccgcagtctgctaacgccaggagagatggtgagtccccccacttccctgcccacatccccgatcatcccaacttctggtacaatcgaacagcacccccctcctccttccgagcctgtcgtgccggccgttatgatggccacacacgaaccaagtgcagatctggctcctaaaaagaagccccgtaaaagctctatgcccgtaaagattgagaaggagataattgacaccgccgacgagttcgatgatgaggatgatgatcctaacgatgggggtgccgtggtaaacgatatgtcgcacgacaaccactgccatagccaggaggagatgtctccaggcatgtcagtaaaggacttctccaagcataacaggaccaggtgtatctcaagaactgagatccgacgcgccgattcgatgactagcgaagatcaggaaccggaaagagactacgagaatgagtcagagtctagcgaacctaagctcggagaggagagcatggagggcgacgagcatatccactccgaggtttccgagaaggtgctcatgaatagtgagcgccccgacgagaaccacagtgagccctcccaccaggatgtgattaaagtgaaagaggaatttacagacccgacttacgatatgttctacatgtcccaatacggcctgtataacggcggcggagcctcaatggcagccctgcatgagagttttacctcctcgctcaattatgggtcacctcagaagtttagcccagaaggggacttgtgttcctctcctgacccaaagatctgttatgtgtgcaaaaaatcgttcaagagctcgtattctgttaagctgcactaccgcaatgtacacttaaaagagatgcatgtgtgcaccgttgcaggatgcaacgctgctttcccttcacgtaggtcccgggacagacactcagccaatatcaatctgcaccgtaaactgctgacaaaggagcttgatgatatgggtcttgactcctcacagcccagtctctccaaggatctgcgggacgagttcctggtcaagatttatggtgcacagcaccccatgggactcgatgtgcgagaggacgcaagttctcccgcaggaaccgaagattcccacctgaatggctatggacggggaatggctgaggactatatggtcctcgatctgtctactacctcttccctgcaatcatcaagcagtatacatagcagtcgcgaatccgacgccgggagtgacgaagggatccttctggatgacatcgatggcgcgtccgacagcggcgaatccgcacataaggcagaggccccagcccttcccgggtcgcttggggccgaggtgagcgggtcgctaatgttctcctcactcagtgggagcaatggtggcatcatgtgcaatatctgtcacaaaatgtattccaataagggcaccttgagggtgcattacaaaaccgtgcacctaagagagatgcacaagtgcaaagtgccagggtgtaacatgatgttttcctccgtgcgctccaggaatcgccactcccaaaaccccaacctccacaagaatattcccttcacttctgttgactag

SEQ ID NO: 180233 - DNA, 984 bp, Artificial Sequence
  Description of Artificial Sequence: Synthetic coding sequence
cccagcgagcccgtggtgcccgccgtgatgatggccacccacgagccaagcgccgacctggccccaaagaagaaaccaaggaagtcttccatgcccgttaagatcgaaaaagaaataatagacaccgccgatgagttcgacgatgaagatgatgatcccaacgacgggggggctgtggtcaacgacatgagccacgataaccactgtcatagtcaggaggagatgtcccctggtatgtctgtgaaggatttttctaagcataaccgcacacgctgtatcagtcggactgaaatccggcgagcagactctatgactagcgaggatcaggagcctgagagggactatgagaatgagtccgaatctagcgaaccaaaactaggggaggagagcatggagggcgatgaacacatccactcggaggtgtctgagaaggtgttgatgaacagcgagcgcccagatgagaatcactcagaaccttctcaccaggatgtaatcaaagtgaaagaggagttcaccgaccccacatatgatatgttttacatgagtcagtacggtctgtacaatgggggcggcgccagcatggctgcgctgcatgaatcctttaccagctcactgaactacgggagcccccagaagttctcccccgagggagatctgtgcagtagtcctgatcctaagatatgctacgtgtgcaaaaaatcgtttaaatcatcatacagcgtgaagctgcattacagaaatgtgcacttaaaagagatgcatgtctgtacagtggctggctgtaacgccgctttcccttccaggcggagccgagatagaaaccggaacctccgtatggagcgtacaataggcccagggcatagagacagtctgcacttgagacgtggaaattcaaacaggccgggtacgtgttgcctgcacactggggattcactggaagagagtgtgatagtacgaatcagttgtaaaaggcttgaatcttag

SEQ ID NO: 180234 - DNA, 2583 bp, Artificial Sequence
  Description of Artificial Sequence: Synthetic coding sequence
agcgaggaggccgaggtggacgtgcgggagcgggagacccagcgggacagagagcctaagcgagcccgggatctcacactgagggattcatgcacagacaattccatgcagtttggaacacggactactacagctgagccgggattcatgggaacctggcagaacgcagacaccaatctgctgttccggatgtcacagcaggccataaggtgcactctggtgaactgcacatgcgaatgtttccagcctgggaagatcaatctgcggacctgcgaccaatgtaaacacggctgggttgcccacgccctggataagctgagtacacagcatctataccacccgactcaggtggaaatcgtgcagtccaacgtggtattcgacattagctcactcatgctgtacggcactcaagcagtgccagttagactcaaaattctgctggacagactcttttctgtgctgaagcaagaagaggtccttcacatactacatgggttgggctggacgctgagggattatgtccgcggatatatccttcaggatgctgccggtaaggttcttgatcggtgggcgatcatgtccagagaagaggaaatcattactctccaacagttcctccgttttggcgagaccaagagcatcgttgagctcatggcaatccaggaaaaagaggggcaggctgtcgctgtgcctagctcgaagaccgacagtgatattcgcacattcatcgaatctaacaatagaacgaggtccccctcactgttggcacaccttgaaaactctaatccaagctctattcatcactttgagaatatccccaacagtttagctttcttgctgccgttccaatatatcaatcccgtgagcgcgcctctgttgggcctcccacctaatggactcttgttggaacagccggggcttaggttgagagagccctccctcagtactcagaacgagtataatgaatcttctgaatctgaagtcagcccaacgccctacaaaaatgaccagactcccaacaggaacgctctaacctccatcacaaacgtagagcccaagacagaacctgcatgcgtgagccccattcagaactccgccccggtctcagacctgactaagactgaacaccctaagtcatctttccgcatccatcgcatgcgtcggatgggttcagcgtcacggaaaggcagggtgttctgcaacgcctgtgggaaaactttctatgacaaaggaactctgaagatccattataatgctgtccatctgaagattaaacatagatgtaccatcgaagggtgcaatatggtgttcagtagcctgagatccagaaaccgacactccgccaaccctaacccacgcctgcatatgccaatgctgcgaaataaccgggataaggacctgatacgggccacttccggcgctgcgacccctgtgatcgcttctaccaaatcaaacctggccctgacaagccctggtaggcctcccatggggtttaccacccctccactggaccccgtgctacagaaccccctcccctcccagctggtgttctccgggctgaaaaccgtacagcccgtcccaccattctacaggtctcttctgactccgggtgaaatggtcagtcccccaacttctctccccacctctcccataataccgacaagcggcactatagaacagcacccaccaccaccatcggaacctgttgtccccgcagtgatgatggccacccacgagccaagtgccgatttagcacccaagaaaaagcctcgcaaatcaagtatgcccgtcaaaatcgagaaggaaatcattgacaccgccgatgagttcgatgacgaggatgacgatcccaatgatgggggtgcggtcgtaaacgacatgtcccacgacaaccattgccacagccaggaagaaatgtccccaggtatgagtgtgaaggatttcagtaagcacaaccggactcgttgcatcagtcggaccgagataagaagagcagatagtatgacgtctgaagatcaagaacccgagagggactatgagaacgaaagcgaatccagcgaaccaaaattgggagaggagtctatggagggcgacgagcatatccattccgaagttagtgaaaaggtgctgatgaattcagaacggccagacgaaaaccacagcgaaccgtcacaccaggacgtcatcaaagtaaaggaagagtttacagaccccacgtacgacatgttctatatgagccagtatgggttgtacaacggtggaggagcttctatggccgcattgcacgaatccttcactagcagcctcaactatggtagccctcagaagttcagcccagagggcgacttgtgttcctctcctgaccctaaaatctgctacgtctgcaaaaagagttttaaaagttcatatagtgtcaagctgcattacagaaatgtacacctcaaggagatgcacgtctgcactgtcgccgggtgcaacgcggcatttccaagcaggagatcaagagacagaaatagaaatctgcgtatggagaggaccatcggcccaggacaccgtgactcgctccacctgctcccaacctag

SEQ ID NO: 180235 - DNA, 1206 bp, Artificial Sequence
  Description of Artificial Sequence: Synthetic coding sequence
atggcccacctgggccccaccccccccccccacagcctgaactacaagtcagaagaccgactgagtgaacaggactggccagcctatttcaaagtgccctgctgcggtgtagatacatcacagatagagagcgaagaggcagaggtcgacgtccgggagcgagaaactcagcgcgacagggagcccaaaagggctcgggacctgactttgagagactcgtgcaccgacaacagcatgcagtttggaacacgcaccaccaccgcagagcctggattcatgggcacctggcagaatgcagacaccaatctgctcttcagaatgagccagcaggtgcccctggcgtgcacgggaagggtgcttggcgctgacttttgtcccaacctggaagagccttaccatcgcctggaagtccaggcaatacggtgcactcttgtcaattgcacatgcgaatgtttccagccgggtaaaatcaacctccgtacctgcgaccagtgcaagcacgggtgggtggcacatgcattggacaagctgtctactcaacatctgtaccacccgacccaggtcgaaatagtccaaagcaacgtcgtgttcgacatatcatcactgatgctgtacgggactcaggccgttcccgtacgcctgaagatccttctagacaggctgtttagtgttctgaagcaggaggaggtcctgcatatcctacacgggctggggtggacactgagagattatgtgcgtgggtatatccttcaggatgccgcaggtaaagtgcttgaccggtgggccatcatgtcacgggaggaggaaattataactctgcagcaattcttaagattcggggagaccaagtcaatcgttgagctcatggccatacaggagaaagagggccaggccgttgccgtacctagcagcaaaaccgactccgacattagaacgttcattgagagtaacaacagaacaaggagtccctcgctcttagcacatttagagaacagtaacccttccagcattcaccacttcgaaaatatccccaattccctggcctttctcctgcccttccagtatatcaatccagtatcagctccactgttaggcctcccccctaatggactgttgctggaacaaccaggacttcgactccgggagcctagtctctccacccaaaacgaatataatgaaagctcagaatccgaagtttccccatag

SEQ ID NO: 180236 - DNA, 306 bp, Artificial Sequence
  Description of Artificial Sequence: Synthetic coding sequence
atgtgccggctgctggtgcccctggcctgcaccggccgggtgctgggtgctgatttttgcccgaacctggaggaaccctatcatcgactcgaggtgcaggcaatcaggtgtaccttggtgaactgtacttgcgagtgctttcagcccggcaagattaatctgcggacatgtgatcagtgcaaacacggatgggtagcccacgcgctcgacaaattgtccactcaacatctctatcatcccacgcaggtcgagatcgtccagtctaatgtcgtgttcgatattagctccctcatgctgtatgggtag

SEQ ID NO: 180237 - DNA, 1233 bp, Artificial Sequence
  Description of Artificial Sequence: Synthetic coding sequence
atggcccacctgggccccaccccccccccccacagcctgaactacaagagtgaggatagactgtcagaacaagattggccggcttactttaaggttccttgctgtggcgtggacactagccagattgaatccgaagaggcagaagtagacgtcagagaaagggaaactcagcgggatcgagagccaaagcgagcgagagatctcacccttagggactcttgcactgacaattcgatgcagttcggcacgagaactactacggccgagccaggcttcatggggacctggcagaacgcggacaccaacctgctatttagaatgtcacagcaagccggcttgaagctgctgaccagcggggatcctcccgtgttagactttcagagcgcggggatcaccggtgtgagccactgtacgaggctgaaggtggccatgattagcaaagccattagatgtaccctggttaattgcacatgcgagtgttttcaacctggtaaaattaatctccgtacttgtgaccagtgcaaacatggctgggttgctcacgccttggacaagctttccactcagcatttataccaccctacccaggtcgaaatcgtccagtctaacgtggtatttgacatttctagtctcatgctgtacggaacccaggctgttccagtaagactcaagatattacttgatcggctgttctccgtgctgaagcaggaagaggttctccacattctacatggcctcggatggaccttgagagactatgtgcgcgggtatatcctgcaggacgcggctggcaaagtgctcgacagatgggccatcatgtccagggaagaagagattatcaccctgcaacagtttctgagattcggcgaaacaaagtcgatcgtggagcttatggcaatccaagagaaagaaggacaggccgtagccgttccatccagcaaaacggactcagacatcaggacttttattgaatctaataaccggactcgctctccctcgctcctcgctcatctggagaacagcaatccctcctcaatacaccattttgagaacatccctaacagccttgcctttctccttccattccagtatatcaaccccgtctccgcgcctctcttggggctcccacccaatgggctacttcttgaacagcctgggttgcggctccgcgagcccagcctttccacgcaaaacgagtataacgagagtagcgaatctgaagtcagtccttag

SEQ ID NO: 180238 - DNA, 2712 bp, Artificial Sequence
  Description of Artificial Sequence: Synthetic coding sequence
atggcccacctgggccccaccccccccccccacagcctgaactacaaatcagaggatcggctaagcgaacaggactggcctgcatactttaaagtgccatgctgtggagttgatacgtcacagatagaaagcgaagaggctgaagtggacgttagagagagggaaacccaacgggaccgtgagcccaagcgggctcgggacctgaccctgcgtgactcttgcactgacaacagcatgcaattcgggacacggacaaccactgctgagcccggattcatggggacttggcagaatgccgacactaacctgttgttcagaatgagtcagcaggccattaggtgcaccctggtgaattgcacttgcgagtgcttccaaccagggaaaatcaacctcaggacatgcgaccagtgtaaacacggttgggtagcgcacgcgcttgacaagctgtctacacagcacctataccacccaacgcaagttgaaatagttcagagtaatgtggtgttcgacatctcttcccttatgttatacggaactcaggccgtgcctgtcaggctgaagatcctactggatagattattttccgttctgaaacaggaggaggtgctacacatacttcacggactcggttggactctgcgggactacgtccgggggtatatccttcaggacgcggcaggaaaagtgttggaccggtgggctatcatgtcacgagaggaagaaatcataactctgcagcaatttctgaggtttggagaaacaaaatcaatcgttgaattgatggctatacaggagaaagagggccaggccgttgctgtcccatcgtcaaaaacggactctgatatcaggacattcattgagtcaaataataggacccggtcaccttcccttctggctcatctggagaactcaaatccatcttcaatccatcattttgaaaatattccaaactccctggcctttttgctaccctttcaatacatcaatcctgtgtccgcgcctctgctgggattaccacctaacggacttctcttagaacagcctggattacggctgcgggagccctctctgtctactcagaatgagtataacgagtccagcgaaagcgaggtttctcctaccccctacaaaaatgatcagactcctaacaggaatgcgctgacgtcaatcaccaatgtggagcccaaaaccgaacctgcgtgcgtgagccccatacagaactctgctccggttagtgatttaaccaaaaccgaacacccaaaatcctcttttagaattcaccggatgcgtaggatgggcagcgcttccagaaaaggtcgagttttttgcaacgcctgtggcaaaaccttttacgacaagggcaccttaaagatccattataacgctgttcacctcaaaatcaaacacagatgtaccatcgaaggctgtaatatggtcttctcgtcactgcgatcaaggaaccggcatagcgcgaatcctaatccccggttgcatatgcccatgcttaggaataaccgggataaggaccttataagagccacctcaggcgccgccacccccgttatcgcgagcaccaagtctaacctggctctcacgagcccgggaagaccccccatggggttcacaactccccctctcgatcctgtccttcagaatccacttccttctcagctggtgtttagcgggctgaagactgtgcagccagtacctcccttttaccgttccctgctgaccccgggcgaaatggtcagtccccctactagcctgcccaccagtcctatcattcccacaagtggtaccattgagcagcatccacccccacctagtgaacctgtcgttcctgccgtaatgatggctacccatgagccttccgcggatctggcacctaaaaaaaaacctcgcaaatcttccatgcccgtcaaaatcgaaaaggagatcatcgatacagcagacgagttcgacgacgaggacgacgatccgaatgacggcggggccgtcgtgaatgacatgtcacacgacaatcactgtcattctcaggaggagatgtctccgggcatgtccgttaaggacttctccaagcataatagaacgcgatgcatttcacgtaccgagattcggagagctgattctatgacctcggaggaccaggaacctgaacgcgattacgagaatgagtcggagtcatccgaaccaaaactgggagaagaaagcatggagggtgacgagcacatacactcagaggtgtctgagaaggtgttaatgaatagcgaacgacccgatgagaatcattcagaaccttcccaccaggacgtaattaaggtgaaggaggagttcacagatcccacgtatgacatgttctacatgagccaatacggtctgtacaatggaggaggcgcaagcatggcagcactccatgaaagtttcacaagcagtcttaactacggaagtcctcaaaaattctcccccgaaggcgatctctgctctagtcccgacccaaaaatttgttacgtttgtaaaaagagttttaagagcagctatagcgtgaagctgcattatcgaaatgtccacctgaaggagatgcacgtgtgcactgtggccggctgcaacgcggcgttccccagcaggaggtctcgggatcggtactgggagaagtccaacgaacagaacggcctgctggtgtcgtggggtgaaactctgagctctcttaaatag

SEQ ID NO: 180239 - DNA, 2712 bp, Artificial Sequence
  Description of Artificial Sequence: Synthetic coding sequence
atggcccacctgggccccaccccccccccccacagcctgaactacaagtccgaagatcgcctgtccgaacaagattggccagcttattttaaggtaccatgttgtggcgttgataccagtcagatcgagtctgaggaagccgaagttgacgttagagaacgagagacccaacgcgatcgcgagccaaagcgtgccagggacctgaccctgagggattcatgtaccgacaactctatgcaatttggcacaaggaccaccacagccgaacccggattcatggggacctggcagaacgccgataccaacttgctattccggatgtctcagcaggccatacgttgtaccctcgtgaattgcacttgtgaatgcttccagccaggcaaaataaatctccgcacatgtgatcaatgcaaacacggctgggtggcacacgctttggataaactgtcaacccagcacctgtatcacccaacacaagtagaaattgtacagtctaacgttgtcttcgatataagctccctcatgctctatggaacccaggcagtgcctgtgcgtcttaaaatcttgctggatcgcctgttttcagtgctgaagcaggaagaagtgttacatatactgcacggcctgggctggaccttgcgtgactatgtccgtggttatattctgcaggacgcagcgggtaaagtgctggaccggtgggccatcatgagcagggaagaggaaatcattactctgcagcagtttctgaggtttggcgaaaccaagtctatagtggagctgatggctatccaggaaaaggaagggcaggctgtggcagtccctagctctaagactgattcagatatcaggaccttcattgaaagcaacaaccgtacgcggtctcctagcctgttggcgcatctggaaaattctaatccatcctccatccaccactttgagaatatcccaaactcactggcctttctgctccccttccagtacattaacccggtatccgccccactgctgggtctcccgcctaacggtctgttacttgagcagcccggtctcaggctgcgagaacctagtctgtcaactcagaatgaatacaacgaatcttctgaaagtgaagtcagcccgaccccttataaaaacgatcagacccccaataggaatgcacttaccagtatcaccaatgtggaacccaaaactgaacccgcctgtgtctctcccattcagaactctgcaccagtcagtgatcttacaaaaactgagcatcccaaatcctcttttagaattcatcggatgaggagaatgggttctgcctcaaggaagggacgcgtattctgtaatgcttgtgggaagacgttttatgataaagggacacttaagatccactacaacgccgtgcacctgaaaatcaagcacagatgcacaattgaaggatgcaatatggttttctctagcctcaggagcagaaaccgccactccgcgaatccaaaccccagattgcatatgccaatgctgaggaataatcgggataaggacctgattcgggcaacatccggcgcagcaactcccgtgatagcctcaaccaagtccaatctggccttaacaagtcctgggcgcccgcccatgggcttcactacccctcctcttgaccccgtactccagaaccctctgccctcccagctggttttctcagggctgaaaaccgtgcagccggtaccgcccttttaccgttctctgctgactcctggcgagatggtgagtccgccaacaagcctcccgacatctccgataatacctacctcgggcacaatagagcagcaccctccccccccaagcgaacccgtcgtgcccgccgtgatgatggcaacacacgagccttccgccgatcttgctcccaagaagaaacctcgaaagtcttcaatgcctgtgaagatcgagaaggagattattgacacagctgacgaattcgatgatgaggacgacgatccaaatgacggaggggcggtggttaacgacatgagtcacgacaaccactgccatagccaagaggagatgtctcccggaatgtctgtgaaagatttttctaaacacaatcggacaagatgtatctccaggacggagattagacgcgctgacagcatgacaagcgaggatcaagaacctgagcgggattacgagaatgagagcgagtcatccgagcccaagcttggagaagagagcatggagggggacgagcacattcactctgaagtgtccgagaaagtcttaatgaactcagaacgccccgacgaaaatcacagtgagccgtcacatcaagatgtcatcaaggtgaaggaagagttcacagaccctacttacgacatgttctacatgtcccagtacggcctgtacaacggcggcggggcaagtatggccgcactgcatgaaagcttcaccagctccctgaattatggatccccacagaaatttagccctgaaggtgacctctgcagcagccctgacccaaagatttgttacgtttgcaagaaatccttcaaatcttcttatagtgtaaaattacactaccgcaacgtgcacttaaaggaaatgcatgtttgcactgtggctggatgcaacgctgcgtttccatcgcgccggagtcgggaccgaaataggaacctacgaatggagaggaccattgggcccggtcaccgtgactcattacaccttaggtctacatag

SEQ ID NO: 180240 - DNA, 1950 bp, Artificial Sequence
  Description of Artificial Sequence: Synthetic coding sequence
atgctgtacggcacccaggccgtgcccgtgcggctgaagatcctgctggatcgtctgttctctgtgctgaaacaggaggaggttctgcacatcctgcatggattgggttggacattaagggattatgtgcgcggttacattttacaagatgcggctggaaaggtgctagacaggtgggccattatgtcgagggaagaggaaattattacactgcaacagttcttgcgatttggcgaaacaaaaagtattgttgagctcatggcaatacaggagaaagaaggccaggcagtggccgttccgagttctaagacagactcggatatccgcacgttcattgaatcaaataaccggacacggagtccctcgctcctcgcccacttagagaattctaacccctcatctatccaccacttcgagaacattcccaactcgctggctttcctcttgccatttcagtatatcaatcccgtcagtgcacctctccttgggctgccacccaacgggctcttgcttgagcagccgggactgcgattaagagagcccagtctgagcacacagaatgaatacaatgagagctccgagtccgaagtgagccccactccctacaagaatgatcagaccccaaacagaaacgccttgacaagcatcaccaacgtagagcccaaaacagagcccgcctgtgtgtcaccgatccagaacagtgcgcccgtcagtgacctgacaaagaccgaacatcctaaaagttcctttcgcatccataggatgagacgtatgggatccgcaagtaggaaggggagagtattctgtaatgcttgcggaaagactttctatgacaagggtacccttaaaatacactacaatgctgttcatctcaagattaagcatcgctgcaccatcgagggctgtaatatggttttttcatctctgcgaagtagaaaccgccatagtgccaaccctaacccccgcctccacatgcctatgttgcgtaataaccgcgacaaagacctgatcagagccacatctggagcagctaccccagtcatcgcctctaccaaatcaaacctggccctgacatcgccgggtcgtcctcccatggggttcaccactcctcccttggatccggtgctacagaaccccctgccatcacagctcgtgttttccggccttaagactgtgcagccagtgccaccgttctaccggtcactgctcactcctggagagatggtaagccctcccacgtctctccctacatccccaatcatccctactagtggcaccattgagcagcacccccccccgccttccgaacctgtggtgcccgcggtcatgatggccacgcatgagccctcagcagacctggcgccgaagaaaaaacccagaaagagcagtatgccagtaaagatcgaaaaggagattatcgatactgccgatgagttcgacgatgaagacgatgatcctaatgacggaggagccgttgttaacgatatgagtcacgacaatcattgccattctcaggaggaaatgtccccgggaatgtctgtcaaagatttttccaagcataacagaacccgttgcatctcccggacggagatccgccgcgctgacagcatgacaagtgaagatcaagagcctgagcgtgactacgaaaatgagtcggagtcttctgagcctaaactgggggaggagtccatggaaggtgacgaacatattcattcagaggtgtcagagaaggtgcttatgaactctgagagacctgacgaaaaccactctgagccttctcatcaggatgtgatcaaggttaaggaggaatttaccgaccctacttatgatatgttttacatgtcacagtacggtctctacaatggcggcggcgcgtctatggctgccctccacgaaagtttcacctcctctttgaactacgggtccccacaggtactgcctcggcggtag

SEQ ID NO: 180241 - DNA, 3015 bp, Artificial Sequence
  Description of Artificial Sequence: Synthetic coding sequence
atgaccgacgacgtgaaggagcccagccggttcagcctgctgctggccatacgttgcactctggtgaactgcacatgtgagtgtttccaaccaggcaagattaatctgaggacatgcgaccaatgtaagcacggctgggttgctcacgctttggataagctcagcacccaacacctgtaccatcctacacaagttgagatcgtgcagtctaacgtggtctttgacatcagctctctgatgctttacggcacccaggccgttccggtgcgactcaaaatacttcttgatcgactgttcagcgttttgaaacaggaagaagtactccatatcctgcatggcctggggtggacccttagagactatgtccgcggctatattcttcaggatgccgctggaaaagtgctggaccggtgggcaattatgtcaagggaagaggagataatcactctgcagcagttcctccgattcggagagacaaagtctattgtggaactgatggcaatacaggagaaggagggtcaggccgtggctgttccttctagcaagaccgacagtgatatccgcaccttcatcgagtcaaacaacagaactaggtctccatcactgttggctcatctcgagaactccaatccaagctccattcatcactttgagaatattcccaacagtctggctttcctgctccctttccagtatattaatcccgtaagcgctcccctccttggtctgccgcccaacggcctgctgctagagcagcccggcttacgactcagggagccttccctgtccactcagaacgagtacaacgagtcttctgagagtgaagtgagccctactccctataaaaatgaccagacaccaaatcggaatgcgttgaccagcatcaccaacgtggagccaaaaactgagcccgcttgcgtgtcacctatccaaaactctgcacccgtatcagacttgacgaagacagagcatcccaaaagttcgtttaggattcatcgcatgcgaagaatgggatccgcgtcgcggaaaggccgggtcttttgcaacgcatgtggtaagactttttacgataagggcacattgaagatacactacaacgcagttcacttgaaaattaaacatcgttgcaccattgagggttgcaatatggtgttctcgtcactgcgatctcgcaaccggcactcagccaaccctaaccccaggctgcatatgcccatgctccggaataatcgggacaaagatctgatcagggccactagtggcgccgcaacgccagtgattgcttctacaaagagtaatctagccttgacttcaccaggaaggccgcctatgggtttcactactcctcccctggatccagtccttcagaacccactcccctcacaactggtcttcagcggattgaaaacggtccagccagtaccacccttttaccgctcactgcttaccccgggcgagatggtgtcacctcccaccagcctcccaacgtcacccattataccgacaagcggcactatagaacagcatccaccgccaccaagcgagcctgtcgtccccgccgtcatgatggctactcatgagccctccgccgacctggcccctaagaagaagccacgaaaatctagtatgccggtgaaaatcgagaaagaaatcatcgatactgcagacgaattcgacgatgaagacgatgaccccaacgacggcggggccgtggtaaacgacatgagtcacgataaccactgccactctcaggaagaaatgagccctggtatgagtgtgaaggatttttccaagcacaataggacacggtgcatctctaggacagaaataaggcgggcagacagtatgacttcagaagatcaagagcccgaacgcgactatgaaaacgagtcagaaagctccgagcccaagctaggcgaggaatccatggaaggggatgagcatattcattcagaagtgagtgagaaggtacttatgaacagcgagagacctgatgaaaaccactcagagccctctcatcaggacgtgatcaaggtcaaggaggagtttacagatcccacgtatgacatgttttacatgagtcagtatggcctatacaacgggggaggggccagtatggcagctctgcacgaaagcttcacctctagccttaattacggctcccctcagaaattttcccccgagggggatctctgtagttcccctgatcctaaaatctgctacgtgtgcaaaaaatcattcaagtcatcatatagcgtgaaattgcattacagaaacgtgcacctcaaggaaatgcacgtttgcacagtcgccggttgcaatgccgcttttccatcccgtcgatctagggatcgtcactccgctaacattaacctgcataggaaacttctgactaaggaactggatgatatgggcctggattcgagccagccttccctcagtaaggaccttcgcgacgaattcctagttaagatctatggagctcagcaccccatgggtctggatgtcagagaagacgcttcttcccccgccgggacggaggacagtcacttgaatgggtatggaaggggaatggccgaggactacatggtccttgatctaagcacgacgtcatctttgcagagtagctcttcaattcattcctctcgagagtcagacgctggcagtgacgagggaattcttctcgacgacatcgatggagcatcagatagcggcgagagcgcacacaaggcagaggcgcccgcccttcccggaagcctgggcgccgaggtcagtggctccctgatgttttcaagcctgagcggcagcaacggcggcattatgtgtaatatatgtcacaagatgtatagtaataagggaacccttagggtacattataaaacagtacacctgcgagaaatgcataagtgtaaagttcctggctgcaatatgatgtttagctcagtgagaagccgcaaccgacattcgcaaaatcctaaccttcataaaaatatcccattcacctccgtcgactag

SEQ ID NO: 180242 - DNA, 11781 bp, Artificial Sequence
  Description of Artificial Sequence: Synthetic coding sequence
atgggcaacgaggtgagcctggagggcggcgccggcgacggccccctacccccaggtggagccggcccagggcccgggcccggaccaggacccggagcgggtaagcccccctcagctcccgccggaggcggacagctaccagccgccggggccgctcggtcgacagctgtgcctccagtgcccggccccggcccagggccaggaccaggacccggtcctggatcaacgagccgccggctggatcccaaagagccattggggaatcagagagccgcttctcccacacctaagcaggcttccgccaccactccgggacacgagagccctagagaaacccgggcccagggacctgctggccaggaggctgacgggccccgaaggacactgcaagttgactctcgtacacagcgatctgggcggtctcccagcgttagccctgatcgcggttccacccctacttctccttactccgtgcctcagatagctcccttgccctcttccaccctctgtccgatttgtaagacctcagatctcacatcgaccccaagtcagcctaatttcaacacctgtacgcagtgtcataacaaagtctgtaaccaatgcggtttcaaccccaatccgcacctgacacaggtcaaggagtggctgtgcttaaattgtcagatgcagcgcgcgctgggcatggatatgaccacagcaccccggtccaagtctcagcaacaactgcattcccctgcccttagtcccgcgcactcaccggctaagcaacctctgggaaaacccgatcaggagcgaagtagaggcccaggggggccccaacctggcagtcgtcaggccgaaacagctcgtgcgacctcagttcccggtccggctcaagcggcagccccacctgaggtcgggcgggtttctccacagcccccacagcccacaaaaccatctacagcagagcccaggcctcctgcgggagaagccccagccaaatccgccacagctgtgcccgccggtctgggagctactgagcaaacgcaggagggcctgacaggcaaactgtttggacttggcgcgtcattactcacgcaggcttctactctcatgtccgtccagcctgaggccgacactcagggtcaaccggctccctcgaagggaaccccgaaaatcgtgtttaacgatgcatcgaaggaagccggccccaaacctctgggctcaggtcctggtccaggtcccgctcctggcgcaaaaactgagccaggagcgcgcatgggtcccgggagcggccctggtgctctcccaaagacgggtggcaccactagtcctaagcatggccgggcagagcatcaggccgccagcaaggccgccgccaagcccaagaccatgcctaaggaacgcgcaatttgccctctgtgccaggctgagttgaatgttggctccaaaagtcccgcgaattacaatacctgtactacatgtcgcctgcaagtatgtaatctgtgtggtttcaatcccaccccgcatctggtcgaaaagactgagtggctgtgcctaaactgtcagactaagcggttgctcgaaggtagcctcggcgagcccacacctttgccgccacccacctcacagcaaccccctgtcggcgcaccacatcgcgcttccggtacatcaccacttaaacagaagggtccacaagggttggggcagccaagtgggcccctacccgcaaaagctagtccactgtctaccaaagcctctcctttacccagtaaagcttcaccacaggctaagccccttcgggccagcgagcctagcaaaaccccttcctctgtgcaggaaaagaagacacgggtaccgaccaaagctgagccaatgcctaaaccccctccggaaactactcccacgcctgctacacccaaggtaaagagtggggttagaagggccgagcctgcgactccagtagtcaaagctgtccctgaggctcctaaggggggagaagctgaagaccttgtcgggaaaccctactcccaagatgcaagcagaagccctcagagcctgtcagacactgggtactcttctgatggaatttcatcatcccagtcggagataacgggagtggtgcagcaagaggtcgagcagctggatagcgcaggggtgactggacctcaccctccatccccatctgagattcataaggtcggcagttcaatgagaccacttctgcaagcccagggcctcgcaccctctgaacggtcgaaacctctatcttctggaacgggagaagagcagaaacagagacctcattcactgagcatcactccagaggcttttgattctgatgaagagctagaggatatcctggaagaagacgaagactctgccgagtggcgccgccggagggaacaacaggataccgctgaatcaagcgatgactttggcagccagcttagacacgactatgtggaagacagttcggaaggaggcctctcacctcttcccccgcagccacctgcccgagctgccgaattaacagacgaggactttatgcgccgccaaatcttagaaatgtctgcagaggaggacaatctagaagaagatgatactgccacctccggaagagggctcgccaagcatggcacacagaaaggaggccctagacctagaccggaacctagccaagaacccgcagctctgcccaagcgtaggctgcctcataacgcaactacgggctatgaggaactgctcccagaggggggaagtgcagaggctacagacggcagtggcacattacagggcggcctgcgaagattcaagactattgagctcaacagtaccggcagttacggacatgagttggatcttggccaagggcctgatccctccctggaccgggagccggaactggaaatggaatccctgacgggctcccccgaagatcggtccagaggtgagcactcttctacactccctgccagtaccccttcttacacaagtggaacgtctccaacctccttgtcctccctggaagaggacagcgattcgtcccctagccgaaggcagcgcttggaggaggccaagcagcagcgcaaggcacgccataggtcacatggacctctgttgcctaccatcgaggattcttcggaggaagaagaactgagagaggaagaagagctgctgcgtgaacaggagaagatgagggaagtcgagcagcagaggatccgatctacagctaggaaaactaggcgtgacaaggaggagttacgtgcgcagcggaggagggagcgatctaagactccccctagcaacctcagtccgatagaggatgcctcgcccactgaggaacttcgtcaggcagcagagatggaggaactccacagatcgagctgtagtgagtacagtccatctccctctctcgacagtgaggcggaggcattagacggaggtccatcccgactgtacaagtcagggtcagagtacaaccttccaacatttatgagcctgtacagtcctacagaaacaccatccgggagttccaccaccccatcctccggcagacctttgaaatctgctgaagaagcttacgaggaaatgatgcgtaaggccgaactgctgcagcgtcaacaggggcaggccgccggagccagaggacctcacggaggacctagtcagccgacaggacctcgggggctgggtagttttgagtaccaggacacaacagatcgggagtacggacaggcggcccagcctgccgcggagggcacccctgccagcctgggggcagctgtgtatgaggaaatcttacagacctcacagagtatcgtccgcatgcggcaggcctcctcacgggaccttgctttcgcagaagacaaaaaaaaagagaaacaattcctgaacgctgaaagcgcctatatggacccaatgaaacaaaacggaggccccctgacccccgggacaagtcctacacagctggccgcacctgtctctttttctacaccaaccagttctgattccagtggtgggcgcgtcatccccgacgttcgtgtcacccaacacttcgcaaaagagacccaagatcctcttaaactgcatagttctccggccagtccatcctccgccagcaaagaaataggaatgccattttctcagggaccaggcacacctgctacaacagcagtggcaccatgccccgccggcctgccccgagggtatatgactccagccagccctgcagggagtgagcggtcaccatccccatcttccactgctcacagctacggacattccccgacaactgcgaactacgggtctcaaactgaagacctgcctcaggcacccagcggcctggcagccgccggtcgcgctgctcgtgaaaaacctcttagcgcctccgacggcgagggaggcacccctcagccaagtagggcctattcttactttgcctctagcagtccacccctgagcccctcctcaccctccgaaagtcctacgttttcgcccggcaaaatgggacctagagcaacagctgagttttccacacagaccccgtcgccagcccccgcttccgacatgcctcgctcccccggagctcccacaccaagccccatggttgctcagggtacgcagactccccatagacccagcaccccaagactggtatggcaggaatctagccaggaggcaccctttatggttatcactctggcctccgatgcctcctcacagaccagaatggtgcatgctagcgccagtacctcccccttatgcagtccgaccgagacgcagcctaccacacacggttactcccagacgacaccaccctccgtgtcccaactcccacctgaacccccgggcccccctggattcccaagagtcccttctgcgggcgccgacggccccctggcgttgtacggttggggtgccctcccggccgaaaatatctctctctgcaggataagctccgtacctgggaccagtcgggtcgagcctggaccccggacccctggaacagctgtggttgacctcagaacagccgtcaaaccgaccccaatcatcctgaccgaccagggcatggacttaacgtcgcttgccgttgaggccaggaagtacggactggcactcgatcctatccccggccggcaaagtacggccgtgcagccgctggtcattaacctaaatgcccaggaacacacctttctcgcgacagctaccacagtctccatcacaatggcttctagtgtgttcatggcccagcagaaacagccagtggtgtacggcgacccctaccaatccagactggactttggccagggcggcggaagccccgtgtgtctcgcccaggttaaacaggtggaacaggccgtacagacagcaccttataggagtgggccccgtggccgacccagagaggccaaatttgcgcggtacaacttgcccaaccaggtggctcccttagctagacgagatgttttgattactcagatggggaccgcacagagtatcggcttgaaacctgggcctgtgccagagccgggcgcggaacctcatcgggcgacgcctgcagagcttcgaagccatgcgctgcctggagcccgtaaaccgcatacagttgtcgtccagatgggggagggaactgccggtacagttacaaccctgttgccggaggaacccgccggggccttagatctgaccggtatgcggccggagagtcaactagcctgctgcgacatggtgtataaattaccctttggctcaagctgtacgggtacgttccatcctgccccttcagtgcctgagaagtcaatggcagatgctgcgcctcctggccagagcagcagccccttttatggcccacgcgacccagaacccccagagccacctacttatagagcccagggggtcgtgggcccggggccccacgaggagcagcgaccgtatccccagggcctgcccggacgcctgtacagcagcatgtcggataccaatctggccgaggcagggttgaattatcatgctcaacgtatcggacagctctttcaaggccctggccgggattctgcgatggatctcagtagcctaaagcatagctactccctgggctttgcagacggtaggtacctgggccagggcttacagtacggctctgtgactgatctgcgtcacccaactgatctcctggctcaccccctgccaatgcggaggtattcaagtgtctccaacatatattccgatcaccgttacgggccacggggcgacgcagttgggttccaggaggcaagcttagcacagtacagcgctacaacggcccgagaaatctcgcgcatgtgcgccgccctgaattcaatggaccagtatgggggacgacatgggtcaggcggcggaggcccagatcttgttcagtaccagccccaacacggacctggcctctctgcaccacagagcctggttccgctcagacctggcctccttggcaaccctacgttcccagaggggcatcccagccctggcaacttggctcaatacggaccagcagccgggcagggtaccgccgtccgccagctgctgccttctactgctaccgtgagggcagcggatggtatgatatatagtaccattaatacaccgatagctgccaccttgccaataactacacagcctgcctcagtcctgcgccctatggtccggggtgggatgtatcgaccctacgcctccggcggaataaccgccgtgcctctcacctccctcacccgcgtacctatgattgcccctagggttccattgggtcccactgggctgtaccgttatcctgctccatctagattccctattgcgtccagcgtccctcctgctgagggaccggtgtacctcggaaagcccgcagctgcgaaggcaccaggagcgggcggcccctcaagacccgaaatgcccgtgggcgcagcccgtgaggagcccctgcccacaaccacccccgccgccatcaaggaggctgccggcgctcctgcccccgctcctttggctggtcagaaaccgcctgccgacgctgctcccggtggggggtcaggcgccctaagccggccgggtttcgaaaaggaagaagcttctcaggaagaacgacaacggaaacagcaggagcagctgcttcagttagagcgggaacgggtcgagctggaaaaacttcggcagctgagactgcaggaggaactggagcgagaacgggtggagctgcagaggcatcgggaggaagaacaactgctggtccaaagagagctgcaggagctgcagactattaagcaccatgtgctgcagcagcaacaggaggagcggcaggcacagtttgcactccaaagagagcagctggctcagcaacggctccagctggagcagatccaacaacttcagcagcagcttcagcagcagctggaagagcagaagcagagacagaaagcgcctttcccagcagcttgtgaagcacctggccggggcccccctctggctgccgctgaattggctcagaacggccaatactggccccccctgacgcacgccgcatttatcgcgatggcaggcccagaggggttggggcagcctagagagccagtgctgcacaggggcctgccaagctccgcgtcagatatgagcctgcagaccgaggaacagtgggaagcaagtcgatcagggattaagaagcggcactcaatgccccgactgagggatgcttgcgagttggagtctggcaccgagccatgcgtcgtgcgccggattgccgatagctcagtgcagacagatgatgaggacggcgaatccaggtatctgctttcgagaaggcgacgagccagaagatccgctgattgcagcgtgcagactgacgatgaggattctgcagagtgggaacagcccgttcgccgacggaggagtagactaccccggcatagcgacagtggtagcgatagtaaacacgatgccactgccagctcaagcagcgccgccgccactgtgagggcaatgtccagcgtggggattcagactataagcgattgcagcgtgcaaactgagccagatcagcttccacgcgttagtccagccatacatattactgcagccaccgacccgaaagtagaaatcgtacgctatatcagcgcacccgaaaagacaggccgaggagagtccctcgcttgccagacagaacccgatggtcaggcgcaaggagtggcagggccccagttggtgggtcccacagccatcagcccatatctccctggaatccaaatagtgactcccggcccactgggacgcttcgaaaagaaaaaaccagaccctctagagataggataccaggctcatctgccacccgaatctctgtcccagctcgtttcccggcagcccccaaaatcacctcaggtattgtatagccctgtcagtcccttaagtccgcacagactgctcgataccagcttcgcctcgagcgagaggttaaataaagctcacgtttccccacagaaacacttcacggccgattccgctctgagacagcaaacactacctagacccatgaagacactccagaggtcactgtctgatcccaagcctttgagtccaaccgcagaggagtccgccaaggaaagatttagcttgtaccagcaccaaggcggactggggtcccaggtgagtgctctccctcctaactctttggtccgcaaagtgaaacggacattgccatctcctccccctgaggaggcccacctgcctctggcaggccaggcttctccacagctttacgcagcctccctactccaaaggggcctgacaggtcccaccaccgtgccagctacgaaggcttctctcctgcgtgagttggacagagatctaagactggtagagcatgaatctaccaaacttagaaaaaaacaggccgaacttgatgaagaagagaaagaaatcgacgcaaaactgaagtacctggagcttggtataacccagaggaaggagtccctggctaaagaccgcggaggaagggattacccaccactgagaggccttggggagcaccgagactatctgagcgattcagagttaaaccaattaagactgcaagggtgcacaacaccagctggtcagtttgtggatttccctgcaacggccgcggcgccagcgacaccgtcagggccaacagcctttcaacagcctcgcttccaacccccagccccacagtacagtgctggtagcggcgggccaacccagaatggtttccctgctcaccaagcaccaacttaccctgggcccagcacataccccgcacccgctttccctcctggtgctagttacccggcagaaccaggcctgcccaatcagcaagcctttcgcccaacgggccactatgccggtcagacgcctatgcccacgacacaaagcacgttgttccccgtgcctgctgattctagggcaccactacagaaaccacggcagacttctctcgccgatctagagcagaaagtgccaactaactacgaggttattgcctcacccgttgtgcccatgtcctctgccccctctgagactagctattcagggcctgcagtgtcttctggttacgagcaggggaaggtgccagaagtgcctcgagctggtgatcgcggatctgtcagtcaaagtcccgcaccgacctaccccagcgactctcactatacttcattagaacaaaatgtcccccgcaattatgttatgatcgacgacattagcgaactcacgaaagatagcacctctaccgccccggacagtcaacggctggaacctcttgggcctgggagctccgggagacctggaaaggaaccgggggagccgggagtcctcgacggccctacactgccatgttgttatgcccgcggtgaggaggagagtgaagaggacagctatgatcctaggggcaagggaggccatcttagatcgatggagtcaaatggtcgaccagcctccacccactactatggcgattctgattacagacatggcgctagagtagaaaaatatggtcctgggccgatggggccaaaacatccctctaagagcttggcccctgccgccatatcatccaaacgctccaaacaccggaaacagggcatggagcagaaaatcagcaagttctcccccattgaggaggccaaagatgtggaatcagatctagcatcataccccccccccgcagtgtcttcctctctagtcagccgcggccgcaagttccaggatgagatcacgtatgggcttaaaaaaaacgtttacgaacagcagaagtattacgggatgagttctagagacgcagtcgaagacgacagaatttacggagggagctctaggtcccgggcacctagtgcctactcaggagaaaagctgtcgagtcatgacttctcaggctgggggaagggctacgagcgcgagcgagaggctgtggagaggttgcagaaagctggccccaagccaagctcactcagcatggctcacagcagagtaagacctcccatgcggtcacaggcttcagaggaagaaagtccagtctctcccctggggcgcccacgcccagcgggcggtcctcttcctcctggtggcgacacctgtccacagttttgcagttctcatagtatgcctgacgtgcaggagcacgtgaaggacggcccgagggctcacgcatacaaacgggaagaagggtatattctggacgacagccactgcgttgtctccgattctgaggcttaccacttaggtcaggaagaaaccgattggtttgacaaaccccgagatgctagatctgacagatttcgacatcacgggggacacgccgtaagttctagttcccagaagagaggtcccgcccgccattcttatcacgactacgacgaaccacccgaagagggcctatggccccatgacgagggcgggccaggccgacatgccagtgcaaaagaacacagacacggcgaccacggtcgtcactctggacgtcacactggagaggaaccaggccgcagagctgccaagccacacgcacgcgatctcgggcgtcacgaggctagacctcattcccagccctccagtgctccagctatgcccaagaaaggccaacccggctatccctcctcggctgaatatagtcagccctcacgtgcctctagcgcttaccaccatgcatctgactctaagaaaggctcccgccaagcacacagcggaccggcagctttgcaatccaaagcggaacctcaggcccaacctcagctgcaagggagacaggcagccccaggaccacagcaaagccagagcccctctagcaggcaaatcccttcgggcgctgcttcacgtcagccgcagactcagcagcagcagcaagggttaggtcttcagccgccccagcaggctctgacgcaggctcgcctgcagcagcagtcccaacctactactaggggatcagctcccgctgcgtcacagccagccggtaagccccaacccggaccttcgaccgcgaccggaccccagcccgccgggccacctagggccgagcagaccaacggctcaaagggaaccgccaaggcccctcagcagggccgcgcacctcaggcccagccagcgccggggccaggtcctgccggagtgaaggcgggggcacggccaggcgggacacccggtgccccagccgggcaacccggtgccgacggcgaaagtgtgtttagtaagattctgcctggcggcgctgccgagcaggccggaaagctgacagaagccgtttccgccttcgggaagaaattttcaagtttttggtag

SEQ ID NO: 180243 - DNA, 702 bp, Artificial Sequence
  Description of Artificial Sequence: Synthetic coding sequence
atggagcccaccgcccccagcctgaccgaggaggacctgaccgaggtgaaaaaagacgcgctcgaaaacctgagagtgtacttgtgcgagaagattatcgcagaacgacatttcgaccacttgcgggcgaagaagattctgagtcgagaggatacagaggagattagctgccgcacttcttccagaaagcgtgcggggaaactcctcgactacctccaggagaatcctaagggtctcgacactttagtcgagagtatccgccgtgagaagactcaaaacttcctcattcagaaaattactgatgaagtgctcaagcttcggaatatcaagctggaacatttgaaaggcctgaagtgctcctcatgtgagccattccccgatggcgctaccaataacctatcccgaagcaactcagatgagtctaacttttctgagaagctgcgcgccagcactgttatgtatcatcccgagggagaatcctccacaactccattttttagtacgaactcgagcctgaacctccctgtcctggaagttggccgtacagaaaataccatttttagttctacaaccctgcccaggcccggagacccaggggcaccccccctgcctcctgatctgcaactcgaggaagagggcacctgtgcaaattcatccgagatgttccttcccttgaggagccggaccgtatccaggcagtag

SEQ ID NO: 180244 - DNA, 702 bp, Artificial Sequence
  Description of Artificial Sequence: Synthetic coding sequence
atggagcccaccgcccccagcctgaccgaggaggacctgaccgaggtgaaaaaggatgctttggaaaacctacgggtttacctctgcgagaaaattatcgctgaacgtcattttgatcatttacgagcaaaaaagattctgagcagggaggacacggaagagatctcttgtcgaacctcctctcgaaaaagagccggcaagctgctggattatctccaggagaatcctaaaggtcttgataccctggtcgaaagtattcgtagagaaaagacccagaacttcctaatacaaaaaattacagacgaggtgctgaaactgcggaatatcaagctggaacatctgaagggtctgaagtgcagcagctgcgagccctttccggatggagctactaacaacctgtcaagaagtaactccgacgagagcaatttcagcgagaagttgagagcctcaaccgtgatgtaccatcccgagggtgaatcaagtaccactccttttttctctaccaatagcagtctaaacctacctgtgctcgaggtaggtcggaccgaaaatacaatcttttcttctaccactctgccgcggccaggggaccccggggccccccccctcccccccgacctgcagcttgaggaagagggaacctgtgctaatagctcggaaatgtttctgcccttacgtagtagaactgtgagccgccagtag

SEQ ID NO: 180245 - DNA, 471 bp, Artificial Sequence
  Description of Artificial Sequence: Synthetic coding sequence
atggagcccaccgcccccagcctgaccgaggaggacctgaccgaggtgaaaaaggatgccctcgagaatttgcgtgtgtacctttgcgagaaaatcatagcagaaaggcattttgaccatctgcgagcgaaaaagattctctccagagaggatacggaggaaattagttgtcgtacctcttcaagaaagagggcaggcaagttgctggactatctgcaagagaaccctaagggtctggatactctcgtagaaagcattcgacgggagaagactcaaaacttcctaatccagaaaataaccgatgaagttctcaaactccgtaacatcaagcttgagcacttaaaagatggtgcgaccaacaacctgtcccgttcaaactccgatgagtccaacttctccgaaaaactccgcgcgtctaccgtcatgtaccacccggagggagagtcatcaacgacaccgtttttttactag

SEQ ID NO: 180246 - DNA, 2508 bp, Artificial Sequence
  Description of Artificial Sequence: Synthetic coding sequence
atgagccggcggaagcagggcaagccccagcacctgagcaagcgggaattctcacccgaaccccttgaggccatcctaacagatgacgagccagatcacgggccactgggagctcctgagggcgatcacgaccttctcacatgtggccagtgccaaatgaattttccattaggagacatactgatttttatagagcacaagcgtaagcagtgcaatgggtctttatgcctcgaaaaagccgtggataagccaccttcgcccagtcctatcgagatgaagaaggctagtaatcccgttgaggtcggaattcaggtgactcccgaggacgacgattgcctgagcacgagcagccgcggtatttgcccgaagcaggagcacatagccgacaaactcttgcactggagaggcctctcatctcctcggtcagcccacggagctctaattcctacccccggaatgtccgccgagtatgccccacagggcatttgtaaggatgaaccaagttcctacacttgcacaacctgtaagcaaccgttcacatctgcttggttcctccttcagcatgcccagaatacacatggcctgaggatttatcttgagagtgaacacggatctcccctgaccccccgggtcggtatcccttcagggctgggggctgagtgcccttctcagcccccactgcacggtatccacatcgccgataataaccctttcaatctgctgaggattcctggctctgtctccagagaggctagcggtctagcagaaggacgattccctcccaccccccctcttttctctcctccaccgcgtcaccatttggacccgcacaggattgagcggctcggggccgaggaaatggccctggcgacccaccacccatctgccttcgatcgagtgctgcggctcaatcctatggccatggagccacccgccatggatttctctcgaagactgagggaactggctggtaacaccagttcccctccactcagtcctggccgcccttctcccatgcaacggctgcttcaaccattccaacctggttcaaagccacctttcctggcaacccctcccctgccccccctgcagtctgcgcctccccctagccagcccccagtaaaatctaagtcgtgcgagttttgcggtaagacattcaagttccagtccaatcttgtggtgcacagaagaagtcacacaggagaaaagccatataagtgtaatctatgcgatcacgcgtgtactcaggcatctaagctcaagaggcacatgaaaacccatatgcacaaatccagccccatgactgtaaagtccgatgacggcctaagcactgcttctagcccagagccaggaactagcgatctggtgggatcggcatccagcgccctgaaaagtgtagtggctaaatttaaatccgagaacgatcctaacctgatcccggaaaatggcgatgaggaggaggaagaggacgacgaggaggaggaggaggaagaggaagaggaagaagaggagctgactgaaagcgaacgtgttgattacggctttggattgtccctggaggcagcaagacaccatgagaattcatctcgcggagcagtggtgggagtgggtgatgagtcaagagcccttcctgatgtgatgcaaggaatggtgctgagcagcatgcagcacttttcggaagctttccaccaggttctcggggagaaacataaacgcggtcacttggccgaggccgagggacaccgcgatacctgcgacgaggatagcgtggctggtgaatccgaccgcatcgatgacggcaccgtaaacggcagagggtgcagccctggtgaaagcgccagcggcggtttgtcaaagaagctattgctggggagcccaagtagcttgagcccattcagcaagcgtattaaactcgaaaaagagttcgaccttccacctgccgccatgcctaataccgagaacgtctactcacaatggctcgccggatatgccgcttctcggcagctgaaagaccctttcttaagttttggcgatagtaggcaaagcccttttgcctcatccagcgagcatagtagcgaaaatggcagcctacgatttagcacccccccaggagaattagatggcggcattagcggtagaagcgggacaggctcggggggatcgaccccgcatattagcggccccggacctggaaggccaagctccaaagaaggcagacgtagcgacacatgcgagtattgcggcaaggtgttcaagaattgtagtaatctcacggtgcacagaagaagtcatactggtgagcgaccctataaatgtgagctctgcaattatgcttgcgcacagtcatctaagctaaccaggcacatgaaaactcacggtcaagtgggcaaggacgtgtacaaatgtgagatttgcaaaatgcccttctccgtctatagcaccttagaaaaacacatgaagaagtggcattccgatagggtgttgaacaacgatataaaaaccgaatag

SEQ ID NO: 180247 - DNA, 2322 bp, Artificial Sequence
  Description of Artificial Sequence: Synthetic coding sequence
atgagccggcggaagcagggcaagccccagcacctgagcaagcgggagtttagcccggagccactggaggctatcctgaccgacgacgagcccgaccatggtcccctcggagcccccgagggtgaccacgatctgctcacctgcggccaatgtcaaatgaattttcccttgggcgatatcctcatttttattgaacacaaacgaaaacagtgtaacggatccctctgtctagaaaaagcagtggacaaacctccatctccaagccccatcgagatgaagaaagcctccaaccctgtcgaagtaggtatccaggtcactcctgaggatgacgattgtttgtcgacttcttcaaggggaatctgtccaaaacaggaacatatcgccgataaattgttgcattggcgcggcctctcgagtcctcggagtgcccacggggcactcatacccacccccggaatgagtgccgaatacgcaccccagggcatctgcaaggatgagccgtcatcttatacctgtacgacctgcaaacagcccttcacatccgcctggtttttgttgcagcacgctcaaaatactcacggtctgaggatctacttggaatccgagcatgggtcaccacttacccctagagtcgggatcccatctggcttgggggccgagtgtccgagccagccgcctttgcacggtattcacattgcggataacaaccccttcaatttgctaagaataccagggagcgtgtctagggaggccagcggactggccgaaggacgtttcccccctacccctccactattctcccccccacccaggcatcacctcgatcctcaccgaatcgagcgactcggcgccgaggaaatggcacttgctacacatcatccatctgccttcgatagagtgttaaggttgaatcctatggccatggaaccccctgctatggatttctcccgtagattgagggaactggccgggaacacgagctcccctcccctgagtcctggcagaccttcccctatgcagcggttgcttcagccctttcagcccggaagcaagcccccttttctggctactcctcccctcccccctttgcaatcggcgcccccaccctcgcagccccctgtaaagtccaagagctgtgagttttgtggcaagacattcaagtttcagtccaacctggttgtgcaccggagatctcatacaggcgagaaaccttacaaatgtaacctttgcgaccacgcgtgcacgcaggcaagcaaattgaaacgtcacatgaagacccatatgcacaagagcagcccaatgacagtgaagagcgacgatggactgagcactgcgagcagccctgagcccggcacaagtgacctggtgggcagcgctagctccgcccttaagtctgttgtcgccaaattcaagagcgagaatgacccgaacttgatcccagaaaatggggatgaggaggaggaagaggacgacgaggaggaggaggaggaagaggaggaggaggaggaagagctgaccgaaagcgagagagtcgattacggcttcggactatccttggaggcagcacgccaccatgaaaactctagcagaggagccgtggtaggtgtgggagacgagtccagagcactgcccgacgtaatgcagggcatggtcctgtcaagtatgcagcacttctctgaagctttccaccaggtccttggcgagaagcacaagagagggcacctggctgaagccgaagggcatcgcgacacttgcgacgaagacagtgtcgctggggagtcagatagaatcgatgacggtactgtgaacggaagaggatgctcaccgggcgagtcagcatccggaggattgagcaaaaaactcctgctgggcagtccttcttctctctcgccttttagcaagcggatcaaactggaaaaggagttcgacctccctcccgctgccatgcccaataccgagaatgtctactctcagtggctggccggctacgcggcctctagacagcttaaagacccttttctttcattcggagattctagacagtcgccatttgcctccagttcagaacattccagcgaaaatggaagtctgcggttttctactcctccaggggagctggatggcggcattagtggacggagcggaacagggagtggtggatctactcctcacatatccggtcctggtccaggtagaccttcgagcaaggaagggagacgctcagatacgtgctcctcccatactcctatccggaggtccacccagagagctcaagatgtgtggcagttctccgacggttcgtcccgggcgctgaaattctag

SEQ ID NO: 180248 - DNA, 2406 bp, Artificial Sequence
  Description of Artificial Sequence: Synthetic coding sequence
atgagccggcggaagcagggcaagccccagcacctgagcaagcgggaatttagcccagaaccactcgaggctattctgactgacgatgaacccgatcacggaccccttggcgctcctgagggcgaccatgatctgctaacatgcggccagtgccaaatgaactttcctctgggcgacattctcatctttatcgagcacaaaagaaagcaatgtaacggttctctgtgcttggagaaagctgtcgacaagccaccatcccccagcccgatcgagatgaaaaaggcatctaaccccgtagaagtgggaatccaggtgacaccagaggatgatgattgtctcagcacaagttcccggggaatatgtcccaagcaggagcatatcgcaggaaaggacgagccttcatcgtacacatgtacaacctgtaagcagccttttacctccgcctggttccttcttcagcacgcacagaatacacatggcctacgtatttatttggaaagcgagcacggctccccactgactccaagggtaggcataccctccggcctgggagccgaatgccccagtcagccgcctcttcatggcatacacattgccgacaataatccctttaacctcctaagaatcccaggctccgtcagtcgggaggccagcggactggcagagggtcgcttcccacccaccccccccctattttctccaccgcctagacatcacctggatccccacagaatcgagagattgggggcagaggagatggccctagctactcatcatccttctgcgttcgacagagttctgaggctgaaccctatggccatggagcctcctgcgatggacttttcgcgcagactgagagagctagccggaaatacctcttcacctccgttatcccctggacggccctccccaatgcagagactgctccagccctttcagcctggaagtaaacctccattcctggctacacccccactgccaccactgcagtctgctcctcccccaagccagccccccgtaaagtccaagagttgtgagttttgcggcaagacttttaaatttcagtcaaatctcgttgttcaccggagatcccacaccggcgagaaaccttacaagtgtaacttatgtgaccatgcttgtacacaagctagcaagcttaaacgccacatgaagacccacatgcacaaatctagccctatgactgtgaaatccgatgacggactgagcacggcgagttctcccgaaccaggtacttcagatctagtgggctctgcgtcaagcgccctgaagtctgttgttgccaagttcaaatcggagaatgaccctaatctgattccggagaacggagatgaggaggaggaggaagatgatgaagaggaggaagaagaggaagaagaggaagaagaggaattaaccgagtccgaaagagtggactatgggttcggtctaagtctcgaggcagcacggcatcatgaaaacagcagtcgaggcgccgtggtgggtgttggcgacgagagtcgcgctctgcccgacgtgatgcagggcatggtactcagctccatgcagcatttctcggaagcctttcatcaagtactgggagagaaacataaacgcgggcatcttgccgaggcagagggccaccgggacacttgtgacgaggattccgtcgccggagaaagtgaccggatcgatgacggaactgtcaatggacgtggatgcagtccaggggagagcgcctccggggggctgtctaaaaagctgctgcttgggagcccttcaagtctaagccctttttctaagagaatcaaactggaaaaagaattcgaccttccccccgctgcaatgccaaacactgagaatgtctattctcagtggctggctggttacgcggctagccgccagctcaaagacccttttctatcattcggggattctcgtcagtctcccttcgcctctagctccgaacacagctccgagaatggaagcctaagattctcaactcctccaggggagttagacggaggcattagtggacgctctggaaccgggagcggagggtctacaccccacatctcagggcctggaccaggcagacccagtagcaaggaaggtcgacgcagtgacacctgtgagtactgcggaaaggtgttcaaaaattgttctaacctcacagtgcaccggcgtagccatacgggagagagaccatacaagtgtgagctgtgcaactacgcttgcgcccagtcctccaagcttacacgacacatgaagacacatggacaggtgggaaaggacgtttataagtgtgaaatatgtaagatgccattttcagtgtattcgactctcgaaaaacacatgaaaaaatggcattccgatcgagtgttgaacaacgatattaaaaccgaatag

SEQ ID NO: 180249 - DNA, 732 bp, Artificial Sequence
  Description of Artificial Sequence: Synthetic coding sequence
atgagccggcggaagcagggcaagccccagcacctgagcaagcgggagtttagtccggagccattggaggctatactgactgatgacgaaccagatcacgggcctttgggcgcccccgagggtgaccatgatctgctgacctgcggccaatgccaaatgaattttcctcttggagatatcttgatcttcattgagcacaagcgaaaacagtgcaatggctctctttgcctggaaaaagccgttgacaaaccaccatctcctagccctattgaaatgaagaaggcctccaacccagtggaagtggggatacaggtcacccctgaggatgacgattgcctgagcacttctagtaggggcatatgtcccaagcaggaacatatcgctgataagttgcttcactggcgcggcctttcttccccgcgaagtgcacatggggccctgatcccgacccccggaatgagtgctgaatatgccccccagggcatttgtaaggatgaaccttcatcttacacgtgtacgacttgcaagcagcctttcaccagcgcgtggttcctgttgcagcacgcccagaacacacatgggctgcgcatataccttgaatcagagcacggttcaccacttacacctagggtgctgcataccccgccttttggggtcgtcccacgcgagttaaagatgtgtggctcctttaggatggaggctcgagaaccgctctcttcagagaagatatag

SEQ ID NO: 180250 - DNA, 2397 bp, Artificial Sequence
  Description of Artificial Sequence: Synthetic coding sequence
atgagcaagggcaccgacgaggacatcttcagcggcgtgagcttctttcttacacggttgtcacgctgtgagcctagcaggcgcccgcccccagcaccccagccaaccatgagtagaaggaagcagggaaagccacaacacctgtccaagagagagttctcgcccgaaccgttagaggccattttgactgacgacgaacctgaccacggccctctgggcgcccccgaaggggaccatgacctgctaacctgtggccagtgtcaaatgaatttccccttgggcgacatcctgattttcatcgagcacaaacggaaacagtgcaatgggtccctctgtctggagaaggcagtggacaaaccgccgtctccatccccaattgaaatgaaaaaagccagcaaccccgtggaggttggcatccaagtcacccctgaggacgatgactgcctttctacgagttcacgtggaatctgccccaaacaggagcatatcgctgataagctgctgcattggagaggcttgtctagccccaggagcgcccacggagcccttattcctaccccaggcatgagcgccgagtatgccccacagggcatctgtaaagacgaaccaagcagctacacatgcaccacctgtaagcagccattcacatcagcatggtttctcctgcaacatgctcagaacacgcacggattgaggatatatctggagtcagagcacggcagtcctcttactcctagagtgggaatccccagcgggttgggcgcagagtgcccttcacaacctccgctgcacgggatacacatcgctgacaataatccttttaatctgctccgaatccctgggtccgtgagtcgcgaagcgtccggcctcgcagaggggaggttcccccccactcctcctctgttcagccccccaccccggcaccaccttgacccacaccgtattgagagactgggtgcagaagaaatggccctggctacgcatcatcctagcgcctttgatagggtccttaggcttaaccccatggctatggaacccccagctatggatttcagtcgacgcctacgggagctggccggtaatactagctctccccccctgagtcccggaaggccgagcccgatgcaacgcctgctccagccatttcagccggggagcaagcctccatttctcgccacacccccacttccccccctccaatctgccccccccccgtcacagccacccgtgaaatcaaagagttgcgaattctgtgggaaaaccttcaaatttcagtcaaatctcgtggttcatagaaggagtcatacaggggaaaaaccctacaagtgtaatctttgcgaccatgcgtgcactcaggcttctaagcttaaacgccacatgaagacacacatgcacaaaagttccccaatgacggtcaaatcagatgacggcctcagcaccgcctcctcacctgagcccggtaccagtgaccttgtgggtagtgcgtcctctgcattgaaaagtgtggttgcgaaatttaaaagcgaaaatgaccctaatctcatccctgagaatggcgatgaggaagaagaggaggatgatgaggaagaggaagaagaggaagaggaagaggaggaagagctgactgaaagtgagcgagttgattacggttttggcttgtctctggaggcggtagtgggagtgggcgacgagtcaagagctctgcccgacgtgatgcagggaatggtactgagtagcatgcagcacttttctgaggcttttcaccaagtgctcggtgagaagcacaagcgcggccatctggcagaagctgagggtcacagagacacttgtgatgaagactcggtagccggcgagagcgacagaatcgacgatgggaccgtcaacgggcgaggctgctctcccggcgagtccgcctccggcggcctgtctaagaaattgcttttgggctccccttccagcctgagccccttttccaagagaatcaagctggaaaaagagtttgatctcccccctgcagcaatgccaaataccgagaacgtatattctcagtggcttgcaggctacgcggcaagtcgccagctcaaggatcccttcctatcgtttggcgactctcggcagtccccctttgccagctcctcagagcatagcagcgagaacgggtcactgaggttcagcacacctcctggtgagttggacggaggcatatccggcagatcaggaactggcagtggaggatccactcctcacatatctggacctgggccaggcaggcccagttcaaaagagggcagacgcagtgacacttgctcaagtcacacccccatcaggcgcagtacccagcgcgcccaagacgtgtggcagttttctgacggcagtagcagggccctgaagttctag

SEQ ID NO: 180251 - DNA, 1329 bp, Artificial Sequence
  Description of Artificial Sequence: Synthetic coding sequence
atgagcgccgagtacgccccccagggcatctgcaaggacgagccctcgtcctatacatgtaccacatgtaagcagccgttcacctctgcgtggtttttgctccaacacgctcagaatactcatggactgcggatctatctggagtctgaacacggatcccccctcacccctaggtcaaaccttgtggtccatcgtagatctcatacgggagagaagccttacaagtgcaatctctgcgatcatgcatgcacacaggcttcgaagctgaaaaggcacatgaaaactcacatgcataagagctcccccatgacagtgaagagtgatgacggactcagcacggcctcctccccggaacctggaacgagtgatctggtcgggagtgcctctagtgcgcttaagagtgtggtggccaaattcaaaagcgagaacgatcccaacctgatcccggagaacggagacgaggaagaggaagaggatgatgaagaggaggaagaggaggaagaggaagaggaggaagagttgaccgaaagtgaaagggtggattatggttttggcctgtctctagaggccgccaggcaccacgaaaatagcagtagaggcgctgtcgtgggggtgggagacgaaagtagggctctgcccgacgtgatgcagggcatggtactgagctccatgcagcacttctccgaagccttccaccaggtgcttggggaaaagcataagcggggccatctggctgaggccgagggtcaccgtgatacgtgcgatgaggacagtgtcgcaggtgaaagcgatcgcattgacgacggaacggtgaacggacgcgggtgttctcccggtgagtcggcgtctggggggctgtccaagaagcttctcctgggtagtcctagctctctgtctccatttagtaagaggatcaagcttgagaaagaattcgatttacctcctgcagccatgccaaacacagaaaatgtttactctcagtggttagccggttacgctgcctcgcgccagttgaaggaccccttcctctcatttggtgactctcggcaatctccttttgcctcgtcatccgagcacagctccgagaacgggtcattgcgcttttctaccccccccggcgagctggatgggggcatcagtggccggtccggcactgggtctgggggcagtactcctcatataagcggaccaggacctggccgtccgagtagcaaggagggccggcgttccgatacttgctcttcccatacaccgattaggaggtctacacagagagcacaggacgtgtggcagttctccgacggctccagtagggcgttgaagttttag

SEQ ID NO: 180252 - DNA, 2382 bp, Artificial Sequence
  Description of Artificial Sequence: Synthetic coding sequence
atgagccggcggaagcagggcaagccccagcacctgagcaagcgggaattcagtcccgagcctcttgaggcgatcctgacggatgacgagcccgaccatggtcccctcggagcccccgaaggggatcatgatctcttgacttgtgggcagtgccagatgaattttccacttggggatattctgatttttattgaacacaagcgcaagcaatgcaatggtagcttgtgcttagagaaagctgtcgataagcctccctctccctctccaatcgagatgaaaaaagccagtaacccggtggaagtggggattcaggtcaccccagaggacgatgactgcttaagcacaagttcacggggcatttgccctaagcaggagcacattgctggtaaggatgagcctagctcatacacttgcaccacatgcaagcagccctttacaagtgcctggttcctgctgcagcacgcccagaacacgcatggcctcagaatttatttggaaagtgagcacggctcaccccttacccccagggtaggcattccctccgggctcggggccgagtgtcccagccaaccgcctctacatggcatccatattgccgataataatccatttaaccttctgcgtataccggggtcagtgagtcgtgaggcaagcggactggctgagggccggtttccgccaacccctcctctcttcagcccacccccgcggcaccatctggacccccacaggatagagcgacttggggccgaggaaatggctctagctacgcaccatccgtctgcattcgacagggtgctgcgcctgaaccccatggcgatggagcctcctgccatggattttagccgtcggctgcgcgaacttgcgggcaatacaagcagtcctccactcagtcccgggaggccctccccaatgcaacggctgttgcagcccttccagccagggagcaagcctcccttcctggcgactccgccactccctcctttacagtccgccccacccccctcccaaccgcccgttaaaagcaagagctgtgagttctgtgggaagacatttaagttccagtccaacctggtggtccaccgccgctcccacaccggcgagaaaccatacaaatgtaacctgtgcgatcatgcctgtactcaggctagcaagctcaaacgccacatgaaaacccacatgcataagagttcccccatgaccgttaagtctgacgatgggctgtcaaccgcctcctctcctgaaccaggaacatccgatctggttggctcagcgtcatctgccctgaagtctgtggtggccaagtttaagtccgaaaatgatcccaaccttatacccgagaatggagatgaagaagaggaagaggacgatgaggaggaggaagaggaggaggaagaagaggaggaagagctgactgagtccgaaagggtggattatggcttcgggctgtcactcgaagcggcccgacaccatgaaaactctagtaggggcgcagtggtcggggtgggcgatgagagccgtgccctgccagatgttatgcaggggatggtgcttagctctatgcagcacttcagcgaagcctttcatcaggtgctgggtgaaaagcacaagcgcggacacctggcagaagcggagggccacagagatacctgcgacgaggactccgttgcaggagaaagcgataggatcgacgacggtaccgtaaacgggcgggggtgctccccaggagaaagtgcttctggggggctttccaagaaattactgcttggaagtccctcgtcactgtctcccttctctaagagaatcaaactcgagaaggaattcgacctcccccctgctgcaatgccgaataccgagaacgtttactcacagtggctggccggatacgctgctagtagacagcttaaggacccctttctgtctttcggggattctaggcagtctccatttgcgtcctcttcggagcatagttccgaaaacgggtccttgcgtttctcaactccacctggggagctggatgggggaatcagcggccggtctgggactggctcgggcggctccactccacacataagtggcccgggccccggccggcccagttccaaagagggcagacgttctgatacctgcgagtattgtggaaaggttttcaagaattgctcaaaccttacggtccaccgtagatcgcatacaggtgagaggccttataagtgtgagctctgtaactatgcctgcgcccagagcagcaaacttactcgtcacatgaagactcatggtcaggtgctgcacaccccgcccttcggggtggtgcctcgcgagctgaaaatgtgtggatctttccggatggaggctcgcgaacccctgagctcggagaaaatctag

SEQ ID NO: 180253 - DNA, 2472 bp, Artificial Sequence
  Description of Artificial Sequence: Synthetic coding sequence
atgagccggcggaagcagggcaacccccagcacctgagccagcgggagctgatcacgcccgaagcagatcacgtagaagccgccattcttgaagaggatgaggggctcgagattgaagagccttctggactgggcctgatggtgggagggccagatccggacctccttacctgtggacaatgtcagatgaattttccacttggggatatattagtctttattgagcacaagaggaagcagtgtggcggatccctgggagcttgttatgataaagccctggacaaagattcgccacccccctcctctcggtccgagctccgcaaagtgtctgagccggtcgagatcggcattcaggtgaccccagatgaggacgatcacttattgtctccaacaaagggcatttgccctaagcaagagaatatcgccggtaaagacgagcccagctcttatatctgtacaacctgcaagcagcctttcaatagtgcatggttcctgctgcagcatgctcagaacacgcatggtttccgcatctatctggagcccgggcccgccagttcttcactcactccgcgtctgacaattccgccccctctggggccagaagcagtcgcgcagagtcctctgatgaatttcctcggggattcgaatccattcaacctgctgaggatgaccggtccaatcctgagagaccaccccggcttcggtgagggacgactgcccggcacaccacctcttttttccccaccccctagacatcacctggacccgcatagactgtctgccgaggaaatgggtttggtcgctcagcatccaagcgcatttgatagagtgatgcggttgaaccctatggccatcgactcccctgctatggatttctctcgcaggctcagggagctcgccggtaatagctccacgcccccgcctgttagcccgggtcgaggaaatcccatgcatcggctgttgaacccctttcagccttcacccaagagtcccttcctgtccacaccaccattgcccccgatgccacccggtggcactccgcccccccagccaccagcgaagagcaaatcctgcgagttctgcggtaagactttcaagtttcagagcaatctgatcgttcataggagatctcacactggcgagaagccctacaaatgtcagctctgcgaccacgcctgcagtcaggcgtctaagctgaaacgacatatgaaaactcacatgcacaaggccgggtctttggctggccggtctgacgacgggttgtccgccgccagtagcccggaacccggcacctctgagctggctggggaaggcttgaaagcagccgacggcgactttagacaccatgagagtgacccctcgctggggcatgagcctgaggaggaggatgaagaggaagaagaagaagaagaggagctcctgctggagaatgagagcaggccagagagctccttctcaatggacagcgagttaagccgcaacagggaaaacgggggtgggggggtgcccggggttcccggagccggtggtggggctgccaaagcactcgccgatgaaaaagccctggtactgggtaaagtcatggagaacgtcggactgggggctctgccccagtacggggagctgctggccgataaacagaagagaggggcctttcttaagagggccgctgggggcggggatgccggcgacgacgacgacgccggtggatgcggggacgccggcgctgggggagctgtgaatggcagaggtggtggtttcgccccagggacagaaccttttccaggcttgttccccaggaagcccgctccgttgccaagccctgggttgaatagtgccgcgaagagaataaaggtggagaaggacctagaactcccccctgctgccctcatcccgtctgaaaacgtgtactctcagtggcttgttgggtatgccgcatctaggcacttcatgaaggacccttttcttggcttcaccgatgctcggcaatccccctttgcgactagttctgaacacagctctgaaaatggaagcttaagattcagtaccccaccaggagatctcctggacgggggattgtccggccggtcaggtactgcctctggtggctcaacaccccacctgggcggacctggaccaggtcggccatcttccaaagagggacgcagatctgacacatgtgaatactgcggaaaggttttcaaaaactgctccaacctgacagttcaccggcgaagtcacaccggagagagaccctataaatgtgaattgtgtaattatgcgtgtgctcaaagtagcaagctgaccagacatatgaagacccacggacagatcgggaaagaagtctaccggtgcgacatttgccagatgcccttctcggtatacagtacacttgagaagcatatgaagaaatggcacggggagcacttattaacgaacgacgtaaagattgagcaggcggagaggtcatag

SEQ ID NO: 180254 - DNA, 2685 bp, Artificial Sequence
  Description of Artificial Sequence: Synthetic coding sequence
atgagccggcggaagcagggcaacccccagcacctgagccagcgggaactcattaccccagaagctgatcacgtcgaggcagcaatactggaggaggatgaggggctcgagatcgaggagcccagcggcttgggcctgatggtcgggggccctgaccccgacttgttaacctgcgggcagtgccagatgaatttccctctgggggatatactcgtctttatagagcacaagaggaagcagtgcgggggaagtcttggtgcatgctatgataaagctttggataaggactcgcccccaccttcatcgcgaagcgaacttaggaaggtcagtgagccagtggagatcggtatccaggtgacacccgacgaggacgaccatctgctctcccctactaaggggatttgccccaagcaggagaacattgcaggtccgtgtaggcccgctcagctacccgcggtagcacccatagccgcctcatcccaccctcattcatcagtgattacctccccgcttcgcgctcttggcgccctgcccccctgcctgcccctaccatgctgctcagctcgccccgtgtcgggcgatggtacccagggagagggacaaactgaggcaccattcggatgtcagtgccaactcagcggaaaagacgagccttcttcgtacatctgtacgacgtgcaaacagccttttaactccgcttggtttctgcttcagcacgcccagaacacacatggattccggatttacctggagcctggacccgccagttctagccttacccctcggcttacaatacctcccccactgggacctgaagccgtggctcagtcacccctcatgaatttccttggcgattcaaatccctttaatctgctgcgcatgacaggacctatcctacgggaccatcccggatttggggaaggccgcttgcctgggaccccgccactattttctcccccacccagacaccacctcgatcctcaccggctgtccgcagaggagatgggcttagtggcccagcatcctagtgccttcgatagagttatgcgccttaatcctatggctatcgattcacccgccatggacttcagtcgccgcttgcgcgagcttgccggtaacagctcaacacccccacccgtgagcccaggcagaggcaaccctatgcacagactattaaatccattccagccttcccctaagtcccctttcctgtctacacccccacttcccccgatgccaccagggggaaccccccctccacagcctcctgccaagtcaaagtcctgtgaattctgtggaaagacatttaagtttcaatccaatctgatcgtccacagacgctcacacacaggagagaaaccctacaaatgccagttgtgtgaccacgcttgcagtcaggcttctaaactcaaacgacacatgaagacccatatgcataaggccggatccttggcaggaagaagcgatgacggcctgtcggccgcctccagccctgagcctggcacctcagagcttgccggcgaggggttgaaggccgctgacggagactttagacaccatgagtcagatccttcacttggacacgaacccgaagaagaagatgaagaagaagaagaggaggaggaggagctgctcctggagaacgagtctcggcccgagagtagcttcagcatggattctgagctctcacgcaacagggaaaacggcgggggcggagtcccaggggtgcctggggctgggggcggagcagccaaagccctcgccgatgagaaagcattagtactgggcaaggtcatggaaaacgtgggactcggggctttaccacagtacggtgaactcctagcagataaacagaagcgcggagccttcctgaaacgtgctgccgggggaggcgacgcaggagacgacgacgatgccggaggttgcggtgacgctggagccggcggagcagtgaacgggcggggtggcggatttgctcctggcacggaaccctttcccggcctgttcccccggaagccggctccgttaccatcacccggcctcaattccgccgccaagagaatcaaagtggaaaaagatttggagctccctccagccgctctaataccgagcgagaacgtgtacagtcagtggctcgtgggatatgccgcttcgcgccactttatgaaagatcccttcctgggctttaccgatgcaagacaaagcccctttgctacctcttccgaacatagcagtgaaaacggatctctgcgtttcagtacacctccgggcgatctactggatggcgggttgagtggcaggagcggtactgcctccggcggatctactccccacctcggcgggccaggtcccggccggccttcctctaaggaaggcagacgatcggacacgtgtgagtactgtgggaaggtgttcaagaactgtagcaacttgacggtccatagacggtcccatacaggcgaacgcccttataagtgcgagctgtgcaactatgcctgtgctcaatcgtctaagcttacgcggcatatgaaaacccatgggcagatcggcaaagaggtgtaccggtgtgacatttgccagatgccgttttctgtttactctacattggagaaacacatgaagaaatggcatggtgagcacctcctgaccaatgatgttaaaatcgagcaggctgagaggtcatag

SEQ ID NO: 180255 - DNA, 1365 bp, Artificial Sequence
  Description of Artificial Sequence: Synthetic coding sequence
atgccccggtgccccgccggcgccatggacgagggccccgtggacttgcgcacacggcctaaggcagccggactgcccggtgccgctctgccactcagaaagaggcccctaagggcccctagccccgagcctgctgccccgcgaggtgcagcaggcctggtcgtaccactcgatcctctgcgcggaggctgtgacctgccagctgtgcctggacctccccatggactagctagacctgaggctttgtactaccctggcgccttgcttcccttgtaccctacacgtgcgatgggcagcccctttccacttgtcaatctgcctaccccactttaccccatgatgtgccccatggaacaccccttgtctgccgacatcgcaatggcaacccgagcagacgaagacggagacacgcctcttcatatcgccgtggttcagggcaatctgccagccgtgcacaggctggtgaatcttttccaacaggggggccgagaactggatatctacaataacctgagacagactcccctgcaccttgccgtgattaccacgctgccttccgtggtccgattactggtgaccgctggagcctcaccaatggcgctagacagacacggccagaccgccgcacacctggcctgtgagcacaggtcccccacctgcctgcgtgccctgctggacagcgccgctccagggaccctggatctcgaggctcgcaattatgatggcctgacggccctgcacgttgccgtgaatacagagtgccaagagacagttcagcttctgcttgaacgcggcgcggacatagacgccgtagacattaagagcggccggtcccccctcatccatgctgtcgagaacaattcgctttctatggtccagctcctgctgcagcatggcgcaaatgttaatgctcagatgtattcagggtcaagcgcgctccactctgcaagcggccggggtctgctacctctggtccgaactctggtgcgcagcggcgccgactcatccctgaagaactgtcataatgacacccccttgatggtggcccggtctcgacgcgtcatcgacatcctccgcgggaaggcaactagacccgcgtctaccagccagcctgatccatctcccgacagaagcgcgaacactagcccagaatcctccagcagactgtcatccaacgggttgctctctgcatcaccctccagctccccctctcagtctcctccgcgcgacccaccaggttttcctatggcaccccctaacttcttcctcccttctccctctcctccggcttttctaccctttgccggagtgctgagaggaccaggccgcccggtacctccatctccagcacctggcgggagttag

SEQ ID NO: 180256 - DNA, 1071 bp, Artificial Sequence
  Description of Artificial Sequence: Synthetic coding sequence
atggaggagggccgggagcggaaccggagctggccccccgccgagtgccaaagtctcccgcgggtgcggctgttcaccccgacaaaggaggaaactgcgcaaaggggcgaggtgtttggacaagggcaccccgccagggctctccttccactatacccaaccagagcaatgggcagcccctttcccttggtaaacctgccaactcccctttaccctatgatgtgtcccatggagcacccacttagtgctgacatcgcaatggcaactcgcgctgatgaggacggtgataccccacttcatattgccgtggtccagggtaatcttcctgcagtacacagattggtgaacctcttccagcaggggggccgggaattggacatttataacaacctacgccagactccgctgcatctagctgtcatcacgaccctgccaagcgttgtgcgtctgcttgtgacagcaggggccagtcctatggcccttgacagacacgggcagactgctgcacacctagcttgtgagcataggtccccgacatgcctcagggccctgctcgactccgccgcgcccggcactctcgaccttgaagcgcggaactacgatggcttgacagccttacatgttgctgttaacacggaatgccaggagactgtccaactgctacttgagaggggggctgatattgacgccgtggatatcaagagcggccgatctccgctgatccatgccgtggagaacaactctcttagtatggtgcagctgctgctccagcatggcgcaaacgtgaacgcccagatgtacagtggcagctcagcgttgcattccgcaagcggtagagggctgctcccactcgtgagaaccttggtgcgatctggcgcggactccagcttaaagaactgccacaatgacacccctctaatggtggcacggtcccggcgcgtctcacgcgggagttgtggtcatgctccctgtacccgcgtctccgcaggttggctccaggcctccgtgcctgagcggaggggcgtgcgagttagtgtaccgttacgcggcggcgagtgggtatcattatag

SEQ ID NO: 180257 - DNA, 1440 bp, Artificial Sequence
  Description of Artificial Sequence: Synthetic coding sequence
atgggcagccccgccgcccccgagggcgccctgggctacgtgcgggagtttactcgccacagttcagatgtgctgggaaatttgaatgagctgcggttgcgcggaattcttacagatgtgaccctcctcgtcggggggcagccgctgcgggcgcacaaggcggtgttgatagcttgcagcggttttttctacagtatctttaggggaagggctggagtgggggttgacgtcctcagcctccctgggggccccgaagctagggggttcgccccattgttagactttatgtacacatcccgccttcgcctttctcctgctactgcacctgctgttcttgctgccgcaacatatctgcagatggagcacgtggtgcaagcctgtcatcggttcattcaggccagctatgaaccactcgggatctccctgaggccattggaggccgaacccccaactccccctacggctccccctccaggcagcccgcgacggtctgaaggccaccccgacccccctacagaatcaaggagttgttcacagggtccaccatctcctgcctctccagacccgaaggcatgtaattggaaaaaatacaagtacattgtgctaaacagtcaggcctcccaggctggtagtcttgttggggaacgttcctctggacagccctgccctcaggccagattgccttctggggacgaggcctcgtcgtcctcttctagctcttcctccagctcagaagagggccccatccccggaccccagagccgtctgagtccaaccgccgctaccgtgcagtttaaatgtggcgccccagcatctaccccatacctcctcacaagccaggctcaggacaccagtggttctccatccgagcgggcaaggccactccctggttccgagtttttctcttgccagaactgcgaggctgtagcaggttgctccagcggactggactccttagtacctggagacgaggacaagccttacaagtgccagctgtgtcgatccagtttccgttataaaggaaacttagcttcccaccgaacggttcatactggtgagaagccctatcactgtagtatttgtggggcccgcttcaatcgtccggctaatctgaagacccattcaaggatccactctggagagaagccatataaatgtgaaacctgtggctctcgctttgtgcaggtagcccatctgagggcacatgttctgatacacactggggaaaagccttatccatgtcccacatgtggcaccagatttaggcacttgcagacgctgaaaagccatgtccgcattcacacaggcgaaaagccatatcactgcgacccctgcgggcttcatttcaggcacaagtcccaactgcggttgcatttgcgccagaagcacggggccgccacaaacactaaggtgcactaccatattctgggtgggccctag

SEQ ID NO: 180258 - DNA, 129 bp, Artificial Sequence
  Description of Artificial Sequence: Synthetic coding sequence
atccacaccggcgagaagccctacccctgccccacctgcggcaccagattccgccacctgcagacattaaagagtcatgtgcgtatccacacgggcgagaagccctatcacgagcctgttacctcatag

SEQ ID NO: 180259 - DNA, 633 bp, Artificial Sequence
  Description of Artificial Sequence: Synthetic coding sequence
atgagcggccggagcgtgcgggccgagacccggagccgggccaaggacgatattaagagagttatggctgcaatagaaaaggtgagaaaatgggaaaaaaagtgggttactgtgggtgatacctcactgagaatttataaatgggtgcctgtcacagagcctaaggtggacgacaagaacaagaacaagaagaaggggaaggacgagaagtgcggaagtgaagtgacaactccagagaactcctcaagccctggaatgatggacatgcacgatgataactccaatcagagcagcattgctgatgctagccccattaagcaggagaactcgtctaattccagccctgcccccgaacctaattctgctgtaccatcagacggaactgaagctaaggtggatgaagcccaggctgacgggaaagagcatccaggggccgaggatgcttccgacgaacaaaactcacagagcagcatggaacattctatgaacagctctgagaaagttgatagacagccgtctggggactctgggctcgcggctgagacctctgcaataagccaggatctcgagggggtcccacccagtaaaaaaatgaaactggaagcttctcagcaaaatagcgaggaaatgtag

SEQ ID NO: 180260 - DNA, 696 bp, Artificial Sequence
  Description of Artificial Sequence: Synthetic coding sequence
atgagcggccggagcgtgcgggccgagacccggagccgggccaaggatgacattaagagagtgatggccgctatcgagaaggtgcggaaatgggaaaagaaatgggtgactgtcggagatacatctttacgtatctacaagtgggtgcccgtaaccgagcccaaagtcgacgacaaaaacaagaataagaaaaaaggtaaagacgagaagtgtggatccgaggttaccactccagaaaactcaagcagcccagggatgatggacatgcatgacgataacagcaatcagtcatcaatcgcagacgcctcgcccataaagcaggagaacagctcaaactcttcacccgcaccagaacccaatagcgctgttccctctgatggaacagaggcaaaagtcgacgaggcgcaggcagatgggaaagagcatcctggcgctgaggacgcctcagacgagcagaacagtcagagttcaatggagcattccatgaatagctcagaaaaggtcgatcgtcagccttccggggattcaggcctggctgccgaaacaagcgccatatcccaagtgcctcgcagccgatcgcagcggggatcccagattggcagagagccaattggtctctctggggacctggagggcgttcctcccagtaaaaagatgaaactggaggcctcccagcagaattccgaagaaatgtag

SEQ ID NO: 180261 - DNA, 528 bp, Artificial Sequence
  Description of Artificial Sequence: Synthetic coding sequence
atggccagccggaaggccggcacccggggcaaggtggccgccaccaaacaagcccagcgcggaagtagtaacgtgttttccatgtttgaacaggctcagatccaggagttcaaagaggctttttcatgtatcgaccagaaccgggatggcatcatctgcaaggcagatttgcgggaaacttacagccagttaggcaaagtatcagttcccgaagaggagctggacgctatgctccaggaggggaagggccccattaacttcacggtttttctcacattattcggggagaagctgaacggaacagaccctgaggaagcaattctgtcagcattccgcatgttcgacccgagcggcaaaggagtggtcaacaaggatgagttcaagcagctgctgcttacgcaagccgataaattctcccctgcggaggttgagcagatgttcgcactgacccctatggatctcgcaggtaatatagactacaaaagcctatgttatatcatcacgcacggagatgaaaaggaagagtag

SEQ ID NO: 180262 - DNA, 438 bp, Artificial Sequence
  Description of Artificial Sequence: Synthetic coding sequence
atgagcggccggagcgtgcgggccgagacccggagccgggccaaggacgatattaagaaggtcatggccgccatcgagaaggtgagaaaatgggagaaaaaatgggtcaccgtcggcgatacatcattgcgcatctttaagtgggtccccgtgaccgacagcaaggagaaagagaagtcaaaaagcaattcttcagccgctcgagagccgaacggcttcccatctgatgcatccgccaattctagcctcttattagaatttcaggaaccttcccttcctagctcagaggttgccgatgaacctcctaccctcaccaaagaagaaccagtcccactcgaaactcaagtagtggaggaggaagaggacagtggtgccccgccactcaagagattctgtgtggatcagcccactgttcctcagacagcttcagagtcttag

SEQ ID NO: 180263 - DNA, 867 bp, Artificial Sequence
  Description of Artificial Sequence: Synthetic coding sequence
atgaaggaccggacccaggagctgcggagcgccaaggacagcgacgatgaagaggaagtcgtgcatgttgatagggaccactttatggatgagtttttcgagcaggtggaggaaatccggggctgcatcgaaaagctatccgaggatgtcgaacaggttaagaaacagcactccgctattcttgccgcccccaatccagatgagaagacaaagcaggaactcgaggacctgaccgcggacattaagaagaccgccaataaggtgaggtctaagctgaaagccatcgagcaatccatcgagcaggaggaaggactgaaccggtcctctgctgaccttcgcattcgaaaaactcagcacagcacgctctctcgaaaatttgtcgaggtgatgaccgagtacaacgccacccagtcaaaatatcgggatagatgcaaggataggattcagcgacagctggagatcactggtaggaccacaacgaacgaggaactcgaggatatgcttgaatcaggcaaactggcaatttttaccgacgatatcaagatggacagccagatgaccaaacaggcactaaatgaaatcgaaacaagacacaatgagatcataaaactcgagacatctatccgggagttgcacgacatgttcgtggatatggccatgttagttgagtctcagggcgagatgatcgatagaattgaatacaatgtggagcactctgtcgattatgtcgagcgagcggtttctgacactaaaaaggccgtcaaatatcaatcaaaagccagacggaagaagataatgatcataatttgctgcgtggttctgggagtggtgttagcctcaagtatcggtggcactctcgggttatag

SEQ ID NO: 180264 - DNA, 729 bp, Artificial Sequence
  Description of Artificial Sequence: Synthetic coding sequence
atggccggccggaccgtgcgggccgagacccggagccgggccaaggatgatattaaaaaagttatggcaacaatcgagaaggttaggcgctgggaaaagcgctgggtgacagtgggcgatactagcctgagaatctttaaatgggttcccgttgtggatccccaggaggaagagcgccggcgggctgggggcggtgcggagagaagccgtggccgggaaaggaggggacggggcgcttcacccagggggggcgggcccttaatactcctagacctgaatgatgagaactccaaccaaagctttcattctgaaggatcacttcagaaggggaccgaacccagccctggggggacgcctcaaccctcccggccagtgagtcctgctggaccaccagaaggtgtgcctgaggaagcccagcctcccaggctcggtcaggagagagatccagggggcatcactgctggttctaccgacgagcctcccatgctaacgaaagaggagccagttcccgagcttctggaggccgaggacagcggggtgcgcatgacacggagagctctccacgaaaaaggcctgaagaccgaacctctgaggagattactccctagaagaggtctacgtaccaatgtccgccccagctccatggcggtgcccgacactagggcacctgggggagggtctaaagccccgcgggctccaaggactattcctcagggcaaggggagatag

SEQ ID NO: 180265 - DNA, 1680 bp, Artificial Sequence
  Description of Artificial Sequence: Synthetic coding sequence
atgcacagcttcatccacgccgccatgggcatggtgatggcctggtgtgccgccgtgataacacaggggcaatacagcttcctggtggtaccatgcaccgggacaaacagttttgggtcccctgcggcccagacttgcctcaacgagtatcacctgttttttctactgaccggtgcattcatgggatatagctacagtctcctctactttgtgaacaacatgaattacttgccttttccgattatccagcagtacaagtttttacgctttcggagatcactgcttttactggtgaagcactcctgcgtggagtctctcttcctcgtgcgaaatttttgtattctttactatttcctaggatacattcctaaggcatggatttccacagcaatgaatttacacattgacgagcaggtgcacaggcctctcgacacagtgtccggactcctcaatttgagcctcctttaccacgtgtggctttgtggcgtttttctgctgacaacatggtacgtctcctggattctgtttaagatctatgccacagaggcacatgtcttccctgtccagcctcccttcgccgaaggctctgatgagtgccttcccaaagtgcttaattcgaacccacccccaatcattaaatatctcgcactccaggacctaatgctgttgtctcaatattccccaagcaggcgtcaagaggtgttttccttatcccaacctgggggccaccctcataactggactgccatttcacgtgagtgccttaatttactaaacggcatgacccagaaattaattctctatcaggaagccgcagccactaatggacgggttagtagttcttaccccgtggagccaaagaaactcaattcccccgaggaaaccgcattccagacaccaaagtcgtcacagatgcctagaccatcagtgccgcccttggtgaagacttccctcttctcctcaaaactttcaactccagacgttgtctcacctttcggcactccctttggctcgagcgtcatgaatcggatggcaggcatttttgatgtgaatacttgttacggatcacctcagagcccccagttaatccggcgaggcccacgcctgtggacttctgcgagtgatcaacagatgacagagttcagtaatccgtctccgtctacaagtatttcagccgaaggcaagaccatgagacaaccttccgttatttatagctggatacagaacaaacgagaacagatcaaaaacttcctaagcaagcgggtgctgatcatgtactttttttccaagcatcccgaggccagcatccaggccgtgttctcagacgcccaaatgcatatatgggctctggagggactaagtcaccttgttgcggcatcatttacggaagatcgtttcggcgtcgtccaaaccaccctgcccgcaattttgaatacgttattgacgctgcaagaggccgtcgacaagtacttcaaattgccacacgctagcagcaagccacccagaattagcgggtccctcgtagatacctcatataagacacttagattcgctttccgggcctcccttaagaccgccatctaccgtataaccacaacatttggagaacatctcaatgcggtacaagctagtgcagagcaccaaaaaagactgcagcagttcctcgagttcaaggagtag

SEQ ID NO: 180266 - DNA, 4500 bp, Artificial Sequence
  Description of Artificial Sequence: Synthetic coding sequence
atgcggatcctggccaacaagacccggctgccccacccccggcggcgtgaagccccaggcagcccaccgttgtctccacgggggcattgccctccagcccccgccaaacccatgcatcccgaaaataagcttaccaaccacggaaagactggaaatggcggagcccaaagccagcatcagaacgtcaatcaaggtcccacctgcaacgtgggcagtaaaggggttggggccggcaatcatggggctaaggctaatcagatctcccccagtaacagcagtcttaagaacccccaagcgggggtgcctccttttagcagtctcaaaggcaaagtgaagagagataggtctgtgagcgttgactctggagagcagagagaggcagggactccttccctggacagcgaagccaaggaggtagcccctaggagtaagcggcggtgcgtgctcgaaagaaagcagccctacagcggtgacgagtggtgctctggccctgattccgaagaagacgacaagcctatcggcgctacccacaactgcaacgtggcggaccctgcaatggcggcccctcagctggggcctgggcagacgactcagctgccactaagtgaaagttcggtcccaggagcgcctcacggcccccccccgggcttgaggccagacgcgccggggggtgggggtgggggcgggggcgtccctgggaaaccccccagccaatttgtgtacgtgtttactactcatctggctaataccgccgccgaggcggtgctccagggtcgggcggactcaattcttgcctatcaccagcagaacgtgccgcgggctaagttagatcaggcacctaaagtgccccctacgccagagcccctacccttaagcacgccatcggccggtacacctcaatctcaacccccaccgttgccaccaccccctccacctgcccccggatcagcacccccagctctaccccctgaggggccaccagaggacagcagccaggacctggccccaaattccgttggggcggctagcactggcggaggaaccgggggcacacaccctaacaccccaacagctacaacggccaacaatcctcttccgcccggaggcgatcctagctccgcccctggtccagcactgctaggggaggcagctgccccaggtaatggacaaagatccttagtagggtcagagggactgtccaaagagcagctggaacatcgcgagagatctctccagaccttgcgggatattgagaggttattactgagatctggggagactgaaccctttctcaaaggccctcccggaggcgccggagagggcgggcctcctgctcaggcgcccccgcctcctcagcagcccccaacagcgcctccctccggacttaagaagtatgaagagcctctgcagtcgatgatcagtcagactcagtccctcggggggcccccacttgagcacgaggtaccgggccatccccccggaggcgatatgggccagcaaatgaacatgatgatccagcggcttgggcaggactcactgactcccgaacaggtcgcctggaggaagttgcaggaggagtactatgaggaaaagcgcagaaaggaagaacaaataggcctccacggaagccgtcctttgcaggacatgatgggcatgggcgggatgatggttcgaggtccccccccaccttatcacagcaaaccaggagaccagtggcctcccggcatgggagcccagttgaggggtccaatggatgtgcaggaccccatgcagctgagaggcggccccccctttcccggcccgcggttccccggaaatcaaattcaacgcgtgccagggtttggaggcatgcaaagtatgccgatggaggtgcctatgaacgccatgcaaagacctgtgagacccgggatgggatggacggaggatttgccgcccatgggcggaccgagtaatttcgcccagaacacaatgccctaccccggcgggcagggagaagccgagcgcttcatgacacctcgcgtcagagaggagctgttgcgccaccagctgcttgaaaaaagaagtatgggcatgcagagaccactagggatggccggatcaggaatgggacagagtatggaaatggagcgaatgatgcaagcccatagacagatggacccagccatgttcccagggcaaatggccggcggggagggactcgcagggactcctatggggatggaattcggggggggacgtgggctcctgagcccgccaatgggccagagcggtctgagggaagtagaccccccgatgggcccaggtaaccttaatatgaatatgaacgtgaacatgaacatgaatatgaatctgaatgtgcaaatgactccccagcagcaaatgctgatgtcccagaagatgcgcgggcccggcgacttaatgggaccccaaggactgtcacctgaggagatggcacgagtacgagcccagaactcatctggcgtcatggggggtcctcagaagatgctaatgccaagtcagttcccaaatcagggacaacaggggttttccggaggccagggaccctatcaggcgatgtctcaggacatgggtaatacccaggatatgttctctcccgaccagagctccatgcccatgagcaatgtagggacaacacgcctgagccatatgccactgccccctgccagcaatccacctggaactgtccactccgccccgaatagaggtctcggtaggcgtccctcagatttgacaatttccattaatcagatggggtcaccgggcatggggcacctcaagtccccgacattatcacaggttcactcgccgctcgtgacctctcctagcgctaacttaaagtctccacagacgccttcgcagatggtgcccctgccgagcgcgaacccgccaggacctctgaaaagccctcaagtgcttggtagttcattgagcgtccggtctccgacaggcagtccttcccgcctcaagtcgccatcaatggcagtgccatcccccggttgggtggccagcccaaagacagccatgccatctccaggggtgtcacaaaataaacagccacctctgaacatgaatagctcgaccaccctctctaacatggagcaggggactcttccaccaagtggacccaggagctcatctagtgccccccccgcaaatcccccctctggcttgatgaacccaagcctcccattcaccagcagccctgaccccactccttcccagaatccactgagtttgatgatgacacagatgtccaagtacgctatgccatcatctaccccgctgtatcacaacgcaatcaagacgattgccacatcggatgacgagctcctacctgaccgtccactcctgcccccccccccacccccacagggctctggtcccggcattagtaactcccagccaagccaaatgcacctgaactccgcggctgctcagtctcccatggggatgaatctaccaggccaacagcctctgagccacgagccgccaccggccatgctgcccagcccaacaccactgggaagcaacattccactgcatcctaacgcccaaggaaccgggggaccaccccagaactctatgatgatggcccctggaggacctgattcgctgaacgcaccttgcgggcctgtcccatcctcatcacagatgatgcctttccccccacgcctacagcaaccccatggagctatggcacccactggcggtggtggagggggacctgggctacagcaacattatccctcagggatggcacttcccccagaagacctacctaaccagcccccgggtcctatgccaccacagcaacacctcatgggaaaggcaatggccgggcgcatgggtgacgcctatcctccaggggtgttgccaggcgtcgctagtgtgctgaacgaccccgagctgtctgaggtgatccgacccaccccaacagggattccggaattcgatttgtctcgtattataccatccgagaaaccgagctcaaccctgcagtactttcctaagagtgagaaccagccccccaaagcacagccacccaacctacatctgatgaacctacaaaacatgatggccgaacaaacacctagcagacctcccaatctgcccggccagcagggagtgcagagaggactaaatatgagcatgtgccatcctggccagatgagcctcctaggtcggacaggcgtgcctccccaacaggggatggtcccccatggcctacaccagggggtcatgtctccacctcagggcctgatgacccagcagaattttatgttgatgaagcaacggggagttgggggtgaagtgtattctcaacctccgcatatgctcagtcctcagggctcattaatgggcccgcccccccaacaaaatctcatggtaagccatccattgcgccagaggagcgtgtcgctggacagtcagatgggatacttgcctgcccccgggggcatggcaaacctccctttttag

SEQ ID NO: 180267 - DNA, 4188 bp, Artificial Sequence
  Description of Artificial Sequence: Synthetic coding sequence
atgcggatcctggccaacaagacccggctgccccacccccggcggcgcgaggcccccgggtcccctccattgtctccccgaggacactgtcctccagcccccgctaaaccaatgcaccctgaaaataagctgaccaaccacggcaaaaccgggaacggaggcgctcaatcccagcatcagaacgtcaaccaggggcccacctgtaacgtgggaagcaaaggcgtgggcgcgggcaatcacggtgccaaggcaaatcagatctcacccagcaactcttctctgaagaatccccaggcaggggttccccccttctcttcactcaaaggcaaggtaaaaagagatcggagtgtatccgtagacagcggggagcaaagagaagctggaacaccatctctggattcagaagctaaggaagtcgccccgcgctctaagcgcaggtgtgttctggaacgaaagcaaccctactccggagatgagtggtgtagcggaccagatagcgaggaggatgataaaccaatcggagctactcataactgcaacgttgctgatcccgctatggcagcccctcagttaggacccgggcaaactacccaattgccactgagtgagagcagtgttcctggcgcgcctcacggtccacctccaggtctgcgtcctgacgctcccgggggcggcggcggtggagggggcgttcctggcaaaccccccagccagttcgtttacgtgttcacaacacacctcgccaacaccgctgctgaagccgttctacagggacgcgccgactccatcctggcttaccatcagcaaaatgtgccgcgcgcaaagcttgaccaggcccccaaggttccccccacccccgagcctctgcccttgtccactccctcagccgggaccccccagagtcagcccccacctctgccccctcccccaccaccagcccccgggtcggcccctccagcgttaccacccgaagggcctccagaagattcttcccaggacttggcacccaactctgtaggcgcagcatctactggcggggggaccggcggaacccaccccaataccccaactgccacgacagctaacaatcctctgccaccagggggcgatccatcaagcgctccggggccagccctgctgggggaagccgccgctccaggaaacggccagagatcattagtggggtctgagggcctgtctaaggagcaactcgaacatcgtgagcgcagtctacagaccttacgggatatcgagagacttctcctccggagtggagagaccgagccttttctgaaagggcctcctggcggcgctggggaaggggggccccctgctcaggcacccccccctcctcagcagccccctacagccccgccttccggcctgaagaaatatgaggaaccacttcagagtatgatatctcagactcaatcccttggcggtccacccttggagcacgaggtgcccggacaccccccgggcggggacatgggacaacagatgaacatgatgattcagaggctcggccaggacagtctgacccccgaacaggtcgcatggcggaaactgcaggaagagtattacgaagagaagaggcggaaggaggagcagatcggcctccacggcagccggccgctccaagacatgatgggaatgggtggcatgatggtcagggggcccccacctccataccatagcaaaccaggcgaccagtggccgcctggtatgggagcgcaacttcggggaccaatggatgtccaagacccgatgcagctacggggaggcccgccattccctggccctaggttccctggcaatcaaatacagcgggtgcctggtttcggcggtatgcaatcaatgcccatggaagtgccgatgaatgctatgcaacggcctgtgaggcccggaatgggctggaccgaagatctccctcccatgggaggaccaagcaattttgcacagaacaccatgccatatcctggaggacagggtgaggcagaaagattcatgactcccagggtcagggaggaactgttgcgtcatcagctgcttgagaaacgcagtatggggatgcagcgcccattgggaatggcagggtctggcatgggccagtccatggagatggaacgaatgatgcaggcacaccggcagatggaccccgcaatgtttccaggccagatggccggtggcgagggcctcgccggcactcctatgggcatggaattcggaggggggcggggcctgctgagccctcctatggggcagtccggcttgcgggaggtggaccccccgatgggaccaggaaacctgaatatgaacatgaatgtgaatatgaatatgaatatgaacctgaacgtgcagatgacaccccaacagcagatgctgatgagccaaaaaatgcggggccctggcgatcttatgggtccccaggggctgagtccggaggaaatggcaagggttcgcgctcagaattcgtctggggtgatgggagggccgcaaaagatgcttatgccctcgcaatttcccaaccaaggccagcagggattctctggcgggcagggcccttaccaggcgatgagtcaggatatggggaatacccaggacatgttttctcctgaccaaagttcaatgcctatgtctaatgtggggacaactcgactgtcccatatgccactgccgcccgcctccaacccgcccggaactgtccactcagcacctaaccggggtctaggccgtaggccctccgacctgaccattagtataaatcagatggggagtcctggtatgggacacctgaaatctcccaccctgagccaagttcattcacctttggtcacatccccgtcagcaaacctgaaatcaccacagactccctcccagatggttcccctgcctagcgcaaacccacccggcccattgaagagcccgcaagtgctagggagctctctctcagtgcgcagccccaccggctcccctagtcggctaaagagcccaagtatggccgtgccctcaccaggctgggtagcctctcccaaaactgccatgccatcccccggcgtatctcagaacaaacagcctcctctgaacatgaattccagtactaccctgagcaacatggaacaaggtactttacctccgtctggccctagaagctcctcctcggctccccccgctaaccctccttccgggctcatgaatccatctctcccatttacatccagtccagatcctaccccatctcagaatcctctcagtctgatgatgacacagatgagcaaatatgctatgccgtccagcaccccactctatcataatgcaatcaagaccatcgctacctctgatgatgaactcttgcccgatcggcccctcttgccccccccccctccacctcagggatccgggccaggtatttcaaatagccagccctctcagatgcacctcaactcggcagctgcccaatccccgatggggatgaacttaccgggccagcagccactttcccatgagccccccccggcgatgctgccctcccccactcctctggggagcaacatccctctgcaccctaatgcacagggaaccggggggcctccccagaactcaatgatgatggctccgggaggacctgacagtctgaatgctccatgcgggcctgtcccttcctcttcccaaatgatgcccttcccacctcggctgcagcagccgcacggagccatggcgcctacaggagggggcggagggggcccaggactacagcagcactatccatccggcatggcgctgcctcctgaagacctgcccaatcagccgcctggacccatgccgcctcagcaacacctgatgggaaaagcaatggcaggcaggatgggcgacgcctatcccccgggcgttctgcccggggtggcttctgtgcttaatgatccggagctgagcgaagtcattcgacccacgcccaccgggatccctgagttcgacctctctcgaattattccatcagaattcttacgcacacggccattctcattctgtctgtatctgttaagaatcctgtccctgctaatgtggcttactcccttgcccccactacccgctggaggctggccaggaggccaagtccctgccggtgccgtcaaccgagcccttcgattctgtgccggtctgtgtgtatgctgcatttccgtgttctag

SEQ ID NO: 180268 - DNA, 4365 bp, Artificial Sequence
  Description of Artificial Sequence: Synthetic coding sequence
atgcggatcctggccaacaagacccggctgccccacccccggcggcgcgaagcgcctgggtcacctccactaagtccaagagggcactgcccaccagctccggcaaaacccatgcatcctgaaaataagctcaccaaccatggtaaaacagggaacggaggggctcaaagccagcatcagaacgtcaaccagggcccaacttgtaacgtggggtccaaaggcgtgggcgccgggaaccacggggctaaggccaatcagatttccccctctaatagtagcctcaagaacccacaggccggagtacccccgtttagttctctgaagggtaaggtgaaacgagataggtcagtcagcgtggactctggggagcaacgtgaagctgggactccttcgcttgactccgaagcaaaggaagtcgctcccagatccaaacggagatgtgttctcgaacgaaagcagccctactcgggcgacgagtggtgcagtgggccggactcggaagaggacgacaaaccgattggcgccactcacaattgcaacgtagccgatccagccatggctgcgccacaactgggccccggccagaccacacaactccccctgtccgagtcctcagtgccaggagcgccacacggacccccaccaggcctaagacctgatgctccaggagggggcggaggcggggggggggtgcctggcaaaccaccgtctcaattcgtttacgtgttcaccacccacctagctaacacagcggcagaagcagtgctgcagggccgcgcagactccattctcgcatatcatcagcagaacgtcccccgcgctaagctggatcaggcacccaaggtgcctcctactccagagcccttgcctctttcaactccatccgccgggactcctcagtcccagccccctccacttccccctcccccacctccagccccaggatctgctcctcctgcccttcctcctgagggccccccagaggacagcagccaagatttggccccaaactctgtaggcgccgcaagcacgggggggggaacgggcggcacgcatcccaacaccccgacagcaaccaccgcgaacaatcccctccccccagggggggatccctccagcgcgccaggccctgcactcctcggcgaggccgccgcacccgggaatggccaaagaagtctggtggggtctgagggactgagcaaggagcaattggagcaccgcgagaggtcactgcagacacttagagacatcgagaggctactcctccggagcggtgaaacggaaccattcttgaaaggcccaccaggaggcgctggggagggagggccccccgctcaggctcctcctccccctcagcagcctccaacggcacctccttccgggttaaagaagtatgaggagccgctgcagtctatgatttctcaaacgcagtcccttggtggcccgcccctagagcacgaggtccctggccacccacctgggggcgacatggggcaacaaatgaacatgatgatacagaggttaggacaggatagtcttaccccggagcaagttgcttggagaaaactgcaagaggagtattacgaggagaagagaaggaaggaggagcaaattggcttacacggctcacgtccccttcaggacatgatggggatgggtggtatgatggtcagaggtcccccaccgccttaccacagcaaaccgggtgaccagtggccaccaggcatgggtgcacagcttcgcggccctatggacgtgcaggacccgatgcagcttaggggtggacccccattccccggaccacgcttccccggcaaccaaatccaacgcgtccccggcttcggcggtatgcagagcatgccaatggaggttcctatgaatgctatgcagagaccagtccgtcctgggatgggttggacagaggacctacctcccatgggggggccttctaatttcgcccaaaacactatgccctaccccgggggccagggcgaagcagaaaggttcatgaccccccgagtccgggaggagctgcttcgtcaccagttactggaaaagaggtccatgggtatgcagcgcccacttggaatggccggtagcggcatgggacagtctatggagatggagaggatgatgcaagcgcacaggcagatggatccagcgatgtttcctggacaaatggctggcggggagggactagctggtacccctatggggatggaatttggcggcggccgaggactgctgtcgcccccaatggggcagtcaggcctgcgggaggtcgatccacccatggggccaggaaacctgaacatgaacatgaacgttaatatgaacatgaacatgaatttaaacgtccagatgacaccgcaacaacagatgctcatgagccaaaagatgagggggccaggggatcttatgggaccccaggggctgagcccagaggagatggcacgagtgcgcgcacagaactccagtggtgtcatgggtggcccacaaaagatgctgatgccttcccaatttcctaatcagggccaacagggcttttctggggggcagggcccttatcaagccatgagccaagacatgggaaacacacaggacatgttttcccccgatcagtcaagcatgccaatgagcaatgtgggtacaacccgcctctctcacatgcctctccccccagctagtaacccccccggaaccgtgcattccgcccccaaccgaggtcttggtaggcgcccatcagatctaaccatttccattaatcagatgggatcaccgggcatgggacacctgaagtcccctactctttcacaggtccacagtcctctggtgactagcccgagcgccaatctgaagtctccacagaccccaagtcagatggtacctctgccatctgccaaccctcctggacctttgaaaagtcctcaggttcttggatcttcactcagcgtgaggtcacctacaggctccccgtccagacttaaaagcccttccatggcagttccctcccctgggtgggtagccagccccaaaactgccatgccttcaccaggggtaagccagaacaaacaacccccacttaacatgaactccagcacaaccctgtcaaatatggagcagggtactctgccaccttctggccctcggtctagcagctcggcacccccagccaatccacccagcggactgatgaatccaagcctgccattcaccagctctccagacccgaccccaagccagaacccactatccctcatgatgacccagatgagtaagtatgccatgccttcatcaactcctctgtatcacaacgcgatcaagacgatagctaccagcgatgacgagctcctgcccgatcgcccattactgccccctccgcctcctcctcagggttctggccccggaatcagcaatagtcagcctagtcagatgcatctgaactcggctgcggcccagagccccatgggtatgaatctgcccggacaacagccactatcacatgagcccccccccgccatgcttccgtcaccaacgcccctgggcagcaatatcccattacacccgaatgctcaaggcactgggggaccaccccagaattctatgatgatggctcccggcgggccagattcgctcaatgcaccatgtggccctgtgccttcaagttcacagatgatgcctttcccgccccgcctgcagcagcctcacggagctatgatggcggggagaatgggggacgcctacccaccaggagtgttgcctggagtggcctccgtccttaatgaccctgagctgtcggaggtgatcaggcctaccccaacgggcattcccgagttcgatctgtccagaataattcctagcgaaaaaccttcttccacgctccagtatttcccgaagtcagagaaccagcctcccaaggcccagccacctaatctccacctcatgaatctgcaaaacatgatggctgagcaaacgccgtcacgacctccgaatctccctggacagcagggtgttcaacggggactgaatatgtccatgtgccatccaggacagatgagcttgctgggaagaaccggagtccccccacagcaaggaatggttcctcatgggttgcaccagggagtcatgagccctccgcagggtctcatgacccagcagaactttatgctgatgaaacagaggggtgtggggggggaggtttactcccagcctccccatatgctgtctcctcagggctctctgatgggaccaccccctcaacaaaatttgatggtttctcatccccttcgtcagcgttcagtcagcctggattctcaaatggggtatctgccggccccaggaggtatggccaacctgccgttctag

SEQ ID NO: 180269 - DNA, 1401 bp, Artificial Sequence
  Description of Artificial Sequence: Synthetic coding sequence
atgagcacccggagcgtgagcagcagcagctaccggcggatgttcggcgggcctggtacggcaagtagaccctccagttcccgaagctacgtgacaaccagtacccggacgtattccctgggaagtgcacttagaccctcgacgtctcggtccctgtatgccagttcacctggtggggtgtacgccaccagaagctcagccgtgcgtttgagatcatccgtccccggggtgaggttattacaggactctgttgatttcagtctcgcagatgccataaatactgagtttaagaacactcgtacgaatgagaaggtggagctccaagaactgaacgatcgcttcgccaattacatagataaggtgagatttctcgaacagcagaataaaatacttttggctgaactggagcaactgaagggacagggcaagagtcgtctgggcgatctttatgaagaggagatgagggaactgaggaggcaggtggatcagctcactaacgataaagcaagagtggaagtcgaaagagataatttggcggaagacataatgaggctgagggagaaactgcaggaagaaatgctgcagcgagaggaggcagagaacacgctgcagagcttcaggcaggatgtggacaatgcctccctggcaaggctcgatctcgagcgcaaggtggagagtctgcaggaggagatcgctttcctgaagaagctacacgaggaagagatccaggaactccaggctcagatccaagaacaacacgtacaaatcgatgtggacgtgagcaagcctgatttaaccgccgccctccgagacgtcaggcagcagtatgagtccgtagccgccaaaaacttacaggaggccgaagaatggtacaagtctaagtttgctgacctgagcgaggcggccaatcgcaacaatgatgcgctgaggcaagcaaaacaagaatcgactgagtatcgtcgacaggtgcaaagcctgacctgcgaagttgacgccctgaagggcacaaacgaatccttggagagacaaatgagagagatggaagagaactttgctgtggaggccgccaactatcaagatacgatcggccggctgcaggatgaaattcagaacatgaaagaggagatggccagacacctgagagaatatcaggacctcctgaatgtgaagatggcactggacatcgagatcgctacttaccgaaaattgctggaaggggaagagtccagaatttccctcccactgcctaacttttcgtctttgaatctgagagagacaaacctggattctctgcctcttgtggatacccattctaaacgcacattgctgattaagacagtggaaactcgagacggacaggtgatcaacgagacctctcaacaccatgatgatcttgagtag

SEQ ID NO: 180270 - DNA, 1302 bp, Artificial Sequence
  Description of Artificial Sequence: Synthetic coding sequence
atggacaagctgaacaagatcaccgtgcccgccagccagaagctgcgtcagctgcagaagatggtccacgatataaagaacaatgagggaggcataatgaataagattaaaaaactcaaggtgaaggcgccacccagtgtacccagacgggattacgccagcgaaagtccagcagacgaggaggagcagtggtcagacgatttcgacagcgattacgagaatccagacgagcactcggatagtgaaatgtatgtgatgcccgccgaggagaacgctgacgattcatatgagccccctcctgttgagcaggagacgaggcccgtgcacccagctcttcccttcgcaaggggagaatatattgataaccggtcttcccagcggcactcccccccattttcaaagacccttccttcaaagcccagttggcctagtgaaaaggctaggctgacatctacactgcccgcgttgaccgccttacaaaaaccacaggtgcctccaaaacctaagggcttgcttgaggatgaggctgactacgtagtgcccgtcgaggacaacgacgagaattatatccacccaaccgaaagctcttccccacctcctgaaaagggacgaaactctggtgcatgggagaccaaaagcccacccccagctgcgccttcccctctgcctcgtgcaggcaaaaaaccgaccaccccattgaaaaccacaccagtggcttctcagcaaaatgcctcaagcgtttgtgaggaaaagcccattcccgcagaaaggcacagaggctccagccaccggcaggaagcagttcagagccctgtgttcccgcctgcacaaaagcaaattcatcagaaacccatccctctgccccgttttaccgaagggggcaatccaaccgtagacggcccacttccatctttctcgtctaacagtacgatatccgaacaggaagccggcgttttgtgtaagccatggtacgctggagcctgtgacaggaagagtgcagaagaagctctgcaccggagtaataaagacggcagctttttaatccggaagagctctgggcacgactccaaacaaccctataccctcgtggtgttttttaacaagcgggtctataacatacctgtgcgattcattgaagccactaaacagtatgccctgggtaggaagaagaacggcgaggagtacttcggctctgtggctgagatcattcgaaaccatcaacacagtccactcgtgctcatcgactcacagaataataccaaggattcaaccagattgaaatatgccgtgaaggtttcctag

SEQ ID NO: 180271 - DNA, 525 bp, Artificial Sequence
  Description of Artificial Sequence: Synthetic coding sequence
atggacaagctgaacaagatcaccgtgcccgccagccagaagctgcgacaattacagaagatggttcacgatattaaaaataacgaaggcggtataatgaacaaaattaagaaactgaaggtaaaggcaccaccaagcgtaccaaggagagactacgcatccgagagcccagcagacgaggaagagcagtggtcagacgactttgattcagattacgagaatcctgacgagcacagtgactctgaaatgtatgttatgcctgcagaggaaaatgctgatgactcatatgagccccctcctgtggagcaagagacccgtccagtccatcccgcactcccgttcgcccgtggtgaatatatcatcttcctgtgcgatttactgaagcagcagaataacatgccctgggctgagcgaaaaatggtgaagtccactctcgaggtgctcctgaaatctagcggtattataaacattgtgctctggtttctgcttacagttcgtatcacccagaagattccccccgactag

SEQ ID NO: 180272 - DNA, 558 bp, Artificial Sequence
  Description of Artificial Sequence: Synthetic coding sequence
atggacaagctgaacaagatcaccgtgcccgccagccagaagctgaggcaactacagaaaatggtgcatgatatcaaaaacaacgaggggggcatcatgaacaagatcaaaaagctgaaggtgaaggcacctccatctgtgcctcgaagagactacgcctctgaatcccctgcggacgaggaagagcagtggagcgacgatttcgacagcgattatgagaatccagacgaacactccgacagtgagatgtacgttatgcccgctgaagagaacgctgatgattcttatgagccccccccggtcgagcaggaaacgagaccagtgcaccccgctctgccttttgccaggggggaatacattgacaaccgcagcagccagcggcatagccctcctttttcaaagacactgccctctaagcccagttggccttcagaaaagtattttggatcagtcgccgaaattatacggaaccatcagcatagcccccttgtactcattgactcgcaaaataacacaaaggattcaacccggctgaagtacgccgttaaggtgtcctag

SEQ ID NO: 180273 - DNA, 204 bp, Artificial Sequence
  Description of Artificial Sequence: Synthetic coding sequence
ctggacagctacagctgcctgctgcagctgcccaaccggatggacaaattgaacaaaattacagtgcctgctagccagaagctaaggcaactccagaagatggttcatgacattaagaataatgagggagggatcatgaataagataaagaaaactgctaccatgaaaatacaaatgtcgactcgcacccagcgctgtacatag

SEQ ID NO: 180274 - DNA, 1215 bp, Artificial Sequence
  Description of Artificial Sequence: Synthetic coding sequence
atggacaagctgaacaagatcaccgtgcccgccagccagaagctgagacagttgcagaagatggttcatgacattaagaacaacgaaggaggaattatgaacaagattaaaaagctcaaggtgaaagctccaccttcagtgcctagacgtgactacgcatcagaatctccagccgatgaggaggagcagtggtcagacgacttcgactctgattacgaaaatcccgatgagcacagcgactccgaaatgtatgtgatgcccgcagaagagaatgctgatgatagctatgagcctccaccagtagaacaggagacgagacctgttcatcccgccctcccgttcgctaggggggagtacatcgataatcgatccagccagcgccattccccccccttctctaagactttgccaagcaaaccttcctggccgagcgaaaaggcacgacttacatccacgctgcctgccctcacggccttgcagaagcctcaggtcccacccaaacctaaaggcctgctggaggacgaggctgattatgttgtaccagtggaggataatgatgaaaattatatacatccgaccgagtcatcatcacctccccctgaaaaagcaccgatggttaacagatccactaagcccaactctagtacacctgcaagcccaccagggacagcatccggaaggaacagtggggcctgggagactaaatcccccccccctgctgcaccatcacctcttcccagagccggtaagaaacccactacccccttaaaaactactcccgtcgcctcacagcagaatgcttcatcagtgtgtgaggagaagcctatcccagccgagcgtcatagggggtcatcacacagacaggaagccgtgcaatcgccagtttttccacctgcccagaaacagatccaccagaaacctattcccctgcctcggttcaccgaaggcggaaaccccactgttgacggtccactcccatcattctcctccaactcaactatctccgaacaggaggccggcgttctctgcaaaccttggtatgctggtgcatgcgatcggaaaagcgctgaggaggctctacacaggagcaacaaatatttcggctccgtagctgagatcataaggaatcatcagcacagcccactggtgttgattgacagtcagaataacaccaaggatagcaccaggctgaaatacgctgttaaagtgagttag

SEQ ID NO: 180275 - DNA, 1266 bp, Artificial Sequence
  Description of Artificial Sequence: Synthetic coding sequence
atggacaagctgaacaagatcaccgtgcccgccagccagaagctgagacagctgcagaaaatggtccacgacattaagaataacgaaggaggaattatgaacaagatcaagaagctcaaggtcaaagctccaccgtcagtgccccgcagggattacgcaagcgagagtcctgctgatgaggaggagcagtggagtgacgactttgacagtgattacgagaatcccgatgagcacagcgattccgaaatgtacgtgatgcccgcagaagagaatgcggacgattcttacgaacctcctcctgtcgaacaagagacacggccggtgcatcctgctctcccatttgcacggggcgagtacatcgataatcgctccagccaaaggcacagccctcccttctccaagacactcccatcaaaacctagttggccatccgagaaagctcgcttgacgagcactctgcctgctttgaccgctctgcagaagccacaggttccaccaaaacctaaaggactgctggaagatgaggcagattacgtggttccggtggaagataatgatgagaattacatccatccgacagagtcttcttctccgcccccagaaaaggcccctatggtaaaccggtccacaaagccgaattcaagtacacctgcatctcctcctggcaccgccagcgggaggaactccggcgcttgggagaccaagtccccacctccagctgcacctagccccctgccgcgggcgggcaaaaagcccacaacgccgcttaagaccaccccagttgcttcccaacagaacgcaagctcagtttgtgaagagaagcctattcccgccgaacgtcatcgtggatctagtcatcgccaggaagccgtacagagtccagtatttcccccagcacagaaacagatccatcagaaacctatccctttgccccggtttaccgagggcggcaacccgactgtggacgggcccctgccaagcttctctagcaattctactatctctgagcaagaggcaggcgtactctgtaaaccctggtatgctggcgcttgtgatagaaaaagcgccgaggaggctctgcacagatcgaacaaggacccccaaccccccctgccaagcaagcagtgggagacacggaagctgcagtacttcgggtccgtcgctgaaataatacggaatcaccagcacagccctctggtgctcatcgatagccagaataacacaaaagattccactcgcctgaagtatgctgttaaggtttcctag

SEQ ID NO: 180276 - DNA, 630 bp, Artificial Sequence
  Description of Artificial Sequence: Synthetic coding sequence
atggacaagctgaacaagatcaccgtgcccgccagccagaagctgcggcagctacagaagatggtgcacgatattaaaaacaacgagggcgggattatgaataagattaagaaattgaaggtaaaagccccgccttcagttccacggcgggattacgcgagtgagtctcctgccgatgaggaagagcagtggtcagatgacttcgattccgattacgaaaatcccgatgagcattccgattcagagatgtacgttatgcccgcggaggagaatgcagacgacagttatgagcccccaccagtggaacaggagaccaggcctgtacaccccgctcttccctttgctcggggggagtacattgataatagaagctctcagaggcactctccacccttctccaagaccctgcccagcaagcccagctggccgtccgaaaaagcgagactgacgtcaaccctgcccgctttgaccgctttgcaaaagccccaggtaccacctaaacctaaaggactgctggaggacgaagccgactacgtggtgcctgtagaggacaacgacgagaactacatccaccccaccgagtctagtagccccccacctgaaaagggtaagaatcaacgccatcattag

SEQ ID NO: 180277 - DNA, 900 bp, Artificial Sequence
  Description of Artificial Sequence: Synthetic coding sequence
atggacaagctgaacaagatcaccgtgcccgccagccagaagctgagacaactgcagaagatggtccacgatataaaaaataatgaaggcggaatcatgaacaagatcaagaagttgaaagtgaaagcgcctccaagcgttcccaggcgcgattacgccagcgagtcacccgctgacgaagaggagcaatggtccgacgactttgactcagattacgaaaaccccgacgaacattctgactctgaaatgtacgtgatgcccgccgaagagaatgccgacgacagctatgaaccaccacctgtggagcaggagaccagacctgtacatcctgcacttccattcgcacgaggcgagtatattggcaggaactctggcgcatgggagacaaagtcccctccacctgctgcgccgagtcctctaccccgggctggaaagaagcccacgaccccacttaaaactaccccggtggccagccaacagaacgcttccagcgtgtgcgaggaaaagccgatccccgccgaaaggcatagggggagttcccaccggcaagaggccgtccagtctccagtcttcccccccgcccagaaacagattcatcagaaacccataccacttcctagattcaccgaaggtggcaacccaacagttgatggaccactaccttctttcagctccaactccaccatttcagagcaagaggcaggagtgctgtgcaaaccttggtacgcgggggcctgcgaccggaagagcgcagaagaggcgttgcataggtccaacaaatatttcggttcggttgctgagattattaggaaccaccaacactctcccctggtcttaatcgattcacagaacaatacaaaagacagcactcgcctgaagtatgcagtgaaagtgagttag

SEQ ID NO: 180278 - DNA, 2358 bp, Artificial Sequence
  Description of Artificial Sequence: Synthetic coding sequence
atgctgcccgccgcccccggcaagggcctgggcagccccgaccccgctccttgcggtcccgccccacccggtaatacaaaagacatcattatgatctatgaggaagatgctgaagagtgggccctctacctgactgaggtcttcctacacgtagtgaagagggaagccattttgctctacaggctggaaaatttttcatttagacacttggagctactgaatctcacatcatataagtgcaagttgctgattctgagtaactccctcttgcgcgatttaacaccaaagaaatgtcagttcctggagaaaattctgcattcccccaaaagcgtcgtcaccttactgtgcggggtgaaatcctccgatcagctgtacgaattgctcaacatttcccagagccgctgggagatcagcaccgaacaggagcctgaagactacatctcggttatacagagtattatatttaaggactccgaagattatttcgaggtcaatatccctaccgacctgagagctaaacactcaggggaaatctcagagcggaaagagattgaggaactgagtgaggcctctagaaacacgattccccttgcagtggtcctgcccaccgaaataccatgcgaaaatcctggtgaaatttttattatcctgcgcgatgaggtgatcggagacaccgtggaagtggagttcacctcctcaaataaacggattcggaccaggccggctctatggaacaagaaggtgtggtgcatgaaggctctggaattccctgccggcagcgttcatgtcaatgtatattgcgatggcattgtcaaagccactaccaagataaaatattaccccactgctaaggccaaagagtgtctgttccggatggctgactcaggtgagagcctctgtcaaaatagtattgaagagcttgacggagtcttaacgagcatcttcaagcacgagattccttactacgaatttcagtccctgcaaaccgagatttgttctcagaataagtacactcattttaaggagctgcccacacttctccactgtgctgctaagtttgggctgaagaatctggccatccacttactccagtgttctggggccacgtgggcatcaaagatgaaaaacatggaaggaagcgatcccgctcacatcgcagagcggcatggtcacaaggagctgaaaaaaatctttgaggacttctcaatccaggagatcgatataaacaatgaacaggagaacgattacgaggaagacattgcctctttcagcacctacatcccttccacacagaaccctgccttccaccacgaaagtcgtaagacgtacggccagtctgccgacggagcagaagccaacgaaatggaaggggaggggaaacagaatggctcaggcatggagacaaaacattcccccttggaagtcggcagcgagtcatccgaagatcagtacgatgatctgtacgttttcatcccaggagccgatcctgagaataatagccaggagcctcttatgtcaagtcgcccgcccctccctccgccgagaccagtcgccaacgcttttcagttggaacgaccccatttcacactgccaggcaccatggtcgaggggcagatggaaaggagccagaactggggacatcctggcgtcaggcaggagaccggtgacgaacctaagggagagaaagaaaaaaaagaggaggaaaaagaacaagaggaagaagaagatccatacactttcgcagaaatcgatgacagcgaatatgatatgatactggctaatctttcgatcaaaaagaagactggctcacggtcctttatcatcaatcggccgcccgccccaacacctaggccgacctccattccaccgaaggaagagaccaccccatatatagcccaggtgttccagcagaaaacagccaggcgacagagcgatgatgataaattctgcggtctaccaaagaagcaagatagagcgaggattgaatcacctgctttctccacactccgtgggtgtctgactgatggccaggaggaacttatcttgttacaggaaaaagtcaagaacggcaaaatgagcatggatgaagctctggagaagttcaagcactggcagatgggcaaatccggcttggaaatgattcagcaagagaagttacggcagttgcgcgactgtatcataggtaagagaccagaagaggagaatgtgtacaataagttgacaatcgttcaccaccctggaggaaaggagaccgctcataacgaaaataaattttacaacgtccacttcagcaacaagttgcccgcaaggccccaagtcgagaaggagtttggtttctgttgtaagaaggatcattag

SEQ ID NO: 180279 - DNA, 1959 bp, Artificial Sequence
  Description of Artificial Sequence: Synthetic coding sequence
atgctgcccgccgcccccggcaagggcctgggcagccccgaccccgccccctgtggcccagcccccccagattcagaggattactttgaagtgaatattcccacagatctccgcgcaaaacatagcggagagatcagcgaacggaaggaaattgaggaactgagcgaggcatccaggaacactatcccactagcagtggtactgcctacagaaatcccatgcgagaaccccggagagatttttatcatcctacgggacgaggtgatcggcgatacagtggaggtcgaatttacttccagcaataagcggattcgcactaggccggccttgtggaataagaaggtgtggtgcatgaaagctctggagttccccgccggatcagtccacgttaatgtctactgtgatggaatcgtcaaggccactacgaagatcaaatactatcccactgcaaaggccaaagaatgcttattcagaatggctgattcgggggaatccctttgtcagaattccattgaggaacttgacggagtcctaaccagcatattcaagcatgaaattccatactatgagttccagagcctgcagacggaaatttgctcacagaacaagtacacacatttcaaagagctacccactctgttgcattgcgcagctaaatttgggctgaaaaacctggctatccatctcttacagtgttccggtgcgacatgggcctccaagatgaaaaatatggaggggtcagatcctgcgcacattgctgaacggcacggacacaaagagctgaaaaagatttttgaggatttctctatccaggaaatcgacattaataacgagcaggagaacgattatgaggaagacatcgcaagttttagcacctacattccctcgacacagaacccagccttccatcacgaaagtcggaaaacgtacggtcaatctgctgatggcgccgaagccaacgaaatggagggagaaggaaaacagaacggctccggaatggagacaaagcacagtcctttagaagtggggtctgagagctctgaagatcagtacgatgacctgtacgtatttataccaggtgctgatcccgagaataacagccaggagcctcttatgtcaagtagacctcccctgccccccccacgccccgtggccaatgcattccagttagagcggcctcacttcacccttcctggcacaatggtggagggccagatggagagatcacagaactggggacatccaggcgtaagacaggaaactggtgacgagccgaaaggcgagaaggagaagaaggaagaggagaaggagcaagaggaggaggaagacccctacacgttcgccgagatcgatgacagtgagtatgatatgatcctagccaacctcagtataaaaaagaagacagggtcgcggtcctttatcatcaatcgaccgccagcacctaccccacgcccaacatcgattccacctaaggaggagactactccctacatcgcgcaagtctttcagcagaagacagccaggagacagtcagacgatgacaagttctgtgggttgccaaagaaacaggaccgcgcccgaatcgagtctcccgcctttagtaccctgagggggtgtctcacagacggacaggaggagctcatcctgctgcaggaaaaggttaagaatgggaagatgtccatggatgaagccctggagaagtttaagcattggcagatgggaaagtcgggccttgaaatgatccaacaggagaaattgagacagttgcgggattgcatcatcgggaaacgacccgaggaagagaatgtctataacaaactgaccatcgttcatcatcctgggggaaaagagactgcccataatgagaacaagttttacaatgtgcacttctccaacaaactgccagctcgcccccaggtggaaaaggaattcggcttctgttgcaagaaggaccactag

SEQ ID NO: 180280 - DNA, 2268 bp, Artificial Sequence
  Description of Artificial Sequence: Synthetic coding sequence
atgatctacgaggaggacgccgaggagtgggccctgtacctgaccgaagtcttcctgcatgtcgtgaaacgcgaagctatcttactgtaccggcttgagaatttctccttccggcacctggaacttctcaacctgacatcttataagtgtaagctgcttattctgtcgaattcactcttgagagacttgaccccaaagaagtgtcagtttctagagaagatcttgcacagccctaaatctgtggtgactctgctatgtggagtaaaatccagtgaccagttgtatgagctccttaatatcagccagagccgctgggaaataagtaccgagcaggagcctgaagactacatctctgttatacaatctatcatctttaaggattctgaagattatttcgaggtcaacatacccactgatctccgggcaaagcatagcggcgaaatctccgagcgcaaagagattgaggagcttagcgaagcaagcagaaacaccattccccttgccgtcgtgctgcctacagaaataccttgcgagaatcctggcgagatttttattattctgagagatgaagtgatcggtgacacagtggaggtagaatttacctcgtcaaacaagagaattagaaccagaccagcactgtggaacaaaaaggtctggtgcatgaaggcactggagtttcctgctggctcagttcacgttaacgtctactgcgatggaattgtgaaagccacgactaagattaagtattaccccaccgccaaagccaaagagtgtctctttagaatggccgatagtggagaatccctttgtcaaaattcaattgaggagctggacggcgtgctcaccagcatcttcaagcacgagattccgtactacgagttccaatccctgcagactgagatttgttcccagaataagtacacccattttaaggaactgccgactcttcttcactgcgccgcaaaattcggcctcaaaaatcttgcaatccacctcctacaatgttccggagccacatgggcctcgaagatgaaaaacatggagggaagcgatcctgcccatatcgcggaaagacatggtcataaggaactgaagaaaattttcgaggatttctctatccaagaaattgacattaataacgagcaggaaaacgattatgaggaagatatcgcttccttttccacttacatccccagcacacaaaacccagcgtttcatcacgagtctagaaaaacatacggacaatcggctgatggggctgaagctaacgagatggagggcgagggcaagcaaaacggatcaggcatggagacaaagcactcacccctggaggtgggcagcgagtcaagcgaggaccagtacgatgacttgtacgtgttcatccctggagccgatcccgagaataatagccaagaaccactgatgtctagcagacctccccttccaccaccccggcctgtcgccaacgcgttccagctggagcgaccccatttcacactccctggtactatggtagagggacaaatggaacgtagtcagaactggggccacccgggagtaagacaggaaaccggcgatgagcccaagggcgaaaaagagaagaaggaggaagaaaaagagcaggaggaggaagaggacccttacaccttcgccgaaatcgatgattctgagtacgatatgatcttggcgaatttgtccataaaaaaaaaaactggcagtagaagttttattatcaatcgtccacccgcccccaccccaagacccacgagtatccctccgaaggaagagaccaccccgtacatcgctcaggtctttcagcagaaaacggcccgccgccagtccgacgacgataaattctgcggccttccgaaaaagcaagacagagctcgaattgagtctccagctttttccacacttcggggatgcctcaccgacggccaggaggaattgattttactccaggagaaagtgaagaatgggaagatgtcgatggacgaggccctggagaagtttaagcactggcagatgggtaaaagtggcctggagatgatccagcaagaaaagttacggcagcttcgcgattgtatcattgggaaacgtcctgaggaggaaaacgtgtataacaagttgacaatcgtccaccatcccggaggcaaggagactgcgcataacgaaaataaattttataatgtccatttcagtaacaagcttcccgctaggccccaggtggagaaagaatttggcttttgctgtaaaaaagatcactag

SEQ ID NO: 180281 - DNA, 2313 bp, Artificial Sequence
  Description of Artificial Sequence: Synthetic coding sequence
atggtgaactgccacctgaagatcggcaacaccaaggacatcatcatgatctacgaagaggacgctgaggagtgggcactatatctgaccgaggtctttcttcatgttgtcaagcgagaagcaattctcctgtatagacttgagaacttctcttttcgccacctggaactgctgaaccttactagttacaaatgcaagctgctgatcctaagtaactcgcttctgcgtgatctgacgcctaaaaagtgtcagtttcttgaaaaaatattgcatagccctaagagcgttgtgacactgttatgcggggtcaagtcctccgatcagctgtacgagctgttgaatatttcacaatcaagatgggaaattagcactgagcaggaaccagaagactacatcagcgtaatacagtccattatctttaaggattcagaggattattttgaggtgaatatcccaaccgacctccgggctaagcactcgggggagatatcagagcgcaaggaaattgaggagctgagcgaggctagcaggaacaccattccactagccgtggtgctcccaacggagattccatgtgagaatcccggagaaattttcatcatcctgcgcgatgaggtcatcggggacactgtggaagtggagtttacatcttcaaacaaacgaatcaggacaaggcccgctttatggaacaagaaggtctggtgtatgaaggctctggaattccctgccgggtcagtccacgtgaatgtgtactgtgatggtattgtcaaagcgaccactaaaattaagtattacccaaccgctaaagccaaggagtgcctgttccggatggcagactctggcgagagcctctgccagaatagtatagaggaactggacggcgtgttaacatccatctttaagcacgagattccatattatgagtttcagtccctgcaaaccgagatctgctctcagaataaatatacccacttcaaggaactcccaacgttactgcactgcgccgcgaaattcggcctgaaaaatctagccatacatctgcttcaatgtagtggggctacctgggcctccaaaatgaagaatatggaggggtcggatccagcccacatcgcagagcggcacggccacaaggagctgaagaaaatattcgaggattttagtattcaagagatcgatatcaacaacgagcaggagaacgactacgaggaggatattgcctcttttagtacatatatcccgtctacccaaaatcctgcgttccaccatgagagccgaaaaacgtacggacagtctgccgatggcgcggaggctaacgagatggaaggcgagggcaaacaaaacggttctggaatggagacaaaacatagcccccttgaagtgggatctgaatcttctgaggaccagtatgacgacctgtacgtgtttatccctggcgctgaccccgaaaataactcacaggaacctcttatgagctctaggcctcccctgccacccccgcgcccagttgctaacgcattccagctggagaggccccacttcacattaccagggaccatggtggaaggtcagatggagcggtcccaaaattggggacatccgggtgtgagacaagagactggagatgaaccgaaaggcgaaaaggaaaaaaaggaggaagaaaaagagcaggaggaggaagaggatccatacacttttgctgagatcgacgactcagaatatgacatgatcctggctaacctgtccatcaaaaagaagactggctcccgctcgttcataataaatagaccgccggcccccacaccacgccccacttcgatccctcccaaggaggaaaccaccccgtacatcgcccaggtgttccagcaaaaaaccgcacggcggcaatctgacgatgacaagttttgtggcctgcctaagaagcaagatcgagctcggattgaatcgccggcgttttccaccttaagagggtgcctgaccgatggccaggaggaacttattctcctgcaggaaaaggtgaagaacggcaagatgtcaatggacgaggcattagaaaagttcaagcattggcagatgggtaagagcggactggagatgatccaacaggagaagctgcggcaattacgagactgtattatcggcaaacgcccggaagaggaaaatgtatacaataaattaacaatcgttcaccaccccgggggcaaggaaacagcgcataacgaaaacaagttctataacgtgcacttctccaacaaactgccagcacggccacaggtggagaaggaatttgggttttgctgtaagaaggatcactag

SEQ ID NO: 180282 - DNA, 1959 bp, Artificial Sequence
  Description of Artificial Sequence: Synthetic coding sequence
atgctgcccgccgcccccggcaagggcctgggcagccccgaccccgcaccctgcggtcctgccccccctgactctgaggactactttgaagtcaatattcccacggatctaagggctaagcattcaggggaaatatccgagcgcaaggagattgaagagcttagcgaggcttccaggaacactatccctttagctgtggtgctcccaacagaaattccctgtgagaacccaggtgaaatattcattatacttcgcgatgaggttatcggtgataccgtcgaggttgagtttactagctcaaataaacgtatccgcacccggcctgccctctggaataaaaaagtttggtgtatgaaagcactcgaattccccgctggatctgtacacgttaatgtgtattgcgacggcattgtaaaggctactaccaaaattaaatactaccccaccgctaaggctaaagagtgtttattcaggatggcagatagtggagagtctctttgtcagaatagtatagaggagctggatggcgtgttaacctctattttcaagcacgagatcccgtactatgaattccagtcactgcagactgagatatgctctcaaaacaagtacacacacttcaaggaactacccacgcttttacattgcgccgcgaagtttggacttaagaatctggcgatacacctgttgcaatgcagtggcgccacgtgggctagcaagatgaaaaatatggagggctccgaccccgcacacattgctgaacgccacgggcacaaggagctgaaaaaaatatttgaagacttttcgatacaggagatcgacattaacaacgagcaggagaacgactacgaagaggatatcgcgtccttcagcacctatatccctagcactcaaaatcctgccttccatcatgaaagtagaaaaacctacggccagtcagctgacggcgctgaggcaaacgagatggagggcgaaggtaagcaaaacggatctggtatggagacaaagcatagcccattggaagtcgggtccgagagcagcgaggaccagtatgacgacctttatgtattcattcccggggcggatccagagaataactcacaggaaccacttatgagctcacgacccccactgcctcctcctagaccggtagcaaatgcgtttcaattggaacgtccacattttacccttcctggcaccatggtagagggtcagatggaacggtcccagaactggggacatccgggcgtcagacaggaaactggggacgagccaaaaggggagaaagagaaaaaggaggaggagaaagagcaggaggaagaggaggatccatacacatttgcagagatcgatgactccgaatatgatatgatcttggctaatctgtctatcaagaaaaaaacaggaagcaggtccttcataataaaccggccaccagctcccaccccacgcccaacaagcatccctcctaaggaagagacaacaccctatatcgcacaggtgtttcaacaaaaaaccgcaaggcggcagagcgacgacgacaaattctgtggcctgcctaagaagcaggacagggcacggatagagagccccgctttttcaacactgcgaggatgcctgactgatggccaggaagagctgattctactccaggagaaggtgaaaaatggaaagatgagtatggacgaggccctggaaaaattcaaacattggcaaatgggcaagtccggcctcgagatgatccagcaggaaaaactgaggcagctgcgggattgcattatcgggaagcgtcccgaagaagagaatgtttataacaagctgaccatcgttcatcaccccgggggtaaggaaactgctcacaatgagaacaagttctacaacgtgcatttttccaacaagctccccgctagaccgcaggtggagaaggaattcggcttctgttgtaaaaaagatcattag

SEQ ID NO: 180283 - DNA, 516 bp, Artificial Sequence
  Description of Artificial Sequence: Synthetic coding sequence
atgcaccccttctacacccgggccgccaccatgatcggcgagatcgccgccgctgtttcctttattagcaagttcctgaggaccaaggggctcactagtgagcgccaactccagacatttagtcagagcctgcaggaattactggccgagcattataaacatcactggttccccgaaaaaccttgtaaaggctccggttatcggtgcatccggatcaaccacaaaatggatccccttattggacaggctgcccagcgcatcgggctcagctctcaggagctgtttaggctgctgccaagcgagttaactctgtgggttgacccctacgaggtgtcatacagaataggggaggatggctcaatatgcgttctgtacgaagcatctccagctggaggaagtacgcaaaattccactaacgtgcagatggttgacagtcgcatctcttgtaaagaggagttgctcctcggccgcacatccccatccaaaaattacaatatgatgaccgtatccggctag

SEQ ID NO: 180284 - DNA, 672 bp, Artificial Sequence
  Description of Artificial Sequence: Synthetic coding sequence
atgcgggacgagatcgccaccaccgtgttcttcgtgacccggctggtcaaaaaacacgataaactgagcaaacagcagatcgaggacttcgctgagaagctgatgaccattctcttcgagacctatagatcacactggcacagcgactgcccaagtaagggacaggccttccgttgcatacgcattaacaacaatcaaaacaaggatcccattttggagcgggcatgtgtagagagcaacgtggacttcagccatcttggtctgccaaaagagatgaccatctgggtcgaccctttcgaagtgtgttgccgatacggtgagaagaatcatccgttcactgtcgccagcttcaaggggcggtgggaggagtgggaattatatcagcagatcagttatgccgtaagtcgggcttccagtgacgtgtcttccggaacgtcctgcgacgaagaaagctgtagcaaggaaccccgagtgatccctaaagtatccaatccgaagtccatctatcaggtggaaaacctgaaacagcctttccagtcttggctgcagatccctcgaaagaagaatgttgtggatgggcgagtggggttactgggaaatacttaccacggaagtcagaagcatccgaaatgctaccgaccagcgatgcacaggcttgacaggatactgtag

SEQ ID NO: 180285 - DNA, 483 bp, Artificial Sequence
  Description of Artificial Sequence: Synthetic coding sequence
atgcgggacgagatcgccaccaccgtgttcttcgtgacccggctggtgaagaagcacgacaagctaagcaagcagcagatagaagattttgcggaaaaacttatgaccatactgtttgagacctatagatcccactggcactctgattgcccctccaaaggacaagcgtttcgatgtatcaggatcaacaataaccaaaataaagaccccatcctggagagggcctgtgtagaatctaacgtggactttagccatttaggtctacctaaagaaatgaccatatgggtggacccctttgaagtgtgctgtaggtacggcgagaaaaatcatccctttactgtggcatcatttaaggggcggtgggaggaatgggagctgtaccagcagatttcctatgcagtctcgcgtgcaagctccgacgtcagtagtggaacatcctgcgacgaagagagctgtagtaaggagccaagggtgattccatag

SEQ ID NO: 180286 - DNA, 1188 bp, Artificial Sequence
  Description of Artificial Sequence: Synthetic coding sequence
atgagcctggtggacctgggcaagaagctgctggaggccgcccgggccggtcaggatgacgaagtgcgcatcctgatggcaaacggggctccattcacaacagactggctgggcacttcaccactccacttagctgcccagtacggacattatagtaccactgaggtgcttcttcgggcgggtgtgtctcgagacgctagaaccaaagtggacaggactcccctgcatatggccgcaagcgaaggacacgcatctatcgtggaggtgttgctgaagcacggggccgatgttaatgccaaagatatgctgaaaatgactgcgcttcactgggcgaccgagcataaccatcaagaggtggtggaactcctgatcaaatatggggcggatgttcacacccagtctaagttctgcaaaactgcattcgatatctcaattgataatggaaacgaggacctggccgaaatcctgcagatcgcaatgcagaaccagatcaacacaaacccggaatctccggacactgtcaccatccacgccgctacgcctcagtttataatcgggccaggtggcgtggttaatttaacaggcctggtgtcgagcgagaattcatcaaaagctaccgatgagacgggcgtctccgccgtccagtttgggaatagctctacatccgtgctggcaactcttgctgctctggctgaagcatctgcgcccctctctaacagtagcgaaacacccgttgttgccaccgaggaggttgtcaccgccgagtcagtcgacggggctatccaacaggtggtgtcaagcgggggccagcaggtaatcaccatagtgacggatggtattcagctggggaatttacattcaattcccaccagtggcatcggacagcccataatcgtgacaatgccggatgggcagcaggtattaaccgtgcccgccactgacatcgccgaagaaacggtgatttccgaagagccccctgccaaaagacagtgtattgagattatagaaaaccgagtggaatctgccgagattgaagaacgggaggctttgcaaaagcagctcgatgaggcgaatcgggaggcgcagaaatataggcagcaactcctcaagaaggaacaagaggcagaggcctatcggcagaaattagaggcaatgactcggttgcagaccaataaagaagccgtctag

SEQ ID NO: 180287 - DNA, 555 bp, Artificial Sequence
  Description of Artificial Sequence: Synthetic coding sequence
atggagcccagccagtgcgtggaggagctggaggacgacgtgttccagccagaggacggagagcctgtgacccaacctgggtccttgctcagcgctgatctgttcgcccagtccctgcttgactgcccactgtcaagactgcagctctttcctctgacccactgctgtgggcctggacttagacctacgtctcaggaagataaagccactcagaccctcagtcccgctagcccttcccagggcgtgatgctcccgtgcggagttactgaggaaccccaacggctcttctatggaaacgcaggctaccggctgccgctgcccgcaagcttccctgcggtccttcccatcggcgaacaaccaccggaaggacagtggcagcaccaagcagaagtgcagatcgcccggaagctgcaatgtatcgcagatcaattccatcgattacacgtgcaacaacatcagcaaaaccagaatagggtgtggtggcagatcctgttatttctccataatctggctctcaacggggaggaaaaccgaaacggcgccggacctcgctag

SEQ ID NO: 180288 - DNA, 555 bp, Artificial Sequence
  Description of Artificial Sequence: Synthetic coding sequence
atggagcccagccagtgcgtggaggagctggaggacgacgtgttccagcctgaagatggagagcccgtgactcagcccggttccttgctgtctgctgatttattcgcacagtcactacttgattgcccactgtcacgactgcagctgttcccattgacccattgctgcggacccgggctgaggccaacctctcaggaagataaggctacgcaaactttatcccccgctagtcctagccagggcgtaatgctcccctgtggcgtgacagaggaacctcagaggctattctatggaaacgcagggtacaggttgccattacctgcctctttccccgctgttctgcccattggggaacagcctcccgaaggacagtggcagcatcaggctgaagtgcagatagctcgcaaattacaatgcatcgcagaccagttccaccgactccatgtccagcagcaccagcagaatcaaaaccgcgtctggtggcaaatcctgctctttctgcacaatcttgctctgaacggagaggaaaatagaaacggagcaggcccccggtag

SEQ ID NO: 180289 - DNA, 492 bp, Artificial Sequence
  Description of Artificial Sequence: Synthetic coding sequence
atggagcccagccagtgcgtggaggagctggaggacgacgtgttccagccagaagacggggagcctgtgacccaacccggatccctcctgagtgccgacttattcgcacagtcgttgctggactgtcccctgagccgcttacagctcttccccctcacacactgttgcggcccggggttgagacctacatcacaggaagataaagcaactcaaacactgtccccagccagcccatcacagggggtcatgctcccttgcggagtgacagaggagccccaacgtctgttttacggcaatgccggctaccggctgccactccctgctagttttccggccgttctgcccattggagagcagccacccgaaggacaatggcagcaccaggcggagcaccagcagaaccagaatagagtatggtggcagatccttctttttctccacaacctcgccttgaacggagaggagaatagaaatggggcaggacctaggtag

SEQ ID NO: 180290 - DNA, 186 bp, Artificial Sequence
  Description of Artificial Sequence: Synthetic coding sequence
atggagcccagccagtgcgtggaggagctggaggacgacgtgttccagcccgaggatggggaacccgtgacacagcctgggtccctgctgtcagcagacctgtttgcacagagcctattagactgtccactctctcgcctgcaactgtttcctttgacacactgctgtgggcctgggttaagatag

SEQ ID NO: 180291 - DNA, 390 bp, Artificial Sequence
  Description of Artificial Sequence: Synthetic coding sequence
atggagcccagccagtgcgtggaggagctggaggacgacgtgttccagcccgaggacggtgaacctgtgactcagcccgggagcctgctttcagcagacctcttcgcccaatcccttctggattgtcccctttcccgactgcagttgttccccttaacccattgctgtgggcctgggctgcggccaacaagccaagaggataaagcaacacaaactctcagccctgctagcccaagccaaggtgttatgttaccctgcggcgtgacagaagagcctcaaaggttattctatgcacccgccgaacccaaatcatgtgtagttgcagatcctcccctcccagcacagccttgtttcgagtggcggagggagcaggaacgcggcaggccatag

SEQ ID NO: 180292 - DNA, 42 bp, Artificial Sequence; identical to SEQ ID NO: 74098
  Description of Artificial Sequence: Synthetic coding sequence

SEQ ID NO: 180293 - DNA, 555 bp, Artificial Sequence
  Description of Artificial Sequence: Synthetic coding sequence
atggagcccagccagtgcgtggaggagctggaggacgacgtgttccagcctgaagatggagaacctgtgacacagccaggatctctcctttccgccgacctttttgctcagtcactcttggattgtcccctcagtaggctgcagttgtttcctcttacacattgttgcggaccaggcttgagacctacaagtcaggaagataaggctacccagactctgtcccctgcctcaccttcgcaaggggtaatgctcccgtgcggcgtgacggaggaaccacaaaggttattctacggaaatgctggctataggctcccgctgcctgcttctttccccgctgtgctacctataggagagcaacccccagaaggacaatggcaacatcaagctgaagtgcagattgcaaggaaactccagtgtatcgccgaccaattccataggctacacgtccagcagcaccagcagaatcaaaaccgagtttggtggcagatactactgtttctgcataacctggcacttaacggcgaggaaaaccgaaacggtgctggtccccgctag

SEQ ID NO: 180294 - DNA, 555 bp, Artificial Sequence
  Description of Artificial Sequence: Synthetic coding sequence
atggagcccagccagtgcgtggaggagctggaggacgacgtgttccaacctgaagatggggagccggttactcaacccgggtctctgttatcagccgacttattcgcacagtcgttattagattgtccactgtcccggcttcaactgttccccctgacacactgctgcgggcccggtcttagacctactagtcaggaagataaagcaacccagacactgtccccagcctccccgagtcagggagttatgctgccttgcggagtgaccgaagaaccccagcggttgttttatggcaacgctggatataggctgccattgccagcttcttttcccgccgtgctgcctatcggggagcagccacctgaaggccaatggcagcatcaggccgaagttcagatcgcccgcaagttgcaatgtatagctgaccagttccatcgcctccacgtgcagcagcatcagcagaaccagaatagggtgtggtggcagattctgctgttcctccacaatcttgcgctgaatggagaagagaacaggaatggcgcgggacccagatag

SEQ ID NO: 180295 - DNA, 585 bp, Artificial Sequence
  Description of Artificial Sequence: Synthetic coding sequence
atgagccagaacggcgcccccggcatgcaggaggagagcctgcagggatcgtgggtcgagttacacttcagcaacaacggtaacggcggcagtgtgccagcgagcgtgtcgatctacaacggagatatggagaagattttgcttgatgcccagcatgagtccggaagatctagcagtaagtcttcacactgcgacagtccgccacgctcacaaaccccacaggatactaaccgcgcatctgagactgacacccattctattggagagaaaaattcaagtcagtcagaggaggacgatatagaaagaaggaaagaagtagagagcatccttaaaaaaaactcagactggatttgggactggtcatcccggcccgagaatattcccccaaaggaattcctattcaagcaccctaaacggaccgcaaccctcagtatgcggaacacaagcgtcatgaagaaaggtggtatcttttcagcagaattcttaaaagtgtttctcccatcactgctgctcagtcatctgctggcaattggcctgggtatatacatcggccgtcggcttacaacatccacctctacgttttag

SEQ ID NO: 180296 - DNA, 543 bp, Artificial Sequence
  Description of Artificial Sequence: Synthetic coding sequence
atgagccagaacggcgcccccggcatgcaggaggagagcctgcagggttcttgggttgagctacacttcagcaataatggaaacggaggatcagttcccgcctccgtctccatctacaacggagatatggaaaagattctcctggacgcacaacacgaaagtggacgctcaagcagcaaatcttctcactgtgactctccccctagatcgcagaccccacaggacaccaatagggcgtctgagaccgatactcatagcattggagaaaagaattctagccagtctgaggaagatgacattgagcgccgtaaggaagtcgagagcattttaaaaaagaacagtgactggatctgggactggagctccaggcccgaaaatatcccacctaaagagttcctgtttaaacatccaaagagaactgctactctgtctatgcggaacacatctgtcatgaagaaggggggtattttcagtgcagagtttctgaaagtattcctccctagtttactcctatctcacctccttgcaattggactgggatag

SEQ ID NO: 180297 - DNA, 1071 bp, Artificial Sequence
  Description of Artificial Sequence: Synthetic coding sequence
atgagccggcccctgctgatcaccttcacccccgccaccgaccccagcgacttatggaaggatggccagcagcagccccagcccgagaagcctgagtctaccctcgatggtgcagccgccctggctttctatgaagctcttatcggggacgaatcctccgcccccgattctcaacgatctcaaaccgaacccgctagggagaggaaacgaaaaaaacggcggatcatgaaggccccagctgcagaagccgtggctgagggcgctagtggtcgacacgggcaagggcgatccctcgaggcggaagataaaatgacccacagaatactcagggctgcgcaggaaggcgacctccctgagctgcgaaggctgctcgagccacatgaagccggcggtgcaggcggcaacattaacgccagggacgccttttggtggactcccctgatgtgcgctgcgcgtgctgggcagggcgccgcagtgtcctatttactgggccgtggcgctgcctgggtcggcgtctgcgaactgtccggaagggacgctgctcagttagcagaagaagctggtttccccgaggtcgctcggatggtccgagaaagtcatggagagacccggtcccccgagaataggtcccctacacccagccttcagtattgtgagaactgtgacacccatttccaagattctaatcatcgcacgagtaccgcccatctgttgtcacttagccaaggacctcagccacctaacctcccgttgggtgtgccaatctcatctccaggtttcaagctcctcttaaggggaggatgggagcctggcatgggcctgggaccgcgtggggagggacgagcaaatcccatcccgacagtgctcaaaagagaccaagagggtcttggctatcggtctgcgccccaaccacgtgttacacactttcctgcctgggacacacgggccgtggccggaagagagaggccccctagggtggccacactgtcctggagagaggagaggcgtagagaggaaaaggaccgagcctgggagcgggacctccggacctatatgaaccttgaattttag

SEQ ID NO: 180298 - DNA, 3399 bp, Artificial Sequence
  Description of Artificial Sequence: Synthetic coding sequence
atggagcccaacgacagcaccagcaccgccgtggaggagcccgactccctggaagtcctggtgaaaactctcgactcgcagacacgtactttcattgtgggcgctcagatgaatgtgaaagagtttaaggaacacatcgcagcatccgtctcaatccctagtgaaaaacaacgactgatctatcaggggcgagtgctgcaggacgataaaaagttacaggagtacaatgtggggggcaaggtcatccacctcgttgagcgggccccaccacagactcatctgccgtccggagcctctagcggtaccggctccgcttcagcaactcatgggggggggtctccaccagggacacggggacctggggctagcgtccatgaccgcaatgcaaattcttacgtgatggtcggcacgttcaatctgccctctgacggctcagcagtggatgtgcatataaatatggaacaggctcctatccagtctgagccccgcgtgcgtctcgttatggcccagcacatgattcgcgacatccagactctgctgtcccggatggagacgctaccctatctccagtgtagaggaggcccccagcctcagcattcccaacccccccctcagcctcctgccgtgacgccagaacccgtggctttatccagccagacgtctgaacctgtggaatccgaagcccctcccagggagcccatggaagccgaagaggtggaagaacgtgctcctgctcaaaaccccgagctgacaccaggccctgcccccgcaggccccacgccagctcctgagacaaatgcgcccaatcacccctcccctgccgagtacgtggaagtcctgcaggagctgcagcgtctcgagtcccgactccagcctttccttcagcggtattatgaggtcttgggggctgctgcgaccaccgactacaataacaaccacgaaggacgagaggaagaccagcgcctgatcaacttagtgggcgagtcactgagactgcttggaaacactttcgtcgctctgagtgaccttcgttgtaatctcgcatgtacaccgccgagacatctccacgtggtgaggcccatgagccattatacaactcccatggttctgcaacaggccgccatccccattcaaatcaatgtcggtaccactgtgactatgacagggaacggtaccagacccccccctaccccaaatgcagaagcacccccaccagggccaggtcaagcatcaagcgtcgccccctcatctactaatgtggagtcatccgcagagggggctccgccacctggacccgcccctccaccggcaacttctcacccacgagtcatacgcatttcgcaccagtctgtggagccagtggtgatgatgcacatgaatattcaggactctggtacccagcccggcggggtgccttctgcacctactggtcccttgggaccaccaggacacggccaaacccttggccagcaggtgccgggattcccaaccgcgccaacaagagtggtcattgcaagaccgacgcctccccaagctaggccgagccaccctggagggcccccagtgagcggcacgttgcagggcgccggattaggaaccaacgcgtcactcgcccagatggttagcggcttggtcggtcagttgctcatgcagccagtattggtcgcccagggcacccccgggatggccccccctcccgcgcccgcgactgcgagcgccagtgccggcaccacaaataccgccaccactgccggacccgcccccggcggcccagcccagcccccacccacgccacagccctccatggccgatctgcagttctcccagctcctgggcaacctcctgggacctgcaggcccaggcgccggcggctccggcgtcgcttctcccacaatcaccgtggctatgccaggagtgccagcctttctacagggaatgaccgactttcttcaagcaacacagactgccccaccaccgccccccccccccccgccacctcccccggcacccgaacaacagacgatgccaccacccggctctcccagcggaggcgccggctctccaggaggcctgggccttgagtccctatctcctgagttcttcacaagcgtagtccaaggggtcctgtcatctctgctcggaagcttgggtgcgcgggccgggagcagtgaaagcatcgccgcatttatccagaggttaagcggaagctccaatattttcgagcctggtgcagatggagccctggggtttttcggtgccctgttgagcctgctctgtcagaatttcagcatggtggatgttgtcatgctgcttcacgggcacttccagcccctccaacggctgcaaccccagctgaggtcattttttcatcagcattatctagggggccaggagcccacaccttcaaatattcggatggctactcacaccttaatcacggggctggaggagtacgtacgagagagtttttcactggtgcaggtgcagcccggcgtggatattatccggactaatctggagttcttgcaggagcagtttaattcaattgccgcccacgtattacattgtaccgattcaggattcggggccaggctcctggaactgtgcaaccagggtttgttcgaatgtttagctctgaatcttcattgtctgggcggccagcagatggaactggcagctgtgattaacggcagaattaggagaatgtcacggggcgtgaacccttccctggtgtcctggctcaccacaatgatggggctccggctccaggtcgtcctcgagcatatgcctgtgggtcccgatgccatcctccgatacgtgcggcgagtgggtgaccctccccagccactgccagaggagcctatggaggtccagggggctgaaagagcaagtcccgagccccagagggaaaacgcatcacccgcacccggcacaactgcagaggaagccatgagccggggacctccacctgcacccgaaggcgggagtcgcgacgagcaggatggggcctctgccgagacggagccgtgggctgctgccgtccctcccgagtgggtgcccattatccagcaggacattcagagccaacgcaaagtaaagcctcagcctcctctctcagatgcctacctgtccggcatgccggcgaagagacgtaagacaatgcaaggcgagggcccgcagctgctgttaagcgaggccgtgtcccgcgctgcaaaggccgcaggagctcgtcccctgacatcaccagaatccctctcgcgtgatttggaggctcccgaagttcaggagagttaccggcagcaactcagaagtgacatacagaagaggctgcaagaggatcccaactattcgccacagaggtttcccaatgcgcaacgcgccttcgctgacgatccttag

SEQ ID NO: 180299 - DNA, 3234 bp, Artificial Sequence
  Description of Artificial Sequence: Synthetic coding sequence
atggagcccaacgacagcaccagcaccgccgtggaggagcccgacagcttggaggttctggtgaagaccctggattcacagacacgcactttcattgttggcgcacagatgaatgtaaaggaatttaaggaacatattgccgcctcggtttccatcccttctgaaaaacagcggctcatctaccaaggtcgtgtgctccaggacgacaaaaaattgcaggagtacaatgtgggaggaaaagtcatccatctggtggagcgagctccaccccaaactcacctgccatctggggcttccagcggaaccggttccgcctcagcaacccatggaggaggtagcccccccgggacccgggggccaggagctagcgtgcatgatcggaatgctaactcctacgtgatggtggggactttcaatttgccaagtgatggctcagctgttgatgtccatattaacatggagcaggcacctattcagtcagaacctcgagtgaggctggtgatggcccaacacatgattcgggacatacaaacactgttatccagaatggagtgcagaggaggacctcagccgcagcactcccagccccctcctcagcctcccgctgtgacacccgagcctgtggctcttagcagccagacaagcgagcccgtggagtccgaggcacctcctagggagcctatggaggccgaagaggtcgaggagcgggcaccggcccagaaccccgagcttactcctgggcctgctcccgcggggcctactcccgccccggaaaccaatgccccgaaccacccctccccggctgaatatgtggaagtgctgcaggaactgcaacgtctcgagagtcgcctgcagccttttctccagcgctattatgaagttttgggggctgcagccaccacagactataacaacaatcatgaaggacgtgaggaagatcagagactgattaatctcgtgggcgagtctctccggcttttagggaatacgtttgttgctctctccgacttgaggtgcaacctggcctgcacccctccgcgtcatttgcatgtggtaagacccatgtcccattacacaacccccatggttttgcagcaggccgcgatccccatacagataaacgtcggcacaactgtgaccatgaccgggaatgggaccagaccacctcctactcccaatgcagaggcgcctcctcccggtccgggccaggcctcaagcgtcgcgccaagcagcacaaatgtggaatccagcgcagagggagccccccctccggggcccgctccaccccctgccactagccaccccagagtcatcagaatttctcaccagtccgtcgaaccagtggtgatgatgcacatgaacatccaagatagtggcacacagcctgggggtgttccctcagcgcctacaggacctctgggcccgcccgggcatggtcaaacacttggccagcaggtgcctggtttcccaactgcacccaccagagtcgtgatcgcacgccccaccccaccccaggcaaggccgtcgcatcctggcggcccaccagtctcaggcacgctgcagggcgccggtctgggtacaaacgccagtctggcacagatggtctctggacttgtcggccagctattaatgcagcctgtgttggtggcacagggaactcccggtatggctcctccacctgctcccgctaccgcctcggctagtgcggggacaaccaacactgccacaacagccggacctgctcctggaggacctgctcagccgccaccaactccacaaccttctatggcggaccttcaattcagccagctgctcggtaatctcctgggacccgctgggcccggagccggcgggagtggagttgcctctccaaccattaccgtggctatgcccggcgtgccggctttcttgcaaggcatgactgacttcttgcaagctacacagacggctccgcccccccctccccctccccctccgccaccccctgcccctgagcagcagacgatgccccctcctggctccccaagcggcggagctggctcacctggcggccttggcctggagtctctgtctcccgaattttttacgtctgtggtacaaggggtactgtcctcactcttaggtagcttgggggcacgcgccgggagctccgagtcaattgctgctttcatacagcgcctgtccggctcaagcaacatcttcgagccaggcgctgatggggctctcgggttctttggtgctttgttgtccctgctgtgtcagaacttttctatggtcgacgtggtaatgttgttgcacggtcacttccagcctcttcaaagattgcagccacaactgcgtagtttcttccatcaacactacttaggcggacaagaaccgacgccttcgaacatccgaatggccacgcacaccctgatcaccgggctcgaggaatatgtccgggagagcttttctctggtgcaggtgcagcccggggtggacataatccggaccaacctggagtttcttcaagaacagtttaatagcatagccgctcatgtgctccactgtacagattctggattcggtgcgcgcctgcttgagctgtgcaaccagggactcttcgaatgcctggcactcaacctgcactgcctgggtggtcagcaaatggagctcgccgctgtcattaacggccgaatcagacgaatgtctcgcggcgtaaatccaagcctcgtctcatggctcaccacaatgatgggactgcgtctgcaggtggtactggaacacatgccagtaggcccagacgccatactcaggtacgtgaggagggtaggggaccctccacaacccctaccagaggaaccaatggaggtgcagggggctgagagggcatctccggaaccacagcgggagaacgcaagccctgcacctggcactacagcggaagaggccatgtctcggggccccccaccagcaccggaggggggcagtcgggacgagcaggacggcgccagtgcggagacagagccttgggctgccgcagtgccaccagagtgggtccccattatccaacaagatattcagtcccagcgcaaggtgaagcctcagccaccgttgtccgatgcatatttgtcaggcatgcctgccaaacgcagaaagctaaggtccgacatacagaagagactgcaggaagatccaaattacagccctcagaggttccctaacgcgcagcgcgcattcgctgacgacccatag

SEQ ID NO: 180300 - DNA, 3399 bp, Artificial Sequence
  Description of Artificial Sequence: Synthetic coding sequence
atggagcccaacgacagcaccagcaccgccgtggaggagcccgactctctggaagtgttggtgaaaacattggatagccagacacgtacattcatcgtgggtgctcagatgaatgtgaaagagttcaaggagcatatagctgccagcgtgtcgatccctagtgaaaaacagaggcttatttaccaggggcgcgtgctccaggatgacaagaagctccaggagtacaacgttggtggcaaggtcatccaccttgtggagcgggccccaccccagacccacttaccctccggcgcgagcagcggaaccggaagcgcctctgccacccacgggggcggctcccctcccggaaccagagggccgggtgcttctgtgcacgatcgaaacgcaaactcttatgtgatggtcgggaccttcaatctaccaagtgacgggagcgccgttgatgttcacatcaatatggaacaggcccccattcagtcagaaccccgggtgcgcctcgtgatggcccagcacatgatcagggacatccagacactgctgagtcggatggagactctgccttatttgcaatgtagggggggccctcaaccccagcattcccaacccccaccccaaccacccgccgtgacgcccgaaccggtcgccctgtcgagtcagactagtgaaccggtggaatcagaagctcctccaagagaacccatggaggcagaggaggtcgaggaaagagcgccggctcagaatccagagcttacacccggccccgctccggctgggcccactccggctcccgaaactaacgctcctaaccacccctctcccgccgaatatgtcgaagtgctgcaagagctgcaacggctcgagagtcgcttacaacccttcctccagcgttactatgaggtgctaggagctgccgctacaacagattataataacaaccacgaggggcgcgaggaggaccagcgactaatcaatctggtaggcgaatctctgagactgcttggcaatacattcgtcgcactgagcgatctccgatgcaacctggcatgcaccccccctagacacctacacgtggttcggcctatgagccactacaccaccccaatggtcctgcagcaagccgccattcctatccagatcaatgttgggaccacagtgaccatgactggtaacggcacccggcccccacccacgcccaatgccgaggcccctccaccaggaccaggacaagcatcgtcggtggcacccagtagcaccaacgtggaaagctccgcagaaggcgcgccacctccgggccccgcaccacctcccgccacttcccaccctcgcgtgattcgtatcagccatcagtccgtagaaccggtggtgatgatgcacatgaatattcaagattccggtacacagcctgggggggtgcccagtgctccaactgggccattgggacctccgggacatggccagaccctgggacaacaggtgcctggatttcctaccgcacctaccagggtcgttattgcgaggccaacacctccccaagcacggccgtcccatcctgggggaccacccgtctccgggactctacaaggagctgggctgggcaccaacgccagcctggcccaaatggtttcagggctcgtgggtcaactgctcatgcaaccagtactggtagcccaaggcacccccggcatggcacctccaccagctcctgcgactgcatctgcctctgctggcactaccaatacagccactaccgccggtccggcccccggcgggcccgcacagcctcccccgacaccccagccatccatggcggacctgcagttcagccaactgctaggaaacttgttaggacccgccggcccgggcgctggggggagcggcgtcgcgtcccctactattacagttgccatgcctggtgtgccagctttcctgcagggaatgacggacttcctgcaggccacacagactgctccccccccccccccaccacctcccccccctccccccgcccctgagcaacagaccatgcccccacccggatcaccgtccgggggcgctggttcccccggcggccttggtctggaatccctatctcctgagtttttcacctccgtggtgcagggagtgctctcgagtttgcttggaagcttaggcgcgagagcaggatccagtgaatcaatagctgctttcatccaacgactttcaggcagctccaatattttcgaacccggggccgatggagcgctgggtttctttggtgccctgttgtccctgctctgccagaatttttccatggtggacgtagtgatgctgttgcatggccatttccaacctctccagcgtctgcagccccagcttaggtcatttttccaccaacactacctcggaggacaggaacccactccctccaacatccgaatggcaactcatactttaatcactggactggaagagtacgtgagagagtccttctctttggttcaggttcagccgggagttgatattattaggaccaacctggagttcctacaggagcaattcaattccatcgctgcccacgtgcttcactgcacggactcagggtttggcgccaggctcctggaactctgcaaccagggcttattcgagtgccttgccctgaacctgcattgcctgggaggccagcagatggaactggccgcagtgatcaatggccggattaggcggatgtcacgaggtgtgaatccgtccctggtctcgtggcttactaccatgatgggcctgagattacaggttgtgcttgaacatatgcctgtgggcccagacgcaatcctgcgttatgtacggcgggtgggcgatcctccccagccactcccggaagagcctatggaggtccaaggggctgagagagcctctcctgaacctcagagggagaacgcttcacccgctccgggaaccactgccgaggaagctatgagtcgggggcctcctccagctcctgagggcggctctagggatgaacaagacggcgccagcgccgagaccgaaccctgggccgcagcagtcccaccggagtgggtgcctattattcagcaagacattcagtcgcagagaaaggtgaaaccacaacctcctctgagtgacgcctatctctccggaatgccagccaagcggcgcaaaacgatgcaaggagaaggcccacaactgttgctgagtgaggccgtcagcagagctgcaaaggctgcgggggccaggccacttactagcccagaatctctgagtcgcgatctagaggccccagaggtacaggaatcctaccggcagcaattgcgctctgatatccagaaaaggctacaggaggacccgaattattccccccagagatttcctaatgctcaaagagcctttgctgatgacccatag

SEQ ID NO: 180301 - DNA, 3381 bp, Artificial Sequence
  Description of Artificial Sequence: Synthetic coding sequence
atggagcccaacgacagcaccagcaccgccgtggaggagcccgactctcttgaagtactggtgaaaacactggactctcagacacggacctttattgtgggtgcccaaatgaacgttaaggaattcaaggagcatattgccgcttcggtctccatcccctccgagaagcagcggctcatttatcagggacgggtgttgcaagacgataaaaagctacaggaatacaatgtaggcggcaaggtcatacacctcgttgagcgcgcgcccccccagacccatctcccttccggggcctcctccgggacggggagcgcctccgctacccatggggggggaagcccacccggcacccgagggccgggtgcgtctgttcatgatcggaacgccaactcatacgtgatggtcggaacttttaatcttccatctgatggatcagcagtcgacgtacacattaatatggaacaggcaccaattcagtctgaacctcgcgtcagactggtgatggcgcagcacatgattagagacatacagactctgttaagccggatggaatgcaggggcgggcctcagcctcagcatagccagccacctccccagcccccagctgtcactcccgagccagtcgctctgtcgtcacagaccagtgaaccagttgagtccgaggcaccgcctagagaacctatggaggcggaagaagtggaagaaagagctccggcgcagaaccctgagctcactcccggacctgccccggccgggcctactcccgctccagaaacaaacgcccctaatcacccaagtcccgctgaatacgtagaggtcctacaagagttgcagaggctggaatcaaggcttcagccatttctccagcggtattacgaggtgctgggcgctgccgctacgaccgattacaacaataatcacgaaggacgggaggaagatcagaggctcatcaatcttgttggtgaaagtctgagactgctcggaaatacctttgtggcgctgagcgacctcaggtgcaacctggcatgcacaccccctaggcacctgcacgtagtgcgacccatgagccactatactacaccaatggtattacagcaggctgccatccctatccaaattaacgtgggtacgactgtcaccatgactggaaatggcactcggccacccccaaccccaaatgccgaagcacctccgccaggtccaggccaggcctcttccgtggcaccttcctccacaaatgtggagtcttccgccgagggagcccccccacctggaccagccccaccccctgctacatcacatccccgcgttatcaggatcagtcatcagtcagtcgagcccgtggtaatgatgcatatgaacatccaagacagcggtacacagcccggcggagttccctcggcaccaaccggacccctggggccccccggccacggccagacactcggccagcaggtccccggattccccactgcccccacaagggtcgtgatcgcacggcctacccccccccaggcaagacctagccatccaggcgggccccccgtcagcggtaccctgcaaggggcagggttgggaacaaacgccagtcttgctcagatggtgagcggattggtcggtcagcttctgatgcagccggtcttggtggcccagggcacacctggaatggcaccccctccggctcctgccactgcgagcgctagcgctggtactactaacactgctactactgcgggtcctgcgcctggaggcccagctcagcctccccccactccacagccatcaatggctgacctgcaattctcccagctgctcggcaaccttcttggtcccgcgggtccaggggctggggggagcggcgtggcctcacctactatcactgtcgcgatgcccggagtgcctgcctttctccagggcatgaccgacttcctccaggcaacacagactgcacctccgcccccacccccacctccgccaccaccccccgctccagaacaacagaccatgccccctcctgggagcccatccgggggtgccgggtcaccgggtggactaggcctggagagtctgtcccctgaattcttcacttcagttgtgcaaggcgtgctctccagcctgttaggtagcctgggcgcacgggctggctcgagcgagagcattgccgccttcatccagcgccttagcggtagtagcaatatttttgaacctggagccgacggggcattgggttttttcggagcactgctgtctttgctgtgccagaatttttccatggtagatgtcgttatgttgctgcacgggcatttccagccgttgcagcggctgcagccgcagttgcgaagctttttccaccagcactatctggggggccaggagcccactccatctaatattaggatggcaacacacaccctaatcactggactcgaggagtacgtccgagaatccttctcacttgtgcaggtccagccaggagtagacattattcgaactaacctagagttcctgcaagaacagttcaatagtatcgcagcacatgtccttcattgcacagattctggcttcggcgctcggctcttggagttgtgtaatcaggggctgtttgagtgcctagcattgaacctacattgtctcggcgggcaacagatggagctcgccgcagttatcaatggcaggataagaaggatgtctagaggagtgaacccgagtctcgtgtcatggctaacaaccatgatggggttgcggctgcaggtggtgctggaacatatgccagtggggcccgacgctattctgcgctatgtgcgacgggtgggcgatccaccgcagcctctgcctgaggaaccgatggaagtccagggagccgagagagcctcacccgagccacaacgagagaatgcatcacccgcgcccggcactaccgcggaggaggctatgtcacgggggccacccccagcccctgaaggcggctcaagagatgaacaggacggggcctcagctgagacagaaccctgggccgcggccgtaccacctgagtgggtaccaataattcaacaggatatccaaagccagaggaaggttaaaccgcagcctccgctgtctgatgcatatctaagcgggatgcctgccaaacggcgcaagaccatgcaaggagagggaccgcagctgcttttgagcgaagctgtaagtagggccgccaaagcggccggagccagaccacttacctcccctgagtccttatccagggaccttgaagccccagaggtacaggagagctataggcagcagctccgatcggacatccagaagagactgcaggaagatcccaactattccccgcagaggtttcctaatgctcagagggcctttgccgacgatccctag

SEQ ID NO: 180302 - DNA, 3381 bp, Artificial Sequence
  Description of Artificial Sequence: Synthetic coding sequence
atggagcccaacgacagcaccagcaccgccgtggaggagcccgactccctcgaggtgctggttaaaaccctggatagtcagacacgcaccttcatcgtgggtgcccagatgaacgttaaagagtttaaagagcatatagcagcctctgtctcaatcccttcggagaagcagagactcatctaccagggaagagtattgcaggacgataaaaaactccaggaatacaacgtcgggggaaaggtgatccacctggtagaaagagcaccgcctcaaacccatctcccctccggagctagcagtggaacgggctcagcgagcgctacgcatgggggagggtctcctccgggtacacgaggacctggggcctcggtgcacgatagaaacgcgaattcatacgttatggtagggactttcaaccttccgagcgacggatcggcagtggacgtccatattaacatggagcaggcacctattcagtctgagccccgcgttagattagttatggcccaacacatgattcgtgatatccagacgctgctgtcacgcatggaatgccgcggaggtccccagccacagcactcccagccccctccccaacctcccgctgtcactcccgaaccagttgccctctcttcccagacttcagaaccagtggagtcggaagctccaccaagagagcctatggaggcagaagaagtggaagaacgggcacccgcccagaatcctgagcttaccccaggacccgccccagcgggtcctacaccagcgccagaaacaaacgcaccaaaccaccccagccccgcagaatacgtggaagttctccaggagctgcaaaggttagagagccggctccagccatttttgcagcgctactatgaagtgctgggtgccgccgccactactgattacaataacaaccatgaagggcgcgaggaagatcagaggctgattaatctggtgggagagtcgcttcgactccttggcaacacttttgtggccctgtccgacctgcgatgcaacctcgcgtgcacccctcccagacatctgcatgtggtaagacctatgtctcactacacgactcccatggttttgcagcaggcagccatccctatccagataaatgtggggaccacggtgacgatgaccggcaacgggacacgcccaccccctaccccaaacgccgaagccccgcctcctggaccaggccaagccagttcggtggccccctccagcacgaacgtcgaatcctccgcggagggcgccccacctcctgggcctgccccaccacccgctaccagccacccacgagtcatcaggattagccatcagagtgtcgagcccgttgttatgatgcatatgaacatacaagattctggaacgcagcccggaggagtgccctcagctcccaccggacccctagggcctcctggccacggccagacgctgggtcagcaggtgcccggtttccccacagcacccacaagggtggtgattgctcggccgacgccccctcaggccaggccaagtcaccccggtggaccgcccgttagcgggacactccagggtgcaggcttgggtacaaatgcgtccctggcccagatggtttctggtctggtcgggcagctgctcatgcagcctgttctcgttgcccagggcactcccggaatggcccctccacccgcaccagccactgcttcagcctctgccggaaccactaatacagcgacaactgctgggccagcgcccggtggtcccgcacaaccgcctccaacgcctcagcccagtatggcagacttacagtttagtcagttactggggaatcttctgggaccagcagggcccggcgcagggggctcaggtgtcgccagccctacaataacagtcgctatgcccggagtgccagccttccttcagggcatgacagatttcttgcaagctacccagacagcccctcctccaccgcctccccccccacccccccccccagcccccgagcaacaaacgatgcctccccctgggagccctagtgggggggcaggctctcctggcggcctggggctcgagagtctgagcccagaattcttcacttcagtggtgcagggcgtcctctcatcactgctcggatctttgggcgcccgcgcggggtcatctgagtctattgctgcattcatacagagactatccggatcctccaacatctttgagcctggagccgatggggcactgggatttttcggagccctgctctcactgttgtgtcagaatttcagtatggtcgacgtagtgatgctccttcacggacactttcagccgctgcaacgcctgcagccccagctgagatctttttttcatcagcactacctgggcggccaggagccaacaccgtccaacatcagaatggctacacacacgctcattacaggccttgaagagtacgtccgggagtcattcagcctggtacaggttcaacccggagtcgacataattcggacgaatctggaattcctacaggaacagttcaatagtatagcagcacatgtcctgcattgcacagactcaggatttggagcccgactactcgagctctgtaatcagggcctcttcgaatgcttggctcttaatttgcactgcctgggtggtcagcaaatggagttggcagctgtgataaatgggcgcattagaaggatgagccggggagtgaacccctcactggtcagttggttaacaaccatgatgggattgagactacaggtcgttttggagcacatgcctgtgggaccggacgcaattctacgctatgtcagaagggtcggagatccaccgcagcccttacctgaagagccaatggaggttcagggagccgagagggcttctccggagccacagagagagaacgcgagccctgcccctggcacaaccgctgaggaagccatgagtaggggccccccgcccgctcctgaagggggctcccgagacgagcaggatggggccagtgctgaaaccgaaccctgggccgccgcagtcccacctgaatgggtacccattatccagcaagatatccaatctcagagaaaggtgaagccccagcctccactgagcgacgcatacctgtctggcatgccagctaaaagacggaaaactatgcaaggcgagggacctcagttactcctcagtgaggccgtaagtcgcgcagcaaaggctgccggagcaagaccattgactagtcctgaatctctgtcgcgtgatttggaagctcccgaagttcaggagtcttacaggcagcagctgcgctcagacatccagaagcgactgcaggaggaccctaactattcaccgcagagattccccaacgcacagcgcgcatttgccgatgacccttag

SEQ ID NO: 180303 - DNA, 3381 bp, Artificial Sequence
  Description of Artificial Sequence: Synthetic coding sequence
atggagcccaacgacagcaccagcaccgccgtggaggagcccgactctctcgaagtgctcgttaagactttggatagccagaccaggactttcattgtgggtgcacaaatgaatgtcaaggagttcaaggagcacattgcagcctccgtctccatcccgagtgagaaacaaaggctcatctatcagggacgagtcttgcaggacgataagaaactccaggaatataacgtcgggggaaaggtaatccacctagtggaaagagccccccctcagacccacttgcctagtggtgcctcttctgggacgggatccgcctccgccacacatgggggcggctcacccccagggacgcgaggcccaggagccagtgtacatgacagaaacgccaactcttatgtaatggtgggcaccttcaatttaccttccgacggttccgctgtcgacgtgcacatcaacatggagcaggcccctattcagtcagagcctcgcgtccgccttgttatggcccagcacatgatcagagacatccagaccctcctttctagaatggagtgtagaggcgggccacagccccagcatagccagccacccccccagcctcccgccgtaacacccgagcccgtggctctgagctcccagacttctgagcccgtggagtccgaggcgcctcctcgagagcctatggaggctgaggaagtggaggagcgcgctccagctcagaatcctgagctgactcctgggccggcccctgccggccctacacccgccccggaaaccaacgcgcccaatcacccctcaccagcagagtacgtagaagtgctccaagaactacagcgtctagagtcacgtctgcagccgtttttacagcgctactatgaagtgctgggagccgcagccaccaccgattacaataataaccacgaaggaagggaggaggatcagaggttaatcaacctggtcggcgaatcactgagactgttgggtaatactttcgttgccctgtccgacctgaggtgtaacctggcatgcaccccacctcggcacctgcacgtagtccgcccaatgtcccactataccacacccatggtactgcagcaagccgccattcctattcagattaatgtgggaacaactgtcaccatgacaggcaacgggacccgccctcctccaacccccaacgccgaggcccctccacctggcccaggacaagcttcctcagtcgctccttcctctaccaatgtcgaatccagtgcggagggtgccccacctccaggccctgcgcctccacctgcgacatctcacccccgagttattcggatcagccaccagtcagtggaaccggtggtgatgatgcatatgaatattcaagattctggaacacaacccggcggcgtgccatctgctccgaccgggcccttgggccctcccggacatgggcagaccctggggcaacaggtgcctggattcccaacggcccctacccgcgtcgtgatcgcaagacccactcctccacaagcccgaccaagtcaccccggaggtccacctgtgagcgggacactgcaaggcgcgggactgggaacaaatgccagtttggcacaaatggtttccggtctcgtgggccagcttctgatgcagcccgttctggtagcccagggcacaccgggtatggcccccccgcctgcacccgccacagcctctgcgagtgctggaacaaccaatactgccacaaccgcgggtcctgcccctggaggccccgcgcaaccgcctcctactccccagcccagcatggcagatctacagttctcacaactcctcggcaacctcctcggccctgcaggtccaggagcaggagggtccggggttgccagtcccactattaccgtggcaatgcctggtgttcccgctttcttacaaggcatgactgacttcctgcaggcaacacagactgctcctccaccccctccccctccgccacctcccccaccggcccctgaacagcaaacgatgcctcccccagggtcccctagcggaggtgccgggtctcccggcgggcttggcttagagtcccttagccctgagtttttcacatcagtggtgcagggtgtccttagctcactgctggggagcctgggtgccagggcaggcagctccgaatctatagccgccttcatacagaggctgagtggctcctcaaacattttcgagcctggggctgatggggccctgggctttttcggtgcactgttgagcctgctttgccagaacttttcaatggtggatgtggttatgttgttgcatggccactttcagccgctgcaaaggctgcagccacagttgagaagttttttccatcagcattacttgggcgggcaagaaccaacaccttccaatatccgaatggctacccataccttgatcacaggcttagaggaatacgtgcgagaatcctttagtctggtgcaagtgcaacccggagtggacataattaggactaaccttgaattcctgcaggagcagttcaatagcatcgctgcacacgtcctccactgcacagatagcggcttcggcgcaagattgctagagttgtgcaatcaggggctctttgaatgcctcgctttaaacctgcactgccttggaggtcagcaaatggaactggccgccgtgatcaatggacgcatcaggcgcatgtctcgaggggtgaatcccagcctcgtgagctggctgactaccatgatggggctgagacttcaggtggttcttgagcacatgcctgtggggccggacgctatattgcgctatgtccgccgcgtgggcgatcccccccagcctctgcccgaagagcctatggaagtccagggtgctgagagggcaagcccagaaccccagagggagaatgcatctcccgcgcccggcaccaccgcggaggaagctatgagccggggccctcctcctgcgcctgaaggcggaagtagggatgagcaagacggcgccagtgccgagaccgagccttgggcagccgctgttccccctgagtgggtgcccattattcagcaggatattcagagccaacgtaaggtcaagccacagccaccgttaagcgacgcatacctgagtggcatgcccgctaagagacgaaagactatgcagggagaaggtccacagctgctcttgtccgaagcagtttcgagggctgctaaggctgccggggctcgacccctgaccagcccagagtctttatcccgcgatcttgaggcccccgaggtacaggagagctatcgacagcagctgcgcagcgacattcagaaaaggctgcaggaggaccctaattactcaccgcaaaggtttcccaatgctcagcgggcttttgccgacgacccctag

SEQ ID NO: 180304 - DNA, 3489 bp, Artificial Sequence
  Description of Artificial Sequence: Synthetic coding sequence
atggagcccaacgacagcaccagcaccgccgtggaggagcccgactccctcgaagtactggttaaaacactggatagccagacgagaacatttatcgtcggggcccagatgaatgtaaaggagtttaaagagcacatcgctgcctctgttagtattccaagtgaaaagcagcgcctcatctaccagggaagggtgctgcaagatgacaaaaaactgcaggagtataacgtcgggggtaaggtgatccacctcgtggagagagccccaccccagacccatctgcccagcggtgccagttcaggtacggggtctgcctcagccactcatggtggtggcagcccgccaggaactcgcggccccggagcgtccgttcacgatagaaatgcaaacagctatgttatggttggaactttcaatctgccatctgacggaagcgcagtggacgttcatataaatatggaacaggcccctatccagagcgagcctcgcgtgagactggtaatggctcagcacatgatcagggatattcagaccctgttaagcaggatggagtgtagaggagggccccaaccccagcatagccaacccccgcctcagccccctgctgttacacctgaaccagtcgccctgtcatctcagacctcagaacccgtcgaatccgaagcaccacctcgagagccaatggaggccgaagaggtggaagagcgtgcccctgctcagaacccagagctgactccgggccctgcccctgctggccccaccccagcaccggaaactaacgcgcccaatcacccctctccagccgaatacgtggaggtgctgcaggagctgcaacggctggagagcaggctgcagccttttttgcagcgttattatgaggtcctcggcgccgcagcaaccaccgactacaataataaccacgagggtagggaggaagatcagcggctcataaaccttgttggcgagagtctccgactgctggggaatacttttgttgccttaagtgatttacgctgtaacctggcttgtacccccccccgccacctccacgtggtccggcccatgtctcattacactacacctatggtgctgcagcaggccgccattccaattcagatcaatgttggcacgacggtcacaatgactgggaacgggactcgacctcctccaacgcccaatgctgaagcgccaccacctggacctggtcaggcttccagtgtggccccctcttctaccaatgttgagagctctgccgagggcgctcctccccctggaccggctccccctcctgcgacaagccatccacgggtcatccgaatctctcaccagtctgtggagccggtggtgatgatgcatatgaacattcaggattccggaacacagcctggcggcgtgcctagcgcaccgacaggacctctcggacccccaggccacggccagacattgggatccaccctcattcagctcccttcacttcctccagagttcatgcacgccgtcgcacatcagattacccatcaagcaatggttgccgccgtggctagcgctgccgcgggccaacaggttccagggtttccgactgcgccaactcgggtagtgatcgctcggccaacacctccgcaggcacgaccttcacatcctggaggaccacctgtctccggtacgctgcagggcgccgggcttggcactaatgcgtcactggctcagatggtgtctggccttgtcggacagctgctgatgcagccagtgctggttgcacagggcacaccaggcatggcgccaccccctgccccagccaccgcgtccgctagtgctggaaccacaaacaccgccaccacagcaggccccgcacctggtggccctgcccagccccccccaactccacagcctagcatggccgacctccagttcagccagctcctgggcaatctgctcggaccagccgggccaggggctggcggaagcggggtcgcctcccccacgataacagtagcgatgcccggggtgcccgctttcctccagggtatgacagacttccttcaggctacccaaacagcgcctcctcctcctccgcctccgcccccccctccccccgctcccgaacagcaaactatgccacccccagggagtccatcaggaggggccggaagtcccggggggctcggactagagagtctcagcccagagttctttacctcggtggtccaaggagttctgagctctctcctgggtagcctcggggcccgagctggaagctctgagagcatagctgcctttatccagcgcctgtctggcagttccaacatctttgaacccggcgctgatggcgcattgggattttttggggcattgctcagtctgttatgtcaaaatttcagcatggtggatgtggtaatgctcctgcatggccacttccagcccctgcagcgcctgcagcctcagctgcgctcattctttcaccaacactatttaggtggccaagaacctaccccatctaacattcgaatggctacacatactcttattaccgggctggaggagtatgtgcgtgaatccttttctcttgttcaggtgcagcctggcgtggacataatacgcactaatctggagttcctccaggaacaatttaactccattgccgcccacgtcctgcactgcaccgattccgggtttggggcacggcttcttgaactgtgtaaccagggtctgttcgagtgcctagccctgaatctacactgtcttggtggacaacagatggaacttgcggctgttattaatggaagaattcgaagaatgagcagaggtgtgaacccctctcttgtgtcatggctgaccacgatgatgggcctgaggctgcaggttgtgctcgagcatatgccggtaggaccagacgctattctgagatacgtgagaagagtaggggaccctcctcagccactcccagaggaaccaatggaagtccagggggccgaacgtgcttcacccgaacctcaaagggagaatgcaagccctgccccaggaacaaccgccgaggaggctatgtcacgagggcctcctccagctccggagggggggtctagagatgagcaggatggcgcaagtgccgagacagaaccatgggccgccgcagtgccacctgaatgggtgccgataatccagcaggatatccaatcccaaaggaaagtaaagccgcaacccccactgagcgatgcctacctgtccgggatgccagctaagcggagaaaaacgatgcagggagagggcccgcagctccttctgtctgaagctgtttcgcgcgcagcaaaggcggccggagcaagacctctaacgtcaccggaatccctttctcgagatctggaggccccagaggtgcaggagagttacagacagcagttgaggagtgatattcaaaagcggctccaggaggacccaaactattccccccagagattcccaaacgctcagcgggccttcgcagacgacccctag

SEQ ID NO: 180305 - DNA, 738 bp, Artificial Sequence
  Description of Artificial Sequence: Synthetic coding sequence
cccccccggcacctgcacgtggtgcggcccatgagccactacaccacaccgatggtgctgcagcaggcagcaatcccaattcagatcaacgtgggcaccacagtaacaatgactggcccggctccccccccagctacctcccacccacgggtgatccggatctctcatcagtccgtggaaccagtcgtaatgatgcacatgaacattcaggattccggcacgcagcctggaggcgtaccatccgcccccacgggccctcttggaccacccgggcatgggcagaccctgggacagcaggtgcctggctttccaactgcacccacccgtgtcgtcattgctcggcccaccccaccgcaagctaggccatctcatccggggggccctccagtcagcggtactcttcagggagccggactgggaacaaacgccagtctggcacagatggtcagcgggttggtgggccagctcctcatgcaacccgtgcttgtcgctcaaggcacacctggtatggccccacctcccgccccggccaccgccagcgccagtgcagggacaacaaataccgctaccaccgccggccctgccccgggcggccctgcccaaccaccacccaccccacagccttctatggccgacctgcagttcagccagctgcttgggaatctgcttggccctgctggccccggagccggcggttctggtgtggcctcaccaacaattactgtggcgatgccatag

SEQ ID NO: 180306 - DNA, 3381 bp, Artificial Sequence
  Description of Artificial Sequence: Synthetic coding sequence
atggagcccaacgacagcaccagcaccgccgtggaggagcccgactccctggaggtgttggttaaaacactcgatagtcaaacccggacctttatcgtcggcgcacagatgaatgtcaaggaatttaaggagcacatagccgcaagcgttagtatccccagcgaaaagcagcgtctgatctatcagggtcgtgtcctgcaagacgataagaaattacaggaatacaacgtggggggtaaggtgatccaccttgtcgagagggcgccccctcagacccacttaccgagcggggctagtagcgggaccggcagcgcctctgcaacccatgggggaggcagtccaccaggcactagaggcccaggggcaagtgtacacgatagaaatgccaactcctacgtaatggttggaacattcaacttgccaagcgatggctctgcagtcgatgtgcacattaacatggagcaggctcctatccagagcgagccaagggtacgtcttgttatggcacagcatatgatccgcgatattcagacacttcttagccgaatggagtgccgggggggaccccagccacagcattcccagccccctcctcagccccctgcggtgaccccagagcctgtggcactgagctcccaaacttccgaacctgtcgagagtgaagcgccaccacgcgaacccatggaagccgaagaggtggaagaacgcgcaccagcacagaacccagaactcactccaggcccagcaccggccggtccaaccccagcacccgagaccaacgctccgaatcatccgagtcccgcagaatacgtagaagtgctccaggagttacagcggctcgagagtaggctgcagccctttctgcagcgttattatgaggtattgggcgccgccgctaccacagactataacaacaaccatgagggtcgagaggaggatcaaaggctgatcaatctcgtcggggagtctctccggctcctgggaaatactttcgtagccctgtcggacctgaggtgtaatctcgcttgcacgccgcccaggcatttacacgtagtccgccccatgagccactatactacacctatggtgctgcaacaagctgcaatacccatacaaataaatgtcggtacaactgtgaccatgaccggaaatggtactaggccacctccgacacccaacgccgaagctccacctcccgggcctgggcaggccagcagcgtggcccctagttccaccaatgtggaaagctctgccgaaggggcgccccctccgggtcctgctccacctcccgcaacaagccaccccagggtcattcgcatctcacatcagtccgtagagcctgtcgtaatgatgcacatgaatatccaagattccgggacacaacccggcggcgtcccctcagcgcctaccggacccctgggcccaccaggccacggacaaactctagggcagcaggtgcccggttttcccacagcacctacccgcgtagtgatagcccggcccactccccctcaagctagaccatctcacccggggggcccacctgttagcggcacgctgcagggggccggtctcgggacgaatgcctccctggctcagatggtgagcggcctggtaggacaactccttatgcagccagtactagtagcccagggcacacccggcatggctcccccccccgctcctgccactgcatccgccagcgctggcaccacgaacaccgcaaccaccgccggcccagccccgggcggccccgcacagcccccccccactccgcagccgtctatggctgaccttcagttcagtcagctgctggggaatctgttggggcccgccggcccaggcgcaggcggtcccggtgtcgcaagcccgacaattacagtggctatgccgggcgtgcccgccttcctgcagggaatgaccgactttctccaagccacccagaccgctccccccccacctcctcctccgccaccgcctcctccagcacccgagcagcagactatgcccccacctggctccccatcgggcggggctggttctcctggtggtctgggcttagagtcactgagccctgagtttttcacctccgtcgtgcaaggcgttctgtccagcctccttggatctctcggggcccgggctggctcctccgaatccatcgctgcgttcatccagaggctgtctggatcatcaaatatctttgagcctggagctgatggggcactaggcttctttggggctctcttgtctcttctatgccagaactttagtatggtcgacgtggtgatgctcttacacggccatttccaaccactccagaggcttcagccacagttaaggagtttcttccatcagcactatttgggcgggcaagagcctactccttccaatatccggatggcaacccatactttaattaccggcttggaggaatatgttcgggagagcttcagcctagtgcaagtccagccaggcgtggacattatccgaacaaatctggaattcctgcaggaacagtttaactctattgcagctcacgtgctccattgtaccgatagcgggttcggcgcacggctgcttgagctctgcaaccagggcctgttcgaatgcctggctctcaatctgcattgtctgggcggtcaacagatggagctcgctgccgtgatcaatggtagaattaggcgcatgagccgaggggtgaatcctagtcttgtgagctggctgaccacaatgatggggctacgcctgcaggtcgtgctcgagcatatgcccgtgggtcccgacgccatactgcgctacgtgcgcagggtcggggaccctcctcagcccttgcctgaggaaccaatggaagttcagggcgcggaacgggcttcacccgagccccagagagaaaatgcaagccccgcccccggtactaccgcagaggaagcaatgtcccgtggtcccccacccgctccagagggcggcagccgagacgagcaagacggagcttcggcagagacagagccatgggcagctgcagtgcctccggagtgggtgcccataattcaacaggacattcagagccagcgcaaggtaaaacctcagccacccctatcagacgcatatctgagcgggatgcccgctaagagaagaaagacaatgcagggggaaggtccccagttgctcctctccgaagccgtttccagggcagcgaaggccgcgggagcccgccccctgacttctccagagagtttgagcagggaccttgaagcccccgaagtgcaggaatcctaccgtcagcaactgcgctcagatattcagaaaagactgcaggaggacccaaattattctccgcagaggttccccaacgcccagagggcgttcgctgatgatccttag

SEQ ID NO: 180307 - DNA, 789 bp, Artificial Sequence
  Description of Artificial Sequence: Synthetic coding sequence
atggagcccaacgacagcaccagcaccgccgtggaggagcccgacagcctggaagtgctagttaagacccttgatagtcagactagaacgttcattgtgggcgctcagatgaatgttaaggaattcaaagaacacatagccgcctcagtgtcgattccgagcgaaaaacagagactgatctaccagggacgcgtactccaagacgacaagaaactgcaggaatacaacgtaggcgggaaggtaatccatttggtagagcgtgccccaccccagacccatttaccatccggcgcatcttcagggacaggcagcgcgtcagctacacatggcggagggtccccccctggaacacgggggcccggcgcctcagtccacgacaggaacgctaatagctatgttatggttggcacttttaatctgccatccgatgggtcagccgtggacgtgcacattaacatggaacaggctccaatccaatctgagccgcgcgtgcgattagttatggcccagcacatgatccgagatatacagacactactgagccggatggagtgccggggaggcccccaaccccagcactcccaacctccaccacagcctcccgcagtcacccctgaaccggtggctctgtcctcgcagacctccgagcctgttgagagcgaagccccgcctcgcgaaccaatggaggcagaggaagttgaggaacgtgcccccgcccaaaatccagagctgacaccaggcccagcgcccgctgggcccacacccgcacccgagactaatgcaccctag

SEQ ID NO: 180308 - DNA, 717 bp, Artificial Sequence
  Description of Artificial Sequence: Synthetic coding sequence
agcagcgccgagggcgcccccccccccggccccgcccccccccccgctactagccatccacgagtgatccgaatctcccaccagagcgtggagcccgtggtgatgatgcacatgaacatacaaggccccctgagtctgtcaccctgtcccgattctggcacccagccagggggggttccgtccgctcccaccggcccgctcggcccacctggacacggccagactcttggtcagcaggtaccaggattccctacagccccaaccagggtggtgatcgcaagaccaactcccccacaggccagaccaagccacccagggggtccgccagtgagcggcacactgcaaggcgctggactcggcaccaatgcgagtttagctcagatggtgagcggcctggtaggccagctgctgatgcaacccgttctcgtcgcacagggcactcctggcatggcacctccacctgccccagcgacggcctccgccagtgcaggaactaccaacacagctacaactgccggcccagcacccggaggcccggcacaacctcctcctaccccccagccaagcatggccgacctccaattcagtcagcttttggggaacctgcttgggccagccggcccaggagcagggggcccaggagtagcctcaccaactatcacagtcgctatgccgggcgtcccagccttcttgcaggggatgaccgattttttgtag

SEQ ID NO: 180309 - DNA, 3381 bp, Artificial Sequence
  Description of Artificial Sequence: Synthetic coding sequence
atggagcccaacgacagcaccagcaccgccgtggaggagcccgacagcctggaggtgctggtcaagactctggacagccaaacaaggacattcattgtgggtgcccaaatgaacgtcaaggaattcaaagagcacatagccgcctctgtctcgatcccatccgaaaagcagaggctgatttatcagggtcgtgtgctccaagatgataagaagctgcaggaatacaacgtaggcgggaaggtcatacacttagtagagcgcgctccgcctcagacccacctccccagtggggccagctctgggacgggatctgcgagtgcaacacatggcggtggctccccaccagggaccagaggcccgggcgctagcgtgcacgacagaaatgcaaatagctacgtgatggtgggcacatttaacctgccctcggatggtagtgctgtggatgtgcacatcaacatggagcaagctccgatccagagcgaacctagggtccgcttagtgatggctcaacatatgataagagatatccagacactgctttctaggatggaatgtaggggcggaccgcagccacagcacagccagccccctccccagcctcccgcagtgacgcctgaacccgtcgccttgagctcacagacgtcggaaccggttgagtccgaagcccccccacgggaacctatggaagctgaggaggtggaagaacgcgctccagctcagaacccggagcttacgcccggtcctgcacccgcgggaccaacacctgctcctgagactaacgcgccaaatcatccctctcctgccgaatacgttgaggttctgcaagaactccagaggctagagagcaggctccagcctttcctgcagagatactacgaggttctgggcgcggctgccacaactgactacaataataaccatgagggtcgggaagaggaccagaggttgatcaacctggtcggcgaatctctgcgactcctggggaacaccttcgtggctctctctgacctgcgatgcaatctggcctgtactccaccacggcacctgcacgtggtgcgacctatgagccactacaccactcccatggtcctgcagcaggcagccatccccattcaaatcaatgtcgggacaactgtgacaatgacagggaacggcacacgccctcctcctactccaaacgccgaagctccaccccctggacctgggcaggcctcatcagtggccccgtcaagcaccaacgtggaaagcagtgcggaaggagccccccccccaggccctgcccctcccccagctacatctcaccccagggtgatccgcatttcacaccagagcgtggagcccgtggtcatgatgcatatgaacatccaggacagtgggacccagcccgggggagtgccaagcgccccgacaggacctctcggtcccccaggacacgggcagacattgggccaacaggtgccgggattccccaccgctcccacccgggtggtcatcgccagaccaactcctccccaggctcgaccgtcgcatcctggtgggcctcccgtctcaggcacccttcagggagccggactcggaacgaacgccagcctggcccagatggtttcaggtctggtcggccagctgctgatgcagccagtcctcgtggcccaaggaacccctggaatggccccaccccccgcccccgccacagccagcgcttctgcagggactacaaacaccgcaactacagctggccccgctccgggcggacccgcgcaaccacctcccactccccaaccctccatggccgaccttcagttttcccagctgctcggcaacctactggggccagcgggtcctggggcaggtgggccaggggtggcttcccctacaattacagtggctatgcctggcgtgccagcctttctgcagggcatgacagattttcttcaggcaacacaaaccgcgccacctccacccccaccaccgcccccccctccacccgcccccgaacagcagaccatgccgcctcctggcagcccgagtggcggtgccggcagcccgggaggactaggtctggagtcactgagccctgagttttttactagcgtggttcagggcgtgctgagctccctgctgggatcactgggcgctcgggccgggagtagcgagtcaatagccgcctttattcaacgtctgtcaggcagcagcaatatatttgagcccggggctgacggagccctgggctttttcggggccctcttgtctttgctatgtcagaacttttccatggtggacgttgtgatgctcctacacggccattttcaacccctccaaaggctccagccccaactgaggtccttcttccaccaacactacctgggcggacaggagcccacaccttccaacatccggatggcaactcacactcttatcactgggctcgaggaatacgtgagggaaagctttagcctggtgcaggtgcagccaggcgttgatattataagaaccaacctggaattcctgcaagaacaattcaacagcatcgccgcccacgttctccactgcaccgacagcgggttcggcgcgcggctgctagagctgtgcaaccagggtctgttcgagtgcctggcgctgaatcttcactgtcttggcggccagcagatggaactggcagctgtgattaatggtaggatacgacgaatgtctcgtggtgtgaacccctccctcgtgagctggttaacaacgatgatgggcttacgtctgcaggttgtgctcgagcacatgcctgtgggaccagatgctatcctgagatatgtaaggagagtgggagacccacctcaaccactgccagaggagcctatggaagtccagggtgctgagcgggcaagtccagagcctcaaagagaaaatgccagcccggctcccgggacgaccgcagaggaagcgatgagcaggggtccgccacccgcgccagaagggggttcacgagacgaacaggatggggccagcgccgagacggagccatgggcagccgccgtgccaccagagtgggtgcccatcattcagcaggatatacaaagtcagcgcaaggtgaagccacagccccctctgtccgacgcctatctgtcagggatgcccgccaaacggcgaaaaacaatgcaaggagagggcccacagctgctgctttctgaggccgtgtctcgagccgctaaagcagccggcgctcgcccactgacaagccctgaatcccttagccgggacctggaagcccccgaggtgcaagagtcatatcgccaacaattgcggagcgacattcagaagcgccttcaggaggatccaaactacagcccacagcgttttccgaacgcccagagagcgttcgcagacgatccttag

SEQ ID NO: 180310 - DNA, 648 bp, Artificial Sequence
  Description of Artificial Sequence: Synthetic coding sequence
atggagcccaacgacagcaccagcaccgccgtggaggagcccgactcacttgaagtgctggtgaagacactcgacagccaaacacggacgttcatagtaggagcccagatgaacgtcaaagagttcaaggaacacattgctgcaagtgtcagcattccatctgaaaagcagcgcttaatttaccagggacgcgttctgcaggatgacaagaagttacaagaatacaatgttgggggtaaagtgattcatttggtcgagcgagctccccctcagacccatttaccatccggcgctagttcaggcaccggctccgcctcagccacacatggcggagggtctccaccaggcacaagaggaccaggagctagtgtgcacgacagaaatgccaattcttacgtgatggttggaactttcaatctgcccagtgaaccacgagtgaggctggtaatggctcaacacatgattagagatatccagacactgctgagccgtatggagtgtcggggaggcccacagccccaacatagccaacctccaccccaaccccccgccgtcacgccagaacctgtggccctgtcctcgcagacctctgaacccgtcgagagcgaggcacctcctcgggagcccatggaggctgaggaggtgtag

SEQ ID NO: 180311 - DNA, 789 bp, Artificial Sequence
  Description of Artificial Sequence: Synthetic coding sequence
atggagcccaacgacagcaccagcaccgccgtggaggagcccgacagtcttgaggtgctcgtgaaaaccctggattcacaaactcggacatttatagtgggagcacagatgaatgtaaaggagttcaaggaacacattgctgcttccgtttctatacctagcgagaagcagcggttaatataccagggccgagtcttgcaggacgacaaaaagctccaggaatacaacgtgggtggtaaagtcattcatctggtggagcgagcccctcctcagacgcatctgcccagcggcgcgtcgagcgggaccggctcagcaagcgcaacacacggaggaggatcacctccagggacacgtggacctggagccagtgtgcatgacagaaacgccaattcttacgtgatggttgggactttcaatctccctagcgatggcagcgctgtggacgtgcacatcaacatggaacaggcccccatccaaagcgagccacgcgtaagacttgtgatggcccagcacatgatcagagacatccaaactttactcagtagaatggagtgccgcgggggacctcagcctcagcacagccagccccctcctcaaccgccagctgtcacccccgaacccgtcgcactgagctcccagacttccgaacctgtggagtctgaggctcccccccgcgagcccatggaagccgaagaggtcgaggaacgagcacccgcccagaatccggagcttaccccagggccagcgccggctggtccaacgcctgctcccgagacaaacgcaccttag

SEQ ID NO: 180312 - DNA, 2232 bp, Artificial Sequence
  Description of Artificial Sequence: Synthetic coding sequence
atggagcccaacgacagcaccagcaccgccgtggaggagcccgacagccttgaagtcttggtgaaaactttagatagtcagacccgcacatttatcgtgggggcccagatgaacgtgaaagagttcaaggaacatatcgctgcaagtgttagcatcccgagtgaaaaacagagactgatctaccagggtcgggtacttcaggacgataaaaaactacaggagtacaatgttggaggaaaagtgatccacttggtggaacgcgcccctccccagactcatttaccctcaggtgcatcttccggcactggcagcgcctccgcaacacacggcgggggttctccccccggcacacgcggtcctggcgcttccgtgcatgatcggaatgctaactcctatgtaatggtcggaacattcaatctgccaagtgacgggagtgcggtagatgtgcacataaacatggaacaagcccctattcaaagcgaacctcgcgtcaggctagttatggcacagcatatgattcgggacatccagaccttgctcagtaggatggagtgcaggggtggcccgcaaccccaacattcacagccgcctccccagccgcccgctgtcacacccgaacccgttgccctgagctcccagacatccgagccagtggagagtgaagcccctccacgtgaacctatggaagcagaggaggtcgaggagagagcccccgcccagaatcccgagctgacccctgggccagcgccggctggcccaacccctgcccccgagaccaatgcccccaaccacccaagccccgctgagtacgtcgaggtgctgcaggaattacaaaggttggagtctagactccagcccttcctgcaacggtattatgaggtcttgggggccgccgccacaacagactataataacaaccacgaagggcgcgaggaggaccagcgattgatcaatctagtgggcgaatctctcagactgctgggcaatacatttgtggccctgtcagatctgaggtgtaacctggcgtgcacaccccctcgccacctgcacgtggtgcgcccgatgtcccattatactacaccaatggtactacagcaggccgccattcctatccaaataaacgtcggaacgacggtcacaatgactggtaacggtactagacctccacccaccccgaacgcagaagctccacctccaggccccgggcaggctagttccgtggccccaagttcaacaaatgttgagtcttccgccgaaggtgccccaccacctgggccagcacccccgcctgccactagccatcctcgtgttatccgaatttcccaccagagcgtagagcccgtggtcatgatgcacatgaacatccaggactctgggacacagcccggcggtgtgccgagtgcccccaccggccccctcggccccccaggacatggacagacactgggatcaacactcatacagttgcctagtctgcccccagagttcatgcacgcagtcgcgcatcagatcactcaccaagctatggtggcagccgtcgcttctgccgccgcaggtcagcaggtgcctggatttccgaccgctccaacaagggtagtcattgccagaccaacaccaccccaagcaaggccctcacatcccggcgggccccctgtgtctggcactctgcagggggccgggctgggcacgaatgcctctctggcccaaatggtgagcggtctggtaggccaacttctcatgcagccggtattggtggcccaggggacgcctggcatggccccccctcctgcgcctgcgaccgcctccgcctccgcggggaccactaatacggccacaactgccggccccgcacccggtggaccagcccagcctccaccaaccccacaaccctcaatggccgatctgcagttctctcagctgctgggaaatttgctcggcccagctggcccgggggcaggagggcccggagttgccagccctaccatcacagtggcaatgcccggagtccctgcatttctgcaagggatgactgacttcctccaagcaacccaaacagctccaccacctcctccacctccccccccccctcccccggcacccgagcagcaaacgatgccgcctccgggctccccttcgggtggcgccggctcgcccgggggcctgggacttgaatctctatccccagaattcttcacgtcagtggtgcagggtgtgctgtcttctttgctgtag

SEQ ID NO: 180313 - DNA, 3381 bp, Artificial Sequence
  Description of Artificial Sequence: Synthetic coding sequence
atggagcccaacgacagcaccagcaccgccgtggaggagcccgacagtctcgaagtactggtgaagaccctcgacagccagacgcgtacctttattgtgggcgctcaaatgaacgtcaaggaattcaaagagcacatcgccgcgtcggtgtctatacctagcgagaaacagcgactgatctaccagggccgtgtcctgcaggacgataagaaactacaggaatacaatgtgggaggaaaagttattcatctggtcgagcgggctcctcctcagacacacctacctagtggggcatcaagtggaactggctctgcaagtgcaacacacggcggtggatctcctcccggaactcgtggtccaggggcgagcgtgcatgataggaatgccaattcctatgtgatggtcggcaccttcaatcttccaagcgacgggtctgccgttgacgtccatatcaatatggaacaagccccaattcaatccgagccccgagtacgcctcgtaatggctcaacacatgatccgcgatatccagaccctcctgtctagaatggaatgtaggggtggcccccagccacagcacagccaacctcctccccagcccccagcggtgactcccgagccagtggccttaagtagccagacctcggaacccgtagaaagtgaggcgcctccccgcgagccaatggaagccgaagaggtggaggaaagggcccctgctcagaaccctgagctgacccccggccctgcccccgctggcccaacccctgctccagagacaaatgcccccaaccaccccagcccagcggagtacgttgaggtcctccaggagctgcaacggctggagtcaagactgcaacccttcctccaacggtattacgaagtcctgggggcagccgcgactacagattataataacaatcatgaaggacgtgaagaggatcagagactcatcaacttggtgggtgagtccctgcgcttactgggaaatacatttgtggctctgagcgacttacgctgtaacctggcttgcaccccgccacgccatctgcatgtggttcggcccatgagtcactacaccacaccgatggtgctgcagcaggctgcgattcccatccagatcaacgtgggcacaacagtgacaatgacagggaacggcacacgtccacctccgactccaaacgctgaggctcctcctccgggcccgggacaggctagttccgtggctccctccagtacaaatgtagagtcttccgctgaaggggctcctccgcccggtccagcacctccccccgcgacctcacacccacgtgtaatccggatttctcatcagtcagttgaaccagtggtgatgatgcacatgaacatccaggacagcgggacccaacccggcggggtgcccagtgcaccaactggacccttgggtcctcccggacacgggcagaccctggggcagcaagtgccagggtttccaactgcccccacccgagttgtgatagcccgccctactcctccccaggccagacctagtcatccaggcggcccccccgtaagcggaacactccaaggcgccgggctcggaaccaacgcttctctggcacagatggttagcggattggttgggcagcttctgatgcaacccgtgttggtggcccagggaacaccaggcatggcaccgccaccggctccagccacggcttccgccagcgctgggactacaaatacggccactactgctggacctgcccccgggggtcccgctcagcccccccctactcctcagcccagtatggcagatttgcagttttctcagctcttgggcaacctgctcggaccggcagggcccggagccgggggacctggcgttgctagccctaccattactgtggctatgcccggggttcccgcattcctgcaagggatgaccgattttcttcaggcgacacagaccgctcctccacctcctccgccaccgccaccgccaccgcccgcaccagaacaacaaaccatgcctccccccggcagccccagcggcggggccggaagcccaggcgggcttggccttgagtcgttgagccctgagtttttcaccagtgtcgtgcagggggtcctgagcagtctgctcggttcattgggggcccgggcaggctcctccgagagcatcgccgcgttcattcaaaggctctccggaagctccaatatcttcgagcccggagctgatggagcccttgggttcttcggtgctcttctttccctgctgtgtcagaattttagcatggtcgatgtcgtgatgctcctgcatggtcatttccaacctctgcagcgcctgcaaccgcagctgcggtccttcttccatcagcactatctcgggggccaggagcctactccatctaacattcgaatggctacccacacactgatcacgggcctggaggaatacgttagggagtccttcagccttgtccaagtccagccaggagtcgatatcatcaggactaacctggagtttctccaggagcaatttaacagtatcgccgcacacgttctgcactgtaccgatagtggctttggagctcgtctgttggagctttgtaatcagggcctattcgaatgcttggctctgaatcttcactgtttggggggacagcaaatggaactggcggcggtcatcaacgggcggattagaagaatgtccagaggagtaaacccgtccttagtgagctggcttacaacgatgatgggacttcggctccaagtggtgcttgaacatatgcctgtgggcccggatgccatcttacgatacgtgagacgggtgggcgaccctccccaaccattacccgaagagccaatggaggtacaaggcgccgaacgagcatccccggagccacagcgggaaaatgcatcccctgccccgggtacaaccgcagaggaagcgatgtcaaggggtcctccaccagctcctgaaggtggtagccgagacgagcaagatggcgcaagtgccgaaacggagccttgggctgctgccgtgcctcccgagtgggtgcctattatccaacaagatatccagtcacagcggaaggttaagccacagcctccactgtctgacgcctacctaagcgggatgcctgccaagcggcggaagacaatgcaaggcgaggggcctcaactactgctctctgaggccgtgtcaagggccgcaaaggcggccggggcccggccattaacctcaccagagagcctttcgcgagatctggaggcccctgaagtccaggagtcatataggcagcagctgcgttccgacattcaaaaacgcttgcaggaggatccgaactattcccctcaaagatttcccaatgcccagcgggcctttgcagacgacccctag

SEQ ID NO: 180314 - DNA, 3381 bp, Artificial Sequence
  Description of Artificial Sequence: Synthetic coding sequence
atggagcccaacgacagcaccagcaccgccgtggaggagcccgactccctggaagttttagtaaaaactctcgacagccaaacccgaacattcatagtgggcgctcaaatgaacgtgaaagagtttaaggagcatatcgccgcgagcgtttctattccctcggaaaaacagcgactgatctaccaggggcgtgtgctgcaggacgataagaagctccaggaatacaacgtgggcggcaaagttattcatctcgtggaacgtgccccaccgcagacacacctgccctccggggcatcctccggaacaggctcggccagcgctactcatggaggcgggtccccaccagggacacgcggccctggcgcttcggtccacgataggaacgccaacagttacgttatggttggcaccttcaacctgccctctgatggatcagccgttgacgttcacatcaacatggaacaggcccccattcagtctgagcctcgggtgcggctagtcatggcgcagcatatgataagggatatccaaacactgctgagccgaatggagtgccgcgggggcccccaacctcagcatagtcaacctcccccacagcccccggccgtgactccagaacctgtcgcactgtcctcccaaaccagtgaacccgtcgagtccgaagcaccccctagagagcctatggaagccgaagaggtagaggagagagctcctgcccaaaacccagagttgacccccgggcctgccccagctggacccacaccagctcctgagactaacgctcctaatcaccccagcccagctgagtacgtcgaggtgttacaggaattacaaagacttgaatcccggctgcaaccctttctacaacgatactatgaagtgctgggagctgctgctaccaccgactataacaacaaccacgaagggcgggaagaggaccagcggttaatcaacctggtgggggagtcattacgtttgctgggcaatacttttgttgccctttctgatctgcgttgcaacctggcatgtaccccaccgcgccatctacatgttgtgcgccccatgtcacactatacgacacctatggtgctgcagcaggccgctatccccatccagattaacgtcggcacaactgttaccatgactggtaatgggacccgcccccccccaacacccaacgccgaggccccccctcctggccccggccaggcttccagcgtcgcaccatcatccacaaatgttgaaagttccgccgaaggggcccccccccctgggcctgccccccctcccgcgacttcacatccacgggtcattaggatctcccatcaaagtgtagagcctgtagtcatgatgcacatgaatatccaggattcaggaacccagcctggcggcgtaccctcagctcccaccggccccttggggccacccgggcatggacagaccctgggccagcaagtgcccgggtttccaactgccccaactagagtcgtcattgcccgaccgactccgccccaagcccgtccaagtcacccaggaggccctcccgtgagcggaactttacagggcgccggcctcggaaccaatgcatcactcgcgcagatggtttctggtctagttgggcagctgctaatgcagcccgtgctcgtggctcaaggtacgcccggcatggcaccacccccggcgcccgcgacagcaagtgcgagcgctggtaccaccaacactgctaccacagctgggcctgctcccggaggtcctgcccagccaccacccactccccagcctagcatggctgatctgcagttttcccagctgctgggtaatttgctcggcccagctggacctggcgcaggcggccccggggtagcatcccccacaattaccgtggcgatgcctggcgtgcccgccttcctgcaggggatgaccgactttctacaggcgacgcagactgcaccaccgccacctcccccaccgcccccacctccgccagcccccgagcaacaaaccatgccaccacccggctctccaagcggtggggccggatccccaggggggctcggtctcgaaagcctgagtcccgagttttttacgagcgtcgtccagggagtgctgagtagcttactcgggagtctcggagctagagctggctcctctgaatcaattgcagctttcatccagcggctgagtggcagttcaaatatcttcgaacctggtgccgacggagctctcggcttttttggggctctcctgagcttgttgtgtcagaattttagcatggtcgacgttgtgatgctcttgcacggccatttccagccacttcagcggctgcagcctcaacttcgttccttcttccatcagcactatctgggaggccaggagcccaccccctccaacattcggatggcaacccacacactgattacagggctggaagaatacgtcagggagagcttctccttggtccaagtgcagccgggggtggacataatccggaccaaccttgagtttctgcaggagcagtttaatagcatcgccgcacacgtacttcactgtactgactcaggcttcggagcacgcctgctcgaactgtgcaaccagggactctttgaatgcctggccctcaacctgcactgcttggggggacagcaaatggagctcgccgcggttatcaacggaaggattcggaggatgtcaagaggagttaatccttcacttgtgagctggctcactaccatgatgggtctccgccttcaagtcgtcctggagcacatgccggtaggccctgatgccatattgaggtacgtccggagagtgggggatccaccacaacctctgcctgaagaaccaatggaggtccaaggcgccgaacgcgcaagcccggagccacagcgggagaatgcatctcccgctcccggtactaccgccgaggaggctatgtcccgaggccccccccctgcacctgaaggcggctctcgggacgagcaggatggggcctccgccgaaactgagccctgggctgccgcggtgccaccagaatgggttccaattattcagcaggatatccaaagccagagaaaggtcaaaccacagcccccgctcagcgacgcctatttgtccggcatgccagcaaaacggcgcaaaaccatgcagggagagggcccacaactcctcctcagcgaggcagtctccagagccgccaaggccgcaggtgccagacctttaacaagtcccgagagcctatcccgcgacctggaggcccccgaggtgcaagaatcatatcggcaacagctcagatcagatattcagaagaggttacaggaggaccctaattacagcccccagaggttccctaatgcccaaagagcctttgctgatgacccctag

SEQ ID NO: 180315 - DNA, 411 bp, Artificial Sequence
  Description of Artificial Sequence: Synthetic coding sequence
tgacggatgagccggggcgtgaaccccagcctggtgagctggctgactacgatgatggggttacggttgcaagtcgtcctcgaacatatgccagtgggcccagacgccatcctgcgatatgttcggagggtcggcgatccaccacagcccttgcctgaggaaccaatggaggtgcagggggctgagagagcatcaccagagccacaggagtgggttccaattatccaacaagacattcagagccagaggaaagtcaagccgcagcccccactgtcggacgcctacctttctggaatgcctgcgaaaagacggaagctgagatccgatatccaaaaacgcctgcaggaggatccgaactactcacctcagcggtttcccaacgcacagcgagctttcgcagacgatccttag

SEQ ID NO: 180316 - DNA, 789 bp, Artificial Sequence
  Description of Artificial Sequence: Synthetic coding sequence
atggagcccaacgacagcaccagcaccgccgtggaggagcccgacagcctggaggtgctggtcaaaactttggacagtcagacacgcacctttattgtcggcgcccagatgaatgtgaaagaattcaaagagcacattgccgcctctgtctccattcctagcgaaaaacaacgactgatctaccaaggcagggtgctgcaggatgataaaaaactgcaagaatacaatgtcggcggtaaggtaattcatctagtggagcgagcccccccgcagactcacttgccttctggcgcctcatcgggaacaggcagcgcatcagcgacacacggtgggggaagtccaccaggcactaggggtcctggagcttcagtccacgatcggaatgccaactcatatgttatggtgggaacctttaacctgccctctgatggctccgccgtcgacgttcacattaacatggaacaggcccccattcagtctgagcctcgagtgaggttggtaatggctcagcacatgattcgggatatccagactctattgagtcgaatggaatgtaggggtggtcctcagccacagcattcgcagcctccaccgcaaccacctgccgtgacacccgaacctgtcgcattgagctcccagaccagtgaaccggtggaaagcgaggccccccctcgtgagccgatggaggctgaggaggtggaagagagggccccagcacagaatcccgaattgacacctggccctgcacctgccggtcccaccccggctccagaaacaaacgccccatag

SEQ ID NO: 180317 - DNA, 735 bp, Artificial Sequence
  Description of Artificial Sequence: Synthetic coding sequence
atggagcccaacgacagcaccagcaccgccgtggaggagcccgactccctggaagtgctggtgaagactctagattcccagacaagaacctttattgttggcgcacaaatgaacgtcaaggaatttaaagaacatattgccgcatcggtgagcatcccttccgagaagcagaggcttatctaccaggggcgagtgcttcaagacgataagaaactccaggagtataatgtgggaggcaaagtaatccatttggtggagagggctcctccacagacccatcttccatctggggcatcttccggcaccgggagcgccagtgctacacacggcggggggagcccacctggtactcgcgggccgggggccagtgttcatgacagaaacgcaaacagctatgtgatggtgggaactttcaaccttcctagcgagcctcgcgtaagattagtgatggcccagcatatgattcgcgacatacagaccttgcttagtagaatggaatgtaggggaggaccgcaacctcagcattcccagcctccaccacaaccaccagcagtcactccagagccagtggctttgtcttcacaaaccagcgagcctgtggagtccgaggcccccccacgggagcccatggaggcggaggaggtggaagaaagggcgcctgcacaaaatccagagctgacccccggaccggcacccgcaggaccgaccccggcccctgagacaaatgctccttag

SEQ ID NO: 180318 - DNA, 594 bp, Artificial Sequence
  Description of Artificial Sequence: Synthetic coding sequence
atggagcccaacgacagcaccagcaccgccgtggaggagcccgactcactggaggtacttgtgaaaacattggattcccagacacggacattcatcgtcggtgcccagatgaacgttaaagaattcaaggaacatatcgccgcgagtgtctcaattccttccgaaaaacagcggttgatttatcagggccgggtcttacaagacgacaagaaactccaagagtataacgtaggaggtaaggtaatccatctggtagaacgggcgcccccgcagacgcacctcccttctggcgccagcagcggcactgggagtgccagcgcgacacatggtggaggtagccctccaggcaccagaggacctggggcctctgtgcacgaccggaacgctaattcttacgtgatggtaggtacttttaatttgcctagtgatggcagtgccgtggacgttcatatcaatatggagcaggctcccattcagtctgagcccagggtgcggttagttatggcgcagcacatgatccgtgacatccagacattactctctaggatggagtgcaggggaggcccccagccgcaacacagccagccaccgtag

SEQ ID NO: 180319 - DNA, 621 bp, Artificial Sequence
  Description of Artificial Sequence: Synthetic coding sequence
atggagcccaacgacagcaccagcaccgccgtggaggagcccgactctttggaagtgctcgtcaagacactagactctcaaactcggaccttcatcgttggggctcagatgaatgtcaaagaattcaaagaacatattgctgcctcggtcagcatcccatccgaaaagcagcggttgatataccaagggcgcgtcctgcaggatgacaagaaactccaggaatataacgtggggggaaaggtgatccacttggtggaacgcgctccgccccagacccacctgccgagcggcgcctccagtggtacgggatctgcctctgcaacacatggagggggctcgcccccaggaacccgcgggccgggggcatctgttcatgatagaaacgccaactcctatgtgatggtgggaacgtttaacctgcctagcgaacctagagtgcgcctggtgatggcacagcatatgatccgggacatccagacccttttatcacgaatggagtgccgcggaggacctcaacctcagcacagccagcccccccctcagccccccgccgtcacacccgagcctgtggcactgagcagtcaaacatccgagcctgttgagtctgaggcgccaccttag

SEQ ID NO: 180320 - DNA, 735 bp, Artificial Sequence
  Description of Artificial Sequence: Synthetic coding sequence
atggagcccaacgacagcaccagcaccgccgtggaggagcccgacagcctggaagtattagtgaaaacccttgacagccagacacggacctttatcgtgggggcccaaatgaacgtgaaggagttcaaggaacacattgcagctagcgtgtccattccctcggagaagcagcggctcatctaccagggtcgggtcctgcaggacgataagaagcttcaggaatataacgtgggagggaaagtgatacatctggtggagagggcccccccccaaacgcatctcccgtctggcgcctcttctgggactggctcagcgtcagcaacccacggaggtggctccccccccgggacgagaggtccaggagcgtcagtgcacgaccgcaatgctaattcttatgtcatggtcggcacctttaacctgccaagcgaaccccgagtaagattggtgatggctcagcacatgattcgggatatccaaaccttacttagcaggatggagtgccgaggggggccccaacctcagcattcccaacctcccccccaaccccctgcggtaacccccgagccggtcgccctttcctctcagactagtgagcccgtcgagtccgaagccccgcctagagagccgatggaagctgaagaagtggaagagagggcccctgcccagaatcctgaactgacacctggaccagctcccgccggcccgactcccgctccagagaccaacgctccctag

SEQ ID NO: 180321 - DNA, 3381 bp, Artificial Sequence
  Description of Artificial Sequence: Synthetic coding sequence
atggagcccaacgacagcaccagcaccgccgtggaggagcccgactccctggaagtcctggtcaagacgcttgactcccagacgagaaccttcattgttggagcccagatgaacgtgaaggaattcaaggaacatatcgccgcaagcgtgtcgattccatctgaaaagcagcgactcatttatcaggggagagttctacaggatgataaaaaactccaggagtacaacgtggggggaaaggtaatccacctggttgagagggcaccccctcagacccaccttccttcgggagcctcatcagggaccgggagcgcaagcgccacgcacggtggggggagcccgccaggaacccgaggccccggggcaagtgttcacgaccggaatgctaatagctacgtgatggtcggaactttcaacttaccaagcgatggaagcgcagtggatgtccatatcaatatggagcaggcccctattcagagcgagcccagagtgaggctcgtgatggcccagcacatgatccgagacattcagactctgctgtctaggatggaatgtaggggtgggccacaaccacagcatagccaacccccaccccagcctccagctgtgacccccgagccagtggcgctgtcatcacagacaagtgaacccgtcgaatcagaggcaccaccacgggagcccatggaagcagaggaggtggaagagcgagccccagcccaaaacccggagctgacgccgggcccagcgcctgcaggacccacccctgcacctgagactaacgctccgaatcacccttcgccagctgagtacgtggaagtgcttcaagagctgcagcgtctggagtcacgcctccaacctttcctccagcgatattacgaggtactgggcgccgcagccacaacagattacaacaacaaccatgagggacgtgaggaagaccagcgcttaataaacctcgtgggggagtctttgaggctgctaggtaacacatttgtcgccctctccgacctccgctgtaacctggcgtgtacccccccgcgacaccttcatgtggtgcgacctatgtctcactatacaaccccaatggtcctgcagcaggctgccatccccattcagatcaacgtaggtactactgttactatgactggcaacgggacccgtccgccgcccacgccaaacgccgaagcccctcctccaggcccgggtcaggcctctagcgtggcccccagctcgaccaacgttgagagcagcgccgaaggagccccacccccaggaccagcgcctccacccgccacaagccacccacgagtcatacgaatctctcaccagtcagtagagcctgtggtaatgatgcatatgaacatacaggacagtgggacacaacctggaggggtgccttctgcccccaccggccccttggggccccccggtcatggtcagactctgggacaacaagtccccggtttccctaccgcacctactagagtcgtgattgctcggccgactccccctcaagccagaccaagccaccccggaggcccccctgtatctggcacccttcagggagcaggtctgggcactaatgcttcactcgcacaaatggtatcaggtctggtgggccagctattgatgcagcctgttttggtcgcacaggggaccccagggatggcgccacctcccgctccagcaacggcatccgcctctgctggaacgacaaataccgccactacggccggccctgcacctggtgggcctgcccagccacctccaaccccacaaccatcgatggcagacctccagttttctcaactccttggaaacttattgggccctgctggcccgggggcgggggggtctggtgtggcttcacccactattactgtcgctatgcccggggtgcccgcatttcttcagggtatgacggattttctccaggcaacacagacggccccacccccccctccaccccctcctccaccacctcccgctccggagcagcaaactatgcccccccccggatcccccagcggtggcgctggatcccccggaggactcgggctggaatcactgagcccagaatttttcacctctgtggttcagggtgtactaagtagcctcctcggtagcttgggagctagagcagggtcgagcgagagcatagcagcatttattcagcggctcagtggatcttccaatatcttcgaacccggtgccgacggggccttgggatttttcggagctcttctttctctcctgtgccagaattttagtatggtggatgtggttatgctccttcacggtcatttccagcccctgcagcgcttacagcctcagcttcgatccttcttccatcagcattacctgggtggacaggagccgactccgtccaatatcagaatggcgactcacacactgatcacaggtttggaggagtatgtgagggaaagcttctcattggtgcaggttcagccaggggtcgacattattagaactaatctggagtttctgcaggagcagttcaacagtattgcagcccatgtgctgcactgtactgactctggattcggcgcgaggctcttggagttatgcaatcagggactgtttgagtgcctggccctgaacctgcactgtctcggtgggcagcagatggaactggccgcagtgattaacggcagaatcagacgcatgagtcggggagttaatccatcgttagtgtcttggttgacgacaatgatgggcttgagactgcaggtggtgctggaacacatgccagtggggcctgatgccatccttaggtatgtgaggagggtaggcgacccccctcagccgttgccagaggagcccatggaggtgcaaggtgccgaacgtgccagcccggagcctcagagagagaatgcgtctccagcacctggaaccacggctgaggaggctatgagtagggggccgccccccgctccagagggggggagtcgggatgagcaagatggggccagcgcggaaactgagccatgggcagctgccgtacctcccgaatgggtaccaatcattcagcaggacatccaaagtcagaggaaagtcaaaccacaaccccccttgtctgacgcttacttgtctggcatgcccgccaagcggcggaaaaccatgcaaggcgagggaccccaattgttactctcagaggctgtgtcccgagcagctaaggccgccggtgccaggcctctcacatctcctgagtcgttgtcccgcgatttagaggcgccagaggtccaggagagctacagacagcaactgagatctgacatacagaaacgcctgcaggaggacccaaactatagtcctcaaagattcccgaatgcacaaagggcttttgccgacgacccttag

SEQ ID NO: 180322 - DNA, 735 bp, Artificial Sequence
  Description of Artificial Sequence: Synthetic coding sequence
atggagcccaacgacagcaccagcaccgccgtggaggagcccgactctttggaagtactggtcaaaacactggacagtcagacccggacctttatcgtaggtgcacagatgaacgttaaagagtttaaggagcatatcgctgcttcagtgtctataccctctgaaaagcagaggcttatctaccagggtcgcgtgctccaagacgacaagaaactgcaagaatacaacgtcggcggaaaagttatacatcttgtggaacgtgctcccccacaaacacatctcccgtctggagcctcgtccggcactggctctgccagcgcgactcacggcgggggctctccgccaggcacccgcgggccaggtgcctcggttcatgaccggaatgcaaactcttacgtcatggtgggcacttttaacttaccttctgagccacgtgtgagactggtcatggcccagcacatgattcgggacatacaaactttgctgagtcggatggaatgtcgggggggcccacaacctcaacattcacagcccccaccccagccgccagccgtgacaccagaacctgttgctctgagttctcagaccagtgagccggtcgagagcgaggcacccccccgcgagccaatggaagcagaggaggtagaagaacgcgcccctgcccaaaatccagaacttacgcctggtcctgctcctgcaggccccacaccggcccccgaaacaaatgccccctag

SEQ ID NO: 180323 - DNA, 717 bp, Artificial Sequence
  Description of Artificial Sequence: Synthetic coding sequence
agcagcgccgagggcgcccccccccccggccccgcccccccccccgccacttctcacccaagagtgattagaatatcccatcagtcagtcgagccagtagtgatgatgcatatgaacattcaaggacctctcagtctgtccccttgcccagattctggcacgcagcctggaggcgtgccgagtgcacctacaggacctctgggccccccagggcacggccagacgctggggcagcaggtaccgggctttcctacagcaccaacaagagttgttatcgctagaccaactcctcctcaagcaagacccagccacccagggggccctccagtctctggaactctccagggggccggtctcggcaccaatgccagtctcgcgcagatggtttccggcctggtgggacaattgttaatgcagcctgttctggtcgcccaaggcactcctggcatggcgccacccccagcccctgccaccgccagcgcctcggctggtaccactaacaccgcgactaccgccggccctgcccccggagggcctgcgcaaccgccccccacccctcagcccagcatggcagacctgcaattcagtcagttgttgggcaatctcctcggcccggcaggacccggcgcaggtgggagtggcgttgcctctccaaccataacagtcgctatgcccggtgtccccgctttcctgcaaggtatgactgactttctgtag

SEQ ID NO: 180324 - DNA, 735 bp, Artificial Sequence
  Description of Artificial Sequence: Synthetic coding sequence
atggagcccaacgacagcaccagcaccgccgtggaggagcccgacagtctggaggtgttggttaaaacccttgactcccaaaccagaacttttatcgtaggtgcccagatgaatgtgaaagaattcaaagagcacatcgcggccagcgtgtctatcccatcagaaaagcagagactcatctaccaggggagagtgctccaagacgataagaaactgcaggagtataacgttggaggaaaggtgattcacctcgtggagagagccccaccacaaacacatctcccttcaggcgcctcctccggcacaggatcagccagtgctacgcatggcggcgggagcccacccggcacacggggtccaggagcttccgtgcacgacaggaacgctaactcctatgttatggtgggcacctttaacctgccgtccgagcctcgcgtgaggcttgtcatggcccaacacatgattagagacatacaaaccctgctctcacgtatggagtgtcgcggtgggcctcagcctcagcattcccagccccctccacaaccccctgctgttacacccgagccagtggccctgtcgagccagacctcagaacctgtggaaagtgaagcgcccccaagagaacctatggaggcagaggaggtcgaggagcgggcccccgcgcagaatcccgagctgactccaggtcctgctcccgctgggccgacacccgccccagagacaaacgctccatag

SEQ ID NO: 180325 - DNA, 2232 bp, Artificial Sequence
  Description of Artificial Sequence: Synthetic coding sequence
atggagcccaacgacagcaccagcaccgccgtggaggagcccgactccctcgaggtactggtgaagacattggactcccagactcggacttttatcgtcggcgctcagatgaacgttaaagagttcaaagaacacattgccgcttcagtgtcaattcctagtgagaaacagagactaatttaccagggccgcgtcctgcaggatgataaaaagttgcaggaatacaacgttgggggaaaagtgatacatctggttgaaagagccccaccacaaacacatctcccgtccggcgcatcgtctgggaccggaagtgcctccgcaacccatggtggtgggagcccccccgggacgagggggccgggtgcctccgtgcacgatagaaacgctaacagctacgtgatggtggggactttcaacctgccctccgatgggtcagccgttgatgttcacatcaacatggagcaggcaccaattcagtcagagccacgggtgcggttagttatggctcaacacatgatacgggatattcaaacgttgctgagcagaatggagtgccgggggggaccacaaccacagcacagccagccgcctcctcagcctcccgcggtgacgcctgagcccgtggctctgtcctctcagactagcgaacccgtcgaatcagaagcaccaccgcgcgaaccaatggaagccgaggaggtggaggaaagagcacccgcccaaaatccagaactgacccctggtcctgccccagcaggacccactccggccccggagacaaatgctccaaatcacccttccccggcggaatatgtggaagttctgcaggagctgcagcgattggaaagcagactgcagcctttcctgcaaaggtattacgaggtgctgggcgccgcagctaccaccgattataacaataaccacgagggacgcgaggaagaccaacgattgattaacctcgtgggtgaatccctgaggttgctgggtaatacattcgtcgcattgagtgatctgaggtgtaacttggcctgtaccccgccacggcatctacatgtggtccgtcctatgtcacactataccacccccatggtgttacagcaggctgcaatccccattcaaatcaatgtaggaaccacggtcactatgaccgggaacggtacccgacctcctccaactccaaatgcagaggcacctcctccaggcccgggccaggccagctctgtggctccctcttcaaccaatgtggaaagctccgcagaaggagcaccaccaccagggccggctcccccacctgccacctcacacccgcgagtcatccgaatctctcaccagagtgtcgagcccgtagtgatgatgcacatgaatatccaggactcaggcacacagccaggaggcgtgccgtctgctccgaccggccccttggggccaccaggtcatggccagacacttggatctacactgatccagctcccttccctgccccctgagttcatgcacgcggtcgcccaccagattacccatcaagctatggttgcagcagtcgcctcagcagctgctggacagcaggtcccaggctttcctactgcacccacgagagtcgtgatcgcccgtcccacccctccccaggcaagaccctcgcacccaggcgggccacctgttagcggaacgttgcagggcgctggattagggacaaatgcttcccttgcacagatggtgtctggtcttgtgggccagttgttaatgcaaccggttctggtggctcagggcactccagggatggctcctcctccggcccccgccacagcatccgctagcgctggcactaccaataccgcgaccactgcaggcccggctcccggcgggcctgcccaaccaccacccactccccagccaagtatggccgacttacaattctcccagcttctcggaaatctgctggggcccgcaggccctggggcaggaggcagtggggttgcgagtccgactataactgtggccatgccaggggtgccagcgttcctgcagggcatgaccgactttctgcaggcaactcagactgctcctccgccccccccaccccctccacccccaccaccggctcccgaacagcagacaatgccccccccagggtctccatccgggggtgcagggtcccccggaggcctgggactcgagtcactgtcacccgagtttttcaccagcgtcgtgcaaggcgtcctgagcagcttgctctag

SEQ ID NO: 180326 - DNA, 477 bp, Artificial Sequence
  Description of Artificial Sequence: Synthetic coding sequence
atggagcccaacgacagcaccagcaccgccgtggaggagcccgacagtctggaagtgttggtgaagaccctcgacagccagaccaggaccttcatcgtcggagcacagatgaacgtgaaggagtttaaagagcacattgccgccagcgtaagcattcccagtgaaaaacaacgcctgatttatcaggggcgggtgttacaggacgataaaaagcttcaggagtacaatgttggcggaaaggtgattcatctagtcgagcgtgctcctcctcaaacacatctcccttccggcgcaagctcaggaacaggtagcgcctcagcaacccacgggggaggcagccctccaggtactcgaggtcctggcgcctctgtgcacgatcgtaatgcgaactcatacgtgatggtgggcactttcaatctgccgtctgatggctccgccgtcgatgtccacatcaatatggagcaagcacccatttag

SEQ ID NO: 180327 - DNA, 681 bp, Artificial Sequence
  Description of Artificial Sequence: Synthetic coding sequence
tgaagcggcttcggcgcccggctgctggagctgtgcaaccagggcctttttgaatgtttggctctgaacctgcattgcttgggggggcagcagatggagttggcggcagtcatcaatggaaggatcagacgcatgagcaggggagtgaatccctctctggtgtcctggttgaccaccatgatggggctgcgcctgcaagtggtcttagaacacatgccggtcggacccgacgcaatcctcaggtatgtccgacgggtgggcgatccccctcagcccctgccagaggagccaatggaggtgcaaggagcggaacgagcatctcccgagccacagcgcgaaaacgccagtcctgcaccgggcaccacggcagaagaagccatgtctcgaggaccacctccggcccccgaaggcggctctagggatgagcaggacggagccagtgccgagactgaaccttgggcggcggcggtaccaccagaatgggtaccaataatacaacaggacatccaaagccagcgcaaagtgaaaccgcaaccaccgctatctgacgcctacctatcaggtatgcctgctaagcgtcggaagctgaggtcagacattcagaagcggttgcaggaggacccaaattactctcctcagcgctttccaaatgcccaaagggcttttgcagatgacccctag

SEQ ID NO: 180328 - DNA, 717 bp, Artificial Sequence
  Description of Artificial Sequence: Synthetic coding sequence
agcagcgccgagggcgcccccccccccggccccgcccccccccccgctacttctcacccacgggtgatccggattagtcaccagtccgtggaacccgtggtcatgatgcacatgaacattcagggaccacttagtctgtccccttgtcctgacagtggaactcaacccgggggagtcccctccgctcctactgggcccctgggacctcctggtcacggccaaactctggggcagcaggtgcctggatttcctaccgcaccaacccgggtcgtcatagccaggccaacccctcctcaggccagaccatcccatcccggcgggcccccggtctcaggtaccctgcagggcgctggccttggcaccaacgcttcactagcccagatggtctctggtctcgtgggtcagttgttgatgcagcccgtactcgtcgcccagggcacaccagggatggcaccccctcctgctccagccactgcgtcagcgtctgcggggactaccaacacagctactacggctggccccgccccaggaggtccagcccagccgccaccgacgccacaaccttcaatggcggatttgcagtttagccaactcctggggaacttgctagggcccgcagggcccggcgccggcgggccaggcgtggcatcacccactatcacagttgctatgccaggagtccccgccttcctgcagggaatgactgattttttgtag

SEQ ID NO: 180329 - DNA, 3381 bp, Artificial Sequence
  Description of Artificial Sequence: Synthetic coding sequence
atggagcccaacgacagcaccagcaccgccgtggaggagcccgactcactggaggttctggtcaagactctcgacagccaaactagaacatttattgtgggagctcaaatgaatgtgaaagagttcaaagagcacatcgccgcaagtgtgtcaataccctcagagaaacagcgtctgatctatcagggccgagtgctccaggatgacaaaaagctgcaggagtacaatgtgggtggtaaggtgattcacctggtggagagagctcctccccagacacacctgccaagcggtgcctcgtctggcaccgggtctgcctccgcaacccacggtggggggtcccctccagggacacgaggcccgggcgcgtcagtccatgatcgaaacgcgaactcctacgtaatggtgggcaccttcaatcttccaagcgatgggagtgctgtggacgtgcatatcaacatggagcaggcccctatacagtctgaaccacgcgtgcggctagtcatggcacagcatatgattagggacattcaaactctgctaagtcgtatggagtgccgcggaggtccacagccacagcattcccagccccctccacagccccccgcggtgaccccagagcctgtggccctctcaagccagacttctgaacccgtagaatctgaggccccaccccgtgaacccatggaagctgaagaagtcgaagagcgggctcccgcccagaatcctgagctgactcccggccctgcccccgctgggccaacgcccgctccagagactaacgcccccaatcatccctctcccgcggagtacgtggaagtcctgcaggagctccagcggctggagtccagactccagccttttttgcagagatattacgaagtgctgggtgccgccgccaccacggactataacaacaatcacgagggacgcgaagaggaccaacgactgatcaatcttgtcggagagtcactccggctcctcggaaatacctttgtcgccctatccgatctgcgctgcaaccttgcttgcacccctcctaggcacctgcacgtggtgcggcccatgtctcactacacaacccctatggtgcttcagcaggccgccatcccaattcaaatcaacgtcgggacaacagtaactatgacaggcaacggcacaagaccgcctcccaccccaaatgccgaggcccctcccccgggtccaggacaggccagcagcgtcgcaccatcctctaccaatgtcgaaagttccgccgagggggcgcctccgcccggcccagctccgcctcctgctacttcacacccaagggtgatacggatatcccaccagtccgtcgagccagtggtaatgatgcatatgaacattcaggatagtggtacccagcctgggggcgtcccatctgcaccgacaggcccactgggtcctcctggccatgggcagacattagggcagcaggtgcctggatttcctacagcccctacaagggtggtaatcgctcgccccactccacctcaggcacggccctcacaccccggcgggcccccggtgagtggcacactgcagggcgccggcctagggactaatgccagcctagctcagatggtgagcggcttggttgggcagctgctgatgcagccggtactcgtagctcaaggaacgccaggcatggctccgcctccggctcccgcaactgcttcagccagcgccggcacaaccaataccgccactactgctggaccggctcctgggggacctgcacagcctccacctacaccacagcctagtatggccgatttgcagttttctcagctcctaggaaatctgctggggcccgctggcccaggtgctggaggtagcggtgtcgcctcaccgaccatcacggtggctatgcctggcgttccagcattcctgcagggcatgactgattttctgcaggcaacccagactgcaccccccccccctccacccccaccccctccacctcctgctcctgagcagcagaccatgccgccgcccgggagccccagtggcggcgcagggtcacccgggggactagggttagaatccttatcaccagaattcttcactagcgtggtccagggagttttaagcagcctgctcgggtctctgggggcccgagccggatcatctgaaagcatcgccgcattcatccaacgtctgagtgggtcttctaatatctttgagccaggggccgatggtgctcttgggttctttggcgccctcctgtctcttctttgccagaacttttccatggtcgacgtcgttatgttgctgcacggacactttcaacccctgcagagactacagcctcagctgagaagtttttttcatcaacattatctggggggacaggagcccactccctctaacatccgaatggctacccatacccttatcaccggcctggaggaatacgtgcgagagagcttcagcctcgtacaggttcagcctggggtggacatcatccgaaccaacctggagtttctccaggagcaatttaattcaatcgctgcacacgtcctccactgcaccgactccgggttcggggcccggcttctggagctgtgtaaccaggggttatttgagtgcctagcactcaatctgcactgtctcggtggccagcagatggagttggccgccgtgattaacggccgcattcgccgaatgagtaggggagtgaatccctctctggtgtcctggttgaccaccatgatgggactcaggctccaggttgttttagagcacatgccagtaggaccggacgccatactgcgatacgtgcgcagggtgggtgatccacctcaaccgctgccagaggagccaatggaagtccaaggagcagagcgggcatcccccgaaccacaacgggaaaatgcaagtccagctccgggcacaacggccgaggaagccatgtctaggggtccacccccagccccagaggggggaagtcgagacgagcaggatggtgcatctgccgaaacggagccatgggccgccgccgtgcctcctgaatgggttcccattatacaacaggacatccagagccagagaaaggtgaaaccacaaccaccactgagcgatgcctacctcagcggtatgccagcaaagcgacgtaagactatgcagggagaggggcctcagctgcttttaagcgaggctgtttcccgcgctgccaaggcagcaggtgctcgccccctgactagcccagagtccctgagccgcgacctggaagcccctgaagtacaggaaagttatcgccaacagctacggagcgatatacagaagaggctgcaggaagacccaaactactctccccagcgtttcccgaacgcacagcgggcatttgcagatgatccctag

SEQ ID NO: 180330 - DNA, 789 bp, Artificial Sequence
  Description of Artificial Sequence: Synthetic coding sequence
atggagcccaacgacagcaccagcaccgccgtggaggagcccgactctctcgaggtgctggtgaagactctggatagccagactcggaccttcatcgtaggtgcccagatgaatgttaaagaattcaaagagcatatcgcagcatccgtatctattccaagcgaaaagcagaggctgatctatcaagggcgtgtcctccaagacgataagaaattgcaggagtataatgtcggtgggaaggtgattcacttggtggaaagggcccctccccagacccacctgccgtcaggggctagctcaggcacgggcagcgctagcgcgacccacggtggaggctccccccctgggacaagaggcccgggggcgagcgtccatgatcgcaacgcaaactcttacgtcatggtaggcacgttcaatctcccttcagacgggtcagccgtcgatgtgcatattaatatggagcaggcacctatccagtctgaaccccgcgtgcgcttagttatggctcagcacatgataagagatattcagacgcttcttagtaggatggaatgccggggcggacctcagccacagcactctcagcccccgccccaaccccccgctgtgacacctgagccagttgccttatcctcccagacctcagaacccgttgagtctgaggccccccctcgggaaccaatggaagccgaagaggtggaagagagggcccccgcacagaacccggaactgaccccaggcccagcaccggcaggaccaactcctgcccccgaaaccaatgcaccatag

SEQ ID NO: 180331 - DNA, 477 bp, Artificial Sequence
  Description of Artificial Sequence: Synthetic coding sequence
atggagcccaacgacagcaccagcaccgccgtggaggagcccgactcactagaggtcttggtcaaaaccctggattctcagacgcggacattcatcgttggggcgcagatgaacgttaaagagttcaaggagcatatcgctgcgagtgtgagcatccccagtgaaaaacagagactaatataccaagggagggtgttgcaggacgacaagaagcttcaggagtacaacgtgggtggtaaggtgattcacctcgttgaacgtgcgcctccacagactcaccttccaagcggggccagttccggcaccggctcagcctctgccactcacgggggcggctctccacctggcacgcgcgggcctggagccagcgttcatgatcgcaatgccaattcatacgtgatggtcggcaccttcaacttgcctagtgacgggtctgcagtcgatgtgcacatcaatatggagcaggccccgatttag

SEQ ID NO: 180332 - DNA, 777 bp, Artificial Sequence
  Description of Artificial Sequence: Synthetic coding sequence
atggagcccaacgacagcaccagcaccgccgtggaggagcccgacagcttagaagtgttagtcaaaaccttggattcccagacgcgcacatttatagtgggggctcaaatgaatgtaaaagagtttaaggagcacatcgcggctagcgtatctatcccctctgagaaacagcggctgatatatcaggggcgcgtgctccaggatgacaaaaagcttcaggaatacaatgtgggtggcaaggttatccacctggtggagcgggcaccacctcagacccatctgccatccggagcatcctcaggcacaggaagtgctagcgctacccatggaggcgggagcccgcctggcacccgcggtcctggcgccagcgtgcatgacagaaatgctaacagttatgttatggttggaacattcaatctgccttctgatggaagcgccgtcgacgtgcacatcaatatggagcaggcacccatccagtcagaacctagagtccggttggtcatggcgcagcatatgatccgagatatccaaacccttttaagcaggatggagtgtcgaggcggccctcaacctcagcactcacagcctcctcctcagccgcctgcggttacgcccgagccggtagccctatcctcacagacgtccgaacccgtcgagtccgaggcacctccacgggagcccatggaggccgaagaggttgaagagcgtgctccggcccaaaacccggaactgacccccgggcctgctccagctggtccaactcctgccccggagtag

SEQ ID NO: 180333 - DNA, 735 bp, Artificial Sequence
  Description of Artificial Sequence: Synthetic coding sequence
atggagcccaacgacagcaccagcaccgccgtggaggagcccgactcgctggaggtgctggtgaaaacgttggactcccagacgcgtaccttcatagtcggggctcagatgaacgttaaagaatttaaggaacatattgcggcgtcggtttccatcccgagcgagaaacaaagactaatctaccagggcagggtcttgcaggacgacaagaagctgcaagagtataacgtcggaggaaaagtcattcatctcgtggaacgagcgcccccacagacccacctccctagcggggcatcaagcggcaccggaagcgctagcgccacccacgggggagggagtccaccgggcacccgcggaccaggcgcttctgtacatgacagaaacgctaattcatatgtgatggtagggacatttaacttgccctcagaaccacgtgttaggctggttatggcccagcacatgatccgcgatattcagacactgctcagtaggatggagtgtcgaggagggccccaacctcagcattcgcagccccctcctcagccccccgcagtgacacccgaaccggtggcactttcctcccaaaccagcgagcctgtcgaaagcgaggcacctccacgggaaccaatggaagccgaggaagtggaggaacgagcccctgcacaaaacccagagttgacacccggtcccgcgcccgctggacccacccccgcccctgagaccaatgcaccctag

SEQ ID NO: 180334 - DNA, 1548 bp, Artificial Sequence
  Description of Artificial Sequence: Synthetic coding sequence
atggagcccaacgacagcaccagcaccgccgtggaggagcccgactccttagaggttctggtgaagaccctcgacagccagacccgaactttcatcgtcggggcccagatgaacgtgaaggagttcaaggagcacattgctgcgagcgtgagcatcccgagtgagaaacaacggctaatctaccagggccgggtgcttcaagatgataaaaagctgcaggaatacaatgtgggcggtaaagtgatccacctggtagaacgagcacctcctcagacccatctgccgagcggcgcgtcgtctgggaccggttcagcgagcgcgacccatggggggggatcacccccggggacccgaggtcctggggccagcgttcacgatcggaacgccaactcctatgtcatggtcggaacctttaacctcccaagtgatggatctgccgtggacgtgcacatcaatatggagcaagcacctattcagtccgagcctagggttaggctggtgatggctcaacacatgatacgcgacatccaaaccctgttatctcggatggaatgtcgcggtggtcctcagccacaacattctcagccaccaccgcagccccccgctgtgacacccgaacccgtcgcactgtcctcccaaaccagtgaaccagtggagtccgaagctccaccaagagagcccatggaggctgaggaggtggaagaaagggcaccagcccagaaccccgagcttactcctggacctgctcccgctggccctaccccagcacctgagactaatgccccaaatcacccaagccctgccgaatatgtggaggtgctccaggagctgcagcggctagagagtcgcctccagcctttcctacagcggtattacgaggtactgggcgctgcagccacaaccgactacaacaataaccatgagggtcgggaggaggatcagcggctcatcaacttagtcggagaatctctcaggctgctgggcaatacctttgtggcccttagcgatctgagatgtaacctagcctgcacccctcctcggcatctccacgttgtccggccaatgtcacattacacaacaccaatggttctacagcaagctgctatccccattcagattaatgtcggtaccactgtgaccatgactggaaatgggacccggcctcccccaacccctaacgcagaggcaccgcccccgggacctggacaggcatcctcagtggcaccctcgtctactaacgtggagtcttcggcagagggggctccacccccagggcccgcccccccaccagccaccagccacccacgcgtgatccgcatttctcatcaaagcgtggagcccgtggtcatgatgcacatgaacatccaggactccgggactcagcctggaggagtcccaagcgctccaaccggcccactgggacctccaggacacggacagactcttgggagtacgctcattcagctcccttcactgcctcccgagttcatgcacgcagtcgcacaccagatcacccatcaggccatggtcgccgcagtcgccagttag

SEQ ID NO: 180335 - DNA, 702 bp, Artificial Sequence
  Description of Artificial Sequence: Synthetic coding sequence
atggagcccaacgacagcaccagcaccgccgtggaggagcccgactccttggaggtcctggtgaaaacacttgattcacaaacacggaccttcatcgtgggggcccagatgaacgttaaggaattcaaggagcatattgcggcctcagtgtctatcccctctgagaagcagaggctcatttaccaaggcagggtgctgcaggacgataaaaagctccaggagtataacgtgggcgggaaggtgatacatctggttgaaagagctcccccgcagactcacttgccatccggggcatcctcaggcactggatctgcgagcgccacgcatgggggggggtcgccccccggcaccaggggtcccggagccagcgtccacgatcggaatgctaactcatatgtaatggtggggacattcaatctgccatccgatggatctgccgtggacgtgcatatcaacatggaacaagcacctattcagtccgaaccccgtgttaggctggtaatggcccaacacatgattcgagatattcaaactctgttatctcgaatggagacactcccttacctacaatgtagaggagggcctcagccacagcactcccagcccccaccccagccaccagctgtgacgccagaaccagtggctctgtcgagccaaacaagtgagcctgtcgagtccgaggctccacccagggaaccatag

SEQ ID NO: 180336 - DNA, 3381 bp, Artificial Sequence
  Description of Artificial Sequence: Synthetic coding sequence
atggagcccaacgacagcaccagcaccgccgtggaggagcccgactcattggaggtgctggtcaagaccttagacagccagactagaacttttatcgtgggggctcagatgaacgtgaaagaattcaaggagcatatcgccgctagtgtatccattccatcagaaaaacagcgactgatctaccagggccgggtactgcaggacgacaagaaactgcaggaatacaacgtggggggcaaggtcatacacttggtcgagcgggcccctccccagacccacctgccttctggcgctagttcgggcacaggctccgcgtctgcgactcatggtggagggagcccgccagggacgcgcgggccgggagcctcagtgcacgaccggaacgctaatagctacgttatggtcggtacctttaatttaccaagtgacggatcagccgtggatgtgcacatcaacatggaacaagcacctattcaatctgagcccagggttaggctagttatggctcagcacatgatcagagatatacagacgctcctgagtcgcatggaatgtcgggggggaccacagcctcagcacagccaaccacctccacagccccccgcagttacacctgagccagtggctctctcctctcagacgtcagagccagtggagagcgaggcccccccgcgggagcccatggaagccgaggaggtggaagaacgcgcgccagctcagaatcccgagctcaccccaggtcctgcaccagctggccccacccctgcccccgagactaatgccccaaaccacccatctcctgccgaatatgtggaagtgttgcaggaactccagcgactggaatccagattacagcccttcctgcaacgctattacgaagtgctgggggctgcagctactactgactacaacaataatcacgaggggagggaggaggatcaaagattaattaacctggttggggagtccttgaggctgctgggcaatacattcgtagccctgagtgatcttcgctgcaatctggcatgtacaccaccacgccacttacatgtcgtccgtcccatgtctcattatacaacaccgatggtcctacagcaagctgctattcctattcaaatcaacgtcgggaccacagtgacaatgactggcaatggcacaagaccacctcccaccccgaatgccgaggccccaccacctgggcccggccaggcttcttcagtggccccgtcttccactaatgtggaaagctccgctgagggcgcccccccaccaggtcccgccccacctcctgccaccagccaccctcgagtcatcagaatcagccaccagagcgtggaaccagttgtcatgatgcacatgaatatccaggattcaggtacgcagcctgggggcgtgccctcagcccccacaggcccattggggccgcccggacacgggcaaaccctgggacagcaggttcccgggtttcctaccgccccaacacgagttgtaatcgccaggcccacacccccacaagcccgacccagccacccgggcggccctccagtgtccggaactctgcagggcgccggcctcgggaccaatgcttccctggcccagatggtgtctggacttgttggccagctgctgatgcagcccgtactcgtggctcaggggacaccggggatggcacccccaccagcccccgcaaccgcctccgcctccgccgggacaactaataccgcaacgaccgcaggtccggcaccaggcggccccgctcagcccccacctacacctcaacccagcatggccgatctgcagttttcccagttacttgggaacctgctgggtcccgctgggccgggcgccggaggcccaggcgtggcaagccccacaattactgtagcgatgcccggggtgcctgccttcctgcagggcatgaccgacttcttacaggctacacagaccgcgcctccaccccctccaccacccccgcctccaccccccgcgccagaacagcagacaatgccacccccggggtctccgagcgggggcgctggctcaccaggcgggttaggcttagaatccctgtctcccgaattcttcacatctgtggtgcaaggggtgttaagtagtctgttagggagcctgggggctagggctggctcatctgaatcgatcgcagcattcatccaacgattgagcgggagcagcaacatttttgaacccggcgctgacggggcactcgggttttttggcgccctgcttagtttgctgtgccaaaacttcagtatggtcgatgtcgtgatgctgctgcacggtcattttcaacctttgcaacggctccaaccgcagcttaggtcctttttccatcagcattacctcggaggccaggaacccacaccctcaaatatacgaatggccacacataccctcatcactggcctggaggagtatgtgcgtgaaagtttttccttagtgcaggtccagcctggcgttgatatcatcagaactaacctggagttcttgcaggaacagttcaacagcatagcagcacacgtccttcactgcaccgatagcggctttggagcacgtctgctggagctgtgtaaccaggggctgtttgagtgtctagcgctcaacctgcattgtctcggcgggcaacagatggagctggccgcagtgataaatgggcggatcaggcgcatgagcagaggagtcaacccatcactggtgtcttggttgacaacaatgatgggtctgaggctccaagtggtgttagaacacatgcccgtcggaccagacgccattttgcggtatgtccgacgcgtgggagaccccccccaacctctgccagaagagccaatggaggtgcagggtgctgagcgggccagcccagagcctcagagggaaaacgcctctcctgctccgggcacaactgctgaggaggccatgagccggggtccaccgcctgcccccgaggggggctctagggacgaacaagacggagcctccgccgagacagagccctgggccgcagcagtgccaccagaatgggtgcccattattcagcaagatattcagtcccagcgaaaagtcaagccacagcctccattatctgatgcgtacctatctggaatgccagcgaaacgcaggaagaccatgcagggggaaggacctcaactcctgctgtccgaggccgtaagtagggctgcaaaagccgctggcgcaagacccttgacatcgccggagagtttgtcgcgggaccttgaggcacctgaagtacaagagagctaccgccagcagctgcgatccgacatccagaagcgactgcaagaggatcccaactatagtccacagcggttcccgaatgctcagcgcgccttcgcggacgatccctag

SEQ ID NO: 180337 - DNA, 789 bp, Artificial Sequence
  Description of Artificial Sequence: Synthetic coding sequence
atggagcccaacgacagcaccagcaccgccgtggaggagcccgactccctggaagtactggtgaagacactcgacagccaaacccgcacgttcatcgtcggggctcaaatgaatgtcaaggaattcaaggagcacatcgcagccagtgtttcgatcccctcagaaaaacagcggctaatctatcaaggacgcgtgctgcaggacgacaaaaagcttcaggagtacaatgtaggcggcaaggtaatccatctggtcgagcgggccccaccccagactcacctcccctccggagcaagctccggcactggcagcgcctctgctactcacgggggaggcagtccgcccgggaccagaggtcctggggctagcgtccacgaccgaaatgcgaactcttacgtgatggttggcacattcaacctgccttcagacgggtccgctgtcgatgtacacataaacatggaacaagctccaattcagtccgagcccagggttagattggtcatggcccaacacatgatacgggatatccagacactgctgtctcgtatggagtgcagaggaggaccgcagccacaacattcccagccgcctccccagccccctgcggtcacaccagagcccgttgccctgagcagtcagaccagcgagccagtcgagtccgaggcccctcctagggagccaatggaggcagaggaagtcgaggagcgggcccccgcccagaaccctgagctgacgccaggccccgctccagcgggccccaccccggcccctgaaacgaacgccccctag

SEQ ID NO: 180338 - DNA, 411 bp, Artificial Sequence
  Description of Artificial Sequence: Synthetic coding sequence
tgacggatgagccggggcgtgaaccccagcctggtgagctggctgacaacaatgatgggcctacgcctccaagtagtcttggagcacatgccagtcgggcctgacgccatactccgatatgtgcggcgggtaggggaccccccacagccgctgcccgaggagccaatggaggtgcagggggctgagagggcaagcccagagcctcaggaatgggttccaataatccaacaggacattcaatcacagaggaaagttaagcctcagccacccctgtccgacgcttacctctctggaatgccagctaagcggagaaagctgcgatctgatattcagaaaagactgcaggaagacccaaactacagtccccagcgtttcccaaacgcccaacgagcgttcgcagacgatccttag

SEQ ID NO: 180339 - DNA, 558 bp, Artificial Sequence
  Description of Artificial Sequence: Synthetic coding sequence
tgactggcctgcacccccccccggcacctgcacgtggtgcggcccatgtctcactacaccacgcctatggtgctccagcaagcggcaataccgattcagattaacgtcggtaccaccgttaccatgacgggtaacggaactcgccccccgcccaccccaaacgcagaggctccaccgccaggccccggacaagcttcaagcgtggcgccctcgtccacaaacgtcgaatccagtgcagagggagcacctccccccggacctgcccccccgcccgcaacctctcaccctcgagtgatcaggattagtcatcaaagtgtagagcccgtagtgatgatgcacatgaatattcaaggacagcaggtgccaggcttccccaccgcccccacaagagtcgtcatcgctcgcccaacacccccccaggctaggccttcacatcccggtggccctcccgttagtggaactctgcagggagccgggctgggtacaaatgccagccttgctcagatggtcagcggactagtcgggcagttactaatgcagcctgttctcgtggcatag

SEQ ID NO: 180340 - DNA, 681 bp, Artificial Sequence
  Description of Artificial Sequence: Synthetic coding sequence
tgaagcggcttcggcgcccggctgctggagctgtgcaaccagggcttgtttgagtgtcttgcactgaatctgcactgcctgggaggtcaacagatggagctggcagcggtgatcaatgggcgcattcggcgcatgtccagaggagtgaatccctctctggtgtcttggttgacaacaatgatgggcctcaggctgcaagtcgtgctggagcacatgcctgttggcccagacgccatccttcgatatgtgcgccgcgttggagaccctccacagccccttcccgaagagccaatggaggtgcagggcgctgagagagcctcgcctgaaccccagagggagaatgcctcaccagcaccaggcacaacagcagaagaagccatgagcaggggacctccccctgctcctgaggggggaagcagagatgagcaggacggggcctccgcggagaccgagccctgggctgcagccgttccaccagagtgggttccaatcatccaacaggacatccaaagccaaaggaaggtcaaacctcagccccctctttctgacgcatacttgtccggtatgccagctaagcgtagaaaactcagatccgatatccagaaaaggctccaggaagaccccaactattcaccacagagattcccaaacgcccagagggccttcgccgacgatccctag

SEQ ID NO: 180341 - DNA, 594 bp, Artificial Sequence
  Description of Artificial Sequence: Synthetic coding sequence
atggagcccaacgacagcaccagcaccgccgtggaggagcccgactcacttgaagtgcttgtcaaaaccctggatagccagaccagaacattcatcgtgggagcacagatgaatgtcaaagagtttaaggagcacattgcagcttctgtgtcgataccttcagagaaacagcgcctcatttaccaagggagggttctgcaggatgataaaaaacttcaagaatataatgtcggagggaaagtcatccaccttgttgaacgagcccccccccaaacacatctaccctctggagcttccagcggcactggaagcgccagcgctacccacggtggcggttctcctcccggaaccagggggcctggggcctccgtacacgatagaaatgctaattcctacgtgatggttggaacctttaatcttccatccgacgggtcagccgtggatgtacacatcaacatggagcaggctccaatccagagcgaaccgcgcgtccgtttggtgatggcccagcacatgattagagatatacagacgctcttaagtcgcatggaatgccgcggaggcccccagccgcaacattctcagcctccatag

SEQ ID NO: 180342 - DNA, 648 bp, Artificial Sequence
  Description of Artificial Sequence: Synthetic coding sequence
atggagcccaacgacagcaccagcaccgccgtggaggagcccgacagcctggaggtactcgttaagactttagacagccagaccaggactttcatcgtcggagctcagatgaacgtgaaagagtttaaggagcatatcgccgcctccgttagcattcccagcgaaaagcagcggctgatataccaggggcgtgtcttgcaggatgacaaaaaattacaagagtacaacgtcggtggcaaggtcattcatcttgtggaacgcgctcctccccagacacacttgcctagcggtgcttcctccgggacagggagtgcctccgccacgcacggaggagggtccccccccgggacacgcgggccgggggccagcgtccacgaccgtaatgctaactcctacgtgatggtcggaacctttaatttgccgtccgaacctagggtccggctggttatggctcagcatatgatccgcgacattcaaactctcctgtccagaatggaatgcaggggcgggccacagccacagcactctcagcccccgcctcagccaccagctgtgacccccgagccggtcgctctgagctcacagacaagcgaaccagtggaaagcgaggcgccgccgagagagcccatggaggcagaggaagtgtag

SEQ ID NO: 180343 - DNA, 702 bp, Artificial Sequence
  Description of Artificial Sequence: Synthetic coding sequence
atggagcccaacgacagcaccagcaccgccgtggaggagcccgacagtcttgaagtactggttaagacccttgattcacagacacgaacattcattgtaggggcacagatgaatgtcaaggagttcaaggaacatatcgcggccagcgtctcaatacccagtgaaaagcagcggttaatttaccaggggagagtccttcaggacgacaagaaacttcaggagtacaatgtgggtgggaaggtgattcatttggttgagagagccccacctcagactcatcttccttcaggagccagcagtggtacggggagtgcctctgctacccacgggggcgggagccctccggggactagagggccaggtgcatctgtgcacgaccgtaacgccaattcgtacgtcatggtcgggacatttaacctgccttctgatggatcagctgtggatgtgcacattaatatggagcaagcaccgatccagagtgagccccgggtgagactggtgatggctcaacatatgattcgagatatccaaacactgctgagtcggatggagaccctgccgtacctgcaatgccgcgggggcccacagcctcaacacagccagcctcctccccagcctccagcagtgacaccagagcctgtggccctctcttcacagacctccgagccggtcgagtccgaagccccaccaagggagccatag

SEQ ID NO: 180344 - DNA, 777 bp, Artificial Sequence
  Description of Artificial Sequence: Synthetic coding sequence
atggagcccaacgacagcaccagcaccgccgtggaggagcccgactctctggaggttttagtgaagactctggattcccagacccgcacctttattgttggagcccagatgaacgtgaaggagttcaaagaacacattgcagcttctgtttctatcccaagcgagaagcagaggctcatttaccaaggtagggtgttgcaggatgacaaaaaactacaagagtacaatgtgggcgggaaggtcatccacttggtggagcgagctcctccccagactcacctgcccagtggcgcttcttctgggaccggctccgcaagcgctacccatgggggtgggtccccacccggcacaagaggacctggagctagcgtgcatgataggaatgcaaatagctatgtgatggtgggaacttttaacctcccaagtgacggatcagctgtcgatgtgcacataaatatggagcaagctccaattcagtccgaaccacgggtgcggcttgtcatggctcagcatatgatcagggacatacagacgttgctgtctaggatggagtgccgcggcggcccacaacctcagcacagtcagcccccccctcagcctccggccgttacacctgagcctgtggccctctcttcgcagacgtccgagccagtggaatccgaggccccccccagggagccaatggaggccgaggaggtggaggagcgagcccctgctcagaatccagaactgactcccgggcctgcacccgccggtcctacgcccgctcccgagtag

SEQ ID NO: 180345 - DNA, 411 bp, Artificial Sequence
  Description of Artificial Sequence: Synthetic coding sequence
tgacggatgagccggggcgtgaaccccagcctggtgagctggctgaccacaatgatgggccttcgcctgcaggttgtactcgagcacatgcccgtcggaccagacgccatcctgcgttatgtgagaagagtgggcgacccgcctcagccactgccagaagagcctatggaggtgcaaggcgcagaacgagccagcccagaacctcaggagtgggtgcccattattcagcaggatattcagtctcagcgaaaagtgaagccacaacctccactttcagatgcctatctatccggtatgcctgccaagcgcagaaagttgcggtctgatatacagaaaagactccaggaagatcctaattactcccctcagcggttcccaaatgcgcagagggctttcgcagacgatccatag

SEQ ID NO: 180346 - DNA, 780 bp, Artificial Sequence
  Description of Artificial Sequence: Synthetic coding sequence
atggagcccaacgacagcaccagcaccgccgtggaggagcccgacagtctggaggtgctggtgaagacgttggattcccagactcgcacatttatagttggtgctcagatgaacgtaaaagagtttaaggaacacatcgctgcgagcgtctctatcccctctgagaaacaacggttgatctaccagggccgcgtacttcaagatgacaagaaacttcaggagtacaacgttggtggcaaggttatccatctggttgagagggcccccccccagactcatctgccgtccggtgcctcaagcggaacaggatccgcttccgcgacccacggggggggtagtcctcctggaacccggggccctggagccagtgtgcatgaccggaatgcaaactcttatgtgatggtcggtacattcaacctcccttccgacgggagtgcagttgacgtccacatcaacatggaacaggctcccatccagtctgagccacgggtcaggcttgttatggcacagcacatgattcgggatattcagactcttctcagccgtatggaatgtcgcgggggccctcagccccaacacagtcaaccccccccccagccgccggccgtcacccctgaaccagtcgctctgagctctcagacttcggaaccagttgaatcagaggccccacctagagaacctatggaggcggaagaggtggaggaaagagctccagctcagaatcctgagttgactccaggcccggctcccgccggaccaacccccgctcctgaaacttag

SEQ ID NO: 180347 - DNA, 2232 bp, Artificial Sequence
  Description of Artificial Sequence: Synthetic coding sequence
atggagcccaacgacagcaccagcaccgccgtggaggagcccgacagtctggaggtgcttgttaaaaccctggacagtcagacccgaactttcatagtgggcgcccagatgaacgtgaaggagtttaaagagcacatagccgcatctgtgtctattcccagcgagaaacagagattaatctatcaggggcgggtattacaggacgacaaaaagctccaagagtataatgtcggagggaaggtgattcacctggttgagcgcgcgccacctcagacgcacctccccagtggggcatcgagcgggacgggcagcgcttcagcaactcacggagggggatccccccctggaacacggggaccaggcgcttcggtacacgatcgcaatgctaacagctacgtaatggtgggcacctttaacctgccaagtgacggttcggctgtggatgtgcacattaatatggagcaggcccccattcaatctgagcccagagtgaggctcgtgatggctcagcacatgattagggacatacagacattgctttccaggatggaatgtagaggcgggccacagccacagcattcacagccacctccacaaccccccgcagtcacccctgagccagtggctctgtcctctcagacatcggagcccgtggagagtgaagcccctccaagggaaccaatggaggctgaggaggttgaggaacgggctccagctcagaaccccgagcttactccaggtccagctcctgccgggcctaccccggcgcctgagactaacgcaccgaaccacccaagcccggcggagtatgttgaggtcttgcaggagctgcagagactggagtccagactccagccgtttctccaacgttactacgaagtcttgggagccgctgcaactaccgattacaataacaaccatgaaggaagggaagaagatcagagactgattaatctcgtaggagagtcactgcgactcttagggaatacctttgtggctctgtccgacctacgctgtaatctcgcatgcacgccaccacggcacctccatgtagtacgtcctatgagtcactataccacccctatggtcctccagcaggctgcgatccccattcaaatcaacgtgggaacgacagtgacaatgacagggaacggcacaagaccacccccgactccgaatgctgaggccccaccacccggcccagggcaggcctcatccgttgcccctagctcaaccaatgtcgaatcgtctgctgagggcgcacccccccctggcccagcccctccccccgccacttcccacccccgggtgatacgcatttctcaccagtcagtggaacccgttgtaatgatgcatatgaacatccaagatagcggcacgcagccagggggggtgccctcagcacctacaggaccattgggcccccccggccacggccagacgctagggtctactctgatccaactgccctccctaccacccgaatttatgcacgccgtggcacatcagatcacgcatcaagctatggtcgctgctgtggccagtgctgccgcggggcagcaggtgcccggatttcccaccgctccaactcgcgtcgttatcgcccgacccactccaccacaagcccgccctagtcaccctggtggcccccccgtgagcggtaccctgcagggagccggtctcggcacaaacgcaagtctggcacagatggttagtggattagtgggccaattgctgatgcagcccgtgctggtggcccaggggacacctggcatggcacctccacctgcgcctgcgactgcttcagcctcagccggcaccaccaacacggccacaaccgcggggcccgcgcccggtggcccggcgcaacctccgcccacaccacaaccctctatggccgatttgcagttcagtcagttattgggcaacctgctggggcctgcagggccaggtgcgggcgggagtggggtcgcgtcacccactatcacggtggccatgccaggcgtgccagcattcctgcaggggatgacagacttcctgcaggcgacacaaactgcaccaccccctccccctcctcccccgcctccaccccctgctcccgagcagcagactatgccaccgccgggttcacccagcgggggtgcaggatcaccaggaggcctgggtctcgaaagcctgtctcccgaattctttacatcagtggttcagggggtgctgtctagcctgctctag

SEQ ID NO: 180348 - DNA, 3399 bp, Artificial Sequence
  Description of Artificial Sequence: Synthetic coding sequence
atggagcccaacgacagcaccagcaccgccgtggaggagcccgactcccttgaggttctggtgaaaacactcgattcccaaacacggacattcattgtgggcgcacagatgaacgtgaaagagtttaaggaacacatcgcagcttccgtctccattccttctgaaaagcaacggcttatctaccaaggacgagtgttgcaggacgacaaaaagctacaggaatacaacgtcggtggtaaggttatccacctcgtggagagggctcccccccagactcacctcccatccggggcatcctctggcaccggatccgcgtccgctacccacgggggcggctctcctccaggtacacggggacccggcgcttccgtacacgatcgaaacgccaactcctatgttatggttggcactttcaatctgccatcagacgggtcagcggtggacgtgcacataaacatggagcaggctcctattcagtcagagccaagggtgcgtctggtgatggcccagcacatgatccgagatatccagactcttctcagtcgcatggaaacactcccctatctgcagtgtcggggcggaccccagccgcagcacagtcaaccccctcctcagccccccgctgtcactccagagcccgtcgccctttctagtcagacgtccgagcctgtggagagtgaggccccgcctcgtgagcccatggaggctgaggaggttgaagaacgggcaccggctcaaaatcccgagcttacacccggacccgcccccgcaggtccaacccccgcgcccgaaaccaatgctccaaatcacccaagtcccgctgagtacgtggaagtcctgcaagagttacagcggctggagtctagactgcagcctttcctacagaggtattacgaagtgttaggggctgcagccaccaccgactataataataatcacgagggtagggaggaagatcagagactgatcaatctcgtgggagaatccctcaggctgctgggcaacacattcgtcgcgctctctgatctgcggtgtaacctcgcttgcacaccgcctaggcatctccacgtggttaggccgatgtcccactataccacaccgatggtactgcagcaggccgctatcccaatacagattaatgtgggaaccactgtgactatgaccggcaatggcacaaggcctcctcctactcccaacgccgaggctcctccacccggtccagggcaggcctcctccgttgccccctcaagtaccaacgttgaatcttctgcagagggggcccctcctccaggaccagcacccccgcccgcgaccagccacccaagagtgattcgtataagccatcaaagtgttgagccagtcgtgatgatgcacatgaacatccaggactccggtacacagcccggtggggtgccttctgcgcctacaggcccattagggcccccaggacatggacagactctgggccagcaggttccgggatttccaaccgcccccacacgagtagtcatcgcccgtccaaccccaccccaggcgaggccttcacatcctggcggcccacccgtctccgggactctgcaaggtgctgggctgggtaccaatgcatctctggcccagatggtgtccggcctagtgggccagctactgatgcagccagtcttggtggctcaggggacccccggcatggcgcctcctcctgcacctgcaactgcctctgcctctgctggaaccacgaataccgctactacagctggcccagctccaggggggcccgcccagccgcccccgactcctcagccctcaatggcggacctccagttcagtcagctcctgggcaacctgttaggtccagctggccctggagctggcggaccaggggtagcaagccccaccatcacagtggccatgcccggcgttccggcctttctccaggggatgacagacttcctccaagctacccaaacagccccgcctcctcctcctccacccccgccacctccccctgcaccagaacagcagacgatgcctcctcctggctctcccagtgggggagctgggagccccggcggactgggcctggagtctctctcgcccgaattcttcacttcggtggtccaaggtgtcctctcctccctgctgggatcgctgggggcgcgagccgggtccagtgagagtatcgccgccttcatccagaggctcagtggctcttctaatatattcgagccaggcgcagacggtgctctgggattctttggcgctctgctcagcctgctgtgtcagaacttcagtatggtcgatgtcgtgatgctgcttcacggccattttcaaccactgcaacgtctacagccccaacttcggtcattctttcaccagcattaccttggcggccaagagcctacccccagtaatattcgcatggccactcacacattaattaccggactggaagagtatgtccgagaatcctttagcctggtccaggtacagcctggggtggacataattagaacaaacctggagttcctacaggaacagttcaactctatcgccgcacatgtactacactgcaccgactcgggattcggcgcacggttactcgaactctgtaatcagggtctattcgaatgcctggctctgaacctgcattgcttaggtggccagcagatggaacttgccgcagtcattaacgggcgaatcaggaggatgagcagaggcgttaacccgtccttggtaagttggctgacgaccatgatggggctgagattacaggtggtcctggagcacatgcctgtggggcctgatgctattttgcgttacgtccgtcgcgtgggtgaccctccccaacccttgcctgaggaaccaatggaagtgcagggcgctgagagagcgagtcctgagccacagcgcgagaatgcaagccccgcacccggcacaaccgcagaagaagctatgagcaggggcccaccaccagctcctgaggggggctctcgcgacgagcaggacggtgcctctgcagagactgagccctgggccgcggcagtgccccctgagtgggtaccaattatccagcaggacatccaatcgcagaggaaagtcaaaccccagcccccactgtccgatgcatatctgtccggaatgccggcaaagaggaggaaaacaatgcagggcgaaggtcctcagctgctgctcagcgaggccgtgtctcgggcagcgaaagcagccggtgcccgtcccctgacaagtcccgagtctctttctcgggatctcgaggcacctgaggtgcaggagtcatatagacaacagctcaggtctgatatccagaagcgcctccaggaggacccaaactattccccgcaacggttcccgaatgcacagcgcgcttttgccgatgatccttag

SEQ ID NO: 180349 - DNA, 594 bp, Artificial Sequence
  Description of Artificial Sequence: Synthetic coding sequence
atggagcccaacgacagcaccagcaccgccgtggaggagcccgactccttagaagttttagtcaaaactctggactcacaaaccagaacctttattgtgggcgcgcagatgaatgtgaaagagttcaaagagcacattgctgcctctgtcagcatcccctctgagaagcagcggctgatttaccagggtagggtcctccaagatgacaagaaactccaagaatacaatgtaggcgggaaggttatccatttggtggaacgtgccccgcctcagacacatctgccatccggcgcatcgagcggtactggaagcgcatcggccacacacgggggtggaagcccccccggcacacggggacctggggcttctgtccacgaccgaaatgctaactcgtacgtaatggttggcacattcaaccttcccagcgatggaagtgctgtcgatgtacatataaacatggagcaggcacccatacaatcagaacccagagtgagactggttatggcgcaacatatgatcagggacatccagacactcctgtccaggatggagtgccgtggcggaccacagccccaacattcccagcccccatag

SEQ ID NO: 180350 - DNA, 735 bp, Artificial Sequence
  Description of Artificial Sequence: Synthetic coding sequence
atggagcccaacgacagcaccagcaccgccgtggaggagcccgacagcctggaggtacttgttaagacactggactcccagaccagaaccttcatcgtgggagctcaaatgaacgtgaaagagttcaaagagcatattgccgcatccgtttccatcccatcagagaagcagagattgatttaccaaggccgggtgttgcaggatgataagaaactgcaggaatacaatgtcggtgggaaagtgattcacttagtggaacgcgctccacctcagactcacctgcccagtggcgcatcttcggggactggatcagccagtgccacacacggcggaggctccccacctggcacgcgcggtcccggcgccagtgtgcacgaccgaaacgctaacagttacgtgatggtcgggaccttcaacctccctagcgaaccccgcgtgcggctggtgatggctcagcatatgattagagacatccagacactgctgtcacgcatggaatgccggggtggtccccagcctcagcactctcagcctcccccccaaccgcctgcagtgacccctgagcccgttgcactgagctcccaaaccagcgaacccgttgaaagcgaagcaccccctcgggaacctatggaagctgaggaggttgaggaaagagcccccgcccagaatccggaactgacaccaggaccagcacccgccggtcctacccccgcccctgaaacaaacgcaccttag

SEQ ID NO: 180351 - DNA, 594 bp, Artificial Sequence
  Description of Artificial Sequence: Synthetic coding sequence
atggagcccaacgacagcaccagcaccgccgtggaggagcccgacagccttgaagtgctggttaaaaccctggactcacagactaggaccttcatcgtgggagctcagatgaacgtgaaggagtttaaggagcacattgccgccagcgtgagtataccatccgaaaaacagaggctgatttatcaaggccgcgtgctgcaggatgataagaagctgcaggagtacaatgtaggcggtaaggtcatccatcttgtcgagcgagcccccccccagacccacttaccgagcggagcctcatccggtaccggctccgcttccgccacgcatggcggcgggtctccacctgggactcgtggccctggggcgtcagtgcacgatagaaacgcaaattcctacgttatggtgggcacattcaacttacctagtgacggctctgctgttgacgtgcacatcaatatggagcaggcccctatccagtctgagccacgtgttcggctcgtgatggcacagcacatgattagggacatccaaacattgttgtcacgaatggaatgccgtggcggacctcagccgcagcattctcagccgccttag

SEQ ID NO: 180352 - DNA, 1548 bp, Artificial Sequence
  Description of Artificial Sequence: Synthetic coding sequence
atggagcccaacgacagcaccagcaccgccgtggaggagcccgactctctcgaagtactggtgaagactctcgattcacaaacccgcactttcatcgtgggcgcccagatgaacgttaaggagtttaaggaacatatcgcagcgagcgtgagcatcccctccgagaaacagagattgatatatcagggtagggtcctgcaggacgacaaaaagctccaagaatacaatgtcggagggaaggttatacacttggtggaaagggctcccccacagacccacctgccctctggagcctcaagtggcacaggatctgcttccgccacccatggcggtggctcacctcctggcacaagggggcctggagcttccgtccacgaccggaatgcaaattcttacgtgatggtgggcaccttcaatctcccatcagatggatctgcggtggacgtgcacatcaacatggagcaggctcctattcaaagcgaaccccgagttaggctggtaatggctcaacacatgatacgtgacatccagacattgctcagccggatggagtgcaggggagggcctcagcctcagcacagccagcccccaccccagcccccagctgtaacaccggagccggtggcgctgtcaagtcaaactagcgagccagtcgaatcagaagcaccaccgagggagcctatggaggccgaggaagtggaggagcgagctccagctcaaaatcccgagctgacacccggcccagcacccgccggtcctacccctgctcctgaaactaatgcgccaaatcatccatctcccgctgagtatgtagaagtcctgcaggagctacagcggcttgagagcaggttacagccttttctgcagcggtattatgaggtgctcggcgccgcagccacaaccgactacaacaacaaccacgaaggacgcgaggaggaccagaggctgataaatttggtgggagaaagtctcaggttgttaggaaacacctttgtggccctgagtgacctgcgctgtaacctggcatgtacaccacccaggcacctgcacgtagtccggcctatgagccactacacgactcctatggtgctgcagcaggccgccataccaattcagattaacgtgggcactaccgtgacgatgacaggaaatggcacgcggccaccccccacccccaacgcggaagccccgcctcctggaccgggccaggcaagcagcgttgccccaagctccacgaatgtcgagtcaagtgctgagggcgctcctccgcctggaccagcccccccgcccgctacatcacacccccgggtgataaggatttcacatcaatccgttgagccagtggtgatgatgcacatgaatatacaagattctggcacgcaaccgggaggcgtgccctcggctccaactggtcctctgggcccccctggtcatggccagactctcgggagcaccttgatacagctgccatcgttaccaccagaattcatgcacgcggtcgcccaccagataacacatcaggctatggtggctgccgtagcgtcctag

SEQ ID NO: 180353 - DNA, 735 bp, Artificial Sequence
  Description of Artificial Sequence: Synthetic coding sequence
atggagcccaacgacagcaccagcaccgccgtggaggagcccgactcactggaggtgctagttaagaccctagattcgcaaacacggacctttatcgtgggggcacagatgaacgtgaaggagtttaaggagcatattgccgcctcagtttctatcccatcagagaagcagcggctgatataccagggtagggtactgcaggacgacaagaaactgcaggaatataacgtgggcggcaaagtgatccaccttgtggaacgtgcccctccgcagacccacctgccctccggcgcctcgtccggcactggcagcgcctcggccacacacgggggcggttctccaccaggtacccggggcccaggcgctagtgttcacgataggaacgccaacagttatgtgatggttggcaccttcaacctaccttccgaaccccgagttcggcttgtgatggcccagcatatgattcgcgatattcagactcttcttagcaggatggaatgcagaggcggaccccagcctcagcactcacaacctccccctcaaccacctgcagtaacccctgaacccgtcgccctgagttcccagacatcagagccagtcgagtccgaagcccctccaagagaaccgatggaagccgaagaagtcgaggagcgagcccccgcccagaaccccgagcttacaccgggtccagctccagcgggccctacccctgcccccgagacaaacgcgccctag

SEQ ID NO: 180354 - DNA, 789 bp, Artificial Sequence
  Description of Artificial Sequence: Synthetic coding sequence
atggagcccaacgacagcaccagcaccgccgtggaggagcccgactccttagaggtgcttgtgaagacactggattcccagacccgcaccttcattgtgggtgcgcagatgaacgttaaggaattcaaggagcatattgctgcttcggtatctataccttccgagaagcagagattaatataccagggtagggtgcttcaggatgataaaaagctgcaagagtacaatgtcggagggaaagttattcaccttgttgaacgtgcccccccacagacacacttgccctccggggcctcctcaggaacaggatccgccagcgccacccatggcggtggctcccctcccgggaccagggggcctggtgcgtccgtccacgataggaacgccaacagctatgtgatggtaggtactttcaatttaccgtctgacgggtctgccgtggatgtgcatatcaatatggagcaagctccaatccagagtgaacctagggtgagattggtaatggctcagcacatgatcagggatatccagactctgctttcccgcatggaatgccggggcgggcctcagccccaacattctcaaccacctccccagccacctgccgttacaccggaacctgtggctctttcttctcagacgtctgagcccgtggagtcggaggctccgccacgagaacccatggaagcagaggaggtggaagagagggctcccgcccagaatccagaactgacccccggcccggccccagccggacccacgccggccccagagactaacgctccttag

SEQ ID NO: 180355 - DNA, 789 bp, Artificial Sequence
  Description of Artificial Sequence: Synthetic coding sequence
atggagcccaacgacagcaccagcaccgccgtggaggagcccgactcactggaagtgctggtcaaaacgctcgattcacagacccgcacattcatcgtgggcgcccaaatgaacgtgaaagaattcaaggaacacattgccgcttccgtgagtataccctccgagaagcaaaggctcatctaccaaggtcgggtcctgcaggatgataagaagctgcaggagtataatgtgggcggcaaggtgatacatctcgtggagagggctccaccccagacacatttgccttcaggcgcttctagtgggaccggttcagcatcagccacccacggaggtggatccccgccagggaccagaggacccggggctagtgtccatgaccggaatgcaaattcttacgttatggtggggacttttaatctgccatcagatgggtcagctgtggatgtgcacattaacatggagcaggcccctattcagtcggaacccagggtacggctggtcatggctcaacatatgatacgcgatattcagaccctgctgtcacggatggaatgtcgggggggaccgcagcctcaacactcccagcctccaccacagcccccagctgtcactccagagcctgtcgctctctctagtcagacatctgaacccgtggagtctgaggctccaccacgcgaacctatggaagccgaggaggtggaagaacgagcacccgctcaaaacccggaactgactcctggacccgcacctgctggacccacacccgcaccagagacaaatgcaccctag

SEQ ID NO: 180356 - DNA, 717 bp, Artificial Sequence
  Description of Artificial Sequence: Synthetic coding sequence
agcagcgccgagggcgcccccccccccggccccgcccccccccccgcaacaagtcacccgcgtgtgattcgtattagccaccagtccgtggagcctgtggtgatgatgcacatgaacattcagggcccactctccctcagtccctgtccggattcaggaacacagccgggaggagtcccctctgcccctaccggtcccttgggcccgcctgggcatggccaaactttggggcagcaggttccaggttttcccaccgctcctactcgtgtagtgatcgcgagacccaccccccctcaggctcggccatcccatccaggcggtccccccgtgtctggaacccttcagggggcgggattggggacaaatgcctctctggcacaaatggtcagcggcctagtggggcagctgctcatgcagcctgtgcttgtggcacagggtacccctggaatggccccaccacctgccccagccaccgctagcgccagtgcgggcactactaatacagctacaacggcaggcccagcccctggcggcccagcccagccaccccctacgccccaacccagcatggccgacttgcaattctcccagctgctgggaaacttgctggggccagctggacctggcgccggggggagcggagttgctagtccgaccatcactgttgcaatgccaggtgttccagcgtttctacaggggatgactgacttcctgtag

SEQ ID NO: 180357 - DNA, 735 bp, Artificial Sequence
  Description of Artificial Sequence: Synthetic coding sequence
atggagcccaacgacagcaccagcaccgccgtggaggagcccgactcattagaagtgctggtcaaaactctggactcccagactcggacctttatcgttggggcccagatgaacgttaaagaatttaaagagcacatcgccgcatcagtgtcaatcccatcagaaaaacaaaggctgatttaccagggccgcgtgctccaggacgacaagaagcttcaggagtataatgtcggagggaaggtgatacacttggtagaaagagcccctccccagacccatctgccatccggggcatcaagcgggactggaagcgccagtgcgacccatgggggaggttcaccacctggcacaagaggccccggcgcatcagttcacgaccggaatgctaactcttacgtgatggttgggaccttcaacctgccgtcagagccccgggtccggctggtgatggctcagcacatgatccgcgatattcagaccctgctatccagaatggaatgcaggggaggccctcaacctcaacatagccagcccccccctcaaccaccagccgttactccagagcccgtagctctgagctcccagacatccgagcctgtggagagtgaggcgcccccccgtgagccaatggaggccgaggaggttgaggagagagccccggcacagaatcccgaattgacccctgggccggctcccgccggccccactcctgctccggagactaacgccccgtag

SEQ ID NO: 180358 - DNA, 621 bp, Artificial Sequence
  Description of Artificial Sequence: Synthetic coding sequence
atggagcccaacgacagcaccagcaccgccgtggaggagcccgacagcctggaggttctggtaaaaacgctggacagccagacaagaacctttattgtgggagctcagatgaatgtcaaggagtttaaggaacatatagcagcctccgtctccataccaagtgaaaaacagcggctcatttatcaagggagggttctgcaggatgacaagaagttgcaggagtacaatgtaggggggaaagttatccaccttgtggagagggccccaccacagacgcacctgccaagcggggctagtagtggaacgggctccgcgtccgcaacacatggtgggggttctccgcccggcaccagaggaccgggagcttccgtgcacgacaggaacgccaactcttatgtgatggtcggaacctttaatttgccgagcgagcctcgcgtaaggctcgtgatggcgcaacatatgatccgtgatattcagacgctcctctccagaatggagtgcaggggaggtccacagccccagcacagtcagcctcctcctcagccacctgcagtgacccctgaacctgtcgcgttgagttcacagactagcgagccggtggagtccgaagcgcccccatag

SEQ ID NO: 180359 - DNA, 735 bp, Artificial Sequence
  Description of Artificial Sequence: Synthetic coding sequence
atggagcccaacgacagcaccagcaccgccgtggaggagcccgacagcttggaagtgttggtgaagaccctggactcacagacgaggactttcatcgttggcgcacagatgaatgttaaagagttcaaagaacacatcgcagcttcggtgagcatcccttctgagaagcagcgcctaatttaccaggggagagtgcttcaggacgataagaagctgcaggagtacaacgtaggaggaaaggtcattcacctggtagaacgtgcaccgccacaaacccaccttccaagtggagccagctctggcacaggcagcgcaagcgcaacacatggtggaggttctcctcctggaacccgagggcccggagctagcgttcacgaccgaaatgccaattcttacgttatggtgggaaccttcaatctgcctagcgagccccgggtccgtctcgttatggcacaacacatgattagggatatccagaccctgttgtcccggatggagtgcagaggtggcccccaaccccagcattcgcagccaccaccccagccaccagctgtgaccccggagcccgtggccctctctagccagactagcgaaccggtcgagtcagaggcacctcctagggaaccaatggaggctgaggaggttgaagaaagagcaccggcccagaacccagaattgactcctggtcccgctccggccggtccaacgcctgccccagagactaatgccccatag

SEQ ID NO: 180360 - DNA, 780 bp, Artificial Sequence
  Description of Artificial Sequence: Synthetic coding sequence
atggagcccaacgacagcaccagcaccgccgtggaggagcccgactcactggaagtcttggtaaagaccctcgacagccagacaaggacttttatcgtgggagcccagatgaatgttaaggagttcaaagaacacattgctgcctcggtctcaatcccctccgaaaagcagaggcttatttaccaaggccgggtcctccaggatgataaaaagcttcaggagtacaacgttggcgggaaggtcatccaccttgtagaacgagcgccaccccagacccacctgcctagcggggcgtccagcggaaccggaagcgcctccgccacacatggaggtgggagtccccctgggacccgcggaccaggggctagtgtgcatgatcgaaacgctaactcttacgtgatggtgggaacctttaacctgccaagcgacggcagtgcggtcgatgtgcacattaatatggaacaagccccaatccagtctgagccccgcgtgagactcgtgatggctcaacatatgatccgggatattcagacgcttctgtccaggatggagtgcagaggcggaccacagccccaacacagccagccacctcctcagcctccggccgtgacacctgagccggtcgccctgtcaagtcaaactagcgaacccgtggagtccgaggccccaccccgcgagcccatggaagcagaagaggtggaggagcgagcccccgcccaaaatcccgagctcacccccggcccggcacccgctggtcccacacctgcccccgaaacttag

SEQ ID NO: 180361 - DNA, 558 bp, Artificial Sequence
  Description of Artificial Sequence: Synthetic coding sequence
tgactggcctgcacccccccccggcacctgcacgtggtgcggcccatgtctcattataccactcctatggttctacaacaggccgccattcccattcagattaacgttgggaccaccgtgaccatgactgggaacggcactaggcctcctccaacaccgaatgctgaagctcctcctcccggacccgggcaagcaagtagtgtggctccctcatccactaatgtcgaatcatccgccgaaggtgcaccacctccgggtcccgcgccccctccagctacaagccatcccagggtgatccggattagccatcagagcgttgaaccagtagtgatgatgcacatgaacattcaggggcaacaggtcccaggctttcctaccgcccccacccgggttgtgatagctcggcccaccccacctcaagctcggccatcccatccgggcggccctcccgtgagcggtacactgcagggagcgggtctcggaacgaacgcctctctggctcaaatggtgagcgggcttgtcggacaactgctgatgcagcctgttcttgtagcttag

SEQ ID NO: 180362 - DNA, 621 bp, Artificial Sequence
  Description of Artificial Sequence: Synthetic coding sequence
atggagcccaacgacagcaccagcaccgccgtggaggagcccgactctttagaagtgctggtaaagacccttgactctcaaaccagaactttcatcgttggtgcccagatgaacgtcaaagaattcaaggaacacattgccgctagtgtttccatcccatcagagaaacagaggttaatttatcagggacgggtgctgcaagatgacaagaagctgcaggagtacaatgtgggagggaaagttatccatctcgttgaacgcgcacctcctcagacccatctgccaagtggggcttcctccggcactggcagcgcctccgccactcacgggggaggttctccaccaggtacacgcgggcctggagcctcagtccacgataggaatgcaaatagttatgtgatggtaggtactttcaatctgccatccgagccacgggtgcggctggttatggcccagcatatgattcgggatatccagacacttctttccaggatggagtgcaggggggggcctcagccacagcattctcaaccaccaccacagccccccgccgttaccccagaacctgtggcgttatcctcacagacctctgaacccgtggagtcagaagcacccccttag

SEQ ID NO: 180363 - DNA, 735 bp, Artificial Sequence
  Description of Artificial Sequence: Synthetic coding sequence
atggagcccaacgacagcaccagcaccgccgtggaggagcccgactctcttgaggttttggttaagacccttgactctcagacacgcacctttatagttggcgctcaaatgaacgttaaggaatttaaggagcacattgcggcttcagtatcaatcccaagcgagaagcagcggctgatttatcaaggacgagtacttcaggacgataaaaaactgcaggagtacaacgtgggaggcaaggtgatacacctagtcgagcgggctcccccacagacacatctccccagtggagcctccagtggtacaggcagcgcctctgccacccacggcgggggtagtcctccaggcactcgcggccccggggccagtgtccacgatcgcaatgcaaacagctatgtgatggtgggcacattcaatcttcccagcgaacctcgtgtcagactcgttatggcccagcatatgattcgcgacattcagaccctgctgagcaggatggagtgcaggggtgggcctcagcctcagcacagccagcccccgccacagcccccagcagttacccctgagcccgtggccctgagctctcagacctcagagcctgttgaatctgaggcgcctccgcgggaacctatggaggctgaggaagtggaagaacgcgccccggcccagaatcctgagttgactccaggacctgctcctgccgggcccacgcctgcccccgagacaaacgccccttag

SEQ ID NO: 180364 - DNA, 1548 bp, Artificial Sequence
  Description of Artificial Sequence: Synthetic coding sequence
atggagcccaacgacagcaccagcaccgccgtggaggagcccgacagcctggaagttctggtgaaaaccttggattctcagacccgtacatttattgtcggcgcacagatgaacgtcaaagaatttaaggaacacatagcggcatcagtgtcaatccctagcgagaagcagcggctgatttatcagggcagagtccttcaggacgacaaaaaactacaagagtataacgtcggcgggaaagtgatacatctggtggaacgcgccccacctcagacacatctccctagtggagcatcatccgggaccggtagtgcaagtgccacccacggcgggggttctcctccaggcaccagaggcccaggagcttccgtacatgaccgtaatgccaactcatatgttatggtgggcacctttaacctgccatctgatggttccgctgtggatgttcatatcaatatggagcaggccccaatacagagcgaaccaagagtgcgtcttgtgatggcgcagcacatgattcgtgacattcagaccctcctgtccaggatggagtgtcggggtggcccacaacctcagcattcccaaccaccaccacaacctccagccgtgacacctgagcccgttgcgctatccagtcagacatctgagcccgtggagagcgaagcacctccccgggagccaatggaggcggaagaagtggaagagcgggctccagcgcagaaccctgaactcacacccggccccgcccctgccggccccactccggccccagagaccaacgcacccaaccatccctccccagccgaatacgtggaggtcttgcaggagctacagcggttagagagcagactacagcctttcctgcagagatattatgaggtgttgggcgcagctgcgacaactgattacaacaacaaccacgaagggcgcgaagaggatcagcgcctgatcaacctggtgggtgagagcctcaggcttctaggtaatactttcgttgcattaagcgaccttagatgcaatctggcgtgtaccccgccccgacacctgcacgtggtgcggcctatgtcacattataccacgccaatggtcctgcagcaggcggcaatccctattcaaatcaatgttggaaccacggtgacgatgactggcaacggcaccagaccgccgcctacacccaacgccgaagccccccctccgggcccagggcaggcgtccagcgtggccccttcctcaacaaacgtggaatcgagcgctgaaggagccccaccgccaggaccagctccacctcccgccactagccaccctagggtgatccggatcagtcaccagagcgtcgaaccagtagttatgatgcatatgaatatacaggactctggtacacagcccggcggtgtgccctctgctccgacaggtcctctggggccccccggacatggccagacgcttggctctacgctgattcaacttccatcgcttcctccggaatttatgcatgcggtggcacaccagatcacccaccaggccatggtggctgcagtggccagctag

SEQ ID NO: 180365 - DNA, 717 bp, Artificial Sequence
  Description of Artificial Sequence: Synthetic coding sequence
agcagcgccgagggcgcccccccccccggccccgcccccccccccgccacttcccatccaagagttattaggatatctcaccaaagtgtcgagccagtggttatgatgcacatgaatatacaagggcccttgtctctcagcccatgtccagattctggaacacaaccaggcggtgtacctagcgcaccaaccgggcccctgggcccccctggacacggacagacgcttggtcagcaggtaccgggtttccccaccgcacccaccagggtggtgatagcacgtcctaccccacctcaggcccgaccaagtcacccgggaggaccgcctgtgtcagggacgctgcagggtgccggcctgggaacgaacgcttcattggcccaaatggtttcgggattggtgggccagttgcttatgcagcccgttctggtggcacagggaacccctggcatggcccccccacccgctccagccacagcaagtgcatcggctggaaccaccaatacagctactactgctggccccgcccctggaggcccagcccagccacctcccacaccgcaaccaagtatggccgatctgcaattttcacaactcctgggcaatctgctgggcccagccgggccgggagctggcggcccgggagtggcctcgccaaccattaccgtggccatgcccggggtaccggcatttctacagggtatgaccgatttcctatag

SEQ ID NO: 180366 - DNA, 648 bp, Artificial Sequence
  Description of Artificial Sequence: Synthetic coding sequence
atggagcccaacgacagcaccagcaccgccgtggaggagcccgactcgttagaagtcctcgtgaagacgctcgacagccagacccgcacctttattgttggagcacagatgaatgtgaaggagttcaaggagcacatagcggcaagcgtgagtataccatctgaaaagcagaggctgatctaccaagggcgggtcctccaggacgacaagaagctccaggagtataacgtcggcggtaaggtcatccacctggtggaacgggctcctcctcagacgcacctgccaagtggagcgtcaagtgggaccggttctgcctcagcgacgcatggtggcggttcacctccaggcacccgtggaccgggcgcgagcgtgcacgataggaacgctaattcctacgtgatggtaggcaccttcaacctgccatccgaacctagggtccgcctggtcatggcgcagcacatgatcagggatatccaaacattgctcagccgaatggaatgtaggggtggtccccagccacaacattcacagccaccaccacagccaccggctgtaacaccggagcccgtagcactgtcaagccagacctccgagccagtagagagcgaagcccctcctcgggaacctatggaggccgaagaggtttag

SEQ ID NO: 180367 - DNA, 477 bp, Artificial Sequence
  Description of Artificial Sequence: Synthetic coding sequence
atggagcccaacgacagcaccagcaccgccgtggaggagcccgacagcttggaagttctagtgaaaaccctggactctcaaacaaggacattcatcgtgggagctcaaatgaatgtcaaggaattcaaagaacacatcgcagcttctgtctcaattccctcagagaaacagagactgatctatcagggacgggttttgcaggatgataagaagctgcaggaatacaatgttggaggcaaagtgatccacctggtggagagagcaccaccacaaacccacctccccagtggcgcttcgtccggaactggctcagccagcgcaacacacggcggaggatcaccgcctggaactagggggccgggcgctagtgttcacgatagaaacgctaactcatacgtaatggtgggcacatttaatcttccgagcgacggatccgccgtggacgttcacatcaacatggagcaggcacctatatag

SEQ ID NO: 180368 - DNA, 702 bp, Artificial Sequence
  Description of Artificial Sequence: Synthetic coding sequence
atggagcccaacgacagcaccagcaccgccgtggaggagcccgactctctggaggtcctagtaaagacacttgacagccagacacggacattcattgtgggggcccaaatgaatgtcaaagagttcaaggaacacattgccgccagtgtctctataccaagcgaaaagcagcgcctcatttaccaaggacgggttctgcaggacgacaagaagctgcaagaatacaatgtgggagggaaagtgatacacctggtggagagagcgcccccacaaactcacctgccaagtggggcatcgagcgggacaggctctgcatcagccactcacggtggtggaagccctcccggaactagagggccgggagcgagcgtacacgataggaatgccaatagctatgtgatggtcggaactttcaacctaccttcagacggatctgcagttgatgtccatattaatatggagcaggccccaatccaatctgagcccagggtgcgccttgtcatggcccagcacatgatccgggatattcagactctgctgtccaggatggaaaccctgccttatctgcagtgtcggggcggccctcagccccaacactcccagccaccaccccaacccccggccgtgacaccagagcccgtggctcttagttcccagacaagcgaaccagtggagtctgaagctcctccaagagagccttag

SEQ ID NO: 180369 - DNA, 780 bp, Artificial Sequence
  Description of Artificial Sequence: Synthetic coding sequence
atggagcccaacgacagcaccagcaccgccgtggaggagcccgactccctggaggtacttgtgaagacacttgatagtcagaccagaacattcatcgtgggggcccagatgaatgttaaggaatttaaagagcacatagccgcctcggtctctatcccttcagaaaagcagaggctgatttatcagggacgagtgttgcaagacgataagaagctgcaggagtataacgtaggtgggaaggtgatacacctggtggaacgggcacccccacagacccatctgccctctggcgccagcagcggcacaggatccgcaagcgccacacacggcggcgggagcccacctggtacacgtggcccgggagcaagtgtacacgaccgcaacgctaattcgtatgtgatggtaggaacatttaacctgccaagcgacgggtctgccgtagacgtgcatataaatatggagcaggcccccatacaatctgagccccgggttcgcttggtgatggcacagcacatgatacgggatatacagacattattgtccaggatggagtgtcgtggtggcccccaaccgcagcactctcagccacccccacagccgcctgcagtgactcctgagccagtggctttgtcctcacagacgagcgaacctgtggaaagtgaggccccaccacgcgaacctatggaggccgaagaggtcgaggagagggctcccgcacagaacccggagctcacgcccgggccagcgccagctggacctaccccagctccagagacctag

SEQ ID NO: 180370 - DNA, 411 bp, Artificial Sequence
  Description of Artificial Sequence: Synthetic coding sequence
tgacggatgagccggggcgtgaaccccagcctggtgagctggctgaccaccatgatgggcctcagattacaggtcgttttggagcacatgcccgtgggtcctgatgcaattctgaggtatgttcgacgggtgggcgaccccccgcagccactccccgaggagcctatggaagtgcagggtgctgagcgcgcaagccccgaacctcaggagtgggtgccaatcatacagcaggacatccagagtcagcgtaaggtgaagcctcagccacccctcagcgacgcgtatctgtccgggatgccggccaagcggagaaagctgcgctcggacatccagaagcgcctgcaagaagatcctaactactccccccagcgcttcccgaatgctcagagggcatttgccgatgacccatag

SEQ ID NO: 180371 - DNA, 735 bp, Artificial Sequence
  Description of Artificial Sequence: Synthetic coding sequence
atggagcccaacgacagcaccagcaccgccgtggaggagcccgactccctcgaagtccttgtgaagactctggattcccagacacgaacttttatcgtgggcgcccagatgaacgtcaaggaatttaaggaacacatagcagcctccgtgtcaataccgtccgaaaaacagagactgatttatcaaggccgcgtcctgcaggatgataaaaaactacaggagtataatgttggaggaaaggtcatccacttagtggagcgcgcacctcctcagacgcacctgccttcaggggccagtagcgggacgggctccgcttctgctacacacggggggggatccccacctggcacccgaggtccaggcgcgtccgtgcacgacaggaatgctaacagttatgtcatggtaggaacgtttaatctgcccagcgaaccacgagtgcgacttgtgatggcccagcatatgatccgcgatatacaaacactgttaagccggatggaatgtcgggggggtcctcaaccacagcatagtcagcctccacctcaacccccggcggtgaccccagagcctgtcgctctgtctagccagacatctgaacctgtggaatccgaagccccccctcgagaaccgatggaggcggaagaggtggaagaacgcgcccccgcccaaaatcccgagcttacccccgggccagcccccgccgggcctacacctgcccccgagaccaacgcgccttag

SEQ ID NO: 180372 - DNA, 3381 bp, Artificial Sequence
  Description of Artificial Sequence: Synthetic coding sequence
atggagcccaacgacagcaccagcaccgccgtggaggagcccgactccttagaggtgctggtgaagaccctggacagccagacgcggacgttcattgtgggagcacaaatgaacgtgaaggagtttaaagaacatattgctgcatcggtttctataccgagtgagaagcaacggctgatctaccaggggcgagtgctgcaagacgacaaaaaactgcaggagtacaatgtaggaggcaaggtgatacatctggtggaacgggccccccctcaaacgcatctgccgagcggcgcatccagcgggaccggctctgcctcggctacacacggcggtgggagccccccggggaccagggggccaggagccagcgttcatgataggaacgcgaattcgtacgttatggttggtacattcaatctaccttccgatggttcagctgtagatgtgcacattaacatggagcaggctccaatccaatctgaaccgagggtacggctggtgatggcacaacacatgattagggacatccaaaccctcctgtcaagaatggagtgcagaggagggccacaaccacaacatagccagccgccgccccagccccctgccgtaacacccgaaccagtcgctctgtcttcacagacctcagagccagttgagtccgaggctccccctagagaacctatggaggccgaagaggtcgaggagcgggcgcctgcgcaaaatcctgaactaacacctggccccgcccctgccggccccacacccgcacctgaaaccaatgcccctaaccatccctcccctgcagagtatgtggaggtccttcaggagctgcagcgactagaatctcgcctgcagccctttctgcagaggtactacgaagtgctgggcgctgcggctacaaccgattataacaacaatcacgagggacgggaggaggatcaacgcttgatcaaccttgttggggagtctctccggctcttgggaaatactttcgtggccttatccgacctcaggtgcaacctggcttgcacccccccccggcatctgcatgtggtgcgtccgatgtcacactatactacaccaatggtgcttcaacaagcagccatccctatccagatcaatgtgggcaccacagtcacaatgaccggcaacgggacaaggcctcctcccacgcccaacgctgaagctcctccccccggaccaggccaggcctctagcgtggctcctagctccaccaatgttgagtcatccgccgagggggccccccctcctggcccggccccaccccctgccacttcgcaccctagggtaatccgcataagtcaccagagtgttgaaccagtggtgatgatgcatatgaacatccaagattctggcacacagccaggtggggtaccctcagctccaactgggccactcggaccacctggacatggccagaccttggggcaacaggtgcctggctttcccaccgctcccactcgtgtcgtgatagccagacccacacctcctcaggctcgacctagccatcctggaggcccaccagttagcggcaccctgcagggtgcagggctgggcacaaacgcctccctggcccagatggtgtcaggcctcgtcggacaactgttgatgcagcccgtgttagtggctcaggggacaccaggtatggctcccccaccagctccggccactgcttcagcgtccgccggcacaaccaacaccgccacaacagcgggccccgcaccagggggacctgcccagcctcccccaacccctcagccatccatggcagatctgcagtttagtcagctcttaggaaatctactgggccctgcggggcccggcgctggcggtccgggggtggcctcgccaaccatcacagttgcaatgcccggggtaccagcattcctgcagggcatgacagacttcctccaagctacccaaacagccccaccccccccaccgcctccaccgccgccgccccccgcaccagagcagcagactatgcctcctccggggagcccaagtggaggcgcagggagcccaggggggctggggcttgagtccctctcacccgaattctttactagcgtggtgcagggagtactctcctccctgctcggctccctgggagcccgtgccgggagctcagaaagcattgccgcatttatccaaagactatctggcagcagcaacatttttgagcccggagcagatggcgccttgggattctttggagccctccttagcctcttgtgccagaatttctctatggtggacgtcgtgatgctgcttcacggccatttccaaccacttcagcgtctgcagccacagcttcgttcattttttcaccagcactacctaggtggtcaggagcccacccctagcaacatcaggatggctacccatacactcatcacggggctcgaggagtatgtgagagaatcctttagcttggtacaagttcagcctggcgttgacattattagaaccaatttagagttcttgcaagaacagttcaactctattgcggctcacgtccttcactgtaccgacagtgggttcggcgcccggcttctcgagctgtgtaaccaggggctcttcgaatgtctggcattaaatctccactgcttgggaggtcagcaaatggaactggcagcagtaattaatggccgtataagaagaatgtcaaggggggtgaacccctctttggtcagttggctgaccacaatgatgggcttgcgtctgcaggtggtattggaacatatgcctgttgggcccgacgccatattacgatacgtgagaagagtgggggatcccccgcagcctctgccagaggaacccatggaggttcagggcgcagaacgggcaagccccgaaccacagagggagaatgcctctcctgcaccaggcaccaccgctgaagaagcgatgtcaagagggcctcctcccgcaccagagggagggtccagagacgagcaggacggtgcttctgcagaaactgagccatgggccgccgctgtgccaccggaatgggtgcccatcatccaacaagatatccagtcacaacgcaaggttaaaccccagccccctctttctgacgcctatttaagcggcatgcctgccaaaaggcgcaaaacaatgcagggtgagggaccccaactgctgctctccgaggctgtcagtcgcgccgccaaagcagccggagcccgcccgttgacatctccagagtctctgtcaagggatctcgaggcccccgaagttcaagagagctacagacagcagctgcggtccgacatacagaaaagactgcaggaagatccgaattacagcccacagcgcttccccaacgctcagcgtgcgttcgcagatgacccttag

SEQ ID NO: 180373 - DNA, 411 bp, Artificial Sequence
  Description of Artificial Sequence: Synthetic coding sequence
tgacggatgagccggggcgtgaaccccagcctggtgagctggctgacaaccatgatgggcctgaggttgcaagtggtcttagagcacatgcccgttggtcctgatgcgattctgaggtacgtgagaagagtgggagacccgccccagccacttcccgaagaacctatggaggtgcagggcgcagagagagcatctccggaaccccaggaatgggtcccaattatccagcaggatatccagtcacagagaaaggtgaaaccccagcctcctctgagtgacgcgtatctcagcgggatgccagccaagcgtcggaaattgcgcagcgacattcagaaacgcctgcaggaagatccgaattatagtcctcaacgattcccaaacgcacaacgggcattcgccgacgatccctag

SEQ ID NO: 180374 - DNA, 648 bp, Artificial Sequence
  Description of Artificial Sequence: Synthetic coding sequence
atggagcccaacgacagcaccagcaccgccgtggaggagcccgacagtctggaggtgctggtgaagaccctcgactctcagacgcgcacatttatcgtgggggcgcagatgaacgtgaaggaatttaaggaacatatcgctgcgtctgtgagcataccaagtgaaaagcagaggctcatttatcagggccgtgtgctgcaggacgacaaaaagcttcaggaatataacgtcggtggtaaggtcattcatttagtggagcgtgccccgccacagactcacctgccaagcggtgcgagcagcggtactggtagcgcgtccgcaactcatggaggagggtctcctcccggcaccagaggcccgggggcatctgtccacgatcgcaatgcgaacagctatgtcatggtaggtacttttaacctgccaagtgaacctagagttcgtctcgttatggctcaacacatgatccgagacatacaaaccctgctgtctcgaatggagtgccgcggaggcccccagcctcagcattcccagccaccccctcagcccccagccgtcacccccgagcccgtcgctttaagcagccagacaagcgagccagtggagtctgaggctcccccacgcgaacctatggaggctgaggaagtgtag

SEQ ID NO: 180375 - DNA, 594 bp, Artificial Sequence
  Description of Artificial Sequence: Synthetic coding sequence
atggagcccaacgacagcaccagcaccgccgtggaggagcccgactcacttgaggtgttggttaaaactctggattcacagacgagaactttcattgtgggtgcccagatgaacgtgaaggagtttaaggaacacatagccgcctcagtatctatcccgagtgaaaagcaacggctcatttaccagggcagagtgctgcaggatgataagaaacttcaggaatataacgtagggggaaaggtgatccatctcgttgagagggcgcccccacagacccacttgccctctggtgcatcttccggaaccgggagtgcaagtgccacacatggtggcgggtctcctcccgggactcggggtcctggcgcatcagtgcacgaccgaaacgcaaacagttacgtgatggtagggacctttaacctcccttccgacggcagtgccgttgatgtccacatcaacatggagcaggcccccatccagagtgagcctcgtgtgaggcttgtgatggctcagcacatgattcgagacatacaaacactactgtctcgcatggagtgcagagggggtccacagccccagcatagtcagcctccctag

SEQ ID NO: 180376 - DNA, 1548 bp, Artificial Sequence
  Description of Artificial Sequence: Synthetic coding sequence
atggagcccaacgacagcaccagcaccgccgtggaggagcccgacagtctggaggtgctcgtaaagaccctcgactcacagacccgaacctttatcgtgggagcccagatgaacgtaaaagagtttaaggagcacatcgctgcaagtgtctctattcctagcgagaaacagcggctgatatatcagggtcgcgtgctacaagatgacaagaagcttcaggaatacaatgttggaggtaaggtcattcatctggtggagcgtgcaccacctcagacccacctgccatctggtgctagtagtggtacaggcagcgcgtccgccactcacggagggggctccccacccggtaccagaggcccgggcgccagcgtccacgacaggaacgccaacagctacgtcatggtcgggacttttaatctgccctctgatggttcagccgttgatgtacacattaacatggaacaggccccaatacagtcagagccaagggtgaggctcgttatggctcagcacatgatcagagacattcagactttgctcagcagaatggaatgcagaggtggcccgcaaccacagcatagccagcctcctcctcagccacctgccgtcacccccgaacccgtcgcactttccagccagaccagtgagcccgttgaaagtgaggccccgccccgggagccaatggaagccgaggaagtggaggagcgcgctcctgcccagaatcctgaactgacaccaggacctgctccggccggaccgactccggcccccgagacaaatgcccccaatcatccttcgcccgcagaatatgtcgaggtactacaggagctgcaacgcctggaatcaaggcttcagccatttctgcagcggtactatgaagttttgggtgcagctgctacaacagattataacaataatcacgaaggcagagaggaagatcagagactgatcaacttggtaggtgaatctttgcggttgctgggaaacacatttgtggcactgtctgacctgcgctgtaatctggcatgcacaccacctaggcatctgcacgtagtcagacccatgtctcactacacaactcctatggtgttgcaacaggcggcgattcccattcaaataaatgttgggactaccgtaacgatgacaggaaacggcacccggccgccacccacccctaacgccgaggctccgccaccgggaccaggacaggccagctcagttgccccaagctcaacaaacgtcgaatccagtgcagaaggcgccccaccacctgggccggcgcctccgccggctacatcacatcctcgggtgatcagaattagccatcaaagcgttgaaccagtggtgatgatgcacatgaacatccaagacagcgggacccagccgggtggggtgccttcagcccccaccggacctttagggccccctggacacgggcagactttgggcagcacactgattcagttaccctctctccctcctgagttcatgcacgcagtcgcccaccagattacgcatcaggccatggtggcagctgtggccagttag

SEQ ID NO: 180377 - DNA, 738 bp, Artificial Sequence
  Description of Artificial Sequence: Synthetic coding sequence
cccccccggcacctgcacgtggtgcggcccatgagccactacaccactcccatggttttacagcaagcagccattccgatccagatcaacgtaggcacaactgtgactatgaccgggccagcaccaccacccgccacgagtcacccacgggtcatccgaatcagccatcagagtgtcgagccggtggtgatgatgcacatgaatatccaggacagtgggacccaacctggcggggtgccaagcgcccctacgggcccgttgggccctcccgggcacggccaaacgttgggtcagcaggtgcccggctttccgactgcccccactcgagtggttattgcccgaccaacaccgccccaggccaggccctctcatccgggagggcccccagtgagtggaaccctgcagggtgccggactgggtaccaacgcctccttagctcagatggtgagtggtctcgtggggcagttgcttatgcaacccgtgttagtggctcagggaacaccagggatggctcctccacccgcccccgctaccgcctctgcgagcgctggtaccacaaataccgccacaaccgcaggcccagcgccagggggacctgcccagcctccccctaccccccagccttctatggctgacctgcagttttcacagctattaggtaatcttcttggccctgccggcccaggagctggagggccgggcgtcgccagtcccaccatcactgtcgccatgccctag

SEQ ID NO: 180378 - DNA, 738 bp, Artificial Sequence
  Description of Artificial Sequence: Synthetic coding sequence
cccccccggcacctgcacgtggtgcggcccatgagccactacaccacaccaatggtgttgcagcaggccgcaatccccatccagattaacgtagggacgacagtcaccatgaccggccctgctcctccacccgctacctcgcatcccagggtgatcagaatttcacaccaatccgtggaaccggtcgtgatgatgcatatgaacatccaggactccggaacacaacccggcggggttcctagcgcaccgaccggaccattggggccgcctggacatggccagaccctcggccagcaggtccctggcttcccaacagctccaacccgtgtggttattgccagaccaacccctccacaggctcggccaagtcacccaggaggaccccccgtgtccggcaccctccagggggctgggctgggaaccaatgcttcccttgctcagatggtaagcggactggtgggccagttactgatgcagccggtgctggtggcacaaggtacgcctggtatggctccaccccccgctcctgctacagcctccgcctcggcgggcactactaataccgcgacaactgccggaccggctcccggaggcccggcgcagcctcctcccacaccacagccatcaatggccgacctccagttttcccagctgctggggaatctgctggggcctgcaggccctggggcaggaggcagcggggtagcctcaccgaccattaccgtagccatgccatag

SEQ ID NO: 180379 - DNA, 777 bp, Artificial Sequence
  Description of Artificial Sequence: Synthetic coding sequence
atggagcccaacgacagcaccagcaccgccgtggaggagcccgacagtctcgaggtgttggtcaaaacattagattcccagacccgaacatttattgtgggagcccaaatgaacgtgaaagaattcaaggaacacatcgctgcaagtgtctcaatacccagtgagaagcagcgccttatctaccagggtcgggtccttcaggatgataagaagctgcaggagtacaacgtgggaggaaaagtcatccatctggtggagcgtgcaccgcctcagacacatctgccttccggcgctagctcagggaccggcagtgcttctgctacacatggtggcggctcgcctcctggaacaaggggacccggcgccagcgtccatgacagaaacgctaattcttatgttatggtcgggacattcaatctcccaagcgacggtagcgccgtggacgttcacattaatatggagcaggctcccatccagtctgagccaagggtgcggctagtgatggcccagcacatgataagagatatccagacgctgctttctcgcatggagtgtagaggagggccacaacctcaacattcacaacctcctccccaaccccccgcagtcactcctgagcccgtagcgctcagtagccagacctcagagccggtggaatcagaagcccctccaagggaaccgatggaggcagaggaggtggaagagcgcgcacccgcccagaacccagaactgacgcccggccccgccccggccggccctacacccgctcccgaatag

SEQ ID NO: 180380 - DNA, 789 bp, Artificial Sequence
  Description of Artificial Sequence: Synthetic coding sequence
atggagcccaacgacagcaccagcaccgccgtggaggagcccgacagcctggaggtgttggtgaagacattagattcacagacaagaactttcatcgtgggggcccagatgaatgtgaaggaattcaaggagcacattgccgcttctgtgtccattccatcggagaaacagagattgatttaccaaggccgcgtgttgcaggacgataaaaaattacaggagtacaacgtgggcgggaaagttatccacctcgtggagagagcccctcctcaaactcaccttccaagtggggccagcagcggcaccggctccgctagcgccacacatgggggcgggagccctcctgggactcgcggcccaggcgcaagcgtccatgacaggaatgcaaattcttacgtaatggtggggacattcaatctgcctagcgatggttcagccgtcgatgtgcatatcaacatggagcaggcgccaattcagagcgaaccccgtgtcaggctggtaatggcccagcatatgattagggacatacagaccctgttgagcaggatggaatgtaggggcgggccccagccacagcattcccagccccctcctcagcccccagcggttactcctgaacctgtggccctgtctagccagacctctgagcctgtagagtccgaggcaccgcctcgcgaacctatggaagccgaggaagtggaggagcgggcgcctgcgcagaacccagaactcacgcctgggcctgcccctgcagggcctactccggccccagaaacaaacgctccttag

SEQ ID NO: 180381 - DNA, 2232 bp, Artificial Sequence
  Description of Artificial Sequence: Synthetic coding sequence
atggagcccaacgacagcaccagcaccgccgtggaggagcccgactctctggaagtactcgtcaagactttggacagccagaccagaacctttatcgtgggagctcagatgaatgtcaaggaattcaaagaacatatcgccgcgtccgtgagcattccatccgagaaacagagacttatttatcaggggagagtgcttcaggacgataaaaagcttcaagaatacaacgttggcgggaaggtgatacacctcgtcgaaagggcaccacctcagacacatctgccaagtggagcctcttcaggaacgggctcagcaagcgctacccacggtggaggatcgccccccggtacccgtggtccaggggcctccgttcatgatagaaatgctaattcatacgtgatggtgggcaccttcaatctcccttccgatgggtctgcggtggacgtccatatcaatatggagcaagccccgattcagagcgagccccgggtgcgcttggtgatggcccagcacatgatccgagatatccagaccctgctgagccgaatggagtgcagaggcggcccccagcctcagcacagccagcctcctccacagccgcccgcagtcacccccgagcccgtagctctgtcttcccaaaccagtgagcctgttgaatccgaggcaccccctagggaacctatggaagctgaagaggtcgaggaacgggcccccgcacaaaacccggaacttactcctggccctgccccagccggtccaaccccagctccagagacaaatgctcctaatcatccatcaccggctgaatacgtggaggttctgcaagagcttcaaagactggaatctcgcctacagccttttctccaaaggtactacgaagtgctcggagccgcagcgaccactgattacaacaacaatcatgaagggcgcgaagaggaccagagactgattaaccttgtcggagaatcactgcgcctactcggcaatacatttgtagccctgagtgaccttcgctgcaacctggcatgtacaccccctagacacctgcacgttgtgcggccgatgagccattatacaacccctatggtgctccagcaggccgccattccaatccagataaatgtcgggacaacggtgactatgactggcaatggaacgcgacctcctcctactcccaatgccgaagctccaccgcccggccccgggcaggcctcaagcgtggccccttcaagcacaaacgttgagagcagcgctgaaggggcccccccaccagggcccgcaccacctccagctacaagtcacccaagagtgattcggatatcacaccagtcggtcgagcccgtcgtaatgatgcatatgaacattcaagactccggtacccagccaggaggggtcccgagtgcgccaacaggccccctaggcccgccggggcatggccagacactcggttcaaccctcattcagttgccgtcgctccctcccgagttcatgcacgccgtggcgcaccagatcactcaccaggcaatggtggctgctgttgctagcgccgcggccggtcaacaggtccccgggtttcccactgcccccacacgggtcgttattgctaggcctacccccccacaagctcgtccgtcccatcccggaggaccgccagtctccgggacattgcagggagccgggctgggcaccaatgcgtctctagcgcaaatggtgtccggtctggtggggcagctgctgatgcaaccagtgttggtggcccagggcactcctggtatggctcctccccctgcccctgccaccgcttccgcatccgcgggaaccacaaatactgcaacaaccgctggacctgctccaggcggccccgcccagccaccacctactccgcagcccagcatggccgacctccagttctcacagctgcttggaaatctgttaggccccgctggtcctggagctggtgggtcaggtgtggcctcacccactatcaccgtagccatgcctggggtgcccgcattcctgcaagggatgaccgactttttgcaagcaacccaaactgctccccccccccctccacccccccctccgccgccccccgcccccgaacagcagaccatgccccctccaggtagcccgtctggcggtgcagggtctccgggcgggctggggctggaaagcctgtcaccagagttctttactagtgtggtgcaaggagtcctgtccagtctgctttag

SEQ ID NO: 180382 - DNA, 777 bp, Artificial Sequence
  Description of Artificial Sequence: Synthetic coding sequence
atggagcccaacgacagcaccagcaccgccgtggaggagcccgacagcctggaggtgctggtgaagaccctcgactctcagacaagaacttttatcgtgggcgcacagatgaatgtcaaggagtttaaggaacatatcgcggccagcgtgtctatcccctctgagaaacagagactgatttaccaaggcagggtgttgcaagatgataagaaactgcaggaatacaacgtgggaggtaaagttatacacttggtggagagggcaccaccccagacccacctgccctccggagcaagttctgggaccgggtcggcaagcgcgactcacggtggtggctccccacctggaactaggggacccggcgcctctgttcacgacagaaatgccaactcatacgtaatggtgggcacctttaatctgcccagcgatggttctgccgttgatgtccacattaatatggagcaagccccaatccagagcgagccaagggtgcggctggttatggcacagcacatgatcagggacatccagacactcctttcccgcatggagtgtcgcggaggtccccaaccgcagcacagtcagcctcccccacagccgccagctgtgacaccggagccggtagccctgagctcccagacgagtgagccagttgagtctgaggcgcccccccgcgaacctatggaggccgaagaggtggaggaacgcgctccggcacagaaccctgagttgacccctgggccagcccctgctggcccaacacccgcccctgagtag

SEQ ID NO: 180383 - DNA, 558 bp, Artificial Sequence
  Description of Artificial Sequence: Synthetic coding sequence
tgactggcctgcacccccccccggcacctgcacgtggtgcggcccatgtcccactataccaccccgatggttctgcagcaggcagctatccctattcagatcaatgtcggtactacagtgactatgaccggcaatggaacacgacccccgccgacgccaaatgccgaggccccacccccgggacccggacaggccagcagcgtagcccctagctcaactaacgttgaaagctctgcagagggcgccccgcccccgggccctgcccctccaccagccacctctcatcctagggtgatcaggatctctcaccagtctgtggagcccgtggtgatgatgcacatgaatatccagggccagcaggtccccggcttcccaaccgccccaacccgggtcgtcatcgcacgacctacccccccccaggcccggccatcgcaccccggggggccccccgtctcaggtactctgcagggggcaggacttggtaccaacgcgtctctggctcagatggtttcagggttagtggggcagctgctgatgcagcccgtacttgtagcttag

SEQ ID NO: 180384 - DNA, 648 bp, Artificial Sequence
  Description of Artificial Sequence: Synthetic coding sequence
atggagcccaacgacagcaccagcaccgccgtggaggagcccgacagcttggaggtcctggtcaagaccctcgacagccagaccaggacttttatcgtgggtgcccagatgaacgtgaaggaatttaaggagcatatcgccgctagcgtgtcaataccaagcgagaagcagcggctaatttatcaaggaagggtgctccaagacgataaaaagctccaggaatataacgtcggcggaaaagtcatacacttggtcgagcgcgcccctccccagacacacctcccctcaggcgcatcatcaggaacaggctcagcgtcagccacacacggtggcggctctccccctggaacacgaggccctggcgcctctgtccatgacagaaacgctaactcttatgtgatggtgggaaccttcaatctaccttcagaaccccgggtgagactagttatggcccaacatatgatcagagacatccaaaccttactgagtcgaatggagtgtaggggcggaccccagccacagcattctcagccccctcctcagccgccggctgtgacccctgagcctgtcgcactcagcagtcagacgtctgaacccgtcgaaagcgaggccccacctcgagagccgatggaggcggaggaagtgtag

SEQ ID NO: 180385 - DNA, 780 bp, Artificial Sequence
  Description of Artificial Sequence: Synthetic coding sequence
atggagcccaacgacagcaccagcaccgccgtggaggagcccgactctctggaggttctcgtgaaaaccctggacagccagactaggactttcattgtcggggctcaaatgaacgttaaagaatttaaagaacacattgcggcttccgtgagcattccatctgagaagcagaggttaatttatcagggacgggtgctacaggatgataagaagctgcaagagtacaacgtgggcgggaaggtgattcatctcgtggaacgcgctcccccccagacacatttaccctccggtgcctctagcggcactggatcagcctcagccacccatggagggggttcacctcccggaacgcgaggtcccggcgcaagcgtgcatgaccgtaacgcaaactcctacgttatggtcgggactttcaatctgccatccgacgggtccgccgtcgatgtgcacatcaacatggaacaggccccaatccagtccgagccacgggttcgcttggtcatggctcagcacatgataagggatattcagaccctgttgagccgaatggagtgcaggggggggccacagccccagcactcccagccaccacctcagccgcctgcggtgaccccagagcctgtggctctctcaagtcaaacctctgaaccggtcgagtcagaagcgcctcctcgcgagcccatggaagctgaggaggtcgaagagagagccccagcccagaatccggaattaaccccagggcctgcacccgcgggacccacccccgctcccgagacgtag

SEQ ID NO: 180386 - DNA, 477 bp, Artificial Sequence
  Description of Artificial Sequence: Synthetic coding sequence
atggagcccaacgacagcaccagcaccgccgtggaggagcccgactccctggaggtgttggtcaagactctcgattctcaaactcggacatttatcgttggcgcccagatgaatgtaaaagaattcaaagaacacatcgcagcctccgttagcataccttccgaaaaacagaggttgatataccagggaagggtcttgcaggatgataagaagttacaggagtataatgtgggcggtaaagtgatccacctggtggagcgcgcacccccccagacacatctgcccagcggcgcaagcagcggaactggttcagctagcgcgacccatgggggtggttcccctccgggaactcggggtcctggggccagcgtccacgatcgcaacgcaaatagctacgtgatggtcggaacctttaacctgccgagtgacgggtctgcggttgatgtgcacataaacatggaacaggccccaatctag

SEQ ID NO: 180387 - DNA, 621 bp, Artificial Sequence
  Description of Artificial Sequence: Synthetic coding sequence
atggagcccaacgacagcaccagcaccgccgtggaggagcccgactccctggaggttttggtgaagaccctcgactcccagacccgtacctttatcgtcggagctcaaatgaacgtgaaggaatttaaggagcacatcgcagctagcgtgtctataccttccgaaaaacagcggctaatttaccagggcagagtattgcaagacgataaaaagttgcaggagtacaacgtaggagggaaggtgatacaccttgttgaacgggcaccacctcagacgcatctcccctccggcgctagctctggcacaggtagtgccagcgccactcatgggggcgggagtccacctggcactcgtggcccaggcgcttctgttcatgacagaaatgcaaattcttacgtcatggttggaaccttcaatctgcctagcgagccgagggtgaggctggtgatggcgcagcacatgatcagggatatccagacattactctctagaatggagtgcagagggggaccacaacctcaacatagccagcccccccctcagccgcccgcggtgactcccgagccggtggcactgagttcacaaacaagtgagcccgtggaatcagaagcccctccttag

SEQ ID NO: 180388 - DNA, 2232 bp, Artificial Sequence
  Description of Artificial Sequence: Synthetic coding sequence
atggagcccaacgacagcaccagcaccgccgtggaggagcccgactcactggaggtgctggtgaaaactctggactcacaaacacgaacttttattgtgggggcacagatgaacgtgaaagaatttaaggaacatatcgccgcatctgtcagtattcccagtgagaaacagcggctcatctatcagggaagggtcctgcaagatgacaaaaagcttcaagagtacaatgtcggtggcaaagtgatccatctggtagagcgcgctcctcctcagacccacctgccttccggggcgagctcagggactggttccgcaagcgccacacacggtggtggcagccctcctggcaccaggggtcctggagcaagtgtgcacgaccgtaacgccaattcttacgtcatggtgggtactttcaatttgccttccgatgggagcgccgtagacgtccacatcaacatggaacaggcccctattcaaagtgagccccgcgtccgcctcgtcatggcccagcatatgatcagagatatccagactcttctatcgaggatggagtgtaggggaggaccacagccccagcactcacagcctccgccacagccacccgccgtgactccggagcctgttgctctgagttcacagacatctgagcctgtggaaagtgaggctcctccccgggagccaatggaggctgaggaggttgaggaaagggcccccgcccaaaatccagaactcaccccaggaccagccccggctggcccgacccccgcgcctgagaccaacgcccccaaccacccatcacccgctgaatacgtggaggtgttgcaagaactacaacgattggaaagcaggctacagccatttctgcaacgctactacgaggtcttaggcgccgccgcaacaaccgactataataacaaccacgagggcagggaggaggatcagcgtctcatcaacttagttggtgaatctctgcgcctgctggggaacactttcgtcgcattatctgaccttaggtgcaacttggcttgcaccccacctcggcatctccacgtggtaagacccatgtcacactatacaacacccatggtgctgcagcaagccgccattccgattcaaattaacgtgggaacaactgtgaccatgacaggaaacgggacccggccccccccaacccctaacgccgaagcacctcccccaggccctggtcaagcctcttcggtggcccccagttccactaacgtagagagctctgccgaaggcgctccgccgccggggcccgctccgcctccagctacaagtcaccccagggtgattaggatctctcaccagtctgttgagcccgtagtaatgatgcacatgaatattcaagatagtggaacacaacctggcggggtccctagcgccccaaccggcccgctgggacccccgggccatggtcagaccctgggaagcacactgattcagttgccttctttgccacctgagttcatgcacgctgtggctcaccagattacccatcaggccatggtggccgcagtggcctcagccgccgctggccaacaggtgcccgggtttccaactgcacccaccagggtcgtcatcgctcgaccaacccctccccaggcccgcccttcccatcctggcggaccccctgtgagcggtactctccagggtgccggcctggggaccaacgccagtctcgcccagatggtttcaggccttgttggacagctgctgatgcaacctgtcctcgtggcccagggtacccctggaatggctcccccccctgcccccgcgacggcctctgcctcggcaggtactaccaatactgccactactgccggccccgctccgggaggaccagcgcagcctcctcccacaccccagccttcgatggcagacctgcagttttctcagcttctgggcaacctcctgggacccgccggtcccggcgccggtggaagcggcgttgcgagtcctacaataactgtcgcaatgccaggcgtgccagccttcttgcaggggatgactgacttcctgcaggccacacagaccgctcccccccccccaccacctccacctcccccacctccagccccagagcagcagactatgccaccacccggatctccctccggaggggcagggtctcccggcggactgggattggagagcctgtctcccgagttctttacctcggtggtgcaaggcgtgttgtcaagtctgctgtag

SEQ ID NO: 180389 - DNA, 681 bp, Artificial Sequence
  Description of Artificial Sequence: Synthetic coding sequence
tgaagcggcttcggcgcccggctgctggagctgtgcaaccagggcctctttgagtgtcttgccctgaacctacattgcctgggtgggcagcagatggagctcgcagctgtcatcaatggccggatacgccgcatgtctaggggagtcaacccatcccttgtgtcttggctgacaactatgatgggattacgcctccaggttgtgctcgaacatatgccagtcggacctgacgcaatcttgcggtacgtgaggcgcgttggggatccaccccagccactccctgaagagccgatggaggttcagggagctgaacgagctagtccagaaccccagcgcgaaaatgcctcaccggcacccgggaccaccgccgaagaggcgatgtctcggggtccacctcccgccccagagggcgggtccagggatgagcaagatggggccagcgcggagacggaaccgtgggctgccgctgttccacccgagtgggtacccatcattcagcaggatatacaaagccagagaaaggttaagccccagccccctctgtcagatgcttaccttagcggtatgcccgctaagcgccgtaagttgcgaagtgacatccagaagcgcctccaggaggacccaaattattcaccgcagcgtttccccaacgcccagcgggcttttgctgacgacccgtag

SEQ ID NO: 180390 - DNA, 594 bp, Artificial Sequence
  Description of Artificial Sequence: Synthetic coding sequence
atggagcccaacgacagcaccagcaccgccgtggaggagcccgactcccttgaggtgttggtgaagacactcgacagccaaacacgcactttcattgtgggagctcagatgaacgtcaaggagtttaaagaacatatcgcagcttctgtgtccatcccgtcagaaaaacaaagactgatttatcagggtagggttttgcaggacgacaagaaactgcaagaatacaacgtcgggggaaaggtgattcacttggtggagagggcacccccccaaactcacctccccagtggagcaagctcaggaacgggctccgctagtgctacacacggcggcggctctccaccaggcactagggggcctggcgcctcggtgcatgaccgaaatgcaaattcctatgttatggttggcacattcaatctcccctccgatggttcagccgtggatgttcacattaacatggagcaggcccctatccagtctgaacccagagtccgtttagtgatggctcagcatatgattcgggatattcagaccctgctttccagaatggagtgcaggggcggcccccaacctcagcattctcaaccaccctag

SEQ ID NO: 180391 - DNA, 717 bp, Artificial Sequence
  Description of Artificial Sequence: Synthetic coding sequence
agcagcgccgagggcgcccccccccccggccccgcccccccccccgctactagtcacccccgcgtaattaggattagccatcagagtgttgagcctgttgtcatgatgcatatgaacatccaaggaccactgtctctctccccttgtccagactccggcacacaacctggcggtgttccttccgcccccaccggacctctcggcccaccagggcatggccagaccctggggcagcaagttccgggattcccaacggcccccactagggtcgtcatcgctcgtcccacccccccccaggccagaccctcccatccaggtggcccaccagtctccggtacattgcagggcgctggactgggtacaaatgcttccctggcccagatggtgtctgggctggttggccagctgctcatgcagccggttctcgtggcccagggtacaccgggcatggcgccccctccagctccagctacggcctcagcgtcagcaggcacaaccaacacagctaccacggccgggcctgccccggggggacctgcgcaacctccacccacgccccaaccctcaatggctgacctgcagttctcgcagcttctggggaacctgctcggcccggcagggcccggggctggcggtagtggcgttgctagcccaactataactgtggcgatgccaggagtgccggcctttctgcagggcatgacagactttctgtag

SEQ ID NO: 180392 - DNA, 735 bp, Artificial Sequence
  Description of Artificial Sequence: Synthetic coding sequence
atggagcccaacgacagcaccagcaccgccgtggaggagcccgactcgctcgaggtacttgtcaaaacacttgactcccagactcgaaccttcatcgtcggagctcagatgaacgtgaaagaattcaaggagcatatcgccgcctccgtgtctatcccaagcgagaagcagcggttgatatatcaaggacgagttttacaggatgataagaagctgcaggaatacaatgtggggggcaaggtaatccacctggtagagagggctccgccccagactcacctccccagcggggcctcatctggtacgggctccgcttctgcaactcacggggggggcagtccccctgggactagaggccctggggcttccgtacacgaccgcaacgccaattcctatgtcatggtgggcaccttcaatctgccatccgaacctagggtcaggctcgtcatggcccagcacatgatacgtgatatccagaccctgctctctaggatggagtgcagaggaggacctcagccacagcattcacagcctcctccacagcctcctgcggtgacacctgaacccgttgcgctctcttcccaaacaagtgaacctgtagaaagcgaagcccctccaagggagcccatggaagcagaagaagtggaggagcgcgccccggctcagaaccctgagttgacgcctggaccagctcccgccgggccaactccagctcctgagaccaacgcaccttag

SEQ ID NO: 180393 - DNA, 789 bp, Artificial Sequence
  Description of Artificial Sequence: Synthetic coding sequence
atggagcccaacgacagcaccagcaccgccgtggaggagcccgacagtctggaagttttggtcaaaacgctggacagccagacccgcacctttatagtcggcgcccagatgaatgtgaaagaattcaaggagcacatcgcagcatcagtgtccataccatcagaaaaacagaggttgatttaccagggccgggttctgcaagatgataagaaactgcaggaatataatgtgggagggaaagttatccatctggtcgagcgagccccgcctcagacccatctgccttctggtgcatcttcaggtaccggcagtgcttccgctacccacggcggtggatctcccccaggcaccagagggcctggtgctagcgtacacgacagaaacgcaaattcatatgtgatggtgggaacttttaatctcccttctgacggcagcgctgtggacgtgcatatcaacatggaacaggcaccaatccaatctgagccaagggtgcgcctggtgatggcccaacatatgatcagagatatccagactctgttgtcacgcatggaatgtaggggcggaccccagcctcaacactcccagccccccccacagcctcccgcagtgacgcctgaaccagtcgcactgtcctcccagacatccgagcctgttgaatctgaggctccgcccagagaaccaatggaagccgaagaagtggaggagagggcccccgcgcagaatccggagcttactcccggccctgccccggctggccctacgcctgcccccgaaacaaatgcgccatag

SEQ ID NO: 180394 - DNA, 2232 bp, Artificial Sequence
  Description of Artificial Sequence: Synthetic coding sequence
atggagcccaacgacagcaccagcaccgccgtggaggagcccgacagcctggaggtgcttgtgaagaccctggatagtcagaccaggacatttattgttggggctcaaatgaatgtcaaggagttcaaagagcacatcgccgcatcagtgtctatcccaagtgagaagcaaagactgatctaccaaggtagagtgctgcaggatgacaaaaaactgcaggaatacaatgtgggtggcaaggtcattcatttggtggagagggcccctcctcagacccatctgccttcaggtgcgagtagcggcacgggatccgcaagtgcaactcacggcggagggtcacccccaggcaccagaggacctggagcctctgtgcacgacagaaacgcaaatagctatgtcatggtcggcacttttaatttgccgtccgacggcagcgccgtcgatgtacatattaatatggaacaggctcccattcaatctgagccaagagttcgtcttgttatggcacaacacatgataagagacattcaaactctgctgagtcgaatggagtgcaggggcgggcctcagcctcagcactctcagcctccaccacaacctcccgcggtgacacctgagcccgttgccctgagctcacagactagcgaaccagtggaatctgaagctcctccccgagagcctatggaagcagaggaagttgaggagcgtgcaccggctcaaaatccagaacttactcccgggccagcacctgcaggccctacccctgcccccgagacgaacgctccgaaccatccttcgccagctgaatatgtggaggtcttgcaggaactccaacgtttggaatctcggctccagcctttcctgcagcgctactacgaggttttgggtgccgcagcgaccacggactataacaataaccacgaagggcgcgaagaggatcagcgcctgatcaatctcgtgggggagtcactaaggctgctcggaaatacgttcgtggccctctctgacctccgctgcaatctggcttgtacccccccaagacacttacacgtggtgcgccctatgtcacactacaccactccaatggttcttcagcaggctgcaattccaatccagatcaacgtgggcactacagtgactatgaccggaaatggaacacggcctccccctactccaaatgctgaagcccccccccctgggcccggacaggccagctccgtcgctccgtcttcaactaacgtagagtcctccgcagaaggcgcacctccccctgggccggctcctcctccagccacaagccacccacgagtaatcaggatcagccaccagagcgtggagccggtcgtcatgatgcatatgaacatacaggacagcggcacacaacctgggggagttccctccgcaccaaccgggcccctcgggccacccggacacggacagacacttgggagcaccctgatccagcttccttctctgcccccggagtttatgcacgctgttgcccaccagatcacgcaccaggccatggtagccgcagtggcctccgcggcggcagggcagcaagttccgggctttcctacggcccctaccagggtcgttatcgcccgtccaactcctccgcaggcaagaccttcccacccagggggaccgccagtgagtggaacccttcagggagccggactcggtaccaacgcgagtctagcccaaatggtcagtggactggtgggccagctgctgatgcaacccgtgctggtcgcgcagggcactccaggcatggccccaccgcctgctcccgcgactgcctcagcttctgccggcacgaccaataccgccacgacagccggacctgctcccggtggaccagcccagcctccccccactcctcagccaagcatggctgatttgcagttctctcagctgctcggcaacctcctcggccctgctggaccgggagcaggcggcccgggagtggcctccccgacaattaccgtcgctatgcctggcgtccccgccttcctgcagggaatgaccgatttcctccaggctacacaaacagccccacccccacctccaccacctcctccaccgcctcctgcccccgagcagcagacaatgcctccgcctggttcaccttccggtggggcgggttctccgggaggattgggacttgaaagtcttagccccgagttctttacttctgttgttcagggggtgttaagcagtttgttgtag

SEQ ID NO: 180395 - DNA, 735 bp, Artificial Sequence
  Description of Artificial Sequence: Synthetic coding sequence
atggagcccaacgacagcaccagcaccgccgtggaggagcccgactccctggaggtgctggttaaaacattggactctcaaacccgtacattcatcgtgggcgctcaaatgaatgttaaggagttcaaagagcacatcgccgctagcgttagtattccatccgagaaacaacgcctcatttaccagggcagggtcctgcaagacgacaagaaattgcaggagtacaacgtgggcgggaaagttatccatcttgtggagagggcgcccccacaaacccacctcccatcaggtgccagtagcgggaccggcagcgccagcgccactcacggaggagggtcaccacctggcacacgtggaccgggggcaagcgtgcacgatcggaatgccaattcctatgtgatggtggggacttttaacctgccctcagagcctcgcgtaagactggtgatggcacaacacatgattagggatattcaaacattactgagccggatggaatgccgaggaggtccgcagccgcagcatagccagcctccgccacagccgccagccgttacacctgagcccgtcgctctgagctcccaaaccagcgagccagtcgagtctgaagcccctccccgggaacctatggaagctgaggaagttgaggaacgcgccccagcacagaacccagagctgacccccggaccggcccctgccgggccaacccctgcccccgagacaaacgccccgtag

SEQ ID NO: 180396 - DNA, 789 bp, Artificial Sequence
  Description of Artificial Sequence: Synthetic coding sequence
atggagcccaacgacagcaccagcaccgccgtggaggagcccgactctctcgaagtgttggtcaaaaccctggatagtcagacccgcacgttcattgtcggtgctcagatgaacgtcaaggaattcaaggagcatatagcagcatcggtgtccatccctagtgagaaacagcgtttgatctaccagggaagggtgctgcaggacgacaaaaaacttcaggagtataacgtcgggggcaaggtgattcacctggtggagcgggcaccaccccagacccatctgccctccggtgcctcctctgggacggggtcagcttcagccactcatggagggggatcacccccaggcaccaggggccccggagccagcgtgcatgataggaatgcgaactcatatgtgatggttggcacatttaacctaccgtctgatggaagcgccgtggacgttcatataaacatggagcaggcgccaattcagtcagagcctcgagttaggctcgtgatggctcagcatatgattcgcgatatccagactctgcttagcaggatggaatgccgcggggggccgcaacctcagcatagccagccccccccgcagccacctgctgtaactcccgaacctgtagccctgagttcccagacgagcgagcctgtggagagcgaggcacccccaagagagcctatggaggcggaggaggtcgaggaaagggccccagctcagaatcccgagctgactccaggtccagctcccgccggtcctacgccagcaccggagaccaacgcgccctag

SEQ ID NO: 180397 - DNA, 2712 bp, Artificial Sequence
  Description of Artificial Sequence: Synthetic coding sequence
atggagcccaacgacagcaccagcaccgccgtggaggagcccgacagtcttgaggtgttagttaagacccttgactctcagacacgaacttttattgtcggagcacagatgaacgtgaaggagttcaaagaacacattgcagcttctgtgtccatcccttcagagaagcaacggcttatctaccagggcagggtcttgcaggacgataagaaactccaggaatacaacgttggcggaaaagtcatccacctagtggagagagcacctcctcagacccatttgccgtctggagcctctagcggcacaggttccgctagcgctacgcatggtggggggtcaccgcctggtacaaggggccctggagcgtcggtgcacgatcgaaacgctaattcctacgttatggtgggcaccttcaacctgccgtcagatggctccgctgtggacgtgcacatcaatatggagcaggctcctattcagtccgagcctagagtgagattagtgatggcccagcacatgatacgagacattcagacgttgcttagtcggatggaatgtcgcggcggcccacaacctcagcatagccagcctccgccccaaccccccgcagtgacacccgagccagtagcactgtcatcccaaacgagcgaacctgttgaatctgaggcgccacctcgagagccaatggaggcagaggaggtggaagaacgagcccctgcgcagaatccagagctgaccccagggcccgccccagctggcccaacacctgctcccgagactaacgctcctaatcacccttcaccagccgaatacgtggaggtattacaggaattacagcgattggaatcaaggttgcagccgtttctccagcgatactacgaggtcttgggcgctgccgcaaccaccgattacaacaacaatcatgaggggcgtgaagaagaccaacgcctgatcaatctcgttggggaaagcctgaggctcctgggcaatactttcgtcgctctcagcgatttgaggtgcaatctggcctgtaccccccccaggcatctgcacgttgtgagacctatgagccactatacaacgcctatggttctgcaacaggctgccattcccattcagatcaatgtgggaaccacagttacaatgactggaaatgggactcggccaccacccacccccaatgccgaggcgcccccccccggcccgggtcaggccagttctgtcgcgccaagctccactaacgtggagtccagtgcagaaggcgctcctccacccgggcctgctcctcctccagctacatcccacccaagggttataaggatctcccaccagtctgtggagcctgtagttatgatgcatatgaacattcaggactctggcacacagcccgggggcgtgccctctgctcctaccggaccgctgggacctcctggtcacggccagacacttgggcagcaggtacctggattccccactgccccaaccagggttgttatcgcaagaccaactccaccccaggcacggccaagccaccccggaggtccccccgtttccgggacactcggggccggccttggcaccaacgcttctttggctcaaatggtgtctggcctggttggtcagctcttgatgcaacccgtgttggtcgcccaggggacacccggctcccccggcggattagggctggagtcactgtctcctgagttcttcacttccgtggtgcagggcgtgctatcctcccttttggggtcactaggtgctcgtgccggctccagcgagtccatcgcggcttttattcagaggttatcaggcagtagtaatatctttgaaccgggagctgatggagccctgggcttttttggagccctcctctccttactgtgccaaaatttttctatggtggacgtggttatgctgttgcatggccacttccagcctctgcaacggctccaaccacagttgcgaagtttcttccaccaacattaccttggagggcaggagccaacaccctctaacatccgcatggccacacacaccctgattactggtctagaggaatacgtcagggagagcttttccttagtgcaagtgcagcctggcgtggatattatacggacgaacctggagtttctgcaggagcaattcaatagcattgccgcacacgtgctccactgtaccgattccggattcggcgctaggcttcttgagctctgcaatcagggtctcttcgagtgcctagccctgaacctgcattgcctggggggtcagcagatggagctggctgccgttatcaatggaaggattcgccggatgtcacgcggagtgaatccttccttggtgagttggctgacaactatgatgggcctgaggcttcaagtagtactcgagcacatgcccgttgggcccgatgccatcctacgctacgtgagaagggtgggcgatccacctcagccgcttcccgaggaaccgatggaggtgcagggggctgaacgggcgtctcccgaacctcaggagtgggtgccgattattcagcaagacatacagagtcagcggaaggttaaaccacagccccccctgtctgatgcatacctgtctggcatgccggccaaaaggaggaagctcagatcggacatccagaaacgcttgcaagaggatcccaattattcacctcaacggtttccaaacgcacagcgcgccttcgccgacgatccatag

SEQ ID NO: 180398 - DNA, 558 bp, Artificial Sequence
  Description of Artificial Sequence: Synthetic coding sequence
tgactggcctgcacccccccccggcacctgcacgtggtgcggcccatgagccattataccacccctatggtgcttcagcaggctgccatcccgattcaaattaatgtgggtaccacagtgaccatgacaggcaatgggacccggccgccacccaccccaaacgcggaagctcctccacctggtcctggacaggcatcctctgttgcgccatcaagcacgaatgttgagagcagcgcagaaggtgctcctcctcctgggcctgccccacctccagctaccagccacccacgggtgattagaataagtcaccagtctgtcgaaccggtggtaatgatgcacatgaatatccaaggccagcaagtcccagggttccccacggcacccacccgggtcgtgatagcaaggccgaccccccctcaggctcggccgagccacccagggggtcctcctgtgtcgggtacgctccaaggagctggactgggcaccaacgcaagtctggcacagatggttagcggtttggtgggccagctgctcatgcagccggttctggtggcttag

SEQ ID NO: 180399 - DNA, 789 bp, Artificial Sequence
  Description of Artificial Sequence: Synthetic coding sequence
atggagcccaacgacagcaccagcaccgccgtggaggagcccgacagcctcgaagtgctggtgaaaactctggactctcagacacgcactttcatcgttggcgctcaaatgaacgtgaaggagttcaaagagcacatcgccgcctcggttagcattccttcagagaagcagcgcttaatttaccaggggcgcgtcctgcaagacgataagaaactgcaggaatacaatgtggggggcaaagtgattcatctggttgagcgagctcccccccaaacccacctgccatctggagcaagctccggaacaggaagcgcctccgctactcatggagggggatccccgccaggcactagaggccccggggcatccgtgcatgatagaaatgcaaacagctatgtaatggtggggacatttaacctgccctccgatggatcggcagtggacgttcatattaacatggagcaggcacctatccagtcggagccacgcgtgcgcttagttatggctcagcacatgatccgcgatattcagaccctgctaagtaggatggagtgtcggggcgggccccaaccacagcatagccagcctccacctcagccccccgctgttacacccgagcctgtagcacttagctctcagacaagcgaacccgtcgaatccgaggctcctcctagagagccaatggaggcagaggaggtagaagaacgggctccagcccagaatcctgaattaacccctggacctgccccagctggaccaactcctgcccccgagaccaatgccccctag

SEQ ID NO: 180400 - DNA, 621 bp, Artificial Sequence
  Description of Artificial Sequence: Synthetic coding sequence
atggagcccaacgacagcaccagcaccgccgtggaggagcccgacagccttgaagtcttggtcaagactctggatagccagactcggacgttcattgtcggcgcccagatgaacgtcaaagagttcaaagagcatatagctgcctccgtgagcattccctccgagaaacagagactcatctatcagggtcgcgtgctccaagatgataagaaactgcaggagtacaatgtgggcgggaaggtcattcatctcgttgagagagcaccaccacagacgcacctgcccagcggcgcgtcttccggaactggttccgcttctgcaacccacggcggggggtctccaccggggacacgtgggccaggggcgtccgtgcatgacaggaacgcgaactcgtacgtgatggttggaacctttaatttgccctccgagcctagagttaggctggtaatggctcaacatatgatccgggacattcagactctcctgtcaagaatggaatgccggggtggcccccaaccacagcacagccaaccaccccctcagcctccggccgtcactccggagccagtcgcccttagtagccaaactagtgagcctgtggaatccgaggcccccccatag

SEQ ID NO: 180401 - DNA, 681 bp, Artificial Sequence
  Description of Artificial Sequence: Synthetic coding sequence
tgaagcggcttcggcgcccggctgctggagctgtgcaaccagggccttttcgagtgtcttgctctcaatctccattgccttggcgggcagcagatggaattggcagccgtgattaacggaagaatccggcggatgtccagaggcgtgaatccctcactggtcagctggctcactaccatgatgggcctgaggctgcaagtagtgttggagcacatgcctgtagggcctgacgctattttgcggtatgtacgccgagttggtgacccgccccagccgctgccagaagagccaatggaagttcaaggcgcagaacgggcttcacctgagcctcaaagagagaatgccagccccgctcccggaaccactgccgaggaggccatgtctcgcggccctccccccgcccccgagggcgggtctcgggatgaacaggacggcgcttccgccgagaccgagccctgggctgctgctgtgccgcctgaatgggtgccaatcatccagcaggacatccagagtcagcgaaaggtcaagcctcagcctcccctgtctgacgcctacctgtccggcatgcccgcgaagcgacgtaagttaagatcggatatccaaaagcgcctgcaggaggatccgaactattcacctcaacgattccccaacgcccaacgtgcctttgccgacgatccttag

SEQ ID NO: 180402 - DNA, 780 bp, Artificial Sequence
  Description of Artificial Sequence: Synthetic coding sequence
atggagcccaacgacagcaccagcaccgccgtggaggagcccgacagcctggaagtcctggtcaagaccctagactcccagactcgtacttttattgtgggggcacaaatgaatgtgaaagaatttaaagagcacattgccgccagtgtttcaatcccttccgagaagcagcgcctcatctaccagggcagggtgcttcaggacgataagaagctgcaagaatataatgttggaggcaaggttatacatttagtagagcgggccccacctcagacccatctgccatccggcgcgagtagcggtaccgggtccgcctcagccacccatggcggggggtccccacccggtacgcgcgggccaggggccagtgttcacgataggaacgctaacagctatgtaatggtcggaacattcaatctgccatccgatgggtcggccgtggacgtgcacatcaatatggaacaagccccaattcagtccgaaccacgagttagactggtcatggcgcaacacatgattcgtgacatacagactcttttatctcgtatggagtgtagaggagggcctcagccacagcatagtcagccgccccctcagccaccggcggttaccccagagcctgtagctctgtctagtcagacctccgaaccggtggagagcgaggcccctccaagggagcccatggaagccgaagaggttgaagagagggcccctgctcaaaacccggagctgaccccaggccctgccccagctggcccgacgcccgcaccagagacctag

SEQ ID NO: 180403 - DNA, 777 bp, Artificial Sequence
  Description of Artificial Sequence: Synthetic coding sequence
atggagcccaacgacagcaccagcaccgccgtggaggagcccgacagtctagaagttctagtgaagactctagacagtcagacacgtacctttatcgtgggcgcccaaatgaacgtcaaggagtttaaagaacacatcgcggcttccgtctccataccatccgaaaaacagagattaatctatcagggtagggttctacaggacgacaagaagttgcaggaatataatgtcggcgggaaggtgatccacctggtggaacgtgccccaccacaaacccacttgcctagcggggccagctccggaaccggttctgcgtctgctacacatggaggaggctcccccccaggaacaagaggccctggcgccagtgttcatgaccggaatgccaactcctatgtcatggtcggcacctttaatctgccaagtgatgggtccgctgtggatgtgcatattaatatggagcaggcgcctatccagtccgagcccagagttcggcttgtgatggctcagcacatgatacgtgatattcaaacattactcagtcgaatggaatgtcggggggggcctcagccacagcacagtcaacctccacctcagcccccagctgttacgcccgagcccgtcgctctctcgagtcagacctcggagccagtggagagtgaggcgccaccacgggagcccatggaggcagaagaggtggaggaacgtgcccctgcccaaaatccagagctaacaccgggtcctgctccggccggaccaacgccggcgccagagtag

SEQ ID NO: 180404 - DNA, 477 bp, Artificial Sequence
  Description of Artificial Sequence: Synthetic coding sequence
atggagcccaacgacagcaccagcaccgccgtggaggagcccgacagcctggaggtgctcgttaagactcttgattcccagactagaacttttatcgtgggggcccagatgaatgttaaagagttcaaagagcacatcgctgcctctgtgagcatacctagtgaaaaacagaggctcatctaccaaggtagggtgctccaggatgataaaaagctgcaagaatacaacgtcgggggtaaggtgatccatctcgtggagcgtgctcctccccagactcatctgccctccggtgcgagctccggaacagggagtgcctctgcaacgcatggtggcgggtcaccgccaggtacccgggggccgggggccagcgtgcacgatcggaacgctaattcctacgtgatggtcggcacctttaacctccctagcgatgggtctgcagtggacgttcacatcaacatggaacaggcgccaatatag

SEQ ID NO: 180405 - DNA, 735 bp, Artificial Sequence
  Description of Artificial Sequence: Synthetic coding sequence
atggagcccaacgacagcaccagcaccgccgtggaggagcccgactcactggaggttctggttaagacactagattcccagacaaggacatttatcgtgggcgcccagatgaacgtcaaagaatttaaagagcacatcgcggcctcggtaagcattccttcggagaaacagcgacttatatatcagggtagagtcctgcaagatgataaaaagctccaggagtacaacgtcggaggtaaggtgattcatctcgtagagcgggctcccccccagacgcacctgccaagcggggcatcatccggaactgggagcgcctccgccacgcatggtgggggttctccacccggaacccggggcccaggagcaagtgtacacgacaggaacgccaattcttacgtgatggtgggcacatttaacctgccttctgagcctagggtgaggctcgtgatggcacagcacatgattcgagacattcaaacacttttgtctcgaatggagtgcagaggcgggccacaaccacagcactcacagccaccacctcagcctcccgcggttacccctgaaccggtggctctctctagccagacaagtgagcccgtggagtctgaggcacccccaagagagcccatggaggctgaggaagtcgaagagcgcgctcctgcacagaatccagaactgacaccagggcctgccccggccggcccaacaccagctcccgaaacaaacgccccgtag

SEQ ID NO: 180406 - DNA, 3381 bp, Artificial Sequence
  Description of Artificial Sequence: Synthetic coding sequence
atggagcccaacgacagcaccagcaccgccgtggaggagcccgacagcctagaggtgctcgtcaagacgctggactctcagacccgtactttcatcgtcggcgcgcaaatgaacgtgaaggaatttaaggagcacatagcggctagtgtaagtattccctctgagaagcagaggctaatatatcaaggccgggtcctccaagacgacaagaaacttcaggagtacaatgtgggaggaaaagtaatacacctagtggaacgggctcctccccaaactcatctgccaagtggcgcgagttccggaacaggatcagccagtgcgacccacgggggtggcagtcctccaggcaccaggggcccaggggcttcagtacacgacaggaatgccaatagctatgtgatggtgggcacctttaacctgccttccgacggatctgcggttgatgtgcacataaacatggagcaagcacccatccagagcgagccaagggttcgattggtaatggcccagcatatgattagggacatacagaccctcctcagtcgtatggagtgcaggggagggccccagcctcaacactcccagcccccaccacagcctcctgcagtaactccagagccagtcgccctcagcagtcagacctctgaacccgtggaatccgaagctccgccacgggagcccatggaggctgaggaggtggaggagagggctcccgcacagaaccccgagcttacccctggcccagctccagccggtcccacccctgcccccgagaccaacgcaccgaaccacccttcacccgccgagtatgttgaggtactacaggagcttcaaagactggaatcgcgactgcagccatttctacagagatactatgaagtgctgggtgccgcagccaccactgattacaacaacaaccatgaaggcagggaagaggaccagcggttgatcaacctcgtaggggagagtctgaggcttctgggaaatacctttgtcgcgctgtcagatctgcgatgtaatctggcttgcactcccccccgtcatcttcacgtcgtgcgccctatgtctcattacacaacacccatggtactgcaacaagctgccattccaattcagatcaatgtgggcaccactgtcaccatgacgggaaacgggacacgcccccccccaactccaaatgcagaggcacccccccctggcccaggtcaggcatcttccgtagctcccagcagcactaatgtcgaaagctccgctgaaggcgccccacccccggggcctgcaccaccacccgcaactagtcaccctcgggtaatccgcatcagccaccagagcgtggaacccgttgtcatgatgcatatgaacattcaagacagcgggacccagccaggaggggtgccttctgctcctacgggtcctctcgggccgcccgggcatggccagactctcggtcaacaggtccccgggtttcctaccgcaccaactagagtcgttatcgccagaccaacacccccacaggctaggccatcccacccagggggcccccctgtctccggcacactccagggtgccggattaggcactaatgccagtcttgcccagatggttagtggcctcgtgggccaactgctcatgcagcccgtgctcgtcgcacagggaacccccggaatggcacccccaccagcgcctgcgacggcaagcgcgtccgcaggaaccaccaacaccgcgactacggccggccccgccccaggagggcccgcgcagccaccacctacccctcagcccagcatggctgatttacagttcagtcagctgctgggcaacttgctgggccctgctgggccaggagctgggggctctggtgtggcgagtccgacaattaccgtggccatgcccggcgtccccgccttcctgcaggggatgaccgatttcttgcaggccacacagactgcacctcccccaccgccgccccccccacccccacctcctgcaccggagcagcaaacgatgccacctcccggctcaccatccggcggagcagggtctcccggcggtctggggctggagagtctgtccccggagttttttaccagtgtggtacagggagtccttagtagcttacttgggagcttaggcgcgagagcaggcagtagcgagtcaatagctgcctttattcagcgtctgtctggatcaagcaatatatttgaacctggcgctgatggggcgctaggcttctttggagccctcttgagtctgctatgccaaaacttttctatggtagacgtggtgatgcttctccatggccattttcagccattgcaaaggctgcagccacagctacggtcttttttccaccagcattacctgggaggtcaggaacccacacccagcaatatacggatggcgacacataccctgatcacaggcctagaggagtacgtcagggagagtttctccctcgtgcaggtgcagccgggggtcgatataatccgcactaatctggaattcctccaggagcagttcaacagtatagcagctcacgtcttgcattgcactgattcaggattcggcgctcggctgcttgagctatgtaaccagggtctttttgaatgcttagccctaaacttacactgtctgggaggccagcagatggaactggccgctgtgattaatggccggataagacggatgagcaggggcgtgaacccgtcactggtgtcctggctgaccaccatgatgggccttcggctacaggtcgttttggagcatatgccagtcggaccagacgccatcctcaggtacgttagaagagtgggcgacccgcctcagccactgcctgaggaaccaatggaagtgcagggggccgagcgagcatccccggaaccccagagagaaaacgcttcacctgcacctggcactacagccgaggaagctatgagtcggggtcctccacccgccccggagggcggctccagggatgagcaagacggtgcatctgctgagacagaaccctgggcggctgccgtcccacccgagtgggtgcctatcattcagcaggacattcagagccagcgcaaagtgaaaccacagcctcctttgagcgatgcctacctgtccggcatgcccgctaagcgccgcaagaccatgcagggcgagggacctcagctgctcctgtccgaggctgtctcaagagctgctaaggcagctggggcccgaccactgactagtcctgagtctctgagtcgcgacctggaggcccccgaagttcaagagtcgtatcgtcagcagttgaggtccgatatacaaaagcggctgcaggaggatccaaactactcaccccagcgctttccaaacgcgcagagagccttcgccgacgacccctag

SEQ ID NO: 180407 - DNA, 735 bp, Artificial Sequence
  Description of Artificial Sequence: Synthetic coding sequence
atggagcccaacgacagcaccagcaccgccgtggaggagcccgactccctggaagttttggtgaaaaccctggattcccaaaccaggactttcattgtgggcgcccagatgaacgtgaaagaatttaaggaacatattgccgcaagcgtttctattccttcagaaaaacagcgtctgatataccagggtcgcgttcttcaggacgataagaagctgcaggagtacaatgtaggaggcaaagtgattcacttggtcgagcgtgcgcccccacagactcatctgccctctggagccagcagtggaacaggctcagctagcgcaacacacggaggtgggagcccccccggcaccaggggtcctggagcgtctgtgcacgatcgcaatgcaaacagttacgtcatggtaggcacctttaatctccccagcgaacctcgcgtccgactcgttatggcccaacatatgatccgcgatatacagacactcttgagccgcatggaatgccgcggggggccccagcctcagcactctcagccgccaccacagcccccggcagtcacccctgagcctgtcgctctgtctagccaaacaagtgagcctgtcgagtctgaagctccaccccgggaaccaatggaagccgaggaagttgaggaacgtgcaccagcccagaatcccgagctgacacccggaccagccccagccggcccaacacctgccccggaaactaacgctccttag

SEQ ID NO: 180408 - DNA, 1548 bp, Artificial Sequence
  Description of Artificial Sequence: Synthetic coding sequence
atggagcccaacgacagcaccagcaccgccgtggaggagcccgacagcctcgaagtgctcgtaaaaacgttggacagccagactcgcacattcatcgttggtgcacagatgaatgtcaaagagttcaaggaacatatcgccgcgagcgtgtccataccctctgagaagcagcgtcttatctatcaggggcgagtgctgcaggatgataagaagcttcaagaatacaatgtgggcggcaaagtcattcacctggtggaaagagcccctccacagactcacctgccttccggcgccagttccggaacggggagcgccagcgccacacacggtggaggcagtcccccagggacccgaggacctggcgcttccgtgcacgaccgcaatgccaacagctatgtgatggtcggtacgttcaacctgccctctgatggcagcgcagtggacgtgcatataaacatggagcaagctcccattcagtccgaacctcgcgtgcgactcgtcatggcccaacacatgatccgtgacatccaaacattgcttagccggatggaatgccgaggtggtccacagccacagcactcacagccacctccgcaacctcctgctgtgacacctgaacctgtcgcactgagcagccaaacctctgagccggtggaatccgaagcacccccccgtgagcccatggaggccgaggaagtggaggagcgagcaccagcgcagaatccggagctcaccccaggccccgcccctgctgggcccacacccgcgcccgagacaaatgctcccaatcatccgtctcccgccgagtacgtggaagttctccaggagttgcagcgtttggagtcccggttgcagcctttcttgcagcgctactatgaagtgctaggggctgccgccaccaccgattacaataacaatcacgagggccgtgaggaggaccaacgcttgatcaatctggtgggcgaaagcttacgtctactgggcaacacttttgtcgctctttctgatctcagatgtaatctagcctgcacccctccacgccacttacacgtagtgcggccaatgagccactacactacacccatggtcctgcagcaggctgctatcccaatccagattaatgtgggaaccaccgtgaccatgacaggcaacggcactcgccctccccccacaccaaacgcagaagccccccccccaggtccaggacaagcttcctctgtcgccccttcaagcacaaatgtggaaagctctgcagagggcgctcccccccctggccctgcacctcctcctgccacctcacatcccagggtaatccgtataagccaccagtccgtcgagccagttgtgatgatgcacatgaatatccaggactctggaactcagcctgggggcgtcccatctgcaccaacgggaccactgggccctcctggacacggccagacactcggctctaccctgattcagctgcctagcctcccaccagagttcatgcacgccgtggctcatcaaatcacccaccaggcaatggtggccgcagtagcgtcctag

SEQ ID NO: 180409 - DNA, 3381 bp, Artificial Sequence
  Description of Artificial Sequence: Synthetic coding sequence
atggagcccaacgacagcaccagcaccgccgtggaggagcccgactcactggaagtgctagtgaaaacactagactcccagacaagaacatttattgtgggggcgcagatgaacgtgaaggagtttaaggaacacattgctgcctccgtttcaattcccagcgagaagcagaggttgatttaccaaggacgggtcctccaggatgacaaaaagctgcaggaatataacgtaggaggtaaggtgatacatctcgtggagcgagcacccccacaaacacatctaccgagtggcgccagtagtggcaccggctcagccagcgcgacgcacggggggggatctccgcctggcactcgcgggcccggcgcttcagttcatgacagaaatgctaattcctatgtcatggtcggcacctttaatctacctagcgatgggtccgcagtcgacgtacatatcaatatggagcaggcacctattcagagcgagcccagggtgaggctcgtcatggcccagcacatgataagagacatccagaccctactatccagaatggaatgtcgaggtggccctcagcctcaacattctcagcctcccccacaacccccagctgtgaccccggagcccgtggcattatcatctcagaccagtgagccggtcgagtctgaggcccctccaagagagcccatggaagctgaggaggtggaggagagagcccctgcgcagaaccctgagttgacaccgggaccagccccagccggtcctactcccgcccccgaaactaacgctcctaaccaccctagtccagcagaatatgtggaagtcctgcaggagctgcagaggcttgagtccaggctacaaccctttctgcagcgttactatgaggtacttggggctgcagcaactacagattacaataataatcacgagggccgggaggaagaccagaggttgatcaatctggtcggcgagtctctccgactgctgggcaacaccttcgtggcactatccgacctgcggtgtaacctggcctgtaccccgccacgccaccttcacgtggttcgccccatgtcccactacactacccctatggttttgcagcaggctgctattcccattcagatcaacgtgggaaccacggtgactatgaccggcaacggaactcgccctccacccactccaaacgcagaggccccacccccgggcccaggccaggcaagttctgttgcacctagctccactaacgtcgagagctcagccgagggggcaccacccccggggccagcccccccccccgcgacatctcaccccagagtcattcggattagccaccagtcggtagagcctgtggtgatgatgcacatgaacatccaggactcggggacccagccaggaggagtcccttcagcccctactggccccctgggccccccaggtcacgggcaaactctcggacaacaggttccagggttccccactgctcctaccagagttgtgatcgctcgaccgaccccaccccaagcacggcctagccacccaggtggacctccggtgagcgggacgctccagggcgcaggtctcggaactaacgccagcctcgctcagatggtgtctggtctggtagggcagctgctgatgcagcccgtgctcgtggcccaaggcacgccaggtatggcgcctcccccagccccagccactgctagcgccagcgctggaaccaccaacacggcaaccaccgccgggcccgcccccggcggtcccgcacagccgcctcccactccccagcccagcatggctgacctgcagttctcccaactcctggggaatctcctgggccccgctggtcctggggcaggaggatctggagtggcgagccccacaatcaccgtggctatgcccggagtgccagcttttttacaaggcatgacagatttcctccaggccacacagacggccccgccacccccccccccccctcccccccccccccccgcaccagagcaacagactatgccgcccccgggtagcccaagtgggggggccggatcacctggaggtttggggctggagtctttgagtcccgagttcttcacatcagtcgtgcaaggcgtcctcagcagtctcttagggagtctgggcgctagggctgggagtagtgagtctatcgccgctttcatccagagactgagcggcagttctaatatttttgaacccggcgccgatggcgctcttgggttctttggagccctgctcagcctgctgtgccaaaatttctcgatggtggatgtcgtgatgctgctccacgggcactttcagcctctgcagaggctgcagccccagttgagatccttttttcaccagcattatctcggagggcaagagcccacccccagtaacattagaatggccacgcataccctcatcacaggactcgaagagtatgtgcgagagagtttttctcttgtccaggtgcagccaggagtggacatcattagaacaaatttagaattcctacaggagcagtttaattccattgcagcacatgttctacattgcaccgacagcggctttggggcccgtttactggagttatgcaatcaggggctgttcgaatgtctggccttgaaccttcactgcctgggcggccagcagatggaactggccgcggtcattaacggtcggataagacggatgtccaggggtgtgaaccccagcttagtttcttggttaactactatgatggggctgagacttcaggtagttctcgaacacatgccagtgggcccggatgccatactgaggtacgtccggagggtgggggaccccccccagcctcttccggaggaaccgatggaagtgcagggcgctgaacgggcgtctcccgagcctcagagagaaaacgcttctccggcaccaggcacaactgccgaagaggccatgtcgagggggcccccccctgcccctgaaggtggatccagagacgaacaggatggggcctctgcagaaactgaaccctgggcagccgccgttcccccagagtgggttcccataatccagcaagatatccaatcacagcggaaggtgaaaccgcaaccacctttgagcgatgcctacctatctggcatgccggccaagagacgaaagactatgcaaggggaggggccccagctcctgttgtccgaagctgtttccagagctgcaaaggcagctggggccagaccacttaccagtcctgagtccctctcacgggacctagaagcacctgaagtgcaggagtcctaccgccagcaactccgctccgatatacagaaaagattgcaggaggacccaaactatagtccgcaaagattcccaaatgcacagagggccttcgctgacgatccatag

SEQ ID NO: 180410 - DNA, 411 bp, Artificial Sequence
  Description of Artificial Sequence: Synthetic coding sequence
tgacggatgagccggggcgtgaaccccagcctggtgagctggctgaccaccatgatgggtctcagacttcaggtcgtgctggagcatatgcctgtaggacccgatgctatcctgcggtatgtacgacgcgtgggtgacccaccgcagcccctgcccgaggagcctatggaggtacagggcgccgagcgggcttcgcctgagcctcaagagtgggtgcccatcatccaacaggacatacagagtcagagaaaagtgaaacctcagccccccctgtcggacgcttatctgtctgggatgcccgcgaagaggcggaaactccgtagcgatattcagaaaagactgcaggaagaccctaactacagccctcagaggttcccaaatgctcagcgcgcttttgcagacgacccctag

SEQ ID NO: 180411 - DNA, 3399 bp, Artificial Sequence
  Description of Artificial Sequence: Synthetic coding sequence
atggagcccaacgacagcaccagcaccgccgtggaggagcccgactcactggaggtgctggtgaagactctggattcccagacgaggaccttcattgtgggagctcagatgaatgtgaaggagtttaaggagcacatagctgccagcgtctctattcccagtgaaaaacagcgactcatttaccaggggcgggttctacaggacgacaaaaaactccaggaatacaacgttgggggtaaagtgattcacttagtggaacgcgctccccctcagacacacctccccagtggtgcatcatccggaacagggtccgcttcagccactcatggaggcggctcaccacccgggacacgtggccctggcgccagcgtgcatgataggaacgcaaacagttacgtcatggtagggaccttcaacctgccatcagatggctcagcggtggatgtacacatcaatatggagcaggctccaatccaatctgaacccagagtccgactagtgatggctcagcatatgattcgcgatattcaaactcttctgtccagaatggagacccttccctacctgcaatgcagagggggtccacagccccagcactctcagccccctccccagccccccgccgtcacacccgagcctgttgcattgtcatcgcagacatctgagcccgtggagtccgaggctccccccagggagccaatggaggctgaagaggtagaggaacgcgcccctgctcaaaatcccgaactgacacccggtcccgccccagccggaccaacacctgcacctgaaaccaatgcccctaaccatcctagcccagccgagtacgtcgaagtgttgcaggagctgcaaagacttgagagtagactccagcccttcctgcagcgatactacgaggtcctgggagccgctgcaaccacggattacaataacaatcatgaaggccgcgaggaagaccaacgactaatcaacctcgtgggcgaaagtctgcgattgctcggtaataccttcgtggctttaagcgatctgaggtgtaacctggcttgcaccccacctcggcatctacatgtcgtgcggccaatgtctcattatacgaccccaatggtgctgcagcaagctgccatccctatacagattaacgtcgggacaacagtgacaatgaccgggaacggtacccgacccccacctactcctaatgctgaagcacctccccccggtccaggacaagcctcttctgttgccccttccagcacaaacgtcgaaagctctgcagagggagcacccccacctggacctgctcctccccccgcaacaagccaccctagagtgataaggattagtcatcagagcgttgagccagttgtaatgatgcatatgaatattcaggatagtggaacccagccaggcggggttcccagcgccccgacaggccccctgggccccccaggccacggccagactctgggccaacaggtccccggatttcccaccgcacctaccagggttgttattgcccggcctacccctcctcaagcccgacctagccaccccggggggccaccagtctccggtaccctgcagggcgcagggctcggcacaaatgcatcactggcccaaatggtttccgggctggtgggccagctgttgatgcagcccgtgctggtggcccaaggaactccagggatggcccctccaccggcccccgcgaccgcctccgcttctgcgggaaccacgaatactgccaccactgccgggccggctcccgggggcccagcccaacccccacccacaccgcagcccagtatggccgacctacagttctctcagttactgggaaacctgttgggccccgctggcccaggagccgggggcccgggtgttgcctctcccacaatcacagtggcgatgcccggcgttcctgcgtttctgcaaggaatgacagactttttacaggctacacagaccgctcctcctccccctcctccccccccacctcccccccctgcccccgaacagcagaccatgccacccccaggatcccccagtgggggcgcaggaagccccgggggcctgggccttgaatccctgtcccccgaattttttacaagcgtggtgcagggtgtgctaagttctctgcttggttccctcggagccagggcgggaagctctgagagcattgcagcatttattcagaggctttctgggagctctaacatcttcgagccaggagcggatggggctctggggttttttggggccctgctgtctctcctgtgccagaacttctccatggtggatgttgtgatgctgctgcatgggcatttccaacctttgcagcgcctgcaaccacagctgcgctccttctttcaccagcactatctgggagggcaggagcctaccccgagtaatatcagaatggctacccatactcttattactggcctggaagagtacgtacgggaatcttttagtctggtgcaagtccagccaggcgtggacatcataagaaccaatttggaattcctccaggaacagttcaactcaattgcagcacatgtcctccattgcacagatagtgggttcggcgctagactcctagagctgtgtaaccaaggcctgttcgaatgtttggcccttaacctccactgcctcgggggccagcaaatggagctggctgccgtcatcaacggaagaattagaaggatgtcacggggcgtgaatcctagtctggtcagctggcttacaacaatgatggggttacgccttcaagtggttttggaacacatgccagtgggacccgacgccattctgaggtatgttaggcgagtaggcgatcctccgcagccccttccagaggaacctatggaggtccaaggcgcagaacgggcatcccctgaaccacagcgtgaaaatgcttcaccagctccggggacaacggccgaagaggccatgtctcggggacctccacctgcgcccgaggggggttcacgggacgagcaggatggtgcctcagcagagaccgaaccctgggcagcagcggtgccacctgaatgggttcctattatccagcaagacatccaatcacagcggaaagtcaagccacagcctcccctgtcagatgcttatctgtccggaatgccggccaagcggaggaaaaccatgcagggagaaggtcctcagctgctgctgagcgaggccgtgtcccgagctgccaaagccgccggcgctaggccactcactagtccagaaagcctgtcaagagatttggaagctcccgaagtgcaggagtcctatagacagcagcttcgatccgatatccagaagagactgcaagaggacccaaattactccccacaaagattccccaatgctcagagagctttcgccgatgacccctag

SEQ ID NO: 180412 - DNA, 702 bp, Artificial Sequence
  Description of Artificial Sequence: Synthetic coding sequence
atggagcccaacgacagcaccagcaccgccgtggaggagcccgacagcctggaagtcctcgtcaaaacactggacagccagacaaggacctttatagtgggggcccagatgaacgtcaaagagttcaaagaacacattgccgctagtgtttctatcccgtctgagaaacaaagactgatttatcagggacgggtgctgcaagacgacaagaaattacaggagtacaacgtcggcggaaaggttatacatctggtggaaagagcacctccccagactcatcttccctccggcgcttctagcggcaccggctctgctagtgcaactcatggcggcggtagcccacctggtactcgcggccccggggcatccgtccacgaccggaacgcgaactcttacgtgatggtgggcaccttcaatttgccgtccgatggtagtgccgtcgatgtgcacattaatatggagcaggcccctattcagtcagaaccgagggttcgcctggtgatggcacaacacatgatcagagatatccagacactgctgagccgaatggagaccctcccgtaccttcaatgtagggggggtcctcagccgcagcattcccagcctcctccacaaccacccgccgtgacacctgaacccgtggccctcagttcacaaacctctgagccagtggaaagcgaagcaccccctagggagccctag

SEQ ID NO: 180413 - DNA, 558 bp, Artificial Sequence
  Description of Artificial Sequence: Synthetic coding sequence
tgactggcctgcacccccccccggcacctgcacgtggtgcggcccatgtcacactataccactcctatggtgctgcagcaggcggccataccgattcaaattaacgtcgggacaacggtgaccatgaccgggaatggcactagaccgccgccaactccaaacgcagaggctcctcctcctggcccagggcaggcgtcatccgtggcgccctcgtctaccaacgttgaaagttctgccgaaggagccccccctcccggccctgccccgccccctgcaacctcacatcctagagtgattcgcatcagccatcaatcagttgagccagttgtcatgatgcacatgaacatacagggtcagcaggtgcccggattccctaccgccccaaccagagttgttatcgccagacctaccccgcctcaagcgaggccatcccacccaggtgggccacctgtgtctggcactctgcaaggcgccggcctcggcacaaatgccagtctggcgcagatggtctccggactggtggggcagttgcttatgcagcctgtcctggtggcatag

SEQ ID NO: 180414 - DNA, 738 bp, Artificial Sequence
  Description of Artificial Sequence: Synthetic coding sequence
cccccccggcacctgcacgtggtgcggcccatgagccactacaccactccaatggttctgcagcaggccgccatcccgatacagattaacgtcgggacaaccgtgacaatgacaggcccagctccccctcctgctacaagtcaccccagagtgatccggatctcccatcagtcggtggaacctgtcgttatgatgcatatgaacatccaggactccggcacccagccggggggagtgccttctgcccctacaggacctctcgggcccccaggccatgggcaaactctcggccagcaggtgcccggcttccccaccgcccccactcgcgtggtcatcgctcggcccacgccgcctcaggccagacccagccatccaggaggaccccccgtcagcggcaccctgcaaggcgctggcctaggtaccaacgcatccctggcccagatggtgtcaggactggtggggcaattgctcatgcagcccgttctcgtagcccagggcacgccaggaatggcgccacctcccgccccagctactgcctctgccagcgccggcactaccaatactgcgaccacagcagggccagcccccggggggcctgcacagcctccccctacgccacagccttcaatggccgatcttcaattcagtcagttactgggaaatctgctgggcccggccggacctggggccggcggtccaggagtggcctctcccaccattaccgttgcaatgccctag

SEQ ID NO: 180415 - DNA, 702 bp, Artificial Sequence
  Description of Artificial Sequence: Synthetic coding sequence
atggagcccaacgacagcaccagcaccgccgtggaggagcccgactcccttgaggtcttggtgaagacactggattctcagacccgcacctttatagtcggcgcacagatgaatgtcaaggaatttaaagaacacatcgctgcctcagttagcattccatccgaaaagcaacgtctgatctatcagggaagggtgctacaggatgataaaaagctgcaggagtacaatgttggagggaaggtaattcatctggttgaacgagcccctccccagacacaccttccatctggagcctcttctgggaccggaagtgcatcagcaacccacgggggtggatcaccccccggcacccggggacccggcgcaagcgttcatgaccgtaacgcgaattcctatgtcatggtgggcacttttaacctgccctcggatggaagcgcagtagatgtccacataaacatggagcaggcaccgattcagagcgaaccccgagttaggttggtgatggcccagcacatgatcagagacatacagactttgctctctcgcatggagaccctgccctatctgcaatgtcgaggcggcccacagcctcagcattcccaaccccccccccagcctcctgcggtgacccccgagcccgtcgcgctgagtagtcaaacaagtgagcccgtagaaagcgaggcccccccacgggaaccctag

SEQ ID NO: 180416 - DNA, 780 bp, Artificial Sequence
  Description of Artificial Sequence: Synthetic coding sequence
atggagcccaacgacagcaccagcaccgccgtggaggagcccgactcactggaagtgttagttaaaactctggacagccagacgcgaacatttatcgtcggagctcagatgaacgtcaaagaattcaaagaacacattgcagcttccgtctccataccctctgaaaaacaacgcctcatctatcagggaagggtcttacaggatgataagaaactgcaggaatacaatgtagggggaaaggtgatccacctggtcgagcgggctcctccacaaacccaccttccctcgggcgcttcatccggtacaggaagtgctagcgccacacatggaggtggatcccccccaggaactcgcggccccggagccagcgtccatgaccgcaacgctaacagctacgtcatggtgggaacctttaaccttcctagtgacggttctgcagtggacgtgcacattaacatggagcaagcacccatccagtcggaacctagggtgcgactggtcatggcccaacatatgatccgagacattcaaaccttactgagtaggatggaatgccggggggggcctcagccccagcacagccagccccccccccaacctcccgctgttacaccagaaccagtcgccttatcttcccagaccagcgagcccgtcgagtcggaagccccccctcgcgaaccaatggaagcggaggaagtggaggaaagggcacccgctcagaaccccgaactgacacctggccccgccccggccggcccaacaccagctccggagacgtag

SEQ ID NO: 180417 - DNA, 702 bp, Artificial Sequence
  Description of Artificial Sequence: Synthetic coding sequence
atggagcccaacgacagcaccagcaccgccgtggaggagcccgacagccttgaggtattggtgaaaacccttgatagccagacccggacctttattgtgggggcccagatgaatgttaaagagttcaaggaacacattgcggcctccgttagtattccaagtgaaaagcagagactgatttaccagggtcgagtattgcaagacgataagaagctgcaggagtacaatgtgggcgggaaggtcattcatctagtggagcgcgcgccacctcagacgcatctgcctagcggggcaagcagcggaacaggctctgccagtgctactcatggagggggctccccccccggtactcgtgggcccggagcatctgtccatgaccgaaatgccaacagttacgtcatggtcggaacattcaatctaccatcggatgggtccgccgtagatgttcacattaacatggagcaggccccaatccagagcgagccaagagtgcggttagtgatggcccagcatatgatcagggatattcagacgctgctttctcggatggaaacactcccatatctgcaatgtcgcggcggcccccagcctcagcatagtcagcccccgccccagcctcctgctgtgacgcccgagccggtggcgctatcaagtcagacaagtgaacctgtcgaatcagaagctcccccgagagagccatag

SEQ ID NO: 180418 - DNA, 1548 bp, Artificial Sequence
  Description of Artificial Sequence: Synthetic coding sequence
atggagcccaacgacagcaccagcaccgccgtggaggagcccgactccctcgaagtcttggttaaaactcttgattctcagactcgaaccttcatcgtcggcgcacagatgaatgtcaaggagttcaaagagcatattgccgccagcgtgagtattccaagtgagaagcaaagactgatctatcaagggcgagtcctgcaggatgacaaaaagttacaggagtacaacgtgggaggaaaagtcatacatttagttgaacgcgcccctccgcagacccacctaccctctggcgcgagcagtggcactggatctgctagtgccacccatggcggggggtcacctcccggaacgcgagggcccggcgcttccgtgcacgataggaacgccaatagctatgtcatggttggaacttttaaccttcctagcgacgggtcagctgtcgatgtccacatcaacatggaacaagctcccatccaaagcgagccaagggtgagacttgttatggcacagcacatgatcagagatatccagacactgctgtcaaggatggaatgccggggaggaccgcaacctcagcatagccagcctcctcctcagcctcctgccgtcacgcccgaacctgtggcgctgtctagccagacctccgagcccgtggagtcagaagccccacctcgggaacccatggaggcagaggaggtcgaggaacgcgctcccgcccaaaacccagagctgactcctgggcccgcgccagcaggccctactcctgcccctgagacaaatgcccccaaccacccatccccagccgagtatgtggaggttctgcaggagttgcagagactcgagagccggctccaacccttccttcagcggtattacgaggtgcttggggccgctgctactaccgattacaacaacaatcatgaggggagagaggaggatcagagactaatcaacttagttggtgaatctctgagacttctcgggaatacattcgtagctttatcagatctgagatgtaatctcgcttgtacacccccccggcatcttcacgtcgtccgacccatgagtcactatacaactcccatggtactgcagcaggctgccattccaattcaaatcaacgtaggaactaccgtgaccatgacaggaaacggaacgcgcccacctcctacgccaaacgcggaggcccctccacctgggccaggtcaggctagcagcgtagctccttcttccacaaatgtggaaagtagcgccgagggggcacccccccccggcccagcccctcccccagctacctcccaccctcgcgtgattcggattagccaccagagtgtggagcccgtggttatgatgcacatgaatattcaggacagcggcacacaaccaggcggggttccctctgctccaacaggaccactcggcccacctggccatggccagacgctggggtccaccctgattcagctgccctcactgccccctgagttcatgcatgcagttgcccatcagattacacatcaagccatggtcgcggccgttgcctcctag

SEQ ID NO: 180419 - DNA, 477 bp, Artificial Sequence
  Description of Artificial Sequence: Synthetic coding sequence
atggagcccaacgacagcaccagcaccgccgtggaggagcccgacagtttggaagtgctagtcaagacgctcgatagtcagacacgtacatttatcgtcggcgcccagatgaatgtcaaagaattcaaagaacatatcgccgcatctgtttctattcctagtgaaaaacagcgccttatttaccaaggaagggtgcttcaggacgacaaaaagctccaagagtataacgtcggtgggaaggtgattcacctggttgagcgagccccaccccaaacccacctgccaagtggagcctccagtggtaccggctcagcttctgccacccatggcggcggcagtcctccgggcacacgcggaccaggagcttccgttcacgatcgaaacgctaactcttatgtgatggtagggaccttcaacctgccctctgatggtagtgccgtggatgtgcatatcaacatggagcaagcgcctatttag

SEQ ID NO: 180420 - DNA, 702 bp, Artificial Sequence
  Description of Artificial Sequence: Synthetic coding sequence
atggagcccaacgacagcaccagcaccgccgtggaggagcccgacagcctggaagtccttgtgaagaccctggatagtcagacccgtacgtttatagtgggcgcccagatgaacgtcaaagagtttaaagagcatattgcagcctctgtgagtatccccagtgagaagcagaggctgatctatcagggaagggtccttcaggacgacaagaaactccaggagtacaacgtaggcggtaaggttattcatcttgttgaaagagctcccccccagacccacctaccatctggagcttcatcaggcacgggaagtgctagtgccactcacggtggcggaagcccgccgggaacccgcggccccggcgcctcggtgcacgaccgcaacgctaacagttatgtgatggttgggacgttcaacctcccgtcagatggttcagcagtggacgtccatatcaatatggagcaagcacccatacagtcagaaccccgagttcggctcgtaatggcacagcatatgattcgggatattcagactctgctgagcagaatggaaactctaccttatctacagtgtagaggaggcccacaacctcagcatagccagccacccccccaacccccagccgtcacgccagaacctgtggctttgtcctcccaaacaagtgaacccgtggaatccgaagcccccccacgggaaccctag

SEQ ID NO: 180421 - DNA, 735 bp, Artificial Sequence
  Description of Artificial Sequence: Synthetic coding sequence
atggagcccaacgacagcaccagcaccgccgtggaggagcccgactccctggaggtactggtgaaaactttagacagtcagacaaggacattcatcgtgggagctcagatgaacgtcaaagagtttaaggagcatatcgcagcatcagtgtccatcccctctgagaaacagcggttaatctaccaagggcgggtgctgcaggatgataaaaagctgcaggagtataatgtaggtgggaaagtgatacatctggtagaacgggctccaccccaaacgcatctaccatctggcgcctcaagcggcacagggagcgcctcagctacacatggtggaggcagtcccccaggtacccggggccctggtgctagcgtgcacgaccgaaacgccaattcctacgtaatggtgggcaccttcaatcttccatcggaaccaagggtcagactcgtgatggctcagcacatgattagagatattcagaccctcctgtcaagaatggagtgtcgtggcgggcctcaaccacaacacagtcagcccccaccccaacccccggcagtgacacccgaacctgtcgctctttcatcacagacatccgagcctgtggagagcgaagccccaccccgtgaacctatggaggcggaggaggttgaggagcgagctccggcccagaaccccgagctgacaccaggcccagcgcctgccggccccacgccggccccggaaacaaacgctccgtag

SEQ ID NO: 180422 - DNA, 3399 bp, Artificial Sequence
  Description of Artificial Sequence: Synthetic coding sequence
atggagcccaacgacagcaccagcaccgccgtggaggagcccgacagccttgaggtgctggttaagacgctagattcacaaacacgaaccttcatcgttggcgcacagatgaacgttaaagagttcaaagaacacatcgctgcttctgtgagcattccttcggaaaaacagaggcttatataccaaggcagagtgttacaggacgataagaagctccaggagtataatgtgggtggaaaggtcatccacctcgtagaacgtgccccgcctcagacacatttgccctctggggcctcaagcggcacgggatccgcgtctgctactcacggaggtgggtctccccctggcacacgcggaccaggggcctcagtgcacgatcgcaacgcaaacagctacgtgatggtcggaaccttcaatctgcccagcgacggatctgccgtcgacgttcacatcaacatggaacaggctcctattcagtccgaacctcgggttagactagttatggcccagcatatgattcgggacattcaaacactgctgtcccggatggaaactttaccgtatctccagtgtcggggtgggcctcagccccaacattcccaaccgcctcctcaaccgccagcggtcacacccgaaccagtggcgctgtcctctcagacgtccgagcctgtcgagtccgaggctcctccacgggagcccatggaggcagaagaagttgaagaaagggcccccgcacagaacccggagttgacaccagggcccgccccggcaggtcccacgcccgcccccgagacaaatgccccaaaccatccctcgcccgcggaatacgtggaggtgttacaggagttgcaaagactggagagccgtctccagcccttcctccagaggtattacgaggttctcggagctgccgcaaccaccgactacaacaataaccacgaggggagagaagaggaccagcgcttgatcaatctagtcggcgaaagtctccgtttactaggcaataccttcgtagctttgagcgatctacgatgcaacttggcctgcactccaccacggcaccttcatgtcgtgcgccctatgtcccactacacgactccaatggtactacagcaggcagctatacccattcagatcaacgtcggcaccaccgtgaccatgactgggaatggcacccgaccaccccccacgcctaatgccgaagcccccccaccaggacccggacaggcatcatcagtggcgccaagcagcacaaacgtggagagctcagccgagggcgccccaccgcctggtccagcaccgccaccagccacgtcccatccacgcgtgattcggatttcccaccaatctgttgaaccagtggtcatgatgcatatgaacatccaagatagtgggacgcaacctggcggggtcccatccgccccaacgggccccctaggcccacccggtcatgggcaaacactgggccagcaagtgccagggttcccaactgcccctacgagggtcgtgatcgcacgccccacacctcctcaggcccgaccgtcccacccaggtggtcctccagtctctggtacgctgcagggcgcgggtttaggcaccaacgcttccctggctcagatggtatcaggactcgtgggtcaactgcttatgcagcctgttctggtggcacaggggactccaggaatggccccaccccccgcccccgctaccgccagcgcctccgcaggcacaacaaacacagcaactactgcaggcccggcccccggcgggccagcccaacctccacctactccacagcccagtatggccgacttgcagttttcccagcttctggggaatctgctggggccagcagggcccggggctggggggtcaggagtggcctctcctacaatcacagtggctatgccaggcgtcccagcctttcttcaaggtatgaccgatttcctgcaggccacccaaacagccccaccccctcccccacctccccctccacctccccccgccccggagcagcagactatgcccccgccgggatctccttctgggggtgcgggaagtcctggcgggcttggactagaatcgcttagtcctgaattttttacttccgtcgtacaaggggttctcagtagcctgctgggtagcctgggggcaagggccgggtcaagtgaatctatcgccgcttttatccagcgactctccgggtctagcaacatctttgagcccggcgcagacggggccctgggattcttcggagcactgctgagtttactatgccaaaacttctcaatggtggacgtcgtaatgctcctacacggccacttccaacctttacagcgcctgcagcctcaactccgcagctttttccaccagcattacctgggcggtcaagaaccaaccccctcaaatatacggatggccactcacaccttgatcaccggattagaggagtacgttagagaaagcttctccctcgtgcaggttcaacctggagtagacataatccggactaatcttgagttcctgcaagagcagtttaattctattgcggctcatgtgctccactgtactgacagtggatttggggctaggttgctggagctttgcaaccagggcttgtttgaatgtttggcccttaatttgcattgtctggggggccaacagatggagctggccgccgttattaatgggaggatccgtaggatgtctcggggcgtaaacccctcccttgtgagttggcttaccactatgatgggactgagactccaagtggtgctggagcatatgccggttgggccagatgctattcttaggtatgtcaggagagtcggcgatcccccccagcctctgcccgaggagcctatggaggttcagggggccgaaagggccagccctgaaccacagcgcgagaatgcttccccagctcctggcacgaccgccgaggaagctatgagccgaggccctcctcccgcccccgaaggagggtcccgcgatgaacaggatggggccagcgccgagacggagccctgggctgctgctgtcccccctgagtgggtacctattatccaacaggacatccagagtcagcgcaaggtgaagccgcagccgcccctgagcgacgcatacctctcgggtatgccggcgaagcgccgtaagaccatgcaaggggaaggaccgcagctgctgctgagtgaagctgtgagcagggccgccaaagccgctggggccaggccattgactagccccgagtcactgtcccgcgatctcgaagccccagaggttcaggaaagctaccgacagcagctcaggtccgacatccagaaacgcctccaggaggacccgaattatagtccacagcgctttccaaatgctcaacgagccttcgctgacgatccatag

SEQ ID NO: 180423 - DNA, 1548 bp, Artificial Sequence
  Description of Artificial Sequence: Synthetic coding sequence
atggagcccaacgacagcaccagcaccgccgtggaggagcccgactccctcgaggtgttggtaaaaacattggacagccagacacgcacattcattgtgggggcacagatgaacgtgaaggaattcaaagaacacattgcagcatctgtgtcaatcccatccgagaaacagcgcctgatctatcagggccgggtcctccaggatgacaagaaactgcaggagtataatgtgggcggaaaggtgatccatttggtggaaagagcgcctccccagacccatctgccctccggcgccagctcaggaacaggaagtgccagtgcgacccacggcggcggttcacccccaggtacccgcgggccaggagcatcagtgcacgacaggaatgcaaattcttatgttatggtcggtacttttaacctgccatcagacgggtccgcagttgatgtccatatcaacatggaacaggctccaatccagagcgaaccaagggtccgcctggttatggcccagcacatgatcagagatattcaaaccctgctgtctcgaatggagtgccgcggtgggccacagccacagcactcacagccacctccacaacctcccgccgtcacaccggaacccgtagccctgtctagccagacatccgagcctgtcgagagcgaagcaccgcctcgtgaacctatggaagcggaagaggtggaggagcgagcacccgcgcaaaatccggagttgacacccggccctgcacctgccgggccaacccccgccccagagacgaacgctcctaatcatccctctccggctgagtacgtagaggtcttgcaggaacttcagcggctggaatccaggctccagcctttcctccagcgatactacgaggttctgggagctgccgcaacaactgattacaacaacaatcacgagggcagagaggaagatcagaggctcatcaatttggtgggggaaagtctgagattgttgggcaacactttcgttgcactcagcgaccttcgttgtaatttggcgtgcactccaccaaggcaccttcatgtcgtgcgacccatgtctcattataccactcctatggtactgcaacaagcagcaattcctattcagatcaatgtgggtaccacagttactatgacagggaatggaacaagaccaccgccaactccaaatgctgaagctccccctccaggccccggccaggcttcaagcgtggcccctagttccaccaatgtggagtccagcgccgagggagctccgccacctggccctgcacccccccccgctactagtcacccaagggtgatccggatctcacaccaaagtgtggagccagtcgtcatgatgcacatgaatatccaggactcaggtacgcaaccggggggggtgcccagcgctccaacagggccactgggcccacctggacacggccagaccttagggagcactctgatacaactgccttctcttccaccagagttcatgcacgctgtcgcccaccagattacccatcaagccatggtcgccgccgtggcaagctag

SEQ ID NO: 180424 - DNA, 735 bp, Artificial Sequence
  Description of Artificial Sequence: Synthetic coding sequence
atggagcccaacgacagcaccagcaccgccgtggaggagcccgactcgctcgaagttttggtcaaaaccttggactctcaaacacgaacgttcatcgtaggtgcgcaaatgaacgtgaaagagtttaaggagcatatcgccgccagcgtctccattccctccgaaaagcagagactaatttaccaaggacgtgtcctccaggacgataagaaacttcaggagtataatgtcggaggcaaggtgatccatctggtagaacgagcaccaccacagactcatctcccgtctggggcctcctcaggaacaggcagcgccagcgctacacatggcggtgggagccctcccggtacacgcggccctggggcgtcggtccacgatagaaacgctaattcgtatgtgatggtcggcacctttaatttacctagtgaaccacgtgtgcgcctagtaatggcccagcacatgattcgcgatattcagactctgctgtcacgcatggagtgccgagggggccctcaaccccagcatagtcaaccaccgccccagcccccagcagttactcctgaaccagtggcactctcttctcagacgtcagaacccgtggaatcagaagctccccccagggaacccatggaagccgaggaggtggaagagagagcacccgctcaaaatcccgaactgacaccaggccctgctcccgccggacctactccagcaccagaaacgaatgctccatag

SEQ ID NO: 180425 - DNA, 2232 bp, Artificial Sequence
  Description of Artificial Sequence: Synthetic coding sequence
atggagcccaacgacagcaccagcaccgccgtggaggagcccgactctctggaagtgctcgtgaaaactcttgactctcagactcgaacctttatagttggcgcgcaaatgaacgtcaaagagtttaaggaacacatcgccgcgtctgtgagcatacccagcgagaaacagcggctgatctaccagggcagggtgttgcaggatgataaaaagctccaggagtacaatgttggcggcaaggtgatacatctggtggagcgagctcctccccagacacatctcccatccggcgcttctagtggtaccggatcagccagtgccacacacggcgggggcagtccacctggtacaaggggccctggtgccagcgtgcacgaccgcaacgcgaactcgtatgtcatggtgggaacctttaacctcccgagcgatggttctgccgtcgatgtgcacattaacatggagcaagccccgattcagtcagagcctagggtccgtttggttatggcacaacatatgattagggatattcaaaccctactatccaggatggaatgccggggtggtccacagccacagcatagccagccacccccacagccaccagccgtaacgccagagccggtcgcactgagttctcagaccagcgaacccgtcgagtccgaggctcctcccagggagccaatggaggcagaggaagtggaagagagagctcctgcacagaaccctgagctaacaccggggccggcaccagctgggcctactcccgctcctgagacaaacgctcccaatcatcctagcccggccgaatatgtggaggtcctccaagagttgcagaggctcgaaagtagactacaacccttcttgcagcgatactatgaggtgctaggggctgctgccaccactgactataacaacaaccacgagggccgagaggaggaccagcggctcattaatctggtgggcgaatctttaagactgttggggaacaccttcgtggcgctaagtgaccttaggtgtaacctggcatgcacaccaccacggcacctgcatgttgttcgacctatgagccattacaccacgcccatggtgttacagcaggccgccatccccatccagataaatgtgggaaccacagtcaccatgacgggcaacggtacgcgtcctcctcctaccccaaacgctgaagcacctcctccaggccccggccaggcatcctccgtcgccccctcttctactaatgtggaaagcagtgccgaaggggctccccctcctggccccgctccaccacccgccactagccacccacgcgtgattcgaatctcccaccagtctgttgagcccgtagttatgatgcacatgaatattcaggattcaggtactcagccaggtggcgttccttcagcccccaccggcccactcggccctccaggccatggtcagacccttggatcaacactgatccagttgccatccctgcccccagaatttatgcacgctgtcgcccatcaaattacacaccaggctatggtcgccgccgtcgcaagtgcagcagcaggccagcaagtgcctggatttcctaccgccccaacgcgcgtggtgatcgccaggcccacaccaccccaagccaggccgagtcatccgggtggtcctccagtgtcaggtaccctgcagggagccggtctggggactaacgcctcgctcgctcaaatggtaagcggtctggtggggcagctgctgatgcagcctgtcctagttgcgcagggtacaccaggcatggcccctccacctgctccagctaccgccagtgcgagcgcaggcaccacaaatactgccacaaccgccgggcccgcccccggcggcccagcccagccccccccaacccctcaaccttcaatggccgacctgcagttcagtcagctgctaggcaatctactggggcctgccggcccgggggctgggggtccaggtgtggctagcccaaccataaccgtagccatgcctggcgtaccagcgttccttcaggggatgaccgacttcttacaggcgactcagaccgccccacctcctcccccacctccgccaccacctccgccggccccagagcaacagacgatgccaccccctggcagtccctcaggaggtgcaggctcacctggcggcttggggctcgaatcactgtcccccgagttttttacctccgtcgtgcagggagtgttgtctagccttctgtag

SEQ ID NO: 180426 - DNA, 735 bp, Artificial Sequence
  Description of Artificial Sequence: Synthetic coding sequence
atggagcccaacgacagcaccagcaccgccgtggaggagcccgactctttggaggtgctcgtgaaaacactggactcgcaaacccgtacttttatcgtgggggctcagatgaatgtcaaagagttcaaagagcatattgcagcctccgtgtccattccctctgagaagcagcgactgatctatcagggtcgcgtcctgcaggacgataaaaagctccaagagtacaatgtgggggggaaagttatccacctagtcgagagagctccgcctcagactcatctcccctctggggccagcagtgggacaggcagcgcgtccgctacccacggaggaggcagcccccccggaacacggggccctggtgcaagcgtccatgaccgcaacgccaactcatatgtaatggtggggaccttcaacctcccatcagaaccccgagtcagactggtgatggcccagcacatgattagggacatccaaaccctactttctaggatggaatgccgcggcgggcctcagcctcagcacagtcagcccccaccccagccccctgctgtcacgcccgaaccagtggccttatcttcccagactagcgagcctgtggaatcagaagccccccctcgcgagcccatggaggcggaagaggtcgaagagagagcccccgctcagaaccctgagctgacccccggacctgctcctgccgggccaacccctgcccctgagactaacgccccatag

SEQ ID NO: 180427 - DNA, 735 bp, Artificial Sequence
  Description of Artificial Sequence: Synthetic coding sequence
atggagcccaacgacagcaccagcaccgccgtggaggagcccgactctctcgaagtcctagtgaaaacgctcgacagtcagactagaacctttatcgtgggtgctcaaatgaatgttaaggaatttaaggagcacatcgctgcatctgtcagcatccccagcgaaaagcagcggctgatttaccagggccgggtgttacaggacgataaaaagcttcaggagtacaacgtcggcgggaaagtcatccatttggtcgagcgagctccccctcagacccacctcccctcaggggccagcagcggtacgggcagtgcctctgcgacacacggtggaggcagtcctcccgggactcgcggacctggcgcctcagtgcacgatcgaaacgccaatagctatgtcatggtgggtacttttaacctcccctccgagccaagagtgagactggttatggcccagcatatgattcgggacatacagacgttactctctcgaatggaatgtcggggaggaccccagcctcagcattcacagccgcctccacagccccctgctgtgactcctgagcctgtggctttatcatcacagacctcggaaccagtcgagtcagaggctcccccaagagaaccaatggaggccgaggaggtagaggaacgggctcccgctcagaaccctgaactgacaccaggcccggctccagcaggacctactccggcacctgagacaaacgccccatag

SEQ ID NO: 180428 - DNA, 3399 bp, Artificial Sequence
  Description of Artificial Sequence: Synthetic coding sequence
atggagcccaacgacagcaccagcaccgccgtggaggagcccgacagcctagaggtcttagtcaaaactctggacagtcagacgcgcactttcatcgtcggcgcccagatgaacgtgaaggaattcaaggagcacattgctgccagcgtgtcaatcccgagtgaaaagcagaggctgatctaccagggccgagtgctgcaggatgataagaaacttcaggaatacaatgtgggcggaaaggtcatccatttggtcgagagagcccccccccagacccacctccccagcggcgcaagttcgggtaccgggagtgctagcgctacacacgggggaggatcccctcccgggacccgaggacccggcgcttctgtccacgatcgaaacgccaattcttacgtaatggtcggaacgtttaacctaccatccgacggaagcgccgttgacgtccatatcaatatggaacaggcacctatccagagcgaacctcgcgtgcggctagtaatggcgcagcatatgatacgagacatccagactttgctgagcagaatggagactctgccttatctgcaatgcagaggtgggccacagccacagcattctcagccacctcctcagccgcctgccgtaacgccggaaccagtggccctaagctcgcagacctcagagcctgtagaaagcgaggcccctcctagagagcccatggaggctgaggaggtcgaagagagggcccctgcacagaatccagagttgactcctggtcccgctcctgctgggccgaccccagctccagagaccaacgcaccaaaccaccccagcccagctgaatatgttgaagtgctacaggagttgcaaaggctagagagtcggttacagcccttcctccagcgctactatgaagtcctgggagccgctgcgacaacagactacaacaacaatcacgaaggccgtgaagaagaccagagactcatcaacctggttggcgagtccctgagactgctgggcaacacttttgtcgcgctgagcgacttgcggtgcaatttggcttgcacacccccgcggcacctccacgtggtccggccgatgagccactatactactccaatggtgctgcagcaggctgccatcccaattcaaatcaacgtgggtactaccgtgaccatgactggaaatggaacaaggccacctcccacccccaatgcagaggcacccccaccagggccaggtcaagccagttctgtggctcctagctcaaccaatgttgaatcttcggctgagggtgcgccacctcccggcccagccccccctccagctaccagccaccctagggtgatccgtattagccaccaaagcgtagagcctgtggtgatgatgcatatgaatatccaggatagcggcacccagcccgggggagtgcctagcgcaccaacaggacccctcgggcccccgggacatggtcagacactgggccaacaggtgccaggcttccctactgcccctacacgcgtggtaatagccagaccaacacccccccaagctaggcctagccatccaggaggcccccctgtaagcgggaccctgcagggagccggattgggcacaaacgcatccctggctcaaatggttagcggtctggttggacaactcctgatgcagccagtgctggtagcgcagggcacaccgggaatggcgccgcccccggcacctgccacagccagcgcaagtgctgggaccaccaacacggcgactactgccggccccgcccctggaggacccgcgcagccacctcccacccctcaacctagcatggccgatctccagttttcacaacttctcgggaacctcctggggcccgcaggccccggtgccggcggaagcggtgtcgctagtcccacgatcacggtggccatgccaggcgttcccgcgttccttcaggggatgaccgatttcctgcaagccacacaaactgccccgcctcccccgccaccccctccaccacctcctcccgcacccgaacaacagaccatgcctccccctggctcaccgagtggcggagctggcagccccggtggcctagggttggagtccctttcaccggaattttttaccagcgtggtccagggcgtgctgtccagcctgcttggctcgctcggagctcgtgctgggtcatccgagtcaatagcagcgttcattcaaaggctaagtggatctagcaacatctttgaaccaggcgctgacggtgcactgggctttttcggcgctctgctcagcttgctctgtcagaatttctcaatggtggatgtggtgatgcttctccatggtcacttccagccccttcagaggctacaaccacaactacgctccttctttcaccagcattatttaggaggccaagaacccaccccttcaaacatcaggatggccacacataccctcattacaggtttggaggagtatgtgcgggaatcattctctctcgtccaagtgcaacccggggtagatataattagaacaaaccttgaattcctgcaggaacaatttaattccattgccgcccatgtgcttcattgcaccgactctgggtttggcgccaggctgctagagctgtgcaatcagggcctcttcgagtgtctggctctgaacctccattgcttaggcggccagcaaatggaattagcggcggttatcaatggaagaatcaggcggatgtcacgtggggtgaacccctccctggtgagttggctaaccaccatgatgggattgcgactgcaggtcgtactggagcatatgccagtgggtcctgatgccatcctgagatacgtgagacgagttggcgatcctccgcagccgctgccagaagaacccatggaagtgcagggcgccgagcgcgccagccctgagccccagcgggagaacgccagcccagcccccgggaccaccgcggaagaagccatgagtaggggcccacccccagcgcccgaagggggatcccgtgatgagcaggatggtgcatctgccgaaaccgaaccatgggcagccgccgtccctcccgaatgggtgccaatcatccagcaggatattcagtcccagcgaaaggtcaagccccagcctcctctaagcgatgcctatctgtctggtatgccggctaagcgtagaaaaacaatgcagggcgaaggcccccagctactgctgtctgaggccgtgagtcgcgccgctaaagctgctggcgcgaggcccctgacatcaccagagtccctttccagagatctggaggcccccgaagtgcaggagagttatcggcaacagctccgaagcgatatacagaagaggctgcaggaggatccaaactattccccacaacgatttccaaacgcacagcgtgcttttgctgatgatccatag

SEQ ID NO: 180429 - DNA, 738 bp, Artificial Sequence
  Description of Artificial Sequence: Synthetic coding sequence
cccccccggcacctgcacgtggtgcggcccatgagccactacaccactcccatggtcctgcaacaagctgctatcccaatccagatcaacgtgggaaccaccgtgacaatgaccggcccggctcctcctcccgctacatcacatcctagagtgataagaatatcccaccagagcgtcgaacctgttgtcatgatgcacatgaacattcaggattccggcacccaaccaggtggggtcccctccgccccaacgggtcctttgggacccccaggccatgggcaaactctgggtcagcaggtgcctggcttccctactgcacctacgagagttgtcattgctcgacctaccccaccacaggcaagaccctctcatcccggaggacctcccgtgtccggcaccttacagggggccggtttgggcaccaacgccagcctggcgcaaatggtaagcggcctggttggacagctgctgatgcagcccgtacttgtggctcagggcactcctggcatggccccacctcccgcgccagctactgcatcagccagcgcaggaacaaccaacacagctaccaccgcaggtcccgcacctggagggcctgctcagccacccccgaccccacagccctccatggctgacttgcagtttagccaactgttaggcaacctgcttggcccagcggggccgggagctggcgggcctggagtggccagccctactatcactgtggcgatgccttag

SEQ ID NO: 180430 - DNA, 777 bp, Artificial Sequence
  Description of Artificial Sequence: Synthetic coding sequence
atggagcccaacgacagcaccagcaccgccgtggaggagcccgactctttagaggttttagtgaagactctcgattcacagacacgtaccttcattgtgggtgcgcagatgaacgttaaagagttcaaagagcacattgcggccagcgtgtccatcccaagcgagaagcaacgcctgatctatcaggggagggtgctgcaggacgataagaagctgcaggagtataatgtcggtggcaaggtgatccacctagttgagcgagctccccctcagactcatctgccctccggcgcgagcagtggcactggctctgctagcgcgacccacggggggggttcacctccaggaactcgtgggccaggcgcatccgtccacgaccgaaatgccaactcttatgtcatggtgggtacatttaacctcccttctgacggatcagccgtcgacgtgcatattaacatggagcaggctcccattcagagcgagcccagagtccggctggttatggctcaacacatgatcagggatattcagactctactgtccaggatggaatgtagaggcggccctcagccacagcattcacaacctcccccacaacctccagcagtgacccctgaaccggtggcccttagttcacagacctctgagcccgtggagagcgaggcaccaccaagagagccgatggaggctgaagaagtcgaagaaagggctccggcccagaatccagagctaaccccaggtcccgcacctgctgggcctacacctgctccagaatag

SEQ ID NO: 180431 - DNA, 789 bp, Artificial Sequence
  Description of Artificial Sequence: Synthetic coding sequence
atggagcccaacgacagcaccagcaccgccgtggaggagcccgactccctggaggtgctcgtaaagacactcgatagccagacacgtaccttcatcgtcggggcacagatgaacgtgaaagagttcaaggagcacatcgccgccagtgtgagcattcccagcgagaagcagcgcctcatctaccaaggtcgggtccttcaggacgataaaaaacttcaggaatataacgtagggggtaaagtcatccatttagtggagagagctcccccccaaacacatctcccttcgggcgctagcagtggcaccggcagcgcttccgctacgcacggcggaggttccccccctggcaccaggggccccggcgctagcgtgcatgataggaacgccaactcctatgtgatggtgggcactttcaatctgccatcggacgggagtgcagttgatgtccacattaacatggagcaggcacccatccagagtgagcctcgagttcggctggtgatggcacagcacatgatccgcgacatacagacactgctctcacgaatggagtgcagaggcggtccacagcctcaacacagccagccacctcctcagccccctgcagtgacccctgagccggtcgctcttagcagccagacaagcgaaccggtggagtcggaggccccccctcgagagcccatggaggcggaggaagttgaagagcgggcacccgcgcaaaatcctgagttaaccccaggccccgccccagcaggtcccacgccagctcctgaaaccaatgccccctag

SEQ ID NO: 180432 - DNA, 789 bp, Artificial Sequence
  Description of Artificial Sequence: Synthetic coding sequence
atggagcccaacgacagcaccagcaccgccgtggaggagcccgactcattggaggtgctggtgaaaactctggattctcagacccgcacatttatcgtgggcgctcagatgaatgttaaagaatttaaggagcacatagccgcttccgtttccataccctctgaaaagcagagattaatctatcagggccgggtcctccaagatgataagaagctgcaggagtacaatgtgggcgggaaggtgattcacttggtagaacgggctcctccccagactcacttacccagcggagccagttccggcactggctctgcgtctgcaacccacggaggcggaagtccaccaggaaccaggggtcccggggctagcgtacacgatcgcaacgctaacagttacgttatggttggcacctttaatctcccaagtgatggaagcgcagttgatgtccacattaatatggaacaggcccctattcagtccgagccgagagtccgtctggtgatggcccaacacatgatacgcgacatacaaaccttactgagtaggatggagtgcaggggcggcccacagccacaacatagtcagccacctcctcaacctcccgctgttacccccgaaccagttgcactctcctcccagaccagtgaacccgtcgagtcagaggcacctcctagggaacccatggaggctgaggaggtagaagaaagagcccctgctcaaaaccctgagctcacacctgggcctgcccctgctggaccaactcccgccccagagactaacgccccctag

SEQ ID NO: 180433 - DNA, 738 bp, Artificial Sequence
  Description of Artificial Sequence: Synthetic coding sequence
cccccccggcacctgcacgtggtgcggcccatgagccactacaccactcctatggtcctgcagcaagctgccatacctatccagatcaacgtcggcactactgtcacaatgactgggccagccccaccgcccgctacaagccatcctcgcgtgatccgcatcagtcaccagagcgtggaaccagttgtcatgatgcacatgaatattcaggatagcggaacgcagccaggcggagtaccctccgctcctacaggcccccttgggccgcccggccatgggcagaccttgggccagcaagtgcccggctttcctacagcccccactagggtagtgatcgcacgccccaccccaccgcaggcccgcccatcccacccgggcggacccccagtgtccgggactctccagggcgcaggcttgggtaccaacgccagccttgcacagatggtttcaggattggtgggccagctactaatgcaacctgtgctcgtggcgcagggcacgcctggtatggcgcccccacccgctcccgcaacggcctccgcgtcagccggaaccacaaatacagccactacagctggacccgccccgggcggaccggcccagcctcctccgactccacagccctccatggccgacctccaatttagccaattgctgggcaatcttctgggccctgctggacctggagcaggaggatctggagtggcttccccgactatcactgtcgcaatgccatag

SEQ ID NO: 180434 - DNA, 648 bp, Artificial Sequence
  Description of Artificial Sequence: Synthetic coding sequence
atggagcccaacgacagcaccagcaccgccgtggaggagcccgactcattggaggtcctcgtgaagacactggattctcagacccgtaccttcatagtcggagctcaaatgaatgtgaaagagtttaaggagcatatagctgcgagcgtatccatccctagcgagaaacagcgattgatataccaaggaagagttctacaagatgacaaaaagttacaggaatataatgtgggcggaaaggtgatccatctagttgaacgggcacccccccagactcatctcccgtctggggcatcatctgggaccgggagcgcctccgccactcatgggggaggctccccaccaggtactcggggccccggagcatccgtgcacgataggaatgctaacagctatgtgatggtggggaccttcaatctgccctcagaacctagagttcgactagttatggcccagcacatgatcagagatattcagaccttactatcccgcatggaatgcagaggcgggcctcaacctcagcattcccagcctccaccccagcctcctgccgtcacccctgagccagtggctctatccagccagacctctgagcccgtcgaaagcgaggcccccccccgggaacctatggaggccgaagaggtgtag

SEQ ID NO: 180435 - DNA, 735 bp, Artificial Sequence
  Description of Artificial Sequence: Synthetic coding sequence
atggagcccaacgacagcaccagcaccgccgtggaggagcccgacagccttgaggtgcttgtcaagacgttggactcacagactcgcacattcatagttggcgctcagatgaacgttaaggaattcaaagagcacattgcagcctctgtatccatccctagtgagaaacagcgtctcatctatcagggtcgggtcctccaggacgacaagaagctgcaggaatataatgtgggagggaaggttattcatttagtggagcgtgcacctccacagactcacctcccctcaggagctagttccggcacggggagcgccagtgccacacacggtgggggttctccccccggaactagaggtcccggagccagcgtacatgaccggaacgcaaacagctatgtcatggtaggaactttcaaccttcccagcgagccgcgtgtccggctcgtgatggcacagcacatgataagagacattcagacactgttgtcacggatggagtgcaggggcggaccccagccacaacattcccagcccccaccccagccccccgcagtaacacccgaaccggtggctctatcgagccagacttctgaaccagtcgagtctgaggcgccacctagggagcccatggaagccgaagaggtggaagagcgggcccctgcacagaatcctgaactgactcctggtccagctcctgcgggaccaaccccagcaccggaaaccaacgctccttag

SEQ ID NO: 180436 - DNA, 558 bp, Artificial Sequence
  Description of Artificial Sequence: Synthetic coding sequence
tgactggcctgcacccccccccggcacctgcacgtggtgcggcccatgtcacattatactacgcctatggtactccagcaggctgccatcccaattcaaattaatgtgggcactacagtgaccatgacaggaaacgggacccgtcccccacctactcctaacgctgaggcgcctcctcccggcccaggacaggctagtagcgtggctccgtcaagtacaaacgtagaatcctccgccgaaggggcacctccccccggcccagcgcctccacccgcgacgtcccaccccagagtcatccgcatttcacaccaaagcgttgagcccgttgtcatgatgcacatgaatattcagggccaacaggttcccggtttcccaacagcccccaccagagtggtgatcgctagaccaacgcctccacaggcacgtcctagtcacccaggaggaccacctgtttcaggcacactgcagggggcaggactgggcacgaatgccagcctggcgcaaatggtgagcggcctcgtggggcagctgcttatgcagccagtactggtggcttag

SEQ ID NO: 180437 - DNA, 780 bp, Artificial Sequence
  Description of Artificial Sequence: Synthetic coding sequence
atggagcccaacgacagcaccagcaccgccgtggaggagcccgacagtctggaggtactcgtcaaaactctggacagccagactagaaccttcatagtgggcgcgcagatgaacgtgaaggagtttaaagagcacattgccgcgagcgtttccattccatctgaaaagcagcgattgatatatcaagggcgcgtgctccaggacgacaaaaaactgcaggaatacaacgtaggaggaaaggtcattcacctcgtggagcgagctcccccacagacccatttgccttccggggcttctagcggaaccggatctgctagcgctacccatggaggcggatcgccgccaggcacaaggggtccaggggccagtgtccacgaccgcaacgccaacagctacgtcatggtgggtacttttaatctgccatcagacgggagtgccgtcgacgtgcacatcaacatggaacaggccccaattcagagtgaaccaagggtgaggctggtgatggctcagcatatgatccgtgacattcagactctcctgtcacgaatggaatgtcggggcggtccgcagccccagcatagccagccaccaccacagccccctgccgtcacccccgagccagtggccttaagcagccagacctctgagcctgtggagtccgaggcccccccaagggagccaatggaggctgaagaggttgaagagcgcgcccctgctcagaaccccgaattgaccccgggcccagctcccgctggacccactccagcccctgaaacatag

SEQ ID NO: 180438 - DNA, 477 bp, Artificial Sequence
  Description of Artificial Sequence: Synthetic coding sequence
atggagcccaacgacagcaccagcaccgccgtggaggagcccgactcgttggaggtgttggttaaaaccctcgatagtcagacaagaacatttattgtgggcgcgcagatgaatgtgaaggaatttaaggagcatatagcagcttccgtgagtatcccctccgaaaaacagaggctgatctaccagggccgcgtgctgcaggatgataagaagctgcaggagtataacgtcggggggaaggtgatacatctagtggaacgcgcgcccccccagacccacctaccatccggcgcgtcgtccgggactgggtccgccagtgcaacccacgggggggggagtcccccaggcacaaggggcccaggggcctccgttcatgatcgtaacgctaattcatatgtgatggtgggaaccttcaaccttcccagcgatggttcagctgtggatgttcacattaacatggagcaggcccctatttag

SEQ ID NO: 180439 - DNA, 621 bp, Artificial Sequence
  Description of Artificial Sequence: Synthetic coding sequence
atggagcccaacgacagcaccagcaccgccgtggaggagcccgactctctggaagtgctggtaaaaacgctggatagtcaaacgcgtactttcatcgtgggagcccaaatgaatgttaaagagtttaaggaacatattgcagctagcgtctctatcccttctgagaaacagcgtctgatttaccagggccgggtcttgcaggacgacaagaagctgcaggaatacaacgttggggggaaagtgattcacctggttgagagagctcctccccaaacacacctcccttccggcgcatcgagtggaactgggtcagccagtgcaactcacggcggaggttctccccccggaacccgggggcctggcgcttccgtccacgatcgaaacgctaattcctacgttatggttggtacatttaaccttccctccgaaccacgagtgagactcgtgatggcacagcacatgatccgagacatacagacgctcttatcccggatggagtgccgcgggggaccccagccccaacattcccagccaccaccccagccccccgccgttacccctgaaccggtggccctcagctcccagaccagtgaacccgtggagtcagaggctccaccttag

SEQ ID NO: 180440 - DNA, 3399 bp, Artificial Sequence
  Description of Artificial Sequence: Synthetic coding sequence
atggagcccaacgacagcaccagcaccgccgtggaggagcccgactcactggaagtgctggtgaaaacactagactcacaaacgagaacattcatcgttggtgctcaaatgaacgtcaaggagttcaaggagcatattgcagctagcgtctctatccctagcgagaaacagaggctgatttaccagggtagggtgttacaggatgacaaaaagcttcaggaatacaatgtgggtggaaaagttattcatctggtcgagcgagcaccaccgcaaactcatctgccatccggagcttcctccggtactggcagcgccagcgccactcatggtgggggcagtccccccggtacacgaggaccaggcgcttctgttcatgatcgaaacgccaactcttacgtcatggtcggcactttcaatctccctagcgacggatcagctgttgatgtgcatattaatatggagcaggcacctatccaatccgagccacgcgtccggctggttatggcccagcacatgatccgggacatccagacacttctgagtaggatggagacgctgccctaccttcagtgccgcggaggaccacagccgcagcactcacagccaccaccccaaccgccagccgtgacgcctgagcctgttgctctctcttcccagacatcagagcccgtggagtctgaggccccgccccgagaaccaatggaggccgaggaagtcgaggaacgtgcgccggctcagaacccggagctcactccaggccctgccccagctggtcctacacctgccccagaaacaaatgctcctaatcacccttcgcctgcagaatatgtggaggtactccaggaattacaaaggcttgagtctagattgcaaccttttctgcagcggtactacgaggtgctcggagctgctgccaccaccgattacaataataaccatgaaggcagggaggaggaccaacggctaatcaacctggttggtgagtctcttcggttactgggaaacacttttgtggcactctccgatttgaggtgtaacctggcatgtacaccgcctcgtcatctgcatgtagtgcggcctatgagccactatacgactccgatggtgcttcagcaggccgcgattcctattcagataaacgtgggaactacagtgaccatgacaggaaacggaactagacccccccccacccctaacgctgaggcccctcctccagggcccggacaggccagcagtgtggcaccgtccagcacaaatgtggaatcctctgctgaaggtgcgccgcctccaggacccgcacccccccccgctacaagtcacccacgagttataagaattagccaccaatcagtagaaccggttgttatgatgcacatgaacattcaggattccggcactcaaccagggggcgtgccttccgcacccactggacctctcggccctcccggacacggccagacgttaggacagcaggtgcctggattccccaccgcacccacgagggtcgttatcgcacggcctacccccccgcaagctcgaccttcccaccccggcgggccccccgtgtccggcacgttgcagggagccggactgggcacgaatgcctccctggcacagatggtgtccggacttgtgggacagcttctcatgcagcccgtactcgtggcacaagggacgccagggatggcccctccccctgctccggccaccgcttccgcatctgccggaaccactaacactgctacaacggctggtcctgcccccggtgggcccgcacagcctccacctactcctcagccttctatggctgacctgcagttcagtcagctccttggaaacctacttgggcctgctggacccggcgccggggggccaggcgtggccagccccactatcacggtagccatgccgggcgtcccggcatttctgcaggggatgacagacttcctccaggcaacacagacggctccaccacctccacccccccccccacccccacccccggcaccagagcagcagactatgccaccgccagggagcccttccggtggcgcaggatctcccggggggctcgggctggagtcactcagcccagagttctttacctccgtcgtacaaggcgtcctgtcctcgttgttgggcagtcttggggcacgtgctggatctagtgagtcaatagccgcctttatacagaggttgagcggatcgagtaatatctttgaacctggagctgacggcgcattaggcttctttggggcactactctctctactttgtcagaacttctctatggtggacgtggtgatgctcttgcacgggcacttccagcctctccagcgactccagcctcagctgagaagctttttccatcagcactatctgggcggccaggagcctaccccttccaacatacgaatggcgactcatactctgattactggccttgaggaatatgtgcgagagtccttctccttggtacaggtacaacctggcgtggatattatccgcacgaacctggagttcctgcaggagcagttcaattctatagctgctcacgtattgcactgtactgactccgggttcggcgccagactgttggagctgtgtaaccaggggctctttgaatgccttgcgctgaacctgcactgtctcggaggccagcaaatggaactggcggctgtgatcaacggaagaatcaggagaatgtcccgcggtgtaaaccctagccttgtgtcctggttgaccaccatgatgggattgcggctgcaagtcgtgctggagcacatgcctgtcggccctgacgcaatcctgcggtacgtgagaagagttggggacccacctcagccgctccccgaggagccaatggaagtacagggggctgaaagagcatcaccagagccacagcgtgagaacgcatcgcccgctcccggcactactgcagaggaggccatgtctcggggcccccctcccgcccctgagggcgggtcccgcgacgagcaggatggcgcttctgcagaaacagagccctgggcagcagccgtcccgcctgagtgggtacctataatccagcaggatattcaatcccaacggaaggtcaaaccgcagcctcctctgtctgacgcttatctgagtggcatgcctgcaaaaaggcgcaagaccatgcagggcgaaggccctcaactcctcctgtccgaagcggtgtcacgcgcggccaaagctgcaggggcaaggccactcactagtccagagagtctgagtcgggacctggaagcccccgaggtgcaggagagttacaggcagcagctgcggagcgacatccagaaacgtctacaggaagatcccaactattcccctcaacgcttccctaatgctcagagagccttcgcagacgacccttag

SEQ ID NO: 180441 - DNA, 717 bp, Artificial Sequence
  Description of Artificial Sequence: Synthetic coding sequence
agcagcgccgagggcgcccccccccccggccccgcccccccccccgcgactagtcatcctcgcgtgatcagaattagccaccaatcagtagaaccagtcgttatgatgcatatgaacatccagggccccctgtccctctccccctgcccagatagcggaacacagcccggcggagttcccagcgcgcccaccgggcccctaggacccccaggacacgggcagaccctgggtcagcaggtgccaggatttcctaccgctcctaccagggtggtcattgctcggccaactccccctcaggctcgcccaagtcacccgggcggccccccagtgtccgggaccctccagggtgccggtctgggaactaatgcatcattagcccagatggttagcggcctggtggggcagctgctgatgcagcctgttttagtggcccagggaactccaggcatggccccacctcctgctccagccaccgcctcagccagcgccggtactaccaacaccgccacaacagctggtcctgcacccggcgggcctgcccagccacctccaaccccccagccttccatggctgacctgcagttcagtcagctgcttggcaaccttttaggtccagctggcccaggagccggtggcagtggggtggcctcaccaactattactgtcgccatgccaggagtgcccgcttttctccagggtatgaccgatttcctatag

SEQ ID NO: 180442 - DNA, 621 bp, Artificial Sequence
  Description of Artificial Sequence: Synthetic coding sequence
atggagcccaacgacagcaccagcaccgccgtggaggagcccgacagtttggaagttctggttaaaacactggatagccagacacggacattcatcgtgggcgcccagatgaacgtcaaagagttcaaagaacacatcgccgcatctgtgtccatccctagcgaaaaacagagactgatttaccaagggcgcgtgttacaggatgacaagaagctacaggagtataatgttggagggaaagtcatacatctagtggagcgagccccgccccaaactcacttgccttccggggcctcgtcagggaccggatcagccagcgccacgcacggaggaggctccccacccgggacccgaggtccaggcgccagtgtgcatgatcgaaacgccaactcctacgtgatggttgggacgtttaatctccccagtgagccgagggtcaggcttgttatggcacagcacatgattcgggacattcagacgcttctcagccgcatggaatgtagggggggaccacagccacagcatagccagccacctcctcagcctcctgccgtgaccccagaaccggtggctctcagctcccagacctcagagcctgtggagagcgaggcccctccctag

SEQ ID NO: 180443 - DNA, 558 bp, Artificial Sequence
  Description of Artificial Sequence: Synthetic coding sequence
tgactggcctgcacccccccccggcacctgcacgtggtgcggcccatgtcgcattatacaacccccatggtgctgcagcaggccgctatccctattcagattaacgtcggcaccaccgtcacaatgacaggcaacggtactcggcccccccccacacccaacgctgaggccccgcctcctggaccgggccaagcttccagcgtcgcgccttcctcaacgaacgtggagagtagtgcagagggtgcccctccgccagggcctgccccacctccagccacaagccaccctcgagttatcaggatatcacatcagtcagttgagccggtggtgatgatgcacatgaatatacagggccagcaggttccgggattcccaacagcacccacgagggttgtgatagctagacctacaccaccccaggctagaccctctcaccccggcggtccacccgtgagtggaacactgcagggggctggcctggggacaaacgcttctctggctcaaatggtttccggccttgtgggacagctcctgatgcagcctgtccttgtggcttag

SEQ ID NO: 180444 - DNA, 648 bp, Artificial Sequence
  Description of Artificial Sequence: Synthetic coding sequence
atggagcccaacgacagcaccagcaccgccgtggaggagcccgactctctggaagtgctcgtgaagaccctcgacagccagactaggaccttcatcgttggcgcacagatgaacgtgaaagagttcaaagagcacattgcagcttccgtgtccataccttcagaaaaacagcgactgatctaccagggcagggtactgcaggacgacaagaagctgcaggagtacaacgtagggggcaaagtgatccatctggtcgaacgcgctcccccccagacacacttgccgtccggcgcctcttctgggaccggaagcgcgtctgccacacacgggggaggttccccacccgggacccgaggtccaggcgccagcgtgcatgacaggaatgccaattcctacgtgatggtgggaacatttaatctgccaagtgaacccagggtgagactggtaatggcgcagcatatgatccgagacatccagacgttgttgtccaggatggagtgtaggggcggcccgcagccccaacacagtcagcccccccctcagcctcccgctgtgactcccgagccagtcgcactgagtagccagacaagcgaaccagttgagagtgaagcccccccacgcgagccaatggaagccgaggaggtctag

SEQ ID NO: 180445 - DNA, 789 bp, Artificial Sequence
  Description of Artificial Sequence: Synthetic coding sequence
atggagcccaacgacagcaccagcaccgccgtggaggagcccgacagcctggaagtccttgttaaaaccctagactctcagacccggactttcattgtgggagctcagatgaacgttaaggaatttaaggaacacattgccgcttccgtgtccataccatctgagaaacaaagactcatctatcaagggagagtgctgcaggacgacaagaaactgcaggaatataacgtggggggcaaggtgattcacctggtggaacgggcccctcctcagactcacctcccatctggggcttctagtggcactggctctgccagcgctacacacggcggcgggtccccacctgggacccgaggccccggtgcttctgtccacgaccggaacgctaacagttacgtcatggtcgggacctttaacctgcccagcgatggatcggcggtagacgtgcacattaatatggagcaggcccctatacagtctgaaccgagagtgcggctggtcatggctcagcacatgatccgcgatatacagactcttcttagcagaatggagtgccgcggtggtccccaaccccaacatagtcagcctccgccccagccccctgcagtcacgcctgaacccgtcgcattgagctcccagacgagcgagcccgtggaatctgaagcaccccctagggagcccatggaggccgaggaagtggaggaaagggcaccggcccaaaacccggagctgacacccggacctgcccccgccggtccaacgcccgccccagaaactaatgccccatag

SEQ ID NO: 180446 - DNA, 594 bp, Artificial Sequence
  Description of Artificial Sequence: Synthetic coding sequence
atggagcccaacgacagcaccagcaccgccgtggaggagcccgactcactggaagttctcgtgaagactctggacagccaaactaggacttttatagtgggcgctcagatgaatgtgaaggaattcaaggaacacatcgctgccagtgtctctattccgagcgagaagcagcgactgatctaccaggggagagtactgcaggacgataaaaagttgcaggaatataatgtggggggcaaagttattcacctcgtcgaacgggccccccctcagacacaccttccctccggggcctcgtcagggacaggaagcgcctccgcaacgcacggtggaggctctcctccaggtacaaggggccctggagcttccgtccacgacagaaatgcgaacagctatgtcatggtgggcacttttaatttgccatctgacgggtcggctgtggacgtgcatataaatatggaacaagccccaatccagtcagaaccgcgagtccgactcgtgatggcccaacacatgatcagagacattcagacactcttatcgcggatggaatgtcgaggggggccccaaccgcagcattcccagcctccctag

SEQ ID NO: 180447 - DNA, 735 bp, Artificial Sequence
  Description of Artificial Sequence: Synthetic coding sequence
atggagcccaacgacagcaccagcaccgccgtggaggagcccgactcattggaagttctcgtgaagactttagacagccagacacgtacttttatcgtgggtgcccaaatgaacgtgaaggagttcaaagaacacatcgccgccagtgtgtccatcccctctgagaaacagcgactaatataccaggggagagtgctgcaggatgacaagaagctacaggagtacaatgtcggagggaaagttatacatctggtggaacgcgccccccctcagactcacctgccctcgggtgctagttccgggacagggtctgctagcgctacacatggtgggggatccccaccaggcactagagggcctggagcctccgtacatgatagaaatgccaacagctacgtcatggtgggcactttcaatttgccatcggaacccagagtaaggctagttatggctcaacacatgatccgcgacattcagacactgctgtcccgaatggagtgccggggcggaccacaacctcagcacagccagccacccccacagccacccgccgtaacaccagaaccagtggcactgagcagtcagacatccgaacctgtcgaaagcgaggccccaccacgcgagccaatggaagccgaagaggtcgaagagagagcgccagcccagaaccccgagctcacgccgggacctgccccagccggacctacaccagctcccgaaacgaacgccccctag

SEQ ID NO: 180448 - DNA, 681 bp, Artificial Sequence
  Description of Artificial Sequence: Synthetic coding sequence
tgaagcggcttcggcgcccggctgctggagctgtgcaaccagggcctgtttgagtgccttgcactcaatctacactgcttgggaggccagcaaatggagctggccgctgttataaacgggaggatccggcgaatgagccgcggagtgaacccaagtctagtatcctggctcaccacaatgatgggtctgcgtctgcaagtggtcctcgagcacatgccagtggggccagatgctattctccgttatgtccgtagggtaggcgacccaccccagcccctacctgaggagccaatggaggtacagggggccgagcgtgccagccctgaacctcagcgcgaaaatgcgtcccctgctccagggacgactgctgaggaggcaatgagtaggggccccccccctgcccccgaaggcggttcacgcgatgagcaggacggagcaagcgcagaaactgaaccatgggcagctgctgtcccacccgagtgggtccctatcattcagcaagacatacagagccaacggaaagtgaaacctcagcctcctctgtcggacgcctatttgtctggtatgcctgcaaaaaggcgaaagttgagaagcgacatccagaagagactccaagaggatccgaattactctccccaaaggttcccaaacgctcagcgggcttttgccgacgatccctag

SEQ ID NO: 180449 - DNA, 738 bp, Artificial Sequence
  Description of Artificial Sequence: Synthetic coding sequence
cccccccggcacctgcacgtggtgcggcccatgagccactacaccacccccatggtcctgcagcaggcagctattccaatccagatcaatgtaggcaccacagtcacgatgaccggacccgcaccgccccccgccaccagtcacccacgcgtcattaggatctcgcatcaatcagtggagcctgtcgtgatgatgcacatgaacatccaggactctggcacacagcccggtggcgtgccctcagctcccacagggcctctgggtccgcccgggcacggccagacgctggggcagcaggtgcccggcttccccaccgctcccacgcgcgtggttatcgccaggccaactcccccccaggcccgcccgtcccacccggggggcccgcctgtgtcaggtacactgcaaggagccggcctcggaacaaacgccagcctagctcagatggtgagcggactcgtgggccagttgctgatgcaacctgtgcttgtggcacagggaacccccgggatggccccgcctccagctcccgctacggctagcgcttcagccggtactaccaatacggctacaacagctgggccagcacccggaggtccggctcagccccctcctacgccgcaaccctcaatggctgatctccagttctctcagctactggggaatctgctgggacccgccgggcctggtgcagggggcagtggagtggcttctccaaccattactgtggcaatgccatag

SEQ ID NO: 180450 - DNA, 681 bp, Artificial Sequence
  Description of Artificial Sequence: Synthetic coding sequence
tgaagcggcttcggcgcccggctgctggagctgtgcaaccagggcctcttcgagtgcttggccctgaacttgcattgcttgggtgggcagcagatggagctagcagctgtcatcaatggtagaatcagaaggatgagcagaggagtgaatccatccctggtcagctggctgacgaccatgatgggcttgaggctgcaggtcgtattggagcacatgcctgtcggacctgacgctattctgagatatgtgcgcagagtgggcgatccccctcaacccttgcctgaagagcccatggaggttcagggtgcagagcgcgcatcacccgaacctcagagagaaaatgctagccctgcgccggggacaaccgctgaggaagccatgtctaggggtcccccgcctgcacccgagggtggctctagagacgagcaagacggagcatccgccgagactgaaccttgggcagcagccgttcctcccgagtgggtcccgattatccagcaagatattcaatcacagcgaaaagtcaaacctcagcccccactatctgatgcttatctgtcaggtatgcccgctaagcggcgcaagctcagatctgacattcaaaaaagacttcaggaagacccaaattattcaccacaacgattccccaatgctcagagggcgtttgcggacgacccatag

SEQ ID NO: 180451 - DNA, 681 bp, Artificial Sequence
  Description of Artificial Sequence: Synthetic coding sequence
tgaagcggcttcggcgcccggctgctggagctgtgcaaccagggccttttcgaatgcctggctctcaatctccactgtctgggcggacagcagatggaactggctgccgtgattaacgggaggattcggcgaatgagccggggagtcaacccttctctggtgtcatggctgacaaccatgatgggcttgagactgcaggtcgtgctcgaacacatgcctgtcggaccggacgccattttgcgctacgtgcgtcgagttggcgacccgccacagcctctacccgaagaaccaatggaggtccagggtgccgaacgagccagtcctgagccacaacgtgagaacgcatcccctgcacctgggaccaccgcagaggaggctatgagccgtggacctcctcctgcacctgaaggtggcagtcgagacgagcaggatggagccagcgctgaaacagagccttgggccgccgctgtaccgcccgagtgggtgcctattatacagcaggacattcagagccagagaaaggttaagcctcaacctcccctgtcagacgcatacctgtcagggatgcccgccaagcggaggaagcttagatcggatatacagaaaagacttcaggaggaccccaattacagcccccagaggttcccaaacgcccagagagccttcgcagacgacccgtag

SEQ ID NO: 180452 - DNA, 777 bp, Artificial Sequence
  Description of Artificial Sequence: Synthetic coding sequence
atggagcccaacgacagcaccagcaccgccgtggaggagcccgactcactggaggtcctggtgaagactctggattcccagactcggacgttcatagtgggagcccaaatgaacgtgaaagaattcaaggaacatattgctgccagtgtgtctataccctctgagaaacagaggttaatttaccagggtcgggtcctccaagacgacaagaaactccaggagtataatgtagggggaaaagtgatccatctggtagaaagggccccacctcagacacatctgcctagtggcgctagtagtggcacaggttctgcctccgccacacacggaggtggatctcctccgggaacccgcgggcccggtgcttccgtacatgaccgcaatgctaactcctacgttatggtggggaccttcaacctgcccagcgacggctccgccgtagacgttcacatcaatatggagcaggctccaatccagagcgaaccgcgggtgcgactcgtgatggcccaacacatgatcagagatatacagactctgctgtcccggatggagtgccggggagggcctcagcctcaacactcccaaccacccccccagccacccgctgtgacaccggagcccgtggctctgagtagccaaacttcagagccagtcgaaagtgaagcgccacctcgcgagccaatggaggcggaggaagttgaggagcgcgccccagcccagaacccagaactcactcccggccctgcacctgcagggccgactccagcgccagagtag

SEQ ID NO: 180453 - DNA, 411 bp, Artificial Sequence
  Description of Artificial Sequence: Synthetic coding sequence
tgacggatgagccggggcgtgaaccccagcctggtgagctggctgactaccatgatgggcctacgcctgcaagtagttctggaacacatgccggtcggccctgacgccattctgaggtacgtgagacgcgtgggggatccaccccagccgctcccggaagaaccaatggaggtgcagggtgctgagcgcgccagtcccgagccccaggagtgggtgccaattatccagcaggatatccaatcgcagagaaaggtcaaaccgcagccccctctcagtgatgcctatctgagcggcatgccggccaaacgcagaaagttacgttcagatatccagaagaggctacaggaagacccaaattattcacctcaacgattcccaaatgcgcaacgcgcgtttgccgatgacccgtag

SEQ ID NO: 180454 - DNA, 3489 bp, Artificial Sequence
  Description of Artificial Sequence: Synthetic coding sequence
atggagcccaacgacagcaccagcaccgccgtggaggagcccgactctcttgaagtgctcgttaagacattagactctcagactcgaacctttatcgttggtgcccagatgaatgtaaaggagttcaaggagcatattgccgcgagcgtctcaatcccttccgagaaacagcgcctcatatatcaggggcgggttctgcaggacgacaagaagctgcaagaatataatgtgggagggaaagtgattcatctggtcgagcgcgctcctcctcaaacccacctgccgtccggagctagttcaggaacaggaagtgcttcagccacgcacggaggaggatccccgcctgggacaaggggtccaggcgcttccgtgcacgaccgaaacgccaatagctatgtgatggtgggcacatttaaccttccatccgatggctcagccgtggacgtgcatattaatatggagcaggcccccatccagtcagagccccgggtacgccttgttatggctcagcacatgatacgggatatccagaccctgctatccagaatggagtgtaggggcgggccccagcctcagcactcccagccacccccccagccccccgccgtgacccccgagcctgtagccctatcctcgcagacctcagaaccagtggagtccgaagctccaccccgcgaaccaatggaggccgaggaagtggaagagagagcccccgcccagaaccctgagctgacaccagggcccgcaccggctggtccgaccccagctccagaaacaaatgccccaaatcacccctctcccgctgaatacgtggaggtcttacaggagctgcagcgcctcgagtctaggctgcaaccattcctccaaagatactacgaagtcctgggcgctgccgcgactactgattacaacaacaaccacgagggcagagaggaagatcaacgtctgattaacctggtgggcgagtcacttagactcctcggcaacacctttgtggctctgagtgacctgcgctgcaacctcgcctgcaccccccccagacacctgcacgtggtgagaccaatgtctcattacacgacgcccatggtcttgcagcaggctgcaatacctattcagataaatgttgggaccacagtgacaatgaccggaaacggcacgcgacctcccccaactccaaacgctgaagcccccccgccgggccccgggcaggcgtctagtgtggctccctccagcacgaacgtggagtcttccgctgagggagcccctccaccaggacctgctcctccaccagctacgagccacccaagggttattaggattagccatcagagtgtcgagcctgtggtgatgatgcacatgaatatacaggattctggcactcagccagggggtgtaccgtctgctcctacaggccctttggggccaccaggtcacggccagacactcggctcaaccctgattcagcttccatcactgcctccagaatttatgcatgctgtggctcaccagatcacccatcaggcgatggtcgcagcagtagcctccgctgctgctgggcagcaggtaccaggatttcctaccgcccctaccagagtggtaatagctcgaccaacccccccccaagccagaccttctcaccctgggggccctccagtgtccggcaccctgcagggcgccggcctgggtacgaacgcaagcttggcccagatggttagcggcttggtcgggcagctgctgatgcagcccgtcctagtcgcccagggcacccctgggatggcgccacctcccgccccagctactgcctctgccagtgcgggtaccaccaacactgccacaaccgccgggccagccccaggcggaccagctcagcctccgcccactccgcaaccctccatggctgacttgcagttcagccaactcctggggaaccttctcggccccgcaggacctggggctgggggacccggagtggccagccccaccatcaccgtggcgatgcctggtgtccccgcatttcttcaaggcatgaccgactttcttcaggcgacccaaactgcccccccaccacccccccctcccccaccccccccccctgcgcccgagcaacagacaatgccccctccgggttccccctcgggtggcgccgggagccctggagggctgggcttagagtcactcagccctgaattttttacatccgtggtgcagggcgtcttgtcatccctccttggctctcttggtgccagggccggcagcagcgagtcaatagctgcgttcatacagagactgtccggatcatccaatattttcgagcccggcgctgatggggcgctgggttttttcggggccctgttatccctcttgtgtcagaacttctcaatggtcgatgttgtaatgctgctccacggccatttccagcctctgcaacgcctgcagccccagctgcgttccttctttcaccagcattacctgggtggacaggaaccaacgccgagcaacattcgcatggctacccacaccctgatcaccggactggaggagtacgtgcgtgaatccttctcactcgttcaggtacagccaggtgtggatatcatccggacgaacctcgagtttttacaagaacagttcaactctatcgccgcccacgtgctgcactgtactgattccgggttcggcgcccgactactggaactttgcaaccagggcttattcgagtgcttggctctgaatcttcattgtctgggcggtcagcagatggagctggctgcagtcatcaatggccgaatcagaagaatgagtcggggggtaaatccctctttggtctcttggctgaccactatgatgggactaagacttcaagttgtgcttgagcatatgcccgttgggcctgacgctatactgcggtatgtgcgtcgggtgggcgaccctccccagcctctgccggaagaacccatggaggtgcagggcgcagaaagggcttcaccggaaccccagagggagaatgcaagtcccgcccctggtacaactgcagaggaagcaatgagccggggcccaccgccggcccccgaaggcggaagcagggatgagcaggatggggcaagtgccgaaacagaaccatgggccgcagcggtaccacctgagtgggtgccgatcatccaacaggatattcagagtcaacgtaaggtaaagccccagcctcccctgtcggatgcatatctaagcggaatgcccgctaaaaggaggaagactatgcaaggcgagggtcctcagctgcttctttccgaggccgtgagtcgggctgcaaaggccgctggcgcaagaccgttgacctccccggagtcactttcacgcgatctcgaggcccctgaagttcaagagagttaccggcagcagttgcggtctgatattcaaaagcggctgcaagaagatccaaattactctccacagcgatttccgaatgcccagagagcctttgccgacgacccctag

SEQ ID NO: 180455 - DNA, 2712 bp, Artificial Sequence
  Description of Artificial Sequence: Synthetic coding sequence
atggagcccaacgacagcaccagcaccgccgtggaggagcccgactccctagaagtgctggtgaagaccctagactcccagactcgaacattcatcgtgggcgcacagatgaacgtcaaggagttcaaagagcacattgctgcctcggtcagcatcccctctgagaagcagcgactcatctatcagggccgtgtgctccaggacgataaaaaactgcaagaatacaacgtcggtggcaaggtgatacatctagttgagcgagcaccgccacagactcacctgccgtctggagcctcctctggcactgggtctgccagcgctacacacgggggagggtcaccaccgggcactaggggacccggagcatcagtgcatgaccgcaacgccaatagctatgtgatggtaggtactttcaacctccccagcgatgggtcagccgtcgacgttcatatcaacatggagcaggcccccattcaatctgagcctcgcgtgagattagttatggcacaacacatgatccgagacattcagaccctcctgtcgagaatggaatgcaggggcgggccacagccacaacattcccagccacctccacagccccccgctgttactcctgaacccgtggcactctcttctcagactagtgaaccggtggagagtgaagcccctccccgagagccaatggaagcggaggaggttgaagagagggctcctgctcagaatccagaactgacccccgggccagcgccagccggacctacacccgcccccgagactaacgcccctaatcacccttcaccagcggagtacgtggaggtgctgcaggagctccagcgtctagaatctcggcttcaaccattcctacagaggtactatgaggtgctcggagctgccgccaccacggactataataacaatcatgaaggccgtgaggaggatcagcggctgatcaatttggtcggggagagtcttagactcttgggcaacacttttgtcgccctatccgatctacgctgtaacctggcctgtacccccccacggcatcttcacgttgttcgtcccatgtctcactatacaacgcccatggttttacagcaggcagccatccctatccaaattaacgtggggacaacggtcactatgactggaaatggcacgagaccgccccccacacccaatgctgaggcccctccaccaggtcctggccaggctagctctgtagctccgagttccaccaatgtggagtcgagcgccgaaggcgccccaccgcccggccctgctccacctcctgccacttcccacccccgggtgatcaggatctcccaccagtcagtggagccagtggttatgatgcacatgaacatccaggactccgggacccagcctggcggcgttccaagcgcccctaccgggcccctgggcccacctggacacggccagacacttgggcagcaggtcccaggttttcctaccgcccctactagggtcgtgatagcaaggcccacacctccccaggcacgtccatcccatcccgggggccctccagtatctgggacacttggcgccggtcttgggacaaacgcgagcctggctcagatggtttccggcctcgtgggtcagctcctgatgcagcccgtgctggtcgcgcagggcaccccaggtagcccagggggattggggctggaaagtctgtcaccggagtttttcaccagcgtggttcagggagtcctgtccagtctgctgggttctctcggagctagagcaggcagctcagagtcaattgctgcttttatccagaggctgtctggaagctcaaacatctttgagcccggggccgacggagcacttggtttcttcggggccctcctgtcattactgtgtcagaacttcagcatggtagacgtggttatgctgctgcacggccacttccaaccacttcagcgcctacagccgcagctgaggagcttctttcaccagcactatcttgggggtcaagaacccacaccctcaaacatcaggatggcaactcacaccctcattacaggactggaagagtacgttagggaaagctttagtctggtccaagtccagcccggcgtggacataatcagaacaaacttggagtttctccaggagcagttcaactctatcgctgctcacgtactgcactgtacagatagcggttttggcgcacgcttacttgaactctgcaatcagggactgttcgagtgcctggccttgaatttgcattgcctgggagggcagcagatggaactcgccgcagtgatcaatgggcgtatcaggcgcatgtcgagaggtgtcaacccctcgctcgtctcctggctaacgacaatgatgggacttagactccaagtagtgctggaacacatgccggtcggccctgatgccattttgcggtacgtgcggcgcgtaggcgacccaccacaaccattacccgaagagccaatggaagtgcagggggccgaacgtgcatcaccagaaccccaggaatgggtgcccattattcaacaagacatccagtcgcagcgcaaggtgaaacctcagccccctctgtcggacgcctacctttcaggcatgcctgccaaaaggcgaaaattacggtccgacatacagaagcgcttgcaggaagatcctaactactctccccagcgcttccccaacgcacaaagggcgttcgccgacgatccttag

SEQ ID NO: 180456 - DNA, 2712 bp, Artificial Sequence
  Description of Artificial Sequence: Synthetic coding sequence
atggagcccaacgacagcaccagcaccgccgtggaggagcccgacagcctcgaggtcctcgtaaaaaccctcgactcacagacaaggactttcattgtcggagcccagatgaacgtcaaagaatttaaggaacatatcgcggcttctgtctctattccatctgaaaaacagcgcttaatctatcagggccgggtgctgcaggatgataaaaagctgcaggagtataatgttggtggaaaagtgatccatttggtggagagagctccaccacagacccacctaccgtctggcgccagctctgggacaggatcagcttccgccacgcacggcgggggctccccaccagggacccgcggccctggagcctccgtgcatgatcgcaatgctaatagctacgtgatggtgggaaccttcaacttgccttcagatgggagtgccgtcgacgtccatattaatatggaacaagcccctattcagtcagagccaagggttcgcctggttatggcccaacacatgatccgagacatacaaacattattatcgcgtatggagtgtagggggggtccacagccccagcactcccagcccccacctcagccaccagccgtgacacctgagcccgtggccctgagttctcagacgtccgagccagtagagagcgaggcccctccccgggagccgatggaggccgaagaggttgaagagcgcgccccagcccagaaccctgagctcaccccaggccccgcacctgccggtcccacaccagcccccgagaccaacgcccccaatcaccccagcccagcggaatacgtggaggtcttacaagagctgcaaagattggaatcgagactgcagccctttcttcagagatactatgaggtgctcggcgctgccgccactacagattataataacaatcacgaaggacgagaggaggaccagaggctcattaatcttgttggcgaatcattacggttgcttgggaatacctttgtggctctgagcgacctaaggtgtaaccttgcttgtacacctcctcggcacctgcacgtggttaggcccatgagccattacaccactcctatggtgctgcagcaggccgcgattccaatccagattaacgtgggcacaacagttacaatgacagggaacggtaccaggcctccaccaacacctaacgcagaggcaccacccccaggcccgggtcaggcttcttctgtcgcccctagcagcaccaacgtggagagctctgcagaaggcgctcccccaccagggccagccccaccgcctgctacctcccatcctcgcgtcatccgtattagccatcagtcagtggagcccgtggtaatgatgcatatgaatattcaggattccggtacccagcctggaggagtgcccagtgctcctacgggaccacttgggccaccaggtcacggtcagacactagggcagcaggtgcccggcttcccaactgccccgactcgcgtggtcatcgcaaggccgacaccaccccaggcccggccaagtcaccctggcggccctccggtgtccggaacactaggggctgggttaggtaccaatgcgtctctcgcccagatggtttcaggcctcgtcggacaactgctcatgcaacccgttctcgtggcacaggggacccctggctcccccggcggactagggctcgagtccctttcccccgagttcttcacatctgtggtccaaggcgtgcttagttcactcctgggctctctcggtgccagagcagggtccagtgagtccatcgctgcatttatccagcggctgtccgggtcttccaatatttttgaaccgggtgcagatggtgctctgggattttttggggccctgttgtctttgctctgccagaattttagcatggtggacgtagtaatgctgctccatggccatttccagccacttcagcgtctgcagcctcagctgaggtccttctttcaccagcactacctgggagggcaggaaccaacgccaagcaatatccgcatggccacccataccctgattactggcttggaagaatacgtccgagaaagcttttctcttgtccaggtgcagcccggggttgatattatacgtacaaacctggagtttctgcaggaacagttcaattccattgcagcacatgtcctgcattgtacagattccggatttggtgctaggctcctggagctctgcaaccaaggactcttcgaatgtcttgctttgaatcttcactgcctcggcgggcagcagatggaactggcggcagtgattaatggacggatacggaggatgtcaaggggggtgaatcccagtctcgtgtcctggctcaccaccatgatgggtcttaggctgcaagtggtcctggagcatatgcctgttggtccagacgcaatcctgcgatatgtgcgccgggtgggagatccacctcaaccattgccggaggagccgatggaggttcagggagccgagagggcctctccagagccacaggaatgggtgcctatcatccagcaggacatccaatctcagcgaaaagtcaagccccagcctcctttgtccgatgcatatctgtccggcatgccagctaagaggaggaaactccggtcggatattcagaagcggctccaggaagacccgaactatagccctcagcgattccccaatgctcagagggccttcgcagatgatccctag

SEQ ID NO: 180457 - DNA, 3234 bp, Artificial Sequence
  Description of Artificial Sequence: Synthetic coding sequence
atggagcccaacgacagcaccagcaccgccgtggaggagcccgactccctggaagtactggtcaagacattggattcccagacccggacgtttatagtgggcgctcagatgaacgtgaaagaattcaaggagcatattgccgcatcagtgtcaattccttcggaaaagcagagattgatctaccagggacgcgtgctgcaggacgacaaaaagctgcaagagtacaatgtggggggcaaagtgatacacctcgtggaaagggctcctccacagactcacctgccttctggcgcttcctcaggcacgggttcagcttctgccacacatggcggcggctcccccccaggtacccgcggccctggcgcatccgtccacgacaggaatgccaattcttatgtgatggttggaacattcaacttgccctccgacggctcagccgttgacgtgcacattaatatggagcaggctcccattcagtcggagccaagagttcgcctggttatggcccagcatatgataagagatatccagacactgctatcacggatggagtgtcggggggggcctcagcctcagcattcccagcctcctccacaaccccctgctgtgacaccagaaccggtcgctctctctagccagacgagcgagcccgtggaatccgaggctccgcccagggaacctatggaggccgaagaggtagaggagcgggccccggctcagaatccagagcttacacccggtcccgcccctgcaggaccaacgccagcccctgagaccaatgcgccaaaccatccgagtcctgccgagtatgtggaggtgctccaggagctgcagcgactcgagagtcgtctccagccatttttgcagcgctattatgaagttttgggagctgcagccacaactgactataacaataaccatgaaggacgcgaagaagaccagcgactgatcaacctggttggagagagtctgagactactgggcaatacgtttgttgccctttccgatttaaggtgtaatttggcatgtacgcctcctagacacctgcacgtggtgcgacctatgtcccactacacgacaccgatggtactccagcaggctgcaattcccatccagataaatgtgggaactactgttactatgaccggaaacggcaccagaccacctccaacccctaacgccgaggcaccgccccccggaccggggcaggcttccagtgtggcccccagttccacgaatgtggagtcttctgccgagggtgcccccccacccggaccagccccaccccccgccacaagccacccccgcgtaatcagaattagtcaccagtctgttgagcctgtggtgatgatgcatatgaatatacaggattctggcacgcagcccgggggtgtccccagtgcccctacaggtcccctaggcccaccgggccatggccagacactggggcaacaggtgcctggattcccaacagctcccacccgagtggttatagctagacctaccccacctcaggctaggccatctcaccccggagggccacccgtctctgggacacttcagggggctggcctaggaaccaacgcctccctggcacaaatggtgtcagggctcgtgggacaacttctaatgcaaccagtcctcgtcgcccaggggacccctggaatggcaccaccgcccgctccggcaacggcctcagcctctgcaggaaccacgaacaccgcaaccactgctggacctgctcctggggggccagcacaaccccctcctaccccgcagccatctatggccgatctgcaattctcacaactgctgggaaacctgctcggccctgcaggcccaggcgccggaggctccggagttgctagcccgacgatcacagtggcgatgcctggtgtgcccgcctttctgcaagggatgactgacttcctgcaggcaacccagaccgcccccccccctccacccccccccccacccccaccacccgcgcccgaacagcaaaccatgcctccaccaggaagcccatccggcggtgctggctcacctggcggtctcgggctcgagtctctgtcacccgagttttttacatctgtggtgcaaggggttctctcctcacttctgggcagcctcggagccagagcaggcagttctgagtccattgcagcttttattcagagactttcaggttcaagtaatatctttgagccgggggccgatggggccctgggtttcttcggtgctctcctcagcttgttatgtcagaacttctccatggtggacgtagtgatgttactgcacggccattttcagccacttcagagattacagccacagcttagatctttctttcatcagcattatctcggggggcaggaacctactcccagcaatattcgtatggccacccataccctgataacaggactggaagagtatgtgagagagagcttcagtttggtccaagtacagcccggcgtggatatcatccgtactaatctggagttcctccaggagcagtttaactctatcgcggcccacgttcttcattgtactgacagcggctttggtgctcgcttactcgagctgtgcaatcagggcctcttcgagtgtctggccttgaatctgcactgtctgggcggccagcaaatggaactcgccgcggttattaacggccggatccgtaggatgagccgaggcgttaatcctagcctcgtatcctggctgactaccatgatgggcttgcgtctgcaggttgtcctggaacatatgcccgttggaccggacgctatcctacggtatgtgcgacgcgtcggtgaccctccccagcctctccccgaggagccaatggaagttcaaggggccgaacgggcgtctccggagccccagcgggaaaacgcttcccccgctcccggcactacagccgaggaggcaatgagtcgaggaccaccaccagctcctgagggagggtctagagacgaacaggatggtgctagcgcagaaacagagccctgggctgctgccgtgccccccgagtgggtacccattatccaacaagatattcagagccagcgaaaggtgaaacctcagccccctttatctgatgcctatctctctggcatgcctgccaaaaggcgaaaactgcgctctgatatccagaagcggcttcaagaagacccaaactactcccctcagagatttccaaacgcacagcgagctttcgctgacgatccgtag

SEQ ID NO: 180458 - DNA, 3234 bp, Artificial Sequence
  Description of Artificial Sequence: Synthetic coding sequence
atggagcccaacgacagcaccagcaccgccgtggaggagcccgactccttggaagttctggtgaagactctcgactcacaaacaagaactttcatcgtgggagcccagatgaatgtgaaggagtttaaggaacacattgccgcctccgtatcgataccgtcagaaaaacagcggctgatataccagggccgggtcctgcaggacgacaagaaactacaggaatacaatgtcggaggcaaagtcatacacctcgttgagagggcccctccgcagacccatcttccctcgggggcgagctctgggactgggagcgcctctgcaacacatggaggtggttctccaccaggcactaggggacctggggccagcgtccacgatcggaatgcgaattcctacgtcatggtcgggacattcaatttaccttccgatgggtccgccgtcgatgtgcatatcaatatggagcaagccccaatacaatccgagccaagagtgagactggtgatggctcagcatatgattcgggacatccagactctactgtcacgcatggagtgtcgtggaggaccacagccgcagcatagccagcctccgcctcaaccccctgcggtgacacctgagccggtcgcactatcttcccagacgtctgaaccggtggagagcgaggcccctcccagggaacccatggaagcagaggaggttgaagaaagggcgccggcccagaatccagagctaactccagggcctgccccggccggacccacaccagctcctgagacaaatgctcccaaccatccttcacccgccgagtacgtggaagtgttgcaagagctccagcggctggagtccagattacaacccttccttcaacgctactatgaggtcctcggcgccgcggcaacgaccgactataacaataaccacgagggccgtgaagaggaccagcgtctgattaatttggtgggtgaatctcttagactgttgggcaatacattcgtagctctctcggatctcagatgcaatctcgcttgcactccacctagacatctgcatgtggtgagacccatgtcacactacaccacacctatggtgcttcagcaggccgcgatacccatccagataaatgttgggacaacggtgacaatgaccggtaatggaaccagacctcctcccactcccaatgcagaagcgcccccccccggcccaggacaggcatcttcagtggctccttccagcacaaatgtggaatcctcggctgaaggcgcacctccccccggccccgccccaccacctgcgaccagccatccacgggttattcgcatctcccatcagtccgtggaacccgtggttatgatgcacatgaacatacaggacagtggcacccagccgggaggggtgccttccgcccctaccggcccactggggccgcccgggcacggacagacccttggacaacaagtgcccggctttccgacagctcctacgcgtgtagtgatcgcccgtcccacaccacctcaggctagaccaagccaccccggcggcccaccagtatcaggcactcttcagggcgcaggtctcggaaccaacgcctcccttgctcagatggtcagcggtttggtcggccagctgctaatgcagccagtgctggttgcccagggtactcccggaatggcaccaccaccggctccagcaactgcctccgcctccgccggtactacgaataccgctaccacggccggccctgcccctggaggaccagctcagccccctcctacccctcagccatccatggccgacctccagttttctcagcttcttggtaatctcttggggcctgctggccctggcgctggaggtcctggcgtggcctcacctacaattactgtcgccatgcccggcgtcccagcttttctgcagggcatgacagacttcctccaggccacccaaaccgcccctccacctcccccccctccaccgccgcctccaccggcgcccgagcagcagacaatgcctccacccggctcccccagtgggggcgccggatccccgggaggcttgggtttagagagcctgagtcctgagttttttacgagcgtcgttcagggagtgctgtcaagcctgctgggctctttgggggccagggccgggtcctccgaatcaatcgcggcctttatacagagactttcaggctcatccaatatcttcgagccaggggctgatggcgcattggggttcttcggcgctctgctgtcgctgttgtgtcagaattttagtatggtggatgtggttatgctcctccacggccacttccagccactgcaaagactccagcctcagctcaggtctttcttccatcagcattatctcggcgggcaggagccaactccgtctaacatcaggatggcaacccatacactcataacaggtcttgaggagtacgtgcgggagtccttctcactggttcaggttcagcctggcgtggatatcataagaacaaatctggagttcctacaggagcagttcaacagtattgcagcccatgtgcttcactgcactgatagcggatttggcgccagactgctggaactgtgcaatcaggggctgttcgagtgccttgcactgaacctccactgcctgggcggccaacaaatggaactggccgctgtgatcaatggcagaatccgcaggatgagcagaggagtcaacccgagccttgtcagttggttgaccactatgatgggtctcaggctccaggtggtgctggaacacatgccagtgggtcccgatgctatcttgcggtacgttcgacgagtgggcgaccccccacagcccctgcctgaagagccaatggaggtgcagggtgccgagcgagcctcgccagagccccagcgggaaaatgccagcccagcccctggaaccaccgccgaggaggcaatgagccgtgggcctccacctgccccagaaggtggatcacgtgacgagcaggacggcgcaagtgccgagactgaaccttgggctgccgccgttccacctgagtgggtgcccatcattcagcaagatatccagagtcagagaaaggtgaagcctcagcctcctcttagtgacgcttatctgtctgggatgcctgctaaacgcagaaaactccgttcggatatccagaaacgcttgcaagaagatcccaactactctccacagcgctttcctaatgcacagcgggcctttgcagatgacccctag

SEQ ID NO: 180459 - DNA, 3489 bp, Artificial Sequence
  Description of Artificial Sequence: Synthetic coding sequence
atggagcccaacgacagcaccagcaccgccgtggaggagcccgactcactcgaggtgctcgtcaaaactctcgattcccaaacaagaacgtttattgtgggcgcgcagatgaatgtcaaggagttcaaggagcatatcgccgctagtgtttccatcccttcagagaaacagcgcctgatctatcaggggcgggtgcttcaggatgataagaaattgcaggagtacaatgtcggcggtaaagtgattcaccttgtagaacgggccccacctcaaacacacctcccctccggggcttcaagcggaacaggttctgctagtgccacacatggaggcggaagtcctcccggcactcggggacccggggcctccgtccatgatcgcaacgccaacagttacgtgatggtgggaaccttcaatttacccagcgatggctctgcagttgacgttcacattaacatggagcaggctccaatccagtcggaaccgagagtcaggctggtgatggcacagcatatgatccgggatatccagaccctgctgtcgcgcatggaatgtcgcggaggtccacagccccaacattcgcagccacctccccaacctccagctgtcacacccgaacctgttgcactgtcgagccagacaagtgagcccgtggagagcgaggccccccctcgcgagccaatggaagcagaggaggtagaggagagggcgccggcccagaatcccgagctgacacccggcccagctccagccggtcccactccggcccccgagaccaatgcaccgaatcacccctcacctgcagagtacgtcgaagtgctgcaggagctccaacggcttgaatcccgcctccagcccttcctacagagatattacgaagtgctaggggccgcagcaacaacagattataataacaaccacgagggtagggaggaagaccagcgcctcattaatctggtcggcgaaagcctgagattacttgggaatactttcgtggccctgtctgatcttagatgtaacctggcatgcacccctccaaggcacttgcacgtggttcgcccgatgtcccattataccactcctatggtattgcagcaggcagccatccccattcaaattaatgtgggaacaactgttaccatgaccgggaacggtacgagacctccacctacgcccaatgcggaggccccacccccagggcccggacaagctagctctgtggctccatcttccactaacgtggaatcaagcgccgaaggcgctccaccccccgggcctgcccctcctccagctaccagtcaccctcgcgtaataaggataagccatcaaagcgtcgagcctgtcgttatgatgcacatgaatatacaggattcgggtacacagccgggcggggtgccctccgctccaaccgggccccttggtcctcctggccacggccaaactctgggcagcacacttatacaactgcctagcctgcccccagagtttatgcacgccgtggcccaccagatcacgcaccaggctatggtggcagctgtggctagtgccgctgccgggcaacaggtcccgggcttccctaccgcgccgacccgggtggtgattgcccgcccaactccgcctcaggcgcggccatctcatcctggaggtccgccggtcagcggaaccttgcagggcgccggcctcggaactaatgccagcctagcccagatggtgtcaggactcgtgggacaattgctcatgcagccggttctggtcgcacaggggacacctggcatggcgccgccccctgctccagctaccgcatcagcctcagcagggacaactaacaccgccacaactgctggaccggctcccggaggacccgcgcagccccctcccacacctcagccatccatggctgacctgcagttttctcagctgttagggaatttattaggaccagcaggacccggagcaggtggacccggtgtggccagcccaacgattacggttgccatgccaggagtgccagcctttctccaggggatgactgacttcctacaggctacgcagaccgcccccccaccaccaccccctcctcccccacctccccctgcccctgaacaacagaccatgccacccccaggttcccccagcggcggggctggatccccaggaggactgggactcgaatccctgagccctgagttctttacgtccgtggtccaaggggtgctcagttctttgctaggctctcttggagctcgtgccggaagtagtgagtcaatagccgcattcatccagcgcctaagtggctcatccaacatctttgagcccggcgccgacggcgccctgggtttctttggggcactcctctcgctattgtgtcagaacttctctatggtggacgtagtcatgctcctccacggccacttccagcctttacaacgccttcagcctcagcttagatctttttttcaccagcattatctgggcggacaagagccaactccatccaacattagaatggccacacatacccttattacgggtctcgaggaatacgtacgggagtcttttagcctggtgcaagtacagccaggagtggacattattcggactaatctagaattcctccaggaacagttcaactccattgctgcgcacgtgctccactgtaccgatagcggtttcggcgcccggctcctggagctttgcaaccaagggctctttgagtgtttagctctgaatctccattgcctgggcggccagcagatggaactggctgccgtaatcaatggaaggattcggcgtatgagcagaggggtcaatcctagcctagtgagttggttgaccactatgatggggttacggctgcaggtcgtcctggagcatatgcctgttgggccagacgctatcttgcgctacgtgcggagggtcggtgatccccctcaacccctgcctgaagaaccaatggaggttcagggcgccgagagggcctctcccgagccgcagcgcgaaaatgctagccccgcaccaggcactacagccgaggaagctatgagtcgcgggcctccccctgcacccgagggcgggtcccgcgacgaacaggacggcgctagtgccgagactgagccgtgggccgcagctgttcctccagaatgggtcccaattatccagcaggatatccaaagccaacgcaaggtcaaacctcagcccccactgtccgacgcatacctttctggtatgcccgccaagaggcgcaaaaccatgcaaggcgaagggccacagttactcctttcagaagcagtgagccgggctgcgaaagcagcaggtgccagacctctgacttcaccagagtccctctcaagagatttggaagcgccggaagtgcaagagagttacaggcagcaactgcgctccgatatccaaaagagactacaggaagaccccaactactcaccacagcgatttccgaatgcccagcgcgcatttgccgatgacccctag

SEQ ID NO: 180460 - DNA, 3234 bp, Artificial Sequence
  Description of Artificial Sequence: Synthetic coding sequence
atggagcccaacgacagcaccagcaccgccgtggaggagcccgactctttagaagtactcgtgaagacactggacagtcagacaaggacgttcatcgtcggcgctcagatgaatgtcaaggaattcaaggaacatatcgccgcatccgtctctattcccagtgaaaagcagaggctgatctatcagggtagagtcctgcaggacgacaaaaagctccaggagtacaatgtcggcgggaaagtaattcacctggttgagagggctccccctcaaacccaccttccaagcggtgcctcctccggcaccggctcagctagcgcgactcatggcggtgggtccccgcccgggacacgcgggcccggcgcaagcgttcatgaccggaacgccaattcatacgtcatggtaggcacatttaaccttccttcagatggctccgccgtcgatgtccatataaacatggagcaggcgcccatccagtccgagcctagagttagactggtgatggcgcaacacatgatccgggacatccagaccctcctaagccggatggagtgtcgggggggcccacagccgcagcactcccagccccccccacagcctccagctgtgactcctgaaccagtggcgctgagctcacagacatcagaacccgtcgaaagtgaagccccccccagagaacctatggaggctgaggaggtggaggagcgcgccccggcacagaatcctgagctcacacccggcccggctcctgcggggccgaccccagctcctgagaccaacgctcccaaccacccctctccggcggagtatgtggaggtgctgcaagagcttcagagacttgaatcccggctgcaaccatttctgcagcgatattatgaggttttgggcgccgccgcaaccacagactataacaacaaccacgagggtcgcgaggaggaccagagactgataaatttggtgggagagtctctgcgacttctggggaatacttttgtagctctgtccgatctcagatgcaatctagcctgtacacccccccggcacctacatgtagtcaggcccatgtcccattataccacgcctatggtgcttcagcaggccgccattccgatccaaatcaatgtgggcactactgtcacaatgaccggaaacggcacgcgccctcccccgaccccaaatgctgaggcaccccctcctggccccggccaggcttcctccgtggctccctcttcaaccaatgttgagtcaagcgccgaaggagccccaccccctggcccggcgccccctcccgcaacatctcaccctcgtgtcatcagaattagccaccagagcgtggagcctgtggtgatgatgcacatgaacatccaggactccggaacgcaacccggcggggtgccgagtgcaccaactgggccgctcggtccacccggccacggacagactctaggccagcaggtgcctggcttccctaccgcccctacgagggtggtgatagctcgccctaccccaccccaggcacgcccctcccaccccggcggacccccggtgtccgggacactgcaaggtgcgggcttaggaaccaacgcctcactggcacaaatggtcagcggtctggtgggacagttgctgatgcaacctgtgctcgttgcccaggggacccccggcatggctccccctccggcccccgccaccgccagcgcctccgctggaactaccaataccgccaccacagctggccctgcgccaggcggcccagctcagcctccgcctacacctcagccctccatggctgaccttcagttttcacaattgcttggcaatttactgggccccgcgggtcccggggctgggggatcaggggttgccagtcccacgattaccgtcgcgatgcctggagtgcctgcatttctccaagggatgacagatttcttgcaggccacacagacggctccacctccacctcctcctccccctccaccgcccccagcccccgagcagcagaccatgcctccccctggaagcccttctggaggggctgggtctccaggcggactggggttagaaagtctgtcccccgagtttttcacgtctgtggtacagggagttctgagcagcctgttggggtccctgggagccagagccggatcttccgagtccattgcggccttcattcagcgcctgagcgggagctccaacatattcgagcccggggccgacggcgccttggggtttttcggggcccttctgtccctgttgtgccaaaatttctccatggtcgacgtagtgatgctgctgcacggccacttccagccactgcaaagattgcagccacagctgcgaagctttttccatcagcattatttaggcgggcaggagcccacaccaagcaacattcgaatggcgacccacaccctcatcaccgggcttgaggaatacgtccgggagtccttcagtctggtgcaggtgcaacctggcgtggatatcatacgcactaatctggagtttttgcaggagcagttcaatagtattgctgcccatgtgctgcactgcactgacagcggctttggagctagattgctggagctctgcaatcaaggactctttgaatgcctcgccctcaatctccattgcctcgggggccagcagatggagctggctgcagtgattaatggtaggatcaggcgcatgtcacgaggtgtaaaccctagtttagtgagctggctaacaaccatgatggggctgcgcctgcaagtggtgctcgaacatatgccggtaggtccggatgcaattctgagatacgtgagacgcgttggggacccaccccagcctttaccagaagaacctatggaggtccagggtgctgagagagcctctcccgagccacagagggaaaacgcctcaccagctcctgggaccacggccgaggaagccatgtcccggggccccccccccgcaccggagggcggctctagggatgagcaagacggggccagtgccgaaacagagccgtgggccgcagccgtgcctcctgagtgggtcccaattatccagcaggacattcagtcgcagcgtaaagtaaaaccgcagccccctttgagcgacgcgtacctcagcgggatgcccgctaagagaaggaaactgagatcggatatccaaaaaagactacaggaagaccccaattattcgccgcagcgatttcctaatgcacaacgggccttcgctgacgatccttag

SEQ ID NO: 180461 - DNA, 2712 bp, Artificial Sequence
  Description of Artificial Sequence: Synthetic coding sequence
atggagcccaacgacagcaccagcaccgccgtggaggagcccgactcactggaagtgctggtgaagaccctggactcacagaccagaacctttattgttggggcccaaatgaacgtgaaagaattcaaagagcacatcgcggcatccgtatcgatcccatccgaaaagcagaggttaatctaccaaggccgggtgctgcaggatgataaaaagctgcaggagtataatgtaggaggcaaagtcattcacctcgtcgagcgggcacccccacagactcacttgccaagcggcgcttcctcaggtaccgggtctgcatccgctactcacggtggtggttctccccctggaacccgcggccctggcgctagtgttcatgatcggaacgccaattcctacgtgatggtgggcacatttaacttaccatctgatggtagcgcagtcgatgttcacattaacatggagcaggctcccattcagtctgaacccagagtccggcttgttatggcacagcatatgattagagatatccaaaccctactgtcacggatggagtgtcggggcgggccacagccccagcatagccagcctccaccacaacctccagcagtaacacctgaaccggtggctttatcatcacagacatccgagcccgtggaaagcgaagcccctccccgcgagcccatggaggccgaggaggtggaggagcgagctcccgcccagaaccccgaactgaccccaggccccgctcctgcaggtcctacacctgcacccgaaacaaacgcacccaaccaccccagccccgccgagtacgtggaagtacttcaggagcttcagcggctcgaaagcagactgcagccgttcttgcagaggtactacgaagttttgggcgctgccgctaccacagactacaataataaccatgaggggcgtgaggaagatcaacgcctgataaatttggtcggagaatctcttcgactcctgggcaatacatttgtggccctgtcagatctgcgctgtaatctggcctgtacccctccaaggcacttgcacgtcgtgcggccgatgtcacattatactacacccatggtgctccaacaagcggcaatccctatccagattaacgtggggacgacagtaactatgactgggaacggaacaagacccccccctacgcctaacgcagaggcacccccacctggcccaggtcaggcaagtagcgtggcacctagtagtacaaacgttgaatctagtgcggaaggagctcctccgccagggccagctcctcctcctgctacctcacatcctcgtgtcatacggatctctcaccagtctgtagaacctgtggttatgatgcacatgaacatacaggacagcggcacccagcctgggggcgtgccatctgcaccgaccggccccctgggaccgcccggccacggccagaccttaggacagcaggtgcccgggttccccactgcgcccacccgagtggtaatcgcacggcccactcctccacaggcccggccttctcaccccggcgggccgccagtttccggcacccttggcgctggattggggacgaacgccagcctcgcccaaatggtttctggcctcgttggccagctgcttatgcagcccgtattggtggcacaggggactcctggctctccaggtgggctgggcctggaaagtttgtctcctgagttctttacaagcgtcgtgcagggtgtgttatcatccttactgggatcattaggcgcccgtgcggggtcgagtgagtccatcgccgcattcatccagcgcctgagtggcagttctaatatctttgagcctggcgctgatggtgctttggggtttttcggggcactcttgagcctgctgtgccagaacttctcaatggtagatgtcgtcatgctcctgcacggacacttccaacccctgcagcggcttcaaccgcagctgcggtccttctttcaccagcactatctcgggggacaagagcctacaccttctaacatacggatggctactcatactttgatcaccgggctagaggagtatgtcagagagtccttttcgctggtgcaggtacagccaggcgttgatattatccggaccaacctcgagttcctccaggagcagtttaacagcattgctgcacacgttctgcactgtaccgattcagggttcggtgctcggctgctcgagctatgcaaccaaggcctgttcgaatgcttggcccttaaccttcactgtcttggcggacaacagatggagttggccgctgtgataaatggaagaattcggcggatgagccggggcgtgaacccttccctggtgtcgtggctcaccactatgatggggctaaggctgcaggtagttctcgagcacatgccggtaggcccagacgccatcctgcgttacgtgcgcagggtcggggatccgcctcagccactcccagaggagcctatggaggtccagggtgccgaaagagctagccctgagcctcaggagtgggtaccgatcattcagcaggatattcagtcgcagcggaaagtcaagccccagcctcccctgtccgatgcctacctgtccggcatgccagcaaaaaggaggaagctgcggtctgacatacagaagcggctgcaggaagaccccaattatagcccacagagattccccaatgcacagcgagcgttcgcggacgatccttag

SEQ ID NO: 180462 - DNA, 3489 bp, Artificial Sequence
  Description of Artificial Sequence: Synthetic coding sequence
atggagcccaacgacagcaccagcaccgccgtggaggagcccgactccctggaggtactagttaaaactctggactcacagacgaggacattcatagtcggcgcccagatgaacgttaaggaatttaaggaacacattgcagcatccgtgagcatccccagcgagaagcagaggcttatttatcaagggagagtgttgcaagatgacaaaaaactgcaggagtacaacgtggggggcaaggttattcacctcgttgagcgtgcccccccacagacccatttaccctccggggctagctcaggtacaggctcggccagcgctacacatggcggggggtcaccaccagggacccgcggaccaggggccagcgtgcacgatcggaatgccaactcttatgttatggtcggcacatttaacctgccctccgacggctctgccgtggacgtgcacataaatatggagcaagcaccgattcagagtgaaccacgcgtgaggttggtgatggctcagcacatgatccgcgatattcagacactgctatcaagaatggaatgcagaggtggtccgcaacctcagcacagccagcccccaccgcagcctccggcagtcacaccggagccagtggcgttatcgagtcagactagcgaaccagtggagagcgaggcaccaccgcgcgaaccaatggaggctgaagaggtggaagaacgagcccccgcccagaaccccgaactgacacccggacctgcgccagctggacccacaccagctccagagaccaatgctcctaatcacccttcaccagccgagtacgtcgaggtgctccaggagcttcagcggttggagtctcggctccaaccgttcctccagcgatattacgaggtgcttggggcagccgccacaacggattacaacaacaaccacgaaggcagggaggaggaccagagactcatcaacctggttggggagagtttgcgtctgttgggtaataccttcgtggccttaagcgacctccgatgtaacctcgcttgcacaccacctcgccacctccatgtggtgagaccgatgtcccattatactactcctatggtgctccagcaggcagccatcccgattcagataaatgtggggacaacggtgactatgacaggtaatggcacgaggcctccccctacaccaaatgccgaagctcctcccccgggccccggccaggcctcttctgtcgcccctagcagtaccaacgtcgaatcatccgctgagggcgccccccccccagggcccgcccctccgccggctaccagtcacccccgagtcattagaatcagtcatcaatcggtggaaccagttgttatgatgcatatgaatatacaggattctgggacacagccagggggggttccctctgcccctacaggtcctttgggtccccccggtcatggccaaacgctgggcagcacactgattcagctgcccagcctgccacccgagttcatgcacgccgtcgctcaccagatcacacatcaagcaatggtcgccgccgtcgcgtccgcagctgccggacagcaagtccccggttttcccactgctcccacccgcgtggtcatcgcacggccaactccccctcaagcccggccctctcaccccggcggccctcctgtaagcgggaccctgcagggagcaggcctaggcacaaacgcttccctggcacagatggtgagtggcctggtgggccagctcctcatgcagcctgttctggtggcccaaggtaccccagggatggcacctcccccagctccagcaactgctagcgcctctgccggcaccactaatacagcaacgacagccggcccagccccaggcgggccagcacagcctccccccacacctcagcctagtatggcggacttgcaattctctcagttgctgggcaacttattgggccccgcaggacctggagccggtggctccggagtggccagtcctactattacagtggcaatgcctggtgtgccagccttcctgcaaggtatgaccgactttctacaggccacacagacagcaccccctccccctccacctccacctccccccccacccgcaccggagcagcagactatgccgcctccaggatctccaagcggaggcgccggtagtccgggaggcctgggactcgaaagccttagccccgagttctttacatccgtcgtccaaggagtcctatcttccctcctgggttccttaggggcacgcgcaggatcatcagagtctattgcagcatttattcagagactgtctggctcatctaatatctttgagccgggcgctgatggggctctggggttcttcggggctcttctgtcccttttatgccagaacttttccatggtagatgtcgtcatgttgttacatggtcatttccagccactacaacggctccagccacagctacgaagcttttttcaccaacactacttaggggggcaagaacccactccttccaatatcaggatggcaacacacaccctaatcactgggctagaggagtacgtgagggagagtttcagtctagtgcaggttcagcctggcgtggacattatcaggactaaccttgagtttttgcaggagcagtttaactccatagccgcacatgtactgcactgcacagactccgggttcggagcccgtctgttggaactctgtaaccagggactgttcgagtgcctcgctctcaatttgcactgcctggggggacagcagatggagctagccgccgtcatcaatggccggattcggagaatgtcacggggtgtgaacccctccttagtcagctggctgaccaccatgatggggcttcgcctgcaggtcgtgcttgagcacatgcctgttggaccagacgccattcttcgctatgtgcgccgggtgggggatccaccacaacccttgccggaagaaccaatggaagtccagggagcagagagagcctcacctgagccgcagagagagaacgcatcacccgctcccgggaccacagcagaggaggccatgagtcggggacctccgcctgcacctgaggggggttcaagggatgaacaggatggcgcgagcgccgagactgagccttgggcagccgcagtgccacccgagtgggtgccaatcatacagcaggatatacagtcgcagcgcaaggtcaagccccagcccccgctgagcgatgcctatctatcaggaatgccagctaagcggcggaaaacaatgcagggcgagggaccccagttactgttaagcgaagcagtgagcagagctgccaaggccgccggtgccaggcccctcacctcacccgaaagtctgtccagagacctggaagcaccagaggtccaggagagctacaggcagcagctgcgctcagatatacaaaagcgcttacaggaggatcctaactacagcccgcagcgcttcccaaatgcccagcgcgcttttgcggacgatccctag

SEQ ID NO: 180463 - DNA, 3234 bp, Artificial Sequence
  Description of Artificial Sequence: Synthetic coding sequence
atggagcccaacgacagcaccagcaccgccgtggaggagcccgactccctcgaggtactggtgaagactttagacagccagacccgcaccttcatcgtcggcgcacaaatgaacgttaaggagtttaaagagcatatcgcagcatccgtctcgattcctagtgaaaagcagagactaatttaccaaggccgggtgctgcaggacgacaagaaactccaggagtacaatgtgggcggaaaggtcatccaccttgtggagcgagcaccacctcagactcacctgccttctggcgccagctcaggtaccggaagtgcatctgccactcacggcgggggcagtcctcctgggacacgcggacctggcgcttctgtgcacgatcggaacgccaactcatatgtaatggtgggcacatttaatctccccagtgacggctccgccgtggatgttcacattaatatggagcaagctcccatccagtctgaaccaagggtgagactcgttatggcccagcatatgatacgggatattcagaccctgctgagtaggatggagtgtagaggaggaccacagccacaacactcccagcctccaccacagccacccgcagtgacacctgagccagtcgcactgtccagccagaccagtgagccagtggaaagtgaggcacccccacgagagccaatggaagctgaagaagtcgaggaacgcgcacctgcacagaacccagagttgacgccaggacccgcccccgcgggtcctacacctgctccggagactaatgcgcccaaccaccctagccccgctgaatacgtcgaggtcttacaggagctccaacggctggaatccaggctgcagccgtttctacagcggtactatgaagtcctcggagccgcagccacaaccgattacaacaacaatcatgaaggtcgcgaggaggatcaacgcctgatcaacctagtaggcgagagcctccgcctcctaggtaatacttttgtggctttgtccgaccttcgatgtaatttggcatgcacgccgcctagacacctccatgttgtaaggcctatgtcacattacaccactcccatggtgctccaacaggcagctatcccgattcaaattaacgtggggacaaccgtcaccatgactggtaatggcacaagacctccaccaacacctaatgctgaggcccctcccccgggcccaggtcaggcctcaagtgtggccccaagttcaacgaacgttgaaagcagcgcagagggtgccccccctccaggcccggcccccccacccgccacctctcatcccagggtgatccgcatcagtcatcaatccgtggagcccgttgtgatgatgcacatgaacattcaggattccggaacccagccaggaggggtgccaagcgccccgactggcccactgggcccccccggacacggccaaactctcgggcagcaggtaccaggttttcctaccgcgccgactagagtggtgatagccagacccacccccccccaggctcggccatcacatccagggggccctccggtgtcgggcacccttcaaggcgcagggctgggcacaaacgcaagcctggctcagatggtgtccggactggttggacaattgctaatgcagccagtgctggtggctcaaggcactccgggcatggcccctcctccagcaccagccacagcatcagctagcgcaggaacgacaaatacagcgacaacggccgggccagcgccagggggccccgcccagcctcctccaactccgcaacccagcatggccgacttacagtttagtcagttgcttggaaacctccttgggcctgcgggacccggcgccggtggccccggggtggcatcccctactattacagtggctatgccgggcgtgccagctttcttgcagggaatgactgacttcctgcaggctacccagacagccccacctcctccaccaccacctccaccccctccacccgcccccgagcagcaaaccatgcccccccctgggtcccctagcggtggggccgggtccccaggaggactgggccttgaaagcctctctcctgaattctttacttcagttgttcagggagtactttcttccctgctcggctcactcggggcccgggcaggtagcagcgagtcaattgcggcattcattcagcggctatccggctcctcaaacatcttcgagccaggagctgacggcgctttaggctttttcggagcactactttccctgttgtgccaaaacttcagtatggtagatgtggtgatgctcctccatggccatttccagccactgcagcgtttacaaccgcagctgcgcagcttcttccatcagcactatctgggcggccaagagccaactccgtccaacattaggatggcaacacacactctaatcacgggactggaagagtatgtccgggagtcttttagtcttgtgcaagttcagccaggggttgacatcatacgcaccaatttggagttccttcaagagcagtttaatagcatcgctgcccacgtcctccattgtactgatagcggtttcggcgctcgcctgctggaactctgtaatcagggactgttcgaatgcctggctttgaatttgcactgtcttgggggccagcagatggagctggccgctgtaatcaacgggagaattcggagaatgtcaaggggagtgaatccaagcctggtgagttggttgactactatgatgggactcaggctgcaggtggtgctggaacatatgcccgtcggcccggatgccattctgagatacgtgcgcagggttggtgatccacctcagcctctcccagaagaaccaatggaagtgcagggagccgagcgcgcttcacctgaacctcagcgcgaaaacgcctcacccgctcctggaaccaccgcagaggaagccatgtcaagaggccctccacccgccccggagggcgggagccgcgatgaacaggacggtgcttctgcagagaccgagccttgggcagctgctgtgcccccggagtgggttcccatcattcagcaggatatccagagccagagaaaggtgaaaccacagccccccttgagcgacgcctatctgtcaggcatgccagccaaaaggcggaagttgaggtctgacattcagaagcgtctccaggaggaccctaattattccccgcaacgattcccgaatgcccaaagggcgttcgctgatgacccatag

SEQ ID NO: 180464 - DNA, 2712 bp, Artificial Sequence
  Description of Artificial Sequence: Synthetic coding sequence
atggagcccaacgacagcaccagcaccgccgtggaggagcccgacagtctggaggtgctggtgaaaactctggactcccagactcgaacatttattgtgggggcacagatgaacgtgaaggagttcaaggagcatatcgccgcgtctgtgtctataccaagtgagaaacagcgactaatctaccagggcagagtgttacaggatgataagaagctacaggaatataacgtcggcggaaaggtgatccatctggtcgaaagagctcccccacagacccatttgccatcaggagcttcctccggaacagggagtgcaagcgctacgcatggaggcgggtcccctcctggtacgcgcgggcccggtgccagtgtgcatgatcgcaatgctaacagctatgtcatggttggtactttcaacctcccctcagacggatcagcagtcgatgttcacatcaatatggaacaggccccaatccagtccgaacctagggtgcgtttggttatggctcaacatatgattagggatatccaaactctactcagtcgcatggagtgcaggggtggccctcagccccaacacagtcagccaccgcctcagccaccggcagtcacacccgagccagtggctttgtccagccaaacttctgagcccgtcgaatctgaagccccgccgcgggaaccaatggaagctgaggaggtggaggagcgggctcccgctcaaaacccggagttaacacccggacctgcacccgctggcccgacacctgctccggagactaacgcgcctaaccacccatcccccgctgagtatgtggaggtgctgcaggaacttcagcgtctggagtccaggctgcaacccttcttgcaacggtattacgaagttttaggagcagcagctactactgattacaacaacaaccacgagggcagggaggaagatcagcggctaatcaatctggtgggggagtctctgagacttctggggaacacctttgttgcgctcagtgaccttcggtgcaatttggcttgtacacctccacggcatcttcatgtggtccgcccaatgtcacactataccacccccatggtgctgcagcaggcggctatccccatccagataaatgtcgggactacagtgaccatgacgggcaacggtacacgaccacctcctacccctaatgccgaggcacccccacctggccccggacaggcatcctctgtagctccttctagtactaatgttgagtcttcggccgagggagctccaccaccaggacctgcaccaccccccgccacttcacacccacgcgttattcgaatttcccaccagagcgtggagcccgtagtgatgatgcatatgaatattcaggattcaggcactcagcctggaggggtaccttccgctcctaccgggccactgggcccacctggccacggacagaccttgggacagcaggtgcctggtttccctactgcccctactagggtagtaattgctcgtcccacgcccccccaggccagaccttcccatcctgggggtccaccagtcagtgggacccttggggccgggctcggcacaaatgccagtttagcccagatggtatccggtctagtcggacagctccttatgcagcccgtcttggtcgctcagggtacacccgggtctcccggcggtctgggcctcgagagtctttcccccgaattttttacttcagtggttcagggggtcctctcttctctgctcgggtcccttggtgctcgcgcgggaagctctgaatccattgccgcctttatccagcgcctgagcggatccagcaatatcttcgagcctggcgcagacggagctctgggctttttcggggcactcctcagtctcctgtgccagaatttcagcatggttgatgttgtgatgttgctgcacggccattttcagcccctgcagcggctccaaccgcagttacggagcttttttcaccagcactacctcgggggacaggagcccaccccgtcaaatatccgtatggccacacataccctgatcacaggcctggaggaatacgtgcgggaaagctttagcctggttcaagtacagcccggtgtggacattattaggacaaatctggagtttctacaggaacagttcaattcaatcgctgcacacgtgctacattgtactgactcagggttcggagcccgacttctggaactatgcaatcagggattgttcgaatgcttagcacttaacctgcactgcctgggaggtcagcaaatggaattagccgccgtgatcaacggcagaataaggcgaatgtcccggggcgtaaatccttctcttgtatcatggctcaccacaatgatgggcctgcgactccaggtggtgttggagcacatgcctgtggggcctgatgccatcctgaggtatgtgcgtcgggtaggagacccacctcaacccttgcctgaggaaccaatggaggtgcagggagcagagagagccagtccagagcctcaggagtgggtgcctattatacagcaggatatccagagccagaggaaggtcaagcctcagccccctctgagcgatgcctatttatccggtatgcctgcaaaacgacgaaagttgaggtcagacatccaaaaaaggcttcaggaagaccccaattattccccacagaggttcccaaatgcccaaagagctttcgccgacgatccttag

SEQ ID NO: 180465 - DNA, 2712 bp, Artificial Sequence
  Description of Artificial Sequence: Synthetic coding sequence
atggagcccaacgacagcaccagcaccgccgtggaggagcccgacagcctcgaagtattggtcaagacactggacagccagacacgcaccttcatagtcggcgcacaaatgaacgtaaaagagtttaaggagcacattgccgcctcagtctctattccgagcgagaagcagagactgatttaccagggacgggtgctgcaggatgacaagaagctacaggagtacaacgtaggcggtaaggtgatccacctggtggaaagggcccctccccagacccacctgccatcgggggccagcagcggcacgggcagcgcctcggccacacacggcgggggctccccgccgggcaccaggggaccaggggccagtgtgcatgaccgcaacgcgaactcctacgtgatggtgggcaccttcaatctgccctccgatggttcagccgtggacgtccacattaatatggaacaggcccctattcagagcgagcctcgggtgaggctcgtcatggcccagcatatgattagggatattcaaaccttattatctcgcatggaatgccgcggcgggccacagcctcagcatagccagcccccccctcagcctcccgccgtgactcccgagcccgtggccctgagtagccagacatctgagcctgtggagagcgaggcaccccctcgggaacccatggaagccgaggaggtggaagagagggcccctgctcaaaacccagaactgactcccgggccggccccggcaggtcccactccggcaccagagactaatgccccgaaccacccgtctcccgccgaatatgttgaagtgctgcaggagctgcaacggctcgagagcaggttgcagcctttccttcagcgctactatgaagttctgggtgccgccgcaaccactgattacaacaataatcacgagggccgggaggaggaccagcgactcatcaaccttgttggcgaatccctgcgacttttaggcaatactttcgtagcgctgagcgacctgcgctgtaacctcgcctgtacacctccccgccacctacacgttgtgcgtccaatgtcccactacacaacaccaatggtcctgcagcaagcagctatcccgatccagatcaatgtcggcactactgtgacaatgactgggaacggcacccggccgccacccacaccaaatgccgaggccccaccgcccgggcccggacaggcctcctctgtcgctccctcttccacgaacgtggagtcctcagccgaaggggcccctccccctggtcccgctcctccccctgctacgtcccatcctagagtaataaggattagccatcaatctgtggaacctgtagtgatgatgcacatgaacatccaggatagcggcacacaacccggaggagtcccttccgccccgaccggccccttaggcccccctggtcacggccagaccttgggtcagcaggtgcctggcttccccactgcacctacaagggtggtgatcgccagacccaccccaccacaggctagaccctcacatcctggaggccctcccgtttcagggacacttggagccgggctgggtactaacgcttctctggcacagatggtctcagggttggttggccaactcttgatgcagcctgtgctggtggcccagggcacacctggatcccctggggggttgggtcttgaatccctctctccggagttctttaccagtgtggtacaaggcgtactgtcttctctcctcggcagcctaggagcacgggcaggctccagcgagtccatcgccgcttttatacagcgcttgtctggatcttcaaacatctttgaaccaggggcagacggcgcccttggcttcttcggtgcgttactgtccttgctctgccaaaacttctctatggtcgacgtggtgatgctgttacacggacacttccagccactgcagagactgcagcctcagcttcggtcgttcttccatcagcactatcttgggggccaggagcctactccgtccaatatcaggatggccactcacacgttaatcaccggacttgaggaatacgtgcgcgaaagcttctctcttgtacaggtgcagcctggtgtggatattatccggaccaacctcgagtttctgcaagaacagttcaattcaatcgccgcccacgtgctgcactgcactgactcaggatttggagcccgcctcctggagctttgtaaccagggtctatttgagtgcctcgctttgaatctacactgtctgggaggacagcaaatggaattggcagccgtgataaatggccgcattcgccggatgtcaaggggggtcaacccatccttagtgtcctggctgactactatgatgggcctgcgtctgcaggtagtcctggagcatatgcctgtgggccccgacgccatactgaggtatgtacgacgcgttggtgacccacctcagccccttcccgaggagccaatggaagtccagggcgcggagagggcatctcctgagcctcaggaatgggttccgattatccagcaggacatccaatctcagagaaaggtgaaacctcaacctccgctcagcgatgcctacctatccggaatgcccgccaagaggcgtaagttacggtccgacatccaaaagcggctgcaagaggatcccaattatagtcctcagaggttccctaacgctcaacgggcttttgctgatgatccctag

SEQ ID NO: 180466 - DNA, 3489 bp, Artificial Sequence
  Description of Artificial Sequence: Synthetic coding sequence
atggagcccaacgacagcaccagcaccgccgtggaggagcccgactctcttgaagttttagtgaagaccctcgatagccagacccggacttttattgtcggcgctcagatgaacgttaaggaattcaaagaacatatcgctgcttctgtgtcaattccctctgaaaaacagaggctcatttaccagggtagggtcctccaggatgacaagaagttacaggagtacaatgtgggagggaaagttatacaccttgtagagcgggccccaccccagacacatctgccctctggtgccagttctggtacagggtcagcgagcgcaacccatggaggtggcagcccgcccgggacccgtggaccgggggcgtctgtccatgatcgcaatgctaattcctatgtgatggtggggaccttcaacctcccctccgatggtagcgcggtcgatgtccatatcaacatggaacaggctcccatccagagcgagccccgggttagactggtcatggcacagcatatgatccgggacatccagactctcctgagccgcatggaatgtcgcggtggaccccagcctcagcacagccaaccaccccctcaaccgccagctgtgacacctgagcccgtcgctttgtctagccagacctctgagccagtagagtccgaggcccctcccagagagccgatggaagcagaggaagtcgaggagcgagcacccgcccagaaccctgaactcacacccggcccggctcccgcaggccctaccccagctccagagaccaatgccccaaatcacccatcgccagcagaatacgtcgaggtactgcaggaattgcagcggctggagtcccggctccagccctttctgcaaagatactatgaggtcctgggcgcggcagcgactactgactacaataacaatcacgaaggcagggaggaggatcagcgccttatcaacctggtgggggagtcactgagactgctgggcaatacctttgtagccctgtctgatctgcgctgtaatctagcttgcactccacctaggcatctgcatgtggtcagacccatgagccactatacaacaccaatggttctgcaacaggcagctatccccatccagatcaacgttggcaccaccgtaacaatgacgggtaacgggacgagaccgcccccaactcccaacgcagaggcaccccctccaggacccggccaggcttctagtgtagccccgtcctccacgaatgtggaaagctccgcagagggagcaccacctcccggcccggcaccacctccagcaacctcccatccccgggtgatacggatctcccatcagtctgtcgaaccggtcgttatgatgcacatgaacatccaggacagcgggacccagcccggcggagtaccctccgcccccacgggcccattagggcctccggggcatggacagaccttagggagtaccctaatccagcttccatccctgccgccagagttcatgcacgcagtggcccaccagatcacacatcaggccatggtcgccgccgtcgcaagcgccgccgccggacagcaggtgcctgggtttccaacagcacctaccagggtggtgatcgcacgcccaacccccccgcaggctagaccttctcacccgggtggcccccccgtaagtgggactctgcagggcgccggcctgggcacaaatgcttctctggctcagatggtttcaggactggtcggtcagctgcttatgcagcctgtactcgtcgcccagggtactcccggtatggcgccccccccggcacctgccacagccagcgcgtcggcggggaccactaacaccgcgaccactgctggcccggctcccggcggccctgcccagcccccacctacaccccaacccagtatggccgacttgcaatttagccaattactggggaacttactgggtccagcgggccctggagctggtggctctggagtcgcctctccaactatcaccgttgcgatgcccggcgtccctgcattcctgcagggtatgacagattttctgcaggcaacacagacagctcctccccccccccccccaccccctcctccgcctcccgcaccagagcagcagacaatgcctccgcctggaagcccgtctgggggggcgggttcaccagggggcctaggtctcgaatccctgtcacctgaattcttcacaagtgtggttcagggcgtgctatcttccctactgggatctctgggggctagagcggggagtagcgagagtattgcagcgttcatccagcgcctctccggcagctcaaatattttcgaaccaggagccgatggggcgctgggtttcttcggcgctctgctctcactactgtgccagaatttctccatggtggatgtcgttatgttacttcatggccattttcaacccttgcagcgactccagcctcaacttaggtccttttttcatcagcactacctggggggacaggagcctaccccatctaacatccggatggcaacacacacactaatcaccggactcgaagagtacgtgagggagagttttagcctcgttcaggttcagccaggagtcgacataatcaggacaaatctggaatttctacaggagcagtttaactccattgccgcccatgtgctccactgtaccgatagtggcttcggcgctagacttctggagctctgtaaccaagggctgttcgaatgtctggccctcaacttgcactgtttgggggggcagcaaatggagctggccgcggtgatcaacggccgtatacgaaggatgtcgcggggcgtgaatcctagtttggtgtcatggctgactaccatgatgggccttcgattgcaggtcgtccttgagcatatgcccgtaggcccagatgccattcttcgatatgtgcgaagggttggcgaccctcctcagccccttcctgaggagcctatggaggtccagggagccgagagggccagcccagagccacagcgggagaacgcctccccagccccaggcaccaccgccgaggaagcaatgtcacgaggccccccccccgcccccgagggcggcagtcgagatgagcaggacggcgctagcgccgagactgagccatgggccgcagccgtgcctcctgaatgggtgccaatcattcagcaggacatccagagtcaaagaaaggtgaaacctcagcctcctctgtccgacgcctacctgagcggaatgcctgcaaaacgccgtaagacaatgcagggggaaggccctcagctgctgctctcagaagcagtgagcagggctgccaaggcggctggggccaggccgttgacatctcccgaatccttatctcgggacttggaggcccccgaagtccaggagagctacaggcagcagttgcgatcagatattcagaagcgccttcaagaggatcctaactactcacctcagcgtttccctaacgcgcagcgtgccttcgccgatgacccatag

SEQ ID NO: 180467 - DNA, 3489 bp, Artificial Sequence
  Description of Artificial Sequence: Synthetic coding sequence
atggagcccaacgacagcaccagcaccgccgtggaggagcccgactctctcgaggtgctcgtcaagacgctggatagccagactaggacctttattgtgggggcccagatgaacgtcaaggagttcaaggagcacatcgctgcttcggttagcattccttccgaaaaacagcggctgatctaccagggccgagtcctgcaggacgataagaagcttcaggaatacaacgtgggtggcaaagtcattcatctggtcgaacgagcccctcctcagactcacttgccgtctggggcgtcgagcggcaccgggagtgcctccgcaacacatggaggcggcagtccacccggcacacgaggccccggggcctcagttcatgatcgcaatgccaactcatacgttatggtgggaacttttaatttgccgagcgacggttctgctgtggacgtccacatcaacatggagcaggccccaatccaaagcgaaccacgggtacgcttagtgatggcccagcacatgatacgcgatattcagaccttactgtcacgcatggagtgccggggcggcccgcaaccccagcactctcagccaccgccacagccgccggctgtcactccagagcccgtcgcactgagcagtcaaacaagcgagccagtggagtctgaggcccctcccagggaacccatggaggctgaggaagttgaagagagggcacctgcacaaaaccccgagctcacccctggtcccgccccagccgggccaaccccagctcccgagacgaacgccccaaaccacccctcaccagccgaatatgtggaggtacttcaggagctacagcggttggagtcacggttacagccgttcctgcagcggtattatgaggtgctgggagccgcggccacaacggactacaataataatcacgaaggacgggaagaagaccagcgactaataaacttggtcggggagagcctcaggctgcttggaaacacttttgtcgctttgtctgacctcaggtgcaatctggcatgcacacctcctagacacctccacgtcgtgcgcccaatgagtcattatacaacacctatggttctgcagcaagctgctatacctatccagattaacgtcggcactacagtcaccatgacagggaacggtaccagacccccaccaactcccaatgccgaggccccacccccaggacctggacaagccagttctgttgctccctcatcgaccaatgttgagagctctgccgagggagcacctccccccggtcctgccccaccacctgctaccagtcacccccgggtgatccgtatttcccaccagagcgttgagccagttgtgatgatgcacatgaatattcaagattccggaacccaacctggaggcgtaccttccgccccaaccggtccgctcgggcctcctggccacggccagacccttgggtctaccttaatccagctcccttctctccctccagagtttatgcacgctgttgcccatcagatcacacaccaggcaatggtcgccgcggtggcctctgctgctgctggccaacaagttcccgggtttcctactgcacctactcgcgttgttatcgcacgacccacaccgcctcaggctcggccgtctcaccccgggggccccccggtctcaggaacattgcagggagcaggtttgggaacgaatgcctctcttgctcagatggtgagcgggctggttggccagctgctcatgcagcccgttctcgtggctcagggcaccccagggatggctccaccccccgcccccgctacggctagcgccagcgccggcaccaccaacacagccaccacagccgggcctgctcctggcgggcccgcacagcccccccccacaccccagcccagtatggccgatctgcagttttctcagctgctgggcaatctgctcggtcccgctggtcctggggccggtggccccggggtcgcaagccccacaatcacagtggcaatgccgggagtgcccgcctttttacaggggatgactgacttcctacaggctacccaaactgcgccacccccaccccctccgccgcctcctccaccccctgccccggaacagcagactatgcccccacctggctcgccgtctggaggggccggcagtcctggaggcttaggcctagagagcctgtctccagagttctttacgtccgttgttcagggcgttcttagctctcttctcggtagccttggtgctagagcaggcagctctgagagcattgccgcatttatccaacgcctgtccggatcctcgaacatatttgagcccggagctgacggggcgctcggtttttttggagcacttttatctctcttgtgtcagaatttttccatggtcgatgtggtgatgcttctgcatgggcacttccaaccgttgcagcggctccaaccccaacttcgctcattctttcatcagcattacctggggggacaagaaccaacaccatctaatattagaatggctacccacacgcttattacaggcctggaggaatacgttcgcgagtcatttagtttggtgcaagtacagcctggggtggacatcatccggactaacttagagttcctacaggaacagtttaactctatcgctgcacatgtgctccattgtaccgattcgggctttggtgcccggttgcttgagctgtgtaaccagggattattcgaatgcttggctctcaacctgcactgcctaggagggcagcagatggagctcgcggctgtgatcaatggtcgaattagacgtatgagccgcggcgtgaacccttccctggtcagttggcttaccacgatgatgggactgcgcctgcaagtggtgctggagcacatgccagtgggtccagacgcaatcctccgttatgttagaagagtcggggacccgcctcagcctctgccagaggagccaatggaagtccagggcgctgagcgcgcttccccagaacctcaacgagaaaacgcctctcccgcacccggcactactgctgaagaggccatgtctcgcgggccaccaccggcccctgagggaggttcccgggacgaacaggacggcgcttcagctgagacagaaccttgggctgccgccgtgcccccagagtgggtgccaatcattcagcaagacatccagagccagaggaaggttaagccacagcccccgctgtctgatgcctacctctccgggatgcctgccaaacggagaaagacgatgcaaggggagggacctcagctgctcctaagtgaggctgtaagcagagctgccaaggccgcgggggctcgaccacttactagcccagagtctttgtcgagagatttggaagcccccgaagtccaagagtcatacaggcagcagctgcggagcgatatccagaaacgccttcaggaagaccccaactactcaccgcaacgtttcccgaacgcacaaagggcctttgctgatgatccgtag

SEQ ID NO: 180468 - DNA, 3489 bp, Artificial Sequence
  Description of Artificial Sequence: Synthetic coding sequence
atggagcccaacgacagcaccagcaccgccgtggaggagcccgactcccttgaagtccttgtgaaaactctcgactctcagactcggaccttcattgttggggcccagatgaatgtcaaggagtttaaagaacatatcgcggcctcagtgagcatacctagtgagaagcagcgtctgatctaccaggggagagtgttgcaggatgataaaaagctccaagagtataatgtcgggggaaaagttatccatcttgtcgagcgggctcccccacagactcacttgccatccggagcatctagcgggaccggcagcgctagtgcaacgcatggaggcggatccccacctggcacccgcgggcccggagcctctgtacatgatcggaatgccaatagctacgtgatggttggtacctttaatctgccctcagacgggtctgctgtggatgtacatattaacatggaacaggctccgatccagagcgaaccccgggtccgcttagtcatggcgcagcatatgatccgtgacattcagactttattgagccgcatggagtgtcgcggcggtccacagccacaacacagccagccgccaccacaaccacccgctgtcactccagagcctgtagcactgagctcccagacgtccgagcccgttgagagcgaagcacctccgcgggagcccatggaggcagaagaggtcgaagagcgcgcacccgcccagaacccagagctgacccctggtcctgctcccgcagggccaaccccagcaccggaaactaacgcacccaatcatccatctcctgctgaatacgttgaggtgctgcaggaactccagcggcttgagtctcgactccaaccctttctacagaggtactacgaggtactcggggctgcagcaaccaccgattataacaataaccacgagggacgcgaggaggaccaaaggctgatcaatctagtaggcgaaagcctccggttactaggaaatacttttgttgctctgtccgatttgcgctgtaacctcgcctgtactccaccacgccatctacacgttgtgcgccccatgagtcactacaccaccccaatggttctgcagcaggctgccatacctattcagattaacgtgggaacgacagtgacaatgacaggaaatggtaccagacctcctccaacaccaaatgctgaagcacccccccccggaccgggacaggcatcatcagtggctccatcctcaacaaacgttgaatccagtgcagagggggccccgccccccggcccagctccaccgcccgccacctcccatccccgtgtcatacgcatcagtcatcagtcggtggagcccgtggtcatgatgcacatgaatattcaggacagcggcacacagcctggcggcgtgcccagcgcaccgacaggccctcttggccccccaggacacggacagactcttggctccacactcattcagctcccctccctccctcccgaattcatgcacgccgttgcccaccagatcacacatcaggcgatggtagctgccgtcgcatccgcagcagccggccagcaggtcccggggttccccacagcccccactagagtggtcatcgcccggcctacacctccacaagcccggccatctcaccccgggggaccacccgtatctggcactttacagggcgcaggcttaggaaccaacgcctctctggcacagatggtttccggcttggttgggcagcttttaatgcagcccgtgctggtcgcccaaggtactcccgggatggccccaccaccagcccccgccacagcatccgcctccgctggaactactaacactgccaccaccgccggtcctgctcccggaggacccgctcagccaccaccgactcctcagccaagtatggccgacttacagttctcacagctgctcgggaaccttctgggccccgctggtccaggggctgggggctctggggttgcctccccaacaattacggtcgccatgccaggcgtgcctgcatttctgcagggaatgaccgacttccttcaggcaactcaaacagccccgccacctcctccccccccccccccacccccccctgcccctgagcaacagacgatgcctccacctggttctcctagtggtggtgcaggcagcccggggggattgggactcgaatctttaagccccgaatttttcacgtccgtggtccagggtgtactttccagtttactgggatcattgggggctcgggccggatctagcgagagcattgctgcttttatacagagactgagcggcagtagcaatatatttgagccgggagccgacggagcactcggcttcttcggagcactgctgtccctgctgtgccagaacttctcaatggtggacgtcgtcatgctcctccatggacatttccagccccttcagcgactccaaccacagctcagaagcttctttcaccagcactatctgggcggacaggagcctacaccatccaacatcagaatggcaacacacactctgattactggattagaagaatacgtgcgcgagtccttctccctcgtacaggtacagcctggtgtagatatcatcagaaccaacttggaatttctacaagaacagtttaatagcatcgctgcacatgtgctacactgcactgattccggcttcggtgccagactactggagctgtgcaaccaagggctgtttgagtgtctcgccctgaatctgcattgcttaggagggcagcaaatggaattggcggccgtgataaacggcaggattagacggatgtctcggggagtgaatccatctctcgtgtcctggcttacgaccatgatgggacttcgactgcaggtagttctcgaacacatgcctgtgggtccagacgccatcctgagatacgtgcgaagggtgggtgacccgccacaaccactgcctgaagagccaatggaagtgcagggagctgagcgcgcctcccctgagccacagcgcgagaatgccagtcctgcacctgggactacagccgaagaagctatgtcgagggggccgcctcctgcgcctgagggtggctccagagatgagcaagacggagctagtgctgaaaccgagccctgggccgcagctgtcccacccgaatgggtaccaatcattcagcaggacatccaaagtcagcggaaggtcaagccccaacccccactcagtgatgcctatctgtccggaatgcccgccaagagaagaaagactatgcaaggagaagggccccagctgcttctttcagaggctgtgtctcgggctgccaaggcggccggggcacgacctctgacgtcccctgagtctctgtcacgcgacctcgaggctcccgaagtgcaggaatcctacaggcagcagctgaggtccgatattcagaaacgcctgcaggaggatcctaattactcgcctcagcgttttcccaacgcccagcgggcatttgctgatgacccctag

SEQ ID NO: 180469 - DNA, 3234 bp, Artificial Sequence
  Description of Artificial Sequence: Synthetic coding sequence
atggagcccaacgacagcaccagcaccgccgtggaggagcccgactctctcgaagtactcgtgaagactctggatagccagactagaaccttcattgtgggagcccagatgaatgtgaaggaattcaaggaacatatcgccgcttccgtatcaattccctctgaaaagcaaagattgatttaccaggggcgcgttctgcaggacgacaagaagttacaggagtataatgtgggaggcaaggttatacatctggtggagcgcgctcctccgcagacccatctcccatccggtgctagtagtggcacaggctccgcctccgcaacccacggaggtggaagcccccctggaacaaggggcccgggggccagcgttcacgaccggaacgctaactcctacgtgatggtgggcacctttaatctgccaagtgatgggtccgccgtcgacgtccacataaatatggagcaagcccctattcagagcgagccgcgcgtacggttggtaatggcacagcacatgataagggacatacagaccttactcagccgaatggaatgccggggcggcccacaaccacaacattctcagccccctccccagccccccgctgtcacacctgagccagttgccctgtcaagtcagacatcggaaccggtcgaaagtgaagcccctcccagggaacccatggaggcggaggaggtggaagagcgcgctccagctcaaaaccctgagctgacaccaggccctgctccagctggccctacacctgcgccggaaacgaatgcccctaatcacccttcaccagccgagtacgttgaagtgcttcaggagctgcagagactagagtcaaggctacagccgtttctccagagatattatgaggtgctaggtgcagccgcaacaacagactataataacaaccatgagggacgcgaagaagatcaaaggctaattaaccttgtcggggagagcctgcgcctcctaggaaacacatttgtggccctgtctgatcttaggtgcaatctcgcttgtacccctcctcgtcacctgcatgtggtgagaccgatgagccattataccacaccaatggttctccagcaagccgctattcccatccagatcaacgtagggaccactgtgacgatgactggtaatgggacaaggcccccacctaccccaaacgcggaggcccctccacccggacctggccaggcgtcttccgtggccccttcgagcaccaacgtcgagtcaagtgcagagggggctcccccaccagggcccgctcccccgcctgccacgtcccatcctagggttattcgcatatcacatcaatcggttgagcccgtggtgatgatgcatatgaatatacaggattcaggtactcaacctggaggtgtgccaagtgcccccaccggacccctcggtcctcccggacacggacagacgctgggacagcaggtacccggctttccgacagcacctacgagggtggtgatcgctaggcccacacctccccaagcccggccctcgcacccaggtggcccccccgtctcaggcacactacaaggagctggactgggcacgaacgcttctctcgcccaaatggtatctgggttggttgggcagctgctgatgcagcccgtactcgtggcccagggaactcctggcatggctccgcccccggcgccggccactgccagcgcctctgcaggcacaacaaacactgcaaccacagctggcccagcacctggcgggccagcccagcccccacctacgccccagccatctatggctgatctccagttcagccagctccttggaaatctcctgggacccgccgggcccggcgctggaggtccgggcgtcgcctcgccaaccattacagtggctatgccaggcgtgccggccttcctacaggggatgactgatttcctccaagccacgcagactgcccccccgccgcccccccccccaccaccacccccacctgcccctgaacagcagactatgccaccccctggttcaccgtctgggggggcaggctctcccggagggcttggccttgaatcactttcgcctgagttttttacgtctgtcgtgcagggcgttctgagttctctcctgggatcacttggagctcgcgctggttctagtgagtcaatagccgccttcatccaaagattgtccggctccagtaacatcttcgagcctggggcagacggagcgctggggttcttcggagctcttctgtcactgctgtgccagaatttttcaatggtggatgtggttatgttgctgcacgggcatttccagccccttcagcgcctgcaaccacagctccgatccttcttccatcagcactacctcggcggtcaggaacctacaccttctaacatacgaatggccacccatactctgatcaccgggttagaagaatacgtcagggagagtttttcccttgtgcaggtccaaccaggggtggatattatacgcactaatcttgagtttctgcaggaacagttcaattcaattgcggcacatgtgctgcactgcacagactcaggcttcggagcacggctgttggagttgtgtaatcagggcctgtttgagtgcctggcactcaatttacactgcctaggcggccagcaaatggaattagccgctgtaatcaatggacgcattcgacgcatgagtcggggagtcaaccctagcctcgtatcctggcttactactatgatgggccttcgactgcaggtcgttttggaacacatgcccgtcgggccagacgctattctgaggtatgtgcggcgagttggagacccaccccagcccctgcccgaagagccaatggaggtacagggcgctgaacgcgcaagcccagagcctcagagggaaaacgcctcaccagcacccggaaccaccgccgaggaggccatgagccgtggacctccacccgcccccgaagggggttccagggacgagcaggatggtgcctctgctgaaactgagccctgggccgccgcggtgccaccagagtgggtgccgatcatccagcaagacattcagtcccagaggaaggtcaaacctcaaccacctctctccgatgcatatctatccggaatgccagccaagaggcggaaactcaggtccgacatccagaagcgtctccaggaggaccccaattactctccccagagatttccaaacgctcagcgcgcctttgcagatgatccatag
